United States Patent 11,640,849 (METHODS FOR HISTOLOGICAL DIAGNOSIS AND TREATMENT OF DISEASES) - sequence listing, part 75

SEQ ID NO: 2859155 - protein, 8 aa, Entamoeba invadens
GEKNPLPV

SEQ ID NO: 2859156 - protein, 6 aa, Entamoeba invadens
GEKNRK

SEQ ID NO: 2859157 - protein, 13 aa, Entamoeba invadens
GEKPETKSPPTGL

SEQ ID NO: 2859158 - protein, 6 aa, Entamoeba invadens
GEKPFQ

SEQ ID NO: 2859159 - protein, 9 aa, Entamoeba invadens
GEKPNWNTA

SEQ ID NO: 2859160 - protein, 8 aa, Entamoeba invadens
GEKPQSGL

SEQ ID NO: 2859161 - protein, 16 aa, Entamoeba invadens
GEKPRLVGNKASDVNE

SEQ ID NO: 2859162 - protein, 16 aa, Entamoeba invadens
GEKPVKTKNSEKLREE

SEQ ID NO: 2859163 - protein, 5 aa, Entamoeba invadens
GEKPY

SEQ ID NO: 2859164 - protein, 9 aa, Entamoeba invadens
GEKQITEEN

SEQ ID NO: 2859165 - protein, 9 aa, Entamoeba invadens
GEKQNEMPL

SEQ ID NO: 2859166 - protein, 11 aa, Entamoeba invadens
GEKRAVENKDN

SEQ ID NO: 2859167 - protein, 21 aa, Entamoeba invadens
GEKRCQQCNTTCNGNCYTDTG

SEQ ID NO: 2859168 - protein, 4 aa, Entamoeba invadens
GEKS

SEQ ID NO: 2859169 - protein, 9 aa, Entamoeba invadens
GEKSGKTER

SEQ ID NO: 2859170 - protein, 14 aa, Entamoeba invadens
GEKSKLKQIWVLQL

SEQ ID NO: 2859171 - protein, 9 aa, Entamoeba invadens
GEKSQFNGK

SEQ ID NO: 2859172 - protein, 7 aa, Entamoeba invadens
GEKSTEV

SEQ ID NO: 2859173 - protein, 20 aa, Entamoeba invadens
GEKSTKKSKEKERAAEATGG

SEQ ID NO: 2859174 - protein, 11 aa, Entamoeba invadens
GEKSTTTSQIG

SEQ ID NO: 2859175 - protein, 11 aa, Entamoeba invadens
GEKTHLDGDEL

SEQ ID NO: 2859176 - protein, 44 aa, Entamoeba invadens
GEKTKEDSKKKAQKKSDPKKDEKKEDKEEKKTGIPKQKNVDSGV

SEQ ID NO: 2859177 - protein, 17 aa, Entamoeba invadens
GEKTQAENDLAERRRTF

SEQ ID NO: 2859178 - protein, 8 aa, Entamoeba invadens
GEKYPNTT

SEQ ID NO: 2859179 - protein, 9 aa, Entamoeba invadens
GEKYTTSAD

SEQ ID NO: 2859180 - protein, 9 aa, Entamoeba invadens
GELATQNAK

SEQ ID NO: 2859181 - protein, 15 aa, Entamoeba invadens
GELEEQEKISNDLQT

SEQ ID NO: 2859182 - protein, 18 aa, Entamoeba invadens
GELEKEKKMREETKPRLA

SEQ ID NO: 2859183 - protein, 7 aa, Entamoeba invadens
GELETAN

SEQ ID NO: 2859184 - protein, 4 aa, Entamoeba invadens
GELN

SEQ ID NO: 2859185 - protein, 8 aa, Entamoeba invadens
GELNKETI

SEQ ID NO: 2859186 - protein, 8 aa, Entamoeba invadens
GELNTPSG

SEQ ID NO: 2859187 - protein, 8 aa, Entamoeba invadens
GELNTTDE

SEQ ID NO: 2859188 - protein, 13 aa, Entamoeba invadens
GELPEKDDTTRQS

SEQ ID NO: 2859189 - protein, 6 aa, Entamoeba invadens
GELPTK

SEQ ID NO: 2859190 - protein, 4 aa, Entamoeba invadens
GELR

SEQ ID NO: 2859191 - protein, 17 aa, Entamoeba invadens
GELRAKDETNSLEPPQI

SEQ ID NO: 2859192 - protein, 15 aa, Entamoeba invadens
GELSPIGKEKEGTYD

SEQ ID NO: 2859193 - protein, 7 aa, Entamoeba invadens
GELSTGE

SEQ ID NO: 2859194 - protein, 5 aa, Entamoeba invadens
GELSV

SEQ ID NO: 2859195 - protein, 10 aa, Entamoeba invadens
GELTAKKSNL

SEQ ID NO: 2859196 - protein, 6 aa, Entamoeba invadens
GELTET

SEQ ID NO: 2859197 - protein, 9 aa, Entamoeba invadens
GELTGFPPE

SEQ ID NO: 2859198 - protein, 21 aa, Entamoeba invadens
GELTSKTHIKAKPKKEHTEQV

SEQ ID NO: 2859199 - protein, 11 aa, Entamoeba invadens
GELTTKDRNAI

SEQ ID NO: 2859200 - protein, 66 aa, Entamoeba invadens
GEMDDNSSSENSAHSSETSEKEGSSENSEKSVDTSKSFSVSGDNSVESENEEKNEEQSALPTEESP

SEQ ID NO: 2859201 - protein, 5 aa, Entamoeba invadens
GEMES

SEQ ID NO: 2859202 - protein, 15 aa, Entamoeba invadens
GEMGNERVKKVSEQM

SEQ ID NO: 2859203 - protein, 5 aa, Entamoeba invadens
GEMKS

SEQ ID NO: 2859204 - protein, 4 aa, Entamoeba invadens
GEMP

SEQ ID NO: 2859205 - protein, 4 aa, Entamoeba invadens
GEMQ

SEQ ID NO: 2859206 - protein, 5 aa, Entamoeba invadens
GEMRE

SEQ ID NO: 2859207 - protein, 23 aa, Entamoeba invadens
GEMSEDDYDYQDDAPEYIPDDEI

SEQ ID NO: 2859208 - protein, 5 aa, Entamoeba invadens
GEMTT

SEQ ID NO: 2859209 - protein, 11 aa, Entamoeba invadens
GENASERRDNP

SEQ ID NO: 2859210 - protein, 8 aa, Entamoeba invadens
GENDAERE

SEQ ID NO: 2859211 - protein, 10 aa, Entamoeba invadens
GENDKVSDVA

SEQ ID NO: 2859212 - protein, 6 aa, Entamoeba invadens
GENDVP

SEQ ID NO: 2859213 - protein, 5 aa, Entamoeba invadens
GENDW

SEQ ID NO: 2859214 - protein, 12 aa, Entamoeba invadens
GENEDKKVQLPE

SEQ ID NO: 2859215 - protein, 8 aa, Entamoeba invadens
GENEPSYS

SEQ ID NO: 2859216 - protein, 12 aa, Entamoeba invadens
GENEVLTEKEVK

SEQ ID NO: 2859217 - protein, 6 aa, Entamoeba invadens
GENEYN

SEQ ID NO: 2859218 - protein, 7 aa, Entamoeba invadens
GENEYNQ

SEQ ID NO: 2859219 - protein, 5 aa, Entamoeba invadens
GENFG

SEQ ID NO: 2859220 - protein, 4 aa, Entamoeba invadens
GENG

SEQ ID NO: 2859221 - protein, 4 aa, Entamoeba invadens
GENI

SEQ ID NO: 2859222 - protein, 11 aa, Entamoeba invadens
GENISGGERDV

SEQ ID NO: 2859223 - protein, 9 aa, Entamoeba invadens
GENKLSDYN

SEQ ID NO: 2859224 - protein, 19 aa, Entamoeba invadens
GENKPEPRAKSLKPQVRYS

SEQ ID NO: 2859225 - protein, 9 aa, Entamoeba invadens
GENNDFEER

SEQ ID NO: 2859226 - protein, 6 aa, Entamoeba invadens
GENNVQ

SEQ ID NO: 2859227 - protein, 5 aa, Entamoeba invadens
GENPF

SEQ ID NO: 2859228 - protein, 10 aa, Entamoeba invadens
GENPKEKKPI

SEQ ID NO: 2859229 - protein, 6 aa, Entamoeba invadens
GENPKY

SEQ ID NO: 2859230 - protein, 21 aa, Entamoeba invadens
GENQKSEPPDLTNNSQNSKIE

SEQ ID NO: 2859231 - protein, 12 aa, Entamoeba invadens
GENQNSTPKVET

SEQ ID NO: 2859232 - protein, 9 aa, Entamoeba invadens
GENQPVSPI

SEQ ID NO: 2859233 - protein, 4 aa, Entamoeba invadens
GENS

SEQ ID NO: 2859234 - protein, 8 aa, Entamoeba invadens
GENSGFQK

SEQ ID NO: 2859235 - protein, 12 aa, Entamoeba invadens
GENSHKECGYRG

SEQ ID NO: 2859236 - protein, 6 aa, Entamoeba invadens
GENSLD

SEQ ID NO: 2859237 - protein, 19 aa, Entamoeba invadens
GENSQDASKVLDYVSLVID

SEQ ID NO: 2859238 - protein, 7 aa, Entamoeba invadens
GENTAVD

SEQ ID NO: 2859239 - protein, 8 aa, Entamoeba invadens
GENTFKSN

SEQ ID NO: 2859240 - protein, 12 aa, Entamoeba invadens
GENVKLENGKLV

SEQ ID NO: 2859241 - protein, 8 aa, Entamoeba invadens
GENVPEGE

SEQ ID NO: 2859242 - protein, 5 aa, Entamoeba invadens
GENVQ

SEQ ID NO: 2859243 - protein, 5 aa, Entamoeba invadens
GENWG

SEQ ID NO: 2859244 - protein, 10 aa, Entamoeba invadens
GENYDNDYYE

SEQ ID NO: 2859245 - protein, 7 aa, Entamoeba invadens
GENYKDE

SEQ ID NO: 2859246 - protein, 8 aa, Entamoeba invadens
GENYPPTE

SEQ ID NO: 2859247 - protein, 6 aa, Entamoeba invadens
GEPAKK

SEQ ID NO: 2859248 - protein, 23 aa, Entamoeba invadens
GEPAPQEEQKTEAKRIEEDIDDD

SEQ ID NO: 2859249 - protein, 6 aa, Entamoeba invadens
GEPEET

SEQ ID NO: 2859250 - protein, 5 aa, Entamoeba invadens
GEPET

SEQ ID NO: 2859251 - protein, 9 aa, Entamoeba invadens
GEPFDASSL

SEQ ID NO: 2859252 - protein, 24 aa, Entamoeba invadens
GEPGSGIKDEEDKMECEPKKYELS

SEQ ID NO: 2859253 - protein, 10 aa, Entamoeba invadens
GEPIAKPKGV

SEQ ID NO: 2859254 - protein, 5 aa, Entamoeba invadens
GEPKL

SEQ ID NO: 2859255 - protein, 11 aa, Entamoeba invadens
GEPNKTSLDES

SEQ ID NO: 2859256 - protein, 6 aa, Entamoeba invadens
GEPPHY

SEQ ID NO: 2859257 - protein, 7 aa, Entamoeba invadens
GEPQKYP

SEQ ID NO: 2859258 - protein, 11 aa, Entamoeba invadens
GEPSSGKTSTI

SEQ ID NO: 2859259 - protein, 6 aa, Entamoeba invadens
GEPYET

SEQ ID NO: 2859260 - protein, 6 aa, Entamoeba invadens
GEQEGK

SEQ ID NO: 2859261 - protein, 8 aa, Entamoeba invadens
GEQGEISQ

SEQ ID NO: 2859262 - protein, 8 aa, Entamoeba invadens
GEQGEVKL

SEQ ID NO: 2859263 - protein, 18 aa, Entamoeba invadens
GEQGKKLSKWSKDKKKFC

SEQ ID NO: 2859264 - protein, 6 aa, Entamoeba invadens
GEQGPM

SEQ ID NO: 2859265 - protein, 5 aa, Entamoeba invadens
GEQLP

SEQ ID NO: 2859266 - protein, 5 aa, Entamoeba invadens
GEQLS

SEQ ID NO: 2859267 - protein, 16 aa, Entamoeba invadens
GEQMGGLRSGTIDTPS

SEQ ID NO: 2859268 - protein, 4 aa, Entamoeba invadens
GEQQ

SEQ ID NO: 2859269 - protein, 4 aa, Entamoeba invadens
GEQR

SEQ ID NO: 2859270 - protein, 7 aa, Entamoeba invadens
GEQRQNR

SEQ ID NO: 2859271 - protein, 6 aa, Entamoeba invadens
GEQSAL

SEQ ID NO: 2859272 - protein, 10 aa, Entamoeba invadens
GEQSDRYIEG

SEQ ID NO: 2859273 - protein, 8 aa, Entamoeba invadens
GEQSNMKS

SEQ ID NO: 2859274 - protein, 4 aa, Entamoeba invadens
GEQV

SEQ ID NO: 2859275 - protein, 6 aa, Entamoeba invadens
GEREGR

SEQ ID NO: 2859276 - protein, 12 aa, Entamoeba invadens
GERETGADVRTQ

SEQ ID NO: 2859277 - protein, 5 aa, Entamoeba invadens
GERGL

SEQ ID NO: 2859278 - protein, 7 aa, Entamoeba invadens
GERGNEM

SEQ ID NO: 2859279 - protein, 8 aa, Entamoeba invadens
GERGNGEG

SEQ ID NO: 2859280 - protein, 6 aa, Entamoeba invadens
GERGPL

SEQ ID NO: 2859281 - protein, 14 aa, Entamoeba invadens
GERIKKERKKKAME

SEQ ID NO: 2859282 - protein, 7 aa, Entamoeba invadens
GERPTLN

SEQ ID NO: 2859283 - protein, 5 aa, Entamoeba invadens
GERRD

SEQ ID NO: 2859284 - protein, 5 aa, Entamoeba invadens
GERRE

SEQ ID NO: 2859285 - protein, 4 aa, Entamoeba invadens
GERS

SEQ ID NO: 2859286 - protein, 8 aa, Entamoeba invadens
GERSLNEK

SEQ ID NO: 2859287 - protein, 8 aa, Entamoeba invadens
GERSRRYK

SEQ ID NO: 2859288 - protein, 6 aa, Entamoeba invadens
GERTAL

SEQ ID NO: 2859289 - protein, 5 aa, Entamoeba invadens
GERTL

SEQ ID NO: 2859290 - protein, 7 aa, Entamoeba invadens
GERTRIR

SEQ ID NO: 2859291 - protein, 10 aa, Entamoeba invadens
GERVSGVPDI

SEQ ID NO: 2859292 - protein, 12 aa, Entamoeba invadens
GESAAQSSSFSK

SEQ ID NO: 2859293 - protein, 8 aa, Entamoeba invadens
GESAESAF

SEQ ID NO: 2859294 - protein, 7 aa, Entamoeba invadens
GESDGES

SEQ ID NO: 2859295 - protein, 4 aa, Entamoeba invadens
GESE

SEQ ID NO: 2859296 - protein, 6 aa, Entamoeba invadens
GESEAN

SEQ ID NO: 2859297 - protein, 9 aa, Entamoeba invadens
GESEKAGKL

SEQ ID NO: 2859298 - protein, 11 aa, Entamoeba invadens
GESEKTENNEY

SEQ ID NO: 2859299 - protein, 7 aa, Entamoeba invadens
GESELPT

SEQ ID NO: 2859300 - protein, 6 aa, Entamoeba invadens
GESETD

SEQ ID NO: 2859301 - protein, 5 aa, Entamoeba invadens
GESEY

SEQ ID NO: 2859302 - protein, 7 aa, Entamoeba invadens
GESEYDQ

SEQ ID NO: 2859303 - protein, 6 aa, Entamoeba invadens
GESEYN

SEQ ID NO: 2859304 - protein, 10 aa, Entamoeba invadens
GESGAGKTVA

SEQ ID NO: 2859305 - protein, 7 aa, Entamoeba invadens
GESGFKS

SEQ ID NO: 2859306 - protein, 9 aa, Entamoeba invadens
GESGMSASA

SEQ ID NO: 2859307 - protein, 6 aa, Entamoeba invadens
GESGQV

SEQ ID NO: 2859308 - protein, 4 aa, Entamoeba invadens
GESI

SEQ ID NO: 2859309 - protein, 4 aa, Entamoeba invadens
GESK

SEQ ID NO: 2859310 - protein, 10 aa, Entamoeba invadens
GESKDRMHKG

SEQ ID NO: 2859311 - protein, 6 aa, Entamoeba invadens
GESLCG

SEQ ID NO: 2859312 - protein, 4 aa, Entamoeba invadens
GESM

SEQ ID NO: 2859313 - protein, 4 aa, Entamoeba invadens
GESN

SEQ ID NO: 2859314 - protein, 9 aa, Entamoeba invadens
GESNSGNTM

SEQ ID NO: 2859315 - protein, 10 aa, Entamoeba invadens
GESNTKALKG

SEQ ID NO: 2859316 - protein, 7 aa, Entamoeba invadens
GESNVQN

SEQ ID NO: 2859317 - protein, 4 aa, Entamoeba invadens
GESP

SEQ ID NO: 2859318 - protein, 8 aa, Entamoeba invadens
GESPDSSY

SEQ ID NO: 2859319 - protein, 8 aa, Entamoeba invadens
GESPPENL

SEQ ID NO: 2859320 - protein, 7 aa, Entamoeba invadens
GESQSSC

SEQ ID NO: 2859321 - protein, 5 aa, Entamoeba invadens
GESQV

SEQ ID NO: 2859322 - protein, 8 aa, Entamoeba invadens
GESSSSLS

SEQ ID NO: 2859323 - protein, 9 aa, Entamoeba invadens
GESSVGKTS

SEQ ID NO: 2859324 - protein, 5 aa, Entamoeba invadens
GESTD

SEQ ID NO: 2859325 - protein, 5 aa, Entamoeba invadens
GESTI

SEQ ID NO: 2859326 - protein, 5 aa, Entamoeba invadens
GESTT

SEQ ID NO: 2859327 - protein, 24 aa, Entamoeba invadens
GESTTLDETEKVDSKNYFNDFTYC

SEQ ID NO: 2859328 - protein, 7 aa, Entamoeba invadens
GETDETK

SEQ ID NO: 2859329 - protein, 9 aa, Entamoeba invadens
GETDKDTFD

SEQ ID NO: 2859330 - protein, 8 aa, Entamoeba invadens
GETDPSIA

SEQ ID NO: 2859331 - protein, 25 aa, Entamoeba invadens
GETEGKVAKGEMKEGEKKEEKAEIA

SEQ ID NO: 2859332 - protein, 15 aa, Entamoeba invadens
GETERLAKEKNNETV

SEQ ID NO: 2859333 - protein, 13 aa, Entamoeba invadens
GETETKAQDTTSL

SEQ ID NO: 2859334 - protein, 9 aa, Entamoeba invadens
GETGEKDYV

SEQ ID NO: 2859335 - protein, 4 aa, Entamoeba invadens
GETI

SEQ ID NO: 2859336 - protein, 7 aa, Entamoeba invadens
GETIGDY

SEQ ID NO: 2859337 - protein, 5 aa, Entamoeba invadens
GETIQ

SEQ ID NO: 2859338 - protein, 5 aa, Entamoeba invadens
GETIS

SEQ ID NO: 2859339 - protein, 7 aa, Entamoeba invadens
GETISCD

SEQ ID NO: 2859340 - protein, 8 aa, Entamoeba invadens
GETKSEKK

SEQ ID NO: 2859341 - protein, 17 aa, Entamoeba invadens
GETKVPKIVTKKSEKFE

SEQ ID NO: 2859342 - protein, 4 aa, Entamoeba invadens
GETL

SEQ ID NO: 2859343 - protein, 10 aa, Entamoeba invadens
GETLEIPQAD

SEQ ID NO: 2859344 - protein, 6 aa, Entamoeba invadens
GETLTK

SEQ ID NO: 2859345 - protein, 4 aa, Entamoeba invadens
GETN

SEQ ID NO: 2859346 - protein, 9 aa, Entamoeba invadens
GETNENEIT

SEQ ID NO: 2859347 - protein, 12 aa, Entamoeba invadens
GETNKQIKENAK

SEQ ID NO: 2859348 - protein, 12 aa, Entamoeba invadens
GETNVDKTRSAM

SEQ ID NO: 2859349 - protein, 4 aa, Entamoeba invadens
GETQ

SEQ ID NO: 2859350 - protein, 11 aa, Entamoeba invadens
GETQQLSAPEY

SEQ ID NO: 2859351 - protein, 13 aa, Entamoeba invadens
GETRRRLKESIER

SEQ ID NO: 2859352 - protein, 5 aa, Entamoeba invadens
GETSN

SEQ ID NO: 2859353 - protein, 14 aa, Entamoeba invadens
GETSPDVEKPQSLD

SEQ ID NO: 2859354 - protein, 10 aa, Entamoeba invadens
GETTFRNDTT

SEQ ID NO: 2859355 - protein, 15 aa, Entamoeba invadens
GETTLIPEERPVDNP

SEQ ID NO: 2859356 - protein, 5 aa, Entamoeba invadens
GETYQ

SEQ ID NO: 2859357 - protein, 6 aa, Entamoeba invadens
GETYQS

SEQ ID NO: 2859358 - protein, 35 aa, Entamoeba invadens
GEVATPAGGESDKSGKKAEGKSKPAKDKKKGGCAF

SEQ ID NO: 2859359 - protein, 4 aa, Entamoeba invadens
GEVD

SEQ ID NO: 2859360 - protein, 13 aa, Entamoeba invadens
GEVDEEGKTQEEI

SEQ ID NO: 2859361 - protein, 6 aa, Entamoeba invadens
GEVDGA

SEQ ID NO: 2859362 - protein, 8 aa, Entamoeba invadens
GEVDTQQS

SEQ ID NO: 2859363 - protein, 10 aa, Entamoeba invadens
GEVEKRNSNF

SEQ ID NO: 2859364 - protein, 8 aa, Entamoeba invadens
GEVEPSRG

SEQ ID NO: 2859365 - protein, 26 aa, Entamoeba invadens
GEVFDGADNLTSAAKNLKTSNLREGY

SEQ ID NO: 2859366 - protein, 23 aa, Entamoeba invadens
GEVKPIKRKSQGSQESSEEKRRV

SEQ ID NO: 2859367 - protein, 17 aa, Entamoeba invadens
GEVPDYIDEEKGKTTVP

SEQ ID NO: 2859368 - protein, 16 aa, Entamoeba invadens
GEVPEGEEEKPQKMEE

SEQ ID NO: 2859369 - protein, 6 aa, Entamoeba invadens
GEVPPG

SEQ ID NO: 2859370 - protein, 15 aa, Entamoeba invadens
GEVRKMKKNRSVDGW

SEQ ID NO: 2859371 - protein, 9 aa, Entamoeba invadens
GEVSKQEEN

SEQ ID NO: 2859372 - protein, 8 aa, Entamoeba invadens
GEVSPIDK

SEQ ID NO: 2859373 - protein, 9 aa, Entamoeba invadens
GEVTKDGNG

SEQ ID NO: 2859374 - protein, 10 aa, Entamoeba invadens
GEVTLTDETP

SEQ ID NO: 2859375 - protein, 32 aa, Entamoeba invadens
GEVTPKNKTRTAEDSGKCVEEDYEDDAKSRES

SEQ ID NO: 2859376 - protein, 7 aa, Entamoeba invadens
GEVVENP

SEQ ID NO: 2859377 - protein, 13 aa, Entamoeba invadens
GEWKKRKKDSLTQ

SEQ ID NO: 2859378 - protein, 4 aa, Entamoeba invadens
GEYD

SEQ ID NO: 2859379 - protein, 6 aa, Entamoeba invadens
GEYGNY

SEQ ID NO: 2859380 - protein, 13 aa, Entamoeba invadens
GEYKCTSRFPKGT

SEQ ID NO: 2859381 - protein, 5 aa, Entamoeba invadens
GEYKS

SEQ ID NO: 2859382 - protein, 13 aa, Entamoeba invadens
GEYLREEDTLMVQ

SEQ ID NO: 2859383 - protein, 22 aa, Entamoeba invadens
GEYMEDKGTSDGQTELHETPLT

SEQ ID NO: 2859384 - protein, 6 aa, Entamoeba invadens
GEYQDK

SEQ ID NO: 2859385 - protein, 6 aa, Entamoeba invadens
GEYRPE

SEQ ID NO: 2859386 - protein, 4 aa, Entamoeba invadens
GEYS

SEQ ID NO: 2859387 - protein, 6 aa, Entamoeba invadens
GEYSGL

SEQ ID NO: 2859388 - protein, 31 aa, Entamoeba invadens
GEYSPTNELSVEKKNDTIEQKIQSSSAELKE

SEQ ID NO: 2859389 - protein, 10 aa, Entamoeba invadens
GEYTTEDNGH

SEQ ID NO: 2859390 - protein, 7 aa, Entamoeba invadens
GEYVATE

SEQ ID NO: 2859391 - protein, 8 aa, Entamoeba invadens
GFAAASAN

SEQ ID NO: 2859392 - protein, 20 aa, Entamoeba invadens
GFAEQRKAAKESSKQTRRRF

SEQ ID NO: 2859393 - protein, 6 aa, Entamoeba invadens
GFAHEK

SEQ ID NO: 2859394 - protein, 7 aa, Entamoeba invadens
GFDEPTA

SEQ ID NO: 2859395 - protein, 5 aa, Entamoeba invadens
GFDES

SEQ ID NO: 2859396 - protein, 9 aa, Entamoeba invadens
GFDETTNEE

SEQ ID NO: 2859397 - protein, 6 aa, Entamoeba invadens
GFDKRG

SEQ ID NO: 2859398 - protein, 6 aa, Entamoeba invadens
GFDNEQ

SEQ ID NO: 2859399 - protein, 17 aa, Entamoeba invadens
GFDPHKRAGQAYGPGEY

SEQ ID NO: 2859400 - protein, 17 aa, Entamoeba invadens
GFDPHRRAGQAYGPGEY

SEQ ID NO: 2859401 - protein, 7 aa, Entamoeba invadens
GFDPRDF

SEQ ID NO: 2859402 - protein, 11 aa, Entamoeba invadens
GFDRASGVANL

SEQ ID NO: 2859403 - protein, 7 aa, Entamoeba invadens
GFDRQQA

SEQ ID NO: 2859404 - protein, 11 aa, Entamoeba invadens
GFDSDGDEGVV

SEQ ID NO: 2859405 - protein, 10 aa, Entamoeba invadens
GFDSDGEEGF

SEQ ID NO: 2859406 - protein, 8 aa, Entamoeba invadens
GFDTKGES

SEQ ID NO: 2859407 - protein, 6 aa, Entamoeba invadens
GFDTRG

SEQ ID NO: 2859408 - protein, 12 aa, Entamoeba invadens
GFEEPQLKKKLN

SEQ ID NO: 2859409 - protein, 12 aa, Entamoeba invadens
GFEESLGKQTVP

SEQ ID NO: 2859410 - protein, 4 aa, Entamoeba invadens
GFEG

SEQ ID NO: 2859411 - protein, 6 aa, Entamoeba invadens
GFEGEM

SEQ ID NO: 2859412 - protein, 10 aa, Entamoeba invadens
GFEKDETENY

SEQ ID NO: 2859413 - protein, 10 aa, Entamoeba invadens
GFENESQKKV

SEQ ID NO: 2859414 - protein, 6 aa, Entamoeba invadens
GFEPTK

SEQ ID NO: 2859415 - protein, 18 aa, Entamoeba invadens
GFEQRSRGPRKGQTVQSP

SEQ ID NO: 2859416 - protein, 7 aa, Entamoeba invadens
GFERSSQ

SEQ ID NO: 2859417 - protein, 5 aa, Entamoeba invadens
GFERV

SEQ ID NO: 2859418 - protein, 5 aa, Entamoeba invadens
GFETQ

SEQ ID NO: 2859419 - protein, 10 aa, Entamoeba invadens
GFGAESPFGQ

SEQ ID NO: 2859420 - protein, 16 aa, Entamoeba invadens
GFGDSEKLKTLGASSD

SEQ ID NO: 2859421 - protein, 4 aa, Entamoeba invadens
GFGE

SEQ ID NO: 2859422 - protein, 12 aa, Entamoeba invadens
GFGGEEKTLEIG

SEQ ID NO: 2859423 - protein, 17 aa, Entamoeba invadens
GFGGRQRSGPRKGRTVQ

SEQ ID NO: 2859424 - protein, 9 aa, Entamoeba invadens
GFGKDAKSV

SEQ ID NO: 2859425 - protein, 5 aa, Entamoeba invadens
GFGKK

SEQ ID NO: 2859426 - protein, 16 aa, Entamoeba invadens
GFGSSKGLKVSDNIEG

SEQ ID NO: 2859427 - protein, 42 aa, Entamoeba invadens
GFKEQQERFDKTSPKTPERQENVKIDKQDETQPIKNPTNPKI

SEQ ID NO: 2859428 - protein, 6 aa, Entamoeba invadens
GFKPGF

SEQ ID NO: 2859429 - protein, 6 aa, Entamoeba invadens
GFKPSY

SEQ ID NO: 2859430 - protein, 18 aa, Entamoeba invadens
GFKPTQTAEAKKVLPRDK

SEQ ID NO: 2859431 - protein, 7 aa, Entamoeba invadens
GFKRETA

SEQ ID NO: 2859432 - protein, 4 aa, Entamoeba invadens
GFND

SEQ ID NO: 2859433 - protein, 7 aa, Entamoeba invadens
GFNKDTP

SEQ ID NO: 2859434 - protein, 12 aa, Entamoeba invadens
GFNNTQNCADVN

SEQ ID NO: 2859435 - protein, 7 aa, Entamoeba invadens
GFPDNAT

SEQ ID NO: 2859436 - protein, 5 aa, Entamoeba invadens
GFPEG

SEQ ID NO: 2859437 - protein, 4 aa, Entamoeba invadens
GFPL

SEQ ID NO: 2859438 - protein, 26 aa, Entamoeba invadens
GFPPPPMTSQPQQQFQQPQPTQPNPF

SEQ ID NO: 2859439 - protein, 6 aa, Entamoeba invadens
GFPPST

SEQ ID NO: 2859440 - protein, 7 aa, Entamoeba invadens
GFPQPSF

SEQ ID NO: 2859441 - protein, 9 aa, Entamoeba invadens
GFPSGIDGN

SEQ ID NO: 2859442 - protein, 13 aa, Entamoeba invadens
GFPSGKTGISAGV

SEQ ID NO: 2859443 - protein, 6 aa, Entamoeba invadens
GFQGNE

SEQ ID NO: 2859444 - protein, 7 aa, Entamoeba invadens
GFQGNEA

SEQ ID NO: 2859445 - protein, 5 aa, Entamoeba invadens
GFQGR

SEQ ID NO: 2859446 - protein, 16 aa, Entamoeba invadens
GFQNGTKTKITDSDFS

SEQ ID NO: 2859447 - protein, 19 aa, Entamoeba invadens
GFQPSFQQSVKESSGSVQL

SEQ ID NO: 2859448 - protein, 5 aa, Entamoeba invadens
GFQSR

SEQ ID NO: 2859449 - protein, 17 aa, Entamoeba invadens
GFQTEEKKEEVPPASNL

SEQ ID NO: 2859450 - protein, 4 aa, Entamoeba invadens
GFRG

SEQ ID NO: 2859451 - protein, 5 aa, Entamoeba invadens
GFRQD

SEQ ID NO: 2859452 - protein, 18 aa, Entamoeba invadens
GFSDDSTDKYSDSLTAET

SEQ ID NO: 2859453 - protein, 42 aa, Entamoeba invadens
GFSDTTSDKTNTRENLEYTEHNAQKGRPAKGESRSSQNRFRP

SEQ ID NO: 2859454 - protein, 8 aa, Entamoeba invadens
GFSESEAD

SEQ ID NO: 2859455 - protein, 5 aa, Entamoeba invadens
GFSPE

SEQ ID NO: 2859456 - protein, 6 aa, Entamoeba invadens
GFSPTN

SEQ ID NO: 2859457 - protein, 8 aa, Entamoeba invadens
GFSQNETR

SEQ ID NO: 2859458 - protein, 8 aa, Entamoeba invadens
GFSQPAPF

SEQ ID NO: 2859459 - protein, 9 aa, Entamoeba invadens
GFSQTAPFE

SEQ ID NO: 2859460 - protein, 14 aa, Entamoeba invadens
GFSTSEDKSENVPV

SEQ ID NO: 2859461 - protein, 16 aa, Entamoeba invadens
GFTDSGKTVFDDGTTF

SEQ ID NO: 2859462 - protein, 6 aa, Entamoeba invadens
GFTEQD

SEQ ID NO: 2859463 - protein, 16 aa, Entamoeba invadens
GFTEQGKTLFDDGSVT

SEQ ID NO: 2859464 - protein, 19 aa, Entamoeba invadens
GFTEQGKTVFDDGSTTVKS

SEQ ID NO: 2859465 - protein, 5 aa, Entamoeba invadens
GFTPL

SEQ ID NO: 2859466 - protein, 27 aa, Entamoeba invadens
GFTPSKANPPKTVRPPPKLASKKHSIE

SEQ ID NO: 2859467 - protein, 5 aa, Entamoeba invadens
GFTSP

SEQ ID NO: 2859468 - protein, 7 aa, Entamoeba invadens
GFTVPED

SEQ ID NO: 2859469 - protein, 10 aa, Entamoeba invadens
GFYESRDEEM

SEQ ID NO: 2859470 - protein, 5 aa, Entamoeba invadens
GFYNT

SEQ ID NO: 2859471 - protein, 5 aa, Entamoeba invadens
GFYQG

SEQ ID NO: 2859472 - protein, 7 aa, Entamoeba invadens
GGAAEVK

SEQ ID NO: 2859473 - protein, 27 aa, Entamoeba invadens
GGAAPARSGLTHPSIAPYGQYTAGDGQ

SEQ ID NO: 2859474 - protein, 9 aa, Entamoeba invadens
GGAAPQYGM

SEQ ID NO: 2859475 - protein, 4 aa, Entamoeba invadens
GGAD

SEQ ID NO: 2859476 - protein, 10 aa, Entamoeba invadens
GGAEATTPRT

SEQ ID NO: 2859477 - protein, 12 aa, Entamoeba invadens
GGAETGSGKTAA

SEQ ID NO: 2859478 - protein, 9 aa, Entamoeba invadens
GGAGETNQK

SEQ ID NO: 2859479 - protein, 15 aa, Entamoeba invadens
GGAGLPKDKKEQFKA

SEQ ID NO: 2859480 - protein, 9 aa, Entamoeba invadens
GGAGTAADL

SEQ ID NO: 2859481 - protein, 7 aa, Entamoeba invadens
GGAHGGH

SEQ ID NO: 2859482 - protein, 9 aa, Entamoeba invadens
GGAKKEGEE

SEQ ID NO: 2859483 - protein, 6 aa, Entamoeba invadens
GGALPQ

SEQ ID NO: 2859484 - protein, 8 aa, Entamoeba invadens
GGAPGMAP

SEQ ID NO: 2859485 - protein, 17 aa, Entamoeba invadens
GGAPSRMQMGKPEKRNA

SEQ ID NO: 2859486 - protein, 13 aa, Entamoeba invadens
GGAREKVPTRDPM

SEQ ID NO: 2859487 - protein, 8 aa, Entamoeba invadens
GGASKRPI

SEQ ID NO: 2859488 - protein, 6 aa, Entamoeba invadens
GGASVN

SEQ ID NO: 2859489 - protein, 10 aa, Entamoeba invadens
GGATNEPLEP

SEQ ID NO: 2859490 - protein, 13 aa, Entamoeba invadens
GGAVPGKTRNVSS

SEQ ID NO: 2859491 - protein, 14 aa, Entamoeba invadens
GGAVVRSNGKIMSQ

SEQ ID NO: 2859492 - protein, 6 aa, Entamoeba invadens
GGAYGS

SEQ ID NO: 2859493 - protein, 10 aa, Entamoeba invadens
GGCGAAENNR

SEQ ID NO: 2859494 - protein, 5 aa, Entamoeba invadens
GGCKE

SEQ ID NO: 2859495 - protein, 10 aa, Entamoeba invadens
GGCNGPERTN

SEQ ID NO: 2859496 - protein, 8 aa, Entamoeba invadens
GGCNSSTG

SEQ ID NO: 2859497 - protein, 4 aa, Entamoeba invadens
GGCR

SEQ ID NO: 2859498 - protein, 10 aa, Entamoeba invadens
GGCTRPKKDL

SEQ ID NO: 2859499 - protein, 15 aa, Entamoeba invadens
GGDAEKVVEKAKKMG

SEQ ID NO: 2859500 - protein, 19 aa, Entamoeba invadens
GGDDFRASAGGAKKGQRGA

SEQ ID NO: 2859501 - protein, 6 aa, Entamoeba invadens
GGDDQN

SEQ ID NO: 2859502 - protein, 6 aa, Entamoeba invadens
GGDDRN

SEQ ID NO: 2859503 - protein, 19 aa, Entamoeba invadens
GGDDSGASAGGANKGQRGA

SEQ ID NO: 2859504 - protein, 20 aa, Entamoeba invadens
GGDDSGASAGGANKGQRGAK

SEQ ID NO: 2859505 - protein, 19 aa, Entamoeba invadens
GGDDSGVSAGGANKGQRGA

SEQ ID NO: 2859506 - protein, 5 aa, Entamoeba invadens
GGDDT

SEQ ID NO: 2859507 - protein, 5 aa, Entamoeba invadens
GGDDV

SEQ ID NO: 2859508 - protein, 21 aa, Entamoeba invadens
GGDEEKEKSEEKDAQESGFAF

SEQ ID NO: 2859509 - protein, 5 aa, Entamoeba invadens
GGDEV

SEQ ID NO: 2859510 - protein, 4 aa, Entamoeba invadens
GGDF

SEQ ID NO: 2859511 - protein, 17 aa, Entamoeba invadens
GGDGKMTKSKEIKSTEP

SEQ ID NO: 2859512 - protein, 6 aa, Entamoeba invadens
GGDGSV

SEQ ID NO: 2859513 - protein, 6 aa, Entamoeba invadens
GGDGVL

SEQ ID NO: 2859514 - protein, 6 aa, Entamoeba invadens
GGDINT

SEQ ID NO: 2859515 - protein, 16 aa, Entamoeba invadens
GGDKSPIKTETREEIE

SEQ ID NO: 2859516 - protein, 8 aa, Entamoeba invadens
GGDKTEGI

SEQ ID NO: 2859517 - protein, 8 aa, Entamoeba invadens
GGDKTRKS

SEQ ID NO: 2859518 - protein, 5 aa, Entamoeba invadens
GGDLC

SEQ ID NO: 2859519 - protein, 18 aa, Entamoeba invadens
GGDLKKAEGQDNIDTKRY

SEQ ID NO: 2859520 - protein, 12 aa, Entamoeba invadens
GGDNKPRASKED

SEQ ID NO: 2859521 - protein, 13 aa, Entamoeba invadens
GGDPSGTGNGGRS

SEQ ID NO: 2859522 - protein, 5 aa, Entamoeba invadens
GGDQC

SEQ ID NO: 2859523 - protein, 8 aa, Entamoeba invadens
GGDRGKFE

SEQ ID NO: 2859524 - protein, 12 aa, Entamoeba invadens
GGDRLKDNYSSE

SEQ ID NO: 2859525 - protein, 80 aa, Entamoeba invadens
GGDRTHRERRDRDERPRDENGAELPTEADTADNWRRKDGDSYVPRSSGDERENRREGRERKSELVGPTEADTSDNWRRKE

SEQ ID NO: 2859526 - protein, 13 aa, Entamoeba invadens
GGDSKKKEKARIR

SEQ ID NO: 2859527 - protein, 8 aa, Entamoeba invadens
GGDTQNPA

SEQ ID NO: 2859528 - protein, 6 aa, Entamoeba invadens
GGDTTP

SEQ ID NO: 2859529 - protein, 5 aa, Entamoeba invadens
GGDVK

SEQ ID NO: 2859530 - protein, 7 aa, Entamoeba invadens
GGDYERS

SEQ ID NO: 2859531 - protein, 10 aa, Entamoeba invadens
GGDYNTRDGT

SEQ ID NO: 2859532 - protein, 10 aa, Entamoeba invadens
GGEDLGSCVP

SEQ ID NO: 2859533 - protein, 6 aa, Entamoeba invadens
GGEDSV

SEQ ID NO: 2859534 - protein, 5 aa, Entamoeba invadens
GGEEF

SEQ ID NO: 2859535 - protein, 9 aa, Entamoeba invadens
GGEEGLRDD

SEQ ID NO: 2859536 - protein, 6 aa, Entamoeba invadens
GGEEIN

SEQ ID NO: 2859537 - protein, 7 aa, Entamoeba invadens
GGEGENV

SEQ ID NO: 2859538 - protein, 5 aa, Entamoeba invadens
GGEIT

SEQ ID NO: 2859539 - protein, 5 aa, Entamoeba invadens
GGEIY

SEQ ID NO: 2859540 - protein, 8 aa, Entamoeba invadens
GGEKAGRI

SEQ ID NO: 2859541 - protein, 6 aa, Entamoeba invadens
GGEKIE

SEQ ID NO: 2859542 - protein, 6 aa, Entamoeba invadens
GGEKRE

SEQ ID NO: 2859543 - protein, 8 aa, Entamoeba invadens
GGEKTPRD

SEQ ID NO: 2859544 - protein, 5 aa, Entamoeba invadens
GGELK

SEQ ID NO: 2859545 - protein, 9 aa, Entamoeba invadens
GGELKGPRK

SEQ ID NO: 2859546 - protein, 9 aa, Entamoeba invadens
GGELRPGKG

SEQ ID NO: 2859547 - protein, 4 aa, Entamoeba invadens
GGEN

SEQ ID NO: 2859548 - protein, 6 aa, Entamoeba invadens
GGENAT

SEQ ID NO: 2859549 - protein, 9 aa, Entamoeba invadens
GGERAPKID

SEQ ID NO: 2859550 - protein, 10 aa, Entamoeba invadens
GGERQQREVE

SEQ ID NO: 2859551 - protein, 10 aa, Entamoeba invadens
GGERRDRMSN

SEQ ID NO: 2859552 - protein, 5 aa, Entamoeba invadens
GGESL

SEQ ID NO: 2859553 - protein, 12 aa, Entamoeba invadens
GGETCVSTKSDF

SEQ ID NO: 2859554 - protein, 6 aa, Entamoeba invadens
GGETTR

SEQ ID NO: 2859555 - protein, 31 aa, Entamoeba invadens
GGEVNLEREGVSGKVAKPKKQKQSGKSRCSI

SEQ ID NO: 2859556 - protein, 13 aa, Entamoeba invadens
GGEVPLTSQEGGF

SEQ ID NO: 2859557 - protein, 6 aa, Entamoeba invadens
GGFNGR

SEQ ID NO: 2859558 - protein, 30 aa, Entamoeba invadens
GGFNSHRNSPTTVERKEKKTPSPQTNYHTE

SEQ ID NO: 2859559 - protein, 5 aa, Entamoeba invadens
GGFQS

SEQ ID NO: 2859560 - protein, 9 aa, Entamoeba invadens
GGFSQTEPF

SEQ ID NO: 2859561 - protein, 5 aa, Entamoeba invadens
GGFTT

SEQ ID NO: 2859562 - protein, 14 aa, Entamoeba invadens
GGGDDGDGADFGGF

SEQ ID NO: 2859563 - protein, 7 aa, Entamoeba invadens
GGGDKQS

SEQ ID NO: 2859564 - protein, 6 aa, Entamoeba invadens
GGGEDG

SEQ ID NO: 2859565 - protein, 14 aa, Entamoeba invadens
GGGENSKKATEEFG

SEQ ID NO: 2859566 - protein, 5 aa, Entamoeba invadens
GGGET

SEQ ID NO: 2859567 - protein, 5 aa, Entamoeba invadens
GGGEV

SEQ ID NO: 2859568 - protein, 23 aa, Entamoeba invadens
GGGFGGQPQQAPNGLGQPQQNQL

SEQ ID NO: 2859569 - protein, 5 aa, Entamoeba invadens
GGGGL

SEQ ID NO: 2859570 - protein, 5 aa, Entamoeba invadens
GGGIK

SEQ ID NO: 2859571 - protein, 7 aa, Entamoeba invadens
GGGIRNG

SEQ ID NO: 2859572 - protein, 4 aa, Entamoeba invadens
GGGM

SEQ ID NO: 2859573 - protein, 9 aa, Entamoeba invadens
GGGNTKING

SEQ ID NO: 2859574 - protein, 8 aa, Entamoeba invadens
GGGPSLTQ

SEQ ID NO: 2859575 - protein, 21 aa, Entamoeba invadens
GGGQCRSSDECRDVEGAREKL

SEQ ID NO: 2859576 - protein, 13 aa, Entamoeba invadens
GGGQLTDPETKTK

SEQ ID NO: 2859577 - protein, 9 aa, Entamoeba invadens
GGGSANKSY

SEQ ID NO: 2859578 - protein, 9 aa, Entamoeba invadens
GGGSAVDAA

SEQ ID NO: 2859579 - protein, 8 aa, Entamoeba invadens
GGGSGRPA

SEQ ID NO: 2859580 - protein, 7 aa, Entamoeba invadens
GGGSGSV

SEQ ID NO: 2859581 - protein, 5 aa, Entamoeba invadens
GGGTL

SEQ ID NO: 2859582 - protein, 80 aa, Entamoeba invadens
GGGTNGIDKAGKIEEVKDQKDVEKKEVQLKETQDPKDLHTDTKDTTEDMKVEDNGNKKEEKEKESLKVSTQSEDKIQKEY

SEQ ID NO: 2859583 - protein, 15 aa, Entamoeba invadens
GGGTVFDQENKEGRK

SEQ ID NO: 2859584 - protein, 4 aa, Entamoeba invadens
GGGV

SEQ ID NO: 2859585 - protein, 6 aa, Entamoeba invadens
GGGVGQ

SEQ ID NO: 2859586 - protein, 7 aa, Entamoeba invadens
GGGWGPL

SEQ ID NO: 2859587 - protein, 6 aa, Entamoeba invadens
GGGWKS

SEQ ID NO: 2859588 - protein, 7 aa, Entamoeba invadens
GGGYDGG

SEQ ID NO: 2859589 - protein, 11 aa, Entamoeba invadens
GGGYEADEDYP

SEQ ID NO: 2859590 - protein, 8 aa, Entamoeba invadens
GGHFGRND

SEQ ID NO: 2859591 - protein, 11 aa, Entamoeba invadens
GGHFNTTTQQC

SEQ ID NO: 2859592 - protein, 21 aa, Entamoeba invadens
GGHKESQQNKNTQKSSFDIFL

SEQ ID NO: 2859593 - protein, 13 aa, Entamoeba invadens
GGHSDDVNGVSTS

SEQ ID NO: 2859594 - protein, 14 aa, Entamoeba invadens
GGHSGGEIHKQRAS

SEQ ID NO: 2859595 - protein, 11 aa, Entamoeba invadens
GGHTFNGNTKK

SEQ ID NO: 2859596 - protein, 7 aa, Entamoeba invadens
GGHTPAR

SEQ ID NO: 2859597 - protein, 6 aa, Entamoeba invadens
GGHTQG

SEQ ID NO: 2859598 - protein, 7 aa, Entamoeba invadens
GGIDSSV

SEQ ID NO: 2859599 - protein, 7 aa, Entamoeba invadens
GGIEASD

SEQ ID NO: 2859600 - protein, 10 aa, Entamoeba invadens
GGIEEDAYTD

SEQ ID NO: 2859601 - protein, 4 aa, Entamoeba invadens
GGIG

SEQ ID NO: 2859602 - protein, 4 aa, Entamoeba invadens
GGIK

SEQ ID NO: 2859603 - protein, 10 aa, Entamoeba invadens
GGINPPPPSG

SEQ ID NO: 2859604 - protein, 6 aa, Entamoeba invadens
GGIPDV

SEQ ID NO: 2859605 - protein, 7 aa, Entamoeba invadens
GGIPSDI

SEQ ID NO: 2859606 - protein, 14 aa, Entamoeba invadens
GGISGTLKTTYDDS

SEQ ID NO: 2859607 - protein, 19 aa, Entamoeba invadens
GGISSAGYPAISETPVEDA

SEQ ID NO: 2859608 - protein, 11 aa, Entamoeba invadens
GGISVKGKEVK

SEQ ID NO: 2859609 - protein, 4 aa, Entamoeba invadens
GGIT

SEQ ID NO: 2859610 - protein, 4 aa, Entamoeba invadens
GGKC

SEQ ID NO: 2859611 - protein, 16 aa, Entamoeba invadens
GGKCDTTSGNCTGCDT

SEQ ID NO: 2859612 - protein, 9 aa, Entamoeba invadens
GGKCDTTTG

SEQ ID NO: 2859613 - protein, 4 aa, Entamoeba invadens
GGKD

SEQ ID NO: 2859614 - protein, 10 aa, Entamoeba invadens
GGKDKGGKLG

SEQ ID NO: 2859615 - protein, 11 aa, Entamoeba invadens
GGKEEVNGGHK

SEQ ID NO: 2859616 - protein, 12 aa, Entamoeba invadens
GGKEKEQKEMET

SEQ ID NO: 2859617 - protein, 5 aa, Entamoeba invadens
GGKEQ

SEQ ID NO: 2859618 - protein, 10 aa, Entamoeba invadens
GGKEVSCGRE

SEQ ID NO: 2859619 - protein, 15 aa, Entamoeba invadens
GGKFNQNSYKVSGGL

SEQ ID NO: 2859620 - protein, 18 aa, Entamoeba invadens
GGKGCGSTDITRGDEEEL

SEQ ID NO: 2859621 - protein, 6 aa, Entamoeba invadens
GGKGKF

SEQ ID NO: 2859622 - protein, 6 aa, Entamoeba invadens
GGKGSI

SEQ ID NO: 2859623 - protein, 9 aa, Entamoeba invadens
GGKGSPQFK

SEQ ID NO: 2859624 - protein, 15 aa, Entamoeba invadens
GGKKAWSDMAERANT

SEQ ID NO: 2859625 - protein, 8 aa, Entamoeba invadens
GGKKGDAY

SEQ ID NO: 2859626 - protein, 10 aa, Entamoeba invadens
GGKKGKGRTV

SEQ ID NO: 2859627 - protein, 9 aa, Entamoeba invadens
GGKKKPPMW

SEQ ID NO: 2859628 - protein, 52 aa, Entamoeba invadens
GGKKSLTELEKDSQMRSAAMKQDKEKVETKPTLQPLDQSQHASKQQKKQKSM

SEQ ID NO: 2859629 - protein, 8 aa, Entamoeba invadens
GGKMTEIK

SEQ ID NO: 2859630 - protein, 8 aa, Entamoeba invadens
GGKNENIK

SEQ ID NO: 2859631 - protein, 6 aa, Entamoeba invadens
GGKNKE

SEQ ID NO: 2859632 - protein, 11 aa, Entamoeba invadens
GGKNKEAEAKK

SEQ ID NO: 2859633 - protein, 4 aa, Entamoeba invadens
GGKP

SEQ ID NO: 2859634 - protein, 6 aa, Entamoeba invadens
GGKPIE

SEQ ID NO: 2859635 - protein, 7 aa, Entamoeba invadens
GGKPKEK

SEQ ID NO: 2859636 - protein, 4 aa, Entamoeba invadens
GGKQ

SEQ ID NO: 2859637 - protein, 4 aa, Entamoeba invadens
GGKR

SEQ ID NO: 2859638 - protein, 7 aa, Entamoeba invadens
GGKRSVE

SEQ ID NO: 2859639 - protein, 23 aa, Entamoeba invadens
GGKSIQKSTTDKRRRKLQMRNEM

SEQ ID NO: 2859640 - protein, 5 aa, Entamoeba invadens
GGKSV

SEQ ID NO: 2859641 - protein, 28 aa, Entamoeba invadens
GGKTAFAEPENEEKKDAALSQYKTERAK

SEQ ID NO: 2859642 - protein, 8 aa, Entamoeba invadens
GGKTEEAL

SEQ ID NO: 2859643 - protein, 15 aa, Entamoeba invadens
GGKTGKFPQNCIMAF

SEQ ID NO: 2859644 - protein, 8 aa, Entamoeba invadens
GGKTSYIR

SEQ ID NO: 2859645 - protein, 5 aa, Entamoeba invadens
GGKTT

SEQ ID NO: 2859646 - protein, 10 aa, Entamoeba invadens
GGKVGDRYPK

SEQ ID NO: 2859647 - protein, 16 aa, Entamoeba invadens
GGKVPSSLKMNTPPNL

SEQ ID NO: 2859648 - protein, 8 aa, Entamoeba invadens
GGKVPSTL

SEQ ID NO: 2859649 - protein, 6 aa, Entamoeba invadens
GGKVTL

SEQ ID NO: 2859650 - protein, 4 aa, Entamoeba invadens
GGLD

SEQ ID NO: 2859651 - protein, 11 aa, Entamoeba invadens
GGLDTKNRSMG

SEQ ID NO: 2859652 - protein, 6 aa, Entamoeba invadens
GGLEDD

SEQ ID NO: 2859653 - protein, 13 aa, Entamoeba invadens
GGLEDGEGCTAYD

SEQ ID NO: 2859654 - protein, 6 aa, Entamoeba invadens
GGLEDV

SEQ ID NO: 2859655 - protein, 10 aa, Entamoeba invadens
GGLEQTKQEL

SEQ ID NO: 2859656 - protein, 6 aa, Entamoeba invadens
GGLESK

SEQ ID NO: 2859657 - protein, 14 aa, Entamoeba invadens
GGLGTTMGCTGPKG

SEQ ID NO: 2859658 - protein, 11 aa, Entamoeba invadens
GGLKGKQEALS

SEQ ID NO: 2859659 - protein, 11 aa, Entamoeba invadens
GGLKGKQEPLS

SEQ ID NO: 2859660 - protein, 11 aa, Entamoeba invadens
GGLKIDKSTSF

SEQ ID NO: 2859661 - protein, 12 aa, Entamoeba invadens
GGLKPARHPTHL

SEQ ID NO: 2859662 - protein, 4 aa, Entamoeba invadens
GGLN

SEQ ID NO: 2859663 - protein, 10 aa, Entamoeba invadens
GGLNDESQGP

SEQ ID NO: 2859664 - protein, 9 aa, Entamoeba invadens
GGLNTEQKA

SEQ ID NO: 2859665 - protein, 4 aa, Entamoeba invadens
GGLP

SEQ ID NO: 2859666 - protein, 9 aa, Entamoeba invadens
GGLSERAPS

SEQ ID NO: 2859667 - protein, 7 aa, Entamoeba invadens
GGLTKNQ

SEQ ID NO: 2859668 - protein, 9 aa, Entamoeba invadens
GGLTPGGRV

SEQ ID NO: 2859669 - protein, 4 aa, Entamoeba invadens
GGLV

SEQ ID NO: 2859670 - protein, 4 aa, Entamoeba invadens
GGMG

SEQ ID NO: 2859671 - protein, 6 aa, Entamoeba invadens
GGMKNR

SEQ ID NO: 2859672 - protein, 4 aa, Entamoeba invadens
GGMN

SEQ ID NO: 2859673 - protein, 8 aa, Entamoeba invadens
GGMPGQQM

SEQ ID NO: 2859674 - protein, 7 aa, Entamoeba invadens
GGMTESE

SEQ ID NO: 2859675 - protein, 6 aa, Entamoeba invadens
GGMTQG

SEQ ID NO: 2859676 - protein, 10 aa, Entamoeba invadens
GGNDGNTIVS

SEQ ID NO: 2859677 - protein, 5 aa, Entamoeba invadens
GGNDI

SEQ ID NO: 2859678 - protein, 11 aa, Entamoeba invadens
GGNDKMKITNK

SEQ ID NO: 2859679 - protein, 8 aa, Entamoeba invadens
GGNDQDFT

SEQ ID NO: 2859680 - protein, 5 aa, Entamoeba invadens
GGNEF

SEQ ID NO: 2859681 - protein, 7 aa, Entamoeba invadens
GGNEGPA

SEQ ID NO: 2859682 - protein, 11 aa, Entamoeba invadens
GGNGPISTEKM

SEQ ID NO: 2859683 - protein, 14 aa, Entamoeba invadens
GGNGQSEQAKRIQQ

SEQ ID NO: 2859684 - protein, 4 aa, Entamoeba invadens
GGNI

SEQ ID NO: 2859685 - protein, 4 aa, Entamoeba invadens
GGNL

SEQ ID NO: 2859686 - protein, 4 aa, Entamoeba invadens
GGNM

SEQ ID NO: 2859687 - protein, 5 aa, Entamoeba invadens
GGNPI

SEQ ID NO: 2859688 - protein, 13 aa, Entamoeba invadens
GGNPKKKDEEVLE

SEQ ID NO: 2859689 - protein, 7 aa, Entamoeba invadens
GGNQGAV

SEQ ID NO: 2859690 - protein, 17 aa, Entamoeba invadens
GGNQSKNQLQTREGESC

SEQ ID NO: 2859691 - protein, 4 aa, Entamoeba invadens
GGNS

SEQ ID NO: 2859692 - protein, 7 aa, Entamoeba invadens
GGNSLGY

SEQ ID NO: 2859693 - protein, 8 aa, Entamoeba invadens
GGNSNKLF

SEQ ID NO: 2859694 - protein, 7 aa, Entamoeba invadens
GGNTIDN

SEQ ID NO: 2859695 - protein, 7 aa, Entamoeba invadens
GGNTSFK

SEQ ID NO: 2859696 - protein, 7 aa, Entamoeba invadens
GGNTSNI

SEQ ID NO: 2859697 - protein, 8 aa, Entamoeba invadens
GGNTTLKG

SEQ ID NO: 2859698 - protein, 7 aa, Entamoeba invadens
GGNVDSY

SEQ ID NO: 2859699 - protein, 31 aa, Entamoeba invadens
GGNVKEANDYQEDTYEGSSAISKMRNDKKQD

SEQ ID NO: 2859700 - protein, 13 aa, Entamoeba invadens
GGNVNAHNNKGIT

SEQ ID NO: 2859701 - protein, 9 aa, Entamoeba invadens
GGNYKGREA

SEQ ID NO: 2859702 - protein, 9 aa, Entamoeba invadens
GGPAAGGHN

SEQ ID NO: 2859703 - protein, 9 aa, Entamoeba invadens
GGPASGKTS

SEQ ID NO: 2859704 - protein, 5 aa, Entamoeba invadens
GGPFY

SEQ ID NO: 2859705 - protein, 12 aa, Entamoeba invadens
GGPGGGKTTSLT

SEQ ID NO: 2859706 - protein, 14 aa, Entamoeba invadens
GGPLQGLPPQQMGQ

SEQ ID NO: 2859707 - protein, 4 aa, Entamoeba invadens
GGPM

SEQ ID NO: 2859708 - protein, 11 aa, Entamoeba invadens
GGPSEISNEIN

SEQ ID NO: 2859709 - protein, 18 aa, Entamoeba invadens
GGPSGLAAAKAALDTNKS

SEQ ID NO: 2859710 - protein, 8 aa, Entamoeba invadens
GGPTPQLT

SEQ ID NO: 2859711 - protein, 6 aa, Entamoeba invadens
GGQEKE

SEQ ID NO: 2859712 - protein, 6 aa, Entamoeba invadens
GGQEKK

SEQ ID NO: 2859713 - protein, 7 aa, Entamoeba invadens
GGQGTRL

SEQ ID NO: 2859714 - protein, 21 aa, Entamoeba invadens
GGQQQEKEELKKKTEKTSKMI

SEQ ID NO: 2859715 - protein, 11 aa, Entamoeba invadens
GGQQQQQQNNF

SEQ ID NO: 2859716 - protein, 8 aa, Entamoeba invadens
GGQRSERK

SEQ ID NO: 2859717 - protein, 6 aa, Entamoeba invadens
GGQSKI

SEQ ID NO: 2859718 - protein, 7 aa, Entamoeba invadens
GGQSSLR

SEQ ID NO: 2859719 - protein, 5 aa, Entamoeba invadens
GGRKE

SEQ ID NO: 2859720 - protein, 17 aa, Entamoeba invadens
GGRKNKQNWDTTYYDNS

SEQ ID NO: 2859721 - protein, 6 aa, Entamoeba invadens
GGRNKE

SEQ ID NO: 2859722 - protein, 10 aa, Entamoeba invadens
GGRPTDRTSQ

SEQ ID NO: 2859723 - protein, 14 aa, Entamoeba invadens
GGRRGGMSSEGREL

SEQ ID NO: 2859724 - protein, 8 aa, Entamoeba invadens
GGRVGSGE

SEQ ID NO: 2859725 - protein, 15 aa, Entamoeba invadens
GGSAGWQAPEAIRGE

SEQ ID NO: 2859726 - protein, 6 aa, Entamoeba invadens
GGSAMD

SEQ ID NO: 2859727 - protein, 7 aa, Entamoeba invadens
GGSAPNV

SEQ ID NO: 2859728 - protein, 6 aa, Entamoeba invadens
GGSCDN

SEQ ID NO: 2859729 - protein, 11 aa, Entamoeba invadens
GGSCDSTNGTC

SEQ ID NO: 2859730 - protein, 9 aa, Entamoeba invadens
GGSETYPQI

SEQ ID NO: 2859731 - protein, 5 aa, Entamoeba invadens
GGSFG

SEQ ID NO: 2859732 - protein, 6 aa, Entamoeba invadens
GGSFPS

SEQ ID NO: 2859733 - protein, 6 aa, Entamoeba invadens
GGSGRK

SEQ ID NO: 2859734 - protein, 14 aa, Entamoeba invadens
GGSGRKGKSSFSFG

SEQ ID NO: 2859735 - protein, 6 aa, Entamoeba invadens
GGSGST

SEQ ID NO: 2859736 - protein, 6 aa, Entamoeba invadens
GGSGSV

SEQ ID NO: 2859737 - protein, 10 aa, Entamoeba invadens
GGSIKKNGVY

SEQ ID NO: 2859738 - protein, 8 aa, Entamoeba invadens
GGSIPTAV

SEQ ID NO: 2859739 - protein, 7 aa, Entamoeba invadens
GGSKDVL

SEQ ID NO: 2859740 - protein, 11 aa, Entamoeba invadens
GGSKNSDHNPT

SEQ ID NO: 2859741 - protein, 5 aa, Entamoeba invadens
GGSKS

SEQ ID NO: 2859742 - protein, 9 aa, Entamoeba invadens
GGSKTEQQF

SEQ ID NO: 2859743 - protein, 7 aa, Entamoeba invadens
GGSLDSR

SEQ ID NO: 2859744 - protein, 5 aa, Entamoeba invadens
GGSLG

SEQ ID NO: 2859745 - protein, 13 aa, Entamoeba invadens
GGSLLSKSEKTEL

SEQ ID NO: 2859746 - protein, 4 aa, Entamoeba invadens
GGSM

SEQ ID NO: 2859747 - protein, 27 aa, Entamoeba invadens
GGSNDCDVSNNAQNTPPQNHVDEDETE

SEQ ID NO: 2859748 - protein, 6 aa, Entamoeba invadens
GGSNHY

SEQ ID NO: 2859749 - protein, 9 aa, Entamoeba invadens
GGSNPAFPP

SEQ ID NO: 2859750 - protein, 5 aa, Entamoeba invadens
GGSNV

SEQ ID NO: 2859751 - protein, 5 aa, Entamoeba invadens
GGSPI

SEQ ID NO: 2859752 - protein, 6 aa, Entamoeba invadens
GGSPIP

SEQ ID NO: 2859753 - protein, 30 aa, Entamoeba invadens
GGSPQPTQQPVQQQAPAQQNKPAIDLSFLG

SEQ ID NO: 2859754 - protein, 8 aa, Entamoeba invadens
GGSQDYYS

SEQ ID NO: 2859755 - protein, 9 aa, Entamoeba invadens
GGSQPLTTT

SEQ ID NO: 2859756 - protein, 23 aa, Entamoeba invadens
GGSQQKKRTKKNAKKAQEEYNEL

SEQ ID NO: 2859757 - protein, 9 aa, Entamoeba invadens
GGSQRKFEK

SEQ ID NO: 2859758 - protein, 6 aa, Entamoeba invadens
GGSRVD

SEQ ID NO: 2859759 - protein, 7 aa, Entamoeba invadens
GGSSDGT

SEQ ID NO: 2859760 - protein, 8 aa, Entamoeba invadens
GGSSKIDK

SEQ ID NO: 2859761 - protein, 6 aa, Entamoeba invadens
GGSSLL

SEQ ID NO: 2859762 - protein, 6 aa, Entamoeba invadens
GGSSLT

SEQ ID NO: 2859763 - protein, 12 aa, Entamoeba invadens
GGSSNLIGTTSK

SEQ ID NO: 2859764 - protein, 7 aa, Entamoeba invadens
GGSSYSF

SEQ ID NO: 2859765 - protein, 4 aa, Entamoeba invadens
GGST

SEQ ID NO: 2859766 - protein, 8 aa, Entamoeba invadens
GGSTITQE

SEQ ID NO: 2859767 - protein, 5 aa, Entamoeba invadens
GGSVI

SEQ ID NO: 2859768 - protein, 9 aa, Entamoeba invadens
GGSVKTTKK

SEQ ID NO: 2859769 - protein, 6 aa, Entamoeba invadens
GGSVVD

SEQ ID NO: 2859770 - protein, 8 aa, Entamoeba invadens
GGSVVDGT

SEQ ID NO: 2859771 - protein, 10 aa, Entamoeba invadens
GGTASGKTTF

SEQ ID NO: 2859772 - protein, 11 aa, Entamoeba invadens
GGTDLASDKYQ

SEQ ID NO: 2859773 - protein, 4 aa, Entamoeba invadens
GGTE

SEQ ID NO: 2859774 - protein, 5 aa, Entamoeba invadens
GGTEF

SEQ ID NO: 2859775 - protein, 7 aa, Entamoeba invadens
GGTEGFQ

SEQ ID NO: 2859776 - protein, 4 aa, Entamoeba invadens
GGTF

SEQ ID NO: 2859777 - protein, 6 aa, Entamoeba invadens
GGTGGC

SEQ ID NO: 2859778 - protein, 6 aa, Entamoeba invadens
GGTGLT

SEQ ID NO: 2859779 - protein, 7 aa, Entamoeba invadens
GGTGRAP

SEQ ID NO: 2859780 - protein, 9 aa, Entamoeba invadens
GGTGSGLGS

SEQ ID NO: 2859781 - protein, 11 aa, Entamoeba invadens
GGTGTNKVPNV

SEQ ID NO: 2859782 - protein, 8 aa, Entamoeba invadens
GGTIETVK

SEQ ID NO: 2859783 - protein, 11 aa, Entamoeba invadens
GGTKESRDECK

SEQ ID NO: 2859784 - protein, 9 aa, Entamoeba invadens
GGTLDPSTA

SEQ ID NO: 2859785 - protein, 6 aa, Entamoeba invadens
GGTLDT

SEQ ID NO: 2859786 - protein, 7 aa, Entamoeba invadens
GGTLDTT

SEQ ID NO: 2859787 - protein, 10 aa, Entamoeba invadens
GGTMGTKGNT

SEQ ID NO: 2859788 - protein, 7 aa, Entamoeba invadens
GGTPSSN

SEQ ID NO: 2859789 - protein, 8 aa, Entamoeba invadens
GGTQVEKS

SEQ ID NO: 2859790 - protein, 4 aa, Entamoeba invadens
GGTS

SEQ ID NO: 2859791 - protein, 8 aa, Entamoeba invadens
GGTSGIGE

SEQ ID NO: 2859792 - protein, 7 aa, Entamoeba invadens
GGTSMYS

SEQ ID NO: 2859793 - protein, 7 aa, Entamoeba invadens
GGTSNDL

SEQ ID NO: 2859794 - protein, 6 aa, Entamoeba invadens
GGTSSV

SEQ ID NO: 2859795 - protein, 16 aa, Entamoeba invadens
GGTSTEPPPIPPGDRN

SEQ ID NO: 2859796 - protein, 5 aa, Entamoeba invadens
GGTSV

SEQ ID NO: 2859797 - protein, 7 aa, Entamoeba invadens
GGTTNGR

SEQ ID NO: 2859798 - protein, 9 aa, Entamoeba invadens
GGTTPAYDT

SEQ ID NO: 2859799 - protein, 7 aa, Entamoeba invadens
GGTTQVM

SEQ ID NO: 2859800 - protein, 10 aa, Entamoeba invadens
GGTVSEVTDL

SEQ ID NO: 2859801 - protein, 7 aa, Entamoeba invadens
GGTWGSG

SEQ ID NO: 2859802 - protein, 4 aa, Entamoeba invadens
GGVD

SEQ ID NO: 2859803 - protein, 6 aa, Entamoeba invadens
GGVDEI

SEQ ID NO: 2859804 - protein, 5 aa, Entamoeba invadens
GGVDS

SEQ ID NO: 2859805 - protein, 10 aa, Entamoeba invadens
GGVEAGTEEE

SEQ ID NO: 2859806 - protein, 9 aa, Entamoeba invadens
GGVEIDNSP

SEQ ID NO: 2859807 - protein, 20 aa, Entamoeba invadens
GGVEKREFSKDEKLSGTKDP

SEQ ID NO: 2859808 - protein, 8 aa, Entamoeba invadens
GGVGEERR

SEQ ID NO: 2859809 - protein, 7 aa, Entamoeba invadens
GGVGKSA

SEQ ID NO: 2859810 - protein, 7 aa, Entamoeba invadens
GGVGKTS

SEQ ID NO: 2859811 - protein, 7 aa, Entamoeba invadens
GGVGRVT

SEQ ID NO: 2859812 - protein, 4 aa, Entamoeba invadens
GGVI

SEQ ID NO: 2859813 - protein, 12 aa, Entamoeba invadens
GGVKKSNDDANR

SEQ ID NO: 2859814 - protein, 17 aa, Entamoeba invadens
GGVKRGPPTAGSYGKRK

SEQ ID NO: 2859815 - protein, 5 aa, Entamoeba invadens
GGVNT

SEQ ID NO: 2859816 - protein, 4 aa, Entamoeba invadens
GGVP

SEQ ID NO: 2859817 - protein, 11 aa, Entamoeba invadens
GGVRPQVKPYV

SEQ ID NO: 2859818 - protein, 25 aa, Entamoeba invadens
GGVSDKKINKTTKAEPKKKLPKNPY

SEQ ID NO: 2859819 - protein, 17 aa, Entamoeba invadens
GGVSDVGKKAVTNPFGT

SEQ ID NO: 2859820 - protein, 11 aa, Entamoeba invadens
GGVSGESEQKI

SEQ ID NO: 2859821 - protein, 7 aa, Entamoeba invadens
GGVSNGI

SEQ ID NO: 2859822 - protein, 4 aa, Entamoeba invadens
GGVV

SEQ ID NO: 2859823 - protein, 19 aa, Entamoeba invadens
GGWTSTPQTKESPTVSRES

SEQ ID NO: 2859824 - protein, 4 aa, Entamoeba invadens
GGYD

SEQ ID NO: 2859825 - protein, 7 aa, Entamoeba invadens
GGYDDDE

SEQ ID NO: 2859826 - protein, 6 aa, Entamoeba invadens
GGYDGE

SEQ ID NO: 2859827 - protein, 6 aa, Entamoeba invadens
GGYDKN

SEQ ID NO: 2859828 - protein, 18 aa, Entamoeba invadens
GGYDPLEKDKGIDGARKR

SEQ ID NO: 2859829 - protein, 13 aa, Entamoeba invadens
GGYGNENGKFNEP

SEQ ID NO: 2859830 - protein, 4 aa, Entamoeba invadens
GGYI

SEQ ID NO: 2859831 - protein, 8 aa, Entamoeba invadens
GGYKDTTK

SEQ ID NO: 2859832 - protein, 8 aa, Entamoeba invadens
GGYKESVH

SEQ ID NO: 2859833 - protein, 6 aa, Entamoeba invadens
GGYSSC

SEQ ID NO: 2859834 - protein, 4 aa, Entamoeba invadens
GGYT

SEQ ID NO: 2859835 - protein, 9 aa, Entamoeba invadens
GHAQGAGLH

SEQ ID NO: 2859836 - protein, 4 aa, Entamoeba invadens
GHDA

SEQ ID NO: 2859837 - protein, 8 aa, Entamoeba invadens
GHDASKAA

SEQ ID NO: 2859838 - protein, 10 aa, Entamoeba invadens
GHDEADAQPF

SEQ ID NO: 2859839 - protein, 6 aa, Entamoeba invadens
GHDELK

SEQ ID NO: 2859840 - protein, 12 aa, Entamoeba invadens
GHDTIKGEIAKT

SEQ ID NO: 2859841 - protein, 12 aa, Entamoeba invadens
GHEDETNNLNNS

SEQ ID NO: 2859842 - protein, 6 aa, Entamoeba invadens
GHEGPI

SEQ ID NO: 2859843 - protein, 5 aa, Entamoeba invadens
GHEKF

SEQ ID NO: 2859844 - protein, 14 aa, Entamoeba invadens
GHEKNDCPEKGKQI

SEQ ID NO: 2859845 - protein, 6 aa, Entamoeba invadens
GHEKRY

SEQ ID NO: 2859846 - protein, 5 aa, Entamoeba invadens
GHENR

SEQ ID NO: 2859847 - protein, 7 aa, Entamoeba invadens
GHEPFDA

SEQ ID NO: 2859848 - protein, 11 aa, Entamoeba invadens
GHEQSRRDDLE

SEQ ID NO: 2859849 - protein, 5 aa, Entamoeba invadens
GHERF

SEQ ID NO: 2859850 - protein, 14 aa, Entamoeba invadens
GHEYEGKYSISTSF

SEQ ID NO: 2859851 - protein, 41 aa, Entamoeba invadens
GHFSNKCPQREEYYNTNKQNHQGTNEEEYYEEQEEDPHTDQ

SEQ ID NO: 2859852 - protein, 8 aa, Entamoeba invadens
GHGEGDLA

SEQ ID NO: 2859853 - protein, 4 aa, Entamoeba invadens
GHGF

SEQ ID NO: 2859854 - protein, 8 aa, Entamoeba invadens
GHGGAETA

SEQ ID NO: 2859855 - protein, 10 aa, Entamoeba invadens
GHGGDKGSYY

SEQ ID NO: 2859856 - protein, 9 aa, Entamoeba invadens
GHGGDNVSK

SEQ ID NO: 2859857 - protein, 9 aa, Entamoeba invadens
GHGGKEAAY

SEQ ID NO: 2859858 - protein, 8 aa, Entamoeba invadens
GHGGPQVS

SEQ ID NO: 2859859 - protein, 7 aa, Entamoeba invadens
GHGGSDA

SEQ ID NO: 2859860 - protein, 5 aa, Entamoeba invadens
GHGMT

SEQ ID NO: 2859861 - protein, 11 aa, Entamoeba invadens
GHGNSEYKSSL

SEQ ID NO: 2859862 - protein, 21 aa, Entamoeba invadens
GHGSRTTTIGKESKSNLISSV

SEQ ID NO: 2859863 - protein, 7 aa, Entamoeba invadens
GHIGSGS

SEQ ID NO: 2859864 - protein, 5 aa, Entamoeba invadens
GHKGT

SEQ ID NO: 2859865 - protein, 19 aa, Entamoeba invadens
GHKGYKAGLDVDTDTTGVT

SEQ ID NO: 2859866 - protein, 6 aa, Entamoeba invadens
GHKITA

SEQ ID NO: 2859867 - protein, 7 aa, Entamoeba invadens
GHKTGKR

SEQ ID NO: 2859868 - protein, 13 aa, Entamoeba invadens
GHLSGSCPEKEQH

SEQ ID NO: 2859869 - protein, 22 aa, Entamoeba invadens
GHLTKECPNKVTEKKTKKHQKK

SEQ ID NO: 2859870 - protein, 7 aa, Entamoeba invadens
GHMQNED

SEQ ID NO: 2859871 - protein, 10 aa, Entamoeba invadens
GHNFDEGEED

SEQ ID NO: 2859872 - protein, 10 aa, Entamoeba invadens
GHNGDGAAIS

SEQ ID NO: 2859873 - protein, 9 aa, Entamoeba invadens
GHNGDQASA

SEQ ID NO: 2859874 - protein, 5 aa, Entamoeba invadens
GHNGM

SEQ ID NO: 2859875 - protein, 6 aa, Entamoeba invadens
GHNGMG

SEQ ID NO: 2859876 - protein, 10 aa, Entamoeba invadens
GHNGSETALE

SEQ ID NO: 2859877 - protein, 11 aa, Entamoeba invadens
GHNGTEASNIC

SEQ ID NO: 2859878 - protein, 7 aa, Entamoeba invadens
GHNPNEM

SEQ ID NO: 2859879 - protein, 36 aa, Entamoeba invadens
GHNTNKCPQKEKEQQNDENEKKSETGKKGGKKREEF

SEQ ID NO: 2859880 - protein, 4 aa, Entamoeba invadens
GHPE

SEQ ID NO: 2859881 - protein, 18 aa, Entamoeba invadens
GHPIGEKEIEGTRKDIQS

SEQ ID NO: 2859882 - protein, 11 aa, Entamoeba invadens
GHQSFSSTQSP

SEQ ID NO: 2859883 - protein, 7 aa, Entamoeba invadens
GHQTEEQ

SEQ ID NO: 2859884 - protein, 4 aa, Entamoeba invadens
GHRT

SEQ ID NO: 2859885 - protein, 5 aa, Entamoeba invadens
GHRTP

SEQ ID NO: 2859886 - protein, 6 aa, Entamoeba invadens
GHSGFQ

SEQ ID NO: 2859887 - protein, 5 aa, Entamoeba invadens
GHSGS

SEQ ID NO: 2859888 - protein, 7 aa, Entamoeba invadens
GHSGSVT

SEQ ID NO: 2859889 - protein, 7 aa, Entamoeba invadens
GHSGTDC

SEQ ID NO: 2859890 - protein, 103 aa, Entamoeba invadens
GHSKDECPQRNQDEVLDPNADSQESEEQKSLEKVEKQSEEQKPTSPEKPKSVEKEKKTVGKKVNKQMKTNTNKKVNGKPKGEKRNNKFAKGNKAKQNNKRQSR

SEQ ID NO: 2859891 - protein, 15 aa, Entamoeba invadens
GHSKNNCTEKDTAVP

SEQ ID NO: 2859892 - protein, 9 aa, Entamoeba invadens
GHSKRTKST

SEQ ID NO: 2859893 - protein, 5 aa, Entamoeba invadens
GHSQA

SEQ ID NO: 2859894 - protein, 8 aa, Entamoeba invadens
GHSSFSHS

SEQ ID NO: 2859895 - protein, 6 aa, Entamoeba invadens
GHSTPL

SEQ ID NO: 2859896 - protein, 36 aa, Entamoeba invadens
GHTAPIPHNTPFTRPNKAAPIPQKKKPQRHPTLPEL

SEQ ID NO: 2859897 - protein, 9 aa, Entamoeba invadens
GHTETDTTL

SEQ ID NO: 2859898 - protein, 6 aa, Entamoeba invadens
GHTGRK

SEQ ID NO: 2859899 - protein, 6 aa, Entamoeba invadens
GHTGSV

SEQ ID NO: 2859900 - protein, 8 aa, Entamoeba invadens
GHTKTDCE

SEQ ID NO: 2859901 - protein, 9 aa, Entamoeba invadens
GHTNQPEIS

SEQ ID NO: 2859902 - protein, 5 aa, Entamoeba invadens
GHTRE

SEQ ID NO: 2859903 - protein, 10 aa, Entamoeba invadens
GHTSGSKLSG

SEQ ID NO: 2859904 - protein, 6 aa, Entamoeba invadens
GHTSQV

SEQ ID NO: 2859905 - protein, 8 aa, Entamoeba invadens
GHTSTGES

SEQ ID NO: 2859906 - protein, 9 aa, Entamoeba invadens
GHTTRTDDG

SEQ ID NO: 2859907 - protein, 5 aa, Entamoeba invadens
GHVDG

SEQ ID NO: 2859908 - protein, 12 aa, Entamoeba invadens
GHVDSGKSTTVG

SEQ ID NO: 2859909 - protein, 5 aa, Entamoeba invadens
GHVKP

SEQ ID NO: 2859910 - protein, 7 aa, Entamoeba invadens
GHYSPKD

SEQ ID NO: 2859911 - protein, 20 aa, Entamoeba invadens
GIAASTGSACASESLQANPT

SEQ ID NO: 2859912 - protein, 12 aa, Entamoeba invadens
GIAESAGNQPIT

SEQ ID NO: 2859913 - protein, 5 aa, Entamoeba invadens
GIAET

SEQ ID NO: 2859914 - protein, 8 aa, Entamoeba invadens
GIAKKQDK

SEQ ID NO: 2859915 - protein, 7 aa, Entamoeba invadens
GIAKPSR

SEQ ID NO: 2859916 - protein, 10 aa, Entamoeba invadens
GIANKGDKEY

SEQ ID NO: 2859917 - protein, 19 aa, Entamoeba invadens
GIAPPKLPESAPPQRKETM

SEQ ID NO: 2859918 - protein, 13 aa, Entamoeba invadens
GIAPSANINPDRT

SEQ ID NO: 2859919 - protein, 9 aa, Entamoeba invadens
GIASTPASH

SEQ ID NO: 2859920 - protein, 8 aa, Entamoeba invadens
GIDDGDNV

SEQ ID NO: 2859921 - protein, 9 aa, Entamoeba invadens
GIDDNKEYA

SEQ ID NO: 2859922 - protein, 12 aa, Entamoeba invadens
GIDDTTHSSQCS

SEQ ID NO: 2859923 - protein, 4 aa, Entamoeba invadens
GIDE

SEQ ID NO: 2859924 - protein, 6 aa, Entamoeba invadens
GIDEDK

SEQ ID NO: 2859925 - protein, 14 aa, Entamoeba invadens
GIDEERYKKLEQTA

SEQ ID NO: 2859926 - protein, 9 aa, Entamoeba invadens
GIDEKSSDL

SEQ ID NO: 2859927 - protein, 11 aa, Entamoeba invadens
GIDEKTADRRI

SEQ ID NO: 2859928 - protein, 4 aa, Entamoeba invadens
GIDG

SEQ ID NO: 2859929 - protein, 8 aa, Entamoeba invadens
GIDGTKRN

SEQ ID NO: 2859930 - protein, 4 aa, Entamoeba invadens
GIDI

SEQ ID NO: 2859931 - protein, 4 aa, Entamoeba invadens
GIDK

SEQ ID NO: 2859932 - protein, 10 aa, Entamoeba invadens
GIDNDSDRSV

SEQ ID NO: 2859933 - protein, 5 aa, Entamoeba invadens
GIDPT

SEQ ID NO: 2859934 - protein, 6 aa, Entamoeba invadens
GIDPTK

SEQ ID NO: 2859935 - protein, 10 aa, Entamoeba invadens
GIDQTHNPEF

SEQ ID NO: 2859936 - protein, 5 aa, Entamoeba invadens
GIDSE

SEQ ID NO: 2859937 - protein, 11 aa, Entamoeba invadens
GIDSGAFSDCS

SEQ ID NO: 2859938 - protein, 10 aa, Entamoeba invadens
GIDSQKKGIE

SEQ ID NO: 2859939 - protein, 4 aa, Entamoeba invadens
GIDT

SEQ ID NO: 2859940 - protein, 4 aa, Entamoeba invadens
GIDV

SEQ ID NO: 2859941 - protein, 10 aa, Entamoeba invadens
GIEEKDKMGN

SEQ ID NO: 2859942 - protein, 7 aa, Entamoeba invadens
GIEERDV

SEQ ID NO: 2859943 - protein, 14 aa, Entamoeba invadens
GIEETGAKKGFPTS

SEQ ID NO: 2859944 - protein, 6 aa, Entamoeba invadens
GIEEVT

SEQ ID NO: 2859945 - protein, 13 aa, Entamoeba invadens
GIEGENSALSQLG

SEQ ID NO: 2859946 - protein, 5 aa, Entamoeba invadens
GIEPK

SEQ ID NO: 2859947 - protein, 19 aa, Entamoeba invadens
GIEPKGVVQPEEGKKKKLS

SEQ ID NO: 2859948 - protein, 7 aa, Entamoeba invadens
GIEPNKN

SEQ ID NO: 2859949 - protein, 30 aa, Entamoeba invadens
GIEPSNEQPNVQQEQQITETPFKDERDNQI

SEQ ID NO: 2859950 - protein, 14 aa, Entamoeba invadens
GIEQKSAKEKEEEM

SEQ ID NO: 2859951 - protein, 4 aa, Entamoeba invadens
GIES

SEQ ID NO: 2859952 - protein, 5 aa, Entamoeba invadens
GIESE

SEQ ID NO: 2859953 - protein, 25 aa, Entamoeba invadens
GIETERKKHKTRPLKPRNNINSMPE

SEQ ID NO: 2859954 - protein, 16 aa, Entamoeba invadens
GIETSKKSLKDCQAPD

SEQ ID NO: 2859955 - protein, 5 aa, Entamoeba invadens
GIEYD

SEQ ID NO: 2859956 - protein, 4 aa, Entamoeba invadens
GIFP

SEQ ID NO: 2859957 - protein, 11 aa, Entamoeba invadens
GIGDKSANPTK

SEQ ID NO: 2859958 - protein, 4 aa, Entamoeba invadens
GIGE

SEQ ID NO: 2859959 - protein, 10 aa, Entamoeba invadens
GIGERESREI

SEQ ID NO: 2859960 - protein, 5 aa, Entamoeba invadens
GIGES

SEQ ID NO: 2859961 - protein, 9 aa, Entamoeba invadens
GIGKGKQIC

SEQ ID NO: 2859962 - protein, 9 aa, Entamoeba invadens
GIGKKVEGH

SEQ ID NO: 2859963 - protein, 13 aa, Entamoeba invadens
GIGNTEAKTKNCT

SEQ ID NO: 2859964 - protein, 6 aa, Entamoeba invadens
GIGPYT

SEQ ID NO: 2859965 - protein, 18 aa, Entamoeba invadens
GIGRRDKAKEKDEKSEES

SEQ ID NO: 2859966 - protein, 13 aa, Entamoeba invadens
GIGSEDITSGNSK

SEQ ID NO: 2859967 - protein, 4 aa, Entamoeba invadens
GIGT

SEQ ID NO: 2859968 - protein, 6 aa, Entamoeba invadens
GIGTPK

SEQ ID NO: 2859969 - protein, 11 aa, Entamoeba invadens
GIGTPKYTAPE

SEQ ID NO: 2859970 - protein, 7 aa, Entamoeba invadens
GIGTPNY

SEQ ID NO: 2859971 - protein, 6 aa, Entamoeba invadens
GIGTPT

SEQ ID NO: 2859972 - protein, 8 aa, Entamoeba invadens
GIGTPTYM

SEQ ID NO: 2859973 - protein, 6 aa, Entamoeba invadens
GIGTPV

SEQ ID NO: 2859974 - protein, 5 aa, Entamoeba invadens
GIGYG

SEQ ID NO: 2859975 - protein, 8 aa, Entamoeba invadens
GIHDTTHN

SEQ ID NO: 2859976 - protein, 5 aa, Entamoeba invadens
GIHET

SEQ ID NO: 2859977 - protein, 6 aa, Entamoeba invadens
GIHETT

SEQ ID NO: 2859978 - protein, 4 aa, Entamoeba invadens
GIHS

SEQ ID NO: 2859979 - protein, 9 aa, Entamoeba invadens
GIIPKGTQY

SEQ ID NO: 2859980 - protein, 6 aa, Entamoeba invadens
GIKAKE

SEQ ID NO: 2859981 - protein, 9 aa, Entamoeba invadens
GIKATKSKS

SEQ ID NO: 2859982 - protein, 6 aa, Entamoeba invadens
GIKDES

SEQ ID NO: 2859983 - protein, 19 aa, Entamoeba invadens
GIKDTMKTATTCKDGEKLS

SEQ ID NO: 2859984 - protein, 5 aa, Entamoeba invadens
GIKEE

SEQ ID NO: 2859985 - protein, 6 aa, Entamoeba invadens
GIKEGE

SEQ ID NO: 2859986 - protein, 11 aa, Entamoeba invadens
GIKEKHKEGDF

SEQ ID NO: 2859987 - protein, 7 aa, Entamoeba invadens
GIKKPKL

SEQ ID NO: 2859988 - protein, 6 aa, Entamoeba invadens
GIKKRR

SEQ ID NO: 2859989 - protein, 5 aa, Entamoeba invadens
GIKKS

SEQ ID NO: 2859990 - protein, 26 aa, Entamoeba invadens
GIKNPQGAQQQQQNQMAQQQAMMPAM

SEQ ID NO: 2859991 - protein, 7 aa, Entamoeba invadens
GIKNSKA

SEQ ID NO: 2859992 - protein, 8 aa, Entamoeba invadens
GIKPTTQK

SEQ ID NO: 2859993 - protein, 13 aa, Entamoeba invadens
GIKSPLEGLDDDK

SEQ ID NO: 2859994 - protein, 12 aa, Entamoeba invadens
GILSGEKQRIGR

SEQ ID NO: 2859995 - protein, 13 aa, Entamoeba invadens
GIMDSTDNFGEKE

SEQ ID NO: 2859996 - protein, 7 aa, Entamoeba invadens
GINDGSV

SEQ ID NO: 2859997 - protein, 4 aa, Entamoeba invadens
GINE

SEQ ID NO: 2859998 - protein, 8 aa, Entamoeba invadens
GINGEPTC

SEQ ID NO: 2859999 - protein, 5 aa, Entamoeba invadens
GINMN

SEQ ID NO: 2860000 - protein, 5 aa, Entamoeba invadens
GINNR

SEQ ID NO: 2860001 - protein, 12 aa, Entamoeba invadens
GINPKSPDLDGN

SEQ ID NO: 2860002 - protein, 8 aa, Entamoeba invadens
GINQNTPF

SEQ ID NO: 2860003 - protein, 5 aa, Entamoeba invadens
GINSP

SEQ ID NO: 2860004 - protein, 6 aa, Entamoeba invadens
GINTTV

SEQ ID NO: 2860005 - protein, 4 aa, Entamoeba invadens
GIPC

SEQ ID NO: 2860006 - protein, 4 aa, Entamoeba invadens
GIPD

SEQ ID NO: 2860007 - protein, 7 aa, Entamoeba invadens
GIPDDLP

SEQ ID NO: 2860008 - protein, 6 aa, Entamoeba invadens
GIPDQA

SEQ ID NO: 2860009 - protein, 9 aa, Entamoeba invadens
GIPGDNDPV

SEQ ID NO: 2860010 - protein, 19 aa, Entamoeba invadens
GIPGIEEQEKLYQKSPTES

SEQ ID NO: 2860011 - protein, 11 aa, Entamoeba invadens
GIPNGKGNEWG

SEQ ID NO: 2860012 - protein, 9 aa, Entamoeba invadens
GIPNTADAD

SEQ ID NO: 2860013 - protein, 10 aa, Entamoeba invadens
GIPPAPRGVP

SEQ ID NO: 2860014 - protein, 6 aa, Entamoeba invadens
GIPPDQ

SEQ ID NO: 2860015 - protein, 13 aa, Entamoeba invadens
GIPPLKERESWTP

SEQ ID NO: 2860016 - protein, 14 aa, Entamoeba invadens
GIPPLKNADKWSRE

SEQ ID NO: 2860017 - protein, 13 aa, Entamoeba invadens
GIPPMKNRDKLEP

SEQ ID NO: 2860018 - protein, 7 aa, Entamoeba invadens
GIPPSIK

SEQ ID NO: 2860019 - protein, 7 aa, Entamoeba invadens
GIPSSSH

SEQ ID NO: 2860020 - protein, 8 aa, Entamoeba invadens
GIPTKPAN

SEQ ID NO: 2860021 - protein, 9 aa, Entamoeba invadens
GIPTQKDGA

SEQ ID NO: 2860022 - protein, 6 aa, Entamoeba invadens
GIPTSE

SEQ ID NO: 2860023 - protein, 4 aa, Entamoeba invadens
GIPY

SEQ ID NO: 2860024 - protein, 5 aa, Entamoeba invadens
GIQEP

SEQ ID NO: 2860025 - protein, 9 aa, Entamoeba invadens
GIQPSLANN

SEQ ID NO: 2860026 - protein, 5 aa, Entamoeba invadens
GIQSI

SEQ ID NO: 2860027 - protein, 9 aa, Entamoeba invadens
GIQSSGVGK

SEQ ID NO: 2860028 - protein, 11 aa, Entamoeba invadens
GIQTQTRQSIQ

SEQ ID NO: 2860029 - protein, 4 aa, Entamoeba invadens
GIRD

SEQ ID NO: 2860030 - protein, 13 aa, Entamoeba invadens
GIREDKEEKVENK

SEQ ID NO: 2860031 - protein, 7 aa, Entamoeba invadens
GIRGDTC

SEQ ID NO: 2860032 - protein, 6 aa, Entamoeba invadens
GIRGES

SEQ ID NO: 2860033 - protein, 11 aa, Entamoeba invadens
GIRHGEKTGTC

SEQ ID NO: 2860034 - protein, 10 aa, Entamoeba invadens
GIRKDDKKKY

SEQ ID NO: 2860035 - protein, 13 aa, Entamoeba invadens
GIRPSVPSPESKV

SEQ ID NO: 2860036 - protein, 9 aa, Entamoeba invadens
GISAEKEEV

SEQ ID NO: 2860037 - protein, 11 aa, Entamoeba invadens
GISDKTNSEMI

SEQ ID NO: 2860038 - protein, 10 aa, Entamoeba invadens
GISEDKERFD

SEQ ID NO: 2860039 - protein, 14 aa, Entamoeba invadens
GISEDSTRVKKNRA

SEQ ID NO: 2860040 - protein, 5 aa, Entamoeba invadens
GISEL

SEQ ID NO: 2860041 - protein, 4 aa, Entamoeba invadens
GISG

SEQ ID NO: 2860042 - protein, 43 aa, Entamoeba invadens
GISGDPEDADPFGIPPPDGSAKKVEKDPTKPKKVISKEEQNAQ

SEQ ID NO: 2860043 - protein, 10 aa, Entamoeba invadens
GISGDSSLQR

SEQ ID NO: 2860044 - protein, 4 aa, Entamoeba invadens
GISK

SEQ ID NO: 2860045 - protein, 5 aa, Entamoeba invadens
GISKD

SEQ ID NO: 2860046 - protein, 8 aa, Entamoeba invadens
GISKIKPE

SEQ ID NO: 2860047 - protein, 4 aa, Entamoeba invadens
GISN

SEQ ID NO: 2860048 - protein, 11 aa, Entamoeba invadens
GISNSSKKEPE

SEQ ID NO: 2860049 - protein, 15 aa, Entamoeba invadens
GISPQTPLSQLSTTD

SEQ ID NO: 2860050 - protein, 12 aa, Entamoeba invadens
GISPSISDVSQL

SEQ ID NO: 2860051 - protein, 6 aa, Entamoeba invadens
GISPVE

SEQ ID NO: 2860052 - protein, 8 aa, Entamoeba invadens
GISQAMSQ

SEQ ID NO: 2860053 - protein, 9 aa, Entamoeba invadens
GISQENNGA

SEQ ID NO: 2860054 - protein, 4 aa, Entamoeba invadens
GISS

SEQ ID NO: 2860055 - protein, 13 aa, Entamoeba invadens
GISSEDKENESKL

SEQ ID NO: 2860056 - protein, 11 aa, Entamoeba invadens
GISSKTAMRRY

SEQ ID NO: 2860057 - protein, 18 aa, Entamoeba invadens
GISSSTVGKNQRVKPNNV

SEQ ID NO: 2860058 - protein, 21 aa, Entamoeba invadens
GISTRATLETNVPNQEDISER

SEQ ID NO: 2860059 - protein, 5 aa, Entamoeba invadens
GISVP

SEQ ID NO: 2860060 - protein, 6 aa, Entamoeba invadens
GISYGK

SEQ ID NO: 2860061 - protein, 5 aa, Entamoeba invadens
GITAS

SEQ ID NO: 2860062 - protein, 11 aa, Entamoeba invadens
GITDATQTEIE

SEQ ID NO: 2860063 - protein, 11 aa, Entamoeba invadens
GITEDLRKESK

SEQ ID NO: 2860064 - protein, 13 aa, Entamoeba invadens
GITEGDVKKLEDA

SEQ ID NO: 2860065 - protein, 6 aa, Entamoeba invadens
GITETP

SEQ ID NO: 2860066 - protein, 12 aa, Entamoeba invadens
GITGEAEKTPCR

SEQ ID NO: 2860067 - protein, 10 aa, Entamoeba invadens
GITKGRRVAY

SEQ ID NO: 2860068 - protein, 14 aa, Entamoeba invadens
GITKNSKDSNGNTA

SEQ ID NO: 2860069 - protein, 7 aa, Entamoeba invadens
GITKPED

SEQ ID NO: 2860070 - protein, 15 aa, Entamoeba invadens
GITNNSNNFKSLREA

SEQ ID NO: 2860071 - protein, 15 aa, Entamoeba invadens
GITNPATIASQTPFE

SEQ ID NO: 2860072 - protein, 16 aa, Entamoeba invadens
GITPETPRDIWKATLK

SEQ ID NO: 2860073 - protein, 8 aa, Entamoeba invadens
GITQEERE

SEQ ID NO: 2860074 - protein, 5 aa, Entamoeba invadens
GITQN

SEQ ID NO: 2860075 - protein, 11 aa, Entamoeba invadens
GITQTEEPQTI

SEQ ID NO: 2860076 - protein, 6 aa, Entamoeba invadens
GITSPN

SEQ ID NO: 2860077 - protein, 14 aa, Entamoeba invadens
GITTTTDKAPTPIN

SEQ ID NO: 2860078 - protein, 6 aa, Entamoeba invadens
GIVNEG

SEQ ID NO: 2860079 - protein, 5 aa, Entamoeba invadens
GIVNP

SEQ ID NO: 2860080 - protein, 4 aa, Entamoeba invadens
GIVP

SEQ ID NO: 2860081 - protein, 4 aa, Entamoeba invadens
GIVQ

SEQ ID NO: 2860082 - protein, 9 aa, Entamoeba invadens
GIVQSSDKV

SEQ ID NO: 2860083 - protein, 5 aa, Entamoeba invadens
GIYGN

SEQ ID NO: 2860084 - protein, 23 aa, Entamoeba invadens
GIYKEKDSGKTVTSEDLFRRVTQ

SEQ ID NO: 2860085 - protein, 7 aa, Entamoeba invadens
GIYPSKH

SEQ ID NO: 2860086 - protein, 13 aa, Entamoeba invadens
GKADSEVKPISSK

SEQ ID NO: 2860087 - protein, 9 aa, Entamoeba invadens
GKADTVPAS

SEQ ID NO: 2860088 - protein, 7 aa, Entamoeba invadens
GKAGEGY

SEQ ID NO: 2860089 - protein, 9 aa, Entamoeba invadens
GKAGSDGVD

SEQ ID NO: 2860090 - protein, 7 aa, Entamoeba invadens
GKAHAQG

SEQ ID NO: 2860091 - protein, 8 aa, Entamoeba invadens
GKAIENDV

SEQ ID NO: 2860092 - protein, 7 aa, Entamoeba invadens
GKAITDQ

SEQ ID NO: 2860093 - protein, 4 aa, Entamoeba invadens
GKAK

SEQ ID NO: 2860094 - protein, 6 aa, Entamoeba invadens
GKAKEC

SEQ ID NO: 2860095 - protein, 10 aa, Entamoeba invadens
GKAKEDLEST

SEQ ID NO: 2860096 - protein, 9 aa, Entamoeba invadens
GKAKSKWYS

SEQ ID NO: 2860097 - protein, 8 aa, Entamoeba invadens
GKAKYPVD

SEQ ID NO: 2860098 - protein, 18 aa, Entamoeba invadens
GKALPTEYEPTTTETETS

SEQ ID NO: 2860099 - protein, 9 aa, Entamoeba invadens
GKANANWTG

SEQ ID NO: 2860100 - protein, 9 aa, Entamoeba invadens
GKANNTENF

SEQ ID NO: 2860101 - protein, 7 aa, Entamoeba invadens
GKAPSQV

SEQ ID NO: 2860102 - protein, 11 aa, Entamoeba invadens
GKAQTGSGKTI

SEQ ID NO: 2860103 - protein, 8 aa, Entamoeba invadens
GKASYTSN

SEQ ID NO: 2860104 - protein, 9 aa, Entamoeba invadens
GKATEEGKT

SEQ ID NO: 2860105 - protein, 9 aa, Entamoeba invadens
GKATGQMGN

SEQ ID NO: 2860106 - protein, 7 aa, Entamoeba invadens
GKATPEE

SEQ ID NO: 2860107 - protein, 9 aa, Entamoeba invadens
GKATYPGNI

SEQ ID NO: 2860108 - protein, 8 aa, Entamoeba invadens
GKCDKPEC

SEQ ID NO: 2860109 - protein, 8 aa, Entamoeba invadens
GKCDSDRY

SEQ ID NO: 2860110 - protein, 13 aa, Entamoeba invadens
GKCDTTNGHCTGC

SEQ ID NO: 2860111 - protein, 7 aa, Entamoeba invadens
GKCEKSQ

SEQ ID NO: 2860112 - protein, 8 aa, Entamoeba invadens
GKCGDSVA

SEQ ID NO: 2860113 - protein, 12 aa, Entamoeba invadens
GKCGTFDQERIA

SEQ ID NO: 2860114 - protein, 9 aa, Entamoeba invadens
GKCKDGEDL

SEQ ID NO: 2860115 - protein, 4 aa, Entamoeba invadens
GKCL

SEQ ID NO: 2860116 - protein, 8 aa, Entamoeba invadens
GKCNTETG

SEQ ID NO: 2860117 - protein, 13 aa, Entamoeba invadens
GKCSDDKKVNSVH

SEQ ID NO: 2860118 - protein, 9 aa, Entamoeba invadens
GKCSQSTRN

SEQ ID NO: 2860119 - protein, 9 aa, Entamoeba invadens
GKCTDDQLK

SEQ ID NO: 2860120 - protein, 9 aa, Entamoeba invadens
GKCVSSNEI

SEQ ID NO: 2860121 - protein, 6 aa, Entamoeba invadens
GKCWQE

SEQ ID NO: 2860122 - protein, 9 aa, Entamoeba invadens
GKDAATKKD

SEQ ID NO: 2860123 - protein, 31 aa, Entamoeba invadens
GKDAEDEEDNTKPKENQQGEDSAMKTKAGTV

SEQ ID NO: 2860124 - protein, 7 aa, Entamoeba invadens
GKDAEKR

SEQ ID NO: 2860125 - protein, 8 aa, Entamoeba invadens
GKDAQSIK

SEQ ID NO: 2860126 - protein, 7 aa, Entamoeba invadens
GKDATSV

SEQ ID NO: 2860127 - protein, 17 aa, Entamoeba invadens
GKDAVLESKESNTDSFQ

SEQ ID NO: 2860128 - protein, 4 aa, Entamoeba invadens
GKDD

SEQ ID NO: 2860129 - protein, 10 aa, Entamoeba invadens
GKDDDLGNAE

SEQ ID NO: 2860130 - protein, 8 aa, Entamoeba invadens
GKDDDLKG

SEQ ID NO: 2860131 - protein, 19 aa, Entamoeba invadens
GKDDDQSTITVDSDEWEEV

SEQ ID NO: 2860132 - protein, 9 aa, Entamoeba invadens
GKDDETGQE

SEQ ID NO: 2860133 - protein, 9 aa, Entamoeba invadens
GKDDKIGTT

SEQ ID NO: 2860134 - protein, 9 aa, Entamoeba invadens
GKDDKTIYQ

SEQ ID NO: 2860135 - protein, 9 aa, Entamoeba invadens
GKDEENAGT

SEQ ID NO: 2860136 - protein, 10 aa, Entamoeba invadens
GKDEGEQKKV

SEQ ID NO: 2860137 - protein, 7 aa, Entamoeba invadens
GKDEGRL

SEQ ID NO: 2860138 - protein, 5 aa, Entamoeba invadens
GKDEN

SEQ ID NO: 2860139 - protein, 12 aa, Entamoeba invadens
GKDEQKYTGTPF

SEQ ID NO: 2860140 - protein, 8 aa, Entamoeba invadens
GKDERDGL

SEQ ID NO: 2860141 - protein, 6 aa, Entamoeba invadens
GKDEYI

SEQ ID NO: 2860142 - protein, 8 aa, Entamoeba invadens
GKDFPDVE

SEQ ID NO: 2860143 - protein, 8 aa, Entamoeba invadens
GKDGKPVD

SEQ ID NO: 2860144 - protein, 8 aa, Entamoeba invadens
GKDGLGIT

SEQ ID NO: 2860145 - protein, 9 aa, Entamoeba invadens
GKDGNIDRK

SEQ ID NO: 2860146 - protein, 4 aa, Entamoeba invadens
GKDI

SEQ ID NO: 2860147 - protein, 7 aa, Entamoeba invadens
GKDIAEG

SEQ ID NO: 2860148 - protein, 33 aa, Entamoeba invadens
GKDIEDSANCSFTQKRKNGIKHRDHTKKFSFQK

SEQ ID NO: 2860149 - protein, 8 aa, Entamoeba invadens
GKDIGKGI

SEQ ID NO: 2860150 - protein, 6 aa, Entamoeba invadens
GKDISK

SEQ ID NO: 2860151 - protein, 23 aa, Entamoeba invadens
GKDKPKSPRAKSPRTAQSDDLEK

SEQ ID NO: 2860152 - protein, 7 aa, Entamoeba invadens
GKDLKDA

SEQ ID NO: 2860153 - protein, 6 aa, Entamoeba invadens
GKDLKE

SEQ ID NO: 2860154 - protein, 13 aa, Entamoeba invadens
GKDLNEQIKKMDE

SEQ ID NO: 2860155 - protein, 8 aa, Entamoeba invadens
GKDNVKNR

SEQ ID NO: 2860156 - protein, 8 aa, Entamoeba invadens
GKDPHRIN

SEQ ID NO: 2860157 - protein, 9 aa, Entamoeba invadens
GKDPKKMGK

SEQ ID NO: 2860158 - protein, 4 aa, Entamoeba invadens
GKDQ

SEQ ID NO: 2860159 - protein, 6 aa, Entamoeba invadens
GKDRNP

SEQ ID NO: 2860160 - protein, 9 aa, Entamoeba invadens
GKDRTEQTA

SEQ ID NO: 2860161 - protein, 7 aa, Entamoeba invadens
GKDRTNV

SEQ ID NO: 2860162 - protein, 31 aa, Entamoeba invadens
GKDSEGGEEANTTNVNNTGDDSSIKDKAGSV

SEQ ID NO: 2860163 - protein, 14 aa, Entamoeba invadens
GKDSFPSNTLVHRS

SEQ ID NO: 2860164 - protein, 11 aa, Entamoeba invadens
GKDSNGESTEL

SEQ ID NO: 2860165 - protein, 21 aa, Entamoeba invadens
GKDTMKPTPDSMVEYLKKHHQ

SEQ ID NO: 2860166 - protein, 15 aa, Entamoeba invadens
GKDTQPKMFTPSRRR

SEQ ID NO: 2860167 - protein, 18 aa, Entamoeba invadens
GKDTVKPCQEGICEYLKK

SEQ ID NO: 2860168 - protein, 10 aa, Entamoeba invadens
GKDVKSAEGM

SEQ ID NO: 2860169 - protein, 4 aa, Entamoeba invadens
GKDY

SEQ ID NO: 2860170 - protein, 9 aa, Entamoeba invadens
GKDYDPEGF

SEQ ID NO: 2860171 - protein, 7 aa, Entamoeba invadens
GKDYGTN

SEQ ID NO: 2860172 - protein, 8 aa, Entamoeba invadens
GKEAAEYV

SEQ ID NO: 2860173 - protein, 8 aa, Entamoeba invadens
GKEAERKI

SEQ ID NO: 2860174 - protein, 5 aa, Entamoeba invadens
GKEAG

SEQ ID NO: 2860175 - protein, 5 aa, Entamoeba invadens
GKEAH

SEQ ID NO: 2860176 - protein, 8 aa, Entamoeba invadens
GKEATKVS

SEQ ID NO: 2860177 - protein, 7 aa, Entamoeba invadens
GKEDIER

SEQ ID NO: 2860178 - protein, 15 aa, Entamoeba invadens
GKEDKGKSTPPIITK

SEQ ID NO: 2860179 - protein, 11 aa, Entamoeba invadens
GKEDPDFASNY

SEQ ID NO: 2860180 - protein, 7 aa, Entamoeba invadens
GKEDSIA

SEQ ID NO: 2860181 - protein, 4 aa, Entamoeba invadens
GKEE

SEQ ID NO: 2860182 - protein, 12 aa, Entamoeba invadens
GKEEEASKALKA

SEQ ID NO: 2860183 - protein, 22 aa, Entamoeba invadens
GKEEEKKKEKEVKRFVVFRLEK

SEQ ID NO: 2860184 - protein, 13 aa, Entamoeba invadens
GKEEEVPLTGNTT

SEQ ID NO: 2860185 - protein, 6 aa, Entamoeba invadens
GKEEGT

SEQ ID NO: 2860186 - protein, 10 aa, Entamoeba invadens
GKEEKDGKTE

SEQ ID NO: 2860187 - protein, 8 aa, Entamoeba invadens
GKEEKGEF

SEQ ID NO: 2860188 - protein, 5 aa, Entamoeba invadens
GKEEQ

SEQ ID NO: 2860189 - protein, 8 aa, Entamoeba invadens
GKEEQEKI

SEQ ID NO: 2860190 - protein, 12 aa, Entamoeba invadens
GKEERDKWEGQL

SEQ ID NO: 2860191 - protein, 8 aa, Entamoeba invadens
GKEFGGKP

SEQ ID NO: 2860192 - protein, 9 aa, Entamoeba invadens
GKEFPPGKH

SEQ ID NO: 2860193 - protein, 23 aa, Entamoeba invadens
GKEGRELEDKQQEKLHADTQDRY

SEQ ID NO: 2860194 - protein, 9 aa, Entamoeba invadens
GKEGVSIGD

SEQ ID NO: 2860195 - protein, 6 aa, Entamoeba invadens
GKEHQP

SEQ ID NO: 2860196 - protein, 5 aa, Entamoeba invadens
GKEID

SEQ ID NO: 2860197 - protein, 10 aa, Entamoeba invadens
GKEIEGASEG

SEQ ID NO: 2860198 - protein, 11 aa, Entamoeba invadens
GKEKEFGNTQN

SEQ ID NO: 2860199 - protein, 9 aa, Entamoeba invadens
GKEKEKTDF

SEQ ID NO: 2860200 - protein, 11 aa, Entamoeba invadens
GKEKESLGMTS

SEQ ID NO: 2860201 - protein, 8 aa, Entamoeba invadens
GKEKGVER

SEQ ID NO: 2860202 - protein, 5 aa, Entamoeba invadens
GKEKI

SEQ ID NO: 2860203 - protein, 9 aa, Entamoeba invadens
GKEKKTLAD

SEQ ID NO: 2860204 - protein, 17 aa, Entamoeba invadens
GKEKNGIKAKTLSRRFS

SEQ ID NO: 2860205 - protein, 7 aa, Entamoeba invadens
GKEKNGK

SEQ ID NO: 2860206 - protein, 14 aa, Entamoeba invadens
GKEKPNEVKEEPEI

SEQ ID NO: 2860207 - protein, 6 aa, Entamoeba invadens
GKEKQL

SEQ ID NO: 2860208 - protein, 14 aa, Entamoeba invadens
GKEKTQKETLENAH

SEQ ID NO: 2860209 - protein, 6 aa, Entamoeba invadens
GKEKVG

SEQ ID NO: 2860210 - protein, 14 aa, Entamoeba invadens
GKEKYDKCESPKLV

SEQ ID NO: 2860211 - protein, 6 aa, Entamoeba invadens
GKELDA

SEQ ID NO: 2860212 - protein, 7 aa, Entamoeba invadens
GKELKGE

SEQ ID NO: 2860213 - protein, 5 aa, Entamoeba invadens
GKENI

SEQ ID NO: 2860214 - protein, 15 aa, Entamoeba invadens
GKENIRMDNEKNQLR

SEQ ID NO: 2860215 - protein, 6 aa, Entamoeba invadens
GKENSF

SEQ ID NO: 2860216 - protein, 4 aa, Entamoeba invadens
GKEP

SEQ ID NO: 2860217 - protein, 8 aa, Entamoeba invadens
GKEPTREF

SEQ ID NO: 2860218 - protein, 8 aa, Entamoeba invadens
GKERAKEL

SEQ ID NO: 2860219 - protein, 25 aa, Entamoeba invadens
GKEREGDDQVQNKKVENFKEGETVR

SEQ ID NO: 2860220 - protein, 6 aa, Entamoeba invadens
GKERMG

SEQ ID NO: 2860221 - protein, 6 aa, Entamoeba invadens
GKERQY

SEQ ID NO: 2860222 - protein, 6 aa, Entamoeba invadens
GKERTF

SEQ ID NO: 2860223 - protein, 8 aa, Entamoeba invadens
GKESAGVH

SEQ ID NO: 2860224 - protein, 15 aa, Entamoeba invadens
GKESFGSTATSYLND

SEQ ID NO: 2860225 - protein, 10 aa, Entamoeba invadens
GKESKRPSSL

SEQ ID NO: 2860226 - protein, 5 aa, Entamoeba invadens
GKESL

SEQ ID NO: 2860227 - protein, 13 aa, Entamoeba invadens
GKESVGENGASYY

SEQ ID NO: 2860228 - protein, 9 aa, Entamoeba invadens
GKESYTSSS

SEQ ID NO: 2860229 - protein, 4 aa, Entamoeba invadens
GKET

SEQ ID NO: 2860230 - protein, 7 aa, Entamoeba invadens
GKETADQ

SEQ ID NO: 2860231 - protein, 8 aa, Entamoeba invadens
GKETEGFK

SEQ ID NO: 2860232 - protein, 6 aa, Entamoeba invadens
GKETFS

SEQ ID NO: 2860233 - protein, 5 aa, Entamoeba invadens
GKETH

SEQ ID NO: 2860234 - protein, 9 aa, Entamoeba invadens
GKETITSEV

SEQ ID NO: 2860235 - protein, 7 aa, Entamoeba invadens
GKEVEQI

SEQ ID NO: 2860236 - protein, 13 aa, Entamoeba invadens
GKEVGRHKNDHGY

SEQ ID NO: 2860237 - protein, 14 aa, Entamoeba invadens
GKEVNDNKRKYESE

SEQ ID NO: 2860238 - protein, 13 aa, Entamoeba invadens
GKEVPKYSHLLIQ

SEQ ID NO: 2860239 - protein, 14 aa, Entamoeba invadens
GKEVTKKAKHTKAV

SEQ ID NO: 2860240 - protein, 7 aa, Entamoeba invadens
GKEWEET

SEQ ID NO: 2860241 - protein, 5 aa, Entamoeba invadens
GKEWN

SEQ ID NO: 2860242 - protein, 4 aa, Entamoeba invadens
GKEY

SEQ ID NO: 2860243 - protein, 5 aa, Entamoeba invadens
GKEYE

SEQ ID NO: 2860244 - protein, 9 aa, Entamoeba invadens
GKEYGRQNI

SEQ ID NO: 2860245 - protein, 8 aa, Entamoeba invadens
GKFASNGK

SEQ ID NO: 2860246 - protein, 6 aa, Entamoeba invadens
GKFDNT

SEQ ID NO: 2860247 - protein, 8 aa, Entamoeba invadens
GKFDPDKL

SEQ ID NO: 2860248 - protein, 7 aa, Entamoeba invadens
GKFGNGK

SEQ ID NO: 2860249 - protein, 7 aa, Entamoeba invadens
GKFNPKK

SEQ ID NO: 2860250 - protein, 6 aa, Entamoeba invadens
GKFPPF

SEQ ID NO: 2860251 - protein, 11 aa, Entamoeba invadens
GKFPSKTIQQI

SEQ ID NO: 2860252 - protein, 7 aa, Entamoeba invadens
GKFSDTR

SEQ ID NO: 2860253 - protein, 8 aa, Entamoeba invadens
GKFSHSDR

SEQ ID NO: 2860254 - protein, 7 aa, Entamoeba invadens
GKFTEDQ

SEQ ID NO: 2860255 - protein, 13 aa, Entamoeba invadens
GKFTGGKPDTDLG

SEQ ID NO: 2860256 - protein, 9 aa, Entamoeba invadens
GKGAAEAAK

SEQ ID NO: 2860257 - protein, 8 aa, Entamoeba invadens
GKGAPESF

SEQ ID NO: 2860258 - protein, 11 aa, Entamoeba invadens
GKGCSFGTADS

SEQ ID NO: 2860259 - protein, 8 aa, Entamoeba invadens
GKGDGTIS

SEQ ID NO: 2860260 - protein, 6 aa, Entamoeba invadens
GKGDIK

SEQ ID NO: 2860261 - protein, 23 aa, Entamoeba invadens
GKGDSKSDSKSPDKSSKEGTQNT

SEQ ID NO: 2860262 - protein, 4 aa, Entamoeba invadens
GKGE

SEQ ID NO: 2860263 - protein, 6 aa, Entamoeba invadens
GKGENT

SEQ ID NO: 2860264 - protein, 65 aa, Entamoeba invadens
GKGESEEEKQEKAEKLRKEKEEAERLAKEQAEKERLERMKEQDRKREEQKKKEEEDRKRREEEYF

SEQ ID NO: 2860265 - protein, 8 aa, Entamoeba invadens
GKGEYGEG

SEQ ID NO: 2860266 - protein, 13 aa, Entamoeba invadens
GKGGDIQKFDNSK

SEQ ID NO: 2860267 - protein, 5 aa, Entamoeba invadens
GKGGF

SEQ ID NO: 2860268 - protein, 6 aa, Entamoeba invadens
GKGGFG

SEQ ID NO: 2860269 - protein, 12 aa, Entamoeba invadens
GKGGVGKSTFTT

SEQ ID NO: 2860270 - protein, 13 aa, Entamoeba invadens
GKGGVGKSTVASS

SEQ ID NO: 2860271 - protein, 7 aa, Entamoeba invadens
GKGHSES

SEQ ID NO: 2860272 - protein, 14 aa, Entamoeba invadens
GKGIKTEKNENKSQ

SEQ ID NO: 2860273 - protein, 7 aa, Entamoeba invadens
GKGIPRN

SEQ ID NO: 2860274 - protein, 16 aa, Entamoeba invadens
GKGIQNGKHFEQPNSP

SEQ ID NO: 2860275 - protein, 11 aa, Entamoeba invadens
GKGKEEKRGKF

SEQ ID NO: 2860276 - protein, 8 aa, Entamoeba invadens
GKGKTGST

SEQ ID NO: 2860277 - protein, 8 aa, Entamoeba invadens
GKGKYGTV

SEQ ID NO: 2860278 - protein, 5 aa, Entamoeba invadens
GKGLF

SEQ ID NO: 2860279 - protein, 5 aa, Entamoeba invadens
GKGLT

SEQ ID NO: 2860280 - protein, 5 aa, Entamoeba invadens
GKGMG

SEQ ID NO: 2860281 - protein, 16 aa, Entamoeba invadens
GKGMNQTDNDVPLSED

SEQ ID NO: 2860282 - protein, 6 aa, Entamoeba invadens
GKGNIG

SEQ ID NO: 2860283 - protein, 8 aa, Entamoeba invadens
GKGPNTPR

SEQ ID NO: 2860284 - protein, 24 aa, Entamoeba invadens
GKGRKEQNTKMTMEERKQQASERL

SEQ ID NO: 2860285 - protein, 10 aa, Entamoeba invadens
GKGRVDGKVN

SEQ ID NO: 2860286 - protein, 45 aa, Entamoeba invadens
GKGSDEQTQQRQNEKAHRKQDKKRKKEVIKTDEKADYTTQDPRTE

SEQ ID NO: 2860287 - protein, 6 aa, Entamoeba invadens
GKGSFG

SEQ ID NO: 2860288 - protein, 7 aa, Entamoeba invadens
GKGSFKQ

SEQ ID NO: 2860289 - protein, 33 aa, Entamoeba invadens
GKGSKGAKGSKGGKRIRTKPGQQDALKGITKPA

SEQ ID NO: 2860290 - protein, 6 aa, Entamoeba invadens
GKGSKM

SEQ ID NO: 2860291 - protein, 18 aa, Entamoeba invadens
GKGSKQFVNGEVSKPTVT

SEQ ID NO: 2860292 - protein, 9 aa, Entamoeba invadens
GKGTDPSDG

SEQ ID NO: 2860293 - protein, 5 aa, Entamoeba invadens
GKGTF

SEQ ID NO: 2860294 - protein, 18 aa, Entamoeba invadens
GKGTFDGCKNLNHLDLLK

SEQ ID NO: 2860295 - protein, 8 aa, Entamoeba invadens
GKGTQSNF

SEQ ID NO: 2860296 - protein, 6 aa, Entamoeba invadens
GKGTSV

SEQ ID NO: 2860297 - protein, 5 aa, Entamoeba invadens
GKGTY

SEQ ID NO: 2860298 - protein, 7 aa, Entamoeba invadens
GKGVCKT

SEQ ID NO: 2860299 - protein, 8 aa, Entamoeba invadens
GKGVGGLT

SEQ ID NO: 2860300 - protein, 5 aa, Entamoeba invadens
GKGVP

SEQ ID NO: 2860301 - protein, 8 aa, Entamoeba invadens
GKGVSVDK

SEQ ID NO: 2860302 - protein, 12 aa, Entamoeba invadens
GKHDDDEETKAC

SEQ ID NO: 2860303 - protein, 5 aa, Entamoeba invadens
GKHEP

SEQ ID NO: 2860304 - protein, 6 aa, Entamoeba invadens
GKHETV

SEQ ID NO: 2860305 - protein, 6 aa, Entamoeba invadens
GKHGRF

SEQ ID NO: 2860306 - protein, 7 aa, Entamoeba invadens
GKHIARD

SEQ ID NO: 2860307 - protein, 19 aa, Entamoeba invadens
GKHLGDEKDVMTCKLSLGI

SEQ ID NO: 2860308 - protein, 14 aa, Entamoeba invadens
GKHMKHQKAKKESQ

SEQ ID NO: 2860309 - protein, 5 aa, Entamoeba invadens
GKHMT

SEQ ID NO: 2860310 - protein, 9 aa, Entamoeba invadens
GKHQQDGIP

SEQ ID NO: 2860311 - protein, 5 aa, Entamoeba invadens
GKHRG

SEQ ID NO: 2860312 - protein, 4 aa, Entamoeba invadens
GKHT

SEQ ID NO: 2860313 - protein, 7 aa, Entamoeba invadens
GKHTKYG

SEQ ID NO: 2860314 - protein, 9 aa, Entamoeba invadens
GKIASDDDK

SEQ ID NO: 2860315 - protein, 5 aa, Entamoeba invadens
GKIDK

SEQ ID NO: 2860316 - protein, 8 aa, Entamoeba invadens
GKIDTKDF

SEQ ID NO: 2860317 - protein, 6 aa, Entamoeba invadens
GKIEEN

SEQ ID NO: 2860318 - protein, 12 aa, Entamoeba invadens
GKIGRQSKKEKI

SEQ ID NO: 2860319 - protein, 21 aa, Entamoeba invadens
GKIKEGAYKESPLQNKSDAVK

SEQ ID NO: 2860320 - protein, 7 aa, Entamoeba invadens
GKIKENF

SEQ ID NO: 2860321 - protein, 6 aa, Entamoeba invadens
GKIKTN

SEQ ID NO: 2860322 - protein, 6 aa, Entamoeba invadens
GKIMSQ

SEQ ID NO: 2860323 - protein, 7 aa, Entamoeba invadens
GKINSTD

SEQ ID NO: 2860324 - protein, 7 aa, Entamoeba invadens
GKIPAGT

SEQ ID NO: 2860325 - protein, 5 aa, Entamoeba invadens
GKIPD

SEQ ID NO: 2860326 - protein, 5 aa, Entamoeba invadens
GKIPP

SEQ ID NO: 2860327 - protein, 14 aa, Entamoeba invadens
GKIQGDIQPTAGEV

SEQ ID NO: 2860328 - protein, 6 aa, Entamoeba invadens
GKIQSA

SEQ ID NO: 2860329 - protein, 8 aa, Entamoeba invadens
GKIRGQNE

SEQ ID NO: 2860330 - protein, 6 aa, Entamoeba invadens
GKISNL

SEQ ID NO: 2860331 - protein, 5 aa, Entamoeba invadens
GKIST

SEQ ID NO: 2860332 - protein, 12 aa, Entamoeba invadens
GKISYEKDVPTY

SEQ ID NO: 2860333 - protein, 19 aa, Entamoeba invadens
GKITKDDKCDTSTNACGNK

SEQ ID NO: 2860334 - protein, 9 aa, Entamoeba invadens
GKITKESGE

SEQ ID NO: 2860335 - protein, 8 aa, Entamoeba invadens
GKITSEQK

SEQ ID NO: 2860336 - protein, 4 aa, Entamoeba invadens
GKIV

SEQ ID NO: 2860337 - protein, 9 aa, Entamoeba invadens
GKKAGINHK

SEQ ID NO: 2860338 - protein, 7 aa, Entamoeba invadens
GKKANTL

SEQ ID NO: 2860339 - protein, 8 aa, Entamoeba invadens
GKKASTYL

SEQ ID NO: 2860340 - protein, 9 aa, Entamoeba invadens
GKKATKVSL

SEQ ID NO: 2860341 - protein, 11 aa, Entamoeba invadens
GKKDSSETDKL

SEQ ID NO: 2860342 - protein, 9 aa, Entamoeba invadens
GKKDTDDGV

SEQ ID NO: 2860343 - protein, 22 aa, Entamoeba invadens
GKKEEERTYKVKGDDDDWGNDD

SEQ ID NO: 2860344 - protein, 10 aa, Entamoeba invadens
GKKEEKKEEV

SEQ ID NO: 2860345 - protein, 8 aa, Entamoeba invadens
GKKEEYTK

SEQ ID NO: 2860346 - protein, 12 aa, Entamoeba invadens
GKKEGNKGKFSP

SEQ ID NO: 2860347 - protein, 10 aa, Entamoeba invadens
GKKERKLDPD

SEQ ID NO: 2860348 - protein, 9 aa, Entamoeba invadens
GKKETTSVK

SEQ ID NO: 2860349 - protein, 29 aa, Entamoeba invadens
GKKGEFIQEQEEQKMEEEENTQTKEVPVD

SEQ ID NO: 2860350 - protein, 9 aa, Entamoeba invadens
GKKGETKGN

SEQ ID NO: 2860351 - protein, 5 aa, Entamoeba invadens
GKKGK

SEQ ID NO: 2860352 - protein, 5 aa, Entamoeba invadens
GKKIG

SEQ ID NO: 2860353 - protein, 10 aa, Entamoeba invadens
GKKIQTTKQV

SEQ ID NO: 2860354 - protein, 9 aa, Entamoeba invadens
GKKKEDATK

SEQ ID NO: 2860355 - protein, 13 aa, Entamoeba invadens
GKKKEIEKRDVEV

SEQ ID NO: 2860356 - protein, 10 aa, Entamoeba invadens
GKKKPKRKEL

SEQ ID NO: 2860357 - protein, 14 aa, Entamoeba invadens
GKKMKTKIAPPSIN

SEQ ID NO: 2860358 - protein, 13 aa, Entamoeba invadens
GKKMRGDRSKKML

SEQ ID NO: 2860359 - protein, 10 aa, Entamoeba invadens
GKKNEKTLTD

SEQ ID NO: 2860360 - protein, 9 aa, Entamoeba invadens
GKKNKTLKK

SEQ ID NO: 2860361 - protein, 8 aa, Entamoeba invadens
GKKPEEEI

SEQ ID NO: 2860362 - protein, 16 aa, Entamoeba invadens
GKKPKKGRSFSVPDET

SEQ ID NO: 2860363 - protein, 18 aa, Entamoeba invadens
GKKPSDEENGEESDQPVK

SEQ ID NO: 2860364 - protein, 8 aa, Entamoeba invadens
GKKPTPKE

SEQ ID NO: 2860365 - protein, 7 aa, Entamoeba invadens
GKKPVDA

SEQ ID NO: 2860366 - protein, 6 aa, Entamoeba invadens
GKKPVT

SEQ ID NO: 2860367 - protein, 6 aa, Entamoeba invadens
GKKQEA

SEQ ID NO: 2860368 - protein, 12 aa, Entamoeba invadens
GKKQSKDDLGRA

SEQ ID NO: 2860369 - protein, 18 aa, Entamoeba invadens
GKKRKRSSKVDDEDDDEW

SEQ ID NO: 2860370 - protein, 8 aa, Entamoeba invadens
GKKRPSCN

SEQ ID NO: 2860371 - protein, 18 aa, Entamoeba invadens
GKKRRQGKSEFAQNRAEY

SEQ ID NO: 2860372 - protein, 8 aa, Entamoeba invadens
GKKSEEDI

SEQ ID NO: 2860373 - protein, 10 aa, Entamoeba invadens
GKKSHPPANY

SEQ ID NO: 2860374 - protein, 11 aa, Entamoeba invadens
GKKSKGETFPG

SEQ ID NO: 2860375 - protein, 8 aa, Entamoeba invadens
GKKSQAVS

SEQ ID NO: 2860376 - protein, 8 aa, Entamoeba invadens
GKKSSRDA

SEQ ID NO: 2860377 - protein, 7 aa, Entamoeba invadens
GKKSVNY

SEQ ID NO: 2860378 - protein, 31 aa, Entamoeba invadens
GKKTCQRCAENPEEGIDTKNRRSNENSVGGS

SEQ ID NO: 2860379 - protein, 33 aa, Entamoeba invadens
GKKTDRLSDEFQKPKTRNSDVKKPKKSEKKRNC

SEQ ID NO: 2860380 - protein, 11 aa, Entamoeba invadens
GKKTGTLRRDE

SEQ ID NO: 2860381 - protein, 5 aa, Entamoeba invadens
GKKTK

SEQ ID NO: 2860382 - protein, 18 aa, Entamoeba invadens
GKKTQEKKQQTTEDKEIQ

SEQ ID NO: 2860383 - protein, 11 aa, Entamoeba invadens
GKKTQKKSYID

SEQ ID NO: 2860384 - protein, 7 aa, Entamoeba invadens
GKKTQLD

SEQ ID NO: 2860385 - protein, 13 aa, Entamoeba invadens
GKKTTAYNHSNTA

SEQ ID NO: 2860386 - protein, 8 aa, Entamoeba invadens
GKKTTKYY

SEQ ID NO: 2860387 - protein, 4 aa, Entamoeba invadens
GKKV

SEQ ID NO: 2860388 - protein, 11 aa, Entamoeba invadens
GKKVKKVNGEK

SEQ ID NO: 2860389 - protein, 9 aa, Entamoeba invadens
GKKVSTRVS

SEQ ID NO: 2860390 - protein, 12 aa, Entamoeba invadens
GKKYERSEKSFE

SEQ ID NO: 2860391 - protein, 8 aa, Entamoeba invadens
GKKYKTKV

SEQ ID NO: 2860392 - protein, 6 aa, Entamoeba invadens
GKKYRD

SEQ ID NO: 2860393 - protein, 8 aa, Entamoeba invadens
GKKYSEKS

SEQ ID NO: 2860394 - protein, 8 aa, Entamoeba invadens
GKLAPDAI

SEQ ID NO: 2860395 - protein, 14 aa, Entamoeba invadens
GKLDEDDEDKVEED

SEQ ID NO: 2860396 - protein, 5 aa, Entamoeba invadens
GKLDH

SEQ ID NO: 2860397 - protein, 13 aa, Entamoeba invadens
GKLENDNKQNEFE

SEQ ID NO: 2860398 - protein, 13 aa, Entamoeba invadens
GKLESSAKLNAEL

SEQ ID NO: 2860399 - protein, 8 aa, Entamoeba invadens
GKLEVNNE

SEQ ID NO: 2860400 - protein, 7 aa, Entamoeba invadens
GKLGKRE

SEQ ID NO: 2860401 - protein, 10 aa, Entamoeba invadens
GKLGYPHKGF

SEQ ID NO: 2860402 - protein, 9 aa, Entamoeba invadens
GKLKADSIE

SEQ ID NO: 2860403 - protein, 10 aa, Entamoeba invadens
GKLKGNEKQF

SEQ ID NO: 2860404 - protein, 8 aa, Entamoeba invadens
GKLKYPDE

SEQ ID NO: 2860405 - protein, 6 aa, Entamoeba invadens
GKLNEH

SEQ ID NO: 2860406 - protein, 7 aa, Entamoeba invadens
GKLNPKK

SEQ ID NO: 2860407 - protein, 11 aa, Entamoeba invadens
GKLNTKSTPEL

SEQ ID NO: 2860408 - protein, 15 aa, Entamoeba invadens
GKLPQKEKRKTETLK

SEQ ID NO: 2860409 - protein, 7 aa, Entamoeba invadens
GKLRDGK

SEQ ID NO: 2860410 - protein, 12 aa, Entamoeba invadens
GKLREKANGKQK

SEQ ID NO: 2860411 - protein, 9 aa, Entamoeba invadens
GKLRSKTAE

SEQ ID NO: 2860412 - protein, 10 aa, Entamoeba invadens
GKLSAKKSTL

SEQ ID NO: 2860413 - protein, 8 aa, Entamoeba invadens
GKLSEGDM

SEQ ID NO: 2860414 - protein, 7 aa, Entamoeba invadens
GKLSGEL

SEQ ID NO: 2860415 - protein, 5 aa, Entamoeba invadens
GKLTD

SEQ ID NO: 2860416 - protein, 8 aa, Entamoeba invadens
GKLTQSYA

SEQ ID NO: 2860417 - protein, 5 aa, Entamoeba invadens
GKMDD

SEQ ID NO: 2860418 - protein, 9 aa, Entamoeba invadens
GKMDSRANN

SEQ ID NO: 2860419 - protein, 9 aa, Entamoeba invadens
GKMDTNGNY

SEQ ID NO: 2860420 - protein, 7 aa, Entamoeba invadens
GKMENDC

SEQ ID NO: 2860421 - protein, 8 aa, Entamoeba invadens
GKMGKPAI

SEQ ID NO: 2860422 - protein, 6 aa, Entamoeba invadens
GKMGSQ

SEQ ID NO: 2860423 - protein, 9 aa, Entamoeba invadens
GKMKQKHRE

SEQ ID NO: 2860424 - protein, 5 aa, Entamoeba invadens
GKMLN

SEQ ID NO: 2860425 - protein, 5 aa, Entamoeba invadens
GKMQD

SEQ ID NO: 2860426 - protein, 7 aa, Entamoeba invadens
GKMSQQK

SEQ ID NO: 2860427 - protein, 8 aa, Entamoeba invadens
GKMTESDS

SEQ ID NO: 2860428 - protein, 11 aa, Entamoeba invadens
GKMTSEKAKKF

SEQ ID NO: 2860429 - protein, 17 aa, Entamoeba invadens
GKMTTSSKELVSDTNIS

SEQ ID NO: 2860430 - protein, 6 aa, Entamoeba invadens
GKNADG

SEQ ID NO: 2860431 - protein, 6 aa, Entamoeba invadens
GKNAEK

SEQ ID NO: 2860432 - protein, 9 aa, Entamoeba invadens
GKNAGTTTL

SEQ ID NO: 2860433 - protein, 8 aa, Entamoeba invadens
GKNATNEI

SEQ ID NO: 2860434 - protein, 6 aa, Entamoeba invadens
GKNATY

SEQ ID NO: 2860435 - protein, 4 aa, Entamoeba invadens
GKNC

SEQ ID NO: 2860436 - protein, 13 aa, Entamoeba invadens
GKNCEIAANLLFE

SEQ ID NO: 2860437 - protein, 4 aa, Entamoeba invadens
GKND

SEQ ID NO: 2860438 - protein, 7 aa, Entamoeba invadens
GKNDENG

SEQ ID NO: 2860439 - protein, 7 aa, Entamoeba invadens
GKNDIYD

SEQ ID NO: 2860440 - protein, 5 aa, Entamoeba invadens
GKNDQ

SEQ ID NO: 2860441 - protein, 16 aa, Entamoeba invadens
GKNDTGNTKKEKPEVQ

SEQ ID NO: 2860442 - protein, 20 aa, Entamoeba invadens
GKNEEDLKYTEEKNDKEKAF

SEQ ID NO: 2860443 - protein, 8 aa, Entamoeba invadens
GKNEEGQT

SEQ ID NO: 2860444 - protein, 10 aa, Entamoeba invadens
GKNEEKRVES

SEQ ID NO: 2860445 - protein, 9 aa, Entamoeba invadens
GKNEEYRRV

SEQ ID NO: 2860446 - protein, 9 aa, Entamoeba invadens
GKNEISPTQ

SEQ ID NO: 2860447 - protein, 7 aa, Entamoeba invadens
GKNEREQ

SEQ ID NO: 2860448 - protein, 8 aa, Entamoeba invadens
GKNESTQL

SEQ ID NO: 2860449 - protein, 8 aa, Entamoeba invadens
GKNEVTQI

SEQ ID NO: 2860450 - protein, 16 aa, Entamoeba invadens
GKNGAGNNWGKGHYTD

SEQ ID NO: 2860451 - protein, 14 aa, Entamoeba invadens
GKNGERSNPLDETD

SEQ ID NO: 2860452 - protein, 10 aa, Entamoeba invadens
GKNGESAMKE

SEQ ID NO: 2860453 - protein, 7 aa, Entamoeba invadens
GKNGIGK

SEQ ID NO: 2860454 - protein, 9 aa, Entamoeba invadens
GKNGKKDVK

SEQ ID NO: 2860455 - protein, 7 aa, Entamoeba invadens
GKNGPFD

SEQ ID NO: 2860456 - protein, 8 aa, Entamoeba invadens
GKNGVSYK

SEQ ID NO: 2860457 - protein, 4 aa, Entamoeba invadens
GKNI

SEQ ID NO: 2860458 - protein, 6 aa, Entamoeba invadens
GKNIGW

SEQ ID NO: 2860459 - protein, 5 aa, Entamoeba invadens
GKNKN

SEQ ID NO: 2860460 - protein, 5 aa, Entamoeba invadens
GKNMC

SEQ ID NO: 2860461 - protein, 16 aa, Entamoeba invadens
GKNPSKNKIKRQNRLK

SEQ ID NO: 2860462 - protein, 7 aa, Entamoeba invadens
GKNPTFA

SEQ ID NO: 2860463 - protein, 6 aa, Entamoeba invadens
GKNRPI

SEQ ID NO: 2860464 - protein, 7 aa, Entamoeba invadens
GKNSDGF

SEQ ID NO: 2860465 - protein, 10 aa, Entamoeba invadens
GKNSELGTQG

SEQ ID NO: 2860466 - protein, 6 aa, Entamoeba invadens
GKNSGV

SEQ ID NO: 2860467 - protein, 8 aa, Entamoeba invadens
GKNSKKMK

SEQ ID NO: 2860468 - protein, 5 aa, Entamoeba invadens
GKNTK

SEQ ID NO: 2860469 - protein, 8 aa, Entamoeba invadens
GKNTKFGD

SEQ ID NO: 2860470 - protein, 8 aa, Entamoeba invadens
GKNTKKRE

SEQ ID NO: 2860471 - protein, 13 aa, Entamoeba invadens
GKNVNNESLSHSN

SEQ ID NO: 2860472 - protein, 8 aa, Entamoeba invadens
GKNVSPAA

SEQ ID NO: 2860473 - protein, 5 aa, Entamoeba invadens
GKNYY

SEQ ID NO: 2860474 - protein, 4 aa, Entamoeba invadens
GKPA

SEQ ID NO: 2860475 - protein, 14 aa, Entamoeba invadens
GKPAPPRNKKLLQP

SEQ ID NO: 2860476 - protein, 7 aa, Entamoeba invadens
GKPCDPE

SEQ ID NO: 2860477 - protein, 11 aa, Entamoeba invadens
GKPCVSGAEGI

SEQ ID NO: 2860478 - protein, 7 aa, Entamoeba invadens
GKPDPFN

SEQ ID NO: 2860479 - protein, 9 aa, Entamoeba invadens
GKPEESDKD

SEQ ID NO: 2860480 - protein, 5 aa, Entamoeba invadens
GKPEG

SEQ ID NO: 2860481 - protein, 21 aa, Entamoeba invadens
GKPEPKREMSSVDNGTPHRLK

SEQ ID NO: 2860482 - protein, 4 aa, Entamoeba invadens
GKPF

SEQ ID NO: 2860483 - protein, 8 aa, Entamoeba invadens
GKPFGVTD

SEQ ID NO: 2860484 - protein, 10 aa, Entamoeba invadens
GKPFKEDEVR

SEQ ID NO: 2860485 - protein, 6 aa, Entamoeba invadens
GKPITA

SEQ ID NO: 2860486 - protein, 9 aa, Entamoeba invadens
GKPKESAEK

SEQ ID NO: 2860487 - protein, 5 aa, Entamoeba invadens
GKPKL

SEQ ID NO: 2860488 - protein, 4 aa, Entamoeba invadens
GKPL

SEQ ID NO: 2860489 - protein, 6 aa, Entamoeba invadens
GKPLGG

SEQ ID NO: 2860490 - protein, 21 aa, Entamoeba invadens
GKPLNAREISSAKVKNNQEFE

SEQ ID NO: 2860491 - protein, 8 aa, Entamoeba invadens
GKPLTPDE

SEQ ID NO: 2860492 - protein, 7 aa, Entamoeba invadens
GKPMTET

SEQ ID NO: 2860493 - protein, 5 aa, Entamoeba invadens
GKPNI

SEQ ID NO: 2860494 - protein, 23 aa, Entamoeba invadens
GKPNLGERKSIPSVNIGNHMRSV

SEQ ID NO: 2860495 - protein, 25 aa, Entamoeba invadens
GKPPEMKTEELKKRQTNAKEAIEKL

SEQ ID NO: 2860496 - protein, 38 aa, Entamoeba invadens
GKPPSKDEEKKKEPTKEETQEEKKEEKPSLQEENTESL

SEQ ID NO: 2860497 - protein, 53 aa, Entamoeba invadens
GKPREKVVEKSTEKPVESEAKVESTQLPQEEENNTNETPKEEQEKEIKNNEMK

SEQ ID NO: 2860498 - protein, 9 aa, Entamoeba invadens
GKPTHEDLT

SEQ ID NO: 2860499 - protein, 44 aa, Entamoeba invadens
GKPTKEAGKKARKVKEATKKTQTAYEDRDADAYNKNNKEMVKDA

SEQ ID NO: 2860500 - protein, 11 aa, Entamoeba invadens
GKPTPQSNVTS

SEQ ID NO: 2860501 - protein, 8 aa, Entamoeba invadens
GKPVAGGI

SEQ ID NO: 2860502 - protein, 9 aa, Entamoeba invadens
GKPVEQSQV

SEQ ID NO: 2860503 - protein, 6 aa, Entamoeba invadens
GKPVFS

SEQ ID NO: 2860504 - protein, 6 aa, Entamoeba invadens
GKPVSY

SEQ ID NO: 2860505 - protein, 12 aa, Entamoeba invadens
GKPWSIQPGSSF

SEQ ID NO: 2860506 - protein, 5 aa, Entamoeba invadens
GKQCG

SEQ ID NO: 2860507 - protein, 11 aa, Entamoeba invadens
GKQDEKFKSGE

SEQ ID NO: 2860508 - protein, 10 aa, Entamoeba invadens
GKQDRNRVSD

SEQ ID NO: 2860509 - protein, 7 aa, Entamoeba invadens
GKQEEVE

SEQ ID NO: 2860510 - protein, 9 aa, Entamoeba invadens
GKQELYKDS

SEQ ID NO: 2860511 - protein, 9 aa, Entamoeba invadens
GKQGDTPHA

SEQ ID NO: 2860512 - protein, 13 aa, Entamoeba invadens
GKQIKNSRTTVDS

SEQ ID NO: 2860513 - protein, 7 aa, Entamoeba invadens
GKQIRQS

SEQ ID NO: 2860514 - protein, 10 aa, Entamoeba invadens
GKQKLYENSY

SEQ ID NO: 2860515 - protein, 25 aa, Entamoeba invadens
GKQLTKGEPDGSSFPNGGLRNTHQA

SEQ ID NO: 2860516 - protein, 7 aa, Entamoeba invadens
GKQNPIA

SEQ ID NO: 2860517 - protein, 9 aa, Entamoeba invadens
GKQPQQQLY

SEQ ID NO: 2860518 - protein, 9 aa, Entamoeba invadens
GKQQTTDYQ

SEQ ID NO: 2860519 - protein, 6 aa, Entamoeba invadens
GKQRNT

SEQ ID NO: 2860520 - protein, 5 aa, Entamoeba invadens
GKQSF

SEQ ID NO: 2860521 - protein, 16 aa, Entamoeba invadens
GKQSLAADIKTAEGQN

SEQ ID NO: 2860522 - protein, 12 aa, Entamoeba invadens
GKQTKKTGSAKD

SEQ ID NO: 2860523 - protein, 6 aa, Entamoeba invadens
GKQTLQ

SEQ ID NO: 2860524 - protein, 11 aa, Entamoeba invadens
GKQTQPPVQPP

SEQ ID NO: 2860525 - protein, 8 aa, Entamoeba invadens
GKQVEVDH

SEQ ID NO: 2860526 - protein, 8 aa, Entamoeba invadens
GKRDEASL

SEQ ID NO: 2860527 - protein, 7 aa, Entamoeba invadens
GKRDQME

SEQ ID NO: 2860528 - protein, 10 aa, Entamoeba invadens
GKRESEVSEI

SEQ ID NO: 2860529 - protein, 6 aa, Entamoeba invadens
GKREVS

SEQ ID NO: 2860530 - protein, 4 aa, Entamoeba invadens
GKRG

SEQ ID NO: 2860531 - protein, 14 aa, Entamoeba invadens
GKRGLVPANFIDYV

SEQ ID NO: 2860532 - protein, 7 aa, Entamoeba invadens
GKRGWAP

SEQ ID NO: 2860533 - protein, 11 aa, Entamoeba invadens
GKRIKNDGTVR

SEQ ID NO: 2860534 - protein, 25 aa, Entamoeba invadens
GKRKGQQIDDTEDFTRETITSQKYS

SEQ ID NO: 2860535 - protein, 16 aa, Entamoeba invadens
GKRKSISSTPIKRDSI

SEQ ID NO: 2860536 - protein, 11 aa, Entamoeba invadens
GKRKSVEKCGG

SEQ ID NO: 2860537 - protein, 13 aa, Entamoeba invadens
GKRKVDALIALSC

SEQ ID NO: 2860538 - protein, 12 aa, Entamoeba invadens
GKRLENRKNIPE

SEQ ID NO: 2860539 - protein, 12 aa, Entamoeba invadens
GKRLENRKNIPK

SEQ ID NO: 2860540 - protein, 6 aa, Entamoeba invadens
GKRLPH

SEQ ID NO: 2860541 - protein, 12 aa, Entamoeba invadens
GKRLPKPENFSD

SEQ ID NO: 2860542 - protein, 5 aa, Entamoeba invadens
GKRLS

SEQ ID NO: 2860543 - protein, 5 aa, Entamoeba invadens
GKRMD

SEQ ID NO: 2860544 - protein, 11 aa, Entamoeba invadens
GKRNGDDRDHL

SEQ ID NO: 2860545 - protein, 8 aa, Entamoeba invadens
GKRPNGDN

SEQ ID NO: 2860546 - protein, 7 aa, Entamoeba invadens
GKRPSTI

SEQ ID NO: 2860547 - protein, 6 aa, Entamoeba invadens
GKRQHE

SEQ ID NO: 2860548 - protein, 8 aa, Entamoeba invadens
GKRQNLSI

SEQ ID NO: 2860549 - protein, 7 aa, Entamoeba invadens
GKRRKET

SEQ ID NO: 2860550 - protein, 6 aa, Entamoeba invadens
GKRRNE

SEQ ID NO: 2860551 - protein, 5 aa, Entamoeba invadens
GKRRS

SEQ ID NO: 2860552 - protein, 4 aa, Entamoeba invadens
GKRS

SEQ ID NO: 2860553 - protein, 11 aa, Entamoeba invadens
GKRSSSEHEAV

SEQ ID NO: 2860554 - protein, 8 aa, Entamoeba invadens
GKRSTYKF

SEQ ID NO: 2860555 - protein, 8 aa, Entamoeba invadens
GKRTDEKM

SEQ ID NO: 2860556 - protein, 19 aa, Entamoeba invadens
GKRTKPVSKSHKPDKRKNL

SEQ ID NO: 2860557 - protein, 10 aa, Entamoeba invadens
GKRTNEKVTY

SEQ ID NO: 2860558 - protein, 13 aa, Entamoeba invadens
GKRTSQNENETLR

SEQ ID NO: 2860559 - protein, 5 aa, Entamoeba invadens
GKRVA

SEQ ID NO: 2860560 - protein, 13 aa, Entamoeba invadens
GKRVERDSNIPEP

SEQ ID NO: 2860561 - protein, 8 aa, Entamoeba invadens
GKSAHGSG

SEQ ID NO: 2860562 - protein, 7 aa, Entamoeba invadens
GKSARAS

SEQ ID NO: 2860563 - protein, 8 aa, Entamoeba invadens
GKSCEERA

SEQ ID NO: 2860564 - protein, 9 aa, Entamoeba invadens
GKSDKRGTK

SEQ ID NO: 2860565 - protein, 9 aa, Entamoeba invadens
GKSDNPDLQ

SEQ ID NO: 2860566 - protein, 4 aa, Entamoeba invadens
GKSE

SEQ ID NO: 2860567 - protein, 10 aa, Entamoeba invadens
GKSEAETKNN

SEQ ID NO: 2860568 - protein, 10 aa, Entamoeba invadens
GKSEDGGTVL

SEQ ID NO: 2860569 - protein, 10 aa, Entamoeba invadens
GKSEDNNRTI

SEQ ID NO: 2860570 - protein, 6 aa, Entamoeba invadens
GKSELI

SEQ ID NO: 2860571 - protein, 11 aa, Entamoeba invadens
GKSFDEGYDGR

SEQ ID NO: 2860572 - protein, 7 aa, Entamoeba invadens
GKSFGNG

SEQ ID NO: 2860573 - protein, 15 aa, Entamoeba invadens
GKSFKPAYVVALSWS

SEQ ID NO: 2860574 - protein, 4 aa, Entamoeba invadens
GKSG

SEQ ID NO: 2860575 - protein, 8 aa, Entamoeba invadens
GKSGELKD

SEQ ID NO: 2860576 - protein, 7 aa, Entamoeba invadens
GKSGEVD

SEQ ID NO: 2860577 - protein, 10 aa, Entamoeba invadens
GKSGKITGYK

SEQ ID NO: 2860578 - protein, 5 aa, Entamoeba invadens
GKSGM

SEQ ID NO: 2860579 - protein, 10 aa, Entamoeba invadens
GKSGQNVQPI

SEQ ID NO: 2860580 - protein, 25 aa, Entamoeba invadens
GKSIAKTSKNGVKYDKRNHNAATNN

SEQ ID NO: 2860581 - protein, 6 aa, Entamoeba invadens
GKSIKS

SEQ ID NO: 2860582 - protein, 5 aa, Entamoeba invadens
GKSIY

SEQ ID NO: 2860583 - protein, 9 aa, Entamoeba invadens
GKSIYRNSM

SEQ ID NO: 2860584 - protein, 7 aa, Entamoeba invadens
GKSKALD

SEQ ID NO: 2860585 - protein, 6 aa, Entamoeba invadens
GKSKSV

SEQ ID NO: 2860586 - protein, 7 aa, Entamoeba invadens
GKSKYSL

SEQ ID NO: 2860587 - protein, 4 aa, Entamoeba invadens
GKSL

SEQ ID NO: 2860588 - protein, 17 aa, Entamoeba invadens
GKSLEDIKPSNPSPRVA

SEQ ID NO: 2860589 - protein, 7 aa, Entamoeba invadens
GKSMYPG

SEQ ID NO: 2860590 - protein, 17 aa, Entamoeba invadens
GKSNKRYAKNEGHKKQR

SEQ ID NO: 2860591 - protein, 22 aa, Entamoeba invadens
GKSNPKLEFDDNNPVKKAEKLM

SEQ ID NO: 2860592 - protein, 8 aa, Entamoeba invadens
GKSNSHEK

SEQ ID NO: 2860593 - protein, 9 aa, Entamoeba invadens
GKSNSTINE

SEQ ID NO: 2860594 - protein, 5 aa, Entamoeba invadens
GKSNT

SEQ ID NO: 2860595 - protein, 9 aa, Entamoeba invadens
GKSPITGEM

SEQ ID NO: 2860596 - protein, 14 aa, Entamoeba invadens
GKSPKKTKEDTPLI

SEQ ID NO: 2860597 - protein, 5 aa, Entamoeba invadens
GKSPL

SEQ ID NO: 2860598 - protein, 15 aa, Entamoeba invadens
GKSQEELKEFVDSLH

SEQ ID NO: 2860599 - protein, 8 aa, Entamoeba invadens
GKSRYADV

SEQ ID NO: 2860600 - protein, 7 aa, Entamoeba invadens
GKSSDSY

SEQ ID NO: 2860601 - protein, 8 aa, Entamoeba invadens
GKSSFGKK

SEQ ID NO: 2860602 - protein, 8 aa, Entamoeba invadens
GKSSITVQ

SEQ ID NO: 2860603 - protein, 8 aa, Entamoeba invadens
GKSSKESV

SEQ ID NO: 2860604 - protein, 5 aa, Entamoeba invadens
GKSSQ

SEQ ID NO: 2860605 - protein, 4 aa, Entamoeba invadens
GKST

SEQ ID NO: 2860606 - protein, 7 aa, Entamoeba invadens
GKSTCSN

SEQ ID NO: 2860607 - protein, 8 aa, Entamoeba invadens
GKSTKEKW

SEQ ID NO: 2860608 - protein, 17 aa, Entamoeba invadens
GKSTQDTVEKALSGTKE

SEQ ID NO: 2860609 - protein, 8 aa, Entamoeba invadens
GKSTRTEV

SEQ ID NO: 2860610 - protein, 8 aa, Entamoeba invadens
GKSVDNPV

SEQ ID NO: 2860611 - protein, 22 aa, Entamoeba invadens
GKSVESESKGQTTSAVKQINKP

SEQ ID NO: 2860612 - protein, 11 aa, Entamoeba invadens
GKSVFTGSDDG

SEQ ID NO: 2860613 - protein, 9 aa, Entamoeba invadens
GKSVGVQDK

SEQ ID NO: 2860614 - protein, 8 aa, Entamoeba invadens
GKSVNNQF

SEQ ID NO: 2860615 - protein, 14 aa, Entamoeba invadens
GKSVPKYLNRKKRH

SEQ ID NO: 2860616 - protein, 15 aa, Entamoeba invadens
GKSYDNIDIDKSGVK

SEQ ID NO: 2860617 - protein, 8 aa, Entamoeba invadens
GKSYKSIE

SEQ ID NO: 2860618 - protein, 14 aa, Entamoeba invadens
GKSYKYNKRSAIYK

SEQ ID NO: 2860619 - protein, 18 aa, Entamoeba invadens
GKTAEDLEPKMKETVDKT

SEQ ID NO: 2860620 - protein, 8 aa, Entamoeba invadens
GKTAETKK

SEQ ID NO: 2860621 - protein, 8 aa, Entamoeba invadens
GKTAQNQL

SEQ ID NO: 2860622 - protein, 5 aa, Entamoeba invadens
GKTDA

SEQ ID NO: 2860623 - protein, 9 aa, Entamoeba invadens
GKTDERSVK

SEQ ID NO: 2860624 - protein, 9 aa, Entamoeba invadens
GKTDFAKKK

SEQ ID NO: 2860625 - protein, 6 aa, Entamoeba invadens
GKTDLT

SEQ ID NO: 2860626 - protein, 6 aa, Entamoeba invadens
GKTDQV

SEQ ID NO: 2860627 - protein, 4 aa, Entamoeba invadens
GKTE

SEQ ID NO: 2860628 - protein, 7 aa, Entamoeba invadens
GKTEAGC

SEQ ID NO: 2860629 - protein, 11 aa, Entamoeba invadens
GKTEAKNPQIC

SEQ ID NO: 2860630 - protein, 8 aa, Entamoeba invadens
GKTEENEP

SEQ ID NO: 2860631 - protein, 7 aa, Entamoeba invadens
GKTEINK

SEQ ID NO: 2860632 - protein, 10 aa, Entamoeba invadens
GKTEKEQLKE

SEQ ID NO: 2860633 - protein, 6 aa, Entamoeba invadens
GKTEMD

SEQ ID NO: 2860634 - protein, 10 aa, Entamoeba invadens
GKTESKRNYE

SEQ ID NO: 2860635 - protein, 4 aa, Entamoeba invadens
GKTF

SEQ ID NO: 2860636 - protein, 11 aa, Entamoeba invadens
GKTFDSAYPFD

SEQ ID NO: 2860637 - protein, 6 aa, Entamoeba invadens
GKTFHS

SEQ ID NO: 2860638 - protein, 16 aa, Entamoeba invadens
GKTFTPKRIVVYQLVD

SEQ ID NO: 2860639 - protein, 5 aa, Entamoeba invadens
GKTGD

SEQ ID NO: 2860640 - protein, 15 aa, Entamoeba invadens
GKTGDIKSCSYIGQV

SEQ ID NO: 2860641 - protein, 8 aa, Entamoeba invadens
GKTGRPNV

SEQ ID NO: 2860642 - protein, 9 aa, Entamoeba invadens
GKTHQLGQP

SEQ ID NO: 2860643 - protein, 6 aa, Entamoeba invadens
GKTISS

SEQ ID NO: 2860644 - protein, 4 aa, Entamoeba invadens
GKTK

SEQ ID NO: 2860645 - protein, 5 aa, Entamoeba invadens
GKTKE

SEQ ID NO: 2860646 - protein, 11 aa, Entamoeba invadens
GKTKEVDAKLE

SEQ ID NO: 2860647 - protein, 8 aa, Entamoeba invadens
GKTKIQNH

SEQ ID NO: 2860648 - protein, 7 aa, Entamoeba invadens
GKTKKTS

SEQ ID NO: 2860649 - protein, 8 aa, Entamoeba invadens
GKTKPDNY

SEQ ID NO: 2860650 - protein, 8 aa, Entamoeba invadens
GKTLATPN

SEQ ID NO: 2860651 - protein, 7 aa, Entamoeba invadens
GKTLSSQ

SEQ ID NO: 2860652 - protein, 7 aa, Entamoeba invadens
GKTMADG

SEQ ID NO: 2860653 - protein, 4 aa, Entamoeba invadens
GKTN

SEQ ID NO: 2860654 - protein, 14 aa, Entamoeba invadens
GKTNGTTAVVEQNQ

SEQ ID NO: 2860655 - protein, 8 aa, Entamoeba invadens
GKTNTVAH

SEQ ID NO: 2860656 - protein, 8 aa, Entamoeba invadens
GKTPEEIR

SEQ ID NO: 2860657 - protein, 14 aa, Entamoeba invadens
GKTPMKIEPKPNRW

SEQ ID NO: 2860658 - protein, 6 aa, Entamoeba invadens
GKTPNL

SEQ ID NO: 2860659 - protein, 10 aa, Entamoeba invadens
GKTPPRTRLT

SEQ ID NO: 2860660 - protein, 5 aa, Entamoeba invadens
GKTPS

SEQ ID NO: 2860661 - protein, 8 aa, Entamoeba invadens
GKTPSNFV

SEQ ID NO: 2860662 - protein, 5 aa, Entamoeba invadens
GKTPV

SEQ ID NO: 2860663 - protein, 16 aa, Entamoeba invadens
GKTQADLKMTRHSVRD

SEQ ID NO: 2860664 - protein, 9 aa, Entamoeba invadens
GKTQEEKRR

SEQ ID NO: 2860665 - protein, 6 aa, Entamoeba invadens
GKTQEL

SEQ ID NO: 2860666 - protein, 9 aa, Entamoeba invadens
GKTQPVKSA

SEQ ID NO: 2860667 - protein, 17 aa, Entamoeba invadens
GKTQSDLKKTQQSVRDG

SEQ ID NO: 2860668 - protein, 9 aa, Entamoeba invadens
GKTQSVNDY

SEQ ID NO: 2860669 - protein, 6 aa, Entamoeba invadens
GKTREE

SEQ ID NO: 2860670 - protein, 7 aa, Entamoeba invadens
GKTRGQV

SEQ ID NO: 2860671 - protein, 8 aa, Entamoeba invadens
GKTRKDIA

SEQ ID NO: 2860672 - protein, 5 aa, Entamoeba invadens
GKTRW

SEQ ID NO: 2860673 - protein, 15 aa, Entamoeba invadens
GKTSEGIGSSTNTNK

SEQ ID NO: 2860674 - protein, 11 aa, Entamoeba invadens
GKTSKKAKLTT

SEQ ID NO: 2860675 - protein, 11 aa, Entamoeba invadens
GKTSQKSRDTI

SEQ ID NO: 2860676 - protein, 11 aa, Entamoeba invadens
GKTSQTTQTLS

SEQ ID NO: 2860677 - protein, 10 aa, Entamoeba invadens
GKTTDISADT

SEQ ID NO: 2860678 - protein, 5 aa, Entamoeba invadens
GKTTI

SEQ ID NO: 2860679 - protein, 7 aa, Entamoeba invadens
GKTTITT

SEQ ID NO: 2860680 - protein, 8 aa, Entamoeba invadens
GKTTLEEQ

SEQ ID NO: 2860681 - protein, 5 aa, Entamoeba invadens
GKTTN

SEQ ID NO: 2860682 - protein, 7 aa, Entamoeba invadens
GKTTRED

SEQ ID NO: 2860683 - protein, 11 aa, Entamoeba invadens
GKTTSPPRRIK

SEQ ID NO: 2860684 - protein, 7 aa, Entamoeba invadens
GKTTTPL

SEQ ID NO: 2860685 - protein, 6 aa, Entamoeba invadens
GKTTVD

SEQ ID NO: 2860686 - protein, 25 aa, Entamoeba invadens
GKTTVVTGHGSSTTIAFEKVSNSIM

SEQ ID NO: 2860687 - protein, 6 aa, Entamoeba invadens
GKTVPE

SEQ ID NO: 2860688 - protein, 7 aa, Entamoeba invadens
GKTVVEK

SEQ ID NO: 2860689 - protein, 5 aa, Entamoeba invadens
GKTYD

SEQ ID NO: 2860690 - protein, 31 aa, Entamoeba invadens
GKVDKAHDDVEAAKKAWLDAKEKKSPDTQKL

SEQ ID NO: 2860691 - protein, 14 aa, Entamoeba invadens
GKVDKKHDAVEEAK

SEQ ID NO: 2860692 - protein, 5 aa, Entamoeba invadens
GKVEA

SEQ ID NO: 2860693 - protein, 8 aa, Entamoeba invadens
GKVEVESV

SEQ ID NO: 2860694 - protein, 6 aa, Entamoeba invadens
GKVFSQ

SEQ ID NO: 2860695 - protein, 10 aa, Entamoeba invadens
GKVGAKREDV

SEQ ID NO: 2860696 - protein, 12 aa, Entamoeba invadens
GKVGGKKDYSSY

SEQ ID NO: 2860697 - protein, 8 aa, Entamoeba invadens
GKVGPQTI

SEQ ID NO: 2860698 - protein, 14 aa, Entamoeba invadens
GKVGTENPTRNSEL

SEQ ID NO: 2860699 - protein, 11 aa, Entamoeba invadens
GKVGTKKTEYV

SEQ ID NO: 2860700 - protein, 4 aa, Entamoeba invadens
GKVI

SEQ ID NO: 2860701 - protein, 4 aa, Entamoeba invadens
GKVK

SEQ ID NO: 2860702 - protein, 6 aa, Entamoeba invadens
GKVKEG

SEQ ID NO: 2860703 - protein, 22 aa, Entamoeba invadens
GKVKPKEAEKLESDDDDEEKKL

SEQ ID NO: 2860704 - protein, 7 aa, Entamoeba invadens
GKVKRSD

SEQ ID NO: 2860705 - protein, 7 aa, Entamoeba invadens
GKVKRSE

SEQ ID NO: 2860706 - protein, 7 aa, Entamoeba invadens
GKVNEGV

SEQ ID NO: 2860707 - protein, 7 aa, Entamoeba invadens
GKVNINP

SEQ ID NO: 2860708 - protein, 15 aa, Entamoeba invadens
GKVPETTEMKGKSAF

SEQ ID NO: 2860709 - protein, 9 aa, Entamoeba invadens
GKVPKTNID

SEQ ID NO: 2860710 - protein, 7 aa, Entamoeba invadens
GKVRCQK

SEQ ID NO: 2860711 - protein, 7 aa, Entamoeba invadens
GKVRDKA

SEQ ID NO: 2860712 - protein, 25 aa, Entamoeba invadens
GKVRNSTKKVDKIDNGKKKFPSGRG

SEQ ID NO: 2860713 - protein, 4 aa, Entamoeba invadens
GKVS

SEQ ID NO: 2860714 - protein, 5 aa, Entamoeba invadens
GKVSE

SEQ ID NO: 2860715 - protein, 13 aa, Entamoeba invadens
GKVSKRKGNQTRV

SEQ ID NO: 2860716 - protein, 4 aa, Entamoeba invadens
GKVT

SEQ ID NO: 2860717 - protein, 5 aa, Entamoeba invadens
GKVTG

SEQ ID NO: 2860718 - protein, 6 aa, Entamoeba invadens
GKVTSD

SEQ ID NO: 2860719 - protein, 11 aa, Entamoeba invadens
GKVTYQERRSN

SEQ ID NO: 2860720 - protein, 18 aa, Entamoeba invadens
GKVVAQGRNRTKEFQDGT

SEQ ID NO: 2860721 - protein, 7 aa, Entamoeba invadens
GKVVTSD

SEQ ID NO: 2860722 - protein, 8 aa, Entamoeba invadens
GKWPNDGF

SEQ ID NO: 2860723 - protein, 14 aa, Entamoeba invadens
GKWSDEDSSWTQEM

SEQ ID NO: 2860724 - protein, 23 aa, Entamoeba invadens
GKYDESIEKEKEEQKSDEEELEK

SEQ ID NO: 2860725 - protein, 6 aa, Entamoeba invadens
GKYDYA

SEQ ID NO: 2860726 - protein, 5 aa, Entamoeba invadens
GKYEE

SEQ ID NO: 2860727 - protein, 7 aa, Entamoeba invadens
GKYEKEI

SEQ ID NO: 2860728 - protein, 6 aa, Entamoeba invadens
GKYEND

SEQ ID NO: 2860729 - protein, 6 aa, Entamoeba invadens
GKYGEE

SEQ ID NO: 2860730 - protein, 12 aa, Entamoeba invadens
GKYGESEKNGIT

SEQ ID NO: 2860731 - protein, 10 aa, Entamoeba invadens
GKYKDEDNYG

SEQ ID NO: 2860732 - protein, 7 aa, Entamoeba invadens
GKYKEDV

SEQ ID NO: 2860733 - protein, 7 aa, Entamoeba invadens
GKYKKDI

SEQ ID NO: 2860734 - protein, 7 aa, Entamoeba invadens
GKYKSKA

SEQ ID NO: 2860735 - protein, 7 aa, Entamoeba invadens
GKYLDEG

SEQ ID NO: 2860736 - protein, 8 aa, Entamoeba invadens
GKYNDAET

SEQ ID NO: 2860737 - protein, 20 aa, Entamoeba invadens
GKYNPSDNQDKRVPRETEEL

SEQ ID NO: 2860738 - protein, 12 aa, Entamoeba invadens
GKYNTSDIEKFN

SEQ ID NO: 2860739 - protein, 4 aa, Entamoeba invadens
GKYP

SEQ ID NO: 2860740 - protein, 7 aa, Entamoeba invadens
GKYPTGY

SEQ ID NO: 2860741 - protein, 14 aa, Entamoeba invadens
GKYQPNEKSEIHTN

SEQ ID NO: 2860742 - protein, 6 aa, Entamoeba invadens
GKYQSA

SEQ ID NO: 2860743 - protein, 6 aa, Entamoeba invadens
GKYRDH

SEQ ID NO: 2860744 - protein, 36 aa, Entamoeba invadens
GKYRSTSCNPKDTSGSSFEEPHQERKKRKSKKTECP

SEQ ID NO: 2860745 - protein, 5 aa, Entamoeba invadens
GKYSA

SEQ ID NO: 2860746 - protein, 7 aa, Entamoeba invadens
GKYSDME

SEQ ID NO: 2860747 - protein, 8 aa, Entamoeba invadens
GKYSNLNL

SEQ ID NO: 2860748 - protein, 8 aa, Entamoeba invadens
GKYSTESI

SEQ ID NO: 2860749 - protein, 4 aa, Entamoeba invadens
GKYT

SEQ ID NO: 2860750 - protein, 7 aa, Entamoeba invadens
GKYTPDA

SEQ ID NO: 2860751 - protein, 9 aa, Entamoeba invadens
GKYTQDAKS

SEQ ID NO: 2860752 - protein, 5 aa, Entamoeba invadens
GLALA

SEQ ID NO: 2860753 - protein, 4 aa, Entamoeba invadens
GLAP

SEQ ID NO: 2860754 - protein, 17 aa, Entamoeba invadens
GLASEGIKKKSENDSVK

SEQ ID NO: 2860755 - protein, 5 aa, Entamoeba invadens
GLASG

SEQ ID NO: 2860756 - protein, 8 aa, Entamoeba invadens
GLDAVPQD

SEQ ID NO: 2860757 - protein, 7 aa, Entamoeba invadens
GLDDNDA

SEQ ID NO: 2860758 - protein, 13 aa, Entamoeba invadens
GLDEAKGNDKDMS

SEQ ID NO: 2860759 - protein, 5 aa, Entamoeba invadens
GLDEK

SEQ ID NO: 2860760 - protein, 7 aa, Entamoeba invadens
GLDEKEE

SEQ ID NO: 2860761 - protein, 14 aa, Entamoeba invadens
GLDESKDGSRTCPE

SEQ ID NO: 2860762 - protein, 9 aa, Entamoeba invadens
GLDETVRSA

SEQ ID NO: 2860763 - protein, 4 aa, Entamoeba invadens
GLDG

SEQ ID NO: 2860764 - protein, 5 aa, Entamoeba invadens
GLDGD

SEQ ID NO: 2860765 - protein, 11 aa, Entamoeba invadens
GLDKEGDEDIL

SEQ ID NO: 2860766 - protein, 65 aa, Entamoeba invadens
GLDKKETKKQKKINSPRESDEEKIEVKDTQAGLKDKDEKETTQDSKDGKETKEAKDEKEKKSSKK

SEQ ID NO: 2860767 - protein, 12 aa, Entamoeba invadens
GLDKTGGVQENK

SEQ ID NO: 2860768 - protein, 9 aa, Entamoeba invadens
GLDNATDKE

SEQ ID NO: 2860769 - protein, 7 aa, Entamoeba invadens
GLDNEKN

SEQ ID NO: 2860770 - protein, 8 aa, Entamoeba invadens
GLDQEQSN

SEQ ID NO: 2860771 - protein, 9 aa, Entamoeba invadens
GLDSSEDIE

SEQ ID NO: 2860772 - protein, 7 aa, Entamoeba invadens
GLDTPGL

SEQ ID NO: 2860773 - protein, 10 aa, Entamoeba invadens
GLDTQDPQHI

SEQ ID NO: 2860774 - protein, 16 aa, Entamoeba invadens
GLDTTQTSKSEKKMKA

SEQ ID NO: 2860775 - protein, 8 aa, Entamoeba invadens
GLEDEREI

SEQ ID NO: 2860776 - protein, 24 aa, Entamoeba invadens
GLEEAKSHDEKDMENAIQDKNNKI

SEQ ID NO: 2860777 - protein, 7 aa, Entamoeba invadens
GLEETQA

SEQ ID NO: 2860778 - protein, 9 aa, Entamoeba invadens
GLEGNESIN

SEQ ID NO: 2860779 - protein, 9 aa, Entamoeba invadens
GLEGSLTRN

SEQ ID NO: 2860780 - protein, 6 aa, Entamoeba invadens
GLEKEP

SEQ ID NO: 2860781 - protein, 8 aa, Entamoeba invadens
GLESGRVV

SEQ ID NO: 2860782 - protein, 5 aa, Entamoeba invadens
GLESK

SEQ ID NO: 2860783 - protein, 11 aa, Entamoeba invadens
GLESSNTLTKN

SEQ ID NO: 2860784 - protein, 10 aa, Entamoeba invadens
GLETKSEVEC

SEQ ID NO: 2860785 - protein, 8 aa, Entamoeba invadens
GLFPAPTR

SEQ ID NO: 2860786 - protein, 6 aa, Entamoeba invadens
GLGASG

SEQ ID NO: 2860787 - protein, 8 aa, Entamoeba invadens
GLGEEYNE

SEQ ID NO: 2860788 - protein, 16 aa, Entamoeba invadens
GLGETELTGVNGETNH

SEQ ID NO: 2860789 - protein, 7 aa, Entamoeba invadens
GLGGTSF

SEQ ID NO: 2860790 - protein, 10 aa, Entamoeba invadens
GLGKKSQAVE

SEQ ID NO: 2860791 - protein, 11 aa, Entamoeba invadens
GLGKNARRRKK

SEQ ID NO: 2860792 - protein, 4 aa, Entamoeba invadens
GLGM

SEQ ID NO: 2860793 - protein, 4 aa, Entamoeba invadens
GLGR

SEQ ID NO: 2860794 - protein, 7 aa, Entamoeba invadens
GLGRSGT

SEQ ID NO: 2860795 - protein, 6 aa, Entamoeba invadens
GLGTKD

SEQ ID NO: 2860796 - protein, 11 aa, Entamoeba invadens
GLGTSKDSDAK

SEQ ID NO: 2860797 - protein, 5 aa, Entamoeba invadens
GLHDP

SEQ ID NO: 2860798 - protein, 17 aa, Entamoeba invadens
GLIPPSSKYGNVKTKTN

SEQ ID NO: 2860799 - protein, 13 aa, Entamoeba invadens
GLIPSRSSCSTKF

SEQ ID NO: 2860800 - protein, 33 aa, Entamoeba invadens
  misc_feature (18)..(20): Xaa can be any naturally occurring amino acid
GLKDAPLQSLLKKFQYQXXXESMDVNKTPSELL

SEQ ID NO: 2860801 - protein, 6 aa, Entamoeba invadens
GLKDEK

SEQ ID NO: 2860802 - protein, 14 aa, Entamoeba invadens
GLKDSTSATEDTLN

SEQ ID NO: 2860803 - protein, 7 aa, Entamoeba invadens
GLKEDAG

SEQ ID NO: 2860804 - protein, 5 aa, Entamoeba invadens
GLKEG

SEQ ID NO: 2860805 - protein, 8 aa, Entamoeba invadens
GLKKEAQV

SEQ ID NO: 2860806 - protein, 19 aa, Entamoeba invadens
GLKNGLTDVNGTFPKVSGV

SEQ ID NO: 2860807 - protein, 8 aa, Entamoeba invadens
GLKRKDTL

SEQ ID NO: 2860808 - protein, 6 aa, Entamoeba invadens
GLKSDE

SEQ ID NO: 2860809 - protein, 7 aa, Entamoeba invadens
GLKSTRN

SEQ ID NO: 2860810 - protein, 9 aa, Entamoeba invadens
GLKSTTSSV

SEQ ID NO: 2860811 - protein, 6 aa, Entamoeba invadens
GLKSVG

SEQ ID NO: 2860812 - protein, 9 aa, Entamoeba invadens
GLKYATKTT

SEQ ID NO: 2860813 - protein, 7 aa, Entamoeba invadens
GLLERPK

SEQ ID NO: 2860814 - protein, 16 aa, Entamoeba invadens
GLLGGSTIAPKMASST

SEQ ID NO: 2860815 - protein, 10 aa, Entamoeba invadens
GLLGTTGSNV

SEQ ID NO: 2860816 - protein, 6 aa, Entamoeba invadens
GLLPEP

SEQ ID NO: 2860817 - protein, 8 aa, Entamoeba invadens
GLLPNSYK

SEQ ID NO: 2860818 - protein, 4 aa, Entamoeba invadens [sequence omitted]

SEQ ID NO: 2860819 - protein, 9 aa, Entamoeba invadens
GLNARGTKI

SEQ ID NO: 2860820 - protein, 7 aa, Entamoeba invadens
GLNDDQK

SEQ ID NO: 2860821 - protein, 11 aa, Entamoeba invadens
GLNDLSDSEDF

SEQ ID NO: 2860822 - protein, 10 aa, Entamoeba invadens
GLNDNQQLQT

SEQ ID NO: 2860823 - protein, 17 aa, Entamoeba invadens
GLNEEEAQDRKNAWRTR

SEQ ID NO: 2860824 - protein, 5 aa, Entamoeba invadens
GLNEF

SEQ ID NO: 2860825 - protein, 10 aa, Entamoeba invadens
GLNEKRGNTA

SEQ ID NO: 2860826 - protein, 10 aa, Entamoeba invadens
GLNGSGKSNI

SEQ ID NO: 2860827 - protein, 10 aa, Entamoeba invadens
GLNKNTQDLP

SEQ ID NO: 2860828 - protein, 6 aa, Entamoeba invadens
GLNNSR

SEQ ID NO: 2860829 - protein, 8 aa, Entamoeba invadens
GLNPETSE

SEQ ID NO: 2860830 - protein, 7 aa, Entamoeba invadens
GLNPQSA

SEQ ID NO: 2860831 - protein, 10 aa, Entamoeba invadens
GLNPRTRGPL

SEQ ID NO: 2860832 - protein, 12 aa, Entamoeba invadens
GLNQVNPAESSN

SEQ ID NO: 2860833 - protein, 7 aa, Entamoeba invadens
GLNRETF

SEQ ID NO: 2860834 - protein, 7 aa, Entamoeba invadens
GLNSEYT

SEQ ID NO: 2860835 - protein, 8 aa, Entamoeba invadens
GLNSTGEK

SEQ ID NO: 2860836 - protein, 12 aa, Entamoeba invadens
GLNTEGKSPLER

SEQ ID NO: 2860837 - protein, 7 aa, Entamoeba invadens
GLPANTA

SEQ ID NO: 2860838 - protein, 7 aa, Entamoeba invadens
GLPGANY

SEQ ID NO: 2860839 - protein, 12 aa, Entamoeba invadens
GLPLTKKKDGKT

SEQ ID NO: 2860840 - protein, 4 aa, Entamoeba invadens
GLPP

SEQ ID NO: 2860841 - protein, 19 aa, Entamoeba invadens
GLPPQIPQECHKEEQKALQ

SEQ ID NO: 2860842 - protein, 6 aa, Entamoeba invadens
GLPPRF

SEQ ID NO: 2860843 - protein, 5 aa, Entamoeba invadens
GLPPT

SEQ ID NO: 2860844 - protein, 8 aa, Entamoeba invadens
GLPPTGGW

SEQ ID NO: 2860845 - protein, 12 aa, Entamoeba invadens
GLPRESDSMITP

SEQ ID NO: 2860846 - protein, 7 aa, Entamoeba invadens
GLPRPGE

SEQ ID NO: 2860847 - protein, 10 aa, Entamoeba invadens
GLPSKNTRGN

SEQ ID NO: 2860848 - protein, 6 aa, Entamoeba invadens
GLPSPA

SEQ ID NO: 2860849 - protein, 5 aa, Entamoeba invadens
GLPSQ

SEQ ID NO: 2860850 - protein, 10 aa, Entamoeba invadens
GLPTKTLEGK

SEQ ID NO: 2860851 - protein, 12 aa, Entamoeba invadens
GLPTNPAEYDGD

SEQ ID NO: 2860852 - protein, 7 aa, Entamoeba invadens
GLQEQIK

SEQ ID NO: 2860853 - protein, 4 aa, Entamoeba invadens
GLQH

SEQ ID NO: 2860854 - protein, 6 aa, Entamoeba invadens
GLQKNT

SEQ ID NO: 2860855 - protein, 7 aa, Entamoeba invadens
GLQKTGV

SEQ ID NO: 2860856 - protein, 18 aa, Entamoeba invadens
GLQNEENAKAQTERVNPY

SEQ ID NO: 2860857 - protein, 16 aa, Entamoeba invadens
GLQNGTKTKITNSDFS

SEQ ID NO: 2860858 - protein, 10 aa, Entamoeba invadens
GLQSQQQNSW

SEQ ID NO: 2860859 - protein, 4 aa, Entamoeba invadens
GLQT

SEQ ID NO: 2860860 - protein, 8 aa, Entamoeba invadens
GLQTEYQN

SEQ ID NO: 2860861 - protein, 7 aa, Entamoeba invadens
GLQTTKG

SEQ ID NO: 2860862 - protein, 10 aa, Entamoeba invadens
GLQTVGDSSF

SEQ ID NO: 2860863 - protein, 7 aa, Entamoeba invadens
GLRDRHT

SEQ ID NO: 2860864 - protein, 12 aa, Entamoeba invadens
GLRESAKDYVSV

SEQ ID NO: 2860865 - protein, 5 aa, Entamoeba invadens
GLRGS

SEQ ID NO: 2860866 - protein, 6 aa, Entamoeba invadens
GLRNSP

SEQ ID NO: 2860867 - protein, 11 aa, Entamoeba invadens
GLRPNTTSGKC

SEQ ID NO: 2860868 - protein, 10 aa, Entamoeba invadens
GLRPQDMGNP

SEQ ID NO: 2860869 - protein, 10 aa, Entamoeba invadens
GLRPSNLADK

SEQ ID NO: 2860870 - protein, 24 aa, Entamoeba invadens
GLRREEREQPPREPYIRDRFDSRG

SEQ ID NO: 2860871 - protein, 4 aa, Entamoeba invadens
GLSA

SEQ ID NO: 2860872 - protein, 5 aa, Entamoeba invadens
GLSAS

SEQ ID NO: 2860873 - protein, 4 aa, Entamoeba invadens
GLSD

SEQ ID NO: 2860874 - protein, 6 aa, Entamoeba invadens
GLSDGT

SEQ ID NO: 2860875 - protein, 26 aa, Entamoeba invadens
GLSEEDKAAALKRKQVETDAQSAKKL

SEQ ID NO: 2860876 - protein, 15 aa, Entamoeba invadens
GLSEENKKYTTSRAH

SEQ ID NO: 2860877 - protein, 11 aa, Entamoeba invadens
GLSERYEESAL

SEQ ID NO: 2860878 - protein, 12 aa, Entamoeba invadens
GLSERYEESSLN

SEQ ID NO: 2860879 - protein, 4 aa, Entamoeba invadens
GLSG

SEQ ID NO: 2860880 - protein, 9 aa, Entamoeba invadens
GLSGGEAKD

SEQ ID NO: 2860881 - protein, 14 aa, Entamoeba invadens
GLSGSANKKKFSSI

SEQ ID NO: 2860882 - protein, 5 aa, Entamoeba invadens
GLSHC

SEQ ID NO: 2860883 - protein, 15 aa, Entamoeba invadens
GLSKGGQSVSNARQQ

SEQ ID NO: 2860884 - protein, 8 aa, Entamoeba invadens
GLSKGKSR

SEQ ID NO: 2860885 - protein, 10 aa, Entamoeba invadens
GLSKKTVDTD

SEQ ID NO: 2860886 - protein, 7 aa, Entamoeba invadens
GLSNNNA

SEQ ID NO: 2860887 - protein, 8 aa, Entamoeba invadens
GLSPHDKI

SEQ ID NO: 2860888 - protein, 8 aa, Entamoeba invadens
GLSPKQRA

SEQ ID NO: 2860889 - protein, 8 aa, Entamoeba invadens
GLSPKRKI

SEQ ID NO: 2860890 - protein, 6 aa, Entamoeba invadens
GLSPST

SEQ ID NO: 2860891 - protein, 10 aa, Entamoeba invadens
GLSQKTANRR

SEQ ID NO: 2860892 - protein, 27 aa, Entamoeba invadens
GLSQNSSLHQDQSGSSLHESENMSPRI

SEQ ID NO: 2860893 - protein, 14 aa, Entamoeba invadens
GLSREAEDARKYQA

SEQ ID NO: 2860894 - protein, 5 aa, Entamoeba invadens
GLSSE

SEQ ID NO: 2860895 - protein, 10 aa, Entamoeba invadens
GLSSRNAQQR

SEQ ID NO: 2860896 - protein, 8 aa, Entamoeba invadens
GLSTSPNL

SEQ ID NO: 2860897 - protein, 19 aa, Entamoeba invadens
GLSYTEATWEKESDVGDDV

SEQ ID NO: 2860898 - protein, 7 aa, Entamoeba invadens
GLTDEPT

SEQ ID NO: 2860899 - protein, 23 aa, Entamoeba invadens
GLTEAKLDKRKTLGVSPTHSGKQ

SEQ ID NO: 2860900 - protein, 10 aa, Entamoeba invadens
GLTEKDAKKW

SEQ ID NO: 2860901 - protein, 6 aa, Entamoeba invadens
GLTENT

SEQ ID NO: 2860902 - protein, 8 aa, Entamoeba invadens
GLTGSNKR

SEQ ID NO: 2860903 - protein, 15 aa, Entamoeba invadens
GLTKRLNTRKPRLYH

SEQ ID NO: 2860904 - protein, 8 aa, Entamoeba invadens
GLTPSTHY

SEQ ID NO: 2860905 - protein, 4 aa, Entamoeba invadens
GLTQ

SEQ ID NO: 2860906 - protein, 20 aa, Entamoeba invadens
GLTQEEAKTLAKSAAGNIEN

SEQ ID NO: 2860907 - protein, 6 aa, Entamoeba invadens
GLTSSS

SEQ ID NO: 2860908 - protein, 10 aa, Entamoeba invadens
GLTTGDVKYQ

SEQ ID NO: 2860909 - protein, 10 aa, Entamoeba invadens
GLTTGERSQH

SEQ ID NO: 2860910 - protein, 15 aa, Entamoeba invadens
GLVDQKEESRERKNA

SEQ ID NO: 2860911 - protein, 5 aa, Entamoeba invadens
GLYES

SEQ ID NO: 2860912 - protein, 11 aa, Entamoeba invadens
GMAKTSNDKPN

SEQ ID NO: 2860913 - protein, 6 aa, Entamoeba invadens
GMDPQQ

SEQ ID NO: 2860914 - protein, 5 aa, Entamoeba invadens
GMDQR

SEQ ID NO: 2860915 - protein, 4 aa, Entamoeba invadens
GMED

SEQ ID NO: 2860916 - protein, 9 aa, Entamoeba invadens
GMEDDKESL

SEQ ID NO: 2860917 - protein, 5 aa, Entamoeba invadens
GMEKA

SEQ ID NO: 2860918 - protein, 5 aa, Entamoeba invadens
GMEPS

SEQ ID NO: 2860919 - protein, 13 aa, Entamoeba invadens
GMEPTDNRSTDKN

SEQ ID NO: 2860920 - protein, 13 aa, Entamoeba invadens
GMGCPQDKRGARE

SEQ ID NO: 2860921 - protein, 37 aa, Entamoeba invadens
GMGGGMSSGLGTSSGLGNGYQQNTAIGGGLPQQSNSF

SEQ ID NO: 2860922 - protein, 12 aa, Entamoeba invadens
GMGGKGSPQYQE

SEQ ID NO: 2860923 - protein, 9 aa, Entamoeba invadens
GMGGSGQIS

SEQ ID NO: 2860924 - protein, 10 aa, Entamoeba invadens
GMGKNPAASA

SEQ ID NO: 2860925 - protein, 5 aa, Entamoeba invadens
GMGKT

SEQ ID NO: 2860926 - protein, 7 aa, Entamoeba invadens
GMGPYGR

SEQ ID NO: 2860927 - protein, 14 aa, Entamoeba invadens
GMINKKDGRLNKNE

SEQ ID NO: 2860928 - protein, 6 aa, Entamoeba invadens
GMIPPR

SEQ ID NO: 2860929 - protein, 9 aa, Entamoeba invadens
GMKKERNYY

SEQ ID NO: 2860930 - protein, 11 aa, Entamoeba invadens
GMKKSNDYHGQ

SEQ ID NO: 2860931 - protein, 30 aa, Entamoeba invadens
GMKRKDTSSKPFGQQKAESDHRHSDCNYGV

SEQ ID NO: 2860932 - protein, 5 aa, Entamoeba invadens
GMLES

SEQ ID NO: 2860933 - protein, 4 aa, Entamoeba invadens
GMLS

SEQ ID NO: 2860934 - protein, 4 aa, Entamoeba invadens
GMMS

SEQ ID NO: 2860935 - protein, 11 aa, Entamoeba invadens
GMNDDKEIYKG

SEQ ID NO: 2860936 - protein, 7 aa, Entamoeba invadens
GMNDETI

SEQ ID NO: 2860937 - protein, 10 aa, Entamoeba invadens
GMNEEEAVDA

SEQ ID NO: 2860938 - protein, 5 aa, Entamoeba invadens
GMNKD

SEQ ID NO: 2860939 - protein, 9 aa, Entamoeba invadens
GMNPKGNSV

SEQ ID NO: 2860940 - protein, 7 aa, Entamoeba invadens
GMNPTEK

SEQ ID NO: 2860941 - protein, 13 aa, Entamoeba invadens
GMPGLGGMGGLPG

SEQ ID NO: 2860942 - protein, 5 aa, Entamoeba invadens
GMPGM

SEQ ID NO: 2860943 - protein, 12 aa, Entamoeba invadens
GMPKSKVAKESV

SEQ ID NO: 2860944 - protein, 4 aa, Entamoeba invadens
GMPP

SEQ ID NO: 2860945 - protein, 5 aa, Entamoeba invadens
GMPPM

SEQ ID NO: 2860946 - protein, 21 aa, Entamoeba invadens
GMPQSRSRRAKFSKKRNGFSG

SEQ ID NO: 2860947 - protein, 7 aa, Entamoeba invadens
GMPTRSN

SEQ ID NO: 2860948 - protein, 8 aa, Entamoeba invadens
GMQANTQM

SEQ ID NO: 2860949 - protein, 11 aa, Entamoeba invadens
GMQQPGMNPYG

SEQ ID NO: 2860950 - protein, 4 aa, Entamoeba invadens
GMRE

SEQ ID NO: 2860951 - protein, 8 aa, Entamoeba invadens
GMREPEKQ

SEQ ID NO: 2860952 - protein, 10 aa, Entamoeba invadens
GMSASDRESV

SEQ ID NO: 2860953 - protein, 7 aa, Entamoeba invadens
GMSESQK

SEQ ID NO: 2860954 - protein, 18 aa, Entamoeba invadens
GMSGKDHYVKGKEKREMK

SEQ ID NO: 2860955 - protein, 5 aa, Entamoeba invadens
GMSPE

SEQ ID NO: 2860956 - protein, 10 aa, Entamoeba invadens
GMSPQAKEKQ

SEQ ID NO: 2860957 - protein, 18 aa, Entamoeba invadens
GMSTSAGIPDFRTPGTGL

SEQ ID NO: 2860958 - protein, 7 aa, Entamoeba invadens
GMSTTQT

SEQ ID NO: 2860959 - protein, 5 aa, Entamoeba invadens
GMSYD

SEQ ID NO: 2860960 - protein, 6 aa, Entamoeba invadens
GMTKEE

SEQ ID NO: 2860961 - protein, 11 aa, Entamoeba invadens
GMTQNASNKPF

SEQ ID NO: 2860962 - protein, 16 aa, Entamoeba invadens
GMTQQNTLNQTSVQNE

SEQ ID NO: 2860963 - protein, 4 aa, Entamoeba invadens
GMTR

SEQ ID NO: 2860964 - protein, 15 aa, Entamoeba invadens
GMYPTPEEKKEREKA

SEQ ID NO: 2860965 - protein, 5 aa, Entamoeba invadens
GNAAS

SEQ ID NO: 2860966 - protein, 4 aa, Entamoeba invadens
GNAC

SEQ ID NO: 2860967 - protein, 6 aa, Entamoeba invadens
GNADFT

SEQ ID NO: 2860968 - protein, 17 aa, Entamoeba invadens
GNAEKEEKKTKKEKTVK

SEQ ID NO: 2860969 - protein, 9 aa, Entamoeba invadens
GNAENNLKN

SEQ ID NO: 2860970 - protein, 13 aa, Entamoeba invadens
GNAESTTNSVTRA

SEQ ID NO: 2860971 - protein, 6 aa, Entamoeba invadens
GNAGDS

SEQ ID NO: 2860972 - protein, 10 aa, Entamoeba invadens
GNAIPEGTHR

SEQ ID NO: 2860973 - protein, 9 aa, Entamoeba invadens
GNAKPKKKK

SEQ ID NO: 2860974 - protein, 4 aa, Entamoeba invadens
GNAN

SEQ ID NO: 2860975 - protein, 5 aa, Entamoeba invadens
GNANI

SEQ ID NO: 2860976 - protein, 7 aa, Entamoeba invadens
GNAPDGS

SEQ ID NO: 2860977 - protein, 6 aa, Entamoeba invadens
GNAPEI

SEQ ID NO: 2860978 - protein, 11 aa, Entamoeba invadens
GNAPTQGDDTI

SEQ ID NO: 2860979 - protein, 12 aa, Entamoeba invadens
GNAPYSDLNPTA

SEQ ID NO: 2860980 - protein, 13 aa, Entamoeba invadens
GNAQDNRRETTEK

SEQ ID NO: 2860981 - protein, 7 aa, Entamoeba invadens
GNARAKA

SEQ ID NO: 2860982 - protein, 10 aa, Entamoeba invadens
GNASGSFRDK

SEQ ID NO: 2860983 - protein, 13 aa, Entamoeba invadens
GNASVSPTVKNQS

SEQ ID NO: 2860984 - protein, 4 aa, Entamoeba invadens
GNAT

SEQ ID NO: 2860985 - protein, 7 aa, Entamoeba invadens
GNATASE

SEQ ID NO: 2860986 - protein, 14 aa, Entamoeba invadens
GNATDMKLEETDDK

SEQ ID NO: 2860987 - protein, 5 aa, Entamoeba invadens
GNATQ

SEQ ID NO: 2860988 - protein, 6 aa, Entamoeba invadens
GNAWGN

SEQ ID NO: 2860989 - protein, 4 aa, Entamoeba invadens
GNCA

SEQ ID NO: 2860990 - protein, 21 aa, Entamoeba invadens
GNCDPTCGGQCNGSTDVCTGC

SEQ ID NO: 2860991 - protein, 6 aa, Entamoeba invadens
GNCKHH

SEQ ID NO: 2860992 - protein, 5 aa, Entamoeba invadens
GNCPG

SEQ ID NO: 2860993 - protein, 6 aa, Entamoeba invadens
GNCTEC

SEQ ID NO: 2860994 - protein, 7 aa, Entamoeba invadens
GNCTGDN

SEQ ID NO: 2860995 - protein, 4 aa, Entamoeba invadens
GNDA

SEQ ID NO: 2860996 - protein, 6 aa, Entamoeba invadens
GNDAET

SEQ ID NO: 2860997 - protein, 8 aa, Entamoeba invadens
GNDDSKYQ

SEQ ID NO: 2860998 - protein, 7 aa, Entamoeba invadens
GNDDVSY

SEQ ID NO: 2860999 - protein, 5 aa, Entamoeba invadens
GNDGG

SEQ ID NO: 2861000 - protein, 12 aa, Entamoeba invadens
GNDGKRTAKPLK

SEQ ID NO: 2861001 - protein, 5 aa, Entamoeba invadens
GNDGM

SEQ ID NO: 2861002 - protein, 6 aa, Entamoeba invadens
GNDGSL

SEQ ID NO: 2861003 - protein, 7 aa, Entamoeba invadens
GNDGTTR

SEQ ID NO: 2861004 - protein, 4 aa, Entamoeba invadens
GNDI

SEQ ID NO: 2861005 - protein, 6 aa, Entamoeba invadens
GNDKEM

SEQ ID NO: 2861006 - protein, 12 aa, Entamoeba invadens
GNDKKEAGQQQA

SEQ ID NO: 2861007 - protein, 10 aa, Entamoeba invadens
GNDKKPNDSW

SEQ ID NO: 2861008 - protein, 6 aa, Entamoeba invadens
GNDKPL

SEQ ID NO: 2861009 - protein, 8 aa, Entamoeba invadens
GNDKVNSV

SEQ ID NO: 2861010 - protein, 7 aa, Entamoeba invadens
GNDLGDK

SEQ ID NO: 2861011 - protein, 4 aa, Entamoeba invadens
GNDN

SEQ ID NO: 2861012 - protein, 9 aa, Entamoeba invadens
GNDPDVSVR

SEQ ID NO: 2861013 - protein, 17 aa, Entamoeba invadens
GNDRKVEKTLKKEISKK

SEQ ID NO: 2861014 - protein, 10 aa, Entamoeba invadens
GNDRNESVNG

SEQ ID NO: 2861015 - protein, 4 aa, Entamoeba invadens
GNDS

SEQ ID NO: 2861016 - protein, 8 aa, Entamoeba invadens
GNDSEVLE

SEQ ID NO: 2861017 - protein, 7 aa, Entamoeba invadens
GNDSKSI

SEQ ID NO: 2861018 - protein, 4 aa, Entamoeba invadens
GNDY

SEQ ID NO: 2861019 - protein, 5 aa, Entamoeba invadens
GNDYR

SEQ ID NO: 2861020 - protein, 8 aa, Entamoeba invadens
GNEATKLK

SEQ ID NO: 2861021 - protein, 13 aa, Entamoeba invadens
GNEDDNYKSGSSR

SEQ ID NO: 2861022 - protein, 10 aa, Entamoeba invadens
GNEDLKVPRK

SEQ ID NO: 2861023 - protein, 9 aa, Entamoeba invadens
GNEEEEKTH

SEQ ID NO: 2861024 - protein, 6 aa, Entamoeba invadens
GNEEIE

SEQ ID NO: 2861025 - protein, 7 aa, Entamoeba invadens
GNEEKGL

SEQ ID NO: 2861026 - protein, 6 aa, Entamoeba invadens
GNEESA

SEQ ID NO: 2861027 - protein, 7 aa, Entamoeba invadens
GNEFTGE

SEQ ID NO: 2861028 - protein, 16 aa, Entamoeba invadens
GNEGDDSTTEIVEPTA

SEQ ID NO: 2861029 - protein, 7 aa, Entamoeba invadens
GNEGLNT

SEQ ID NO: 2861030 - protein, 7 aa, Entamoeba invadens
GNEHEIS

SEQ ID NO: 2861031 - protein, 4 aa, Entamoeba invadens
GNEI

SEQ ID NO: 2861032 - protein, 7 aa, Entamoeba invadens
GNEIENL

SEQ ID NO: 2861033 - protein, 9 aa, Entamoeba invadens
GNEINNDNN

SEQ ID NO: 2861034 - protein, 6 aa, Entamoeba invadens
GNEKAK

SEQ ID NO: 2861035 - protein, 7 aa, Entamoeba invadens
GNEKDIP

SEQ ID NO: 2861036 - protein, 5 aa, Entamoeba invadens
GNEKN

SEQ ID NO: 2861037 - protein, 11 aa, Entamoeba invadens
GNEKPKAAKPC

SEQ ID NO: 2861038 - protein, 10 aa, Entamoeba invadens
GNEKSETPTF

SEQ ID NO: 2861039 - protein, 9 aa, Entamoeba invadens
GNEKTWDKK

SEQ ID NO: 2861040 - protein, 8 aa, Entamoeba invadens
GNEKYGRV

SEQ ID NO: 2861041 - protein, 4 aa, Entamoeba invadens
GNEL

SEQ ID NO: 2861042 - protein, 7 aa, Entamoeba invadens
GNELSEF

SEQ ID NO: 2861043 - protein, 7 aa, Entamoeba invadens
GNELTLS

SEQ ID NO: 2861044 - protein, 11 aa, Entamoeba invadens
GNELTNLDSND

SEQ ID NO: 2861045 - protein, 6 aa, Entamoeba invadens
GNEMRK

SEQ ID NO: 2861046 - protein, 5 aa, Entamoeba invadens
GNENA

SEQ ID NO: 2861047 - protein, 6 aa, Entamoeba invadens
GNENEL

SEQ ID NO: 2861048 - protein, 20 aa, Entamoeba invadens
GNENKGNDQMSEDELSMNHM

SEQ ID NO: 2861049 - protein, 8 aa, Entamoeba invadens
GNENSQFS

SEQ ID NO: 2861050 - protein, 4 aa, Entamoeba invadens
GNEP

SEQ ID NO: 2861051 - protein, 5 aa, Entamoeba invadens
GNEPC

SEQ ID NO: 2861052 - protein, 8 aa, Entamoeba invadens
GNEPSREY

SEQ ID NO: 2861053 - protein, 5 aa, Entamoeba invadens
GNERR

SEQ ID NO: 2861054 - protein, 8 aa, Entamoeba invadens
GNERTEPI

SEQ ID NO: 2861055 - protein, 6 aa, Entamoeba invadens
GNERVD

SEQ ID NO: 2861056 - protein, 6 aa, Entamoeba invadens
GNESFG

SEQ ID NO: 2861057 - protein, 5 aa, Entamoeba invadens
GNESI

SEQ ID NO: 2861058 - protein, 4 aa, Entamoeba invadens
GNET

SEQ ID NO: 2861059 - protein, 7 aa, Entamoeba invadens
GNETFPR

SEQ ID NO: 2861060 - protein, 5 aa, Entamoeba invadens
GNEVK

SEQ ID NO: 2861061 - protein, 8 aa, Entamoeba invadens
GNEVNREN

SEQ ID NO: 2861062 - protein, 9 aa, Entamoeba invadens
GNFAKKREA

SEQ ID NO: 2861063 - protein, 6 aa, Entamoeba invadens
GNFDED

SEQ ID NO: 2861064 - protein, 9 aa, Entamoeba invadens
GNFEAGEPV

SEQ ID NO: 2861065 - protein, 20 aa, Entamoeba invadens
GNFESIGKSGRKGKSTTDCG

SEQ ID NO: 2861066 - protein, 5 aa, Entamoeba invadens
GNFGV

SEQ ID NO: 2861067 - protein, 6 aa, Entamoeba invadens
GNFKGV

SEQ ID NO: 2861068 - protein, 10 aa, Entamoeba invadens
GNFPGSQEKY

SEQ ID NO: 2861069 - protein, 7 aa, Entamoeba invadens
GNFSPDD

SEQ ID NO: 2861070 - protein, 4 aa, Entamoeba invadens
GNGA

SEQ ID NO: 2861071 - protein, 8 aa, Entamoeba invadens
GNGFSAGE

SEQ ID NO: 2861072 - protein, 12 aa, Entamoeba invadens
GNGIYTRRGGDV

SEQ ID NO: 2861073 - protein, 8 aa, Entamoeba invadens
GNGKINKR

SEQ ID NO: 2861074 - protein, 13 aa, Entamoeba invadens
GNGKKEKKGPYTL

SEQ ID NO: 2861075 - protein, 10 aa, Entamoeba invadens
GNGKVNADEA

SEQ ID NO: 2861076 - protein, 6 aa, Entamoeba invadens
GNGLTK

SEQ ID NO: 2861077 - protein, 8 aa, Entamoeba invadens
GNGPIDGL

SEQ ID NO: 2861078 - protein, 22 aa, Entamoeba invadens
GNGPLTEKECDEKYRDAINEKE

SEQ ID NO: 2861079 - protein, 7 aa, Entamoeba invadens
GNGQIPQ

SEQ ID NO: 2861080 - protein, 28 aa, Entamoeba invadens
GNGQNNDPISGQQQSTNPVLNTPTTSSL

SEQ ID NO: 2861081 - protein, 6 aa, Entamoeba invadens
GNGRPG

SEQ ID NO: 2861082 - protein, 10 aa, Entamoeba invadens
GNGRYDQEKL

SEQ ID NO: 2861083 - protein, 5 aa, Entamoeba invadens
GNGTE

SEQ ID NO: 2861084 - protein, 5 aa, Entamoeba invadens
GNGTI

SEQ ID NO: 2861085 - protein, 14 aa, Entamoeba invadens
GNGTLDDTLEENKA

SEQ ID NO: 2861086 - protein, 4 aa, Entamoeba invadens
GNGV

SEQ ID NO: 2861087 - protein, 7 aa, Entamoeba invadens
GNGVDAL

SEQ ID NO: 2861088 - protein, 7 aa, Entamoeba invadens
GNGVEGA

SEQ ID NO: 2861089 - protein, 8 aa, Entamoeba invadens
GNGWTRSS

SEQ ID NO: 2861090 - protein, 11 aa, Entamoeba invadens
GNGYQDDPNKY

SEQ ID NO: 2861091 - protein, 7 aa, Entamoeba invadens
GNHDPTT

SEQ ID NO: 2861092 - protein, 4 aa, Entamoeba invadens
GNHE

SEQ ID NO: 2861093 - protein, 5 aa, Entamoeba invadens
GNHMA

SEQ ID NO: 2861094 - protein, 13 aa, Entamoeba invadens
GNHSRNNNVANSP

SEQ ID NO: 2861095 - protein, 7 aa, Entamoeba invadens
GNIAAYG

SEQ ID NO: 2861096 - protein, 6 aa, Entamoeba invadens
GNIEAQ

SEQ ID NO: 2861097 - protein, 5 aa, Entamoeba invadens
GNIEI

SEQ ID NO: 2861098 - protein, 6 aa, Entamoeba invadens
GNIENA

SEQ ID NO: 2861099 - protein, 5 aa, Entamoeba invadens
GNIKP

SEQ ID NO: 2861100 - protein, 34 aa, Entamoeba invadens
GNIKRGKEDLGKLTTEYKKLEADNQRLQNEITEH

SEQ ID NO: 2861101 - protein, 8 aa, Entamoeba invadens
GNIKRNGS

SEQ ID NO: 2861102 - protein, 7 aa, Entamoeba invadens
GNIMPPK

SEQ ID NO: 2861103 - protein, 5 aa, Entamoeba invadens
GNIMS

SEQ ID NO: 2861104 - protein, 24 aa, Entamoeba invadens
GNIMSNSKMEEEEPAPLSDEVQKE

SEQ ID NO: 2861105 - protein, 5 aa, Entamoeba invadens
GNIPN

SEQ ID NO: 2861106 - protein, 13 aa, Entamoeba invadens
GNISEDDDGTDIF

SEQ ID NO: 2861107 - protein, 7 aa, Entamoeba invadens
GNISPID

SEQ ID NO: 2861108 - protein, 12 aa, Entamoeba invadens
GNITEKQVRKRV

SEQ ID NO: 2861109 - protein, 10 aa, Entamoeba invadens
GNITEYKTEY

SEQ ID NO: 2861110 - protein, 10 aa, Entamoeba invadens
GNITNEDEKR

SEQ ID NO: 2861111 - protein, 14 aa, Entamoeba invadens
GNKAILNKETEQYI

SEQ ID NO: 2861112 - protein, 17 aa, Entamoeba invadens
GNKCKDREYTKEEWTDS

SEQ ID NO: 2861113 - protein, 6 aa, Entamoeba invadens
GNKCPE

SEQ ID NO: 2861114 - protein, 10 aa, Entamoeba invadens
GNKDATNKAQ

SEQ ID NO: 2861115 - protein, 8 aa, Entamoeba invadens
GNKDGKIS

SEQ ID NO: 2861116 - protein, 7 aa, Entamoeba invadens
GNKDRVD

SEQ ID NO: 2861117 - protein, 6 aa, Entamoeba invadens
GNKDSV

SEQ ID NO: 2861118 - protein, 11 aa, Entamoeba invadens
GNKDTYVGDEA

SEQ ID NO: 2861119 - protein, 9 aa, Entamoeba invadens
GNKENSNLV

SEQ ID NO: 2861120 - protein, 6 aa, Entamoeba invadens
GNKERV

SEQ ID NO: 2861121 - protein, 6 aa, Entamoeba invadens
GNKESA

SEQ ID NO: 2861122 - protein, 12 aa, Entamoeba invadens
GNKGDDKYYGES

SEQ ID NO: 2861123 - protein, 18 aa, Entamoeba invadens
GNKGEVSLDSNLYHTVFG

SEQ ID NO: 2861124 - protein, 8 aa, Entamoeba invadens
GNKGSTIK

SEQ ID NO: 2861125 - protein, 15 aa, Entamoeba invadens
GNKIPKKEKQLLNLL

SEQ ID NO: 2861126 - protein, 13 aa, Entamoeba invadens
GNKKSKISTPQNT

SEQ ID NO: 2861127 - protein, 8 aa, Entamoeba invadens
GNKKVRGV

SEQ ID NO: 2861128 - protein, 17 aa, Entamoeba invadens
GNKNFPGSQPGESPDVP

SEQ ID NO: 2861129 - protein, 11 aa, Entamoeba invadens
GNKNTKTQDEL

SEQ ID NO: 2861130 - protein, 8 aa, Entamoeba invadens
GNKSDASN

SEQ ID NO: 2861131 - protein, 14 aa, Entamoeba invadens
GNKSDLTSAINESD

SEQ ID NO: 2861132 - protein, 5 aa, Entamoeba invadens
GNKSG

SEQ ID NO: 2861133 - protein, 8 aa, Entamoeba invadens
GNKSPEVK

SEQ ID NO: 2861134 - protein, 5 aa, Entamoeba invadens
GNKTQ

SEQ ID NO: 2861135 - protein, 7 aa, Entamoeba invadens
GNKTRLS

SEQ ID NO: 2861136 - protein, 10 aa, Entamoeba invadens
GNKTTTTQAR

SEQ ID NO: 2861137 - protein, 4 aa, Entamoeba invadens
GNKV

SEQ ID NO: 2861138 - protein, 6 aa, Entamoeba invadens
GNKVSP

SEQ ID NO: 2861139 - protein, 11 aa, Entamoeba invadens
GNKYSEKADKW

SEQ ID NO: 2861140 - protein, 7 aa, Entamoeba invadens
GNLDSGH

SEQ ID NO: 2861141 - protein, 6 aa, Entamoeba invadens
GNLEAT

SEQ ID NO: 2861142 - protein, 5 aa, Entamoeba invadens
GNLEK

SEQ ID NO: 2861143 - protein, 18 aa, Entamoeba invadens
GNLEQELPSEYNSYSEPS

SEQ ID NO: 2861144 - protein, 12 aa, Entamoeba invadens
GNLHKEEDEKVE

SEQ ID NO: 2861145 - protein, 8 aa, Entamoeba invadens
GNLKSDKL

SEQ ID NO: 2861146 - protein, 5 aa, Entamoeba invadens
GNLPG

SEQ ID NO: 2861147 - protein, 8 aa, Entamoeba invadens
GNLPPQQI

SEQ ID NO: 2861148 - protein, 5 aa, Entamoeba invadens
GNLPY

SEQ ID NO: 2861149 - protein, 5 aa, Entamoeba invadens
GNLQQ

SEQ ID NO: 2861150 - protein, 7 aa, Entamoeba invadens
GNLSDNL

SEQ ID NO: 2861151 - protein, 7 aa, Entamoeba invadens
GNLTAEE

SEQ ID NO: 2861152 - protein, 7 aa, Entamoeba invadens
GNLTPDT

SEQ ID NO: 2861153 - protein, 10 aa, Entamoeba invadens
GNLTVDGEIE

SEQ ID NO: 2861154 - protein, 12 aa, Entamoeba invadens
GNLVDKDDSISA

SEQ ID NO: 2861155 - protein, 13 aa, Entamoeba invadens
GNLVGDRSKGFTD

SEQ ID NO: 2861156 - protein, 5 aa, Entamoeba invadens
GNLYQ

SEQ ID NO: 2861157 - protein, 7 aa, Entamoeba invadens
GNLYQSP

SEQ ID NO: 2861158 - protein, 5 aa, Entamoeba invadens
GNMAA

SEQ ID NO: 2861159 - protein, 4 aa, Entamoeba invadens
GNMG

SEQ ID NO: 2861160 - protein, 5 aa, Entamoeba invadens
GNMKD

SEQ ID NO: 2861161 - protein, 4 aa, Entamoeba invadens
GNMQ

SEQ ID NO: 2861162 - protein, 7 aa, Entamoeba invadens
GNMRPEP

SEQ ID NO: 2861163 - protein, 6 aa, Entamoeba invadens
GNMRTL

SEQ ID NO: 2861164 - protein, 5 aa, Entamoeba invadens
GNMSY

SEQ ID NO: 2861165 - protein, 5 aa, Entamoeba invadens
GNNAD

SEQ ID NO: 2861166 - protein, 5 aa, Entamoeba invadens
GNNAF

SEQ ID NO: 2861167 - protein, 7 aa, Entamoeba invadens
GNNDDKF

SEQ ID NO: 2861168 - protein, 7 aa, Entamoeba invadens
GNNDTKS

SEQ ID NO: 2861169 - protein, 6 aa, Entamoeba invadens
GNNEEI

SEQ ID NO: 2861170 - protein, 16 aa, Entamoeba invadens
GNNFAKEYEQANEMRT

SEQ ID NO: 2861171 - protein, 6 aa, Entamoeba invadens
GNNFTS

SEQ ID NO: 2861172 - protein, 9 aa, Entamoeba invadens
GNNGAKNAF

SEQ ID NO: 2861173 - protein, 10 aa, Entamoeba invadens
GNNGDTQKFS

SEQ ID NO: 2861174 - protein, 9 aa, Entamoeba invadens
GNNGTSDTI

SEQ ID NO: 2861175 - protein, 4 aa, Entamoeba invadens
GNNH

SEQ ID NO: 2861176 - protein, 9 aa, Entamoeba invadens
GNNIPPNIT

SEQ ID NO: 2861177 - protein, 9 aa, Entamoeba invadens
GNNITEGGH

SEQ ID NO: 2861178 - protein, 4 aa, Entamoeba invadens
GNNK

SEQ ID NO: 2861179 - protein, 8 aa, Entamoeba invadens
GNNKKNVQ

SEQ ID NO: 2861180 - protein, 12 aa, Entamoeba invadens
GNNQENDEQLES

SEQ ID NO: 2861181 - protein, 13 aa, Entamoeba invadens
GNNRYQTNKQKYQ

SEQ ID NO: 2861182 - protein, 17 aa, Entamoeba invadens
GNNSACTRSSSHTFSNT

SEQ ID NO: 2861183 - protein, 6 aa, Entamoeba invadens
GNNSDV

SEQ ID NO: 2861184 - protein, 6 aa, Entamoeba invadens
GNNSFE

SEQ ID NO: 2861185 - protein, 8 aa, Entamoeba invadens
GNNSFNGC

SEQ ID NO: 2861186 - protein, 10 aa, Entamoeba invadens
GNNSVKFNTK

SEQ ID NO: 2861187 - protein, 5 aa, Entamoeba invadens
GNNTI

SEQ ID NO: 2861188 - protein, 8 aa, Entamoeba invadens
GNNTKSDF

SEQ ID NO: 2861189 - protein, 5 aa, Entamoeba invadens
GNNTL

SEQ ID NO: 2861190 - protein, 7 aa, Entamoeba invadens
GNNTTSK

SEQ ID NO: 2861191 - protein, 4 aa, Entamoeba invadens
GNNV

SEQ ID NO: 2861192 - protein, 7 aa, Entamoeba invadens
GNNVMDK

SEQ ID NO: 2861193 - protein, 6 aa, Entamoeba invadens
GNNVPG

SEQ ID NO: 2861194 - protein, 11 aa, Entamoeba invadens
GNPANLNPLSP

SEQ ID NO: 2861195 - protein, 15 aa, Entamoeba invadens
GNPASLDPLAPEEMG

SEQ ID NO: 2861196 - protein, 9 aa, Entamoeba invadens
GNPDFNRKT

SEQ ID NO: 2861197 - protein, 6 aa, Entamoeba invadens
GNPDFV

SEQ ID NO: 2861198 - protein, 6 aa, Entamoeba invadens
GNPDME

SEQ ID NO: 2861199 - protein, 8 aa, Entamoeba invadens
GNPDPSPI

SEQ ID NO: 2861200 - protein, 11 aa, Entamoeba invadens
GNPEENGLYDP

SEQ ID NO: 2861201 - protein, 7 aa, Entamoeba invadens
GNPESLP

SEQ ID NO: 2861202 - protein, 8 aa, Entamoeba invadens
GNPFGDIS

SEQ ID NO: 2861203 - protein, 9 aa, Entamoeba invadens
GNPFTSPKV

SEQ ID NO: 2861204 - protein, 9 aa, Entamoeba invadens
GNPGNTLIS

SEQ ID NO: 2861205 - protein, 7 aa, Entamoeba invadens
GNPIAED

SEQ ID NO: 2861206 - protein, 5 aa, Entamoeba invadens
GNPID

SEQ ID NO: 2861207 - protein, 7 aa, Entamoeba invadens
GNPITDQ

SEQ ID NO: 2861208 - protein, 7 aa, Entamoeba invadens
GNPKGPI

SEQ ID NO: 2861209 - protein, 19 aa, Entamoeba invadens
GNPKSKVKVPSLYSPPSYV

SEQ ID NO: 2861210 - protein, 4 aa, Entamoeba invadens
GNPL

SEQ ID NO: 2861211 - protein, 15 aa, Entamoeba invadens
GNPLQSSSSGVQSLS

SEQ ID NO: 2861212 - protein, 6 aa, Entamoeba invadens
GNPLTG

SEQ ID NO: 2861213 - protein, 6 aa, Entamoeba invadens
GNPNSL

SEQ ID NO: 2861214 - protein, 7 aa, Entamoeba invadens
GNPPLPQ

SEQ ID NO: 2861215 - protein, 18 aa, Entamoeba invadens
GNPPNIQQLPSSPSEKDI

SEQ ID NO: 2861216 - protein, 5 aa, Entamoeba invadens
GNPPY

SEQ ID NO: 2861217 - protein, 9 aa, Entamoeba invadens
GNPPYYDLP

SEQ ID NO: 2861218 - protein, 6 aa, Entamoeba invadens
GNPQES

SEQ ID NO: 2861219 - protein, 8 aa, Entamoeba invadens
GNPQPEKL

SEQ ID NO: 2861220 - protein, 4 aa, Entamoeba invadens
GNPS

SEQ ID NO: 2861221 - protein, 8 aa, Entamoeba invadens
GNPSDDVG

SEQ ID NO: 2861222 - protein, 7 aa, Entamoeba invadens
GNPSKDE

SEQ ID NO: 2861223 - protein, 6 aa, Entamoeba invadens
GNPSVE

SEQ ID NO: 2861224 - protein, 6 aa, Entamoeba invadens
GNPSWQ

SEQ ID NO: 2861225 - protein, 7 aa, Entamoeba invadens
GNPTAKC

SEQ ID NO: 2861226 - protein, 6 aa, Entamoeba invadens
GNPTQW

SEQ ID NO: 2861227 - protein, 5 aa, Entamoeba invadens
GNPYR

SEQ ID NO: 2861228 - protein, 9 aa, Entamoeba invadens
GNQGKQKAT

SEQ ID NO: 2861229 - protein, 5 aa, Entamoeba invadens
GNQKM

SEQ ID NO: 2861230 - protein, 10 aa, Entamoeba invadens
GNQKTVQEMR

SEQ ID NO: 2861231 - protein, 4 aa, Entamoeba invadens
GNQL

SEQ ID NO: 2861232 - protein, 16 aa, Entamoeba invadens
GNQLAKQAETKYEKEA

SEQ ID NO: 2861233 - protein, 5 aa, Entamoeba invadens
GNQLQ

SEQ ID NO: 2861234 - protein, 8 aa, Entamoeba invadens
GNQPKAVE

SEQ ID NO: 2861235 - protein, 20 aa, Entamoeba invadens
GNQQGLANTQGQQMQQQPNM

SEQ ID NO: 2861236 - protein, 7 aa, Entamoeba invadens
GNQSQYT

SEQ ID NO: 2861237 - protein, 7 aa, Entamoeba invadens
GNQTKKY

SEQ ID NO: 2861238 - protein, 7 aa, Entamoeba invadens
GNQTRSI

SEQ ID NO: 2861239 - protein, 4 aa, Entamoeba invadens
GNQY

SEQ ID NO: 2861240 - protein, 23 aa, Entamoeba invadens
GNRARKVEEVQSEEVEEPEERKM

SEQ ID NO: 2861241 - protein, 6 aa, Entamoeba invadens
GNRDQT

SEQ ID NO: 2861242 - protein, 9 aa, Entamoeba invadens
GNRGGFGGG

SEQ ID NO: 2861243 - protein, 8 aa, Entamoeba invadens
GNRKIQAR

SEQ ID NO: 2861244 - protein, 14 aa, Entamoeba invadens
GNRLEKDDNISTEE

SEQ ID NO: 2861245 - protein, 5 aa, Entamoeba invadens
GNRLS

SEQ ID NO: 2861246 - protein, 13 aa, Entamoeba invadens
GNRMQKPDTIGDK

SEQ ID NO: 2861247 - protein, 7 aa, Entamoeba invadens
GNRQLKG

SEQ ID NO: 2861248 - protein, 5 aa, Entamoeba invadens
GNRSH

SEQ ID NO: 2861249 - protein, 22 aa, Entamoeba invadens
GNRSLSNSQIQPSTTQRQKERI

SEQ ID NO: 2861250 - protein, 7 aa, Entamoeba invadens
GNRSLTS

SEQ ID NO: 2861251 - protein, 7 aa, Entamoeba invadens
GNRSQVV

SEQ ID NO: 2861252 - protein, 8 aa, Entamoeba invadens
GNSAASNY

SEQ ID NO: 2861253 - protein, 7 aa, Entamoeba invadens
GNSADEV

SEQ ID NO: 2861254 - protein, 10 aa, Entamoeba invadens
GNSDAVPETQ

SEQ ID NO: 2861255 - protein, 4 aa, Entamoeba invadens
GNSE

SEQ ID NO: 2861256 - protein, 21 aa, Entamoeba invadens
GNSERAKAVPVAKPKTKRKNA

SEQ ID NO: 2861257 - protein, 13 aa, Entamoeba invadens
GNSEVSGSCSEQN

SEQ ID NO: 2861258 - protein, 5 aa, Entamoeba invadens
GNSFA

SEQ ID NO: 2861259 - protein, 4 aa, Entamoeba invadens
GNSG

SEQ ID NO: 2861260 - protein, 15 aa, Entamoeba invadens
GNSGRLSSTARHGKR

SEQ ID NO: 2861261 - protein, 8 aa, Entamoeba invadens
GNSKKGVT

SEQ ID NO: 2861262 - protein, 5 aa, Entamoeba invadens
GNSLL

SEQ ID NO: 2861263 - protein, 5 aa, Entamoeba invadens
GNSLS

SEQ ID NO: 2861264 - protein, 5 aa, Entamoeba invadens
GNSLT

SEQ ID NO: 2861265 - protein, 18 aa, Entamoeba invadens
GNSLTSKSATVATYASSG

SEQ ID NO: 2861266 - protein, 5 aa, Entamoeba invadens
GNSNE

SEQ ID NO: 2861267 - protein, 7 aa, Entamoeba invadens
GNSNTQI

SEQ ID NO: 2861268 - protein, 8 aa, Entamoeba invadens
GNSPTELL

SEQ ID NO: 2861269 - protein, 15 aa, Entamoeba invadens
GNSPVSQDNTSVNKE

SEQ ID NO: 2861270 - protein, 4 aa, Entamoeba invadens
GNSQ

SEQ ID NO: 2861271 - protein, 7 aa, Entamoeba invadens
GNSQGMT

SEQ ID NO: 2861272 - protein, 6 aa, Entamoeba invadens
GNSRGV

SEQ ID NO: 2861273 - protein, 5 aa, Entamoeba invadens
GNSRI

SEQ ID NO: 2861274 - protein, 6 aa, Entamoeba invadens
GNSRTQ

SEQ ID NO: 2861275 - protein, 7 aa, Entamoeba invadens
GNSSKNN

SEQ ID NO: 2861276 - protein, 14 aa, Entamoeba invadens
GNSSNLNNDDLKSQ

SEQ ID NO: 2861277 - protein, 8 aa, Entamoeba invadens
GNSSVGDV

SEQ ID NO: 2861278 - protein, 8 aa, Entamoeba invadens
GNSTCNSC

SEQ ID NO: 2861279 - protein, 14 aa, Entamoeba invadens
GNSTDVHPSSEDAQ

SEQ ID NO: 2861280 - protein, 7 aa, Entamoeba invadens
GNSTEEI

SEQ ID NO: 2861281 - protein, 8 aa, Entamoeba invadens
GNSTFSDH

SEQ ID NO: 2861282 - protein, 8 aa, Entamoeba invadens
GNSTIPND

SEQ ID NO: 2861283 - protein, 7 aa, Entamoeba invadens
GNSTLPS

SEQ ID NO: 2861284 - protein, 7 aa, Entamoeba invadens
GNSTQSV

SEQ ID NO: 2861285 - protein, 18 aa, Entamoeba invadens
GNSTTSSLFGNQQQSNNL

SEQ ID NO: 2861286 - protein, 13 aa, Entamoeba invadens
GNSVAVSDTKGKV

SEQ ID NO: 2861287 - protein, 8 aa, Entamoeba invadens
GNSVDKKT

SEQ ID NO: 2861288 - protein, 5 aa, Entamoeba invadens
GNSVE

SEQ ID NO: 2861289 - protein, 5 aa, Entamoeba invadens
GNSVK

SEQ ID NO: 2861290 - protein, 11 aa, Entamoeba invadens
GNSYNKCESCA

SEQ ID NO: 2861291 - protein, 8 aa, Entamoeba invadens
GNSYRNKT

SEQ ID NO: 2861292 - protein, 8 aa, Entamoeba invadens
GNTADKAY

SEQ ID NO: 2861293 - protein, 9 aa, Entamoeba invadens
GNTEAWKSS

SEQ ID NO: 2861294 - protein, 9 aa, Entamoeba invadens
GNTEEFTKE

SEQ ID NO: 2861295 - protein, 19 aa, Entamoeba invadens
GNTENDKDNGTAAVADTQL

SEQ ID NO: 2861296 - protein, 9 aa, Entamoeba invadens
GNTENTHGK

SEQ ID NO: 2861297 - protein, 10 aa, Entamoeba invadens
GNTEYQNLKQ

SEQ ID NO: 2861298 - protein, 9 aa, Entamoeba invadens
GNTGNAQLA

SEQ ID NO: 2861299 - protein, 20 aa, Entamoeba invadens
GNTGPSQQAVQTISTSKKIE

SEQ ID NO: 2861300 - protein, 10 aa, Entamoeba invadens
GNTIDQIGTR

SEQ ID NO: 2861301 - protein, 13 aa, Entamoeba invadens
GNTKNELQAALGT

SEQ ID NO: 2861302 - protein, 4 aa, Entamoeba invadens
GNTL

SEQ ID NO: 2861303 - protein, 47 aa, Entamoeba invadens
GNTLENSDLPPLPPGLAPPDGMLPPPGLAPPGGMLPPPGLAPPGGLM

SEQ ID NO: 2861304 - protein, 12 aa, Entamoeba invadens
GNTNGRRQCEEL

SEQ ID NO: 2861305 - protein, 6 aa, Entamoeba invadens
GNTNKR

SEQ ID NO: 2861306 - protein, 10 aa, Entamoeba invadens
GNTNKTTKVE

SEQ ID NO: 2861307 - protein, 11 aa, Entamoeba invadens
GNTNMTNNNTL

SEQ ID NO: 2861308 - protein, 5 aa, Entamoeba invadens
GNTNP

SEQ ID NO: 2861309 - protein, 56 aa, Entamoeba invadens
GNTNSAMGQPNSLYGGQQPQATNSLFGGNTNPMGQNPGNVLGQNGMTQQNNPMGLQ

SEQ ID NO: 2861310 - protein, 14 aa, Entamoeba invadens
GNTPHQSYSNPINP

SEQ ID NO: 2861311 - protein, 7 aa, Entamoeba invadens
GNTPPFV

SEQ ID NO: 2861312 - protein, 34 aa, Entamoeba invadens
GNTPSQIGSNPLMGGQPQNNLFGGNTQQQSGLGG

SEQ ID NO: 2861313 - protein, 26 aa, Entamoeba invadens
GNTPTPFHSTTDKLSDKQPQTDDDRI

SEQ ID NO: 2861314 - protein, 13 aa, Entamoeba invadens
GNTQDGASANMGC

SEQ ID NO: 2861315 - protein, 10 aa, Entamoeba invadens
GNTQPPPNFD

SEQ ID NO: 2861316 - protein, 22 aa, Entamoeba invadens
GNTQQNTFGQQPTQPNSLFGNT

SEQ ID NO: 2861317 - protein, 35 aa, Entamoeba invadens
GNTQQQMGSTNTNMMGNQQQNSLFGSTSLQQGGLG

SEQ ID NO: 2861318 - protein, 10 aa, Entamoeba invadens
GNTQTGFGTM

SEQ ID NO: 2861319 - protein, 8 aa, Entamoeba invadens
GNTRKASQ

SEQ ID NO: 2861320 - protein, 19 aa, Entamoeba invadens
GNTRRTKGCGFRGTPRYAA

SEQ ID NO: 2861321 - protein, 11 aa, Entamoeba invadens
GNTSLNDGQAQ

SEQ ID NO: 2861322 - protein, 4 aa, Entamoeba invadens
GNTT

SEQ ID NO: 2861323 - protein, 8 aa, Entamoeba invadens
GNTTASPA

SEQ ID NO: 2861324 - protein, 18 aa, Entamoeba invadens
GNTTKKTAKRRIQPTKRR

SEQ ID NO: 2861325 - protein, 6 aa, Entamoeba invadens
GNTTNH

SEQ ID NO: 2861326 - protein, 8 aa, Entamoeba invadens
GNTTNVQT

SEQ ID NO: 2861327 - protein, 8 aa, Entamoeba invadens
GNTTPTAS

SEQ ID NO: 2861328 - protein, 7 aa, Entamoeba invadens
GNTTPVP

SEQ ID NO: 2861329 - protein, 7 aa, Entamoeba invadens
GNTTTRV

SEQ ID NO: 2861330 - protein, 9 aa, Entamoeba invadens
GNTTTTQTL

SEQ ID NO: 2861331 - protein, 4 aa, Entamoeba invadens
GNTV

SEQ ID NO: 2861332 - protein, 6 aa, Entamoeba invadens
GNTVTL

SEQ ID NO: 2861333 - protein, 4 aa, Entamoeba invadens
GNTY

SEQ ID NO: 2861334 - protein, 4 aa, Entamoeba invadens
GNVD

SEQ ID NO: 2861335 - protein, 9 aa, Entamoeba invadens
GNVDIANSD

SEQ ID NO: 2861336 - protein, 20 aa, Entamoeba invadens
GNVFGSYNSTKIQPDTGAVW

SEQ ID NO: 2861337 - protein, 8 aa, Entamoeba invadens
GNVHSNTT

SEQ ID NO: 2861338 - protein, 6 aa, Entamoeba invadens
GNVKDK

SEQ ID NO: 2861339 - protein, 9 aa, Entamoeba invadens
GNVNDDTTY

SEQ ID NO: 2861340 - protein, 5 aa, Entamoeba invadens
GNVNQ

SEQ ID NO: 2861341 - protein, 6 aa, Entamoeba invadens
GNVNSL

SEQ ID NO: 2861342 - protein, 15 aa, Entamoeba invadens
GNVNVQDKEGETPLH

SEQ ID NO: 2861343 - protein, 7 aa, Entamoeba invadens
GNVNVRP

SEQ ID NO: 2861344 - protein, 9 aa, Entamoeba invadens
GNVPKSPPI

SEQ ID NO: 2861345 - protein, 8 aa, Entamoeba invadens
GNVPQTTG

SEQ ID NO: 2861346 - protein, 5 aa, Entamoeba invadens
GNVQP

SEQ ID NO: 2861347 - protein, 6 aa, Entamoeba invadens
GNVQSN

SEQ ID NO: 2861348 - protein, 5 aa, Entamoeba invadens
GNVSA

SEQ ID NO: 2861349 - protein, 8 aa, Entamoeba invadens
GNVSYPSD

SEQ ID NO: 2861350 - protein, 4 aa, Entamoeba invadens
GNVT

SEQ ID NO: 2861351 - protein, 7 aa, Entamoeba invadens
GNVTASS

SEQ ID NO: 2861352 - protein, 7 aa, Entamoeba invadens
GNVTESW

SEQ ID NO: 2861353 - protein, 4 aa, Entamoeba invadens
GNYE

SEQ ID NO: 2861354 - protein, 5 aa, Entamoeba invadens
GNYEA

SEQ ID NO: 2861355 - protein, 7 aa, Entamoeba invadens
GNYIGRS

SEQ ID NO: 2861356 - protein, 5 aa, Entamoeba invadens
GNYKK

SEQ ID NO: 2861357 - protein, 13 aa, Entamoeba invadens
GNYLEKPEKTPQA

SEQ ID NO: 2861358 - protein, 4 aa, Entamoeba invadens
GNYP

SEQ ID NO: 2861359 - protein, 4 aa, Entamoeba invadens
GNYQ

SEQ ID NO: 2861360 - protein, 9 aa, Entamoeba invadens
GNYQNSSAY

SEQ ID NO: 2861361 - protein, 6 aa, Entamoeba invadens
GNYQVQ

SEQ ID NO: 2861362 - protein, 5 aa, Entamoeba invadens
GNYST

SEQ ID NO: 2861363 - protein, 7 aa, Entamoeba invadens
GNYSTSD

SEQ ID NO: 2861364 - protein, 5 aa, Entamoeba invadens
GNYTE

SEQ ID NO: 2861365 - protein, 5 aa, Entamoeba invadens
GNYTL

SEQ ID NO: 2861366 - protein, 8 aa, Entamoeba invadens
GNYTNNCD

SEQ ID NO: 2861367 - protein, 6 aa, Entamoeba invadens
GPAAKD

SEQ ID NO: 2861368 - protein, 8 aa, Entamoeba invadens
GPAKMQKY

SEQ ID NO: 2861369 - protein, 4 aa, Entamoeba invadens
GPAP

SEQ ID NO: 2861370 - protein, 10 aa, Entamoeba invadens
GPAPEQGKYT

SEQ ID NO: 2861371 - protein, 23 aa, Entamoeba invadens
GPAPQRKTRKKVVSAERTSKFDP

SEQ ID NO: 2861372 - protein, 21 aa, Entamoeba invadens
GPAQPVQQGAPMQQQGAPATS

SEQ ID NO: 2861373 - protein, 7 aa, Entamoeba invadens
GPAQQKL

SEQ ID NO: 2861374 - protein, 4 aa, Entamoeba invadens
GPAR

SEQ ID NO: 2861375 - protein, 8 aa, Entamoeba invadens
GPCPDTVN

SEQ ID NO: 2861376 - protein, 6 aa, Entamoeba invadens
GPCYDD

SEQ ID NO: 2861377 - protein, 9 aa, Entamoeba invadens
GPDDLARSE

SEQ ID NO: 2861378 - protein, 4 aa, Entamoeba invadens
GPDF

SEQ ID NO: 2861379 - protein, 6 aa, Entamoeba invadens
GPDIRG

SEQ ID NO: 2861380 - protein, 13 aa, Entamoeba invadens
GPDLPIRRESSIR

SEQ ID NO: 2861381 - protein, 13 aa, Entamoeba invadens
GPDLPISRESSIR

SEQ ID NO: 2861382 - protein, 7 aa, Entamoeba invadens
GPDRSIG

SEQ ID NO: 2861383 - protein, 9 aa, Entamoeba invadens
GPDSQRTKT

SEQ ID NO: 2861384 - protein, 11 aa, Entamoeba invadens
GPDSSSPSPIY

SEQ ID NO: 2861385 - protein, 18 aa, Entamoeba invadens
GPDTVSKINEVTQHLKLL

SEQ ID NO: 2861386 - protein, 6 aa, Entamoeba invadens
GPEFTS

SEQ ID NO: 2861387 - protein, 9 aa, Entamoeba invadens
GPEGQSSFV

SEQ ID NO: 2861388 - protein, 5 aa, Entamoeba invadens
GPEHP

SEQ ID NO: 2861389 - protein, 4 aa, Entamoeba invadens
GPEM

SEQ ID NO: 2861390 - protein, 15 aa, Entamoeba invadens
GPERNPIRSEDARFS

SEQ ID NO: 2861391 - protein, 6 aa, Entamoeba invadens
GPFASR

SEQ ID NO: 2861392 - protein, 5 aa, Entamoeba invadens
GPFKE

SEQ ID NO: 2861393 - protein, 9 aa, Entamoeba invadens
GPFPNNGGT

SEQ ID NO: 2861394 - protein, 6 aa, Entamoeba invadens
GPFSEP

SEQ ID NO: 2861395 - protein, 4 aa, Entamoeba invadens
GPGA

SEQ ID NO: 2861396 - protein, 11 aa, Entamoeba invadens
GPGAGKGTQCE

SEQ ID NO: 2861397 - protein, 5 aa, Entamoeba invadens
GPGDV

SEQ ID NO: 2861398 - protein, 4 aa, Entamoeba invadens
GPGE

SEQ ID NO: 2861399 - protein, 19 aa, Entamoeba invadens
GPGGLRRETSYNQERVESN

SEQ ID NO: 2861400 - protein, 19 aa, Entamoeba invadens
GPGGLRRETSYNQERVETN

SEQ ID NO: 2861401 - protein, 16 aa, Entamoeba invadens
GPGKGNGGAVCGRDGG

SEQ ID NO: 2861402 - protein, 7 aa, Entamoeba invadens
GPGLKTG

SEQ ID NO: 2861403 - protein, 10 aa, Entamoeba invadens
GPGLNRAGKF

SEQ ID NO: 2861404 - protein, 9 aa, Entamoeba invadens
GPGQLKSGL

SEQ ID NO: 2861405 - protein, 15 aa, Entamoeba invadens
GPGSSPEMKTQASAG

SEQ ID NO: 2861406 - protein, 7 aa, Entamoeba invadens
GPGTGNL

SEQ ID NO: 2861407 - protein, 4 aa, Entamoeba invadens
GPIA

SEQ ID NO: 2861408 - protein, 16 aa, Entamoeba invadens
GPIDEPENSFLKTKIV

SEQ ID NO: 2861409 - protein, 10 aa, Entamoeba invadens
GPIEDDTLNK

SEQ ID NO: 2861410 - protein, 4 aa, Entamoeba invadens
GPIG

SEQ ID NO: 2861411 - protein, 8 aa, Entamoeba invadens
GPIGEEPK

SEQ ID NO: 2861412 - protein, 13 aa, Entamoeba invadens
GPINKEKKKFKRN

SEQ ID NO: 2861413 - protein, 14 aa, Entamoeba invadens
GPISSQKEYDPRHP

SEQ ID NO: 2861414 - protein, 10 aa, Entamoeba invadens
GPKADTSKQT

SEQ ID NO: 2861415 - protein, 7 aa, Entamoeba invadens
GPKAKGM

SEQ ID NO: 2861416 - protein, 6 aa, Entamoeba invadens
GPKARA

SEQ ID NO: 2861417 - protein, 15 aa, Entamoeba invadens
GPKGYVAGSLRGDTG

SEQ ID NO: 2861418 - protein, 4 aa, Entamoeba invadens
GPKK

SEQ ID NO: 2861419 - protein, 20 aa, Entamoeba invadens
GPKKEKFEKTKKVTEGNANN

SEQ ID NO: 2861420 - protein, 8 aa, Entamoeba invadens
GPKKNGAI

SEQ ID NO: 2861421 - protein, 9 aa, Entamoeba invadens
GPKKSGAIQ

SEQ ID NO: 2861422 - protein, 5 aa, Entamoeba invadens
GPKQY

SEQ ID NO: 2861423 - protein, 4 aa, Entamoeba invadens
GPLN

SEQ ID NO: 2861424 - protein, 12 aa, Entamoeba invadens
GPLNKNGVNEFG

SEQ ID NO: 2861425 - protein, 8 aa, Entamoeba invadens
GPLPVGEG

SEQ ID NO: 2861426 - protein, 15 aa, Entamoeba invadens
GPLTRVPGDKMPRDD

SEQ ID NO: 2861427 - protein, 5 aa, Entamoeba invadens
GPLVS

SEQ ID NO: 2861428 - protein, 9 aa, Entamoeba invadens
GPMKSETKE

SEQ ID NO: 2861429 - protein, 5 aa, Entamoeba invadens
GPMPW

SEQ ID NO: 2861430 - protein, 8 aa, Entamoeba invadens
GPNCSGKS

SEQ ID NO: 2861431 - protein, 10 aa, Entamoeba invadens
GPNDTVSSSC

SEQ ID NO: 2861432 - protein, 7 aa, Entamoeba invadens
GPNENLT

SEQ ID NO: 2861433 - protein, 10 aa, Entamoeba invadens
GPNGAGKSNL

SEQ ID NO: 2861434 - protein, 7 aa, Entamoeba invadens
GPNGGFN

SEQ ID NO: 2861435 - protein, 6 aa, Entamoeba invadens
GPNGTN

SEQ ID NO: 2861436 - protein, 5 aa, Entamoeba invadens
GPNIE

SEQ ID NO: 2861437 - protein, 9 aa, Entamoeba invadens
GPNKAIPGK

SEQ ID NO: 2861438 - protein, 8 aa, Entamoeba invadens
GPNNAKIV

SEQ ID NO: 2861439 - protein, 8 aa, Entamoeba invadens
GPNNTEDT

SEQ ID NO: 2861440 - protein, 4 aa, Entamoeba invadens
GPNS

SEQ ID NO: 2861441 - protein, 6 aa, Entamoeba invadens
GPNSGW

SEQ ID NO: 2861442 - protein, 5 aa, Entamoeba invadens
GPNSS

SEQ ID NO: 2861443 - protein, 4 aa, Entamoeba invadens
GPNT

SEQ ID NO: 2861444 - protein, 9 aa, Entamoeba invadens
GPNTMTSPD

SEQ ID NO: 2861445 - protein, 24 aa, Entamoeba invadens
GPNVSGGYTTEEIEEEFKTGCEAK

SEQ ID NO: 2861446 - protein, 8 aa, Entamoeba invadens
GPPGCGKT

SEQ ID NO: 2861447 - protein, 12 aa, Entamoeba invadens
GPPGNSKTMQAK

SEQ ID NO: 2861448 - protein, 8 aa, Entamoeba invadens
GPPGTGKS

SEQ ID NO: 2861449 - protein, 10 aa, Entamoeba invadens
GPPGTGKSTV

SEQ ID NO: 2861450 - protein, 9 aa, Entamoeba invadens
GPPGTGKTL

SEQ ID NO: 2861451 - protein, 11 aa, Entamoeba invadens
GPPGTGKTTTA

SEQ ID NO: 2861452 - protein, 8 aa, Entamoeba invadens
GPPKTNLD

SEQ ID NO: 2861453 - protein, 8 aa, Entamoeba invadens
GPPKVGKT

SEQ ID NO: 2861454 - protein, 4 aa, Entamoeba invadens
GPPL

SEQ ID NO: 2861455 - protein, 5 aa, Entamoeba invadens
GPPLQ

SEQ ID NO: 2861456 - protein, 8 aa, Entamoeba invadens
GPQDSVKG

SEQ ID NO: 2861457 - protein, 5 aa, Entamoeba invadens
GPQIS

SEQ ID NO: 2861458 - protein, 38 aa, Entamoeba invadens
GPQVGPPRPETSSSTSRVTRGSGRVPPRRGLTKTRGDM

SEQ ID NO: 2861459 - protein, 4 aa, Entamoeba invadens
GPRA

SEQ ID NO: 2861460 - protein, 7 aa, Entamoeba invadens
GPRPQME

SEQ ID NO: 2861461 - protein, 5 aa, Entamoeba invadens
GPRQS

SEQ ID NO: 2861462 - protein, 7 aa, Entamoeba invadens
GPRSFHP

SEQ ID NO: 2861463 - protein, 10 aa, Entamoeba invadens
GPRSTNSAPF

SEQ ID NO: 2861464 - protein, 12 aa, Entamoeba invadens
GPSFEDKEKHEK

SEQ ID NO: 2861465 - protein, 7 aa, Entamoeba invadens
GPSFPTI

SEQ ID NO: 2861466 - protein, 6 aa, Entamoeba invadens
GPSGFS

SEQ ID NO: 2861467 - protein, 9 aa, Entamoeba invadens
GPSGGGKTT

SEQ ID NO: 2861468 - protein, 12 aa, Entamoeba invadens
GPSKDYNAAEDK

SEQ ID NO: 2861469 - protein, 31 aa, Entamoeba invadens
GPSKQNDKAERQKASNEVKKRLSTSAPKSLK

SEQ ID NO: 2861470 - protein, 5 aa, Entamoeba invadens
GPSRV

SEQ ID NO: 2861471 - protein, 7 aa, Entamoeba invadens
GPSSAVS

SEQ ID NO: 2861472 - protein, 11 aa, Entamoeba invadens
GPSSSGKTNFS

SEQ ID NO: 2861473 - protein, 10 aa, Entamoeba invadens
GPSSSGKTTF

SEQ ID NO: 2861474 - protein, 5 aa, Entamoeba invadens
GPSTA

SEQ ID NO: 2861475 - protein, 9 aa, Entamoeba invadens
GPSTINDGM

SEQ ID NO: 2861476 - protein, 13 aa, Entamoeba invadens
GPSVDTSRLYNAY

SEQ ID NO: 2861477 - protein, 5 aa, Entamoeba invadens
GPTDC

SEQ ID NO: 2861478 - protein, 22 aa, Entamoeba invadens
GPTETIHNQTQKMETMEDDDTS

SEQ ID NO: 2861479 - protein, 5 aa, Entamoeba invadens
GPTNF

SEQ ID NO: 2861480 - protein, 7 aa, Entamoeba invadens
GPTNTQS

SEQ ID NO: 2861481 - protein, 4 aa, Entamoeba invadens
GPTP

SEQ ID NO: 2861482 - protein, 8 aa, Entamoeba invadens
GPTPYYRG

SEQ ID NO: 2861483 - protein, 4 aa, Entamoeba invadens
GPTQ

SEQ ID NO: 2861484 - protein, 9 aa, Entamoeba invadens
GPTQTPYEG

SEQ ID NO: 2861485 - protein, 6 aa, Entamoeba invadens
GPTRGG

SEQ ID NO: 2861486 - protein, 4 aa, Entamoeba invadens
GPTV

SEQ ID NO: 2861487 - protein, 11 aa, Entamoeba invadens
GPVDASKFTER

SEQ ID NO: 2861488 - protein, 6 aa, Entamoeba invadens
GPVEET

SEQ ID NO: 2861489 - protein, 13 aa, Entamoeba invadens
GPVQMSPMKQKAK

SEQ ID NO: 2861490 - protein, 6 aa, Entamoeba invadens
GPVQNA

SEQ ID NO: 2861491 - protein, 9 aa, Entamoeba invadens
GPVQQQNNQ

SEQ ID NO: 2861492 - protein, 6 aa, Entamoeba invadens
GPVREL

SEQ ID NO: 2861493 - protein, 8 aa, Entamoeba invadens
GPYHSGKS

SEQ ID NO: 2861494 - protein, 8 aa, Entamoeba invadens
GPYPPESS

SEQ ID NO: 2861495 - protein, 6 aa, Entamoeba invadens
GPYVGL

SEQ ID NO: 2861496 - protein, 5 aa, Entamoeba invadens
GQADN

SEQ ID NO: 2861497 - protein, 8 aa, Entamoeba invadens
GQADRQKI

SEQ ID NO: 2861498 - protein, 6 aa, Entamoeba invadens
GQAGDT

SEQ ID NO: 2861499 - protein, 5 aa, Entamoeba invadens
GQAGR

SEQ ID NO: 2861500 - protein, 34 aa, Entamoeba invadens
GQAPPPNKKPAPPPPHKQLPPKLPHKEVNQQQQI

SEQ ID NO: 2861501 - protein, 6 aa, Entamoeba invadens
GQATLS

SEQ ID NO: 2861502 - protein, 12 aa, Entamoeba invadens
GQATSCPQAPAH

SEQ ID NO: 2861503 - protein, 4 aa, Entamoeba invadens
GQCG

SEQ ID NO: 2861504 - protein, 7 aa, Entamoeba invadens
GQCGVTK

SEQ ID NO: 2861505 - protein, 7 aa, Entamoeba invadens
GQCKYEN

SEQ ID NO: 2861506 - protein, 7 aa, Entamoeba invadens
GQDDGTF

SEQ ID NO: 2861507 - protein, 5 aa, Entamoeba invadens
GQDHA

SEQ ID NO: 2861508 - protein, 9 aa, Entamoeba invadens
GQDKERTQI

SEQ ID NO: 2861509 - protein, 5 aa, Entamoeba invadens
GQDKL

SEQ ID NO: 2861510 - protein, 9 aa, Entamoeba invadens
GQDQESKAL

SEQ ID NO: 2861511 - protein, 5 aa, Entamoeba invadens
GQDRF

SEQ ID NO: 2861512 - protein, 10 aa, Entamoeba invadens
GQDVNDSLEK

SEQ ID NO: 2861513 - protein, 8 aa, Entamoeba invadens
GQDVSESI

SEQ ID NO: 2861514 - protein, 18 aa, Entamoeba invadens
GQDVSESIEKIANEKGFT

SEQ ID NO: 2861515 - protein, 6 aa, Entamoeba invadens
GQEANP

SEQ ID NO: 2861516 - protein, 15 aa, Entamoeba invadens
GQEDVTQKEDEKVEM

SEQ ID NO: 2861517 - protein, 11 aa, Entamoeba invadens
GQEFTDSESEY

SEQ ID NO: 2861518 - protein, 6 aa, Entamoeba invadens
GQEGLK

SEQ ID NO: 2861519 - protein, 5 aa, Entamoeba invadens
GQEGN

SEQ ID NO: 2861520 - protein, 9 aa, Entamoeba invadens
GQEKFRSGI

SEQ ID NO: 2861521 - protein, 9 aa, Entamoeba invadens
GQENAESKN

SEQ ID NO: 2861522 - protein, 6 aa, Entamoeba invadens
GQENGN

SEQ ID NO: 2861523 - protein, 4 aa, Entamoeba invadens
GQER

SEQ ID NO: 2861524 - protein, 5 aa, Entamoeba invadens
GQESL

SEQ ID NO: 2861525 - protein, 16 aa, Entamoeba invadens
GQETSKSLSRAYYNGA

SEQ ID NO: 2861526 - protein, 13 aa, Entamoeba invadens
GQEVPRSHLRGGK

SEQ ID NO: 2861527 - protein, 4 aa, Entamoeba invadens
GQFE

SEQ ID NO: 2861528 - protein, 16 aa, Entamoeba invadens
GQFGSRLQGGKDQAAA

SEQ ID NO: 2861529 - protein, 6 aa, Entamoeba invadens
GQFPHA

SEQ ID NO: 2861530 - protein, 30 aa, Entamoeba invadens
GQFQSESAAPKDTSYMTEGTTETTDTMGSM

SEQ ID NO: 2861531 - protein, 17 aa, Entamoeba invadens
GQFSEDQNFRVMLNYCF

SEQ ID NO: 2861532 - protein, 22 aa, Entamoeba invadens
GQFSKSTSPRRRASPRVIPPHQ

SEQ ID NO: 2861533 - protein, 7 aa, Entamoeba invadens
GQFTQKE

SEQ ID NO: 2861534 - protein, 12 aa, Entamoeba invadens
GQGFKTSPRPMV

SEQ ID NO: 2861535 - protein, 21 aa, Entamoeba invadens
GQGMSGMRNGQIADKEKSMRT

SEQ ID NO: 2861536 - protein, 13 aa, Entamoeba invadens
GQGNQYPGQEAGD

SEQ ID NO: 2861537 - protein, 7 aa, Entamoeba invadens
GQGPTLA

SEQ ID NO: 2861538 - protein, 7 aa, Entamoeba invadens
GQGREEH

SEQ ID NO: 2861539 - protein, 6 aa, Entamoeba invadens
GQGSFG

SEQ ID NO: 2861540 - protein, 7 aa, Entamoeba invadens
GQGVDSA

SEQ ID NO: 2861541 - protein, 5 aa, Entamoeba invadens
GQHRG

SEQ ID NO: 2861542 - protein, 5 aa, Entamoeba invadens
GQIEE

SEQ ID NO: 2861543 - protein, 13 aa, Entamoeba invadens
GQIGPKKTRSKYL

SEQ ID NO: 2861544 - protein, 19 aa, Entamoeba invadens
GQIKEGAKHDVTTQEMTTA

SEQ ID NO: 2861545 - protein, 24 aa, Entamoeba invadens
GQIKPENEKFEEKNEKEKDEIIRE

SEQ ID NO: 2861546 - protein, 22 aa, Entamoeba invadens
GQIKRKSKGSDKLNKRSSVKPT

SEQ ID NO: 2861547 - protein, 4 aa, Entamoeba invadens
GQIP

SEQ ID NO: 2861548 - protein, 6 aa, Entamoeba invadens
GQIPEN

SEQ ID NO: 2861549 - protein, 8 aa, Entamoeba invadens
GQIPPTSN

SEQ ID NO: 2861550 - protein, 14 aa, Entamoeba invadens
GQIRETAQKAKQNY

SEQ ID NO: 2861551 - protein, 15 aa, Entamoeba invadens
GQITTNNQIQYTNQP

SEQ ID NO: 2861552 - protein, 9 aa, Entamoeba invadens
GQIYSQGTK

SEQ ID NO: 2861553 - protein, 11 aa, Entamoeba invadens
GQKARKAVSDA

SEQ ID NO: 2861554 - protein, 5 aa, Entamoeba invadens
GQKDA

SEQ ID NO: 2861555 - protein, 10 aa, Entamoeba invadens
GQKDQVAEVT

SEQ ID NO: 2861556 - protein, 40 aa, Entamoeba invadens
GQKERRKEAAKDVQKSSVERHTPPPKETKPIKQRTLTPQE

SEQ ID NO: 2861557 - protein, 16 aa, Entamoeba invadens
GQKGYISKRPKVDEAR

SEQ ID NO: 2861558 - protein, 7 aa, Entamoeba invadens
GQKHQNI

SEQ ID NO: 2861559 - protein, 4 aa, Entamoeba invadens
GQKK

SEQ ID NO: 2861560 - protein, 7 aa, Entamoeba invadens
GQKKFQD

SEQ ID NO: 2861561 - protein, 15 aa, Entamoeba invadens
GQKLDKDTRHFNDYK

SEQ ID NO: 2861562 - protein, 14 aa, Entamoeba invadens
GQKLEKSKNDKDEE

SEQ ID NO: 2861563 - protein, 9 aa, Entamoeba invadens
GQKPFNGAQ

SEQ ID NO: 2861564 - protein, 24 aa, Entamoeba invadens
GQKPQNEQTEKQKRITQKPSESLG

SEQ ID NO: 2861565 - protein, 9 aa, Entamoeba invadens
GQKPRIPFS

SEQ ID NO: 2861566 - protein, 16 aa, Entamoeba invadens
GQKQNRENKSVSPKMK

SEQ ID NO: 2861567 - protein, 8 aa, Entamoeba invadens
GQKRIGKD

SEQ ID NO: 2861568 - protein, 8 aa, Entamoeba invadens
GQKRIPNG

SEQ ID NO: 2861569 - protein, 10 aa, Entamoeba invadens
GQKSIKKSTV

SEQ ID NO: 2861570 - protein, 4 aa, Entamoeba invadens
GQKT

SEQ ID NO: 2861571 - protein, 8 aa, Entamoeba invadens
GQKTLGNF

SEQ ID NO: 2861572 - protein, 4 aa, Entamoeba invadens
GQKY

SEQ ID NO: 2861573 - protein, 9 aa, Entamoeba invadens
GQLKTSNGK

SEQ ID NO: 2861574 - protein, 5 aa, Entamoeba invadens
GQLSR

SEQ ID NO: 2861575 - protein, 6 aa, Entamoeba invadens
GQLTDE

SEQ ID NO: 2861576 - protein, 13 aa, Entamoeba invadens
GQLYASGSEDRTV

SEQ ID NO: 2861577 - protein, 4 aa, Entamoeba invadens
GQME

SEQ ID NO: 2861578 - protein, 6 aa, Entamoeba invadens
GQMGSY

SEQ ID NO: 2861579 - protein, 9 aa, Entamoeba invadens
GQMPPQMQG

SEQ ID NO: 2861580 - protein, 8 aa, Entamoeba invadens
GQMRQGQQ

SEQ ID NO: 2861581 - protein, 10 aa, Entamoeba invadens
GQMTGQINEG

SEQ ID NO: 2861582 - protein, 4 aa, Entamoeba invadens
GQND

SEQ ID NO: 2861583 - protein, 5 aa, Entamoeba invadens
GQNEF

SEQ ID NO: 2861584 - protein, 7 aa, Entamoeba invadens
GQNGKKV

SEQ ID NO: 2861585 - protein, 4 aa, Entamoeba invadens
GQNP

SEQ ID NO: 2861586 - protein, 6 aa, Entamoeba invadens
GQNSAI

SEQ ID NO: 2861587 - protein, 7 aa, Entamoeba invadens
GQNSAKL

SEQ ID NO: 2861588 - protein, 8 aa, Entamoeba invadens
GQNTKEIE

SEQ ID NO: 2861589 - protein, 6 aa, Entamoeba invadens
GQNVEL

SEQ ID NO: 2861590 - protein, 8 aa, Entamoeba invadens
GQNVTKSQ

SEQ ID NO: 2861591 - protein, 12 aa, Entamoeba invadens
GQNYLTDENAVK

SEQ ID NO: 2861592 - protein, 12 aa, Entamoeba invadens
GQNYNSNENQKN

SEQ ID NO: 2861593 - protein, 5 aa, Entamoeba invadens
GQNYT

SEQ ID NO: 2861594 - protein, 4 aa, Entamoeba invadens
GQPA

SEQ ID NO: 2861595 - protein, 6 aa, Entamoeba invadens
GQPCNA

SEQ ID NO: 2861596 - protein, 6 aa, Entamoeba invadens
GQPCPK

SEQ ID NO: 2861597 - protein, 15 aa, Entamoeba invadens
GQPDKRGNLVVKLNY

SEQ ID NO: 2861598 - protein, 7 aa, Entamoeba invadens
GQPDLNW

SEQ ID NO: 2861599 - protein, 13 aa, Entamoeba invadens
GQPGTRPGTPPLE

SEQ ID NO: 2861600 - protein, 9 aa, Entamoeba invadens
GQPHSTPAV

SEQ ID NO: 2861601 - protein, 6 aa, Entamoeba invadens
GQPINK

SEQ ID NO: 2861602 - protein, 9 aa, Entamoeba invadens
GQPINPANR

SEQ ID NO: 2861603 - protein, 13 aa, Entamoeba invadens
GQPMPPPPQPPQQ

SEQ ID NO: 2861604 - protein, 31 aa, Entamoeba invadens
GQPNPVVQQPQQQYQTMQQPQQTNGNPLGAQ

SEQ ID NO: 2861605 - protein, 7 aa, Entamoeba invadens
GQPNTRY

SEQ ID NO: 2861606 - protein, 5 aa, Entamoeba invadens
GQPPD

SEQ ID NO: 2861607 - protein, 8 aa, Entamoeba invadens
GQPPPQNY

SEQ ID NO: 2861608 - protein, 4 aa, Entamoeba invadens
GQPQ

SEQ ID NO: 2861609 - protein, 6 aa, Entamoeba invadens
GQPQEA

SEQ ID NO: 2861610 - protein, 7 aa, Entamoeba invadens
GQPQPQG

SEQ ID NO: 2861611 - protein, 12 aa, Entamoeba invadens
GQPQQKGEHSQK

SEQ ID NO: 2861612 - protein, 18 aa, Entamoeba invadens
GQPQQPQQFQQQPQNNFA

SEQ ID NO: 2861613 - protein, 5 aa, Entamoeba invadens
GQPSA

SEQ ID NO: 2861614 - protein, 6 aa, Entamoeba invadens
GQPSLS

SEQ ID NO: 2861615 - protein, 12 aa, Entamoeba invadens
GQPTNEKKEKKC

SEQ ID NO: 2861616 - protein, 21 aa, Entamoeba invadens
GQPTQQQQGTGLSGMTQPQMG

SEQ ID NO: 2861617 - protein, 6 aa, Entamoeba invadens
GQPTVE

SEQ ID NO: 2861618 - protein, 4 aa, Entamoeba invadens
GQPV

SEQ ID NO: 2861619 - protein, 7 aa, Entamoeba invadens
GQQAEKL

SEQ ID NO: 2861620 - protein, 9 aa, Entamoeba invadens
GQQANSEFV

SEQ ID NO: 2861621 - protein, 6 aa, Entamoeba invadens
GQQERV

SEQ ID NO: 2861622 - protein, 19 aa, Entamoeba invadens
GQQFDDQFEKDERENTRGT

SEQ ID NO: 2861623 - protein, 5 aa, Entamoeba invadens
GQQFN

SEQ ID NO: 2861624 - protein, 4 aa, Entamoeba invadens
GQQI

SEQ ID NO: 2861625 - protein, 18 aa, Entamoeba invadens
GQQISPIDTTAPPAAKPI

SEQ ID NO: 2861626 - protein, 4 aa, Entamoeba invadens
GQQK

SEQ ID NO: 2861627 - protein, 35 aa, Entamoeba invadens
GQQNNSTEKCGKNSGKKEKVDRYEKADNLTEISPT

SEQ ID NO: 2861628 - protein, 10 aa, Entamoeba invadens
GQQPGSGHKA

SEQ ID NO: 2861629 - protein, 220 aa, Entamoeba invadens
GQQPGYPPQAYGQQPQAYGAYPPQQGYGQQGYPPQQGAYPMQGYPPQGAQQQKPGAPPIPPKQGQQPQGAYPPQGYPPQQYQMQPGQSTPQQGAYPPQQPGQYQQQYPGAPQAAQKQGQPMPPQQGTYQQPYQNPQQPGQPIAQQGAYPQQPYGAQQPPQAAQKPGQPMPQQQGTYQQQPYGAQQPQQGAYPPQPYQQQGYPPQQPGQPMPQGQQQGNTY

SEQ ID NO: 2861630 - protein, 5 aa, Entamoeba invadens
GQQPQ

SEQ ID NO: 2861631 - protein, 10 aa, Entamoeba invadens
GQQPQGNSLF

SEQ ID NO: 2861632 - protein, 6 aa, Entamoeba invadens
GQQQNI

SEQ ID NO: 2861633 - protein, 6 aa, Entamoeba invadens
GQQQRT

SEQ ID NO: 2861634 - protein, 10 aa, Entamoeba invadens
GQQQWDENNP

SEQ ID NO: 2861635 - protein, 21 aa, Entamoeba invadens
GQQTSAQTVQLQQEKTEEQVD

SEQ ID NO: 2861636 - protein, 12 aa, Entamoeba invadens
GQQTTEYYNSGE

SEQ ID NO: 2861637 - protein, 6 aa, Entamoeba invadens
GQQTTG

SEQ ID NO: 2861638 - protein, 6 aa, Entamoeba invadens
GQQTTL

SEQ ID NO: 2861639 - protein, 7 aa, Entamoeba invadens
GQQVQTQ

SEQ ID NO: 2861640 - protein, 8 aa, Entamoeba invadens
GQRAPTLA

SEQ ID NO: 2861641 - protein, 4 aa, Entamoeba invadens
GQRG

SEQ ID NO: 2861642 - protein, 4 aa, Entamoeba invadens
GQRL

SEQ ID NO: 2861643 - protein, 18 aa, Entamoeba invadens
GQRPQQKSTQTCQPPVGN

SEQ ID NO: 2861644 - protein, 6 aa, Entamoeba invadens
GQRRPY

SEQ ID NO: 2861645 - protein, 7 aa, Entamoeba invadens
GQSCSSQ

SEQ ID NO: 2861646 - protein, 27 aa, Entamoeba invadens
GQSGEEQKDVQPIDKQQIPENKEMNTI

SEQ ID NO: 2861647 - protein, 5 aa, Entamoeba invadens
GQSGT

SEQ ID NO: 2861648 - protein, 8 aa, Entamoeba invadens
GQSGTETL

SEQ ID NO: 2861649 - protein, 13 aa, Entamoeba invadens
GQSKPSSRGNSFT

SEQ ID NO: 2861650 - protein, 6 aa, Entamoeba invadens
GQSLGN

SEQ ID NO: 2861651 - protein, 16 aa, Entamoeba invadens
GQSMAEPNEELEVSGG

SEQ ID NO: 2861652 - protein, 5 aa, Entamoeba invadens
GQSNE

SEQ ID NO: 2861653 - protein, 7 aa, Entamoeba invadens
GQSQPEE

SEQ ID NO: 2861654 - protein, 4 aa, Entamoeba invadens
GQST

SEQ ID NO: 2861655 - protein, 9 aa, Entamoeba invadens
GQSTNENSV

SEQ ID NO: 2861656 - protein, 6 aa, Entamoeba invadens
GQSTQK

SEQ ID NO: 2861657 - protein, 9 aa, Entamoeba invadens
GQSTSSCQL

SEQ ID NO: 2861658 - protein, 11 aa, Entamoeba invadens
GQSTSSYDFDP

SEQ ID NO: 2861659 - protein, 4 aa, Entamoeba invadens
GQSY

SEQ ID NO: 2861660 - protein, 15 aa, Entamoeba invadens
GQTENIPSYTYTDGD

SEQ ID NO: 2861661 - protein, 8 aa, Entamoeba invadens
GQTGSGKT

SEQ ID NO: 2861662 - protein, 11 aa, Entamoeba invadens
GQTGSGKTFTT

SEQ ID NO: 2861663 - protein, 20 aa, Entamoeba invadens
GQTGSGKTYTMEGEEGKPGM

SEQ ID NO: 2861664 - protein, 19 aa, Entamoeba invadens
GQTGSGKTYTMEGEESHPG

SEQ ID NO: 2861665 - protein, 20 aa, Entamoeba invadens
GQTGTGKTFTMEGEEKNEGV

SEQ ID NO: 2861666 - protein, 6 aa, Entamoeba invadens
GQTKGD

SEQ ID NO: 2861667 - protein, 7 aa, Entamoeba invadens
GQTKNGA

SEQ ID NO: 2861668 - protein, 6 aa, Entamoeba invadens
GQTNPK

SEQ ID NO: 2861669 - protein, 8 aa, Entamoeba invadens
GQTPNSNT

SEQ ID NO: 2861670 - protein, 11 aa, Entamoeba invadens
GQTQPDDESIE

SEQ ID NO: 2861671 - protein, 9 aa, Entamoeba invadens
GQTSGNVTV

SEQ ID NO: 2861672 - protein, 11 aa, Entamoeba invadens
GQTSGSALSQT

SEQ ID NO: 2861673 - protein, 4 aa, Entamoeba invadens
GQTT

SEQ ID NO: 2861674 - protein, 7 aa, Entamoeba invadens
GQTTRED

SEQ ID NO: 2861675 - protein, 11 aa, Entamoeba invadens
GQTVSVDGEEE

SEQ ID NO: 2861676 - protein, 4 aa, Entamoeba invadens
GQTY

SEQ ID NO: 2861677 - protein, 13 aa, Entamoeba invadens
GQVASNLKGDVAD

SEQ ID NO: 2861678 - protein, 19 aa, Entamoeba invadens
GQVDNEKATKTAIEEASKY

SEQ ID NO: 2861679 - protein, 8 aa, Entamoeba invadens
GQVGRNEK

SEQ ID NO: 2861680 - protein, 4 aa, Entamoeba invadens
GQVI

SEQ ID NO: 2861681 - protein, 5 aa, Entamoeba invadens
GQVLE

SEQ ID NO: 2861682 - protein, 4 aa, Entamoeba invadens
GQVP

SEQ ID NO: 2861683 - protein, 11 aa, Entamoeba invadens
GQVPSESKAGK

SEQ ID NO: 2861684 - protein, 6 aa, Entamoeba invadens
GQVQPI

SEQ ID NO: 2861685 - protein, 7 aa, Entamoeba invadens
GQVRERG

SEQ ID NO: 2861686 - protein, 14 aa, Entamoeba invadens
GQWGDAKARGEALD

SEQ ID NO: 2861687 - protein, 12 aa, Entamoeba invadens
GQYDKTKQKTGD

SEQ ID NO: 2861688 - protein, 10 aa, Entamoeba invadens
GQYDRANMSV

SEQ ID NO: 2861689 - protein, 5 aa, Entamoeba invadens
GQYDV

SEQ ID NO: 2861690 - protein, 5 aa, Entamoeba invadens
GQYGI

SEQ ID NO: 2861691 - protein, 5 aa, Entamoeba invadens
GQYKG

SEQ ID NO: 2861692 - protein, 16 aa, Entamoeba invadens
GQYPDGATTDVTRTNY

SEQ ID NO: 2861693 - protein, 4 aa, Entamoeba invadens
GQYQ

SEQ ID NO: 2861694 - protein, 8 aa, Entamoeba invadens
GQYQTTVM

SEQ ID NO: 2861695 - protein, 9 aa, Entamoeba invadens
GQYVENDRK

SEQ ID NO: 2861696 - protein, 13 aa, Entamoeba invadens
GRAGRRGKDDQGT

SEQ ID NO: 2861697 - protein, 5 aa, Entamoeba invadens
GRAGV

SEQ ID NO: 2861698 - protein, 26 aa, Entamoeba invadens
GRAGVDPNIYGQTVSDEGLDNPNNDV

SEQ ID NO: 2861699 - protein, 4 aa, Entamoeba invadens
GRAP

SEQ ID NO: 2861700 - protein, 9 aa, Entamoeba invadens
GRAPNSVKN

SEQ ID NO: 2861701 - protein, 4 aa, Entamoeba invadens
GRCG

SEQ ID NO: 2861702 - protein, 5 aa, Entamoeba invadens
GRCKP

SEQ ID NO: 2861703 - protein, 6 aa, Entamoeba invadens
GRCKPC

SEQ ID NO: 2861704 - protein, 5 aa, Entamoeba invadens
GRCKQ

SEQ ID NO: 2861705 - protein, 4 aa, Entamoeba invadens
GRCY

SEQ ID NO: 2861706 - protein, 19 aa, Entamoeba invadens
GRDEERRSRGIEGDKEDTI

SEQ ID NO: 2861707 - protein, 17 aa, Entamoeba invadens
GRDEGRGNFVGIGGSIS

SEQ ID NO: 2861708 - protein, 12 aa, Entamoeba invadens
GRDGKIKNNDFE

SEQ ID NO: 2861709 - protein, 10 aa, Entamoeba invadens
GRDNKIEYDD

SEQ ID NO: 2861710 - protein, 9 aa, Entamoeba invadens
GRDPNALGT

SEQ ID NO: 2861711 - protein, 16 aa, Entamoeba invadens
GRDPNPDALLRRDGLL

SEQ ID NO: 2861712 - protein, 5 aa, Entamoeba invadens
GRDQV

SEQ ID NO: 2861713 - protein, 26 aa, Entamoeba invadens
GRDRERTPYDRQSTDGPTTDRGSDRM

SEQ ID NO: 2861714 - protein, 6 aa, Entamoeba invadens
GRDSKI

SEQ ID NO: 2861715 - protein, 8 aa, Entamoeba invadens
GRDTVDKM

SEQ ID NO: 2861716 - protein, 5 aa, Entamoeba invadens
GRDVE

SEQ ID NO: 2861717 - protein, 8 aa, Entamoeba invadens
GRDVRSED

SEQ ID NO: 2861718 - protein, 7 aa, Entamoeba invadens
GRDYDEA

SEQ ID NO: 2861719 - protein, 9 aa, Entamoeba invadens
GREAGTPFA

SEQ ID NO: 2861720 - protein, 7 aa, Entamoeba invadens
GREDEGV

SEQ ID NO: 2861721 - protein, 5 aa, Entamoeba invadens
GREDV

SEQ ID NO: 2861722 - protein, 7 aa, Entamoeba invadens
GREENED

SEQ ID NO: 2861723 - protein, 6 aa, Entamoeba invadens
GREGLV

SEQ ID NO: 2861724 - protein, 9 aa, Entamoeba invadens
GREGTFPKN

SEQ ID NO: 2861725 - protein, 8 aa, Entamoeba invadens
GREISQQE

SEQ ID NO: 2861726 - protein, 6 aa, Entamoeba invadens
GREKEI

SEQ ID NO: 2861727 - protein, 43 aa, Entamoeba invadens
GREKPEKTAAGKAVKKGGAGMNSHSGVNSKKIEEKVDGTDAPL

SEQ ID NO: 2861728 - protein, 4 aa, Entamoeba invadens
GREL

SEQ ID NO: 2861729 - protein, 7 aa, Entamoeba invadens
GRELTGQ

SEQ ID NO: 2861730 - protein, 11 aa, Entamoeba invadens
GREMRRNSRYG

SEQ ID NO: 2861731 - protein, 15 aa, Entamoeba invadens
GRENPVEPDLPTPDD

SEQ ID NO: 2861732 - protein, 4 aa, Entamoeba invadens
GREP

SEQ ID NO: 2861733 - protein, 16 aa, Entamoeba invadens
GREPKCDALMIKNGFT

SEQ ID NO: 2861734 - protein, 5 aa, Entamoeba invadens
GRESH

SEQ ID NO: 2861735 - protein, 9 aa, Entamoeba invadens
GRESITPKD

SEQ ID NO: 2861736 - protein, 8 aa, Entamoeba invadens
GRESVVGK

SEQ ID NO: 2861737 - protein, 9 aa, Entamoeba invadens
GRETYTSKE

SEQ ID NO: 2861738 - protein, 9 aa, Entamoeba invadens
GREVEQSKD

SEQ ID NO: 2861739 - protein, 18 aa, Entamoeba invadens
GRFEEKRAARYIKSTTEA

SEQ ID NO: 2861740 - protein, 11 aa, Entamoeba invadens
GRFPKKNNFKE

SEQ ID NO: 2861741 - protein, 7 aa, Entamoeba invadens
GRFPTKS

SEQ ID NO: 2861742 - protein, 7 aa, Entamoeba invadens
GRGAAPL

SEQ ID NO: 2861743 - protein, 6 aa, Entamoeba invadens
GRGAPN

SEQ ID NO: 2861744 - protein, 7 aa, Entamoeba invadens
GRGATST

SEQ ID NO: 2861745 - protein, 4 aa, Entamoeba invadens
GRGD

SEQ ID NO: 2861746 - protein, 8 aa, Entamoeba invadens
GRGDAEYV

SEQ ID NO: 2861747 - protein, 13 aa, Entamoeba invadens
GRGDDMAGRFNDG

SEQ ID NO: 2861748 - protein, 5 aa, Entamoeba invadens
GRGDS

SEQ ID NO: 2861749 - protein, 6 aa, Entamoeba invadens
GRGEGV

SEQ ID NO: 2861750 - protein, 10 aa, Entamoeba invadens
GRGEKEALTT

SEQ ID NO: 2861751 - protein, 13 aa, Entamoeba invadens
GRGETVNKKMERA

SEQ ID NO: 2861752 - protein, 7 aa, Entamoeba invadens
GRGFPGL

SEQ ID NO: 2861753 - protein, 14 aa, Entamoeba invadens
GRGFTKQRKPQHAR

SEQ ID NO: 2861754 - protein, 11 aa, Entamoeba invadens
GRGGRSAEKKR

SEQ ID NO: 2861755 - protein, 10 aa, Entamoeba invadens
GRGKGYKTEE

SEQ ID NO: 2861756 - protein, 9 aa, Entamoeba invadens
GRGKRSRGK

SEQ ID NO: 2861757 - protein, 6 aa, Entamoeba invadens
GRGKYS

SEQ ID NO: 2861758 - protein, 8 aa, Entamoeba invadens
GRGPSSDA

SEQ ID NO: 2861759 - protein, 15 aa, Entamoeba invadens
GRGRAATSSKSKRKI

SEQ ID NO: 2861760 - protein, 15 aa, Entamoeba invadens
GRGRPPIPLAQPEEA

SEQ ID NO: 2861761 - protein, 10 aa, Entamoeba invadens
GRGRSTQIKN

SEQ ID NO: 2861762 - protein, 7 aa, Entamoeba invadens
GRGRTGT

SEQ ID NO: 2861763 - protein, 5 aa, Entamoeba invadens
GRGRY

SEQ ID NO: 2861764 - protein, 11 aa, Entamoeba invadens
GRGSARAMSGD

SEQ ID NO: 2861765 - protein, 6 aa, Entamoeba invadens
GRGSGE

SEQ ID NO: 2861766 - protein, 13 aa, Entamoeba invadens
GRGSGKGQFKEPS

SEQ ID NO: 2861767 - protein, 6 aa, Entamoeba invadens
GRGSTG

SEQ ID NO: 2861768 - protein, 4 aa, Entamoeba invadens
GRGT

SEQ ID NO: 2861769 - protein, 5 aa, Entamoeba invadens
GRGTP

SEQ ID NO: 2861770 - protein, 11 aa, Entamoeba invadens
GRGTSNPDPSF

SEQ ID NO: 2861771 - protein, 8 aa, Entamoeba invadens
GRGTSTFD

SEQ ID NO: 2861772 - protein, 9 aa, Entamoeba invadens
GRGTSTHDG

SEQ ID NO: 2861773 - protein, 6 aa, Entamoeba invadens
GRGTSV

SEQ ID NO: 2861774 - protein, 9 aa, Entamoeba invadens
GRGTYPGNI

SEQ ID NO: 2861775 - protein, 7 aa, Entamoeba invadens
GRGYGES

SEQ ID NO: 2861776 - protein, 11 aa, Entamoeba invadens
GRHDKNEKVAS

SEQ ID NO: 2861777 - protein, 4 aa, Entamoeba invadens
GRHQ

SEQ ID NO: 2861778 - protein, 9 aa, Entamoeba invadens
GRHSEKGYS

SEQ ID NO: 2861779 - protein, 6 aa, Entamoeba invadens
GRHTNT

SEQ ID NO: 2861780 - protein, 6 aa, Entamoeba invadens
GRIADV

SEQ ID NO: 2861781 - protein, 8 aa, Entamoeba invadens
GRIDGQQK

SEQ ID NO: 2861782 - protein, 8 aa, Entamoeba invadens
GRIEEERE

SEQ ID NO: 2861783 - protein, 8 aa, Entamoeba invadens
GRINTNES

SEQ ID NO: 2861784 - protein, 4 aa, Entamoeba invadens
GRIS

SEQ ID NO: 2861785 - protein, 5 aa, Entamoeba invadens
GRISD

SEQ ID NO: 2861786 - protein, 8 aa, Entamoeba invadens
GRISGGGA

SEQ ID NO: 2861787 - protein, 5 aa, Entamoeba invadens
GRITP

SEQ ID NO: 2861788 - protein, 6 aa, Entamoeba invadens
GRITPK

SEQ ID NO: 2861789 - protein, 8 aa, Entamoeba invadens
GRKAKRAE

SEQ ID NO: 2861790 - protein, 20 aa, Entamoeba invadens
GRKAKYSSDEEYKNAIQNEI

SEQ ID NO: 2861791 - protein, 4 aa, Entamoeba invadens
GRKC

SEQ ID NO: 2861792 - protein, 6 aa, Entamoeba invadens
GRKGDV

SEQ ID NO: 2861793 - protein, 7 aa, Entamoeba invadens
GRKGTLQ

SEQ ID NO: 2861794 - protein, 10 aa, Entamoeba invadens
GRKKDEQPSD

SEQ ID NO: 2861795 - protein, 8 aa, Entamoeba invadens
GRKLTGQL

SEQ ID NO: 2861796 - protein, 11 aa, Entamoeba invadens
GRKMKEEQDTI

SEQ ID NO: 2861797 - protein, 9 aa, Entamoeba invadens
GRKQGEPNC

SEQ ID NO: 2861798 - protein, 15 aa, Entamoeba invadens
GRKRSSSNGSSPLSE

SEQ ID NO: 2861799 - protein, 8 aa, Entamoeba invadens
GRKTEENV

SEQ ID NO: 2861800 - protein, 8 aa, Entamoeba invadens
GRKTRSLP

SEQ ID NO: 2861801 - protein, 15 aa, Entamoeba invadens
GRKTTGETKVKSEDI

SEQ ID NO: 2861802 - protein, 7 aa, Entamoeba invadens
GRKVSQE

SEQ ID NO: 2861803 - protein, 6 aa, Entamoeba invadens
GRLEKT

SEQ ID NO: 2861804 - protein, 13 aa, Entamoeba invadens
GRLETSPKTHGKK

SEQ ID NO: 2861805 - protein, 13 aa, Entamoeba invadens
GRLGNEEDSSFNP

SEQ ID NO: 2861806 - protein, 6 aa, Entamoeba invadens
GRLPDD

SEQ ID NO: 2861807 - protein, 10 aa, Entamoeba invadens
GRLPSKAQQM

SEQ ID NO: 2861808 - protein, 4 aa, Entamoeba invadens
GRLQ

SEQ ID NO: 2861809 - protein, 5 aa, Entamoeba invadens
GRLQP

SEQ ID NO: 2861810 - protein, 8 aa, Entamoeba invadens
GRLQSEPI

SEQ ID NO: 2861811 - protein, 6 aa, Entamoeba invadens
GRLSEG

SEQ ID NO: 2861812 - protein, 10 aa, Entamoeba invadens
GRLVKSEKTK

SEQ ID NO: 2861813 - protein, 8 aa, Entamoeba invadens
GRMKEPQK

SEQ ID NO: 2861814 - protein, 4 aa, Entamoeba invadens
GRNA

SEQ ID NO: 2861815 - protein, 8 aa, Entamoeba invadens
GRNDEKAA

SEQ ID NO: 2861816 - protein, 8 aa, Entamoeba invadens
GRNEESQI

SEQ ID NO: 2861817 - protein, 6 aa, Entamoeba invadens
GRNENS

SEQ ID NO: 2861818 - protein, 7 aa, Entamoeba invadens
GRNESNT

SEQ ID NO: 2861819 - protein, 12 aa, Entamoeba invadens
GRNLPKADVAQR

SEQ ID NO: 2861820 - protein, 7 aa, Entamoeba invadens
GRNNYEV

SEQ ID NO: 2861821 - protein, 4 aa, Entamoeba invadens
GRNS

SEQ ID NO: 2861822 - protein, 15 aa, Entamoeba invadens
GRNSKRSNKEGDEIV

SEQ ID NO: 2861823 - protein, 8 aa, Entamoeba invadens
GRNSNKIQ

SEQ ID NO: 2861824 - protein, 7 aa, Entamoeba invadens
GRNTEQK

SEQ ID NO: 2861825 - protein, 6 aa, Entamoeba invadens
GRNVYD

SEQ ID NO: 2861826 - protein, 5 aa, Entamoeba invadens
GRNWE

SEQ ID NO: 2861827 - protein, 8 aa, Entamoeba invadens
GRNYTRTR

SEQ ID NO: 2861828 - protein, 7 aa, Entamoeba invadens
GRPDGQV

SEQ ID NO: 2861829 - protein, 4 aa, Entamoeba invadens
GRPE

SEQ ID NO: 2861830 - protein, 7 aa, Entamoeba invadens
GRPFGNE

SEQ ID NO: 2861831 - protein, 5 aa, Entamoeba invadens
GRPKH

SEQ ID NO: 2861832 - protein, 5 aa, Entamoeba invadens
GRPKQ

SEQ ID NO: 2861833 - protein, 4 aa, Entamoeba invadens
GRPL

SEQ ID NO: 2861834 - protein, 5 aa, Entamoeba invadens
GRPLT

SEQ ID NO: 2861835 - protein, 7 aa, Entamoeba invadens
GRPNDNP

SEQ ID NO: 2861836 - protein, 12 aa, Entamoeba invadens
GRPNKTQLNSNT

SEQ ID NO: 2861837 - protein, 7 aa, Entamoeba invadens
GRPPHAE

SEQ ID NO: 2861838 - protein, 5 aa, Entamoeba invadens
GRPPS

SEQ ID NO: 2861839 - protein, 8 aa, Entamoeba invadens
GRPPVEKN

SEQ ID NO: 2861840 - protein, 9 aa, Entamoeba invadens
GRPQKAKMT

SEQ ID NO: 2861841 - protein, 7 aa, Entamoeba invadens
GRPRTLR

SEQ ID NO: 2861842 - protein, 8 aa, Entamoeba invadens
GRPYQQTV

SEQ ID NO: 2861843 - protein, 4 aa, Entamoeba invadens
GRQI

SEQ ID NO: 2861844 - protein, 14 aa, Entamoeba invadens
GRQKGIPNDPFYPD

SEQ ID NO: 2861845 - protein, 6 aa, Entamoeba invadens
GRQSEA

SEQ ID NO: 2861846 - protein, 16 aa, Entamoeba invadens
GRQSQNQAPLSQSEET

SEQ ID NO: 2861847 - protein, 4 aa, Entamoeba invadens
GRQV

SEQ ID NO: 2861848 - protein, 34 aa, Entamoeba invadens
GRRASSKKSSSRSKSSSSSEDPREELYAKVQKKK

SEQ ID NO: 2861849 - protein, 5 aa, Entamoeba invadens
GRRDF

SEQ ID NO: 2861850 - protein, 12 aa, Entamoeba invadens
GRRDKEKNESLE

SEQ ID NO: 2861851 - protein, 8 aa, Entamoeba invadens
GRRDSMQD

SEQ ID NO: 2861852 - protein, 5 aa, Entamoeba invadens
GRRGE

SEQ ID NO: 2861853 - protein, 15 aa, Entamoeba invadens
GRRGQINTKTTESLI

SEQ ID NO: 2861854 - protein, 5 aa, Entamoeba invadens
GRRKW

SEQ ID NO: 2861855 - protein, 8 aa, Entamoeba invadens
GRRNAGKK

SEQ ID NO: 2861856 - protein, 25 aa, Entamoeba invadens
GRRSGDGSPRDRSFQTYQNTPTVQT

SEQ ID NO: 2861857 - protein, 11 aa, Entamoeba invadens
GRRSRKTDEKL

SEQ ID NO: 2861858 - protein, 10 aa, Entamoeba invadens
GRRTQTDSYD

SEQ ID NO: 2861859 - protein, 5 aa, Entamoeba invadens
GRRYT

SEQ ID NO: 2861860 - protein, 10 aa, Entamoeba invadens
GRSDKGPWSK

SEQ ID NO: 2861861 - protein, 8 aa, Entamoeba invadens
GRSEEDIK

SEQ ID NO: 2861862 - protein, 5 aa, Entamoeba invadens
GRSEK

SEQ ID NO: 2861863 - protein, 6 aa, Entamoeba invadens
GRSGIG

SEQ ID NO: 2861864 - protein, 11 aa, Entamoeba invadens
GRSGRQGQPGT

SEQ ID NO: 2861865 - protein, 5 aa, Entamoeba invadens
GRSKG

SEQ ID NO: 2861866 - protein, 6 aa, Entamoeba invadens
GRSKKT

SEQ ID NO: 2861867 - protein, 6 aa, Entamoeba invadens
GRSMSD

SEQ ID NO: 2861868 - protein, 10 aa, Entamoeba invadens
GRSPKEADGV

SEQ ID NO: 2861869 - protein, 8 aa, Entamoeba invadens
GRSPNNIK

SEQ ID NO: 2861870 - protein, 15 aa, Entamoeba invadens
GRSRLGSNEEKIDKG

SEQ ID NO: 2861871 - protein, 4 aa, Entamoeba invadens
GRSS

SEQ ID NO: 2861872 - protein, 22 aa, Entamoeba invadens
GRSSEGAAAAMSHTGSLAGNDA

SEQ ID NO: 2861873 - protein, 11 aa, Entamoeba invadens
GRSSEKEKEEM

SEQ ID NO: 2861874 - protein, 9 aa, Entamoeba invadens
GRSSQDQLS

SEQ ID NO: 2861875 - protein, 7 aa, Entamoeba invadens
GRSVGES

SEQ ID NO: 2861876 - protein, 11 aa, Entamoeba invadens
GRTARAGKEGI

SEQ ID NO: 2861877 - protein, 12 aa, Entamoeba invadens
GRTARGIKKGTA

SEQ ID NO: 2861878 - protein, 11 aa, Entamoeba invadens
GRTARYNKAGN

SEQ ID NO: 2861879 - protein, 4 aa, Entamoeba invadens
GRTC

SEQ ID NO: 2861880 - protein, 6 aa, Entamoeba invadens
GRTDEG

SEQ ID NO: 2861881 - protein, 7 aa, Entamoeba invadens
GRTDETI

SEQ ID NO: 2861882 - protein, 5 aa, Entamoeba invadens
GRTDP

SEQ ID NO: 2861883 - protein, 7 aa, Entamoeba invadens
GRTEEVR

SEQ ID NO: 2861884 - protein, 5 aa, Entamoeba invadens
GRTEL

SEQ ID NO: 2861885 - protein, 9 aa, Entamoeba invadens
GRTETPQKW

SEQ ID NO: 2861886 - protein, 14 aa, Entamoeba invadens
GRTGGSIEDPPNVD

SEQ ID NO: 2861887 - protein, 10 aa, Entamoeba invadens
GRTGRAGKKG

SEQ ID NO: 2861888 - protein, 11 aa, Entamoeba invadens
GRTGRAGQRGK

SEQ ID NO: 2861889 - protein, 4 aa, Entamoeba invadens
GRTK

SEQ ID NO: 2861890 - protein, 8 aa, Entamoeba invadens
GRTKGDGG

SEQ ID NO: 2861891 - protein, 9 aa, Entamoeba invadens
GRTKTTGLT

SEQ ID NO: 2861892 - protein, 4 aa, Entamoeba invadens
GRTN

SEQ ID NO: 2861893 - protein, 7 aa, Entamoeba invadens
GRTPETN

SEQ ID NO: 2861894 - protein, 8 aa, Entamoeba invadens
GRTPNEAD

SEQ ID NO: 2861895 - protein, 6 aa, Entamoeba invadens
GRTPPG

SEQ ID NO: 2861896 - protein, 5 aa, Entamoeba invadens
GRTQS

SEQ ID NO: 2861897 - protein, 8 aa, Entamoeba invadens
GRTQSTSK

SEQ ID NO: 2861898 - protein, 13 aa, Entamoeba invadens
GRTRKQRYTKSAD

SEQ ID NO: 2861899 - protein, 12 aa, Entamoeba invadens
GRTRSKRDKDVE

SEQ ID NO: 2861900 - protein, 13 aa, Entamoeba invadens
GRTRTDSETNSLR

SEQ ID NO: 2861901 - protein, 7 aa, Entamoeba invadens
GRTTQPD

SEQ ID NO: 2861902 - protein, 8 aa, Entamoeba invadens
GRTTRSNE

SEQ ID NO: 2861903 - protein, 5 aa, Entamoeba invadens
GRTVI

SEQ ID NO: 2861904 - protein, 7 aa, Entamoeba invadens
GRTYDVG

SEQ ID NO: 2861905 - protein, 9 aa, Entamoeba invadens
GRVDGGAGW

SEQ ID NO: 2861906 - protein, 5 aa, Entamoeba invadens
GRVDS

SEQ ID NO: 2861907 - protein, 19 aa, Entamoeba invadens
GRVEKQEKVLNEDNDATEI

SEQ ID NO: 2861908 - protein, 5 aa, Entamoeba invadens
GRVGG

SEQ ID NO: 2861909 - protein, 5 aa, Entamoeba invadens
GRVGS

SEQ ID NO: 2861910 - protein, 4 aa, Entamoeba invadens
GRVN

SEQ ID NO: 2861911 - protein, 6 aa, Entamoeba invadens
GRVNVP

SEQ ID NO: 2861912 - protein, 5 aa, Entamoeba invadens
GRVSG

SEQ ID NO: 2861913 - protein, 9 aa, Entamoeba invadens
GRVTKPSPL

SEQ ID NO: 2861914 - protein, 8 aa, Entamoeba invadens
GRVTTSAT

SEQ ID NO: 2861915 - protein, 4 aa, Entamoeba invadens
GRYD

SEQ ID NO: 2861916 - protein, 6 aa, Entamoeba invadens
GRYDRP

SEQ ID NO: 2861917 - protein, 5 aa, Entamoeba invadens
GRYHS

SEQ ID NO: 2861918 - protein, 4 aa, Entamoeba invadens
GRYM

SEQ ID NO: 2861919 - protein, 15 aa, Entamoeba invadens
GRYTPRMSPATPINP

SEQ ID NO: 2861920 - protein, 8 aa, Entamoeba invadens
GSACETHK

SEQ ID NO: 2861921 - protein, 12 aa, Entamoeba invadens
GSADGYLWSSFY

SEQ ID NO: 2861922 - protein, 5 aa, Entamoeba invadens
GSADR

SEQ ID NO: 2861923 - protein, 6 aa, Entamoeba invadens
GSADRT

SEQ ID NO: 2861924 - protein, 9 aa, Entamoeba invadens
GSAEEGSDV

SEQ ID NO: 2861925 - protein, 9 aa, Entamoeba invadens
GSAEQRSDV

SEQ ID NO: 2861926 - protein, 10 aa, Entamoeba invadens
GSAHKLSKSM

SEQ ID NO: 2861927 - protein, 5 aa, Entamoeba invadens
GSAIQ

SEQ ID NO: 2861928 - protein, 13 aa, Entamoeba invadens
GSAIQGPNEEKKV

SEQ ID NO: 2861929 - protein, 12 aa, Entamoeba invadens
GSAKDAQKMGSE

SEQ ID NO: 2861930 - protein, 27 aa, Entamoeba invadens
GSAKKSLETIEKENKTLGDEVTQNEAE

SEQ ID NO: 2861931 - protein, 6 aa, Entamoeba invadens
GSAKKV

SEQ ID NO: 2861932 - protein, 15 aa, Entamoeba invadens
GSALTGAIPSTFTSS

SEQ ID NO: 2861933 - protein, 6 aa, Entamoeba invadens
GSANAT

SEQ ID NO: 2861934 - protein, 5 aa, Entamoeba invadens
GSANG

SEQ ID NO: 2861935 - protein, 6 aa, Entamoeba invadens
GSANKL

SEQ ID NO: 2861936 - protein, 25 aa, Entamoeba invadens
GSANKMKGKQSDEQEKIEKCGTSEI

SEQ ID NO: 2861937 - protein, 6 aa, Entamoeba invadens
GSAPLT

SEQ ID NO: 2861938 - protein, 10 aa, Entamoeba invadens
GSASNPTAGV

SEQ ID NO: 2861939 - protein, 4 aa, Entamoeba invadens
GSAT

SEQ ID NO: 2861940 - protein, 13 aa, Entamoeba invadens
GSATECPKNHMSG

SEQ ID NO: 2861941 - protein, 15 aa, Entamoeba invadens
GSATFRKSKKTKNTI

SEQ ID NO: 2861942 - protein, 7 aa, Entamoeba invadens
GSATLED

SEQ ID NO: 2861943 - protein, 9 aa, Entamoeba invadens
GSATNDGGC

SEQ ID NO: 2861944 - protein, 20 aa, Entamoeba invadens
GSATSFEGPYYSANPDTVSR

SEQ ID NO: 2861945 - protein, 10 aa, Entamoeba invadens
GSATSYEGRY

SEQ ID NO: 2861946 - protein, 8 aa, Entamoeba invadens
GSCDTTNG

SEQ ID NO: 2861947 - protein, 8 aa, Entamoeba invadens
GSCGRTDL

SEQ ID NO: 2861948 - protein, 7 aa, Entamoeba invadens
GSCPKSY

SEQ ID NO: 2861949 - protein, 19 aa, Entamoeba invadens
GSDATVSRLRDRQKELKNA

SEQ ID NO: 2861950 - protein, 5 aa, Entamoeba invadens
GSDAY

SEQ ID NO: 2861951 - protein, 9 aa, Entamoeba invadens
GSDDFSKGA

SEQ ID NO: 2861952 - protein, 7 aa, Entamoeba invadens
GSDDGAD

SEQ ID NO: 2861953 - protein, 8 aa, Entamoeba invadens
GSDEGKVS

SEQ ID NO: 2861954 - protein, 11 aa, Entamoeba invadens
GSDELSKEYDD

SEQ ID NO: 2861955 - protein, 11 aa, Entamoeba invadens
GSDEPTITMDG

SEQ ID NO: 2861956 - protein, 9 aa, Entamoeba invadens
GSDEVYDTD

SEQ ID NO: 2861957 - protein, 10 aa, Entamoeba invadens
GSDFDTKTSE

SEQ ID NO: 2861958 - protein, 6 aa, Entamoeba invadens
GSDFEA

SEQ ID NO: 2861959 - protein, 7 aa, Entamoeba invadens
GSDGKAY

SEQ ID NO: 2861960 - protein, 6 aa, Entamoeba invadens
GSDIPS

SEQ ID NO: 2861961 - protein, 5 aa, Entamoeba invadens
GSDKN

SEQ ID NO: 2861962 - protein, 6 aa, Entamoeba invadens
GSDLSD

SEQ ID NO: 2861963 - protein, 8 aa, Entamoeba invadens
GSDNEEAI

SEQ ID NO: 2861964 - protein, 9 aa, Entamoeba invadens
GSDNEKATE

SEQ ID NO: 2861965 - protein, 9 aa, Entamoeba invadens
GSDNKDAKQ

SEQ ID NO: 2861966 - protein, 8 aa, Entamoeba invadens
GSDNRKTL

SEQ ID NO: 2861967 - protein, 5 aa, Entamoeba invadens
GSDQT

SEQ ID NO: 2861968 - protein, 32 aa, Entamoeba invadens
GSDREIARTEAPTRTVRTTTHQERYTSNGRNC

SEQ ID NO: 2861969 - protein, 5 aa, Entamoeba invadens
GSDRG

SEQ ID NO: 2861970 - protein, 11 aa, Entamoeba invadens
GSDRSPPGGLG

SEQ ID NO: 2861971 - protein, 7 aa, Entamoeba invadens
GSDSQNC

SEQ ID NO: 2861972 - protein, 10 aa, Entamoeba invadens
GSDSTNAIGI

SEQ ID NO: 2861973 - protein, 11 aa, Entamoeba invadens
GSDSVATAGIY

SEQ ID NO: 2861974 - protein, 7 aa, Entamoeba invadens
GSDTMNE

SEQ ID NO: 2861975 - protein, 11 aa, Entamoeba invadens
GSDWEAKGHVQ

SEQ ID NO: 2861976 - protein, 6 aa, Entamoeba invadens
GSDYTI

SEQ ID NO: 2861977 - protein, 4 aa, Entamoeba invadens
GSEA

SEQ ID NO: 2861978 - protein, 6 aa, Entamoeba invadens
GSEAED

SEQ ID NO: 2861979 - protein, 4 aa, Entamoeba invadens
GSED

SEQ ID NO: 2861980 - protein, 6 aa, Entamoeba invadens
GSEDEI

SEQ ID NO: 2861981 - protein, 16 aa, Entamoeba invadens
GSEDGSISVRDSNKMV

SEQ ID NO: 2861982 - protein, 6 aa, Entamoeba invadens
GSEDIK

SEQ ID NO: 2861983 - protein, 11 aa, Entamoeba invadens
GSEDINSIGDK

SEQ ID NO: 2861984 - protein, 11 aa, Entamoeba invadens
GSEDSARIENE

SEQ ID NO: 2861985 - protein, 11 aa, Entamoeba invadens
GSEDSFDPTTR

SEQ ID NO: 2861986 - protein, 7 aa, Entamoeba invadens
GSEDSSV

SEQ ID NO: 2861987 - protein, 7 aa, Entamoeba invadens
GSEEDND

SEQ ID NO: 2861988 - protein, 9 aa, Entamoeba invadens
GSEEEKKGW

SEQ ID NO: 2861989 - protein, 8 aa, Entamoeba invadens
GSEEPQNI

SEQ ID NO: 2861990 - protein, 13 aa, Entamoeba invadens
GSEESVRSFSAED

SEQ ID NO: 2861991 - protein, 6 aa, Entamoeba invadens
GSEEVN

SEQ ID NO: 2861992 - protein, 5 aa, Entamoeba invadens
GSEEY

SEQ ID NO: 2861993 - protein, 6 aa, Entamoeba invadens
GSEEYA

SEQ ID NO: 2861994 - protein, 7 aa, Entamoeba invadens
GSEFDED

SEQ ID NO: 2861995 - protein, 7 aa, Entamoeba invadens
GSEFDRN

SEQ ID NO: 2861996 - protein, 4 aa, Entamoeba invadens
GSEG

SEQ ID NO: 2861997 - protein, 8 aa, Entamoeba invadens
GSEGSTEF

SEQ ID NO: 2861998 - protein, 4 aa, Entamoeba invadens
GSEI

SEQ ID NO: 2861999 - protein, 5 aa, Entamoeba invadens
GSEIS

SEQ ID NO: 2862000 - protein, 7 aa, Entamoeba invadens
GSEKLNR

SEQ ID NO: 2862001 - protein, 5 aa, Entamoeba invadens
GSEKM

SEQ ID NO: 2862002 - protein, 8 aa, Entamoeba invadens
GSEKPKEV

SEQ ID NO: 2862003 - protein, 19 aa, Entamoeba invadens
GSEKVDEGVRGERLEETKN

SEQ ID NO: 2862004 - protein, 12 aa, Entamoeba invadens
GSENAREPWEGD

SEQ ID NO: 2862005 - protein, 10 aa, Entamoeba invadens
GSENCKRAGV

SEQ ID NO: 2862006 - protein, 8 aa, Entamoeba invadens
GSENRYGQ

SEQ ID NO: 2862007 - protein, 7 aa, Entamoeba invadens
GSENTND

SEQ ID NO: 2862008 - protein, 6 aa, Entamoeba invadens
GSEPMY

SEQ ID NO: 2862009 - protein, 8 aa, Entamoeba invadens
GSEPNTII

SEQ ID NO: 2862010 - protein, 8 aa, Entamoeba invadens
GSEPSQLE

SEQ ID NO: 2862011 - protein, 5 aa, Entamoeba invadens
GSEQH

SEQ ID NO: 2862012 - protein, 7 aa, Entamoeba invadens
GSEQNAA

SEQ ID NO: 2862013 - protein, 6 aa, Entamoeba invadens
GSEQSD

SEQ ID NO: 2862014 - protein, 41 aa, Entamoeba invadens
GSERGLTRTGAVRRRRSQSPQPPTRTGAIRRGRRSTSAPPR

SEQ ID NO: 2862015 - protein, 9 aa, Entamoeba invadens
GSERPSKIT

SEQ ID NO: 2862016 - protein, 22 aa, Entamoeba invadens
GSERQSKTQTKGETLKEAGNIN

SEQ ID NO: 2862017 - protein, 12 aa, Entamoeba invadens
GSERVERSGVTG

SEQ ID NO: 2862018 - protein, 4 aa, Entamoeba invadens
GSET

SEQ ID NO: 2862019 - protein, 15 aa, Entamoeba invadens
GSETAGGFEETRSEI

SEQ ID NO: 2862020 - protein, 8 aa, Entamoeba invadens
GSETDYDR

SEQ ID NO: 2862021 - protein, 17 aa, Entamoeba invadens
GSETQQKDWVPNRFCVR

SEQ ID NO: 2862022 - protein, 5 aa, Entamoeba invadens
GSEVE

SEQ ID NO: 2862023 - protein, 20 aa, Entamoeba invadens
GSEVSKKIDHPVSENTPEII

SEQ ID NO: 2862024 - protein, 11 aa, Entamoeba invadens
GSEVSKTQNNL

SEQ ID NO: 2862025 - protein, 14 aa, Entamoeba invadens
GSEWRGSPESYLGH

SEQ ID NO: 2862026 - protein, 12 aa, Entamoeba invadens
GSFAKKPPPTTI

SEQ ID NO: 2862027 - protein, 4 aa, Entamoeba invadens
GSFE

SEQ ID NO: 2862028 - protein, 7 aa, Entamoeba invadens
GSFEEKR

SEQ ID NO: 2862029 - protein, 6 aa, Entamoeba invadens
GSFEER

SEQ ID NO: 2862030 - protein, 24 aa, Entamoeba invadens
GSFETERETEDKRHKNDRNSQFYR

SEQ ID NO: 2862031 - protein, 4 aa, Entamoeba invadens
GSFG

SEQ ID NO: 2862032 - protein, 26 aa, Entamoeba invadens
GSFGLQDQQRSSHPNTTKSTQKTKPV

SEQ ID NO: 2862033 - protein, 4 aa, Entamoeba invadens
GSFI

SEQ ID NO: 2862034 - protein, 10 aa, Entamoeba invadens
GSFNGSGRSI

SEQ ID NO: 2862035 - protein, 4 aa, Entamoeba invadens
GSFP

SEQ ID NO: 2862036 - protein, 10 aa, Entamoeba invadens
GSFPKSHCEE

SEQ ID NO: 2862037 - protein, 18 aa, Entamoeba invadens
GSFPPKIEKKVNKKGCLI

SEQ ID NO: 2862038 - protein, 5 aa, Entamoeba invadens
GSFPQ

SEQ ID NO: 2862039 - protein, 9 aa, Entamoeba invadens
GSFTEADAS

SEQ ID NO: 2862040 - protein, 5 aa, Entamoeba invadens
GSFTI

SEQ ID NO: 2862041 - protein, 8 aa, Entamoeba invadens
GSFTPTNF

SEQ ID NO: 2862042 - protein, 8 aa, Entamoeba invadens
GSFTTNNL

SEQ ID NO: 2862043 - protein, 8 aa, Entamoeba invadens
GSGAEDSF

SEQ ID NO: 2862044 - protein, 7 aa, Entamoeba invadens
GSGASGV

SEQ ID NO: 2862045 - protein, 7 aa, Entamoeba invadens
GSGAYGK

SEQ ID NO: 2862046 - protein, 4 aa, Entamoeba invadens
GSGD

SEQ ID NO: 2862047 - protein, 7 aa, Entamoeba invadens
GSGEQFV

SEQ ID NO: 2862048 - protein, 7 aa, Entamoeba invadens
GSGESVV

SEQ ID NO: 2862049 - protein, 5 aa, Entamoeba invadens
GSGEV

SEQ ID NO: 2862050 - protein, 5 aa, Entamoeba invadens
GSGFS

SEQ ID NO: 2862051 - protein, 9 aa, Entamoeba invadens
GSGFSGTTL

SEQ ID NO: 2862052 - protein, 8 aa, Entamoeba invadens
GSGFTSLK

SEQ ID NO: 2862053 - protein, 7 aa, Entamoeba invadens
GSGGAGV

SEQ ID NO: 2862054 - protein, 4 aa, Entamoeba invadens
GSGI

SEQ ID NO: 2862055 - protein, 4 aa, Entamoeba invadens
GSGK

SEQ ID NO: 2862056 - protein, 5 aa, Entamoeba invadens
GSGKG

SEQ ID NO: 2862057 - protein, 6 aa, Entamoeba invadens
GSGKGY

SEQ ID NO: 2862058 - protein, 12 aa, Entamoeba invadens
GSGKPVDKGPNV

SEQ ID NO: 2862059 - protein, 7 aa, Entamoeba invadens
GSGKTSL

SEQ ID NO: 2862060 - protein, 7 aa, Entamoeba invadens
GSGKTTL

SEQ ID NO: 2862061 - protein, 9 aa, Entamoeba invadens
GSGLSQTQI

SEQ ID NO: 2862062 - protein, 10 aa, Entamoeba invadens
GSGNGKYHNV

SEQ ID NO: 2862063 - protein, 5 aa, Entamoeba invadens
GSGNT

SEQ ID NO: 2862064 - protein, 8 aa, Entamoeba invadens
GSGPAGLS

SEQ ID NO: 2862065 - protein, 4 aa, Entamoeba invadens
GSGQ

SEQ ID NO: 2862066 - protein, 9 aa, Entamoeba invadens
GSGQTHPSH

SEQ ID NO: 2862067 - protein, 4 aa, Entamoeba invadens
GSGR

SEQ ID NO: 2862068 - protein, 6 aa, Entamoeba invadens
GSGRSD

SEQ ID NO: 2862069 - protein, 13 aa, Entamoeba invadens
GSGRTKIETDEQF

SEQ ID NO: 2862070 - protein, 5 aa, Entamoeba invadens
GSGSG

SEQ ID NO: 2862071 - protein, 6 aa, Entamoeba invadens
GSGSPF

SEQ ID NO: 2862072 - protein, 8 aa, Entamoeba invadens
GSGSVAAT

SEQ ID NO: 2862073 - protein, 15 aa, Entamoeba invadens
GSGSVTKSVQDPSVE

SEQ ID NO: 2862074 - protein, 7 aa, Entamoeba invadens
GSGSYGK

SEQ ID NO: 2862075 - protein, 10 aa, Entamoeba invadens
GSGSYRTKYY

SEQ ID NO: 2862076 - protein, 5 aa, Entamoeba invadens
GSGVH

SEQ ID NO: 2862077 - protein, 11 aa, Entamoeba invadens
GSHAQEDPLPM

SEQ ID NO: 2862078 - protein, 25 aa, Entamoeba invadens
GSHEFKKDANTPKPEVKEIKQTPEI

SEQ ID NO: 2862079 - protein, 4 aa, Entamoeba invadens
GSHN

SEQ ID NO: 2862080 - protein, 7 aa, Entamoeba invadens
GSIASDH

SEQ ID NO: 2862081 - protein, 4 aa, Entamoeba invadens
GSID

SEQ ID NO: 2862082 - protein, 11 aa, Entamoeba invadens
GSIDSKGGFTI

SEQ ID NO: 2862083 - protein, 10 aa, Entamoeba invadens
GSIEDVKHNK

SEQ ID NO: 2862084 - protein, 5 aa, Entamoeba invadens
GSIEE

SEQ ID NO: 2862085 - protein, 6 aa, Entamoeba invadens
GSIESN

SEQ ID NO: 2862086 - protein, 4 aa, Entamoeba invadens
GSIF

SEQ ID NO: 2862087 - protein, 6 aa, Entamoeba invadens
GSIGEQ

SEQ ID NO: 2862088 - protein, 14 aa, Entamoeba invadens
GSIGSKIKKEEGVD

SEQ ID NO: 2862089 - protein, 9 aa, Entamoeba invadens
GSIKKNGVY

SEQ ID NO: 2862090 - protein, 10 aa, Entamoeba invadens
GSIKKNGVYD

SEQ ID NO: 2862091 - protein, 6 aa, Entamoeba invadens
GSIKQT

SEQ ID NO: 2862092 - protein, 5 aa, Entamoeba invadens
GSINN

SEQ ID NO: 2862093 - protein, 6 aa, Entamoeba invadens
GSINTN

SEQ ID NO: 2862094 - protein, 6 aa, Entamoeba invadens
GSIPQY

SEQ ID NO: 2862095 - protein, 4 aa, Entamoeba invadens
GSIQ

SEQ ID NO: 2862096 - protein, 8 aa, Entamoeba invadens
GSISGNPI

SEQ ID NO: 2862097 - protein, 7 aa, Entamoeba invadens
GSISKDA

SEQ ID NO: 2862098 - protein, 7 aa, Entamoeba invadens
GSISKDT

SEQ ID NO: 2862099 - protein, 8 aa, Entamoeba invadens
GSISSTEL

SEQ ID NO: 2862100 - protein, 7 aa, Entamoeba invadens
GSITNTI

SEQ ID NO: 2862101 - protein, 6 aa, Entamoeba invadens
GSITRA

SEQ ID NO: 2862102 - protein, 4 aa, Entamoeba invadens
GSIV

SEQ ID NO: 2862103 - protein, 7 aa, Entamoeba invadens
GSKAEMA

SEQ ID NO: 2862104 - protein, 41 aa, Entamoeba invadens
GSKARIEKEDENVRSEKVREDVGGDVKKSGIRRDVEAPREC

SEQ ID NO: 2862105 - protein, 10 aa, Entamoeba invadens
GSKASTPKKA

SEQ ID NO: 2862106 - protein, 7 aa, Entamoeba invadens
GSKDSTI

SEQ ID NO: 2862107 - protein, 15 aa, Entamoeba invadens
GSKEHQRSYGLTAIV

SEQ ID NO: 2862108 - protein, 5 aa, Entamoeba invadens
GSKEN

SEQ ID NO: 2862109 - protein, 8 aa, Entamoeba invadens
GSKENRKL

SEQ ID NO: 2862110 - protein, 10 aa, Entamoeba invadens
GSKETKPIQE

SEQ ID NO: 2862111 - protein, 15 aa, Entamoeba invadens
GSKGDWTPCGSKENA

SEQ ID NO: 2862112 - protein, 18 aa, Entamoeba invadens
GSKHSKGSYRSLVSAGGA

SEQ ID NO: 2862113 - protein, 13 aa, Entamoeba invadens
GSKIEPDQDKVKQ

SEQ ID NO: 2862114 - protein, 13 aa, Entamoeba invadens
GSKKNEETGQGAN

SEQ ID NO: 2862115 - protein, 21 aa, Entamoeba invadens
GSKKSKSSRDIGKSSMSNATN

SEQ ID NO: 2862116 - protein, 9 aa, Entamoeba invadens
GSKNEQNGF

SEQ ID NO: 2862117 - protein, 5 aa, Entamoeba invadens
GSKPF

SEQ ID NO: 2862118 - protein, 10 aa, Entamoeba invadens
GSKRATPRRD

SEQ ID NO: 2862119 - protein, 17 aa, Entamoeba invadens
GSKSDFDTLPENMDNGS

SEQ ID NO: 2862120 - protein, 16 aa, Entamoeba invadens
GSKSPPFGQKGRPFRP

SEQ ID NO: 2862121 - protein, 13 aa, Entamoeba invadens
GSKTMSSESRLNY

SEQ ID NO: 2862122 - protein, 12 aa, Entamoeba invadens
GSLAAYPNLPNS

SEQ ID NO: 2862123 - protein, 15 aa, Entamoeba invadens
GSLDNIEGKWKPEID

SEQ ID NO: 2862124 - protein, 10 aa, Entamoeba invadens
GSLEEDEVEQ

SEQ ID NO: 2862125 - protein, 17 aa, Entamoeba invadens
GSLEGKSAKDVGLEGEK

SEQ ID NO: 2862126 - protein, 11 aa, Entamoeba invadens
GSLEKDPPERT

SEQ ID NO: 2862127 - protein, 23 aa, Entamoeba invadens
GSLEKKETGTEMKLTGDQRKAAS

SEQ ID NO: 2862128 - protein, 10 aa, Entamoeba invadens
GSLENQKNID

SEQ ID NO: 2862129 - protein, 11 aa, Entamoeba invadens
GSLEQAGITAN

SEQ ID NO: 2862130 - protein, 8 aa, Entamoeba invadens
GSLEQAGL

SEQ ID NO: 2862131 - protein, 7 aa, Entamoeba invadens
GSLKDNS

SEQ ID NO: 2862132 - protein, 11 aa, Entamoeba invadens
GSLKGKPNPDI

SEQ ID NO: 2862133 - protein, 10 aa, Entamoeba invadens
GSLKSTPLYT

SEQ ID NO: 2862134 - protein, 10 aa, Entamoeba invadens
GSLPEEVNPF

SEQ ID NO: 2862135 - protein, 6 aa, Entamoeba invadens
GSLPSN

SEQ ID NO: 2862136 - protein, 10 aa, Entamoeba invadens
GSLQQNTNQS

SEQ ID NO: 2862137 - protein, 8 aa, Entamoeba invadens
GSLSEDEE

SEQ ID NO: 2862138 - protein, 12 aa, Entamoeba invadens
GSLSKSDKEKAF

SEQ ID NO: 2862139 - protein, 21 aa, Entamoeba invadens
GSLSRSRSTSKPKESTPKRLE

SEQ ID NO: 2862140 - protein, 8 aa, Entamoeba invadens
GSLSSSEN

SEQ ID NO: 2862141 - protein, 10 aa, Entamoeba invadens
GSLTDSPSLD

SEQ ID NO: 2862142 - protein, 7 aa, Entamoeba invadens
GSLTGAM

SEQ ID NO: 2862143 - protein, 8 aa, Entamoeba invadens
GSLTKRSK

SEQ ID NO: 2862144 - protein, 12 aa, Entamoeba invadens
GSLTRQNEKTLN

SEQ ID NO: 2862145 - protein, 11 aa, Entamoeba invadens
GSMCGKGIESL

SEQ ID NO: 2862146 - protein, 9 aa, Entamoeba invadens
GSMGNDGKN

SEQ ID NO: 2862147 - protein, 6 aa, Entamoeba invadens
GSMGTS

SEQ ID NO: 2862148 - protein, 6 aa, Entamoeba invadens
GSMPPM

SEQ ID NO: 2862149 - protein, 8 aa, Entamoeba invadens
GSMSDRDI

SEQ ID NO: 2862150 - protein, 7 aa, Entamoeba invadens
GSNCGTL

SEQ ID NO: 2862151 - protein, 4 aa, Entamoeba invadens
GSND

SEQ ID NO: 2862152 - protein, 5 aa, Entamoeba invadens
GSNDG

SEQ ID NO: 2862153 - protein, 6 aa, Entamoeba invadens
GSNDWD

SEQ ID NO: 2862154 - protein, 6 aa, Entamoeba invadens
GSNFDS

SEQ ID NO: 2862155 - protein, 5 aa, Entamoeba invadens
GSNGF

SEQ ID NO: 2862156 - protein, 9 aa, Entamoeba invadens
GSNGSWKMS

SEQ ID NO: 2862157 - protein, 5 aa, Entamoeba invadens
GSNIE

SEQ ID NO: 2862158 - protein, 6 aa, Entamoeba invadens
GSNIGE

SEQ ID NO: 2862159 - protein, 13 aa, Entamoeba invadens
GSNISTGKQTYKN

SEQ ID NO: 2862160 - protein, 9 aa, Entamoeba invadens
GSNKRLEEE

SEQ ID NO: 2862161 - protein, 6 aa, Entamoeba invadens
GSNLNS

SEQ ID NO: 2862162 - protein, 5 aa, Entamoeba invadens
GSNME

SEQ ID NO: 2862163 - protein, 5 aa, Entamoeba invadens
GSNMP

SEQ ID NO: 2862164 - protein, 5 aa, Entamoeba invadens
GSNNE

SEQ ID NO: 2862165 - protein, 8 aa, Entamoeba invadens
GSNPQTIE

SEQ ID NO: 2862166 - protein, 25 aa, Entamoeba invadens
GSNSDSEESRRTSSLQSPSSSMSPR

SEQ ID NO: 2862167 - protein, 6 aa, Entamoeba invadens
GSNTEI

SEQ ID NO: 2862168 - protein, 8 aa, Entamoeba invadens
GSNTETLN

SEQ ID NO: 2862169 - protein, 6 aa, Entamoeba invadens
GSNTGA

SEQ ID NO: 2862170 - protein, 8 aa, Entamoeba invadens
GSNTKCPQ

SEQ ID NO: 2862171 - protein, 5 aa, Entamoeba invadens
GSNTQ

SEQ ID NO: 2862172 - protein, 28 aa, Entamoeba invadens
GSNTTTVNGSDTDSFKNTENKDAKIEEL

SEQ ID NO: 2862173 - protein, 4 aa, Entamoeba invadens
GSNV

SEQ ID NO: 2862174 - protein, 15 aa, Entamoeba invadens
GSNYRETTPTRRPME

SEQ ID NO: 2862175 - protein, 10 aa, Entamoeba invadens
GSPAIKGQIQ

SEQ ID NO: 2862176 - protein, 4 aa, Entamoeba invadens
GSPC

SEQ ID NO: 2862177 - protein, 10 aa, Entamoeba invadens
GSPDESDARQ

SEQ ID NO: 2862178 - protein, 8 aa, Entamoeba invadens
GSPDPVEI

SEQ ID NO: 2862179 - protein, 8 aa, Entamoeba invadens
GSPENGVQ

SEQ ID NO: 2862180 - protein, 5 aa, Entamoeba invadens
GSPFT

SEQ ID NO: 2862181 - protein, 8 aa, Entamoeba invadens
GSPGQTKE

SEQ ID NO: 2862182 - protein, 12 aa, Entamoeba invadens
GSPGVGKTTTAK

SEQ ID NO: 2862183 - protein, 4 aa, Entamoeba invadens
GSPI

SEQ ID NO: 2862184 - protein, 10 aa, Entamoeba invadens
GSPIHDEKEI

SEQ ID NO: 2862185 - protein, 6 aa, Entamoeba invadens
GSPIPC

SEQ ID NO: 2862186 - protein, 7 aa, Entamoeba invadens
GSPIQNN

SEQ ID NO: 2862187 - protein, 9 aa, Entamoeba invadens
GSPKNFGNS

SEQ ID NO: 2862188 - protein, 9 aa, Entamoeba invadens
GSPKRNGSV

SEQ ID NO: 2862189 - protein, 5 aa, Entamoeba invadens
GSPLS

SEQ ID NO: 2862190 - protein, 7 aa, Entamoeba invadens
GSPLSEK

SEQ ID NO: 2862191 - protein, 5 aa, Entamoeba invadens
GSPQL

SEQ ID NO: 2862192 - protein, 12 aa, Entamoeba invadens
GSPRDTESSDTE

SEQ ID NO: 2862193 - protein, 10 aa, Entamoeba invadens
GSPREHGNTS

SEQ ID NO: 2862194 - protein, 31 aa, Entamoeba invadens
GSPRSSKKITASQTNPEKSDHPENNNKTETF

SEQ ID NO: 2862195 - protein, 19 aa, Entamoeba invadens
GSPSFEKEPYGETSIYNED

SEQ ID NO: 2862196 - protein, 22 aa, Entamoeba invadens
GSPSFQSKQTRSSENLTTNPRK

SEQ ID NO: 2862197 - protein, 6 aa, Entamoeba invadens
GSPSLC

SEQ ID NO: 2862198 - protein, 6 aa, Entamoeba invadens
GSPSYV

SEQ ID NO: 2862199 - protein, 19 aa, Entamoeba invadens
GSPTADEIKGMNPESPYTR

SEQ ID NO: 2862200 - protein, 6 aa, Entamoeba invadens
GSPTDV

SEQ ID NO: 2862201 - protein, 6 aa, Entamoeba invadens
GSPTKT

SEQ ID NO: 2862202 - protein, 16 aa, Entamoeba invadens
GSPTTEIGKLESQAKR

SEQ ID NO: 2862203 - protein, 6 aa, Entamoeba invadens
GSPTYP

SEQ ID NO: 2862204 - protein, 4 aa, Entamoeba invadens
GSPW

SEQ ID NO: 2862205 - protein, 9 aa, Entamoeba invadens
GSPYSDISS

SEQ ID NO: 2862206 - protein, 5 aa, Entamoeba invadens
GSQEM

SEQ ID NO: 2862207 - protein, 8 aa, Entamoeba invadens
GSQKEEMD

SEQ ID NO: 2862208 - protein, 5 aa, Entamoeba invadens
GSQKS

SEQ ID NO: 2862209 - protein, 12 aa, Entamoeba invadens
GSQSITTTQKKL

SEQ ID NO: 2862210 - protein, 8 aa, Entamoeba invadens
GSQTAQEI

SEQ ID NO: 2862211 - protein, 8 aa, Entamoeba invadens
GSQYSEEV

SEQ ID NO: 2862212 - protein, 6 aa, Entamoeba invadens
GSQYSN

SEQ ID NO: 2862213 - protein, 5 aa, Entamoeba invadens
GSRDG

SEQ ID NO: 2862214 - protein, 100 aa, Entamoeba invadens
GSRDSYGSYGRQNDRQTRFGGYGSSNYGDKNNSYGDRNNGDRRSGFGGGRFGGDRNNGDRNNSYGDRNGDRRNSGYGDRNGQRGYGDRGNSRDGYRGKSN

SEQ ID NO: 2862215 - protein, 7 aa, Entamoeba invadens
GSRDWSG

SEQ ID NO: 2862216 - protein, 5 aa, Entamoeba invadens
GSRDY

SEQ ID NO: 2862217 - protein, 6 aa, Entamoeba invadens
GSRGDG

SEQ ID NO: 2862218 - protein, 5 aa, Entamoeba invadens
GSRGG

SEQ ID NO: 2862219 - protein, 4 aa, Entamoeba invadens
GSRL

SEQ ID NO: 2862220 - protein, 7 aa, Entamoeba invadens
GSRLSEG

SEQ ID NO: 2862221 - protein, 16 aa, Entamoeba invadens
GSRMEGNTVQKRAEMD

SEQ ID NO: 2862222 - protein, 14 aa, Entamoeba invadens
GSRREKKERNIEQQ

SEQ ID NO: 2862223 - protein, 35 aa, Entamoeba invadens
GSRRGRRVAQKSEVSESISETQSEEPQPQKRRGLQ

SEQ ID NO: 2862224 - protein, 17 aa, Entamoeba invadens
GSRRKGDKQSGKTPEQD

SEQ ID NO: 2862225 - protein, 6 aa, Entamoeba invadens
GSRSFH

SEQ ID NO: 2862226 - protein, 6 aa, Entamoeba invadens
GSRSSI

SEQ ID NO: 2862227 - protein, 7 aa, Entamoeba invadens
GSRYSEK

SEQ ID NO: 2862228 - protein, 11 aa, Entamoeba invadens
GSSALKNNPLE

SEQ ID NO: 2862229 - protein, 7 aa, Entamoeba invadens
GSSAVPY

SEQ ID NO: 2862230 - protein, 7 aa, Entamoeba invadens
GSSDGSV

SEQ ID NO: 2862231 - protein, 6 aa, Entamoeba invadens
GSSDHI

SEQ ID NO: 2862232 - protein, 7 aa, Entamoeba invadens
GSSDKTV

SEQ ID NO: 2862233 - protein, 6 aa, Entamoeba invadens
GSSDRT

SEQ ID NO: 2862234 - protein, 4 aa, Entamoeba invadens
GSSE

SEQ ID NO: 2862235 - protein, 10 aa, Entamoeba invadens
GSSEESERVE

SEQ ID NO: 2862236 - protein, 18 aa, Entamoeba invadens
GSSEESLEYSDESENTNC

SEQ ID NO: 2862237 - protein, 6 aa, Entamoeba invadens
GSSEYN

SEQ ID NO: 2862238 - protein, 7 aa, Entamoeba invadens
GSSEYRI

SEQ ID NO: 2862239 - protein, 27 aa, Entamoeba invadens
GSSFEDSSIKTNAASRKRTKKNDKKNV

SEQ ID NO: 2862240 - protein, 7 aa, Entamoeba invadens
GSSGIRP

SEQ ID NO: 2862241 - protein, 6 aa, Entamoeba invadens
GSSHGK

SEQ ID NO: 2862242 - protein, 9 aa, Entamoeba invadens
GSSHKYKNG

SEQ ID NO: 2862243 - protein, 4 aa, Entamoeba invadens
GSSL

SEQ ID NO: 2862244 - protein, 11 aa, Entamoeba invadens
GSSLEECRAET

SEQ ID NO: 2862245 - protein, 7 aa, Entamoeba invadens
GSSLTGY

SEQ ID NO: 2862246 - protein, 14 aa, Entamoeba invadens
GSSNSDSEDSRGRI

SEQ ID NO: 2862247 - protein, 6 aa, Entamoeba invadens
GSSNTT

SEQ ID NO: 2862248 - protein, 7 aa, Entamoeba invadens
GSSNVHN

SEQ ID NO: 2862249 - protein, 4 aa, Entamoeba invadens
GSSQ

SEQ ID NO: 2862250 - protein, 11 aa, Entamoeba invadens
GSSQDAIQSIS

SEQ ID NO: 2862251 - protein, 9 aa, Entamoeba invadens
GSSQVDESR

SEQ ID NO: 2862252 - protein, 8 aa, Entamoeba invadens
GSSSDSIP

SEQ ID NO: 2862253 - protein, 7 aa, Entamoeba invadens
GSSSGGK

SEQ ID NO: 2862254 - protein, 5 aa, Entamoeba invadens
GSSSI

SEQ ID NO: 2862255 - protein, 6 aa, Entamoeba invadens
GSSSQR

SEQ ID NO: 2862256 - protein, 23 aa, Entamoeba invadens
GSSSSSGSCKTPTKNLADSNGKS

SEQ ID NO: 2862257 - protein, 7 aa, Entamoeba invadens
GSSTGTV

SEQ ID NO: 2862258 - protein, 21 aa, Entamoeba invadens
GSSTRAGNCGQPGSSRDGADV

SEQ ID NO: 2862259 - protein, 22 aa, Entamoeba invadens
GSSTRAGNSGYPGSSRDGADVE

SEQ ID NO: 2862260 - protein, 61 aa, Entamoeba invadens
GSSTSNKPSSQPKPASQPKQEKTENTSNKPQEGTHVPKAKGDQPVIENRPNGKKEVVSGDK

SEQ ID NO: 2862261 - protein, 14 aa, Entamoeba invadens
GSSTTHNTSGTEYI

SEQ ID NO: 2862262 - protein, 6 aa, Entamoeba invadens
GSSVNA

SEQ ID NO: 2862263 - protein, 14 aa, Entamoeba invadens
GSSYKAVSSQSQQT

SEQ ID NO: 2862264 - protein, 8 aa, Entamoeba invadens
GSSYNTPL

SEQ ID NO: 2862265 - protein, 10 aa, Entamoeba invadens
GSSYSYSQHQ

SEQ ID NO: 2862266 - protein, 4 aa, Entamoeba invadens
GSTE

SEQ ID NO: 2862267 - protein, 11 aa, Entamoeba invadens
GSTEFGQEGDS

SEQ ID NO: 2862268 - protein, 6 aa, Entamoeba invadens
GSTIPT

SEQ ID NO: 2862269 - protein, 5 aa, Entamoeba invadens
GSTIS

SEQ ID NO: 2862270 - protein, 8 aa, Entamoeba invadens
GSTKIPKI

SEQ ID NO: 2862271 - protein, 10 aa, Entamoeba invadens
GSTLKSDGKR

SEQ ID NO: 2862272 - protein, 10 aa, Entamoeba invadens
GSTNLNEDQA

SEQ ID NO: 2862273 - protein, 8 aa, Entamoeba invadens
GSTNQNAT

SEQ ID NO: 2862274 - protein, 4 aa, Entamoeba invadens
GSTP

SEQ ID NO: 2862275 - protein, 8 aa, Entamoeba invadens
GSTPTEVK

SEQ ID NO: 2862276 - protein, 9 aa, Entamoeba invadens
GSTQDGALA

SEQ ID NO: 2862277 - protein, 13 aa, Entamoeba invadens
GSTQDGASENMGC

SEQ ID NO: 2862278 - protein, 32 aa, Entamoeba invadens
GSTQSSEQKDCPKQIPSFNTKQSRSDSSSSTC

SEQ ID NO: 2862279 - protein, 8 aa, Entamoeba invadens
GSTRQRVD

SEQ ID NO: 2862280 - protein, 6 aa, Entamoeba invadens
GSTSFT

SEQ ID NO: 2862281 - protein, 7 aa, Entamoeba invadens
GSTSPLA

SEQ ID NO: 2862282 - protein, 15 aa, Entamoeba invadens
GSTSTVPIRNTSSLD

SEQ ID NO: 2862283 - protein, 7 aa, Entamoeba invadens
GSTTTCT

SEQ ID NO: 2862284 - protein, 7 aa, Entamoeba invadens
GSTVESI

SEQ ID NO: 2862285 - protein, 13 aa, Entamoeba invadens
GSTVVGTTRYPEE

SEQ ID NO: 2862286 - protein, 6 aa, Entamoeba invadens
GSVATL

SEQ ID NO: 2862287 - protein, 8 aa, Entamoeba invadens
GSVDESEI

SEQ ID NO: 2862288 - protein, 8 aa, Entamoeba invadens
GSVDKGRS

SEQ ID NO: 2862289 - protein, 10 aa, Entamoeba invadens
GSVEESALSG

SEQ ID NO: 2862290 - protein, 9 aa, Entamoeba invadens
GSVEKNDES

SEQ ID NO: 2862291 - protein, 5 aa, Entamoeba invadens
GSVFG

SEQ ID NO: 2862292 - protein, 21 aa, Entamoeba invadens
GSVGESVKEPSREISDKKGDL

SEQ ID NO: 2862293 - protein, 5 aa, Entamoeba invadens
GSVGK

SEQ ID NO: 2862294 - protein, 6 aa, Entamoeba invadens
GSVGKS

SEQ ID NO: 2862295 - protein, 7 aa, Entamoeba invadens
GSVGKSA

SEQ ID NO: 2862296 - protein, 21 aa, Entamoeba invadens
GSVGYCSDDGKVYNSSGESVK

SEQ ID NO: 2862297 - protein, 4 aa, Entamoeba invadens
GSVI

SEQ ID NO: 2862298 - protein, 9 aa, Entamoeba invadens
GSVKCSSQL

SEQ ID NO: 2862299 - protein, 5 aa, Entamoeba invadens
GSVKN

SEQ ID NO: 2862300 - protein, 10 aa, Entamoeba invadens
GSVKYTDTKG

SEQ ID NO: 2862301 - protein, 5 aa, Entamoeba invadens
GSVLE

SEQ ID NO: 2862302 - protein, 4 aa, Entamoeba invadens
GSVN

SEQ ID NO: 2862303 - protein, 8 aa, Entamoeba invadens
GSVNGRSV

SEQ ID NO: 2862304 - protein, 9 aa, Entamoeba invadens
GSVPAEKEL

SEQ ID NO: 2862305 - protein, 6 aa, Entamoeba invadens
GSVPND

SEQ ID NO: 2862306 - protein, 15 aa, Entamoeba invadens
GSVPQRATSKALRLD

SEQ ID NO: 2862307 - protein, 20 aa, Entamoeba invadens
GSVQNTQPLKVKTNELPKPI

SEQ ID NO: 2862308 - protein, 6 aa, Entamoeba invadens
GSVRKY

SEQ ID NO: 2862309 - protein, 8 aa, Entamoeba invadens
GSVSAALS

SEQ ID NO: 2862310 - protein, 9 aa, Entamoeba invadens
GSVSESERR

SEQ ID NO: 2862311 - protein, 10 aa, Entamoeba invadens
GSVSTGKEAN

SEQ ID NO: 2862312 - protein, 6 aa, Entamoeba invadens
GSVTPN

SEQ ID NO: 2862313 - protein, 15 aa, Entamoeba invadens
GSVTTPCPKEKIDTI

SEQ ID NO: 2862314 - protein, 4 aa, Entamoeba invadens
GSVY

SEQ ID NO: 2862315 - protein, 4 aa, Entamoeba invadens
GSWD

SEQ ID NO: 2862316 - protein, 7 aa, Entamoeba invadens
GSWKDAN

SEQ ID NO: 2862317 - protein, 6 aa, Entamoeba invadens
GSYATV

SEQ ID NO: 2862318 - protein, 5 aa, Entamoeba invadens
GSYDK

SEQ ID NO: 2862319 - protein, 18 aa, Entamoeba invadens
GSYDPTLEDSYKGQITVD

SEQ ID NO: 2862320 - protein, 6 aa, Entamoeba invadens
GSYESL

SEQ ID NO: 2862321 - protein, 16 aa, Entamoeba invadens
GSYGSATSNITETQEQ

SEQ ID NO: 2862322 - protein, 8 aa, Entamoeba invadens
GSYKTSAD

SEQ ID NO: 2862323 - protein, 9 aa, Entamoeba invadens
GSYNGEHGA

SEQ ID NO: 2862324 - protein, 6 aa, Entamoeba invadens
GSYNSL

SEQ ID NO: 2862325 - protein, 5 aa, Entamoeba invadens
GSYNV

SEQ ID NO: 2862326 - protein, 9 aa, Entamoeba invadens
GSYPPKNDF

SEQ ID NO: 2862327 - protein, 9 aa, Entamoeba invadens
GSYPPKNEF

SEQ ID NO: 2862328 - protein, 9 aa, Entamoeba invadens
GSYPQTAGD

SEQ ID NO: 2862329 - protein, 6 aa, Entamoeba invadens
GSYPSQ

SEQ ID NO: 2862330 - protein, 13 aa, Entamoeba invadens
GSYPSRDPYRAEE

SEQ ID NO: 2862331 - protein, 30 aa, Entamoeba invadens
GSYQPKAKPQEQPAAEPAKTTNPAENVFDF

SEQ ID NO: 2862332 - protein, 6 aa, Entamoeba invadens
GSYQYS

SEQ ID NO: 2862333 - protein, 7 aa, Entamoeba invadens
GSYRGND

SEQ ID NO: 2862334 - protein, 4 aa, Entamoeba invadens
GSYS

SEQ ID NO: 2862335 - protein, 18 aa, Entamoeba invadens
GSYSTRAGFAGDEAPRSY

SEQ ID NO: 2862336 - protein, 12 aa, Entamoeba invadens
GSYYGKEEEVPT

SEQ ID NO: 2862337 - protein, 5 aa, Entamoeba invadens
GTAEN

SEQ ID NO: 2862338 - protein, 8 aa, Entamoeba invadens
GTAFRGNA

SEQ ID NO: 2862339 - protein, 6 aa, Entamoeba invadens
GTAGEP

SEQ ID NO: 2862340 - protein, 6 aa, Entamoeba invadens
GTAGGA

SEQ ID NO: 2862341 - protein, 4 aa, Entamoeba invadens
GTAK

SEQ ID NO: 2862342 - protein, 6 aa, Entamoeba invadens
GTAKKE

SEQ ID NO: 2862343 - protein, 19 aa, Entamoeba invadens
GTAKSAGDVGEGKEGNNSA

SEQ ID NO: 2862344 - protein, 5 aa, Entamoeba invadens
GTAKY

SEQ ID NO: 2862345 - protein, 6 aa, Entamoeba invadens
GTALKE

SEQ ID NO: 2862346 - protein, 18 aa, Entamoeba invadens
GTAPGYANAQYPGQQTPV

SEQ ID NO: 2862347 - protein, 14 aa, Entamoeba invadens
GTAQYTADDETHAK

SEQ ID NO: 2862348 - protein, 4 aa, Entamoeba invadens
GTAR

SEQ ID NO: 2862349 - protein, 17 aa, Entamoeba invadens
GTASCNPQEDSPDDGGV

SEQ ID NO: 2862350 - protein, 8 aa, Entamoeba invadens
GTASEKAI

SEQ ID NO: 2862351 - protein, 15 aa, Entamoeba invadens
GTATDAPQKSTETRS

SEQ ID NO: 2862352 - protein, 5 aa, Entamoeba invadens
GTATP

SEQ ID NO: 2862353 - protein, 13 aa, Entamoeba invadens
GTATQKPTETVKR

SEQ ID NO: 2862354 - protein, 6 aa, Entamoeba invadens
GTATSL

SEQ ID NO: 2862355 - protein, 8 aa, Entamoeba invadens
GTATSLEG

SEQ ID NO: 2862356 - protein, 14 aa, Entamoeba invadens
GTATVHPSIKSTYD

SEQ ID NO: 2862357 - protein, 5 aa, Entamoeba invadens
GTCDT

SEQ ID NO: 2862358 - protein, 5 aa, Entamoeba invadens
GTCEN

SEQ ID NO: 2862359 - protein, 4 aa, Entamoeba invadens
GTCR

SEQ ID NO: 2862360 - protein, 5 aa, Entamoeba invadens
GTCVD

SEQ ID NO: 2862361 - protein, 6 aa, Entamoeba invadens
GTDAVK

SEQ ID NO: 2862362 - protein, 8 aa, Entamoeba invadens
GTDDHRTP

SEQ ID NO: 2862363 - protein, 5 aa, Entamoeba invadens
GTDGN

SEQ ID NO: 2862364 - protein, 8 aa, Entamoeba invadens
GTDKADNR

SEQ ID NO: 2862365 - protein, 5 aa, Entamoeba invadens
GTDKE

SEQ ID NO: 2862366 - protein, 7 aa, Entamoeba invadens
GTDKNTL

SEQ ID NO: 2862367 - protein, 7 aa, Entamoeba invadens
GTDKSKV

SEQ ID NO: 2862368 - protein, 17 aa, Entamoeba invadens
GTDKTHTASKHAKIKTP

SEQ ID NO: 2862369 - protein, 10 aa, Entamoeba invadens
GTDKTRTDNF

SEQ ID NO: 2862370 - protein, 7 aa, Entamoeba invadens
GTDLKDV

SEQ ID NO: 2862371 - protein, 11 aa, Entamoeba invadens
GTDLSRDDRTK

SEQ ID NO: 2862372 - protein, 7 aa, Entamoeba invadens
GTDNKTV

SEQ ID NO: 2862373 - protein, 9 aa, Entamoeba invadens
GTDPAYLEG

SEQ ID NO: 2862374 - protein, 6 aa, Entamoeba invadens
GTDPNW

SEQ ID NO: 2862375 - protein, 8 aa, Entamoeba invadens
GTDPTLRR

SEQ ID NO: 2862376 - protein, 9 aa, Entamoeba invadens
GTDRRTFSV

SEQ ID NO: 2862377 - protein, 6 aa, Entamoeba invadens
GTDSEF

SEQ ID NO: 2862378 - protein, 4 aa, Entamoeba invadens
GTEA

SEQ ID NO: 2862379 - protein, 11 aa, Entamoeba invadens
GTEAFSDSTSL

SEQ ID NO: 2862380 - protein, 26 aa, Entamoeba invadens
GTEARQVTSNQGHLSKPTSQARVRGL

SEQ ID NO: 2862381 - protein, 7 aa, Entamoeba invadens
GTECSGS

SEQ ID NO: 2862382 - protein, 6 aa, Entamoeba invadens
GTEEHS

SEQ ID NO: 2862383 - protein, 6 aa, Entamoeba invadens
GTEEVA

SEQ ID NO: 2862384 - protein, 9 aa, Entamoeba invadens
GTEEVEKQR

SEQ ID NO: 2862385 - protein, 16 aa, Entamoeba invadens
GTEFGTKRLTDKPTYQ

SEQ ID NO: 2862386 - protein, 7 aa, Entamoeba invadens
GTEGSKS

SEQ ID NO: 2862387 - protein, 6 aa, Entamoeba invadens
GTEHSN

SEQ ID NO: 2862388 - protein, 6 aa, Entamoeba invadens
GTEIEG

SEQ ID NO: 2862389 - protein, 14 aa, Entamoeba invadens
GTEIPEEKDYFKKN

SEQ ID NO: 2862390 - protein, 9 aa, Entamoeba invadens
GTEKADNRN

SEQ ID NO: 2862391 - protein, 6 aa, Entamoeba invadens
GTEKGD

SEQ ID NO: 2862392 - protein, 16 aa, Entamoeba invadens
GTEKLDSSNKDAQRKI

SEQ ID NO: 2862393 - protein, 20 aa, Entamoeba invadens
GTEKVTSVEENAFKNTPKLE

SEQ ID NO: 2862394 - protein, 12 aa, Entamoeba invadens
GTELKKENEEVL

SEQ ID NO: 2862395 - protein, 5 aa, Entamoeba invadens
GTELP

SEQ ID NO: 2862396 - protein, 9 aa, Entamoeba invadens
GTELPKTST

SEQ ID NO: 2862397 - protein, 4 aa, Entamoeba invadens
GTEN

SEQ ID NO: 2862398 - protein, 10 aa, Entamoeba invadens
GTENQNGKDV

SEQ ID NO: 2862399 - protein, 13 aa, Entamoeba invadens
GTENYTETTIELG

SEQ ID NO: 2862400 - protein, 7 aa, Entamoeba invadens
GTEPVTF

SEQ ID NO: 2862401 - protein, 8 aa, Entamoeba invadens
GTESLQSP

SEQ ID NO: 2862402 - protein, 29 aa, Entamoeba invadens
GTESPDQVRQKDAASKECWTETAGKTNRK

SEQ ID NO: 2862403 - protein, 10 aa, Entamoeba invadens
GTETRDVTEN

SEQ ID NO: 2862404 - protein, 5 aa, Entamoeba invadens
GTEVD

SEQ ID NO: 2862405 - protein, 10 aa, Entamoeba invadens
GTFAKSQEQL

SEQ ID NO: 2862406 - protein, 5 aa, Entamoeba invadens
GTFDT

SEQ ID NO: 2862407 - protein, 4 aa, Entamoeba invadens
GTFE

SEQ ID NO: 2862408 - protein, 13 aa, Entamoeba invadens
GTFKPDEKSTIGA

SEQ ID NO: 2862409 - protein, 16 aa, Entamoeba invadens
GTFKQHNSSTSENNEI

SEQ ID NO: 2862410 - protein, 10 aa, Entamoeba invadens
GTFNGSGRSI

SEQ ID NO: 2862411 - protein, 11 aa, Entamoeba invadens
GTFPKSHDTDD

SEQ ID NO: 2862412 - protein, 8 aa, Entamoeba invadens
GTFPVPEK

SEQ ID NO: 2862413 - protein, 8 aa, Entamoeba invadens
GTFQNRKN

SEQ ID NO: 2862414 - protein, 5 aa, Entamoeba invadens
GTFQQ

SEQ ID NO: 2862415 - protein, 6 aa, Entamoeba invadens
GTFRGN

SEQ ID NO: 2862416 - protein, 8 aa, Entamoeba invadens
GTFSDEVH

SEQ ID NO: 2862417 - protein, 6 aa, Entamoeba invadens
GTFSKS

SEQ ID NO: 2862418 - protein, 8 aa, Entamoeba invadens
GTFTDVGS

SEQ ID NO: 2862419 - protein, 12 aa, Entamoeba invadens
GTFTPPKRTPCI

SEQ ID NO: 2862420 - protein, 4 aa, Entamoeba invadens
GTGA

SEQ ID NO: 2862421 - protein, 5 aa, Entamoeba invadens
GTGAH

SEQ ID NO: 2862422 - protein, 11 aa, Entamoeba invadens
GTGESKTSINP

SEQ ID NO: 2862423 - protein, 5 aa, Entamoeba invadens
GTGEV

SEQ ID NO: 2862424 - protein, 11 aa, Entamoeba invadens
GTGGGEQPKKV

SEQ ID NO: 2862425 - protein, 6 aa, Entamoeba invadens
GTGGSS

SEQ ID NO: 2862426 - protein, 7 aa, Entamoeba invadens
GTGHPDI

SEQ ID NO: 2862427 - protein, 9 aa, Entamoeba invadens
GTGKEKNSV

SEQ ID NO: 2862428 - protein, 12 aa, Entamoeba invadens
GTGKENVDPDDQ

SEQ ID NO: 2862429 - protein, 8 aa, Entamoeba invadens
GTGKGSTV

SEQ ID NO: 2862430 - protein, 4 aa, Entamoeba invadens
GTGL

SEQ ID NO: 2862431 - protein, 9 aa, Entamoeba invadens
GTGNDLSRS

SEQ ID NO: 2862432 - protein, 5 aa, Entamoeba invadens
GTGSF

SEQ ID NO: 2862433 - protein, 6 aa, Entamoeba invadens
GTGSGI

SEQ ID NO: 2862434 - protein, 7 aa, Entamoeba invadens
GTGSVGA

SEQ ID NO: 2862435 - protein, 5 aa, Entamoeba invadens
GTGSY

SEQ ID NO: 2862436 - protein, 8 aa, Entamoeba invadens
GTGTGKTV

SEQ ID NO: 2862437 - protein, 7 aa, Entamoeba invadens
GTGTSGK

SEQ ID NO: 2862438 - protein, 18 aa, Entamoeba invadens
GTGVPNALTYGKKQGSRY

SEQ ID NO: 2862439 - protein, 5 aa, Entamoeba invadens
GTGVT

SEQ ID NO: 2862440 - protein, 4 aa, Entamoeba invadens
GTGY

SEQ ID NO: 2862441 - protein, 7 aa, Entamoeba invadens
GTGYTKI

SEQ ID NO: 2862442 - protein, 16 aa, Entamoeba invadens
GTHKENNEVNTIITQV

SEQ ID NO: 2862443 - protein, 9 aa, Entamoeba invadens
GTHPTDPTI

SEQ ID NO: 2862444 - protein, 10 aa, Entamoeba invadens
GTHPTDPTIR

SEQ ID NO: 2862445 - protein, 5 aa, Entamoeba invadens
GTHSA

SEQ ID NO: 2862446 - protein, 4 aa, Entamoeba invadens
GTID

SEQ ID NO: 2862447 - protein, 23 aa, Entamoeba invadens
GTIDTSKKTIKETIPTESSVEDN

SEQ ID NO: 2862448 - protein, 16 aa, Entamoeba invadens
GTIETLGNDVKERQTQ

SEQ ID NO: 2862449 - protein, 9 aa, Entamoeba invadens
GTIKKGNLE

SEQ ID NO: 2862450 - protein, 7 aa, Entamoeba invadens
GTIKSSP

SEQ ID NO: 2862451 - protein, 6 aa, Entamoeba invadens
GTINKN

SEQ ID NO: 2862452 - protein, 8 aa, Entamoeba invadens
GTINPPHS

SEQ ID NO: 2862453 - protein, 4 aa, Entamoeba invadens
GTIP

SEQ ID NO: 2862454 - protein, 22 aa, Entamoeba invadens
GTIPPPPVHENDTTADTEQTAE

SEQ ID NO: 2862455 - protein, 4 aa, Entamoeba invadens
GTIS

SEQ ID NO: 2862456 - protein, 5 aa, Entamoeba invadens
GTISD

SEQ ID NO: 2862457 - protein, 10 aa, Entamoeba invadens
GTISEAGKYE

SEQ ID NO: 2862458 - protein, 9 aa, Entamoeba invadens
GTITDSETA

SEQ ID NO: 2862459 - protein, 13 aa, Entamoeba invadens
GTITVTQNGKTYG

SEQ ID NO: 2862460 - protein, 6 aa, Entamoeba invadens
GTIVEG

SEQ ID NO: 2862461 - protein, 4 aa, Entamoeba invadens
GTKD

SEQ ID NO: 2862462 - protein, 4 aa, Entamoeba invadens
GTKE

SEQ ID NO: 2862463 - protein, 8 aa, Entamoeba invadens
GTKEEKID

SEQ ID NO: 2862464 - protein, 6 aa, Entamoeba invadens
GTKFGE

SEQ ID NO: 2862465 - protein, 10 aa, Entamoeba invadens
GTKGAAIGNN

SEQ ID NO: 2862466 - protein, 9 aa, Entamoeba invadens
GTKGSVKSL

SEQ ID NO: 2862467 - protein, 6 aa, Entamoeba invadens
GTKGVY

SEQ ID NO: 2862468 - protein, 9 aa, Entamoeba invadens
GTKIKTPKL

SEQ ID NO: 2862469 - protein, 5 aa, Entamoeba invadens
GTKKS

SEQ ID NO: 2862470 - protein, 8 aa, Entamoeba invadens
GTKKSNSR

SEQ ID NO: 2862471 - protein, 9 aa, Entamoeba invadens
GTKMTRSAW

SEQ ID NO: 2862472 - protein, 5 aa, Entamoeba invadens
GTKMY

SEQ ID NO: 2862473 - protein, 14 aa, Entamoeba invadens
GTKNNNLLPTDNYT

SEQ ID NO: 2862474 - protein, 8 aa, Entamoeba invadens
GTKPDFHK

SEQ ID NO: 2862475 - protein, 10 aa, Entamoeba invadens
GTKQSTDQYD

SEQ ID NO: 2862476 - protein, 8 aa, Entamoeba invadens
GTKREGTP

SEQ ID NO: 2862477 - protein, 8 aa, Entamoeba invadens
GTKRNKIS

SEQ ID NO: 2862478 - protein, 4 aa, Entamoeba invadens
GTKS

SEQ ID NO: 2862479 - protein, 5 aa, Entamoeba invadens
GTKSR

SEQ ID NO: 2862480 - protein, 6 aa, Entamoeba invadens
GTKTCK

SEQ ID NO: 2862481 - protein, 6 aa, Entamoeba invadens
GTKTPI

SEQ ID NO: 2862482 - protein, 9 aa, Entamoeba invadens
GTKTSGKQV

SEQ ID NO: 2862483 - protein, 5 aa, Entamoeba invadens
GTKTT

SEQ ID NO: 2862484 - protein, 5 aa, Entamoeba invadens
GTKVL

SEQ ID NO: 2862485 - protein, 6 aa, Entamoeba invadens
GTKYRK

SEQ ID NO: 2862486 - protein, 10 aa, Entamoeba invadens
GTLADQKRRL

SEQ ID NO: 2862487 - protein, 9 aa, Entamoeba invadens
GTLANKGGV

SEQ ID NO: 2862488 - protein, 14 aa, Entamoeba invadens
GTLDTAVGEKKGSH

SEQ ID NO: 2862489 - protein, 14 aa, Entamoeba invadens
GTLDTAVGEKTGSH

SEQ ID NO: 2862490 - protein, 8 aa, Entamoeba invadens
GTLEGRNI

SEQ ID NO: 2862491 - protein, 6 aa, Entamoeba invadens
GTLETT

SEQ ID NO: 2862492 - protein, 10 aa, Entamoeba invadens
GTLKKARQNL

SEQ ID NO: 2862493 - protein, 8 aa, Entamoeba invadens
GTLPPQSY

SEQ ID NO: 2862494 - protein, 6 aa, Entamoeba invadens
GTLQDS

SEQ ID NO: 2862495 - protein, 21 aa, Entamoeba invadens
GTLSPPKPHERGSSGDSTKES

SEQ ID NO: 2862496 - protein, 9 aa, Entamoeba invadens
GTMARKTTV

SEQ ID NO: 2862497 - protein, 6 aa, Entamoeba invadens
GTMEGD

SEQ ID NO: 2862498 - protein, 9 aa, Entamoeba invadens
GTMGTKGNT

SEQ ID NO: 2862499 - protein, 19 aa, Entamoeba invadens
GTMKGKEVGEATPLWGEAV

SEQ ID NO: 2862500 - protein, 9 aa, Entamoeba invadens
GTNARSSVA

SEQ ID NO: 2862501 - protein, 9 aa, Entamoeba invadens
GTNDPNDCF

SEQ ID NO: 2862502 - protein, 7 aa, Entamoeba invadens
GTNDQEK

SEQ ID NO: 2862503 - protein, 12 aa, Entamoeba invadens
GTNEKQTLKVYL

SEQ ID NO: 2862504 - protein, 5 aa, Entamoeba invadens
GTNER

SEQ ID NO: 2862505 - protein, 14 aa, Entamoeba invadens
GTNGDNKKLPSNLT

SEQ ID NO: 2862506 - protein, 6 aa, Entamoeba invadens
GTNGYS

SEQ ID NO: 2862507 - protein, 5 aa, Entamoeba invadens
GTNHA

SEQ ID NO: 2862508 - protein, 4 aa, Entamoeba invadens
GTNK

SEQ ID NO: 2862509 - protein, 9 aa, Entamoeba invadens
GTNKHTPTV

SEQ ID NO: 2862510 - protein, 12 aa, Entamoeba invadens
GTNKKLLGGKGA

SEQ ID NO: 2862511 - protein, 6 aa, Entamoeba invadens
GTNKLP

SEQ ID NO: 2862512 - protein, 7 aa, Entamoeba invadens
GTNMKNG

SEQ ID NO: 2862513 - protein, 6 aa, Entamoeba invadens
GTNNEF

SEQ ID NO: 2862514 - protein, 9 aa, Entamoeba invadens
GTNPDNYKN

SEQ ID NO: 2862515 - protein, 7 aa, Entamoeba invadens
GTNPEEF

SEQ ID NO: 2862516 - protein, 12 aa, Entamoeba invadens
GTNPGYHREKEH

SEQ ID NO: 2862517 - protein, 5 aa, Entamoeba invadens
GTNRQ

SEQ ID NO: 2862518 - protein, 18 aa, Entamoeba invadens
GTNSETGSGSDCSKRSYQ

SEQ ID NO: 2862519 - protein, 20 aa, Entamoeba invadens
GTNSNTISDEKGRRVSTSSC

SEQ ID NO: 2862520 - protein, 9 aa, Entamoeba invadens
GTNSPRPVE

SEQ ID NO: 2862521 - protein, 18 aa, Entamoeba invadens
GTNSSDDQNNKSEKMEKP

SEQ ID NO: 2862522 - protein, 7 aa, Entamoeba invadens
GTNSVRK

SEQ ID NO: 2862523 - protein, 5 aa, Entamoeba invadens
GTNTC

SEQ ID NO: 2862524 - protein, 9 aa, Entamoeba invadens
GTNTNPKTL

SEQ ID NO: 2862525 - protein, 9 aa, Entamoeba invadens
GTNTTTNRS

SEQ ID NO: 2862526 - protein, 6 aa, Entamoeba invadens
GTNVDE

SEQ ID NO: 2862527 - protein, 5 aa, Entamoeba invadens
GTNYT

SEQ ID NO: 2862528 - protein, 6 aa, Entamoeba invadens
GTPAAT

SEQ ID NO: 2862529 - protein, 8 aa, Entamoeba invadens
GTPAEGLS

SEQ ID NO: 2862530 - protein, 5 aa, Entamoeba invadens
GTPAM

SEQ ID NO: 2862531 - protein, 17 aa, Entamoeba invadens
GTPAPKQQQQKPLETGN

SEQ ID NO: 2862532 - protein, 8 aa, Entamoeba invadens
GTPDLNNK

SEQ ID NO: 2862533 - protein, 7 aa, Entamoeba invadens
GTPDVPQ

SEQ ID NO: 2862534 - protein, 7 aa, Entamoeba invadens
GTPDYTA

SEQ ID NO: 2862535 - protein, 8 aa, Entamoeba invadens
GTPDYTAP

SEQ ID NO: 2862536 - protein, 45 aa, Entamoeba invadens
GTPEDTQKECQEISSEESSKEDGRSEPVEIEKESEVNVDEMNSEE

SEQ ID NO: 2862537 - protein, 5 aa, Entamoeba invadens
GTPEY

SEQ ID NO: 2862538 - protein, 7 aa, Entamoeba invadens
GTPGLGD

SEQ ID NO: 2862539 - protein, 5 aa, Entamoeba invadens
GTPGR

SEQ ID NO: 2862540 - protein, 8 aa, Entamoeba invadens
GTPGTGKT

SEQ ID NO: 2862541 - protein, 17 aa, Entamoeba invadens
GTPGYTAPEVETGNYDT

SEQ ID NO: 2862542 - protein, 6 aa, Entamoeba invadens
GTPHGT

SEQ ID NO: 2862543 - protein, 5 aa, Entamoeba invadens
GTPHN

SEQ ID NO: 2862544 - protein, 4 aa, Entamoeba invadens
GTPI

SEQ ID NO: 2862545 - protein, 7 aa, Entamoeba invadens
GTPKYDP

SEQ ID NO: 2862546 - protein, 5 aa, Entamoeba invadens
GTPLE

SEQ ID NO: 2862547 - protein, 5 aa, Entamoeba invadens
GTPLP

SEQ ID NO: 2862548 - protein, 13 aa, Entamoeba invadens
GTPLQAQAAERLR

SEQ ID NO: 2862549 - protein, 8 aa, Entamoeba invadens
GTPNPSWA

SEQ ID NO: 2862550 - protein, 9 aa, Entamoeba invadens
GTPNPSWAS

SEQ ID NO: 2862551 - protein, 13 aa, Entamoeba invadens
GTPNSGPSTKWEG

SEQ ID NO: 2862552 - protein, 14 aa, Entamoeba invadens
GTPPPYPAKPSKQI

SEQ ID NO: 2862553 - protein, 7 aa, Entamoeba invadens
GTPQKKE

SEQ ID NO: 2862554 - protein, 14 aa, Entamoeba invadens
GTPRRSYNDPKYLT

SEQ ID NO: 2862555 - protein, 10 aa, Entamoeba invadens
GTPSALSKPK

SEQ ID NO: 2862556 - protein, 6 aa, Entamoeba invadens
GTPSRN

SEQ ID NO: 2862557 - protein, 5 aa, Entamoeba invadens
GTPST

SEQ ID NO: 2862558 - protein, 6 aa, Entamoeba invadens
GTPTIE

SEQ ID NO: 2862559 - protein, 12 aa, Entamoeba invadens
GTPTPQTEPTQI

SEQ ID NO: 2862560 - protein, 7 aa, Entamoeba invadens
GTPTPQV

SEQ ID NO: 2862561 - protein, 5 aa, Entamoeba invadens
GTPTT

SEQ ID NO: 2862562 - protein, 5 aa, Entamoeba invadens
GTPVR

SEQ ID NO: 2862563 - protein, 8 aa, Entamoeba invadens
GTPYQGPP

SEQ ID NO: 2862564 - protein, 10 aa, Entamoeba invadens
GTQAEHAQGV

SEQ ID NO: 2862565 - protein, 8 aa, Entamoeba invadens
GTQEGKAK

SEQ ID NO: 2862566 - protein, 6 aa, Entamoeba invadens
GTQETP

SEQ ID NO: 2862567 - protein, 9 aa, Entamoeba invadens
GTQLTTQSA

SEQ ID NO: 2862568 - protein, 10 aa, Entamoeba invadens
GTQMSDSRGV

SEQ ID NO: 2862569 - protein, 7 aa, Entamoeba invadens
GTQNGEV

SEQ ID NO: 2862570 - protein, 6 aa, Entamoeba invadens
GTQNKQ

SEQ ID NO: 2862571 - protein, 12 aa, Entamoeba invadens
GTQPKNSEMRNQ

SEQ ID NO: 2862572 - protein, 17 aa, Entamoeba invadens
GTQQPMANTQQQQQPMQ

SEQ ID NO: 2862573 - protein, 19 aa, Entamoeba invadens
GTQRGEDETQIKANRNRSR

SEQ ID NO: 2862574 - protein, 18 aa, Entamoeba invadens
GTQSEKPKKDGKKGKCLL

SEQ ID NO: 2862575 - protein, 6 aa, Entamoeba invadens
GTQSEL

SEQ ID NO: 2862576 - protein, 11 aa, Entamoeba invadens
GTQTEKISLSN

SEQ ID NO: 2862577 - protein, 6 aa, Entamoeba invadens
GTQTSF

SEQ ID NO: 2862578 - protein, 12 aa, Entamoeba invadens
GTQTWKPNATEA

SEQ ID NO: 2862579 - protein, 4 aa, Entamoeba invadens
GTQV

SEQ ID NO: 2862580 - protein, 5 aa, Entamoeba invadens
GTRAG

SEQ ID NO: 2862581 - protein, 6 aa, Entamoeba invadens
GTRAPN

SEQ ID NO: 2862582 - protein, 7 aa, Entamoeba invadens
GTREGRK

SEQ ID NO: 2862583 - protein, 4 aa, Entamoeba invadens
GTRI

SEQ ID NO: 2862584 - protein, 81 aa, Entamoeba invadens
GTRKDKDETNSEEKSEKSEKSEDSKKSEKSEKSEDYKEPKTPKRTSGSNMKNSTVPLDSPRDQKSPDHPQIKKRGFLTFVK

SEQ ID NO: 2862585 - protein, 12 aa, Entamoeba invadens
GTRMKDKKEIVR

SEQ ID NO: 2862586 - protein, 13 aa, Entamoeba invadens
GTRMKYENGQETF

SEQ ID NO: 2862587 - protein, 4 aa, Entamoeba invadens
GTRN

SEQ ID NO: 2862588 - protein, 8 aa, Entamoeba invadens
GTRQYDGQ

SEQ ID NO: 2862589 - protein, 14 aa, Entamoeba invadens
GTRSIEESKIAAKT

SEQ ID NO: 2862590 - protein, 9 aa, Entamoeba invadens
GTRSPKDAF

SEQ ID NO: 2862591 - protein, 5 aa, Entamoeba invadens
GTRSS

SEQ ID NO: 2862592 - protein, 8 aa, Entamoeba invadens
GTRSTKYT

SEQ ID NO: 2862593 - protein, 5 aa, Entamoeba invadens
GTRSV

SEQ ID NO: 2862594 - protein, 5 aa, Entamoeba invadens
GTRVQ

SEQ ID NO: 2862595 - protein, 9 aa, Entamoeba invadens
GTSAEKNLE

SEQ ID NO: 2862596 - protein, 10 aa, Entamoeba invadens
GTSAENKEPV

SEQ ID NO: 2862597 - protein, 5 aa, Entamoeba invadens
GTSDF

SEQ ID NO: 2862598 - protein, 4 aa, Entamoeba invadens
GTSE

SEQ ID NO: 2862599 - protein, 7 aa, Entamoeba invadens
GTSEAKK

SEQ ID NO: 2862600 - protein, 29 aa, Entamoeba invadens
GTSEERYGNLSPRLKPPRKSDPNKHTKSP

SEQ ID NO: 2862601 - protein, 7 aa, Entamoeba invadens
GTSEGKE

SEQ ID NO: 2862602 - protein, 6 aa, Entamoeba invadens
GTSELT

SEQ ID NO: 2862603 - protein, 6 aa, Entamoeba invadens
GTSEYK

SEQ ID NO: 2862604 - protein, 6 aa, Entamoeba invadens
GTSGGQ

SEQ ID NO: 2862605 - protein, 13 aa, Entamoeba invadens
GTSGIDARQTRCE

SEQ ID NO: 2862606 - protein, 8 aa, Entamoeba invadens
GTSGKIES

SEQ ID NO: 2862607 - protein, 6 aa, Entamoeba invadens
GTSGTL

SEQ ID NO: 2862608 - protein, 8 aa, Entamoeba invadens
GTSGVPKG

SEQ ID NO: 2862609 - protein, 9 aa, Entamoeba invadens
GTSGVPKGA

SEQ ID NO: 2862610 - protein, 6 aa, Entamoeba invadens
GTSHGA

SEQ ID NO: 2862611 - protein, 4 aa, Entamoeba invadens
GTSI

SEQ ID NO: 2862612 - protein, 7 aa, Entamoeba invadens
GTSISQR

SEQ ID NO: 2862613 - protein, 14 aa, Entamoeba invadens
GTSKMDKENEDENE

SEQ ID NO: 2862614 - protein, 5 aa, Entamoeba invadens
GTSKN

SEQ ID NO: 2862615 - protein, 5 aa, Entamoeba invadens
GTSLD

SEQ ID NO: 2862616 - protein, 7 aa, Entamoeba invadens
GTSNEDV

SEQ ID NO: 2862617 - protein, 10 aa, Entamoeba invadens
GTSPPRARSI

SEQ ID NO: 2862618 - protein, 14 aa, Entamoeba invadens
GTSQLSTSGDLDKS

SEQ ID NO: 2862619 - protein, 34 aa, Entamoeba invadens
GTSRFTKKSLKKGEEKGLGTPIYASPESFRDEYT

SEQ ID NO: 2862620 - protein, 22 aa, Entamoeba invadens
GTSRFTKKTIGKKQDKGLGTPI

SEQ ID NO: 2862621 - protein, 7 aa, Entamoeba invadens
GTSRPRI

SEQ ID NO: 2862622 - protein, 4 aa, Entamoeba invadens
GTSS

SEQ ID NO: 2862623 - protein, 5 aa, Entamoeba invadens
GTSSF

SEQ ID NO: 2862624 - protein, 28 aa, Entamoeba invadens
GTSSSKIEPKRDINEEKSKDKPIQPTAE

SEQ ID NO: 2862625 - protein, 5 aa, Entamoeba invadens
GTSTI

SEQ ID NO: 2862626 - protein, 8 aa, Entamoeba invadens
GTSTNCTS

SEQ ID NO: 2862627 - protein, 6 aa, Entamoeba invadens
GTSTSD

SEQ ID NO: 2862628 - protein, 4 aa, Entamoeba invadens
GTSV

SEQ ID NO: 2862629 - protein, 8 aa, Entamoeba invadens
GTSYYNPD

SEQ ID NO: 2862630 - protein, 43 aa, Entamoeba invadens
GTTAGNNTLGTTSSLLSPGIGNSIGSTIGGTLGSSIGSTTGGI

SEQ ID NO: 2862631 - protein, 5 aa, Entamoeba invadens
GTTAT

SEQ ID NO: 2862632 - protein, 7 aa, Entamoeba invadens
GTTCEIK

SEQ ID NO: 2862633 - protein, 7 aa, Entamoeba invadens
GTTCQSC

SEQ ID NO: 2862634 - protein, 4 aa, Entamoeba invadens
GTTD

SEQ ID NO: 2862635 - protein, 4 aa, Entamoeba invadens
GTTE

SEQ ID NO: 2862636 - protein, 5 aa, Entamoeba invadens
GTTEL

SEQ ID NO: 2862637 - protein, 7 aa, Entamoeba invadens
GTTETPK

SEQ ID NO: 2862638 - protein, 6 aa, Entamoeba invadens
GTTGFQ

SEQ ID NO: 2862639 - protein, 12 aa, Entamoeba invadens
GTTGSGKSTQLP

SEQ ID NO: 2862640 - protein, 8 aa, Entamoeba invadens
GTTGSVRG

SEQ ID NO: 2862641 - protein, 5 aa, Entamoeba invadens
GTTGY

SEQ ID NO: 2862642 - protein, 4 aa, Entamoeba invadens
GTTK

SEQ ID NO: 2862643 - protein, 5 aa, Entamoeba invadens
GTTKD

SEQ ID NO: 2862644 - protein, 6 aa, Entamoeba invadens
GTTKEK

SEQ ID NO: 2862645 - protein, 5 aa, Entamoeba invadens
GTTKG

SEQ ID NO: 2862646 - protein, 22 aa, Entamoeba invadens
GTTKGITRKEYEYPIPKSDAEE

SEQ ID NO: 2862647 - protein, 8 aa, Entamoeba invadens
GTTKPRDG

SEQ ID NO: 2862648 - protein, 11 aa, Entamoeba invadens
GTTLSHEDAED

SEQ ID NO: 2862649 - protein, 11 aa, Entamoeba invadens
GTTMYTTGEDG

SEQ ID NO: 2862650 - protein, 5 aa, Entamoeba invadens
GTTNL

SEQ ID NO: 2862651 - protein, 5 aa, Entamoeba invadens
GTTNS

SEQ ID NO: 2862652 - protein, 7 aa, Entamoeba invadens
GTTNSKF

SEQ ID NO: 2862653 - protein, 11 aa, Entamoeba invadens
GTTPQENTTQL

SEQ ID NO: 2862654 - protein, 10 aa, Entamoeba invadens
GTTPQPNDIE

SEQ ID NO: 2862655 - protein, 11 aa, Entamoeba invadens
GTTPQRKESVD

SEQ ID NO: 2862656 - protein, 5 aa, Entamoeba invadens
GTTPR

SEQ ID NO: 2862657 - protein, 9 aa, Entamoeba invadens
GTTQASRRY

SEQ ID NO: 2862658 - protein, 9 aa, Entamoeba invadens
GTTQKPGEY

SEQ ID NO: 2862659 - protein, 5 aa, Entamoeba invadens
GTTQL

SEQ ID NO: 2862660 - protein, 5 aa, Entamoeba invadens
GTTRL

SEQ ID NO: 2862661 - protein, 9 aa, Entamoeba invadens
GTTSAGKTS

SEQ ID NO: 2862662 - protein, 6 aa, Entamoeba invadens
GTTSMD

SEQ ID NO: 2862663 - protein, 8 aa, Entamoeba invadens
GTTSRYKK

SEQ ID NO: 2862664 - protein, 14 aa, Entamoeba invadens
GTTSSTGQLSTFNP

SEQ ID NO: 2862665 - protein, 5 aa, Entamoeba invadens
GTTTI

SEQ ID NO: 2862666 - protein, 6 aa, Entamoeba invadens
GTTTMN

SEQ ID NO: 2862667 - protein, 6 aa, Entamoeba invadens
GTTVGT

SEQ ID NO: 2862668 - protein, 9 aa, Entamoeba invadens
GTTYEATKE

SEQ ID NO: 2862669 - protein, 12 aa, Entamoeba invadens
GTTYTKAAYYSS

SEQ ID NO: 2862670 - protein, 13 aa, Entamoeba invadens
GTVAKKEEDIEEL

SEQ ID NO: 2862671 - protein, 6 aa, Entamoeba invadens
GTVGKT

SEQ ID NO: 2862672 - protein, 4 aa, Entamoeba invadens
GTVK

SEQ ID NO: 2862673 - protein, 6 aa, Entamoeba invadens
GTVKKS

SEQ ID NO: 2862674 - protein, 9 aa, Entamoeba invadens
GTVNRGSDM

SEQ ID NO: 2862675 - protein, 13 aa, Entamoeba invadens
GTVQFGDKKTHKA

SEQ ID NO: 2862676 - protein, 6 aa, Entamoeba invadens
GTVRSA

SEQ ID NO: 2862677 - protein, 7 aa, Entamoeba invadens
GTVSSDV

SEQ ID NO: 2862678 - protein, 7 aa, Entamoeba invadens
GTYDESE

SEQ ID NO: 2862679 - protein, 8 aa, Entamoeba invadens
GTYEDSQS

SEQ ID NO: 2862680 - protein, 25 aa, Entamoeba invadens
GTYIAERTEQRPPLRQSLRNPNELS

SEQ ID NO: 2862681 - protein, 10 aa, Entamoeba invadens
GTYKKTETTC

SEQ ID NO: 2862682 - protein, 10 aa, Entamoeba invadens
GTYKNTETSC

SEQ ID NO: 2862683 - protein, 5 aa, Entamoeba invadens
GTYPN

SEQ ID NO: 2862684 - protein, 5 aa, Entamoeba invadens
GVAKE

SEQ ID NO: 2862685 - protein, 4 aa, Entamoeba invadens
GVAN

SEQ ID NO: 2862686 - protein, 6 aa, Entamoeba invadens
GVAPGM

SEQ ID NO: 2862687 - protein, 11 aa, Entamoeba invadens
GVAPPGTKVRA

SEQ ID NO: 2862688 - protein, 10 aa, Entamoeba invadens
GVARKQGEMY

SEQ ID NO: 2862689 - protein, 4 aa, Entamoeba invadens
GVAS

SEQ ID NO: 2862690 - protein, 11 aa, Entamoeba invadens
GVASDSGSSAD

SEQ ID NO: 2862691 - protein, 10 aa, Entamoeba invadens
GVASQDVGEV

SEQ ID NO: 2862692 - protein, 7 aa, Entamoeba invadens
GVATNKT

SEQ ID NO: 2862693 - protein, 18 aa, Entamoeba invadens
GVATSPAKKKRSDKKLKI

SEQ ID NO: 2862694 - protein, 8 aa, Entamoeba invadens
GVATTNVK

SEQ ID NO: 2862695 - protein, 10 aa, Entamoeba invadens
GVCDDKSPLN

SEQ ID NO: 2862696 - protein, 9 aa, Entamoeba invadens
GVCKTRDGI

SEQ ID NO: 2862697 - protein, 4 aa, Entamoeba invadens
GVCN

SEQ ID NO: 2862698 - protein, 4 aa, Entamoeba invadens
GVDA

SEQ ID NO: 2862699 - protein, 20 aa, Entamoeba invadens
GVDANKAQQARVEQEAQERK

SEQ ID NO: 2862700 - protein, 6 aa, Entamoeba invadens
GVDATH

SEQ ID NO: 2862701 - protein, 7 aa, Entamoeba invadens
GVDDNNQ

SEQ ID NO: 2862702 - protein, 7 aa, Entamoeba invadens
GVDDTNK

SEQ ID NO: 2862703 - protein, 20 aa, Entamoeba invadens
GVDEGQNGKERNKEERANKV

SEQ ID NO: 2862704 - protein, 4 aa, Entamoeba invadens
GVDG

SEQ ID NO: 2862705 - protein, 16 aa, Entamoeba invadens
GVDIRERQTRRGTKTS

SEQ ID NO: 2862706 - protein, 9 aa, Entamoeba invadens
GVDKEYGNP

SEQ ID NO: 2862707 - protein, 9 aa, Entamoeba invadens
GVDNNKTGV

SEQ ID NO: 2862708 - protein, 7 aa, Entamoeba invadens
GVDPATL

SEQ ID NO: 2862709 - protein, 5 aa, Entamoeba invadens
GVDPD

SEQ ID NO: 2862710 - protein, 38 aa, Entamoeba invadens
GVDPQIESNNEKKKKKMYEEAEDDLDDSGDSSDSYDLD

SEQ ID NO: 2862711 - protein, 9 aa, Entamoeba invadens
GVDPTKELK

SEQ ID NO: 2862712 - protein, 5 aa, Entamoeba invadens
GVDPY

SEQ ID NO: 2862713 - protein, 10 aa, Entamoeba invadens
GVDQSDPQIV

SEQ ID NO: 2862714 - protein, 12 aa, Entamoeba invadens
GVDQVGNVEADL

SEQ ID NO: 2862715 - protein, 43 aa, Entamoeba invadens
GVDSKKESPMSQKKKELKEMSRMEEKELQETLKNKEKKETENN

SEQ ID NO: 2862716 - protein, 8 aa, Entamoeba invadens
GVDSTLKQ

SEQ ID NO: 2862717 - protein, 10 aa, Entamoeba invadens
GVDVRKNSEF

SEQ ID NO: 2862718 - protein, 4 aa, Entamoeba invadens
GVEA

SEQ ID NO: 2862719 - protein, 18 aa, Entamoeba invadens
GVEAVNDNKFFSDFTYVP

SEQ ID NO: 2862720 - protein, 5 aa, Entamoeba invadens
GVEDP

SEQ ID NO: 2862721 - protein, 4 aa, Entamoeba invadens
GVEE

SEQ ID NO: 2862722 - protein, 18 aa, Entamoeba invadens
GVEEAKTPNTYNRKPHWR

SEQ ID NO: 2862723 - protein, 20 aa, Entamoeba invadens
GVEERSEDDSEEEKVEGEDL

SEQ ID NO: 2862724 - protein, 5 aa, Entamoeba invadens
GVEGR

SEQ ID NO: 2862725 - protein, 4 aa, Entamoeba invadens
GVEK

SEQ ID NO: 2862726 - protein, 12 aa, Entamoeba invadens
GVEKSKDATDKR

SEQ ID NO: 2862727 - protein, 4 aa, Entamoeba invadens
GVEM

SEQ ID NO: 2862728 - protein, 9 aa, Entamoeba invadens
GVENANAGI

SEQ ID NO: 2862729 - protein, 15 aa, Entamoeba invadens
GVEQECSKNFQTGDR

SEQ ID NO: 2862730 - protein, 4 aa, Entamoeba invadens
GVES

SEQ ID NO: 2862731 - protein, 12 aa, Entamoeba invadens
GVESSSKESTCT

SEQ ID NO: 2862732 - protein, 19 aa, Entamoeba invadens
GVETEADKLQCDDKKNAFG

SEQ ID NO: 2862733 - protein, 6 aa, Entamoeba invadens
GVETKK

SEQ ID NO: 2862734 - protein, 5 aa, Entamoeba invadens
GVETL

SEQ ID NO: 2862735 - protein, 14 aa, Entamoeba invadens
GVETPQKGETKNKL

SEQ ID NO: 2862736 - protein, 6 aa, Entamoeba invadens
GVEVDK

SEQ ID NO: 2862737 - protein, 8 aa, Entamoeba invadens
GVEVSDNN

SEQ ID NO: 2862738 - protein, 12 aa, Entamoeba invadens
GVEVTTGPLGAG

SEQ ID NO: 2862739 - protein, 4 aa, Entamoeba invadens
GVFG

SEQ ID NO: 2862740 - protein, 11 aa, Entamoeba invadens
GVFNGTHGGIA

SEQ ID NO: 2862741 - protein, 9 aa, Entamoeba invadens
GVGDSEATA

SEQ ID NO: 2862742 - protein, 11 aa, Entamoeba invadens
GVGEDGPTHQP

SEQ ID NO: 2862743 - protein, 5 aa, Entamoeba invadens
GVGEE

SEQ ID NO: 2862744 - protein, 12 aa, Entamoeba invadens
GVGEKESNKRDT

SEQ ID NO: 2862745 - protein, 6 aa, Entamoeba invadens
GVGHSN

SEQ ID NO: 2862746 - protein, 5 aa, Entamoeba invadens
GVGKT

SEQ ID NO: 2862747 - protein, 6 aa, Entamoeba invadens
GVGKTS

SEQ ID NO: 2862748 - protein, 9 aa, Entamoeba invadens
GVGKTTTKL

SEQ ID NO: 2862749 - protein, 9 aa, Entamoeba invadens
GVGNSSQEY

SEQ ID NO: 2862750 - protein, 16 aa, Entamoeba invadens
GVGQLEQQQQNSSTQN

SEQ ID NO: 2862751 - protein, 5 aa, Entamoeba invadens
GVGRT

SEQ ID NO: 2862752 - protein, 22 aa, Entamoeba invadens
GVGRTLRDSNDTVRDKWKDEGW

SEQ ID NO: 2862753 - protein, 5 aa, Entamoeba invadens
GVGSS

SEQ ID NO: 2862754 - protein, 4 aa, Entamoeba invadens
GVGT

SEQ ID NO: 2862755 - protein, 8 aa, Entamoeba invadens
GVGTNDQG

SEQ ID NO: 2862756 - protein, 7 aa, Entamoeba invadens
GVGTPTY

SEQ ID NO: 2862757 - protein, 13 aa, Entamoeba invadens
GVGVEGGSEDETE

SEQ ID NO: 2862758 - protein, 4 aa, Entamoeba invadens
GVGY

SEQ ID NO: 2862759 - protein, 6 aa, Entamoeba invadens
GVGYGR

SEQ ID NO: 2862760 - protein, 9 aa, Entamoeba invadens
GVKATDVGS

SEQ ID NO: 2862761 - protein, 10 aa, Entamoeba invadens
GVKEDKSKGV

SEQ ID NO: 2862762 - protein, 5 aa, Entamoeba invadens
GVKEG

SEQ ID NO: 2862763 - protein, 9 aa, Entamoeba invadens
GVKEPNEQE

SEQ ID NO: 2862764 - protein, 12 aa, Entamoeba invadens
GVKETTSKVEDL

SEQ ID NO: 2862765 - protein, 78 aa, Entamoeba invadens
GVKGEYDEEEYNEDEGGDNGSSSDNDEDDNNNDQHPNEDNVPQEDEEMNDGYNTESDYSSEEDEGYYVGSDEDKTESF

SEQ ID NO: 2862766 - protein, 8 aa, Entamoeba invadens
GVKGKDGR

SEQ ID NO: 2862767 - protein, 9 aa, Entamoeba invadens
GVKGPVQTR

SEQ ID NO: 2862768 - protein, 14 aa, Entamoeba invadens
GVKGQSHGKSISKT

SEQ ID NO: 2862769 - protein, 8 aa, Entamoeba invadens
GVKGRRAR

SEQ ID NO: 2862770 - protein, 15 aa, Entamoeba invadens
GVKKRDLQNPDTRKK

SEQ ID NO: 2862771 - protein, 15 aa, Entamoeba invadens
GVKKSDLADKETRDK

SEQ ID NO: 2862772 - protein, 5 aa, Entamoeba invadens
GVKNG

SEQ ID NO: 2862773 - protein, 4 aa, Entamoeba invadens
GVKP

SEQ ID NO: 2862774 - protein, 7 aa, Entamoeba invadens
GVKPRHL

SEQ ID NO: 2862775 - protein, 8 aa, Entamoeba invadens
GVKQGEPI

SEQ ID NO: 2862776 - protein, 10 aa, Entamoeba invadens
GVKQQPNKLI

SEQ ID NO: 2862777 - protein, 15 aa, Entamoeba invadens
GVKRAEKSGVIEEEE

SEQ ID NO: 2862778 - protein, 9 aa, Entamoeba invadens
GVKRERTPF

SEQ ID NO: 2862779 - protein, 28 aa, Entamoeba invadens
GVKRRKTRSSTRKMEEIKNEEESNEPIA

SEQ ID NO: 2862780 - protein, 4 aa, Entamoeba invadens
GVKS

SEQ ID NO: 2862781 - protein, 8 aa, Entamoeba invadens
GVKSATSA

SEQ ID NO: 2862782 - protein, 6 aa, Entamoeba invadens
GVKSDV

SEQ ID NO: 2862783 - protein, 9 aa, Entamoeba invadens
GVKSYPSRI

SEQ ID NO: 2862784 - protein, 9 aa, Entamoeba invadens
GVKTPNEPF

SEQ ID NO: 2862785 - protein, 5 aa, Entamoeba invadens
GVKTS

SEQ ID NO: 2862786 - protein, 5 aa, Entamoeba invadens
GVLGS

SEQ ID NO: 2862787 - protein, 13 aa, Entamoeba invadens
GVLSGEKQRIGRS

SEQ ID NO: 2862788 - protein, 9 aa, Entamoeba invadens
GVLTPQRVG

SEQ ID NO: 2862789 - protein, 4 aa, Entamoeba invadens
GVMD

SEQ ID NO: 2862790 - protein, 5 aa, Entamoeba invadens
GVMGT

SEQ ID NO: 2862791 - protein, 7 aa, Entamoeba invadens
GVNGDTV

SEQ ID NO: 2862792 - protein, 11 aa, Entamoeba invadens
GVNGSDDYQGR

SEQ ID NO: 2862793 - protein, 9 aa, Entamoeba invadens
GVNIPSSVT

SEQ ID NO: 2862794 - protein, 58 aa, Entamoeba invadens
GVNKPLKKKDKYQSKTTTPIPKGRGRPGHFNPHSTNTYSTPLEQTPSPNAQSTSVSRP

SEQ ID NO: 2862795 - protein, 13 aa, Entamoeba invadens
GVNLGSTSSEKVI

SEQ ID NO: 2862796 - protein, 14 aa, Entamoeba invadens
GVNSEQGVKDIRER

SEQ ID NO: 2862797 - protein, 9 aa, Entamoeba invadens
GVNSNKKGT

SEQ ID NO: 2862798 - protein, 11 aa, Entamoeba invadens
GVNTKTTEGNN

SEQ ID NO: 2862799 - protein, 7 aa, Entamoeba invadens
GVNTSNI

SEQ ID NO: 2862800 - protein, 7 aa, Entamoeba invadens
GVNTTTF

SEQ ID NO: 2862801 - protein, 6 aa, Entamoeba invadens
GVPDQA

SEQ ID NO: 2862802 - protein, 6 aa, Entamoeba invadens
GVPFTE

SEQ ID NO: 2862803 - protein, 21 aa, Entamoeba invadens
GVPGETLKPRKLPVNNPEQVS

SEQ ID NO: 2862804 - protein, 13 aa, Entamoeba invadens
GVPHPKELTTSST

SEQ ID NO: 2862805 - protein, 11 aa, Entamoeba invadens
GVPKDEKKALR

SEQ ID NO: 2862806 - protein, 9 aa, Entamoeba invadens
GVPLDDPRL

SEQ ID NO: 2862807 - protein, 15 aa, Entamoeba invadens
GVPMKTAKRRIETNR

SEQ ID NO: 2862808 - protein, 5 aa, Entamoeba invadens
GVPMN

SEQ ID NO: 2862809 - protein, 16 aa, Entamoeba invadens
GVPNNDCNNTEKCSTH

SEQ ID NO: 2862810 - protein, 4 aa, Entamoeba invadens
GVPP

SEQ ID NO: 2862811 - protein, 5 aa, Entamoeba invadens
GVPTG

SEQ ID NO: 2862812 - protein, 9 aa, Entamoeba invadens
GVPTQSDGA

SEQ ID NO: 2862813 - protein, 4 aa, Entamoeba invadens
GVPV

SEQ ID NO: 2862814 - protein, 8 aa, Entamoeba invadens
GVQDRDID

SEQ ID NO: 2862815 - protein, 14 aa, Entamoeba invadens
GVQKEYQSINATDS

SEQ ID NO: 2862816 - protein, 6 aa, Entamoeba invadens
GVQNSP

SEQ ID NO: 2862817 - protein, 25 aa, Entamoeba invadens
GVQNTPRVSTEQQSDIKETSPQPKT

SEQ ID NO: 2862818 - protein, 7 aa, Entamoeba invadens
GVQPENK

SEQ ID NO: 2862819 - protein, 12 aa, Entamoeba invadens
GVQQPNLRGQQQ

SEQ ID NO: 2862820 - protein, 8 aa, Entamoeba invadens
GVQQPTTK

SEQ ID NO: 2862821 - protein, 13 aa, Entamoeba invadens
GVQRKANKVYEKG

SEQ ID NO: 2862822 - protein, 14 aa, Entamoeba invadens
GVQSAPYQVKIFKY

SEQ ID NO: 2862823 - protein, 9 aa, Entamoeba invadens
GVQSTGTSA

SEQ ID NO: 2862824 - protein, 17 aa, Entamoeba invadens
GVRCQAKNTKHGATSSV

SEQ ID NO: 2862825 - protein, 11 aa, Entamoeba invadens
GVRDEDKNGDT

SEQ ID NO: 2862826 - protein, 8 aa, Entamoeba invadens
GVRGGKTK

SEQ ID NO: 2862827 - protein, 4 aa, Entamoeba invadens
GVRI

SEQ ID NO: 2862828 - protein, 19 aa, Entamoeba invadens
GVRPPLPKTISKDEAHYTQ

SEQ ID NO: 2862829 - protein, 5 aa, Entamoeba invadens
GVRPT

SEQ ID NO: 2862830 - protein, 47 aa, Entamoeba invadens
GVRRKAERERRRSRSRERDFGRNRSEKYERKTSTIRDARGDGGRMAK

SEQ ID NO: 2862831 - protein, 10 aa, Entamoeba invadens
GVSDEDNSTV

SEQ ID NO: 2862832 - protein, 8 aa, Entamoeba invadens
GVSDPQQI

SEQ ID NO: 2862833 - protein, 12 aa, Entamoeba invadens
GVSEDDRSDQRL

SEQ ID NO: 2862834 - protein, 7 aa, Entamoeba invadens
GVSEQTI

SEQ ID NO: 2862835 - protein, 13 aa, Entamoeba invadens
GVSESTATRRFEK

SEQ ID NO: 2862836 - protein, 9 aa, Entamoeba invadens
GVSGNRAKH

SEQ ID NO: 2862837 - protein, 6 aa, Entamoeba invadens
GVSGTN

SEQ ID NO: 2862838 - protein, 28 aa, Entamoeba invadens
GVSHTDKEQIESEPQEEKFNKKDSQEEK

SEQ ID NO: 2862839 - protein, 5 aa, Entamoeba invadens
GVSKG

SEQ ID NO: 2862840 - protein, 10 aa, Entamoeba invadens
GVSKITEGMA

SEQ ID NO: 2862841 - protein, 10 aa, Entamoeba invadens
GVSKKAFKHT

SEQ ID NO: 2862842 - protein, 10 aa, Entamoeba invadens
GVSKNPSQKI

SEQ ID NO: 2862843 - protein, 15 aa, Entamoeba invadens
GVSLDDKKTSTSDKD

SEQ ID NO: 2862844 - protein, 17 aa, Entamoeba invadens
GVSLNGEYKKTAALTKA

SEQ ID NO: 2862845 - protein, 13 aa, Entamoeba invadens
GVSNEKSRRSLER

SEQ ID NO: 2862846 - protein, 9 aa, Entamoeba invadens
GVSQDTAKE

SEQ ID NO: 2862847 - protein, 6 aa, Entamoeba invadens
GVSRSA

SEQ ID NO: 2862848 - protein, 13 aa, Entamoeba invadens
GVSSENNPVTQTD

SEQ ID NO: 2862849 - protein, 5 aa, Entamoeba invadens
GVSSI

SEQ ID NO: 2862850 - protein, 8 aa, Entamoeba invadens
GVSSNVKA

SEQ ID NO: 2862851 - protein, 11 aa, Entamoeba invadens
GVSSPKANQTI

SEQ ID NO: 2862852 - protein, 15 aa, Entamoeba invadens
GVSSTAAALSNTVGN

SEQ ID NO: 2862853 - protein, 10 aa, Entamoeba invadens
GVSSTKTKAD

SEQ ID NO: 2862854 - protein, 10 aa, Entamoeba invadens
GVSVDGEKVE

SEQ ID NO: 2862855 - protein, 13 aa, Entamoeba invadens
GVTDHSKIQPGTT

SEQ ID NO: 2862856 - protein, 10 aa, Entamoeba invadens
GVTDRAVSDG

SEQ ID NO: 2862857 - protein, 8 aa, Entamoeba invadens
GVTDRDYY

SEQ ID NO: 2862858 - protein, 8 aa, Entamoeba invadens
GVTESLEG

SEQ ID NO: 2862859 - protein, 14 aa, Entamoeba invadens
GVTFESSKKYFLDI

SEQ ID NO: 2862860 - protein, 7 aa, Entamoeba invadens
GVTGTAP

SEQ ID NO: 2862861 - protein, 7 aa, Entamoeba invadens
GVTIPRT

SEQ ID NO: 2862862 - protein, 4 aa, Entamoeba invadens
GVTK

SEQ ID NO: 2862863 - protein, 5 aa, Entamoeba invadens
GVTKI

SEQ ID NO: 2862864 - protein, 8 aa, Entamoeba invadens
GVTLEGKN

SEQ ID NO: 2862865 - protein, 6 aa, Entamoeba invadens
GVTLNK

SEQ ID NO: 2862866 - protein, 8 aa, Entamoeba invadens
GVTPEGGW

SEQ ID NO: 2862867 - protein, 7 aa, Entamoeba invadens
GVTPENI

SEQ ID NO: 2862868 - protein, 9 aa, Entamoeba invadens
GVTPPRQAN

SEQ ID NO: 2862869 - protein, 16 aa, Entamoeba invadens
GVTREKSDKFDKPDAS

SEQ ID NO: 2862870 - protein, 7 aa, Entamoeba invadens
GVTSIGN

SEQ ID NO: 2862871 - protein, 6 aa, Entamoeba invadens
GVTSKT

SEQ ID NO: 2862872 - protein, 10 aa, Entamoeba invadens
GVTSKTPPHK

SEQ ID NO: 2862873 - protein, 5 aa, Entamoeba invadens
GVTSL

SEQ ID NO: 2862874 - protein, 10 aa, Entamoeba invadens
GVTSTKTKAD

SEQ ID NO: 2862875 - protein, 11 aa, Entamoeba invadens
GVTSTPGKTKH

SEQ ID NO: 2862876 - protein, 4 aa, Entamoeba invadens
GVTT

SEQ ID NO: 2862877 - protein, 9 aa, Entamoeba invadens
GVTTCRGEK

SEQ ID NO: 2862878 - protein, 7 aa, Entamoeba invadens
GVTTKGW

SEQ ID NO: 2862879 - protein, 5 aa, Entamoeba invadens
GVTVE

SEQ ID NO: 2862880 - protein, 12 aa, Entamoeba invadens
GVVEEQKKKIES

SEQ ID NO: 2862881 - protein, 8 aa, Entamoeba invadens
GVVETEDI

SEQ ID NO: 2862882 - protein, 10 aa, Entamoeba invadens
GVVGEEEQEC

SEQ ID NO: 2862883 - protein, 12 aa, Entamoeba invadens
GVVKAGNYDEEF

SEQ ID NO: 2862884 - protein, 12 aa, Entamoeba invadens
GVVQESDYPYTA

SEQ ID NO: 2862885 - protein, 6 aa, Entamoeba invadens
GVVSTQ

SEQ ID NO: 2862886 - protein, 14 aa, Entamoeba invadens
GVYTDKNCKSEMSD

SEQ ID NO: 2862887 - protein, 13 aa, Entamoeba invadens
GVYTKSQMDKTFN

SEQ ID NO: 2862888 - protein, 19 aa, Entamoeba invadens
GVYTPKAVTEYKADKDNIK

SEQ ID NO: 2862889 - protein, 23 aa, Entamoeba invadens
GWAAPRLKDAPLNDDEKNEAYRQ

SEQ ID NO: 2862890 - protein, 13 aa, Entamoeba invadens
GWASREEKRFTSE

SEQ ID NO: 2862891 - protein, 6 aa, Entamoeba invadens
GWDRTS

SEQ ID NO: 2862892 - protein, 8 aa, Entamoeba invadens
GWDRTSQL

SEQ ID NO: 2862893 - protein, 5 aa, Entamoeba invadens
GWEDP

SEQ ID NO: 2862894 - protein, 23 aa, Entamoeba invadens
GWGARGGGAFSGKDSSKVDRSGA

SEQ ID NO: 2862895 - protein, 14 aa, Entamoeba invadens
GWGEHSKKASENAV

SEQ ID NO: 2862896 - protein, 9 aa, Entamoeba invadens
GWGQDSSYV

SEQ ID NO: 2862897 - protein, 10 aa, Entamoeba invadens
GWGTGYDGGS

SEQ ID NO: 2862898 - protein, 7 aa, Entamoeba invadens
GWKDGTK

SEQ ID NO: 2862899 - protein, 13 aa, Entamoeba invadens
GWKKQKQKYELKL

SEQ ID NO: 2862900 - protein, 4 aa, Entamoeba invadens
GWKS

SEQ ID NO: 2862901 - protein, 10 aa, Entamoeba invadens
GWKTTSDDIY

SEQ ID NO: 2862902 - protein, 6 aa, Entamoeba invadens
GWNEKQ

SEQ ID NO: 2862903 - protein, 7 aa, Entamoeba invadens
GWNGQQQ

SEQ ID NO: 2862904 - protein, 13 aa, Entamoeba invadens
GWNKSQNRRPTFS

SEQ ID NO: 2862905 - protein, 8 aa, Entamoeba invadens
GWNNNTKT

SEQ ID NO: 2862906 - protein, 9 aa, Entamoeba invadens
GWPADPNSH

SEQ ID NO: 2862907 - protein, 6 aa, Entamoeba invadens
GWQQEA

SEQ ID NO: 2862908 - protein, 7 aa, Entamoeba invadens
GWRPSPV

SEQ ID NO: 2862909 - protein, 14 aa, Entamoeba invadens
GWSEIGRKTKGKWN

SEQ ID NO: 2862910 - protein, 7 aa, Entamoeba invadens
GWSGEGV

SEQ ID NO: 2862911 - protein, 12 aa, Entamoeba invadens
GWTKKDKETLTP

SEQ ID NO: 2862912 - protein, 11 aa, Entamoeba invadens
GWTKKTKDLLT

SEQ ID NO: 2862913 - protein, 7 aa, Entamoeba invadens
GWTSDED

SEQ ID NO: 2862914 - protein, 5 aa, Entamoeba invadens
GWYPE

SEQ ID NO: 2862915 - protein, 21 aa, Entamoeba invadens
GYAESKAREALKKTQNDKEKA

SEQ ID NO: 2862916 - protein, 5 aa, Entamoeba invadens
GYAGE

SEQ ID NO: 2862917 - protein, 10 aa, Entamoeba invadens
GYAPDYRQAR

SEQ ID NO: 2862918 - protein, 16 aa, Entamoeba invadens
GYCDPQNCETSTGITS

SEQ ID NO: 2862919 - protein, 7 aa, Entamoeba invadens
GYDDDNY

SEQ ID NO: 2862920 - protein, 13 aa, Entamoeba invadens
GYDDGEKEDEEID

SEQ ID NO: 2862921 - protein, 6 aa, Entamoeba invadens
GYDDSS

SEQ ID NO: 2862922 - protein, 14 aa, Entamoeba invadens
GYDDSTSDQEHDQM

SEQ ID NO: 2862923 - protein, 4 aa, Entamoeba invadens
GYDI

SEQ ID NO: 2862924 - protein, 16 aa, Entamoeba invadens
GYDKTYAEMSDEEKNL

SEQ ID NO: 2862925 - protein, 11 aa, Entamoeba invadens
GYDNTSKGFDY

SEQ ID NO: 2862926 - protein, 12 aa, Entamoeba invadens
GYDRGYDPRYRD

SEQ ID NO: 2862927 - protein, 4 aa, Entamoeba invadens
GYDV

SEQ ID NO: 2862928 - protein, 11 aa, Entamoeba invadens
GYEGSHRDGYS

SEQ ID NO: 2862929 - protein, 5 aa, Entamoeba invadens
GYEKY

SEQ ID NO: 2862930 - protein, 9 aa, Entamoeba invadens
GYENSTGLS

SEQ ID NO: 2862931 - protein, 27 aa, Entamoeba invadens
GYESENDEEEEKKNKINRRRIAEEDED

SEQ ID NO: 2862932 - protein, 9 aa, Entamoeba invadens
GYESKEAIE

SEQ ID NO: 2862933 - protein, 5 aa, Entamoeba invadens
GYETP

SEQ ID NO: 2862934 - protein, 12 aa, Entamoeba invadens
GYGDENYGEEAG

SEQ ID NO: 2862935 - protein, 13 aa, Entamoeba invadens
GYGEGGPLSDKKA

SEQ ID NO: 2862936 - protein, 4 aa, Entamoeba invadens
GYGI

SEQ ID NO: 2862937 - protein, 4 aa, Entamoeba invadens
GYGK

SEQ ID NO: 2862938 - protein, 8 aa, Entamoeba invadens
GYGKRTAA

SEQ ID NO: 2862939 - protein, 4 aa, Entamoeba invadens
GYGM

SEQ ID NO: 2862940 - protein, 9 aa, Entamoeba invadens
GYGNENGQE

SEQ ID NO: 2862941 - protein, 15 aa, Entamoeba invadens
GYGTNAGEPTEADCK

SEQ ID NO: 2862942 - protein, 4 aa, Entamoeba invadens
GYGV

SEQ ID NO: 2862943 - protein, 5 aa, Entamoeba invadens
GYGVT

SEQ ID NO: 2862944 - protein, 4 aa, Entamoeba invadens
GYHD

SEQ ID NO: 2862945 - protein, 4 aa, Entamoeba invadens
GYHE

SEQ ID NO: 2862946 - protein, 4 aa, Entamoeba invadens
GYHS

SEQ ID NO: 2862947 - protein, 5 aa, Entamoeba invadens
GYHSD

SEQ ID NO: 2862948 - protein, 10 aa, Entamoeba invadens
GYHSDDGKVH

SEQ ID NO: 2862949 - protein, 12 aa, Entamoeba invadens
GYHSDDGNIYQG

SEQ ID NO: 2862950 - protein, 6 aa, Entamoeba invadens
GYHSSS

SEQ ID NO: 2862951 - protein, 12 aa, Entamoeba invadens
GYHTSSSEQDEV

SEQ ID NO: 2862952 - protein, 17 aa, Entamoeba invadens
GYHTTFNTDGNTANCED

SEQ ID NO: 2862953 - protein, 4 aa, Entamoeba invadens
GYIR

SEQ ID NO: 2862954 - protein, 11 aa, Entamoeba invadens
GYISKDGQCQT

SEQ ID NO: 2862955 - protein, 6 aa, Entamoeba invadens
GYISNS

SEQ ID NO: 2862956 - protein, 5 aa, Entamoeba invadens
GYITN

SEQ ID NO: 2862957 - protein, 5 aa, Entamoeba invadens
GYKEG

SEQ ID NO: 2862958 - protein, 9 aa, Entamoeba invadens
GYKEMEGKI

SEQ ID NO: 2862959 - protein, 11 aa, Entamoeba invadens
GYKFETNKTTL

SEQ ID NO: 2862960 - protein, 11 aa, Entamoeba invadens
GYKGANTKALT

SEQ ID NO: 2862961 - protein, 20 aa, Entamoeba invadens
GYKGLQKDMERERKRDVAES

SEQ ID NO: 2862962 - protein, 11 aa, Entamoeba invadens
GYKGRKNYEKH

SEQ ID NO: 2862963 - protein, 18 aa, Entamoeba invadens
GYKRSTDGKSCDKCDESC

SEQ ID NO: 2862964 - protein, 9 aa, Entamoeba invadens
GYKSEGGND

SEQ ID NO: 2862965 - protein, 8 aa, Entamoeba invadens
GYKTISSD

SEQ ID NO: 2862966 - protein, 7 aa, Entamoeba invadens
GYKTKEE

SEQ ID NO: 2862967 - protein, 7 aa, Entamoeba invadens
GYLSNTT

SEQ ID NO: 2862968 - protein, 5 aa, Entamoeba invadens
GYLST

SEQ ID NO: 2862969 - protein, 11 aa, Entamoeba invadens
GYMRSSDGKQC

SEQ ID NO: 2862970 - protein, 10 aa, Entamoeba invadens
GYNAQVSREN

SEQ ID NO: 2862971 - protein, 5 aa, Entamoeba invadens
GYNDD

SEQ ID NO: 2862972 - protein, 20 aa, Entamoeba invadens
GYNEKGDGQKAITREKNDAF

SEQ ID NO: 2862973 - protein, 8 aa, Entamoeba invadens
GYNEQTKN

SEQ ID NO: 2862974 - protein, 6 aa, Entamoeba invadens
GYNERI

SEQ ID NO: 2862975 - protein, 12 aa, Entamoeba invadens
GYNKPSESGDSC

SEQ ID NO: 2862976 - protein, 4 aa, Entamoeba invadens
GYNL

SEQ ID NO: 2862977 - protein, 7 aa, Entamoeba invadens
GYNQEDS

SEQ ID NO: 2862978 - protein, 12 aa, Entamoeba invadens
GYNQNPNYALGF

SEQ ID NO: 2862979 - protein, 9 aa, Entamoeba invadens
GYNSRAKRL

SEQ ID NO: 2862980 - protein, 10 aa, Entamoeba invadens
GYNSSIKTEG

SEQ ID NO: 2862981 - protein, 22 aa, Entamoeba invadens
GYNTTRGVLETESGVKTPKHTL

SEQ ID NO: 2862982 - protein, 4 aa, Entamoeba invadens
GYNW

SEQ ID NO: 2862983 - protein, 4 aa, Entamoeba invadens
GYPE

SEQ ID NO: 2862984 - protein, 12 aa, Entamoeba invadens
GYPFENDEQFKK

SEQ ID NO: 2862985 - protein, 23 aa, Entamoeba invadens
GYPIPKKATDNSSLSGSERTRSN

SEQ ID NO: 2862986 - protein, 7 aa, Entamoeba invadens
GYPLPNS

SEQ ID NO: 2862987 - protein, 10 aa, Entamoeba invadens
GYPNPLPESA

SEQ ID NO: 2862988 - protein, 15 aa, Entamoeba invadens
GYPNQEVKDRKVKLG

SEQ ID NO: 2862989 - protein, 13 aa, Entamoeba invadens
GYPPYAQDRRNHP

SEQ ID NO: 2862990 - protein, 6 aa, Entamoeba invadens
GYPPYK

SEQ ID NO: 2862991 - protein, 15 aa, Entamoeba invadens
GYPQGTKQISLPSRY

SEQ ID NO: 2862992 - protein, 6 aa, Entamoeba invadens
GYPSQN

SEQ ID NO: 2862993 - protein, 5 aa, Entamoeba invadens
GYPTY

SEQ ID NO: 2862994 - protein, 5 aa, Entamoeba invadens
GYQKN

SEQ ID NO: 2862995 - protein, 8 aa, Entamoeba invadens
GYQQGQSD

SEQ ID NO: 2862996 - protein, 10 aa, Entamoeba invadens
GYQVPTSNYD

SEQ ID NO: 2862997 - protein, 5 aa, Entamoeba invadens
GYRAR

SEQ ID NO: 2862998 - protein, 4 aa, Entamoeba invadens
GYRD

SEQ ID NO: 2862999 - protein, 5 aa, Entamoeba invadens
GYREE

SEQ ID NO: 2863000 - protein, 7 aa, Entamoeba invadens
GYRKEKC

SEQ ID NO: 2863001 - protein, 5 aa, Entamoeba invadens
GYRQD

SEQ ID NO: 2863002 - protein, 5 aa, Entamoeba invadens
GYSDE

SEQ ID NO: 2863003 - protein, 17 aa, Entamoeba invadens
GYSGDSRGPRRYHTTPN

SEQ ID NO: 2863004 - protein, 11 aa, Entamoeba invadens
GYSGVEIRKNA

SEQ ID NO: 2863005 - protein, 6 aa, Entamoeba invadens
GYSHKN

SEQ ID NO: 2863006 - protein, 4 aa, Entamoeba invadens
GYSI

SEQ ID NO: 2863007 - protein, 5 aa, Entamoeba invadens
GYSIT

SEQ ID NO: 2863008 - protein, 11 aa, Entamoeba invadens
GYSKKSDNLSF

SEQ ID NO: 2863009 - protein, 11 aa, Entamoeba invadens
GYSKKTATRRV

SEQ ID NO: 2863010 - protein, 6 aa, Entamoeba invadens
GYSNDE

SEQ ID NO: 2863011 - protein, 7 aa, Entamoeba invadens
GYSNKTI

SEQ ID NO: 2863012 - protein, 8 aa, Entamoeba invadens
GYSNTDQL

SEQ ID NO: 2863013 - protein, 6 aa, Entamoeba invadens
GYSPAQ

SEQ ID NO: 2863014 - protein, 7 aa, Entamoeba invadens
GYSPNAY

SEQ ID NO: 2863015 - protein, 10 aa, Entamoeba invadens
GYSQKTREWY

SEQ ID NO: 2863016 - protein, 5 aa, Entamoeba invadens
GYSSA

SEQ ID NO: 2863017 - protein, 12 aa, Entamoeba invadens
GYSSDDNSSKVS

SEQ ID NO: 2863018 - protein, 14 aa, Entamoeba invadens
GYSSNANNKDYSTV

SEQ ID NO: 2863019 - protein, 8 aa, Entamoeba invadens
GYSSQENS

SEQ ID NO: 2863020 - protein, 7 aa, Entamoeba invadens
GYSYDGK

SEQ ID NO: 2863021 - protein, 7 aa, Entamoeba invadens
GYTDERE

SEQ ID NO: 2863022 - protein, 11 aa, Entamoeba invadens
GYTETANNSAE

SEQ ID NO: 2863023 - protein, 8 aa, Entamoeba invadens
GYTGDNNF

SEQ ID NO: 2863024 - protein, 5 aa, Entamoeba invadens
GYTGP

SEQ ID NO: 2863025 - protein, 8 aa, Entamoeba invadens
GYTGYRGG

SEQ ID NO: 2863026 - protein, 16 aa, Entamoeba invadens
GYTKGSTYSDQKTASH

SEQ ID NO: 2863027 - protein, 6 aa, Entamoeba invadens
GYTLQS

SEQ ID NO: 2863028 - protein, 7 aa, Entamoeba invadens
GYTPKTH

SEQ ID NO: 2863029 - protein, 19 aa, Entamoeba invadens
GYTPNTECPPNESSQYKSG

SEQ ID NO: 2863030 - protein, 8 aa, Entamoeba invadens
GYTQSSQT

SEQ ID NO: 2863031 - protein, 6 aa, Entamoeba invadens
GYTREE

SEQ ID NO: 2863032 - protein, 7 aa, Entamoeba invadens
GYTSEQH

SEQ ID NO: 2863033 - protein, 6 aa, Entamoeba invadens
GYTTDS

SEQ ID NO: 2863034 - protein, 4 aa, Entamoeba invadens
GYVP

SEQ ID NO: 2863035 - protein, 8 aa, Entamoeba invadens
GYVPSNQK

SEQ ID NO: 2863036 - protein, 9 aa, Entamoeba invadens
GYVRDTSNT

SEQ ID NO: 2863037 - protein, 5 aa, Entamoeba invadens
GYVST

SEQ ID NO: 2863038 - protein, 4 aa, Entamoeba invadens
GYVT

SEQ ID NO: 2863039 - protein, 5 aa, Entamoeba invadens
GYYEG

SEQ ID NO: 2863040 - protein, 5 aa, Entamoeba invadens
GYYGD

SEQ ID NO: 2863041 - protein, 12 aa, Entamoeba invadens
GYYGECGKRGGY

SEQ ID NO: 2863042 - protein, 9 aa, Entamoeba invadens
GYYKESDKA

SEQ ID NO: 2863043 - protein, 4 aa, Entamoeba invadens
GYYN

SEQ ID NO: 2863044 - protein, 8 aa, Entamoeba invadens
GYYPGSNG

SEQ ID NO: 2863045 - protein, 9 aa, Entamoeba invadens
GYYPGTTGQ

SEQ ID NO: 2863046 - protein, 7 aa, Entamoeba invadens
GYYPSNA

SEQ ID NO: 2863047 - protein, 6 aa, Entamoeba invadens
GYYPYT

SEQ ID NO: 2863048 - protein, 8 aa, Entamoeba invadens
GYYRSGDG

SEQ ID NO: 2863049 - protein, 5 aa, Entamoeba invadens
HAAKT

SEQ ID NO: 2863050 - protein, 22 aa, Entamoeba invadens
HAAYKTEYSKLKRSQRFKFFRI

SEQ ID NO: 2863051 - protein, 8 aa, Entamoeba invadens
HADPVGGT

SEQ ID NO: 2863052 - protein, 9 aa, Entamoeba invadens
HAEAKSDVE

SEQ ID NO: 2863053 - protein, 4 aa, Entamoeba invadens
HAEE

SEQ ID NO: 2863054 - protein, 11 aa, Entamoeba invadens
HAEEKGNTNEV

SEQ ID NO: 2863055 - protein, 10 aa, Entamoeba invadens
HAEKTGPGPS

SEQ ID NO: 2863056 - protein, 11 aa, Entamoeba invadens
HAENKNRETPL

SEQ ID NO: 2863057 - protein, 7 aa, Entamoeba invadens
HAEPEVR

SEQ ID NO: 2863058 - protein, 5 aa, Entamoeba invadens
HAEQV

SEQ ID NO: 2863059 - protein, 36 aa, Entamoeba invadens
HAESGNYEPREGRERKSELVGPTDADTSDNWRRKDG

SEQ ID NO: 2863060 - protein, 10 aa, Entamoeba invadens
HAGNQQPTLN

SEQ ID NO: 2863061 - protein, 10 aa, Entamoeba invadens
HAGSRNAELK

SEQ ID NO: 2863062 - protein, 44 aa, Entamoeba invadens
HAIERKEPKPPKAQRKKLKKRLSEEEDPAKDDEKKSRKRRHNKA

SEQ ID NO: 2863063 - protein, 7 aa, Entamoeba invadens
HAKDERK

SEQ ID NO: 2863064 - protein, 8 aa, Entamoeba invadens
HAKDTNEF

SEQ ID NO: 2863065 - protein, 26 aa, Entamoeba invadens
HAKELTEEKEHHTKEIRSRCDKNEKK

SEQ ID NO: 2863066 - protein, 8 aa, Entamoeba invadens
HAKPLQDK

SEQ ID NO: 2863067 - protein, 5 aa, Entamoeba invadens
HAKQI

SEQ ID NO: 2863068 - protein, 10 aa, Entamoeba invadens
HAKQKGMSEE

SEQ ID NO: 2863069 - protein, 7 aa, Entamoeba invadens
HAKQPKP

SEQ ID NO: 2863070 - protein, 4 aa, Entamoeba invadens
HAKY

SEQ ID NO: 2863071 - protein, 9 aa, Entamoeba invadens
HALSEGNSA

SEQ ID NO: 2863072 - protein, 12 aa, Entamoeba invadens
HANESSDPLPPR

SEQ ID NO: 2863073 - protein, 12 aa, Entamoeba invadens
HANGNIKNAGLN

SEQ ID NO: 2863074 - protein, 4 aa, Entamoeba invadens
HANN

SEQ ID NO: 2863075 - protein, 13 aa, Entamoeba invadens
HANPVTSLADAGE

SEQ ID NO: 2863076 - protein, 26 aa, Entamoeba invadens
HAPAETVDPAKFKEAEEHKMKGNEHL

SEQ ID NO: 2863077 - protein, 17 aa, Entamoeba invadens
HAPANKQLTSPPLNTET

SEQ ID NO: 2863078 - protein, 4 aa, Entamoeba invadens
HAPI

SEQ ID NO: 2863079 - protein, 9 aa, Entamoeba invadens
HAPNQDETT

SEQ ID NO: 2863080 - protein, 7 aa, Entamoeba invadens
HAPNRST

SEQ ID NO: 2863081 - protein, 9 aa, Entamoeba invadens
HAQTEDLSQ

SEQ ID NO: 2863082 - protein, 4 aa, Entamoeba invadens
HASA

SEQ ID NO: 2863083 - protein, 11 aa, Entamoeba invadens
HASDDANERSL

SEQ ID NO: 2863084 - protein, 8 aa, Entamoeba invadens
HASDGPDK

SEQ ID NO: 2863085 - protein, 7 aa, Entamoeba invadens
HASGSTM

SEQ ID NO: 2863086 - protein, 9 aa, Entamoeba invadens
HASSYEELA

SEQ ID NO: 2863087 - protein, 8 aa, Entamoeba invadens
HASTPNLG

SEQ ID NO: 2863088 - protein, 8 aa, Entamoeba invadens
HATAHEDR

SEQ ID NO: 2863089 - protein, 7 aa, Entamoeba invadens
HATKTDG

SEQ ID NO: 2863090 - protein, 10 aa, Entamoeba invadens
HATPSKNKLA

SEQ ID NO: 2863091 - protein, 5 aa, Entamoeba invadens
HATQE

SEQ ID NO: 2863092 - protein, 9 aa, Entamoeba invadens
HATTTDKTE

SEQ ID NO: 2863093 - protein, 6 aa, Entamoeba invadens
HAVPAQ

SEQ ID NO: 2863094 - protein, 6 aa, Entamoeba invadens
HAVTNK

SEQ ID NO: 2863095 - protein, 6 aa, Entamoeba invadens
HCDKTS

SEQ ID NO: 2863096 - protein, 16 aa, Entamoeba invadens
HCEEGGKIAGADPSLV

SEQ ID NO: 2863097 - protein, 6 aa, Entamoeba invadens
HCGESG

SEQ ID NO: 2863098 - protein, 10 aa, Entamoeba invadens
HCGGKDTRCI

SEQ ID NO: 2863099 - protein, 4 aa, Entamoeba invadens
HCGK

SEQ ID NO: 2863100 - protein, 7 aa, Entamoeba invadens
HCGSQPK

SEQ ID NO: 2863101 - protein, 5 aa, Entamoeba invadens
HCPSS

SEQ ID NO: 2863102 - protein, 6 aa, Entamoeba invadens
HCQNTS

SEQ ID NO: 2863103 - protein, 9 aa, Entamoeba invadens
HCSDQKKTE

SEQ ID NO: 2863104 - protein, 10 aa, Entamoeba invadens
HCTSSRDHHH

SEQ ID NO: 2863105 - protein, 5 aa, Entamoeba invadens
HDAAG

SEQ ID NO: 2863106 - protein, 10 aa, Entamoeba invadens
HDANTNDEIP

SEQ ID NO: 2863107 - protein, 6 aa, Entamoeba invadens
HDCSTA

SEQ ID NO: 2863108 - protein, 11 aa, Entamoeba invadens
HDDAQDEPIVQ

SEQ ID NO: 2863109 - protein, 9 aa, Entamoeba invadens
HDDEIEPVA

SEQ ID NO: 2863110 - protein, 8 aa, Entamoeba invadens
HDDGYAEH

SEQ ID NO: 2863111 - protein, 12 aa, Entamoeba invadens
HDDKKSEGKESD

SEQ ID NO: 2863112 - protein, 13 aa, Entamoeba invadens
HDDKTKDDKIGTA

SEQ ID NO: 2863113 - protein, 11 aa, Entamoeba invadens
HDDKVSEMSDK

SEQ ID NO: 2863114 - protein, 7 aa, Entamoeba invadens
HDDNEVH

SEQ ID NO: 2863115 - protein, 9 aa, Entamoeba invadens
HDDPKITNE

SEQ ID NO: 2863116 - protein, 4 aa, Entamoeba invadens
HDDQ

SEQ ID NO: 2863117 - protein, 6 aa, Entamoeba invadens
HDDSNV

SEQ ID NO: 2863118 - protein, 8 aa, Entamoeba invadens
HDDSSDQD

SEQ ID NO: 2863119 - protein, 6 aa, Entamoeba invadens
HDDYTR

SEQ ID NO: 2863120 - protein, 14 aa, Entamoeba invadens
HDEDNDDLSKEEWD

SEQ ID NO: 2863121 - protein, 7 aa, Entamoeba invadens
HDEDNEV

SEQ ID NO: 2863122 - protein, 6 aa, Entamoeba invadens
HDEESR

SEQ ID NO: 2863123 - protein, 8 aa, Entamoeba invadens
HDEEVEKR

SEQ ID NO: 2863124 - protein, 30 aa, Entamoeba invadens
HDEKEKERKRAEEGQKAEEELKQKKETEKA

SEQ ID NO: 2863125 - protein, 10 aa, Entamoeba invadens
HDENEDSIQN

SEQ ID NO: 2863126 - protein, 6 aa, Entamoeba invadens
HDENRA

SEQ ID NO: 2863127 - protein, 8 aa, Entamoeba invadens
HDEPSGTE

SEQ ID NO: 2863128 - protein, 23 aa, Entamoeba invadens
HDEQKKTAHKFRDEKKPFKDSKS

SEQ ID NO: 2863129 - protein, 13 aa, Entamoeba invadens
HDERNTRRCDKKV

SEQ ID NO: 2863130 - protein, 22 aa, Entamoeba invadens
HDERVQKKRERTEEPEKKEEDG

SEQ ID NO: 2863131 - protein, 5 aa, Entamoeba invadens
HDESQ

SEQ ID NO: 2863132 - protein, 6 aa, Entamoeba invadens
HDETKK

SEQ ID NO: 2863133 - protein, 8 aa, Entamoeba invadens
HDETPDGI

SEQ ID NO: 2863134 - protein, 8 aa, Entamoeba invadens
HDFENEDQ

SEQ ID NO: 2863135 - protein, 7 aa, Entamoeba invadens
HDFESED

SEQ ID NO: 2863136 - protein, 9 aa, Entamoeba invadens
HDFGNEEIE

SEQ ID NO: 2863137 - protein, 9 aa, Entamoeba invadens
HDFGNKGAF

SEQ ID NO: 2863138 - protein, 4 aa, Entamoeba invadens
HDGF

SEQ ID NO: 2863139 - protein, 4 aa, Entamoeba invadens
HDGL

SEQ ID NO: 2863140 - protein, 4 aa, Entamoeba invadens
HDGP

SEQ ID NO: 2863141 - protein, 4 aa, Entamoeba invadens
HDGR

SEQ ID NO: 2863142 - protein, 18 aa, Entamoeba invadens
HDGRALQAGQQRGAAQGH

SEQ ID NO: 2863143 - protein, 11 aa, Entamoeba invadens
HDKEDYETNYQ

SEQ ID NO: 2863144 - protein, 8 aa, Entamoeba invadens
HDKESKKL

SEQ ID NO: 2863145 - protein, 5 aa, Entamoeba invadens
HDKNE

SEQ ID NO: 2863146 - protein, 5 aa, Entamoeba invadens
HDKPL

SEQ ID NO: 2863147 - protein, 13 aa, Entamoeba invadens
HDKQEKDYQSLEN

SEQ ID NO: 2863148 - protein, 15 aa, Entamoeba invadens
HDKQRSVGSDLREGR

SEQ ID NO: 2863149 - protein, 13 aa, Entamoeba invadens
HDKTINQEIPTPT

SEQ ID NO: 2863150 - protein, 11 aa, Entamoeba invadens
HDLPYKEEDEY

SEQ ID NO: 2863151 - protein, 4 aa, Entamoeba invadens
HDMT

SEQ ID NO: 2863152 - protein, 19 aa, Entamoeba invadens
HDNEPHEGNRNSNDSLSTS

SEQ ID NO: 2863153 - protein, 19 aa, Entamoeba invadens
HDNEPQEGNRNPNDSLSTS

SEQ ID NO: 2863154 - protein, 4 aa, Entamoeba invadens
HDNG

SEQ ID NO: 2863155 - protein, 10 aa, Entamoeba invadens
HDNGNTINQL

SEQ ID NO: 2863156 - protein, 7 aa, Entamoeba invadens
HDNIKNE

SEQ ID NO: 2863157 - protein, 7 aa, Entamoeba invadens
HDNKKSL

SEQ ID NO: 2863158 - protein, 12 aa, Entamoeba invadens
HDNLEPKTRGMS

SEQ ID NO: 2863159 - protein, 9 aa, Entamoeba invadens
HDPDTFAGR

SEQ ID NO: 2863160 - protein, 4 aa, Entamoeba invadens
HDPK

SEQ ID NO: 2863161 - protein, 6 aa, Entamoeba invadens
HDPKSF

SEQ ID NO: 2863162 - protein, 7 aa, Entamoeba invadens
HDPKSFE

SEQ ID NO: 2863163 - protein, 8 aa, Entamoeba invadens
HDPKSFED

SEQ ID NO: 2863164 - protein, 9 aa, Entamoeba invadens
HDPNGDDLP

SEQ ID NO: 2863165 - protein, 5 aa, Entamoeba invadens
HDPQS

SEQ ID NO: 2863166 - protein, 7 aa, Entamoeba invadens
HDPQTGT

SEQ ID NO: 2863167 - protein, 9 aa, Entamoeba invadens
HDPRVTERY

SEQ ID NO: 2863168 - protein, 13 aa, Entamoeba invadens
HDPSDEPSAPGKI

SEQ ID NO: 2863169 - protein, 9 aa, Entamoeba invadens
HDPSGEDME

SEQ ID NO: 2863170 - protein, 4 aa, Entamoeba invadens
HDPT

SEQ ID NO: 2863171 - protein, 6 aa, Entamoeba invadens
HDPVTN

SEQ ID NO: 2863172 - protein, 20 aa, Entamoeba invadens
HDQPRQVSRWGDDQKYRVES

SEQ ID NO: 2863173 - protein, 4 aa, Entamoeba invadens
HDRA

SEQ ID NO: 2863174 - protein, 5 aa, Entamoeba invadens
HDRIP

SEQ ID NO: 2863175 - protein, 6 aa, Entamoeba invadens
HDRKDT

SEQ ID NO: 2863176 - protein, 11 aa, Entamoeba invadens
HDRSERGKSGI

SEQ ID NO: 2863177 - protein, 5 aa, Entamoeba invadens
HDSET

SEQ ID NO: 2863178 - protein, 13 aa, Entamoeba invadens
HDSFTDKYTEKPA

SEQ ID NO: 2863179 - protein, 11 aa, Entamoeba invadens
HDSIGKSREDD

SEQ ID NO: 2863180 - protein, 6 aa, Entamoeba invadens
HDSQEL

SEQ ID NO: 2863181 - protein, 10 aa, Entamoeba invadens
HDSQSDAKGS

SEQ ID NO: 2863182 - protein, 12 aa, Entamoeba invadens
HDSSEKRNKNVE

SEQ ID NO: 2863183 - protein, 9 aa, Entamoeba invadens
HDTERPSYG

SEQ ID NO: 2863184 - protein, 5 aa, Entamoeba invadens
HDTGS

SEQ ID NO: 2863185 - protein, 23 aa, Entamoeba invadens
HDTIDRSEKDEKSEKDKTEKPSL

SEQ ID NO: 2863186 - protein, 8 aa, Entamoeba invadens
HDTKNPIE

SEQ ID NO: 2863187 - protein, 10 aa, Entamoeba invadens
HDTPRKKSIG

SEQ ID NO: 2863188 - protein, 4 aa, Entamoeba invadens
HDTT

SEQ ID NO: 2863189 - protein, 21 aa, Entamoeba invadens
HDTTAKNKGSKFVPKGKGTFF

SEQ ID NO: 2863190 - protein, 8 aa, Entamoeba invadens
HDTTDNKI

SEQ ID NO: 2863191 - protein, 6 aa, Entamoeba invadens
HDTTHN

SEQ ID NO: 2863192 - protein, 7 aa, Entamoeba invadens
HDTVPKD

SEQ ID NO: 2863193 - protein, 20 aa, Entamoeba invadens
HDVPNSSIALGNTNTHESSN

SEQ ID NO: 2863194 - protein, 7 aa, Entamoeba invadens
HDVQTPE

SEQ ID NO: 2863195 - protein, 10 aa, Entamoeba invadens
HDYKNKKRNL

SEQ ID NO: 2863196 - protein, 20 aa, Entamoeba invadens
HEADDSTKLYEDPDVKNMKT

SEQ ID NO: 2863197 - protein, 4 aa, Entamoeba invadens
HEAL

SEQ ID NO: 2863198 - protein, 8 aa, Entamoeba invadens
HEAPASGS

SEQ ID NO: 2863199 - protein, 6 aa, Entamoeba invadens
HEASIQ

SEQ ID NO: 2863200 - protein, 5 aa, Entamoeba invadens
HEATE

SEQ ID NO: 2863201 - protein, 17 aa, Entamoeba invadens
HEDALKAKNEFTGKEVD

SEQ ID NO: 2863202 - protein, 7 aa, Entamoeba invadens
HEDDTPL

SEQ ID NO: 2863203 - protein, 8 aa, Entamoeba invadens
HEDEMPPD

SEQ ID NO: 2863204 - protein, 12 aa, Entamoeba invadens
HEDETNNLNGSI

SEQ ID NO: 2863205 - protein, 29 aa, Entamoeba invadens
HEDETNNLNGSIKKDRTVKDKKKIADLEQ

SEQ ID NO: 2863206 - protein, 5 aa, Entamoeba invadens
HEDKE

SEQ ID NO: 2863207 - protein, 8 aa, Entamoeba invadens
HEDKNTKD

SEQ ID NO: 2863208 - protein, 5 aa, Entamoeba invadens
HEDNV

SEQ ID NO: 2863209 - protein, 10 aa, Entamoeba invadens
HEDPAGSYRE

SEQ ID NO: 2863210 - protein, 8 aa, Entamoeba invadens
HEDSTHTQ

SEQ ID NO: 2863211 - protein, 10 aa, Entamoeba invadens
HEDTTNRDKL

SEQ ID NO: 2863212 - protein, 39 aa, Entamoeba invadens
HEECVEPTRASDVEHKEDNDVLDQNEDEDEEEEEESNAF

SEQ ID NO: 2863213 - protein, 9 aa, Entamoeba invadens
HEEDEGDAF

SEQ ID NO: 2863214 - protein, 5 aa, Entamoeba invadens
HEEDI

SEQ ID NO: 2863215 - protein, 5 aa, Entamoeba invadens
HEEDT

SEQ ID NO: 2863216 - protein, 6 aa, Entamoeba invadens
HEEEDP

SEQ ID NO: 2863217 - protein, 24 aa, Entamoeba invadens
HEEEEEQKAERVQSKGEKKARKAL

SEQ ID NO: 2863218 - protein, 4 aa, Entamoeba invadens
HEEL

SEQ ID NO: 2863219 - protein, 4 aa, Entamoeba invadens
HEEN

SEQ ID NO: 2863220 - protein, 6 aa, Entamoeba invadens
HEENQV

SEQ ID NO: 2863221 - protein, 5 aa, Entamoeba invadens
HEEPI

SEQ ID NO: 2863222 - protein, 15 aa, Entamoeba invadens
HEEPPQQEQQEHEKY

SEQ ID NO: 2863223 - protein, 4 aa, Entamoeba invadens
HEER

SEQ ID NO: 2863224 - protein, 6 aa, Entamoeba invadens
HEERDV

SEQ ID NO: 2863225 - protein, 25 aa, Entamoeba invadens
HEESIQKELPKQENNSSPNVTTQQQ

SEQ ID NO: 2863226 - protein, 17 aa, Entamoeba invadens
HEESIQTLSDDNEAIRT

SEQ ID NO: 2863227 - protein, 4 aa, Entamoeba invadens
HEEV

SEQ ID NO: 2863228 - protein, 5 aa, Entamoeba invadens
HEFST

SEQ ID NO: 2863229 - protein, 6 aa, Entamoeba invadens
HEGDHD

SEQ ID NO: 2863230 - protein, 5 aa, Entamoeba invadens
HEGDK

SEQ ID NO: 2863231 - protein, 7 aa, Entamoeba invadens
HEGETTL

SEQ ID NO: 2863232 - protein, 8 aa, Entamoeba invadens
HEGKSPFN

SEQ ID NO: 2863233 - protein, 5 aa, Entamoeba invadens
HEGLE

SEQ ID NO: 2863234 - protein, 4 aa, Entamoeba invadens
HEGN

SEQ ID NO: 2863235 - protein, 11 aa, Entamoeba invadens
HEIDKDEDIDK

SEQ ID NO: 2863236 - protein, 4 aa, Entamoeba invadens
HEKD

SEQ ID NO: 2863237 - protein, 32 aa, Entamoeba invadens
HEKDEQQQLKQKELEEAKEREEQEKANAKRPA

SEQ ID NO: 2863238 - protein, 11 aa, Entamoeba invadens
HEKDKSPKNRV

SEQ ID NO: 2863239 - protein, 21 aa, Entamoeba invadens
HEKEDSKKDEIHTNVKSQSYK

SEQ ID NO: 2863240 - protein, 8 aa, Entamoeba invadens
HEKIPEDL

SEQ ID NO: 2863241 - protein, 11 aa, Entamoeba invadens
HEKKDDIADLE

SEQ ID NO: 2863242 - protein, 14 aa, Entamoeba invadens
HEKKEKSRDNPIGT

SEQ ID NO: 2863243 - protein, 22 aa, Entamoeba invadens
HEKKNKKRTKKCETLEKNSTNL

SEQ ID NO: 2863244 - protein, 14 aa, Entamoeba invadens
HEKQRKEKAALKRS

SEQ ID NO: 2863245 - protein, 10 aa, Entamoeba invadens
HEKRSKELNK

SEQ ID NO: 2863246 - protein, 8 aa, Entamoeba invadens
HEKSETVA

SEQ ID NO: 2863247 - protein, 7 aa, Entamoeba invadens
HEKSPKV

SEQ ID NO: 2863248 - protein, 10 aa, Entamoeba invadens
HEKTTSTVDG

SEQ ID NO: 2863249 - protein, 6 aa, Entamoeba invadens
HELAGG

SEQ ID NO: 2863250 - protein, 25 aa, Entamoeba invadens
HELEPNNPTYATTNLEKNTNERPQI

SEQ ID NO: 2863251 - protein, 8 aa, Entamoeba invadens
HELTETKS

SEQ ID NO: 2863252 - protein, 19 aa, Entamoeba invadens
HEMTTKNSKKIKKTNQPDI

SEQ ID NO: 2863253 - protein, 8 aa, Entamoeba invadens
HENATTRI

SEQ ID NO: 2863254 - protein, 8 aa, Entamoeba invadens
HENDTTRI

SEQ ID NO: 2863255 - protein, 16 aa, Entamoeba invadens
HENEEKANETLSRIPD

SEQ ID NO: 2863256 - protein, 6 aa, Entamoeba invadens
HENEEQ

SEQ ID NO: 2863257 - protein, 17 aa, Entamoeba invadens
HENEKTSFKKKCSEEAQ

SEQ ID NO: 2863258 - protein, 5 aa, Entamoeba invadens
HENGV

SEQ ID NO: 2863259 - protein, 14 aa, Entamoeba invadens
HENLSQSYQGWCPW

SEQ ID NO: 2863260 - protein, 14 aa, Entamoeba invadens
HENLSQSYQGWCPY

SEQ ID NO: 2863261 - protein, 4 aa, Entamoeba invadens
HENP

SEQ ID NO: 2863262 - protein, 6 aa, Entamoeba invadens
HENSTP

SEQ ID NO: 2863263 - protein, 10 aa, Entamoeba invadens
HENWSTGTSV

SEQ ID NO: 2863264 - protein, 5 aa, Entamoeba invadens
HEPAT

SEQ ID NO: 2863265 - protein, 185 aa, Entamoeba invadens
HEPEVSSSTQTSSSDESFSLSEESNQSNQSNEDSESYSTTSDYSNNSNNSNYSDDSNNSSEEPYNNSSSSYTSSDQSGQSSYSNESSSLSEESNQSSEEPYNNSSSCDSSSDQSGQSSYSNQSSEEQSTSSESNSIGSDSNTTSSEQNSSESESQYPSEESTESSDSNNSSFDTSSSSNEKDTEY

SEQ ID NO: 2863266 - protein, 11 aa, Entamoeba invadens
HEPHGDKKSKY

SEQ ID NO: 2863267 - protein, 6 aa, Entamoeba invadens
HEPPVP

SEQ ID NO: 2863268 - protein, 8 aa, Entamoeba invadens
HEPPVTSQ

SEQ ID NO: 2863269 - protein, 5 aa, Entamoeba invadens
HEPTM

SEQ ID NO: 2863270 - protein, 11 aa, Entamoeba invadens
HEPYDKDLADR

SEQ ID NO: 2863271 - protein, 7 aa, Entamoeba invadens
HEQASCH

SEQ ID NO: 2863272 - protein, 5 aa, Entamoeba invadens
HEQND

SEQ ID NO: 2863273 - protein, 8 aa, Entamoeba invadens
HEQQDSLN

SEQ ID NO: 2863274 - protein, 6 aa, Entamoeba invadens
HEQSGH

SEQ ID NO: 2863275 - protein, 6 aa, Entamoeba invadens
HERDID

SEQ ID NO: 2863276 - protein, 12 aa, Entamoeba invadens
HERLTQEQLSTR

SEQ ID NO: 2863277 - protein, 5 aa, Entamoeba invadens
HERSI

SEQ ID NO: 2863278 - protein, 6 aa, Entamoeba invadens
HERSIN

SEQ ID NO: 2863279 - protein, 5 aa, Entamoeba invadens
HERSL

SEQ ID NO: 2863280 - protein, 17 aa, Entamoeba invadens
HERSRSNSRERKRKTDF

SEQ ID NO: 2863281 - protein, 6 aa, Entamoeba invadens
HERTVG

SEQ ID NO: 2863282 - protein, 5 aa, Entamoeba invadens
HESAI

SEQ ID NO: 2863283 - protein, 21 aa, Entamoeba invadens
HESCSSSSNSSKKTRKPAKIW

SEQ ID NO: 2863284 - protein, 4 aa, Entamoeba invadens
HESD

SEQ ID NO: 2863285 - protein, 14 aa, Entamoeba invadens
HESFEKKKEKKTWW

SEQ ID NO: 2863286 - protein, 7 aa, Entamoeba invadens
HESGITN

SEQ ID NO: 2863287 - protein, 11 aa, Entamoeba invadens
HESGTEIPQEN

SEQ ID NO: 2863288 - protein, 4 aa, Entamoeba invadens
HESI

SEQ ID NO: 2863289 - protein, 15 aa, Entamoeba invadens
HESKDEDQEKGVHPI

SEQ ID NO: 2863290 - protein, 7 aa, Entamoeba invadens
HESKIDG

SEQ ID NO: 2863291 - protein, 5 aa, Entamoeba invadens
HESKM

SEQ ID NO: 2863292 - protein, 5 aa, Entamoeba invadens
HESLS

SEQ ID NO: 2863293 - protein, 7 aa, Entamoeba invadens
HESPEAR

SEQ ID NO: 2863294 - protein, 7 aa, Entamoeba invadens
HESQSVS

SEQ ID NO: 2863295 - protein, 4 aa, Entamoeba invadens
HESR

SEQ ID NO: 2863296 - protein, 12 aa, Entamoeba invadens
HESRAMSEKNTF

SEQ ID NO: 2863297 - protein, 10 aa, Entamoeba invadens
HESRQMTESY

SEQ ID NO: 2863298 - protein, 7 aa, Entamoeba invadens
HESRRMT

SEQ ID NO: 2863299 - protein, 16 aa, Entamoeba invadens
HESSQTEKRTSFPISK

SEQ ID NO: 2863300 - protein, 4 aa, Entamoeba invadens
HEST

SEQ ID NO: 2863301 - protein, 7 aa, Entamoeba invadens
HESTISE

SEQ ID NO: 2863302 - protein, 4 aa, Entamoeba invadens
HESV

SEQ ID NO: 2863303 - protein, 4 aa, Entamoeba invadens
HESY

SEQ ID NO: 2863304 - protein, 14 aa, Entamoeba invadens
HESYDVSSNTKNSF

SEQ ID NO: 2863305 - protein, 15 aa, Entamoeba invadens
HETESKHKLSMNSAE

SEQ ID NO: 2863306 - protein, 14 aa, Entamoeba invadens
HETGEENKKRSEYK

SEQ ID NO: 2863307 - protein, 6 aa, Entamoeba invadens
HETIRS

SEQ ID NO: 2863308 - protein, 11 aa, Entamoeba invadens
HETKEHTGCPP

SEQ ID NO: 2863309 - protein, 13 aa, Entamoeba invadens
HETKLVSSQNQFK

SEQ ID NO: 2863310 - protein, 12 aa, Entamoeba invadens
HETNPFTNRPFS

SEQ ID NO: 2863311 - protein, 6 aa, Entamoeba invadens
HETQIR

SEQ ID NO: 2863312 - protein, 16 aa, Entamoeba invadens
HETQQKLKNSTSFTYG

SEQ ID NO: 2863313 - protein, 7 aa, Entamoeba invadens
HETSSAK

SEQ ID NO: 2863314 - protein, 7 aa, Entamoeba invadens
HETTTTA

SEQ ID NO: 2863315 - protein, 5 aa, Entamoeba invadens
HETTY

SEQ ID NO: 2863316 - protein, 8 aa, Entamoeba invadens
HETVESSA

SEQ ID NO: 2863317 - protein, 7 aa, Entamoeba invadens
HETVSDT

SEQ ID NO: 2863318 - protein, 6 aa, Entamoeba invadens
HEVARD

SEQ ID NO: 2863319 - protein, 8 aa, Entamoeba invadens
HEVENKIN

SEQ ID NO: 2863320 - protein, 7 aa, Entamoeba invadens
HEVHPGE

SEQ ID NO: 2863321 - protein, 4 aa, Entamoeba invadens
HEWG

SEQ ID NO: 2863322 - protein, 6 aa, Entamoeba invadens
HEYPPG

SEQ ID NO: 2863323 - protein, 5 aa, Entamoeba invadens
HFDNG

SEQ ID NO: 2863324 - protein, 9 aa, Entamoeba invadens
HFGENRDDV

SEQ ID NO: 2863325 - protein, 14 aa, Entamoeba invadens
HFKEQKNKEETKFD

SEQ ID NO: 2863326 - protein, 8 aa, Entamoeba invadens
HFKPSPDG

SEQ ID NO: 2863327 - protein, 13 aa, Entamoeba invadens
HFKSNTTGCKQFT

SEQ ID NO: 2863328 - protein, 15 aa, Entamoeba invadens
HFNDSDTPKNVLALL

SEQ ID NO: 2863329 - protein, 12 aa, Entamoeba invadens
HFPTKTEKIDEV

SEQ ID NO: 2863330 - protein, 8 aa, Entamoeba invadens
HFRGEGQN

SEQ ID NO: 2863331 - protein, 16 aa, Entamoeba invadens
HFTGKNQQTATRRVQK

SEQ ID NO: 2863332 - protein, 4 aa, Entamoeba invadens
HFTN

SEQ ID NO: 2863333 - protein, 23 aa, Entamoeba invadens
HFTTQTEELKNADEKYRRMPGAK

SEQ ID NO: 2863334 - protein, 17 aa, Entamoeba invadens
HGADTTIGYEKRNNMIN

SEQ ID NO: 2863335 - protein, 4 aa, Entamoeba invadens
HGCG

SEQ ID NO: 2863336 - protein, 6 aa, Entamoeba invadens
HGCGKT

SEQ ID NO: 2863337 - protein, 9 aa, Entamoeba invadens
HGDARGPYR

SEQ ID NO: 2863338 - protein, 5 aa, Entamoeba invadens
HGDES

SEQ ID NO: 2863339 - protein, 7 aa, Entamoeba invadens
HGDESST

SEQ ID NO: 2863340 - protein, 9 aa, Entamoeba invadens
HGDGVEEAF

SEQ ID NO: 2863341 - protein, 10 aa, Entamoeba invadens
HGDGVEEAFK

SEQ ID NO: 2863342 - protein, 9 aa, Entamoeba invadens
HGDKANSSL

SEQ ID NO: 2863343 - protein, 8 aa, Entamoeba invadens
HGDMSSRK

SEQ ID NO: 2863344 - protein, 5 aa, Entamoeba invadens
HGDNK

SEQ ID NO: 2863345 - protein, 10 aa, Entamoeba invadens
HGDRSQSDRD

SEQ ID NO: 2863346 - protein, 6 aa, Entamoeba invadens
HGDYGY

SEQ ID NO: 2863347 - protein, 163 aa, Entamoeba invadens
HGEEKEDQKDKSKSDTNAVAPETKDESAILGEDESDKNTYHSHGDVENDEHENKDSKQETHPLGEDNEIKEESNKDVEEKIEKEESHTLSQPQMEEEPTTKHEDKVEDIKEEVKEPSKQEEKVEKKIEEETPKELEKPEKVEEKKSTSSSDEKSYSTEDENKL

SEQ ID NO: 2863348 - protein, 4 aa, Entamoeba invadens
HGEL

SEQ ID NO: 2863349 - protein, 5 aa, Entamoeba invadens
HGELD

SEQ ID NO: 2863350 - protein, 5 aa, Entamoeba invadens
HGENG

SEQ ID NO: 2863351 - protein, 8 aa, Entamoeba invadens
HGETPSMT

SEQ ID NO: 2863352 - protein, 35 aa, Entamoeba invadens
HGEVPSPPHSPNKENSFEGAENGDDFSDAEYEKDV

SEQ ID NO: 2863353 - protein, 52 aa, Entamoeba invadens
HGGADQRKNTGALSASDSHAMKETKAHKTVNEQVRGGADQRKNTGALSSSDA

SEQ ID NO: 2863354 - protein, 8 aa, Entamoeba invadens
HGGAGKVK

SEQ ID NO: 2863355 - protein, 7 aa, Entamoeba invadens
HGGDQVA

SEQ ID NO: 2863356 - protein, 10 aa, Entamoeba invadens
HGGKEAAQVA

SEQ ID NO: 2863357 - protein, 5 aa, Entamoeba invadens
HGGKR

SEQ ID NO: 2863358 - protein, 6 aa, Entamoeba invadens
HGGLNS

SEQ ID NO: 2863359 - protein, 8 aa, Entamoeba invadens
HGGLSPDC

SEQ ID NO: 2863360 - protein, 18 aa, Entamoeba invadens
HGGLTSIKREKQTNTIYY

SEQ ID NO: 2863361 - protein, 6 aa, Entamoeba invadens
HGGQKR

SEQ ID NO: 2863362 - protein, 10 aa, Entamoeba invadens
HGGRTASQHA

SEQ ID NO: 2863363 - protein, 5 aa, Entamoeba invadens
HGGYG

SEQ ID NO: 2863364 - protein, 10 aa, Entamoeba invadens
HGIGSDGSLL

SEQ ID NO: 2863365 - protein, 11 aa, Entamoeba invadens
HGKDPKQDTID

SEQ ID NO: 2863366 - protein, 8 aa, Entamoeba invadens
HGKDTNGS

SEQ ID NO: 2863367 - protein, 7 aa, Entamoeba invadens
HGKEDDG

SEQ ID NO: 2863368 - protein, 12 aa, Entamoeba invadens
HGKKSEKRKSVM

SEQ ID NO: 2863369 - protein, 6 aa, Entamoeba invadens
HGKNCE

SEQ ID NO: 2863370 - protein, 6 aa, Entamoeba invadens
HGKSED

SEQ ID NO: 2863371 - protein, 10 aa, Entamoeba invadens
HGKSEEYKFS

SEQ ID NO: 2863372 - protein, 8 aa, Entamoeba invadens
HGKSTLTD

SEQ ID NO: 2863373 - protein, 6 aa, Entamoeba invadens
HGKSTV

SEQ ID NO: 2863374 - protein, 6 aa, Entamoeba invadens
HGKTSI

SEQ ID NO: 2863375 - protein, 15 aa, Entamoeba invadens
HGNGDGLSVNGSGYN

SEQ ID NO: 2863376 - protein, 8 aa, Entamoeba invadens
HGNGNEKR

SEQ ID NO: 2863377 - protein, 7 aa, Entamoeba invadens
HGNNSQR

SEQ ID NO: 2863378 - protein, 7 aa, Entamoeba invadens
HGNSHPE

SEQ ID NO: 2863379 - protein, 4 aa, Entamoeba invadens
HGNV

SEQ ID NO: 2863380 - protein, 5 aa, Entamoeba invadens
HGPEL

SEQ ID NO: 2863381 - protein, 11 aa, Entamoeba invadens
HGPIKKKTGFY

SEQ ID NO: 2863382 - protein, 4 aa, Entamoeba invadens
HGPK

SEQ ID NO: 2863383 - protein, 20 aa, Entamoeba invadens
HGPKKSSAKTMKDPHTTRKT

SEQ ID NO: 2863384 - protein, 8 aa, Entamoeba invadens
HGPKSGDP

SEQ ID NO: 2863385 - protein, 4 aa, Entamoeba invadens
HGPN

SEQ ID NO: 2863386 - protein, 7 aa, Entamoeba invadens
HGPPCQK

SEQ ID NO: 2863387 - protein, 6 aa, Entamoeba invadens
HGQGIK

SEQ ID NO: 2863388 - protein, 12 aa, Entamoeba invadens
HGQSRPEGYENL

SEQ ID NO: 2863389 - protein, 7 aa, Entamoeba invadens
HGQTEFK

SEQ ID NO: 2863390 - protein, 21 aa, Entamoeba invadens
HGQVKPDQTLPQPKPIQQPQQ

SEQ ID NO: 2863391 - protein, 5 aa, Entamoeba invadens
HGRHP

SEQ ID NO: 2863392 - protein, 18 aa, Entamoeba invadens
HGRPEKVQTGQSFSSTEV

SEQ ID NO: 2863393 - protein, 10 aa, Entamoeba invadens
HGRPNNVGGT

SEQ ID NO: 2863394 - protein, 15 aa, Entamoeba invadens
HGSDTYTAKIEDTAS

SEQ ID NO: 2863395 - protein, 8 aa, Entamoeba invadens
HGSGEEKR

SEQ ID NO: 2863396 - protein, 9 aa, Entamoeba invadens
HGSGKSTIA

SEQ ID NO: 2863397 - protein, 4 aa, Entamoeba invadens
HGSN

SEQ ID NO: 2863398 - protein, 7 aa, Entamoeba invadens
HGSNDYK

SEQ ID NO: 2863399 - protein, 8 aa, Entamoeba invadens
HGSPSDDI

SEQ ID NO: 2863400 - protein, 8 aa, Entamoeba invadens
HGSRRQQL

SEQ ID NO: 2863401 - protein, 8 aa, Entamoeba invadens
HGSSCPEY

SEQ ID NO: 2863402 - protein, 7 aa, Entamoeba invadens
HGSSYNT

SEQ ID NO: 2863403 - protein, 22 aa, Entamoeba invadens
HGSTTTIATYPNTNNNKKDGTI

SEQ ID NO: 2863404 - protein, 6 aa, Entamoeba invadens
HGSVPD

SEQ ID NO: 2863405 - protein, 6 aa, Entamoeba invadens
HGTARA

SEQ ID NO: 2863406 - protein, 18 aa, Entamoeba invadens
HGTDPKFADPISKNGFKV

SEQ ID NO: 2863407 - protein, 9 aa, Entamoeba invadens
HGTDTTDDV

SEQ ID NO: 2863408 - protein, 6 aa, Entamoeba invadens
HGTHKD

SEQ ID NO: 2863409 - protein, 9 aa, Entamoeba invadens
HGTNSLERE

SEQ ID NO: 2863410 - protein, 17 aa, Entamoeba invadens
HGTPEKTAIRRGENNKI

SEQ ID NO: 2863411 - protein, 14 aa, Entamoeba invadens
HGVPERKKPENRPR

SEQ ID NO: 2863412 - protein, 11 aa, Entamoeba invadens
HGYSDTLQPPT

SEQ ID NO: 2863413 - protein, 9 aa, Entamoeba invadens
HGYTSDAKD

SEQ ID NO: 2863414 - protein, 38 aa, Entamoeba invadens
HHAKELTKEKEHHTKDLAEEKEHHAKEIRSRCDKNEKK

SEQ ID NO: 2863415 - protein, 5 aa, Entamoeba invadens
HHDER

SEQ ID NO: 2863416 - protein, 14 aa, Entamoeba invadens
HHEEQAQEKPEEYG

SEQ ID NO: 2863417 - protein, 10 aa, Entamoeba invadens
HHEPPTPTLE

SEQ ID NO: 2863418 - protein, 13 aa, Entamoeba invadens
HHESAPKPLPEQL

SEQ ID NO: 2863419 - protein, 11 aa, Entamoeba invadens
HHETGKTITQN

SEQ ID NO: 2863420 - protein, 8 aa, Entamoeba invadens
HHGEPPEF

SEQ ID NO: 2863421 - protein, 12 aa, Entamoeba invadens
HHITKGKCETCD

SEQ ID NO: 2863422 - protein, 28 aa, Entamoeba invadens
HHKSGDVAASPSGKYPSGGSDPVSYPGS

SEQ ID NO: 2863423 - protein, 9 aa, Entamoeba invadens
HHKTTQRRV

SEQ ID NO: 2863424 - protein, 21 aa, Entamoeba invadens
HHNETKVQKEEQQKQEKKESE

SEQ ID NO: 2863425 - protein, 5 aa, Entamoeba invadens
HHPGA

SEQ ID NO: 2863426 - protein, 19 aa, Entamoeba invadens
HHPKAQKVEDAKKPKPKEI

SEQ ID NO: 2863427 - protein, 7 aa, Entamoeba invadens
HHQNSRS

SEQ ID NO: 2863428 - protein, 11 aa, Entamoeba invadens
HHQPPSSLDDT

SEQ ID NO: 2863429 - protein, 8 aa, Entamoeba invadens
HHQQPSSC

SEQ ID NO: 2863430 - protein, 4 aa, Entamoeba invadens
HHRE

SEQ ID NO: 2863431 - protein, 5 aa, Entamoeba invadens
HHRGK

SEQ ID NO: 2863432 - protein, 16 aa, Entamoeba invadens
HHRREMKKKEAEMEQV

SEQ ID NO: 2863433 - protein, 6 aa, Entamoeba invadens
HHRSAA

SEQ ID NO: 2863434 - protein, 16 aa, Entamoeba invadens
HHRSESSTPTPRANPT

SEQ ID NO: 2863435 - protein, 17 aa, Entamoeba invadens
HHSDESKLTNASNIIPS

SEQ ID NO: 2863436 - protein, 5 aa, Entamoeba invadens
HHSDK

SEQ ID NO: 2863437 - protein, 6 aa, Entamoeba invadens
HHSERT

SEQ ID NO: 2863438 - protein, 15 aa, Entamoeba invadens
HHTKRGRKKSDNIEL

SEQ ID NO: 2863439 - protein, 11 aa, Entamoeba invadens
HHTPDLPNSVT

SEQ ID NO: 2863440 - protein, 5 aa, Entamoeba invadens
HHTSG

SEQ ID NO: 2863441 - protein, 13 aa, Entamoeba invadens
HHTTTLSGKYHDS

SEQ ID NO: 2863442 - protein, 6 aa, Entamoeba invadens
HHVGPD

SEQ ID NO: 2863443 - protein, 6 aa, Entamoeba invadens
HIAGTS

SEQ ID NO: 2863444 - protein, 5 aa, Entamoeba invadens
HIARD

SEQ ID NO: 2863445 - protein, 9 aa, Entamoeba invadens
HIDESRSLN

SEQ ID NO: 2863446 - protein, 7 aa, Entamoeba invadens
HIENAQQ

SEQ ID NO: 2863447 - protein, 8 aa, Entamoeba invadens
HIESGTTM

SEQ ID NO: 2863448 - protein, 11 aa, Entamoeba invadens
HIETTKTTDEL

SEQ ID NO: 2863449 - protein, 12 aa, Entamoeba invadens
HIGESGVQHQTE

SEQ ID NO: 2863450 - protein, 22 aa, Entamoeba invadens
HIGQSKAKVASEISKSRYNPRA

SEQ ID NO: 2863451 - protein, 7 aa, Entamoeba invadens
HIGSTEQ

SEQ ID NO: 2863452 - protein, 6 aa, Entamoeba invadens
HIKGGA

SEQ ID NO: 2863453 - protein, 4 aa, Entamoeba invadens
HINS

SEQ ID NO: 2863454 - protein, 14 aa, Entamoeba invadens
HINVNDQVKKTLTC

SEQ ID NO: 2863455 - protein, 22 aa, Entamoeba invadens
HIPKPSQNTFKDKPQQEIPTKT

SEQ ID NO: 2863456 - protein, 6 aa, Entamoeba invadens
HIPPDL

SEQ ID NO: 2863457 - protein, 12 aa, Entamoeba invadens
HIPQTTKKFETP

SEQ ID NO: 2863458 - protein, 30 aa, Entamoeba invadens
HIPTADASVSTPKEEAKPKESPRENSKSRD

SEQ ID NO: 2863459 - protein, 12 aa, Entamoeba invadens
HIQENGNSAFNT

SEQ ID NO: 2863460 - protein, 19 aa, Entamoeba invadens
HKAFDKKNKEFKKQTKKED

SEQ ID NO: 2863461 - protein, 20 aa, Entamoeba invadens
HKAGDRPPIENVIKQIKALI

SEQ ID NO: 2863462 - protein, 8 aa, Entamoeba invadens
HKASNNEA

SEQ ID NO: 2863463 - protein, 7 aa, Entamoeba invadens
HKCTESE

SEQ ID NO: 2863464 - protein, 19 aa, Entamoeba invadens
HKDALKTKTQLEEKEKTQT

SEQ ID NO: 2863465 - protein, 18 aa, Entamoeba invadens
HKDEKEEFSSSQDEDDKF

SEQ ID NO: 2863466 - protein, 9 aa, Entamoeba invadens
HKDETIDSQ

SEQ ID NO: 2863467 - protein, 8 aa, Entamoeba invadens
HKDKERCQ

SEQ ID NO: 2863468 - protein, 7 aa, Entamoeba invadens
HKDKLGD

SEQ ID NO: 2863469 - protein, 8 aa, Entamoeba invadens
HKDKSYEI

SEQ ID NO: 2863470 - protein, 5 aa, Entamoeba invadens
HKDPS

SEQ ID NO: 2863471 - protein, 17 aa, Entamoeba invadens
HKDQNKYLDKKKERVEK

SEQ ID NO: 2863472 - protein, 4 aa, Entamoeba invadens
HKDS

SEQ ID NO: 2863473 - protein, 15 aa, Entamoeba invadens
HKDSQPTFQFMFVSS

SEQ ID NO: 2863474 - protein, 9 aa, Entamoeba invadens
HKDTQFDKD

SEQ ID NO: 2863475 - protein, 16 aa, Entamoeba invadens
HKDVAEINNDKEKDLR

SEQ ID NO: 2863476 - protein, 40 aa, Entamoeba invadens
HKEDSGRSTRKDAGSTPKNSSCDESVNNKSEKSDTQNEER

SEQ ID NO: 2863477 - protein, 8 aa, Entamoeba invadens
HKEDTENA

SEQ ID NO: 2863478 - protein, 5 aa, Entamoeba invadens
HKEEI

SEQ ID NO: 2863479 - protein, 10 aa, Entamoeba invadens
HKEEPKLGEN

SEQ ID NO: 2863480 - protein, 7 aa, Entamoeba invadens
HKEETIR

SEQ ID NO: 2863481 - protein, 10 aa, Entamoeba invadens
HKEEVDVKKS

SEQ ID NO: 2863482 - protein, 7 aa, Entamoeba invadens
HKEFKDD

SEQ ID NO: 2863483 - protein, 18 aa, Entamoeba invadens
HKEGNGNEMTNPVEQEDR

SEQ ID NO: 2863484 - protein, 6 aa, Entamoeba invadens
HKEGTP

SEQ ID NO: 2863485 - protein, 8 aa, Entamoeba invadens
HKEKQDGY

SEQ ID NO: 2863486 - protein, 10 aa, Entamoeba invadens
HKEKSGSTTL

SEQ ID NO: 2863487 - protein, 7 aa, Entamoeba invadens
HKEKTGN

SEQ ID NO: 2863488 - protein, 46 aa, Entamoeba invadens
HKELEKDDYDLEKGAEPTLDNDKIERERVQNEEEISSEADEEGLDP

SEQ ID NO: 2863489 - protein, 9 aa, Entamoeba invadens
HKENENMTF

SEQ ID NO: 2863490 - protein, 22 aa, Entamoeba invadens
HKENSDDKLPKQKVAKKKIENL

SEQ ID NO: 2863491 - protein, 6 aa, Entamoeba invadens
HKEPLS

SEQ ID NO: 2863492 - protein, 23 aa, Entamoeba invadens
HKETQRKKTTSDFTLPTDKNQIH

SEQ ID NO: 2863493 - protein, 16 aa, Entamoeba invadens
HKEYRNSCHTSNRFGH

SEQ ID NO: 2863494 - protein, 6 aa, Entamoeba invadens
HKGAAS

SEQ ID NO: 2863495 - protein, 14 aa, Entamoeba invadens
HKGDDELDDIKFDD

SEQ ID NO: 2863496 - protein, 32 aa, Entamoeba invadens
HKGDKDKKEKEKEKDEKKKEKDEKKKEKKEKK

SEQ ID NO: 2863497 - protein, 8 aa, Entamoeba invadens
HKGGYSPF

SEQ ID NO: 2863498 - protein, 7 aa, Entamoeba invadens
HKGNAEA

SEQ ID NO: 2863499 - protein, 8 aa, Entamoeba invadens
HKGNPLNE

SEQ ID NO: 2863500 - protein, 13 aa, Entamoeba invadens
HKGPTVMTEEERN

SEQ ID NO: 2863501 - protein, 5 aa, Entamoeba invadens
HKGPV

SEQ ID NO: 2863502 - protein, 6 aa, Entamoeba invadens
HKGPVT

SEQ ID NO: 2863503 - protein, 23 aa, Entamoeba invadens
HKGSRDNSLNSEKIEKGKKENTT

SEQ ID NO: 2863504 - protein, 6 aa, Entamoeba invadens
HKHDED

SEQ ID NO: 2863505 - protein, 6 aa, Entamoeba invadens
HKHKTG

SEQ ID NO: 2863506 - protein, 11 aa, Entamoeba invadens
HKHKTVAKRNR

SEQ ID NO: 2863507 - protein, 8 aa, Entamoeba invadens
HKHNKTEM

SEQ ID NO: 2863508 - protein, 6 aa, Entamoeba invadens
HKHPSE

SEQ ID NO: 2863509 - protein, 12 aa, Entamoeba invadens
HKHPSNTKDRSG

SEQ ID NO: 2863510 - protein, 74 aa, Entamoeba invadens
HKHSEKDSKKSDKKDKKEKKEKKVTSTQEDKEPSKEETKEVETTEEKITKKDKKEKKETQPNKLKEEETPNEEV

SEQ ID NO: 2863511 - protein, 23 aa, Entamoeba invadens
HKIDQDKDNLINENKEIEDHNTE

SEQ ID NO: 2863512 - protein, 13 aa, Entamoeba invadens
HKIEEENQDGTQP

SEQ ID NO: 2863513 - protein, 11 aa, Entamoeba invadens
HKIKNPKSGIS

SEQ ID NO: 2863514 - protein, 10 aa, Entamoeba invadens
HKISATGTPM

SEQ ID NO: 2863515 - protein, 7 aa, Entamoeba invadens
HKISKNK

SEQ ID NO: 2863516 - protein, 16 aa, Entamoeba invadens
HKKADCPEKGKHAPVI

SEQ ID NO: 2863517 - protein, 10 aa, Entamoeba invadens
HKKAGNTIEE

SEQ ID NO: 2863518 - protein, 15 aa, Entamoeba invadens
HKKANSDATKQENTA

SEQ ID NO: 2863519 - protein, 40 aa, Entamoeba invadens
HKKDKDSDNEDIESDNQNLISPRGNSQGISPRGKKNKIVQ

SEQ ID NO: 2863520 - protein, 7 aa, Entamoeba invadens
HKKDPKH

SEQ ID NO: 2863521 - protein, 7 aa, Entamoeba invadens
HKKDPRV

SEQ ID NO: 2863522 - protein, 7 aa, Entamoeba invadens
HKKGTTT

SEQ ID NO: 2863523 - protein, 36 aa, Entamoeba invadens
HKKNEEKDLQKDAQKETIDTPKAEQSEEKVLPPSTK

SEQ ID NO: 2863524 - protein, 17 aa, Entamoeba invadens
HKKNKPQKDEFCDDEDA

SEQ ID NO: 2863525 - protein, 7 aa, Entamoeba invadens
HKKQHEV

SEQ ID NO: 2863526 - protein, 8 aa, Entamoeba invadens
HKKSDDID

SEQ ID NO: 2863527 - protein, 6 aa, Entamoeba invadens
HKKSDE

SEQ ID NO: 2863528 - protein, 8 aa, Entamoeba invadens
HKKSDEIG

SEQ ID NO: 2863529 - protein, 9 aa, Entamoeba invadens
HKKSDNIDY

SEQ ID NO: 2863530 - protein, 8 aa, Entamoeba invadens
HKKSQIER

SEQ ID NO: 2863531 - protein, 7 aa, Entamoeba invadens
HKKTHTS

SEQ ID NO: 2863532 - protein, 7 aa, Entamoeba invadens
HKKTISK

SEQ ID NO: 2863533 - protein, 4 aa, Entamoeba invadens
HKNA

SEQ ID NO: 2863534 - protein, 4 aa, Entamoeba invadens
HKNC

SEQ ID NO: 2863535 - protein, 10 aa, Entamoeba invadens
HKNDDIARGV

SEQ ID NO: 2863536 - protein, 8 aa, Entamoeba invadens
HKNDETRK

SEQ ID NO: 2863537 - protein, 6 aa, Entamoeba invadens
HKNDPM

SEQ ID NO: 2863538 - protein, 7 aa, Entamoeba invadens
HKNEKTV

SEQ ID NO: 2863539 - protein, 10 aa, Entamoeba invadens
HKNENKPVYT

SEQ ID NO: 2863540 - protein, 6 aa, Entamoeba invadens
HKNGNN

SEQ ID NO: 2863541 - protein, 10 aa, Entamoeba invadens
HKNKEENNMN

SEQ ID NO: 2863542 - protein, 8 aa, Entamoeba invadens
HKNNDTPQ

SEQ ID NO: 2863543 - protein, 9 aa, Entamoeba invadens
HKNNGEQVT

SEQ ID NO: 2863544 - protein, 8 aa, Entamoeba invadens
HKNNPGLE

SEQ ID NO: 2863545 - protein, 10 aa, Entamoeba invadens
HKNNTTHEEQ

SEQ ID NO: 2863546 - protein, 4 aa, Entamoeba invadens
HKNP

SEQ ID NO: 2863547 - protein, 5 aa, Entamoeba invadens
HKNQQ

SEQ ID NO: 2863548 - protein, 8 aa, Entamoeba invadens
HKNSKEVN

SEQ ID NO: 2863549 - protein, 8 aa, Entamoeba invadens
HKNSNDVD

SEQ ID NO: 2863550 - protein, 6 aa, Entamoeba invadens
HKNSNE

SEQ ID NO: 2863551 - protein, 19 aa, Entamoeba invadens
HKNSRQGEIDHFQTLTRKI

SEQ ID NO: 2863552 - protein, 5 aa, Entamoeba invadens
HKNTE

SEQ ID NO: 2863553 - protein, 8 aa, Entamoeba invadens
HKNYSTAT

SEQ ID NO: 2863554 - protein, 8 aa, Entamoeba invadens
HKNYTSAV

SEQ ID NO: 2863555 - protein, 5 aa, Entamoeba invadens
HKPDI

SEQ ID NO: 2863556 - protein, 15 aa, Entamoeba invadens
HKPKASKSPTEGNKK

SEQ ID NO: 2863557 - protein, 6 aa, Entamoeba invadens
HKPQTN

SEQ ID NO: 2863558 - protein, 9 aa, Entamoeba invadens
HKPTHPEEY

SEQ ID NO: 2863559 - protein, 8 aa, Entamoeba invadens
HKPTHPNE

SEQ ID NO: 2863560 - protein, 8 aa, Entamoeba invadens
HKPTLQSE

SEQ ID NO: 2863561 - protein, 5 aa, Entamoeba invadens
HKPTP

SEQ ID NO: 2863562 - protein, 10 aa, Entamoeba invadens
HKPTRRSSVT

SEQ ID NO: 2863563 - protein, 11 aa, Entamoeba invadens
HKQELTPEERA

SEQ ID NO: 2863564 - protein, 13 aa, Entamoeba invadens
HKQEQRKVQPESR

SEQ ID NO: 2863565 - protein, 37 aa, Entamoeba invadens
HKQNKEPDQKNLKQKQNQVRKKTSKSKSEQPKQVPFP

SEQ ID NO: 2863566 - protein, 14 aa, Entamoeba invadens
HKQNTQTIESKNDT

SEQ ID NO: 2863567 - protein, 14 aa, Entamoeba invadens
HKQPPYVANEGTTP

SEQ ID NO: 2863568 - protein, 8 aa, Entamoeba invadens
HKQQSGGF

SEQ ID NO: 2863569 - protein, 7 aa, Entamoeba invadens
HKQTRVR

SEQ ID NO: 2863570 - protein, 5 aa, Entamoeba invadens
HKRAY

SEQ ID NO: 2863571 - protein, 7 aa, Entamoeba invadens
HKRESKN

SEQ ID NO: 2863572 - protein, 12 aa, Entamoeba invadens
HKRGDLCVTLKI

SEQ ID NO: 2863573 - protein, 5 aa, Entamoeba invadens
HKRIS

SEQ ID NO: 2863574 - protein, 14 aa, Entamoeba invadens
HKRNKKHSKEKKSL

SEQ ID NO: 2863575 - protein, 4 aa, Entamoeba invadens
HKRP

SEQ ID NO: 2863576 - protein, 7 aa, Entamoeba invadens
HKRPDSK

SEQ ID NO: 2863577 - protein, 10 aa, Entamoeba invadens
HKSATVDDEI

SEQ ID NO: 2863578 - protein, 22 aa, Entamoeba invadens
HKSDIKKKMSKYDQDKSGTIDF

SEQ ID NO: 2863579 - protein, 20 aa, Entamoeba invadens
HKSDLNPIYENKNKKKENLT

SEQ ID NO: 2863580 - protein, 19 aa, Entamoeba invadens
HKSEATVPYTKTKSVDSIQ

SEQ ID NO: 2863581 - protein, 57 aa, Entamoeba invadens
HKSEKKQRKEKTEKMEVEDNLNESFNELQDEDSESELYPKRRKANVQEFEEEDANNP

SEQ ID NO: 2863582 - protein, 7 aa, Entamoeba invadens
HKSEKNR

SEQ ID NO: 2863583 - protein, 7 aa, Entamoeba invadens
HKSFEDA

SEQ ID NO: 2863584 - protein, 9 aa, Entamoeba invadens
HKSNEKTFD

SEQ ID NO: 2863585 - protein, 11 aa, Entamoeba invadens
HKSNEKTHDLS

SEQ ID NO: 2863586 - protein, 8 aa, Entamoeba invadens
HKSNLKNR

SEQ ID NO: 2863587 - protein, 37 aa, Entamoeba invadens
HKSQDCPEKESEKKIVEEKEEQKSTKVDNKKTTQKAK

SEQ ID NO: 2863588 - protein, 7 aa, Entamoeba invadens
HKSQVTS

SEQ ID NO: 2863589 - protein, 8 aa, Entamoeba invadens
HKSSPQKI

SEQ ID NO: 2863590 - protein, 5 aa, Entamoeba invadens
HKSYD

SEQ ID NO: 2863591 - protein, 8 aa, Entamoeba invadens
HKTAESFQ

SEQ ID NO: 2863592 - protein, 4 aa, Entamoeba invadens
HKTC

SEQ ID NO: 2863593 - protein, 7 aa, Entamoeba invadens
HKTEEMY

SEQ ID NO: 2863594 - protein, 4 aa, Entamoeba invadens
HKTG

SEQ ID NO: 2863595 - protein, 5 aa, Entamoeba invadens
HKTGP

SEQ ID NO: 2863596 - protein, 6 aa, Entamoeba invadens
HKTGTA

SEQ ID NO: 2863597 - protein, 7 aa, Entamoeba invadens
HKTKDLD

SEQ ID NO: 2863598 - protein, 15 aa, Entamoeba invadens
HKTNQRNETISETTT

SEQ ID NO: 2863599 - protein, 6 aa, Entamoeba invadens
HKTNTM

SEQ ID NO: 2863600 - protein, 15 aa, Entamoeba invadens
HKTSDDGVVSYDDSD

SEQ ID NO: 2863601 - protein, 8 aa, Entamoeba invadens
HKTSDDVD

SEQ ID NO: 2863602 - protein, 6 aa, Entamoeba invadens
HKTSDE

SEQ ID NO: 2863603 - protein, 8 aa, Entamoeba invadens
HKTSDEIN

SEQ ID NO: 2863604 - protein, 7 aa, Entamoeba invadens
HKTSDEV

SEQ ID NO: 2863605 - protein, 13 aa, Entamoeba invadens
HKTSEEVDMKLRV

SEQ ID NO: 2863606 - protein, 9 aa, Entamoeba invadens
HKTSEKVDN

SEQ ID NO: 2863607 - protein, 7 aa, Entamoeba invadens
HKTSESK

SEQ ID NO: 2863608 - protein, 7 aa, Entamoeba invadens
HKTSMTS

SEQ ID NO: 2863609 - protein, 8 aa, Entamoeba invadens
HKTSNEVN

SEQ ID NO: 2863610 - protein, 4 aa, Entamoeba invadens
HKTT

SEQ ID NO: 2863611 - protein, 10 aa, Entamoeba invadens
HKTTKEGITL

SEQ ID NO: 2863612 - protein, 14 aa, Entamoeba invadens
HKTTTAQPQQPEKL

SEQ ID NO: 2863613 - protein, 7 aa, Entamoeba invadens
HKTVDKT

SEQ ID NO: 2863614 - protein, 20 aa, Entamoeba invadens
HKVKQQSLESPDDDFTLVPI

SEQ ID NO: 2863615 - protein, 5 aa, Entamoeba invadens
HKVKS

SEQ ID NO: 2863616 - protein, 9 aa, Entamoeba invadens
HKVNNSNVS

SEQ ID NO: 2863617 - protein, 10 aa, Entamoeba invadens
HKVSSPCEQK

SEQ ID NO: 2863618 - protein, 7 aa, Entamoeba invadens
HKYEPYD

SEQ ID NO: 2863619 - protein, 7 aa, Entamoeba invadens
HKYKKAA

SEQ ID NO: 2863620 - protein, 9 aa, Entamoeba invadens
HKYQPLPAN

SEQ ID NO: 2863621 - protein, 14 aa, Entamoeba invadens
HKYTEVNDYADRQI

SEQ ID NO: 2863622 - protein, 13 aa, Entamoeba invadens
HLDPSTHTPLQDS

SEQ ID NO: 2863623 - protein, 10 aa, Entamoeba invadens
HLDQKSDKFS

SEQ ID NO: 2863624 - protein, 8 aa, Entamoeba invadens
HLDSSFSQ

SEQ ID NO: 2863625 - protein, 11 aa, Entamoeba invadens
HLEADDVNEDN

SEQ ID NO: 2863626 - protein, 8 aa, Entamoeba invadens
HLENRENI

SEQ ID NO: 2863627 - protein, 10 aa, Entamoeba invadens
HLEVSRKNEK

SEQ ID NO: 2863628 - protein, 9 aa, Entamoeba invadens
HLEYKGDRK

SEQ ID NO: 2863629 - protein, 36 aa, Entamoeba invadens
HLGETKENRVVDDDGNLTNTSQPSSQTSSATATPQK

SEQ ID NO: 2863630 - protein, 4 aa, Entamoeba invadens
HLKP

SEQ ID NO: 2863631 - protein, 9 aa, Entamoeba invadens
HLNESGYNT

SEQ ID NO: 2863632 - protein, 7 aa, Entamoeba invadens
HLPGDDG

SEQ ID NO: 2863633 - protein, 14 aa, Entamoeba invadens
HLPHGPKKWRSRAN

SEQ ID NO: 2863634 - protein, 4 aa, Entamoeba invadens
HLPK

SEQ ID NO: 2863635 - protein, 6 aa, Entamoeba invadens
HLPPND

SEQ ID NO: 2863636 - protein, 26 aa, Entamoeba invadens
HLPPTQPEKEDISNDEDQKKEDDEVP

SEQ ID NO: 2863637 - protein, 19 aa, Entamoeba invadens
HLQENSDRVMSGKNPKFVS

SEQ ID NO: 2863638 - protein, 15 aa, Entamoeba invadens
HLQETQQSAFEDSTS

SEQ ID NO: 2863639 - protein, 4 aa, Entamoeba invadens
HLQT

SEQ ID NO: 2863640 - protein, 16 aa, Entamoeba invadens
HLRDGKEKNDFEKQKE

SEQ ID NO: 2863641 - protein, 10 aa, Entamoeba invadens
HLSDEKGCST

SEQ ID NO: 2863642 - protein, 7 aa, Entamoeba invadens
HLSDRER

SEQ ID NO: 2863643 - protein, 12 aa, Entamoeba invadens
HLSENNVNQYET

SEQ ID NO: 2863644 - protein, 8 aa, Entamoeba invadens
HLTDENEE

SEQ ID NO: 2863645 - protein, 8 aa, Entamoeba invadens
HLTPQQTQ

SEQ ID NO: 2863646 - protein, 4 aa, Entamoeba invadens
HLTR

SEQ ID NO: 2863647 - protein, 5 aa, Entamoeba invadens
HMPEK

SEQ ID NO: 2863648 - protein, 6 aa, Entamoeba invadens
HMPTDT

SEQ ID NO: 2863649 - protein, 4 aa, Entamoeba invadens
HMQK

SEQ ID NO: 2863650 - protein, 11 aa, Entamoeba invadens
HMSPQCKQKDV

SEQ ID NO: 2863651 - protein, 14 aa, Entamoeba invadens
HMTPKSNPQTPRKR

SEQ ID NO: 2863652 - protein, 4 aa, Entamoeba invadens
HMTQ

SEQ ID NO: 2863653 - protein, 7 aa, Entamoeba invadens
HNAIPSH

SEQ ID NO: 2863654 - protein, 5 aa, Entamoeba invadens
HNAPQ

SEQ ID NO: 2863655 - protein, 6 aa, Entamoeba invadens
HNATIG

SEQ ID NO: 2863656 - protein, 15 aa, Entamoeba invadens
HNCGTSQTIGKRTTM

SEQ ID NO: 2863657 - protein, 13 aa, Entamoeba invadens
HNCTKKEDDIADL

SEQ ID NO: 2863658 - protein, 6 aa, Entamoeba invadens
HNDCRE

SEQ ID NO: 2863659 - protein, 4 aa, Entamoeba invadens
HNDD

SEQ ID NO: 2863660 - protein, 8 aa, Entamoeba invadens
HNDECGGC

SEQ ID NO: 2863661 - protein, 8 aa, Entamoeba invadens
HNDETRSV

SEQ ID NO: 2863662 - protein, 6 aa, Entamoeba invadens
HNDNYS

SEQ ID NO: 2863663 - protein, 7 aa, Entamoeba invadens
HNDTMTQ

SEQ ID NO: 2863664 - protein, 4 aa, Entamoeba invadens
HNDY

SEQ ID NO: 2863665 - protein, 4 aa, Entamoeba invadens
HNEA

SEQ ID NO: 2863666 - protein, 29 aa, Entamoeba invadens
HNEADEAKYREAEELNQQKSLKDEITDSK

SEQ ID NO: 2863667 - protein, 11 aa, Entamoeba invadens
HNEAKSAKNGI

SEQ ID NO: 2863668 - protein, 21 aa, Entamoeba invadens
HNEASSSKQMEIENPNKDMND

SEQ ID NO: 2863669 - protein, 12 aa, Entamoeba invadens
HNEDAKIAATNL

SEQ ID NO: 2863670 - protein, 9 aa, Entamoeba invadens
HNEDYAPNR

SEQ ID NO: 2863671 - protein, 5 aa, Entamoeba invadens
HNEEK

SEQ ID NO: 2863672 - protein, 27 aa, Entamoeba invadens
HNEENKRSKLQENTSIETHPQEPPKEV

SEQ ID NO: 2863673 - protein, 11 aa, Entamoeba invadens
HNEKGCLGGGV

SEQ ID NO: 2863674 - protein, 5 aa, Entamoeba invadens
HNEKT

SEQ ID NO: 2863675 - protein, 24 aa, Entamoeba invadens
HNELEKDQKGVKPTKNDQPFPSGD

SEQ ID NO: 2863676 - protein, 5 aa, Entamoeba invadens
HNENI

SEQ ID NO: 2863677 - protein, 8 aa, Entamoeba invadens
HNENNDKS

SEQ ID NO: 2863678 - protein, 10 aa, Entamoeba invadens
HNENVGKENE

SEQ ID NO: 2863679 - protein, 12 aa, Entamoeba invadens
HNEPLPKKENLK

SEQ ID NO: 2863680 - protein, 6 aa, Entamoeba invadens
HNEPRT

SEQ ID NO: 2863681 - protein, 4 aa, Entamoeba invadens
HNER

SEQ ID NO: 2863682 - protein, 6 aa, Entamoeba invadens
HNERPS

SEQ ID NO: 2863683 - protein, 28 aa, Entamoeba invadens
HNESKEKKKQQENKRRKEKMNHSQDTTT

SEQ ID NO: 2863684 - protein, 5 aa, Entamoeba invadens
HNGAV

SEQ ID NO: 2863685 - protein, 13 aa, Entamoeba invadens
HNGDQAAKQAATL

SEQ ID NO: 2863686 - protein, 7 aa, Entamoeba invadens
HNGEDAA

SEQ ID NO: 2863687 - protein, 6 aa, Entamoeba invadens
HNGEET

SEQ ID NO: 2863688 - protein, 8 aa, Entamoeba invadens
HNGEGIDH

SEQ ID NO: 2863689 - protein, 8 aa, Entamoeba invadens
HNGEIESV

SEQ ID NO: 2863690 - protein, 6 aa, Entamoeba invadens
HNGHEA

SEQ ID NO: 2863691 - protein, 13 aa, Entamoeba invadens
HNGIEDPHSSLNE

SEQ ID NO: 2863692 - protein, 14 aa, Entamoeba invadens
HNGIEDPHSSLNES

SEQ ID NO: 2863693 - protein, 11 aa, Entamoeba invadens
HNGKRKEILTS

SEQ ID NO: 2863694 - protein, 12 aa, Entamoeba invadens
HNGNSYDKCESC

SEQ ID NO: 2863695 - protein, 8 aa, Entamoeba invadens
HNGSEQRQ

SEQ ID NO: 2863696 - protein, 10 aa, Entamoeba invadens
HNGSPDDRNR

SEQ ID NO: 2863697 - protein, 4 aa, Entamoeba invadens
HNHP

SEQ ID NO: 2863698 - protein, 10 aa, Entamoeba invadens
HNIPPASDEF

SEQ ID NO: 2863699 - protein, 6 aa, Entamoeba invadens
HNISPV

SEQ ID NO: 2863700 - protein, 27 aa, Entamoeba invadens
HNISSSKTVVQTRDIKETTDSTDDGLD

SEQ ID NO: 2863701 - protein, 5 aa, Entamoeba invadens
HNITE

SEQ ID NO: 2863702 - protein, 13 aa, Entamoeba invadens
HNITTSIKSGAGM

SEQ ID NO: 2863703 - protein, 4 aa, Entamoeba invadens
HNKE

SEQ ID NO: 2863704 - protein, 9 aa, Entamoeba invadens
HNKESGSLR

SEQ ID NO: 2863705 - protein, 9 aa, Entamoeba invadens
HNKKITQIE

SEQ ID NO: 2863706 - protein, 4 aa, Entamoeba invadens
HNKN

SEQ ID NO: 2863707 - protein, 9 aa, Entamoeba invadens
HNKNPVLTN

SEQ ID NO: 2863708 - protein, 9 aa, Entamoeba invadens
HNKPAEKIG

SEQ ID NO: 2863709 - protein, 8 aa, Entamoeba invadens
HNKPEVEV

SEQ ID NO: 2863710 - protein, 11 aa, Entamoeba invadens
HNKRVGEDSFE

SEQ ID NO: 2863711 - protein, 7 aa, Entamoeba invadens
HNKSGVY

SEQ ID NO: 2863712 - protein, 17 aa, Entamoeba invadens
HNKTITNEDPQTIAFDL

SEQ ID NO: 2863713 - protein, 11 aa, Entamoeba invadens
HNKTKKNEKKI

SEQ ID NO: 2863714 - protein, 6 aa, Entamoeba invadens
HNKTLP

SEQ ID NO: 2863715 - protein, 8 aa, Entamoeba invadens
HNMKGKIG

SEQ ID NO: 2863716 - protein, 9 aa, Entamoeba invadens
HNMTNDKYN

SEQ ID NO: 2863717 - protein, 7 aa, Entamoeba invadens
HNNEESV

SEQ ID NO: 2863718 - protein, 8 aa, Entamoeba invadens
HNNEIDSE

SEQ ID NO: 2863719 - protein, 10 aa, Entamoeba invadens
HNNGGRRYWS

SEQ ID NO: 2863720 - protein, 6 aa, Entamoeba invadens
HNNPTC

SEQ ID NO: 2863721 - protein, 10 aa, Entamoeba invadens
HNNYATRTTI

SEQ ID NO: 2863722 - protein, 10 aa, Entamoeba invadens
HNPAGQAHGD

SEQ ID NO: 2863723 - protein, 11 aa, Entamoeba invadens
HNPAKDKRTTV

SEQ ID NO: 2863724 - protein, 5 aa, Entamoeba invadens
HNPAS

SEQ ID NO: 2863725 - protein, 9 aa, Entamoeba invadens
HNPKERETI

SEQ ID NO: 2863726 - protein, 10 aa, Entamoeba invadens
HNPRTSDGGK

SEQ ID NO: 2863727 - protein, 11 aa, Entamoeba invadens
HNPSKDKRTTV

SEQ ID NO: 2863728 - protein, 7 aa, Entamoeba invadens
HNPTGKV

SEQ ID NO: 2863729 - protein, 15 aa, Entamoeba invadens
HNPTGTNFLPPSTCA

SEQ ID NO: 2863730 - protein, 6 aa, Entamoeba invadens
HNPTNL

SEQ ID NO: 2863731 - protein, 5 aa, Entamoeba invadens
HNPTT

SEQ ID NO: 2863732 - protein, 6 aa, Entamoeba invadens
HNQGIT

SEQ ID NO: 2863733 - protein, 9 aa, Entamoeba invadens
HNQSPRNTY

SEQ ID NO: 2863734 - protein, 9 aa, Entamoeba invadens
HNQSTQMKV

SEQ ID NO: 2863735 - protein, 5 aa, Entamoeba invadens
HNRGS

SEQ ID NO: 2863736 - protein, 6 aa, Entamoeba invadens
HNRNSH

SEQ ID NO: 2863737 - protein, 7 aa, Entamoeba invadens
HNRSDEV

SEQ ID NO: 2863738 - protein, 8 aa, Entamoeba invadens
HNSEKSEA

SEQ ID NO: 2863739 - protein, 7 aa, Entamoeba invadens
HNSISAK

SEQ ID NO: 2863740 - protein, 7 aa, Entamoeba invadens
HNSNNPK

SEQ ID NO: 2863741 - protein, 10 aa, Entamoeba invadens
HNSPENKKVV

SEQ ID NO: 2863742 - protein, 23 aa, Entamoeba invadens
HNSPSNYMESNPNYQTYQQPNYS

SEQ ID NO: 2863743 - protein, 5 aa, Entamoeba invadens
HNSQK

SEQ ID NO: 2863744 - protein, 4 aa, Entamoeba invadens
HNSR

SEQ ID NO: 2863745 - protein, 5 aa, Entamoeba invadens
HNSRM

SEQ ID NO: 2863746 - protein, 11 aa, Entamoeba invadens
HNSTPANDFTP

SEQ ID NO: 2863747 - protein, 10 aa, Entamoeba invadens
HNTDSPLNYE

SEQ ID NO: 2863748 - protein, 5 aa, Entamoeba invadens
HNTEH

SEQ ID NO: 2863749 - protein, 8 aa, Entamoeba invadens
HNTGDEKI

SEQ ID NO: 2863750 - protein, 31 aa, Entamoeba invadens
HNTGDMSSAVRQQAAQINPANVRRYNEYAKK

SEQ ID NO: 2863751 - protein, 24 aa, Entamoeba invadens
HNTHQQPQQTQEGSAEQEENDDSI

SEQ ID NO: 2863752 - protein, 7 aa, Entamoeba invadens
HNTKNPI

SEQ ID NO: 2863753 - protein, 6 aa, Entamoeba invadens
HNTKTN

SEQ ID NO: 2863754 - protein, 7 aa, Entamoeba invadens
HNTQSPL

SEQ ID NO: 2863755 - protein, 8 aa, Entamoeba invadens
HNTSGNPW

SEQ ID NO: 2863756 - protein, 11 aa, Entamoeba invadens
HNTSPVCSRSS

SEQ ID NO: 2863757 - protein, 8 aa, Entamoeba invadens
HNTSSTKS

SEQ ID NO: 2863758 - protein, 9 aa, Entamoeba invadens
HNTTQSRQK

SEQ ID NO: 2863759 - protein, 11 aa, Entamoeba invadens
HNTTTEESAVR

SEQ ID NO: 2863760 - protein, 5 aa, Entamoeba invadens
HNVTE

SEQ ID NO: 2863761 - protein, 26 aa, Entamoeba invadens
HNVTTSDTQIGVPENDKEANIKTVKT

SEQ ID NO: 2863762 - protein, 13 aa, Entamoeba invadens
HNYGEVPNGQKKE

SEQ ID NO: 2863763 - protein, 23 aa, Entamoeba invadens
HNYSTESGSGSPSESPPNERIKR

SEQ ID NO: 2863764 - protein, 26 aa, Entamoeba invadens
HPAKTTQIVTEESDDLSPISKLPEDN

SEQ ID NO: 2863765 - protein, 5 aa, Entamoeba invadens
HPANY

SEQ ID NO: 2863766 - protein, 9 aa, Entamoeba invadens
HPAVKQKKI

SEQ ID NO: 2863767 - protein, 4 aa, Entamoeba invadens
HPAY

SEQ ID NO: 2863768 - protein, 10 aa, Entamoeba invadens
HPDATKACRE

SEQ ID NO: 2863769 - protein, 4 aa, Entamoeba invadens
HPDE

SEQ ID NO: 2863770 - protein, 4 aa, Entamoeba invadens
HPDF

SEQ ID NO: 2863771 - protein, 9 aa, Entamoeba invadens
HPDHDDVKK

SEQ ID NO: 2863772 - protein, 5 aa, Entamoeba invadens
HPDIE

SEQ ID NO: 2863773 - protein, 11 aa, Entamoeba invadens
HPDKHPDDAEA

SEQ ID NO: 2863774 - protein, 15 aa, Entamoeba invadens
HPDKNPGDTVAEENF

SEQ ID NO: 2863775 - protein, 16 aa, Entamoeba invadens
HPDKQENKEEAEKQFQ

SEQ ID NO: 2863776 - protein, 4 aa, Entamoeba invadens
HPDN

SEQ ID NO: 2863777 - protein, 9 aa, Entamoeba invadens
HPDNHPKDT

SEQ ID NO: 2863778 - protein, 8 aa, Entamoeba invadens
HPDNPLSN

SEQ ID NO: 2863779 - protein, 4 aa, Entamoeba invadens
HPDT

SEQ ID NO: 2863780 - protein, 7 aa, Entamoeba invadens
HPDTDTL

SEQ ID NO: 2863781 - protein, 6 aa, Entamoeba invadens
HPDTET

SEQ ID NO: 2863782 - protein, 7 aa, Entamoeba invadens
HPDTPEY

SEQ ID NO: 2863783 - protein, 13 aa, Entamoeba invadens
HPDTTLKPNEKPL

SEQ ID NO: 2863784 - protein, 12 aa, Entamoeba invadens
HPDVTKKTSQQI

SEQ ID NO: 2863785 - protein, 4 aa, Entamoeba invadens
HPDY

SEQ ID NO: 2863786 - protein, 10 aa, Entamoeba invadens
HPDYADQKGF

SEQ ID NO: 2863787 - protein, 6 aa, Entamoeba invadens
HPDYRP

SEQ ID NO: 2863788 - protein, 4 aa, Entamoeba invadens
HPEA

SEQ ID NO: 2863789 - protein, 8 aa, Entamoeba invadens
HPEDAADI

SEQ ID NO: 2863790 - protein, 9 aa, Entamoeba invadens
HPEDAADIP

SEQ ID NO: 2863791 - protein, 9 aa, Entamoeba invadens
HPEDEKSVE

SEQ ID NO: 2863792 - protein, 13 aa, Entamoeba invadens
HPEDQSDEEEGEV

SEQ ID NO: 2863793 - protein, 9 aa, Entamoeba invadens
HPEEEGAAI

SEQ ID NO: 2863794 - protein, 14 aa, Entamoeba invadens
HPEETRSTAIESDS

SEQ ID NO: 2863795 - protein, 6 aa, Entamoeba invadens
HPEGPK

SEQ ID NO: 2863796 - protein, 8 aa, Entamoeba invadens
HPEGTSET

SEQ ID NO: 2863797 - protein, 5 aa, Entamoeba invadens
HPEIR

SEQ ID NO: 2863798 - protein, 15 aa, Entamoeba invadens
HPEKGKRVKDAYEHM

SEQ ID NO: 2863799 - protein, 15 aa, Entamoeba invadens
HPEMTGMNKETSQVM

SEQ ID NO: 2863800 - protein, 13 aa, Entamoeba invadens
HPENANYKEEQEK

SEQ ID NO: 2863801 - protein, 4 aa, Entamoeba invadens
HPEP

SEQ ID NO: 2863802 - protein, 19 aa, Entamoeba invadens
HPEPTSPGIPIGKREDSTM

SEQ ID NO: 2863803 - protein, 6 aa, Entamoeba invadens
HPESTL

SEQ ID NO: 2863804 - protein, 4 aa, Entamoeba invadens
HPEY

SEQ ID NO: 2863805 - protein, 5 aa, Entamoeba invadens
HPEYK

SEQ ID NO: 2863806 - protein, 5 aa, Entamoeba invadens
HPEYT

SEQ ID NO: 2863807 - protein, 4 aa, Entamoeba invadens
HPFD

SEQ ID NO: 2863808 - protein, 4 aa, Entamoeba invadens
HPFS

SEQ ID NO: 2863809 - protein, 17 aa, Entamoeba invadens
HPGASARLVPTDGNSIY

SEQ ID NO: 2863810 - protein, 5 aa, Entamoeba invadens
HPGEA

SEQ ID NO: 2863811 - protein, 14 aa, Entamoeba invadens
HPGHSEYKTLSESL

SEQ ID NO: 2863812 - protein, 11 aa, Entamoeba invadens
HPGKLSNQKKV

SEQ ID NO: 2863813 - protein, 12 aa, Entamoeba invadens
HPGKRSKVTASM

SEQ ID NO: 2863814 - protein, 4 aa, Entamoeba invadens
HPGS

SEQ ID NO: 2863815 - protein, 6 aa, Entamoeba invadens
HPHDTT

SEQ ID NO: 2863816 - protein, 5 aa, Entamoeba invadens
HPHES

SEQ ID NO: 2863817 - protein, 6 aa, Entamoeba invadens
HPHSND

SEQ ID NO: 2863818 - protein, 6 aa, Entamoeba invadens
HPIAND

SEQ ID NO: 2863819 - protein, 6 aa, Entamoeba invadens
HPIEEK

SEQ ID NO: 2863820 - protein, 23 aa, Entamoeba invadens
HPIPGSHNNNRCCGGNSGIAIEG

SEQ ID NO: 2863821 - protein, 47 aa, Entamoeba invadens
HPIPRDTKKPAKAKVQQKSEKKIEMENKETPQERHEEELNEEEEEER

SEQ ID NO: 2863822 - protein, 4 aa, Entamoeba invadens
HPIT

SEQ ID NO: 2863823 - protein, 5 aa, Entamoeba invadens
HPKDK

SEQ ID NO: 2863824 - protein, 8 aa, Entamoeba invadens
HPKDNTKE

SEQ ID NO: 2863825 - protein, 21 aa, Entamoeba invadens
HPKEDQAPQITTEDVRRKQIE

SEQ ID NO: 2863826 - protein, 7 aa, Entamoeba invadens
HPKETVE

SEQ ID NO: 2863827 - protein, 6 aa, Entamoeba invadens
HPKGGY

SEQ ID NO: 2863828 - protein, 6 aa, Entamoeba invadens
HPKTGN

SEQ ID NO: 2863829 - protein, 9 aa, Entamoeba invadens
HPKTSHSGD

SEQ ID NO: 2863830 - protein, 6 aa, Entamoeba invadens
HPKVQE

SEQ ID NO: 2863831 - protein, 21 aa, Entamoeba invadens
HPLEQTKEVKEVKDVKQQVEE

SEQ ID NO: 2863832 - protein, 8 aa, Entamoeba invadens
HPLPQEKG

SEQ ID NO: 2863833 - protein, 44 aa, Entamoeba invadens
HPLQNEENTMQRTQDDTQNDVKECAPNTKENKDTLKNDQQEVKK

SEQ ID NO: 2863834 - protein, 9 aa, Entamoeba invadens
HPLSKTSKE

SEQ ID NO: 2863835 - protein, 8 aa, Entamoeba invadens
HPLVPEKS

SEQ ID NO: 2863836 - protein, 4 aa, Entamoeba invadens
HPND

SEQ ID NO: 2863837 - protein, 7 aa, Entamoeba invadens
HPNEHPK

SEQ ID NO: 2863838 - protein, 4 aa, Entamoeba invadens
HPNF

SEQ ID NO: 2863839 - protein, 6 aa, Entamoeba invadens
HPNIGY

SEQ ID NO: 2863840 - protein, 8 aa, Entamoeba invadens
HPNIKRTD

SEQ ID NO: 2863841 - protein, 7 aa, Entamoeba invadens
HPNLSEK

SEQ ID NO: 2863842 - protein, 25 aa, Entamoeba invadens
HPNTPSQHASSPIEKIPQTESNKIG

SEQ ID NO: 2863843 - protein, 6 aa, Entamoeba invadens
HPNTTF

SEQ ID NO: 2863844 - protein, 8 aa, Entamoeba invadens
HPNTTQSM

SEQ ID NO: 2863845 - protein, 4 aa, Entamoeba invadens
HPNW

SEQ ID NO: 2863846 - protein, 4 aa, Entamoeba invadens
HPNY

SEQ ID NO: 2863847 - protein, 6 aa, Entamoeba invadens
HPPENI

SEQ ID NO: 2863848 - protein, 7 aa, Entamoeba invadens
HPPEYSS

SEQ ID NO: 2863849 - protein, 11 aa, Entamoeba invadens
HPPHKDPSDRY

SEQ ID NO: 2863850 - protein, 5 aa, Entamoeba invadens
HPPKE

SEQ ID NO: 2863851 - protein, 35 aa, Entamoeba invadens
HPPKEKDLKVEQIDEKEPPDAANITKSVDSSDRLS

SEQ ID NO: 2863852 - protein, 7 aa, Entamoeba invadens
HPPPDEH

SEQ ID NO: 2863853 - protein, 6 aa, Entamoeba invadens
HPPPGL

SEQ ID NO: 2863854 - protein, 17 aa, Entamoeba invadens
HPPPTFKNKEENSEEIT

SEQ ID NO: 2863855 - protein, 6 aa, Entamoeba invadens
HPPQSV

SEQ ID NO: 2863856 - protein, 5 aa, Entamoeba invadens
HPPRR

SEQ ID NO: 2863857 - protein, 6 aa, Entamoeba invadens
HPQEPS

SEQ ID NO: 2863858 - protein, 6 aa, Entamoeba invadens
HPQPIT

SEQ ID NO: 2863859 - protein, 8 aa, Entamoeba invadens
HPQPPQNN

SEQ ID NO: 2863860 - protein, 20 aa, Entamoeba invadens
HPQPPSRVRQNSANTNATSL

SEQ ID NO: 2863861 - protein, 5 aa, Entamoeba invadens
HPQPQ

SEQ ID NO: 2863862 - protein, 6 aa, Entamoeba invadens
HPQQVD

SEQ ID NO: 2863863 - protein, 5 aa, Entamoeba invadens
HPRDK

SEQ ID NO: 2863864 - protein, 6 aa, Entamoeba invadens
HPREAA

SEQ ID NO: 2863865 - protein, 9 aa, Entamoeba invadens
HPRKDTPKI

SEQ ID NO: 2863866 - protein, 6 aa, Entamoeba invadens
HPRNEF

SEQ ID NO: 2863867 - protein, 12 aa, Entamoeba invadens
HPRSGYMTEKSG

SEQ ID NO: 2863868 - protein, 9 aa, Entamoeba invadens
HPSDDTETD

SEQ ID NO: 2863869 - protein, 15 aa, Entamoeba invadens
HPSEPIVATGGGDAR

SEQ ID NO: 2863870 - protein, 5 aa, Entamoeba invadens
HPSEQ

SEQ ID NO: 2863871 - protein, 13 aa, Entamoeba invadens
HPSETSTSQSEFN

SEQ ID NO: 2863872 - protein, 5 aa, Entamoeba invadens
HPSEV

SEQ ID NO: 2863873 - protein, 8 aa, Entamoeba invadens
HPSEVQSQ

SEQ ID NO: 2863874 - protein, 5 aa, Entamoeba invadens
HPSGN

SEQ ID NO: 2863875 - protein, 8 aa, Entamoeba invadens
HPSLPSNQ

SEQ ID NO: 2863876 - protein, 14 aa, Entamoeba invadens
HPSLPSRATETRDE

SEQ ID NO: 2863877 - protein, 38 aa, Entamoeba invadens
HPSVEEKKEKSFDTKVEENGVEKQSEVTTSPLHATTDE

SEQ ID NO: 2863878 - protein, 6 aa, Entamoeba invadens
HPTAEK

SEQ ID NO: 2863879 - protein, 6 aa, Entamoeba invadens
HPTDPL

SEQ ID NO: 2863880 - protein, 6 aa, Entamoeba invadens
HPTDQR

SEQ ID NO: 2863881 - protein, 6 aa, Entamoeba invadens
HPTEVS

SEQ ID NO: 2863882 - protein, 13 aa, Entamoeba invadens
HPTGNTDYADLDI

SEQ ID NO: 2863883 - protein, 27 aa, Entamoeba invadens
HPTGTQDRDFSQNNKSQTISPLKKSQS

SEQ ID NO: 2863884 - protein, 12 aa, Entamoeba invadens
HPTKEGTSKNVV

SEQ ID NO: 2863885 - protein, 9 aa, Entamoeba invadens
HPTKKSVVT

SEQ ID NO: 2863886 - protein, 5 aa, Entamoeba invadens
HPTKQ

SEQ ID NO: 2863887 - protein, 5 aa, Entamoeba invadens
HPTLD

SEQ ID NO: 2863888 - protein, 15 aa, Entamoeba invadens
HPTNLTTSGSINGKY

SEQ ID NO: 2863889 - protein, 10 aa, Entamoeba invadens
HPTQTTRENK

SEQ ID NO: 2863890 - protein, 9 aa, Entamoeba invadens
HPTRTKTGE

SEQ ID NO: 2863891 - protein, 18 aa, Entamoeba invadens
HPTSIRVPDSQINKSYDG

SEQ ID NO: 2863892 - protein, 11 aa, Entamoeba invadens
HPTTQSAQNVL

SEQ ID NO: 2863893 - protein, 8 aa, Entamoeba invadens
HPTYSEPI

SEQ ID NO: 2863894 - protein, 5 aa, Entamoeba invadens
HPVDG

SEQ ID NO: 2863895 - protein, 9 aa, Entamoeba invadens
HPVDRDPKC

SEQ ID NO: 2863896 - protein, 10 aa, Entamoeba invadens
HPVKADEYKA

SEQ ID NO: 2863897 - protein, 4 aa, Entamoeba invadens
HPVT

SEQ ID NO: 2863898 - protein, 23 aa, Entamoeba invadens
HPYPTEEQKERLGSECGMSPKQV

SEQ ID NO: 2863899 - protein, 4 aa, Entamoeba invadens
HPYT

SEQ ID NO: 2863900 - protein, 9 aa, Entamoeba invadens
HQAGSDSLI

SEQ ID NO: 2863901 - protein, 11 aa, Entamoeba invadens
HQASHNTLRTS

SEQ ID NO: 2863902 - protein, 6 aa, Entamoeba invadens
HQCSPD

SEQ ID NO: 2863903 - protein, 6 aa, Entamoeba invadens
HQDERV

SEQ ID NO: 2863904 - protein, 10 aa, Entamoeba invadens
HQDIANQTKN

SEQ ID NO: 2863905 - protein, 9 aa, Entamoeba invadens
HQDLQDTSM

SEQ ID NO: 2863906 - protein, 24 aa, Entamoeba invadens
HQDNDNREESVNEVETKNIESKKE

SEQ ID NO: 2863907 - protein, 10 aa, Entamoeba invadens
HQDQRRKDGV

SEQ ID NO: 2863908 - protein, 7 aa, Entamoeba invadens
HQDTLGN

SEQ ID NO: 2863909 - protein, 8 aa, Entamoeba invadens
HQEEELNT

SEQ ID NO: 2863910 - protein, 9 aa, Entamoeba invadens
HQEENTDMD

SEQ ID NO: 2863911 - protein, 5 aa, Entamoeba invadens
HQEFD

SEQ ID NO: 2863912 - protein, 9 aa, Entamoeba invadens
HQEKGSRRV

SEQ ID NO: 2863913 - protein, 5 aa, Entamoeba invadens
HQFTD

SEQ ID NO: 2863914 - protein, 22 aa, Entamoeba invadens
HQGELPREIGTSSKDVRIDGYD

SEQ ID NO: 2863915 - protein, 5 aa, Entamoeba invadens
HQGPG

SEQ ID NO: 2863916 - protein, 6 aa, Entamoeba invadens
HQGSKG

SEQ ID NO: 2863917 - protein, 20 aa, Entamoeba invadens
HQGYGLDGKPLPKPTQGAID

SEQ ID NO: 2863918 - protein, 6 aa, Entamoeba invadens
HQHSTH

SEQ ID NO: 2863919 - protein, 6 aa, Entamoeba invadens
HQHTES

SEQ ID NO: 2863920 - protein, 8 aa, Entamoeba invadens
HQKEPMDL

SEQ ID NO: 2863921 - protein, 5 aa, Entamoeba invadens
HQKNV

SEQ ID NO: 2863922 - protein, 47 aa, Entamoeba invadens
HQKRQASPQVLSPNPSSSPKSPSYSNSVNTQNTHAIGQQPTSPILTS

SEQ ID NO: 2863923 - protein, 4 aa, Entamoeba invadens
HQKT

SEQ ID NO: 2863924 - protein, 8 aa, Entamoeba invadens
HQKTKTVR

SEQ ID NO: 2863925 - protein, 9 aa, Entamoeba invadens
HQKVEKGNS

SEQ ID NO: 2863926 - protein, 10 aa, Entamoeba invadens
HQKYDNDNEY

SEQ ID NO: 2863927 - protein, 7 aa, Entamoeba invadens
HQLPTVS

SEQ ID NO: 2863928 - protein, 5 aa, Entamoeba invadens
HQLQI

SEQ ID NO: 2863929 - protein, 6 aa, Entamoeba invadens
HQLRTR

SEQ ID NO: 2863930 - protein, 13 aa, Entamoeba invadens
HQNAIRQNNYKSG

SEQ ID NO: 2863931 - protein, 33 aa, Entamoeba invadens
HQNDEVENEESDDNDEFQEKPLKSRLRKRPSKR

SEQ ID NO: 2863932 - protein, 55 aa, Entamoeba invadens
HQNDQQQQQPMPSQPIPQQPSQPIQPSQPIQQPTQPAQPTQPAGPQLSAEDNAAI

SEQ ID NO: 2863933 - protein, 7 aa, Entamoeba invadens
HQNDYTT

SEQ ID NO: 2863934 - protein, 18 aa, Entamoeba invadens
HQNGGSILGTSRGAQDPK

SEQ ID NO: 2863935 - protein, 8 aa, Entamoeba invadens
HQNKKSNI

SEQ ID NO: 2863936 - protein, 8 aa, Entamoeba invadens
HQNNTTEY

SEQ ID NO: 2863937 - protein, 4 aa, Entamoeba invadens
HQNP

SEQ ID NO: 2863938 - protein, 5 aa, Entamoeba invadens
HQNPM

SEQ ID NO: 2863939 - protein, 5 aa, Entamoeba invadens
HQNRF

SEQ ID NO: 2863940 - protein, 8 aa, Entamoeba invadens
HQNSQLRH

SEQ ID NO: 2863941 - protein, 6 aa, Entamoeba invadens
HQNYPQ

SEQ ID NO: 2863942 - protein, 7 aa, Entamoeba invadens
HQPHSNS

SEQ ID NO: 2863943 - protein, 17 aa, Entamoeba invadens
HQPKSSATFGAKTSSAQ

SEQ ID NO: 2863944 - protein, 8 aa, Entamoeba invadens
HQPLPDDA

SEQ ID NO: 2863945 - protein, 7 aa, Entamoeba invadens
HQPQEVK

SEQ ID NO: 2863946 - protein, 7 aa, Entamoeba invadens
HQPRQTI

SEQ ID NO: 2863947 - protein, 6 aa, Entamoeba invadens
HQPSKY

SEQ ID NO: 2863948 - protein, 11 aa, Entamoeba invadens
HQPYKNVTDKY

SEQ ID NO: 2863949 - protein, 7 aa, Entamoeba invadens
HQPYPQF

SEQ ID NO: 2863950 - protein, 14 aa, Entamoeba invadens
HQQGQQLDKANKTL

SEQ ID NO: 2863951 - protein, 7 aa, Entamoeba invadens
HQQGTEI

SEQ ID NO: 2863952 - protein, 11 aa, Entamoeba invadens
HQQHSSPQSLP

SEQ ID NO: 2863953 - protein, 20 aa, Entamoeba invadens
HQQHTEVQQQEDLRRTGMSS

SEQ ID NO: 2863954 - protein, 23 aa, Entamoeba invadens
HQQSLNKNPSLPSSVTNKEISIT

SEQ ID NO: 2863955 - protein, 5 aa, Entamoeba invadens
HQQVE

SEQ ID NO: 2863956 - protein, 19 aa, Entamoeba invadens
HQRDSSPLNRSPNEASSPL

SEQ ID NO: 2863957 - protein, 20 aa, Entamoeba invadens
HQRSSSNSLFTQKEQQKQQT

SEQ ID NO: 2863958 - protein, 11 aa, Entamoeba invadens
HQSERNKKDLE

SEQ ID NO: 2863959 - protein, 5 aa, Entamoeba invadens
HQSNE

SEQ ID NO: 2863960 - protein, 6 aa, Entamoeba invadens
HQSNNS

SEQ ID NO: 2863961 - protein, 7 aa, Entamoeba invadens
HQSPLPN

SEQ ID NO: 2863962 - protein, 6 aa, Entamoeba invadens
HQSSHG

SEQ ID NO: 2863963 - protein, 16 aa, Entamoeba invadens
HQSSKPTPIARLNVLQ

SEQ ID NO: 2863964 - protein, 6 aa, Entamoeba invadens
HQSTHG

SEQ ID NO: 2863965 - protein, 8 aa, Entamoeba invadens
HQTDKDEF

SEQ ID NO: 2863966 - protein, 10 aa, Entamoeba invadens
HQTGKTQEAE

SEQ ID NO: 2863967 - protein, 7 aa, Entamoeba invadens
HQTIEEV

SEQ ID NO: 2863968 - protein, 9 aa, Entamoeba invadens
HQTLKDDSI

SEQ ID NO: 2863969 - protein, 47 aa, Entamoeba invadens
HQTQVPQTPTKGTSRSTTEHQNSSNSTSVTEKSPKERKKNKHDTTNW

SEQ ID NO: 2863970 - protein, 10 aa, Entamoeba invadens
HQTSSNFLQN

SEQ ID NO: 2863971 - protein, 9 aa, Entamoeba invadens
HRAAANCQS

SEQ ID NO: 2863972 - protein, 4 aa, Entamoeba invadens
HRAG

SEQ ID NO: 2863973 - protein, 4 aa, Entamoeba invadens
HRAP

SEQ ID NO: 2863974 - protein, 8 aa, Entamoeba invadens
HRASQADK

SEQ ID NO: 2863975 - protein, 8 aa, Entamoeba invadens
HRDHSGRT

SEQ ID NO: 2863976 - protein, 29 aa, Entamoeba invadens
HRDNADKDEEKSGEKKGVKATENTDIKEK

SEQ ID NO: 2863977 - protein, 18 aa, Entamoeba invadens
HRDNGGSRTIVVTINGTN

SEQ ID NO: 2863978 - protein, 10 aa, Entamoeba invadens
HRDNKRSDSL

SEQ ID NO: 2863979 - protein, 5 aa, Entamoeba invadens
HRDSS

SEQ ID NO: 2863980 - protein, 5 aa, Entamoeba invadens
HREAS

SEQ ID NO: 2863981 - protein, 6 aa, Entamoeba invadens
HREELA

SEQ ID NO: 2863982 - protein, 6 aa, Entamoeba invadens
HRHEEE

SEQ ID NO: 2863983 - protein, 8 aa, Entamoeba invadens
HRHSKRQH

SEQ ID NO: 2863984 - protein, 4 aa, Entamoeba invadens
HRIY

SEQ ID NO: 2863985 - protein, 14 aa, Entamoeba invadens
HRKAKDKKKITDLE

SEQ ID NO: 2863986 - protein, 5 aa, Entamoeba invadens
HRKAY

SEQ ID NO: 2863987 - protein, 13 aa, Entamoeba invadens
HRKDTSTDYKQSY

SEQ ID NO: 2863988 - protein, 11 aa, Entamoeba invadens
HRKNSEEDPFT

SEQ ID NO: 2863989 - protein, 8 aa, Entamoeba invadens
HRKSSTKM

SEQ ID NO: 2863990 - protein, 20 aa, Entamoeba invadens
HRLKNADIKSSQAVSRVPTR

SEQ ID NO: 2863991 - protein, 16 aa, Entamoeba invadens
HRLPKEEVDALFNKCK

SEQ ID NO: 2863992 - protein, 9 aa, Entamoeba invadens
HRPDEETLK

SEQ ID NO: 2863993 - protein, 6 aa, Entamoeba invadens
HRPIPT

SEQ ID NO: 2863994 - protein, 9 aa, Entamoeba invadens
HRPTTNNDI

SEQ ID NO: 2863995 - protein, 7 aa, Entamoeba invadens
HRPVPLR

SEQ ID NO: 2863996 - protein, 9 aa, Entamoeba invadens
HRQESVSRS

SEQ ID NO: 2863997 - protein, 4 aa, Entamoeba invadens
HRQN

SEQ ID NO: 2863998 - protein, 14 aa, Entamoeba invadens
HRQPLKKDNNGLSC

SEQ ID NO: 2863999 - protein, 7 aa, Entamoeba invadens
HRQQRVG

SEQ ID NO: 2864000 - protein, 9 aa, Entamoeba invadens
HRQQRVGDS

SEQ ID NO: 2864001 - protein, 11 aa, Entamoeba invadens
HRRDNETLQCT

SEQ ID NO: 2864002 - protein, 15 aa, Entamoeba invadens
HRRGANTSLDTSDLP

SEQ ID NO: 2864003 - protein, 9 aa, Entamoeba invadens
HRRSKDKEV

SEQ ID NO: 2864004 - protein, 6 aa, Entamoeba invadens
HRSDEN

SEQ ID NO: 2864005 - protein, 10 aa, Entamoeba invadens
HRSDSAEDRW

SEQ ID NO: 2864006 - protein, 14 aa, Entamoeba invadens
HRSGRTARAGKQGR

SEQ ID NO: 2864007 - protein, 13 aa, Entamoeba invadens
HRSGRTARFGREG

SEQ ID NO: 2864008 - protein, 8 aa, Entamoeba invadens
HRSKAEMT

SEQ ID NO: 2864009 - protein, 7 aa, Entamoeba invadens
HRSKGRF

SEQ ID NO: 2864010 - protein, 4 aa, Entamoeba invadens
HRTE

SEQ ID NO: 2864011 - protein, 10 aa, Entamoeba invadens
HRTETTKLEE

SEQ ID NO: 2864012 - protein, 6 aa, Entamoeba invadens
HRTKQE

SEQ ID NO: 2864013 - protein, 4 aa, Entamoeba invadens
HRTL

SEQ ID NO: 2864014 - protein, 8 aa, Entamoeba invadens
HRTNEQHY

SEQ ID NO: 2864015 - protein, 10 aa, Entamoeba invadens
HRTTKKTGGL

SEQ ID NO: 2864016 - protein, 6 aa, Entamoeba invadens
HRVEEN

SEQ ID NO: 2864017 - protein, 6 aa, Entamoeba invadens
HRYSNQ

SEQ ID NO: 2864018 - protein, 9 aa, Entamoeba invadens
HSADERYSK

SEQ ID NO: 2864019 - protein, 9 aa, Entamoeba invadens
HSADPSPDF

SEQ ID NO: 2864020 - protein, 18 aa, Entamoeba invadens
HSAHPSVSKPLDQDTEAK

SEQ ID NO: 2864021 - protein, 10 aa, Entamoeba invadens
HSAKNEQTQF

SEQ ID NO: 2864022 - protein, 5 aa, Entamoeba invadens
HSANM

SEQ ID NO: 2864023 - protein, 4 aa, Entamoeba invadens
HSAT

SEQ ID NO: 2864024 - protein, 9 aa, Entamoeba invadens
HSATSRPTV

SEQ ID NO: 2864025 - protein, 13 aa, Entamoeba invadens
HSCGTPKKEDEDY

SEQ ID NO: 2864026 - protein, 4 aa, Entamoeba invadens
HSDD

SEQ ID NO: 2864027 - protein, 5 aa, Entamoeba invadens
HSDDG

SEQ ID NO: 2864028 - protein, 17 aa, Entamoeba invadens
HSDDGAIYSGSGNAEFN

SEQ ID NO: 2864029 - protein, 25 aa, Entamoeba invadens
HSDDGQLFDNTGSGASFDRPYNSGD

SEQ ID NO: 2864030 - protein, 15 aa, Entamoeba invadens
HSDEKNNLKKQLETE

SEQ ID NO: 2864031 - protein, 6 aa, Entamoeba invadens
HSDGSV

SEQ ID NO: 2864032 - protein, 6 aa, Entamoeba invadens
HSDKYE

SEQ ID NO: 2864033 - protein, 8 aa, Entamoeba invadens
HSDQNTKK

SEQ ID NO: 2864034 - protein, 4 aa, Entamoeba invadens
HSDS

SEQ ID NO: 2864035 - protein, 16 aa, Entamoeba invadens
HSDSVNPGLSSDELTF

SEQ ID NO: 2864036 - protein, 6 aa, Entamoeba invadens
HSDSVT

SEQ ID NO: 2864037 - protein, 4 aa, Entamoeba invadens
HSDT

SEQ ID NO: 2864038 - protein, 7 aa, Entamoeba invadens
HSEAKPL

SEQ ID NO: 2864039 - protein, 6 aa, Entamoeba invadens
HSEDGV

SEQ ID NO: 2864040 - protein, 8 aa, Entamoeba invadens
HSEDPLKG

SEQ ID NO: 2864041 - protein, 12 aa, Entamoeba invadens
HSEEEAQHKQTI

SEQ ID NO: 2864042 - protein, 4 aa, Entamoeba invadens
HSEF

SEQ ID NO: 2864043 - protein, 11 aa, Entamoeba invadens
HSEHQKPLKRE

SEQ ID NO: 2864044 - protein, 6 aa, Entamoeba invadens
HSEHSY

SEQ ID NO: 2864045 - protein, 7 aa, Entamoeba invadens
HSEIDGN

SEQ ID NO: 2864046 - protein, 15 aa, Entamoeba invadens
HSELDKTETTASNDI

SEQ ID NO: 2864047 - protein, 11 aa, Entamoeba invadens
HSELEKSPRLK

SEQ ID NO: 2864048 - protein, 17 aa, Entamoeba invadens
HSENGLASTQETPKIQD

SEQ ID NO: 2864049 - protein, 6 aa, Entamoeba invadens
HSENNE

SEQ ID NO: 2864050 - protein, 7 aa, Entamoeba invadens
HSENSKE

SEQ ID NO: 2864051 - protein, 47 aa, Entamoeba invadens
HSENSTQLEKPKQKPLPPSRKAPPPSKSPKFTRQTLNPKALEDDGSE

SEQ ID NO: 2864052 - protein, 8 aa, Entamoeba invadens
HSESDEIS

SEQ ID NO: 2864053 - protein, 4 aa, Entamoeba invadens
HSET

SEQ ID NO: 2864054 - protein, 7 aa, Entamoeba invadens
HSETEKL

SEQ ID NO: 2864055 - protein, 14 aa, Entamoeba invadens
HSETNDQPIKYKDK

SEQ ID NO: 2864056 - protein, 8 aa, Entamoeba invadens
HSFEQPNP

SEQ ID NO: 2864057 - protein, 11 aa, Entamoeba invadens
HSFSPQTGRPG

SEQ ID NO: 2864058 - protein, 5 aa, Entamoeba invadens
HSGEF

SEQ ID NO: 2864059 - protein, 7 aa, Entamoeba invadens
HSGGEDL

SEQ ID NO: 2864060 - protein, 5 aa, Entamoeba invadens
HSGLK

SEQ ID NO: 2864061 - protein, 14 aa, Entamoeba invadens
HSGSPRRCGGQGDL

SEQ ID NO: 2864062 - protein, 7 aa, Entamoeba invadens
HSGSVSA

SEQ ID NO: 2864063 - protein, 5 aa, Entamoeba invadens
HSGTI

SEQ ID NO: 2864064 - protein, 7 aa, Entamoeba invadens
HSHSSTA

SEQ ID NO: 2864065 - protein, 6 aa, Entamoeba invadens
HSIDKE

SEQ ID NO: 2864066 - protein, 4 aa, Entamoeba invadens
HSIG

SEQ ID NO: 2864067 - protein, 5 aa, Entamoeba invadens
HSIKT

SEQ ID NO: 2864068 - protein, 6 aa, Entamoeba invadens
HSITEM

SEQ ID NO: 2864069 - protein, 9 aa, Entamoeba invadens
HSKAENIDQ

SEQ ID NO: 2864070 - protein, 10 aa, Entamoeba invadens
HSKEGNDNRV

SEQ ID NO: 2864071 - protein, 6 aa, Entamoeba invadens
HSKEKG

SEQ ID NO: 2864072 - protein, 27 aa, Entamoeba invadens
HSKERKLKIGKNRTGTLQNEEAPNIAT

SEQ ID NO: 2864073 - protein, 7 aa, Entamoeba invadens
HSKGRTT

SEQ ID NO: 2864074 - protein, 7 aa, Entamoeba invadens
HSKIPPK

SEQ ID NO: 2864075 - protein, 4 aa, Entamoeba invadens
HSKK

SEQ ID NO: 2864076 - protein, 14 aa, Entamoeba invadens
HSKKHTNSASKRMK

SEQ ID NO: 2864077 - protein, 14 aa, Entamoeba invadens
HSKKNCPEKDPAVP

SEQ ID NO: 2864078 - protein, 6 aa, Entamoeba invadens
HSKKYP

SEQ ID NO: 2864079 - protein, 13 aa, Entamoeba invadens
HSKNDNVAAPSGT

SEQ ID NO: 2864080 - protein, 20 aa, Entamoeba invadens
HSKNRNRYFSNKAQKDGFDE

SEQ ID NO: 2864081 - protein, 6 aa, Entamoeba invadens
HSKNSV

SEQ ID NO: 2864082 - protein, 6 aa, Entamoeba invadens
HSKNTR

SEQ ID NO: 2864083 - protein, 7 aa, Entamoeba invadens
HSKQSDT

SEQ ID NO: 2864084 - protein, 12 aa, Entamoeba invadens
HSKQTKTDDKMQ

SEQ ID NO: 2864085 - protein, 4 aa, Entamoeba invadens
HSKR

SEQ ID NO: 2864086 - protein, 9 aa, Entamoeba invadens
HSKRNGGRK

SEQ ID NO: 2864087 - protein, 28 aa, Entamoeba invadens
HSLSKEVKSPTLPTSRSYSTPTTKPKID

SEQ ID NO: 2864088 - protein, 5 aa, Entamoeba invadens
HSNEE

SEQ ID NO: 2864089 - protein, 5 aa, Entamoeba invadens
HSNEF

SEQ ID NO: 2864090 - protein, 8 aa, Entamoeba invadens
HSNEQSKL

SEQ ID NO: 2864091 - protein, 5 aa, Entamoeba invadens
HSNGG

SEQ ID NO: 2864092 - protein, 16 aa, Entamoeba invadens
HSNKDCTGSPPTQQEA

SEQ ID NO: 2864093 - protein, 6 aa, Entamoeba invadens
HSNPGK

SEQ ID NO: 2864094 - protein, 12 aa, Entamoeba invadens
HSNSDGKNIEGY

SEQ ID NO: 2864095 - protein, 5 aa, Entamoeba invadens
HSNTT

SEQ ID NO: 2864096 - protein, 9 aa, Entamoeba invadens
HSNTTRLEE

SEQ ID NO: 2864097 - protein, 12 aa, Entamoeba invadens
HSPEIEGQNPQK

SEQ ID NO: 2864098 - protein, 5 aa, Entamoeba invadens
HSPEM

SEQ ID NO: 2864099 - protein, 7 aa, Entamoeba invadens
HSPEVTQ

SEQ ID NO: 2864100 - protein, 15 aa, Entamoeba invadens
HSPISEKSIGASTPE

SEQ ID NO: 2864101 - protein, 5 aa, Entamoeba invadens
HSPKD

SEQ ID NO: 2864102 - protein, 12 aa, Entamoeba invadens
HSPKEKNYDDRK

SEQ ID NO: 2864103 - protein, 4 aa, Entamoeba invadens
HSPN

SEQ ID NO: 2864104 - protein, 7 aa, Entamoeba invadens
HSPPDSD

SEQ ID NO: 2864105 - protein, 13 aa, Entamoeba invadens
HSPPNKTQPNSQL

SEQ ID NO: 2864106 - protein, 10 aa, Entamoeba invadens
HSPPQIGQKY

SEQ ID NO: 2864107 - protein, 6 aa, Entamoeba invadens
HSPSRG

SEQ ID NO: 2864108 - protein, 4 aa, Entamoeba invadens
HSPT

SEQ ID NO: 2864109 - protein, 7 aa, Entamoeba invadens
HSPTSDG

SEQ ID NO: 2864110 - protein, 6 aa, Entamoeba invadens
HSQCGC

SEQ ID NO: 2864111 - protein, 12 aa, Entamoeba invadens
HSQGSWVSSDDD

SEQ ID NO: 2864112 - protein, 5 aa, Entamoeba invadens
HSQNI

SEQ ID NO: 2864113 - protein, 4 aa, Entamoeba invadens
HSQP

SEQ ID NO: 2864114 - protein, 13 aa, Entamoeba invadens
HSQSSKNQRGNTT

SEQ ID NO: 2864115 - protein, 38 aa, Entamoeba invadens
HSQSTSALPQEVNKSQSSQSLDVSPSQLPEEGKRQIVG

SEQ ID NO: 2864116 - protein, 11 aa, Entamoeba invadens
HSQVKNKHTIS

SEQ ID NO: 2864117 - protein, 9 aa, Entamoeba invadens
HSRAGSQVP

SEQ ID NO: 2864118 - protein, 7 aa, Entamoeba invadens
HSRGSNN

SEQ ID NO: 2864119 - protein, 8 aa, Entamoeba invadens
HSRNADNL

SEQ ID NO: 2864120 - protein, 10 aa, Entamoeba invadens
HSRQNDIAGV

SEQ ID NO: 2864121 - protein, 27 aa, Entamoeba invadens
HSRSLTPSGREEIEKEFQQNKEHERWE

SEQ ID NO: 2864122 - protein, 6 aa, Entamoeba invadens
HSSDPY

SEQ ID NO: 2864123 - protein, 80 aa, Entamoeba invadens
HSSDYENSNETSEEGDNQMSEDEEGNDNGEETESAQQKVQNKKKIKKESSSNDSEDSSKSDESNEESDERPKKESKPIKK

SEQ ID NO: 2864124 - protein, 8 aa, Entamoeba invadens
HSSEDDST

SEQ ID NO: 2864125 - protein, 6 aa, Entamoeba invadens
HSSELK

SEQ ID NO: 2864126 - protein, 19 aa, Entamoeba invadens
HSSERYGQRYSSSPNLSVT

SEQ ID NO: 2864127 - protein, 5 aa, Entamoeba invadens
HSSET

SEQ ID NO: 2864128 - protein, 7 aa, Entamoeba invadens
HSSGKNN

SEQ ID NO: 2864129 - protein, 9 aa, Entamoeba invadens
HSSHDHSVQ

SEQ ID NO: 2864130 - protein, 5 aa, Entamoeba invadens
HSSHN

SEQ ID NO: 2864131 - protein, 7 aa, Entamoeba invadens
HSSKNLS

SEQ ID NO: 2864132 - protein, 13 aa, Entamoeba invadens
HSSLTNNGGQAPY

SEQ ID NO: 2864133 - protein, 13 aa, Entamoeba invadens
HSSPDMSTPQYSS

SEQ ID NO: 2864134 - protein, 19 aa, Entamoeba invadens
HSSPLFTKNENKIASKPTI

SEQ ID NO: 2864135 - protein, 6 aa, Entamoeba invadens
HSSPSP

SEQ ID NO: 2864136 - protein, 5 aa, Entamoeba invadens
HSSSS

SEQ ID NO: 2864137 - protein, 15 aa, Entamoeba invadens
HSSSSEASFSSHPTL

SEQ ID NO: 2864138 - protein, 5 aa, Entamoeba invadens
HSSST

SEQ ID NO: 2864139 - protein, 14 aa, Entamoeba invadens
HSSTPRIGAETPIS

SEQ ID NO: 2864140 - protein, 8 aa, Entamoeba invadens
HSSTTEFT

SEQ ID NO: 2864141 - protein, 12 aa, Entamoeba invadens
HSTASSDDKKIT

SEQ ID NO: 2864142 - protein, 4 aa, Entamoeba invadens
HSTE

SEQ ID NO: 2864143 - protein, 6 aa, Entamoeba invadens
HSTEGV

SEQ ID NO: 2864144 - protein, 12 aa, Entamoeba invadens
HSTENKKPTTII

SEQ ID NO: 2864145 - protein, 6 aa, Entamoeba invadens
HSTGKM

SEQ ID NO: 2864146 - protein, 4 aa, Entamoeba invadens
HSTK

SEQ ID NO: 2864147 - protein, 10 aa, Entamoeba invadens
HSTKKEIYTE

SEQ ID NO: 2864148 - protein, 10 aa, Entamoeba invadens
HSTNNTKAFS

SEQ ID NO: 2864149 - protein, 9 aa, Entamoeba invadens
HSTNSAVTS

SEQ ID NO: 2864150 - protein, 10 aa, Entamoeba invadens
HSTQDDIERN

SEQ ID NO: 2864151 - protein, 7 aa, Entamoeba invadens
HSTQNIQ

SEQ ID NO: 2864152 - protein, 7 aa, Entamoeba invadens
HSTRYDK

SEQ ID NO: 2864153 - protein, 13 aa, Entamoeba invadens
HSTSFKQPPTVPL

SEQ ID NO: 2864154 - protein, 6 aa, Entamoeba invadens
HSTSQP

SEQ ID NO: 2864155 - protein, 25 aa, Entamoeba invadens
HSTSTDNLQPKIEHSQTRQSDIQQS

SEQ ID NO: 2864156 - protein, 4 aa, Entamoeba invadens
HSTV

SEQ ID NO: 2864157 - protein, 9 aa, Entamoeba invadens
HSVEKPNSV

SEQ ID NO: 2864158 - protein, 8 aa, Entamoeba invadens
HSVGDYGS

SEQ ID NO: 2864159 - protein, 9 aa, Entamoeba invadens
HSVTPQDIS

SEQ ID NO: 2864160 - protein, 10 aa, Entamoeba invadens
HSYPSSPVSG

SEQ ID NO: 2864161 - protein, 10 aa, Entamoeba invadens
HSYQTSKTSL

SEQ ID NO: 2864162 - protein, 15 aa, Entamoeba invadens
HSYTPEKGVQLSTGI

SEQ ID NO: 2864163 - protein, 10 aa, Entamoeba invadens
HSYTRSDTSC

SEQ ID NO: 2864164 - protein, 10 aa, Entamoeba invadens
HTANNCNDKF

SEQ ID NO: 2864165 - protein, 10 aa, Entamoeba invadens
HTAPEAEPKR

SEQ ID NO: 2864166 - protein, 5 aa, Entamoeba invadens
HTASK

SEQ ID NO: 2864167 - protein, 13 aa, Entamoeba invadens
HTAYDNQPDCEKE

SEQ ID NO: 2864168 - protein, 12 aa, Entamoeba invadens
HTCGATSDIDFG

SEQ ID NO: 2864169 - protein, 7 aa, Entamoeba invadens
HTCGREQ

SEQ ID NO: 2864170 - protein, 7 aa, Entamoeba invadens
HTDAKSL

SEQ ID NO: 2864171 - protein, 8 aa, Entamoeba invadens
HTDDEHHS

SEQ ID NO: 2864172 - protein, 6 aa, Entamoeba invadens
HTDDKK

SEQ ID NO: 2864173 - protein, 5 aa, Entamoeba invadens
HTDGT

SEQ ID NO: 2864174 - protein, 9 aa, Entamoeba invadens
HTDKRKSIQ

SEQ ID NO: 2864175 - protein, 18 aa, Entamoeba invadens
HTDTENCHRKDTSTEYKQ

SEQ ID NO: 2864176 - protein, 4 aa, Entamoeba invadens
HTDV

SEQ ID NO: 2864177 - protein, 5 aa, Entamoeba invadens
HTDVN

SEQ ID NO: 2864178 - protein, 8 aa, Entamoeba invadens
HTEENQMN

SEQ ID NO: 2864179 - protein, 20 aa, Entamoeba invadens
HTEEPLKGKDSKKDKKDKKK

SEQ ID NO: 2864180 - protein, 5 aa, Entamoeba invadens
HTEGF

SEQ ID NO: 2864181 - protein, 6 aa, Entamoeba invadens
HTEGQL

SEQ ID NO: 2864182 - protein, 10 aa, Entamoeba invadens
HTEKRHRESF

SEQ ID NO: 2864183 - protein, 8 aa, Entamoeba invadens
HTEKSHVD

SEQ ID NO: 2864184 - protein, 8 aa, Entamoeba invadens
HTEKTEED

SEQ ID NO: 2864185 - protein, 7 aa, Entamoeba invadens
HTENQRA

SEQ ID NO: 2864186 - protein, 7 aa, Entamoeba invadens
HTENYNK

SEQ ID NO: 2864187 - protein, 9 aa, Entamoeba invadens
HTEPTQAPK

SEQ ID NO: 2864188 - protein, 25 aa, Entamoeba invadens
HTEQPEKKEETTEEKVEEKPVEEEK

SEQ ID NO: 2864189 - protein, 11 aa, Entamoeba invadens
HTETKISANAP

SEQ ID NO: 2864190 - protein, 5 aa, Entamoeba invadens
HTGEL

SEQ ID NO: 2864191 - protein, 7 aa, Entamoeba invadens
HTGEYTG

SEQ ID NO: 2864192 - protein, 7 aa, Entamoeba invadens
HTGKEIK

SEQ ID NO: 2864193 - protein, 17 aa, Entamoeba invadens
HTGKTAFDYAEENKHYA

SEQ ID NO: 2864194 - protein, 8 aa, Entamoeba invadens
HTGQTKEY

SEQ ID NO: 2864195 - protein, 4 aa, Entamoeba invadens
HTGS

SEQ ID NO: 2864196 - protein, 5 aa, Entamoeba invadens
HTGSY

SEQ ID NO: 2864197 - protein, 6 aa, Entamoeba invadens
HTHTKQ

SEQ ID NO: 2864198 - protein, 22 aa, Entamoeba invadens
HTHTKQKETQPPHTSKFSPEMD

SEQ ID NO: 2864199 - protein, 15 aa, Entamoeba invadens
HTIGEPKKAQPPLPQ

SEQ ID NO: 2864200 - protein, 14 aa, Entamoeba invadens
HTIQSDSKAPKPPV

SEQ ID NO: 2864201 - protein, 8 aa, Entamoeba invadens
HTISNPDE

SEQ ID NO: 2864202 - protein, 15 aa, Entamoeba invadens
HTISPPQIVPSQRSK

SEQ ID NO: 2864203 - protein, 16 aa, Entamoeba invadens
HTKADEKLEAKPNIDE

SEQ ID NO: 2864204 - protein, 7 aa, Entamoeba invadens
HTKANYS

SEQ ID NO: 2864205 - protein, 10 aa, Entamoeba invadens
HTKATEQYQP

SEQ ID NO: 2864206 - protein, 8 aa, Entamoeba invadens
HTKEEEEK

SEQ ID NO: 2864207 - protein, 8 aa, Entamoeba invadens
HTKFRNNN

SEQ ID NO: 2864208 - protein, 14 aa, Entamoeba invadens
HTKGTKTVLAEKTP

SEQ ID NO: 2864209 - protein, 10 aa, Entamoeba invadens
HTKINTKVTY

SEQ ID NO: 2864210 - protein, 6 aa, Entamoeba invadens
HTKKEL

SEQ ID NO: 2864211 - protein, 8 aa, Entamoeba invadens
HTKLEPSE

SEQ ID NO: 2864212 - protein, 8 aa, Entamoeba invadens
HTKNGLKE

SEQ ID NO: 2864213 - protein, 11 aa, Entamoeba invadens
HTKPHQKGKTT

SEQ ID NO: 2864214 - protein, 5 aa, Entamoeba invadens
HTKTP

SEQ ID NO: 2864215 - protein, 15 aa, Entamoeba invadens
HTKTPDPDYLDTTNA

SEQ ID NO: 2864216 - protein, 5 aa, Entamoeba invadens
HTLAY

SEQ ID NO: 2864217 - protein, 11 aa, Entamoeba invadens
HTLESSDSVEK

SEQ ID NO: 2864218 - protein, 22 aa, Entamoeba invadens
HTLKEKVDKLKEVGKLPKEFDN

SEQ ID NO: 2864219 - protein, 8 aa, Entamoeba invadens
HTLKTNEM

SEQ ID NO: 2864220 - protein, 13 aa, Entamoeba invadens
HTLQESYSQVPSK

SEQ ID NO: 2864221 - protein, 46 aa, Entamoeba invadens
HTLSREKKAMDKSHKKNNAENKKAREKRKQTRREKQKVEDAIEDQK

SEQ ID NO: 2864222 - protein, 13 aa, Entamoeba invadens
HTNGGRVKNSSYQ

SEQ ID NO: 2864223 - protein, 9 aa, Entamoeba invadens
HTNHPPLKR

SEQ ID NO: 2864224 - protein, 10 aa, Entamoeba invadens
HTNKTTEKEI

SEQ ID NO: 2864225 - protein, 4 aa, Entamoeba invadens
HTNS

SEQ ID NO: 2864226 - protein, 25 aa, Entamoeba invadens
HTNSDDSEEEEKVECKKEDKNIPGS

SEQ ID NO: 2864227 - protein, 15 aa, Entamoeba invadens
HTNYSEKPVNERNIP

SEQ ID NO: 2864228 - protein, 9 aa, Entamoeba invadens
HTPANPQEF

SEQ ID NO: 2864229 - protein, 6 aa, Entamoeba invadens
HTPDVD

SEQ ID NO: 2864230 - protein, 5 aa, Entamoeba invadens
HTPED

SEQ ID NO: 2864231 - protein, 8 aa, Entamoeba invadens
HTPGHSPG

SEQ ID NO: 2864232 - protein, 8 aa, Entamoeba invadens
HTPHPPKI

SEQ ID NO: 2864233 - protein, 4 aa, Entamoeba invadens
HTPK

SEQ ID NO: 2864234 - protein, 7 aa, Entamoeba invadens
HTPNEES

SEQ ID NO: 2864235 - protein, 6 aa, Entamoeba invadens
HTPQNH

SEQ ID NO: 2864236 - protein, 12 aa, Entamoeba invadens
HTPSSQQQYTYN

SEQ ID NO: 2864237 - protein, 8 aa, Entamoeba invadens
HTPTTPEL

SEQ ID NO: 2864238 - protein, 7 aa, Entamoeba invadens
HTQDGVT

SEQ ID NO: 2864239 - protein, 14 aa, Entamoeba invadens
HTQDSYMETENAQY

SEQ ID NO: 2864240 - protein, 32 aa, Entamoeba invadens
HTQGKRHQQNLKARELKDAKDRGVPLKSTTKV

SEQ ID NO: 2864241 - protein, 14 aa, Entamoeba invadens
HTQGPSASLGAPAS

SEQ ID NO: 2864242 - protein, 6 aa, Entamoeba invadens
HTQTEV

SEQ ID NO: 2864243 - protein, 13 aa, Entamoeba invadens
HTRANARWEERGN

SEQ ID NO: 2864244 - protein, 11 aa, Entamoeba invadens
HTRDDDSHGTR

SEQ ID NO: 2864245 - protein, 6 aa, Entamoeba invadens
HTRDSA

SEQ ID NO: 2864246 - protein, 5 aa, Entamoeba invadens
HTRRS

SEQ ID NO: 2864247 - protein, 16 aa, Entamoeba invadens
HTRTPGGSAILTGETK

SEQ ID NO: 2864248 - protein, 10 aa, Entamoeba invadens
HTSAGKTAVA

SEQ ID NO: 2864249 - protein, 15 aa, Entamoeba invadens
HTSAPPMVEVSATPL

SEQ ID NO: 2864250 - protein, 14 aa, Entamoeba invadens
HTSATLSNDHSSRS

SEQ ID NO: 2864251 - protein, 6 aa, Entamoeba invadens
HTSEER

SEQ ID NO: 2864252 - protein, 18 aa, Entamoeba invadens
HTSEHNNLKKTKKTEVVN

SEQ ID NO: 2864253 - protein, 10 aa, Entamoeba invadens
HTSEKSEVST

SEQ ID NO: 2864254 - protein, 10 aa, Entamoeba invadens
HTSEQENGQL

SEQ ID NO: 2864255 - protein, 9 aa, Entamoeba invadens
HTSKDHPDF

SEQ ID NO: 2864256 - protein, 10 aa, Entamoeba invadens
HTSKEEHPDW

SEQ ID NO: 2864257 - protein, 6 aa, Entamoeba invadens
HTSNLP

SEQ ID NO: 2864258 - protein, 28 aa, Entamoeba invadens
HTSNRDNKIINRSTPKHQNLDNKYNQIN

SEQ ID NO: 2864259 - protein, 4 aa, Entamoeba invadens
HTSQ

SEQ ID NO: 2864260 - protein, 24 aa, Entamoeba invadens
HTSQQNENRMSLQSSDGESTLSNL

SEQ ID NO: 2864261 - protein, 6 aa, Entamoeba invadens
HTSREK

SEQ ID NO: 2864262 - protein, 5 aa, Entamoeba invadens
HTSRV

SEQ ID NO: 2864263 - protein, 4 aa, Entamoeba invadens
HTSS

SEQ ID NO: 2864264 - protein, 7 aa, Entamoeba invadens
HTSSNVV

SEQ ID NO: 2864265 - protein, 4 aa, Entamoeba invadens
HTST

SEQ ID NO: 2864266 - protein, 5 aa, Entamoeba invadens
HTSTT

SEQ ID NO: 2864267 - protein, 4 aa, Entamoeba invadens
HTSY

SEQ ID NO: 2864268 - protein, 46 aa, Entamoeba invadens
HTTAQQRSDDMKPRSPESTEQTRLSKQERKTQKKLDKKERKQEERL

SEQ ID NO: 2864269 - protein, 11 aa, Entamoeba invadens
HTTDTSNDEFD

SEQ ID NO: 2864270 - protein, 14 aa, Entamoeba invadens
HTTEDFKQMTKEKK

SEQ ID NO: 2864271 - protein, 6 aa, Entamoeba invadens
HTTFEN

SEQ ID NO: 2864272 - protein, 4 aa, Entamoeba invadens
HTTI

SEQ ID NO: 2864273 - protein, 6 aa, Entamoeba invadens
HTTIDG

SEQ ID NO: 2864274 - protein, 20 aa, Entamoeba invadens
HTTKEDTDKLKQQSSKTRNF

SEQ ID NO: 2864275 - protein, 7 aa, Entamoeba invadens
HTTLQKQ

SEQ ID NO: 2864276 - protein, 11 aa, Entamoeba invadens
HTTNGTVSDAR

SEQ ID NO: 2864277 - protein, 8 aa, Entamoeba invadens
HTTNPTKF

SEQ ID NO: 2864278 - protein, 11 aa, Entamoeba invadens
HTTQKNGSGPI

SEQ ID NO: 2864279 - protein, 12 aa, Entamoeba invadens
HTTQKTDTPLES

SEQ ID NO: 2864280 - protein, 15 aa, Entamoeba invadens
HTTQNAVSMDGGWSA

SEQ ID NO: 2864281 - protein, 5 aa, Entamoeba invadens
HTTRD

SEQ ID NO: 2864282 - protein, 6 aa, Entamoeba invadens
HTTRIK

SEQ ID NO: 2864283 - protein, 14 aa, Entamoeba invadens
HTTRKPRGKERDGV

SEQ ID NO: 2864284 - protein, 7 aa, Entamoeba invadens
HTTSSEI

SEQ ID NO: 2864285 - protein, 13 aa, Entamoeba invadens
HTVNESRSTNDKT

SEQ ID NO: 2864286 - protein, 7 aa, Entamoeba invadens
HTVQSSK

SEQ ID NO: 2864287 - protein, 5 aa, Entamoeba invadens
HTYKQ

SEQ ID NO: 2864288 - protein, 4 aa, Entamoeba invadens
HTYP

SEQ ID NO: 2864289 - protein, 9 aa, Entamoeba invadens
HTYPGDSTE

SEQ ID NO: 2864290 - protein, 13 aa, Entamoeba invadens
HTYPNSIKTNADA

SEQ ID NO: 2864291 - protein, 10 aa, Entamoeba invadens
HTYSSSSHGA

SEQ ID NO: 2864292 - protein, 4 aa, Entamoeba invadens
HTYT

SEQ ID NO: 2864293 - protein, 10 aa, Entamoeba invadens
HVDDEDPDEL

SEQ ID NO: 2864294 - protein, 13 aa, Entamoeba invadens
HVDTGKGKNINKE

SEQ ID NO: 2864295 - protein, 19 aa, Entamoeba invadens
HVEDESTIRQTMTPQPSCK

SEQ ID NO: 2864296 - protein, 13 aa, Entamoeba invadens
HVEKTQDNEIKPV

SEQ ID NO: 2864297 - protein, 9 aa, Entamoeba invadens
HVENSNDEI

SEQ ID NO: 2864298 - protein, 30 aa, Entamoeba invadens
HVEQQNNEMENIKKENDDLKSTKQQNEATL

SEQ ID NO: 2864299 - protein, 6 aa, Entamoeba invadens
HVESSQ

SEQ ID NO: 2864300 - protein, 4 aa, Entamoeba invadens
HVET

SEQ ID NO: 2864301 - protein, 25 aa, Entamoeba invadens
HVGGGERTVDSDVQYSKNKLTESHK

SEQ ID NO: 2864302 - protein, 4 aa, Entamoeba invadens
HVGN

SEQ ID NO: 2864303 - protein, 9 aa, Entamoeba invadens
HVKNEESVK

SEQ ID NO: 2864304 - protein, 6 aa, Entamoeba invadens
HVNDEK

SEQ ID NO: 2864305 - protein, 27 aa, Entamoeba invadens
HVNDSTKGIETTLANTNGITKEANLKP

SEQ ID NO: 2864306 - protein, 9 aa, Entamoeba invadens
HVNSSSGKR

SEQ ID NO: 2864307 - protein, 5 aa, Entamoeba invadens
HVQPG

SEQ ID NO: 2864308 - protein, 13 aa, Entamoeba invadens
HVQSKKQGGTISG

SEQ ID NO: 2864309 - protein, 6 aa, Entamoeba invadens
HVSDNA

SEQ ID NO: 2864310 - protein, 7 aa, Entamoeba invadens
HVSEDSA

SEQ ID NO: 2864311 - protein, 8 aa, Entamoeba invadens
HVSETEEK

SEQ ID NO: 2864312 - protein, 12 aa, Entamoeba invadens
HVSGAPTKMEKA

SEQ ID NO: 2864313 - protein, 9 aa, Entamoeba invadens
HVSPKHPNS

SEQ ID NO: 2864314 - protein, 13 aa, Entamoeba invadens
HVSSPKDRYISEE

SEQ ID NO: 2864315 - protein, 7 aa, Entamoeba invadens
HVSSSRD

SEQ ID NO: 2864316 - protein, 9 aa, Entamoeba invadens
HVSSTVEEA

SEQ ID NO: 2864317 - protein, 19 aa, Entamoeba invadens
HVSTSSQNQCKEKINETHE

SEQ ID NO: 2864318 - protein, 4 aa, Entamoeba invadens
HVTK

SEQ ID NO: 2864319 - protein, 9 aa, Entamoeba invadens
HVTTSKQVY

SEQ ID NO: 2864320 - protein, 6 aa, Entamoeba invadens
HWGDKD

SEQ ID NO: 2864321 - protein, 5 aa, Entamoeba invadens
HWTAT

SEQ ID NO: 2864322 - protein, 7 aa, Entamoeba invadens
HYAEHDG

SEQ ID NO: 2864323 - protein, 5 aa, Entamoeba invadens
HYDED

SEQ ID NO: 2864324 - protein, 5 aa, Entamoeba invadens
HYDND

SEQ ID NO: 2864325 - protein, 4 aa, Entamoeba invadens
HYDS

SEQ ID NO: 2864326 - protein, 4 aa, Entamoeba invadens
HYGG

SEQ ID NO: 2864327 - protein, 15 aa, Entamoeba invadens
HYGGYDGVGDENTPL

SEQ ID NO: 2864328 - protein, 8 aa, Entamoeba invadens
HYGKSQRT

SEQ ID NO: 2864329 - protein, 7 aa, Entamoeba invadens
HYKKAAD

SEQ ID NO: 2864330 - protein, 20 aa, Entamoeba invadens
HYKNETENLRRTEQLEKEKI

SEQ ID NO: 2864331 - protein, 9 aa, Entamoeba invadens
HYNDDEPDI

SEQ ID NO: 2864332 - protein, 7 aa, Entamoeba invadens
HYNETPS

SEQ ID NO: 2864333 - protein, 11 aa, Entamoeba invadens
HYNTQKEEKCT

SEQ ID NO: 2864334 - protein, 10 aa, Entamoeba invadens
HYPSSQNAEF

SEQ ID NO: 2864335 - protein, 8 aa, Entamoeba invadens
HYQKKQDC

SEQ ID NO: 2864336 - protein, 22 aa, Entamoeba invadens
HYQPPSLVPRSRRSRVTTNPNV

SEQ ID NO: 2864337 - protein, 5 aa, Entamoeba invadens
HYQQE

SEQ ID NO: 2864338 - protein, 7 aa, Entamoeba invadens
HYRTGNK

SEQ ID NO: 2864339 - protein, 10 aa, Entamoeba invadens
HYSKKQKVNT

SEQ ID NO: 2864340 - protein, 9 aa, Entamoeba invadens
HYSNENQTC

SEQ ID NO: 2864341 - protein, 10 aa, Entamoeba invadens
HYTANTNTVL

SEQ ID NO: 2864342 - protein, 64 aa, Entamoeba invadens
HYTPDDDYDNEIKEKPRKTLNAKKVTKKSKKSKKKPQKVEKVEKEEKDEKNETVAPQQQEKPIE

SEQ ID NO: 2864343 - protein, 18 aa, Entamoeba invadens
HYTPPQYQNAKMNDHKQQ

SEQ ID NO: 2864344 - protein, 4 aa, Entamoeba invadens
HYTR

SEQ ID NO: 2864345 - protein, 8 aa, Entamoeba invadens
HYTSEQSA

SEQ ID NO: 2864346 - protein, 8 aa, Entamoeba invadens
HYTSNQSQ

SEQ ID NO: 2864347 - protein, 15 aa, Entamoeba invadens
IAADQSDRRKNIEDQ

SEQ ID NO: 2864348 - protein, 21 aa, Entamoeba invadens
IAAERRRKVEKKKNVPQETVN

SEQ ID NO: 2864349 - protein, 18 aa, Entamoeba invadens
IAAETARTCPGRNVSSTP

SEQ ID NO: 2864350 - protein, 10 aa, Entamoeba invadens
IAAGGQLTTT

SEQ ID NO: 2864351 - protein, 130 aa, Entamoeba invadens
IAAKPKTVQVEKGAVEAPPPLAPPGGLAPPPGLAPPGGLAPPPGLAPPGGLEPPGGMLPPPGLAPPGGMLPPPGLEPPGGLMPPPGLAPPGGMMPPPGLAPPGGLMPPPGLAPPGGMMPPPGLAPPGGLM

SEQ ID NO: 2864352 - protein, 7 aa, Entamoeba invadens
IAANKEN

SEQ ID NO: 2864353 - protein, 6 aa, Entamoeba invadens
IAAQDD

SEQ ID NO: 2864354 - protein, 8 aa, Entamoeba invadens
IAAQPDID

SEQ ID NO: 2864355 - protein, 22 aa, Entamoeba invadens
IAATSSPKQVQARPLPPVPAPR

SEQ ID NO: 2864356 - protein, 10 aa, Entamoeba invadens
IADATNADRE

SEQ ID NO: 2864357 - protein, 13 aa, Entamoeba invadens
IADDNNTIDNSLP

SEQ ID NO: 2864358 - protein, 12 aa, Entamoeba invadens
IADEDDDVESSQ

SEQ ID NO: 2864359 - protein, 13 aa, Entamoeba invadens
IADRSEKESEDIR

SEQ ID NO: 2864360 - protein, 14 aa, Entamoeba invadens
IAEAKANKQTEEFE

SEQ ID NO: 2864361 - protein, 9 aa, Entamoeba invadens
IAEEKEEVK

SEQ ID NO: 2864362 - protein, 9 aa, Entamoeba invadens
IAEGKLSAE

SEQ ID NO: 2864363 - protein, 7 aa, Entamoeba invadens
IAEGTGN

SEQ ID NO: 2864364 - protein, 7 aa, Entamoeba invadens
IAEGVKS

SEQ ID NO: 2864365 - protein, 15 aa, Entamoeba invadens
IAEGVKSVGVEVSIH

SEQ ID NO: 2864366 - protein, 33 aa, Entamoeba invadens
IAEKERKKIEKRKQREEEEKAKLESMTEEEREA

SEQ ID NO: 2864367 - protein, 11 aa, Entamoeba invadens
IAEKNEDQFEL

SEQ ID NO: 2864368 - protein, 11 aa, Entamoeba invadens
IAEKTEKTSVE

SEQ ID NO: 2864369 - protein, 10 aa, Entamoeba invadens
IAEKTNGYSG

SEQ ID NO: 2864370 - protein, 25 aa, Entamoeba invadens
IAENEKQIDQYQHNEQINKNKIDQL

SEQ ID NO: 2864371 - protein, 12 aa, Entamoeba invadens
IAENQDREAEYF

SEQ ID NO: 2864372 - protein, 7 aa, Entamoeba invadens
IAENTNF

SEQ ID NO: 2864373 - protein, 22 aa, Entamoeba invadens
IAENTTELQKQREKNKKANETI

SEQ ID NO: 2864374 - protein, 11 aa, Entamoeba invadens
IAEPGDTAKRI

SEQ ID NO: 2864375 - protein, 4 aa, Entamoeba invadens
IAEQ

SEQ ID NO: 2864376 - protein, 10 aa, Entamoeba invadens
IAEQGEAYIN

SEQ ID NO: 2864377 - protein, 7 aa, Entamoeba invadens
IAEQKHK

SEQ ID NO: 2864378 - protein, 8 aa, Entamoeba invadens
IAESGEQE

SEQ ID NO: 2864379 - protein, 10 aa, Entamoeba invadens
IAESKKKTFE

SEQ ID NO: 2864380 - protein, 8 aa, Entamoeba invadens
IAESSITV

SEQ ID NO: 2864381 - protein, 28 aa, Entamoeba invadens
IAETENLTAQIAAKQKQIAALKSETDEL

SEQ ID NO: 2864382 - protein, 8 aa, Entamoeba invadens
IAEVGENN

SEQ ID NO: 2864383 - protein, 4 aa, Entamoeba invadens
IAFG

SEQ ID NO: 2864384 - protein, 7 aa, Entamoeba invadens
IAGENTH

SEQ ID NO: 2864385 - protein, 4 aa, Entamoeba invadens
IAGK

SEQ ID NO: 2864386 - protein, 8 aa, Entamoeba invadens
IAGKDGKI

SEQ ID NO: 2864387 - protein, 5 aa, Entamoeba invadens
IAGKG

SEQ ID NO: 2864388 - protein, 4 aa, Entamoeba invadens
IAGL

SEQ ID NO: 2864389 - protein, 11 aa, Entamoeba invadens
IAGPSLPNTPM

SEQ ID NO: 2864390 - protein, 8 aa, Entamoeba invadens
IAGPSSVQ

SEQ ID NO: 2864391 - protein, 6 aa, Entamoeba invadens
IAGSDE

SEQ ID NO: 2864392 - protein, 12 aa, Entamoeba invadens
IAGTQKRSLAPA

SEQ ID NO: 2864393 - protein, 67 aa, Entamoeba invadens
IAGTSSPKHVQARPLPPVPAPTPFPSTSGEVPKPPRTLYRDRKSSDYEDPTEAIEAARNRHKKPETV

SEQ ID NO: 2864394 - protein, 5 aa, Entamoeba invadens
IAGYN

SEQ ID NO: 2864395 - protein, 12 aa, Entamoeba invadens
IAKDGSEKAEID

SEQ ID NO: 2864396 - protein, 16 aa, Entamoeba invadens
IAKEHKTDDNKLPKTS

SEQ ID NO: 2864397 - protein, 16 aa, Entamoeba invadens
IAKEHKTGDNKLSKTS

SEQ ID NO: 2864398 - protein, 54 aa, Entamoeba invadens
IAKEQEERERVERERIEQERIEKEKAEKEAREKAEAERLEKERLEKERIEQERI

SEQ ID NO: 2864399 - protein, 9 aa, Entamoeba invadens
IAKERKNKE

SEQ ID NO: 2864400 - protein, 11 aa, Entamoeba invadens
IAKETETARKG

SEQ ID NO: 2864401 - protein, 7 aa, Entamoeba invadens
IAKKGVD

SEQ ID NO: 2864402 - protein, 17 aa, Entamoeba invadens
IAKKNSLKKTVKKGEVD

SEQ ID NO: 2864403 - protein, 15 aa, Entamoeba invadens
IAKKSEVLGSSCTQS

SEQ ID NO: 2864404 - protein, 9 aa, Entamoeba invadens
IAKKSPKLY

SEQ ID NO: 2864405 - protein, 7 aa, Entamoeba invadens
IAKNSGV

SEQ ID NO: 2864406 - protein, 4 aa, Entamoeba invadens
IAKQ

SEQ ID NO: 2864407 - protein, 7 aa, Entamoeba invadens
IAKSTSM

SEQ ID NO: 2864408 - protein, 4 aa, Entamoeba invadens
IAKT

SEQ ID NO: 2864409 - protein, 6 aa, Entamoeba invadens
IAKTKL

SEQ ID NO: 2864410 - protein, 7 aa, Entamoeba invadens
IAKTPMD

SEQ ID NO: 2864411 - protein, 8 aa, Entamoeba invadens
IAKTPTRK

SEQ ID NO: 2864412 - protein, 9 aa, Entamoeba invadens
IAKTSKSSD

SEQ ID NO: 2864413 - protein, 4 aa, Entamoeba invadens
IANA

SEQ ID NO: 2864414 - protein, 10 aa, Entamoeba invadens
IANEKEYKKD

SEQ ID NO: 2864415 - protein, 5 aa, Entamoeba invadens
IANES

SEQ ID NO: 2864416 - protein, 11 aa, Entamoeba invadens
IANGLKKKKRL

SEQ ID NO: 2864417 - protein, 8 aa, Entamoeba invadens
IANKTREI

SEQ ID NO: 2864418 - protein, 9 aa, Entamoeba invadens
IANKTSGKV

SEQ ID NO: 2864419 - protein, 6 aa, Entamoeba invadens
IANPKN

SEQ ID NO: 2864420 - protein, 5 aa, Entamoeba invadens
IANSK

SEQ ID NO: 2864421 - protein, 8 aa, Entamoeba invadens
IANTKGKS

SEQ ID NO: 2864422 - protein, 10 aa, Entamoeba invadens
IAPASKEFEE

SEQ ID NO: 2864423 - protein, 17 aa, Entamoeba invadens
IAPEEITSAGDLLLQAI

SEQ ID NO: 2864424 - protein, 14 aa, Entamoeba invadens
IAPEGSDSSGYGEG

SEQ ID NO: 2864425 - protein, 12 aa, Entamoeba invadens
IAPENNATLNKA

SEQ ID NO: 2864426 - protein, 5 aa, Entamoeba invadens
IAPET

SEQ ID NO: 2864427 - protein, 6 aa, Entamoeba invadens
IAPETQ

SEQ ID NO: 2864428 - protein, 7 aa, Entamoeba invadens
IAPGIPS

SEQ ID NO: 2864429 - protein, 8 aa, Entamoeba invadens
IAPKDTEN

SEQ ID NO: 2864430 - protein, 7 aa, Entamoeba invadens
IAPNKIN

SEQ ID NO: 2864431 - protein, 9 aa, Entamoeba invadens
IAPNNKEVN

SEQ ID NO: 2864432 - protein, 18 aa, Entamoeba invadens
IAPNPAAAAKLKSMGYNA

SEQ ID NO: 2864433 - protein, 11 aa, Entamoeba invadens
IAPPGEGEKYT

SEQ ID NO: 2864434 - protein, 8 aa, Entamoeba invadens
IAPPPTRL

SEQ ID NO: 2864435 - protein, 6 aa, Entamoeba invadens
IAPQQQ

SEQ ID NO: 2864436 - protein, 6 aa, Entamoeba invadens
IAPRNG

SEQ ID NO: 2864437 - protein, 10 aa, Entamoeba invadens
IAPSIYGQTE

SEQ ID NO: 2864438 - protein, 8 aa, Entamoeba invadens
IAPSQYNT

SEQ ID NO: 2864439 - protein, 13 aa, Entamoeba invadens
IAPTNRNDYFREK

SEQ ID NO: 2864440 - protein, 7 aa, Entamoeba invadens
IAPTQTG

SEQ ID NO: 2864441 - protein, 69 aa, Entamoeba invadens
IAQENAEKEERERLEKERIETERITQEKAEAERLEKERLEQERLEKERLEAERVAKEKAEQEEKERLER

SEQ ID NO: 2864442 - protein, 12 aa, Entamoeba invadens
IAQESKKRRVER

SEQ ID NO: 2864443 - protein, 10 aa, Entamoeba invadens
IAQGSKKEEN

SEQ ID NO: 2864444 - protein, 10 aa, Entamoeba invadens
IAQKENIDKF

SEQ ID NO: 2864445 - protein, 9 aa, Entamoeba invadens
IAQKGQYGA

SEQ ID NO: 2864446 - protein, 6 aa, Entamoeba invadens
IAQNEF

SEQ ID NO: 2864447 - protein, 4 aa, Entamoeba invadens
IAQQ

SEQ ID NO: 2864448 - protein, 17 aa, Entamoeba invadens
IAQQENTTVPDKQLTPH

SEQ ID NO: 2864449 - protein, 11 aa, Entamoeba invadens
IAQRSSSPQLV

SEQ ID NO: 2864450 - protein, 6 aa, Entamoeba invadens
IAQSNT

SEQ ID NO: 2864451 - protein, 6 aa, Entamoeba invadens
IAQTEQ

SEQ ID NO: 2864452 - protein, 9 aa, Entamoeba invadens
IAREEHGSN

SEQ ID NO: 2864453 - protein, 15 aa, Entamoeba invadens
IAREKSGKMLDSQQQ

SEQ ID NO: 2864454 - protein, 6 aa, Entamoeba invadens
IARGNS

SEQ ID NO: 2864455 - protein, 8 aa, Entamoeba invadens
IARGQQQN

SEQ ID NO: 2864456 - protein, 7 aa, Entamoeba invadens
IARKNPN

SEQ ID NO: 2864457 - protein, 7 aa, Entamoeba invadens
IARNGFS

SEQ ID NO: 2864458 - protein, 86 aa, Entamoeba invadens
IARQKEEREKEENPSMSEDQDNQESENENEEQKQESEDDDENDKKELFPSESEEINDEFSENEFEKAAKQTIKEEAQVKKEAEEEL

SEQ ID NO: 2864459 - protein, 4 aa, Entamoeba invadens
IARS

SEQ ID NO: 2864460 - protein, 8 aa, Entamoeba invadens
IARSGTKT

SEQ ID NO: 2864461 - protein, 11 aa, Entamoeba invadens
IARVGGKVNDS

SEQ ID NO: 2864462 - protein, 21 aa, Entamoeba invadens
IASATRSISTKIEKKRERPGT

SEQ ID NO: 2864463 - protein, 35 aa, Entamoeba invadens
IASDATTNTVDSIRSNNTTKTTLSNNTWDLVPIAK

SEQ ID NO: 2864464 - protein, 13 aa, Entamoeba invadens
IASDKETTKDEHE

SEQ ID NO: 2864465 - protein, 9 aa, Entamoeba invadens
IASETDDDD

SEQ ID NO: 2864466 - protein, 7 aa, Entamoeba invadens
IASGDDK

SEQ ID NO: 2864467 - protein, 10 aa, Entamoeba invadens
IASGNKDNTL

SEQ ID NO: 2864468 - protein, 5 aa, Entamoeba invadens
IASIE

SEQ ID NO: 2864469 - protein, 11 aa, Entamoeba invadens
IASKEGKGVSD

SEQ ID NO: 2864470 - protein, 11 aa, Entamoeba invadens
IASNSKTPESQ

SEQ ID NO: 2864471 - protein, 7 aa, Entamoeba invadens
IASSDVT

SEQ ID NO: 2864472 - protein, 9 aa, Entamoeba invadens
IASTKNEEL

SEQ ID NO: 2864473 - protein, 9 aa, Entamoeba invadens
IASTTAGNV

SEQ ID NO: 2864474 - protein, 11 aa, Entamoeba invadens
IASTTSKITVD

SEQ ID NO: 2864475 - protein, 11 aa, Entamoeba invadens
IATDGQRTISG

SEQ ID NO: 2864476 - protein, 4 aa, Entamoeba invadens
IATE

SEQ ID NO: 2864477 - protein, 5 aa, Entamoeba invadens
IATEH

SEQ ID NO: 2864478 - protein, 5 aa, Entamoeba invadens
IATET

SEQ ID NO: 2864479 - protein, 12 aa, Entamoeba invadens
IATETDSGTTGT

SEQ ID NO: 2864480 - protein, 22 aa, Entamoeba invadens
IATGKDDYVPVQKKQTKPVNNL

SEQ ID NO: 2864481 - protein, 7 aa, Entamoeba invadens
IATGSNS

SEQ ID NO: 2864482 - protein, 9 aa, Entamoeba invadens
IATHDNKDV

SEQ ID NO: 2864483 - protein, 8 aa, Entamoeba invadens
IATKGQQM

SEQ ID NO: 2864484 - protein, 16 aa, Entamoeba invadens
IATKRHDAQNGADREV

SEQ ID NO: 2864485 - protein, 4 aa, Entamoeba invadens
IATN

SEQ ID NO: 2864486 - protein, 11 aa, Entamoeba invadens
IATNGKCASCN

SEQ ID NO: 2864487 - protein, 7 aa, Entamoeba invadens
IATNGKL

SEQ ID NO: 2864488 - protein, 12 aa, Entamoeba invadens
IATNKPSLSERE

SEQ ID NO: 2864489 - protein, 16 aa, Entamoeba invadens
IATNSSDSDSEKYSTY

SEQ ID NO: 2864490 - protein, 12 aa, Entamoeba invadens
IATPGYNGSYNR

SEQ ID NO: 2864491 - protein, 6 aa, Entamoeba invadens
IATPNL

SEQ ID NO: 2864492 - protein, 8 aa, Entamoeba invadens
IATQQPPM

SEQ ID NO: 2864493 - protein, 10 aa, Entamoeba invadens
IATSNKIPTL

SEQ ID NO: 2864494 - protein, 6 aa, Entamoeba invadens
IAVEPE

SEQ ID NO: 2864495 - protein, 19 aa, Entamoeba invadens
IAVPTKRNVSCQKKEIKDT

SEQ ID NO: 2864496 - protein, 6 aa, Entamoeba invadens
ICDSDK

SEQ ID NO: 2864497 - protein, 7 aa, Entamoeba invadens
ICEKAGK

SEQ ID NO: 2864498 - protein, 14 aa, Entamoeba invadens
ICENNTNNCKVTTL

SEQ ID NO: 2864499 - protein, 4 aa, Entamoeba invadens
ICGP

SEQ ID NO: 2864500 - protein, 14 aa, Entamoeba invadens
ICPNEEEEDSDEWS

SEQ ID NO: 2864501 - protein, 9 aa, Entamoeba invadens
ICTPSTSLT

SEQ ID NO: 2864502 - protein, 5 aa, Entamoeba invadens
IDAEI

SEQ ID NO: 2864503 - protein, 9 aa, Entamoeba invadens
IDAKATTIN

SEQ ID NO: 2864504 - protein, 8 aa, Entamoeba invadens
IDANGDGV

SEQ ID NO: 2864505 - protein, 14 aa, Entamoeba invadens
IDAPADGEKHNKND

SEQ ID NO: 2864506 - protein, 10 aa, Entamoeba invadens
IDAPNRKVTD

SEQ ID NO: 2864507 - protein, 12 aa, Entamoeba invadens
IDAPSESQIEKS

SEQ ID NO: 2864508 - protein, 7 aa, Entamoeba invadens
IDASGIG

SEQ ID NO: 2864509 - protein, 9 aa, Entamoeba invadens
IDASKDGIK

SEQ ID NO: 2864510 - protein, 8 aa, Entamoeba invadens
IDASSDAS

SEQ ID NO: 2864511 - protein, 19 aa, Entamoeba invadens
IDDDEKRNVQYKKKNKNKL

SEQ ID NO: 2864512 - protein, 23 aa, Entamoeba invadens
IDDDEPEEENTEESIEEKTNEDF

SEQ ID NO: 2864513 - protein, 18 aa, Entamoeba invadens
IDDDKKEVDEIRQQHEKD

SEQ ID NO: 2864514 - protein, 6 aa, Entamoeba invadens
IDDDKR

SEQ ID NO: 2864515 - protein, 5 aa, Entamoeba invadens
IDDDQ

SEQ ID NO: 2864516 - protein, 5 aa, Entamoeba invadens
IDDDR

SEQ ID NO: 2864517 - protein, 7 aa, Entamoeba invadens
IDDDRSA

SEQ ID NO: 2864518 - protein, 23 aa, Entamoeba invadens
IDDGDEYEEFKNKTQLPKMPKDI

SEQ ID NO: 2864519 - protein, 25 aa, Entamoeba invadens
IDDGVSAKKCTVTGQGIEEPNDQDD

SEQ ID NO: 2864520 - protein, 14 aa, Entamoeba invadens
IDDKTRKENTRREA

SEQ ID NO: 2864521 - protein, 6 aa, Entamoeba invadens
IDDKVG

SEQ ID NO: 2864522 - protein, 4 aa, Entamoeba invadens
IDDL

SEQ ID NO: 2864523 - protein, 4 aa, Entamoeba invadens
IDDQ

SEQ ID NO: 2864524 - protein, 7 aa, Entamoeba invadens
IDDQSAM

SEQ ID NO: 2864525 - protein, 7 aa, Entamoeba invadens
IDDQSNV

SEQ ID NO: 2864526 - protein, 23 aa, Entamoeba invadens
IDDSENDMKEEGKEEKDKDKDKF

SEQ ID NO: 2864527 - protein, 6 aa, Entamoeba invadens
IDDSSD

SEQ ID NO: 2864528 - protein, 4 aa, Entamoeba invadens
IDDT

SEQ ID NO: 2864529 - protein, 9 aa, Entamoeba invadens
IDDTYPRTY

SEQ ID NO: 2864530 - protein, 10 aa, Entamoeba invadens
IDDYKPSGNL

SEQ ID NO: 2864531 - protein, 11 aa, Entamoeba invadens
IDDYNATGTPL

SEQ ID NO: 2864532 - protein, 9 aa, Entamoeba invadens
IDEADGIEG

SEQ ID NO: 2864533 - protein, 7 aa, Entamoeba invadens
IDEAKGK

SEQ ID NO: 2864534 - protein, 5 aa, Entamoeba invadens
IDEAT

SEQ ID NO: 2864535 - protein, 8 aa, Entamoeba invadens
IDECGSEK

SEQ ID NO: 2864536 - protein, 18 aa, Entamoeba invadens
IDECQNKSAQEDTENEEI

SEQ ID NO: 2864537 - protein, 5 aa, Entamoeba invadens
IDEDE

SEQ ID NO: 2864538 - protein, 6 aa, Entamoeba invadens
IDEDNA

SEQ ID NO: 2864539 - protein, 11 aa, Entamoeba invadens
IDEDSKNYKEV

SEQ ID NO: 2864540 - protein, 11 aa, Entamoeba invadens
IDEDSNDFPDE

SEQ ID NO: 2864541 - protein, 8 aa, Entamoeba invadens
IDEDTPDQ

SEQ ID NO: 2864542 - protein, 4 aa, Entamoeba invadens
IDEE

SEQ ID NO: 2864543 - protein, 18 aa, Entamoeba invadens
IDEEDATIREKISNGAGM

SEQ ID NO: 2864544 - protein, 12 aa, Entamoeba invadens
IDEEEMKNQKNE

SEQ ID NO: 2864545 - protein, 7 aa, Entamoeba invadens
IDEEQYK

SEQ ID NO: 2864546 - protein, 6 aa, Entamoeba invadens
IDEETK

SEQ ID NO: 2864547 - protein, 7 aa, Entamoeba invadens
IDEETQN

SEQ ID NO: 2864548 - protein, 18 aa, Entamoeba invadens
IDEFSGDKRFIKKLEILE

SEQ ID NO: 2864549 - protein, 6 aa, Entamoeba invadens
IDEGDR

SEQ ID NO: 2864550 - protein, 18 aa, Entamoeba invadens
IDEGERKDRLKSGGTGSV

SEQ ID NO: 2864551 - protein, 5 aa, Entamoeba invadens
IDEGN

SEQ ID NO: 2864552 - protein, 6 aa, Entamoeba invadens
IDEIKK

SEQ ID NO: 2864553 - protein, 20 aa, Entamoeba invadens
IDEKKKQMEEDSAGSWSTNT

SEQ ID NO: 2864554 - protein, 10 aa, Entamoeba invadens
IDEKKNGPQM

SEQ ID NO: 2864555 - protein, 10 aa, Entamoeba invadens
IDEKPKAEIV

SEQ ID NO: 2864556 - protein, 11 aa, Entamoeba invadens
IDEKQEEKVPL

SEQ ID NO: 2864557 - protein, 8 aa, Entamoeba invadens
IDEKSDSE

SEQ ID NO: 2864558 - protein, 6 aa, Entamoeba invadens
IDEKTH

SEQ ID NO: 2864559 - protein, 12 aa, Entamoeba invadens
IDEKTKTEFEKF

SEQ ID NO: 2864560 - protein, 8 aa, Entamoeba invadens
IDEKTNGS

SEQ ID NO: 2864561 - protein, 6 aa, Entamoeba invadens
IDELES

SEQ ID NO: 2864562 - protein, 12 aa, Entamoeba invadens
IDELKKKKEELD

SEQ ID NO: 2864563 - protein, 4 aa, Entamoeba invadens
IDEM

SEQ ID NO: 2864564 - protein, 5 aa, Entamoeba invadens
IDEMQ

SEQ ID NO: 2864565 - protein, 6 aa, Entamoeba invadens
IDENGA

SEQ ID NO: 2864566 - protein, 11 aa, Entamoeba invadens
IDENGVTRTYD

SEQ ID NO: 2864567 - protein, 8 aa, Entamoeba invadens
IDENSSND

SEQ ID NO: 2864568 - protein, 8 aa, Entamoeba invadens
IDENTEIG

SEQ ID NO: 2864569 - protein, 6 aa, Entamoeba invadens
IDEPIT

SEQ ID NO: 2864570 - protein, 20 aa, Entamoeba invadens
IDEPTPCSINTKTPQTEKTE

SEQ ID NO: 2864571 - protein, 7 aa, Entamoeba invadens
IDEQQKD

SEQ ID NO: 2864572 - protein, 8 aa, Entamoeba invadens
IDEQSHTS

SEQ ID NO: 2864573 - protein, 7 aa, Entamoeba invadens
IDERPNM

SEQ ID NO: 2864574 - protein, 4 aa, Entamoeba invadens
IDES

SEQ ID NO: 2864575 - protein, 15 aa, Entamoeba invadens
IDESEGLEKDEKKMR

SEQ ID NO: 2864576 - protein, 11 aa, Entamoeba invadens
IDETDGMKNAE

SEQ ID NO: 2864577 - protein, 5 aa, Entamoeba invadens
IDETQ

SEQ ID NO: 2864578 - protein, 15 aa, Entamoeba invadens
IDETTHINNDSKKVL

SEQ ID NO: 2864579 - protein, 31 aa, Entamoeba invadens
IDETTKKFSNERPALPQSSVSPNDITKPSWD

SEQ ID NO: 2864580 - protein, 7 aa, Entamoeba invadens
IDETTTK

SEQ ID NO: 2864581 - protein, 9 aa, Entamoeba invadens
IDEVPDTLT

SEQ ID NO: 2864582 - protein, 4 aa, Entamoeba invadens
IDEY

SEQ ID NO: 2864583 - protein, 10 aa, Entamoeba invadens
IDEYEANSSY

SEQ ID NO: 2864584 - protein, 5 aa, Entamoeba invadens
IDGCS

SEQ ID NO: 2864585 - protein, 4 aa, Entamoeba invadens
IDGD

SEQ ID NO: 2864586 - protein, 5 aa, Entamoeba invadens
IDGDA

SEQ ID NO: 2864587 - protein, 14 aa, Entamoeba invadens
IDGEKRKELGPGYQ

SEQ ID NO: 2864588 - protein, 7 aa, Entamoeba invadens
IDGEPEG

SEQ ID NO: 2864589 - protein, 10 aa, Entamoeba invadens
IDGGDNFSLG

SEQ ID NO: 2864590 - protein, 9 aa, Entamoeba invadens
IDGKKNNVE

SEQ ID NO: 2864591 - protein, 5 aa, Entamoeba invadens
IDGKM

SEQ ID NO: 2864592 - protein, 7 aa, Entamoeba invadens
IDGKNAK

SEQ ID NO: 2864593 - protein, 7 aa, Entamoeba invadens
IDGKPLG

SEQ ID NO: 2864594 - protein, 4 aa, Entamoeba invadens
IDGN

SEQ ID NO: 2864595 - protein, 25 aa, Entamoeba invadens
IDGNEQNKDDQRSKNPLERRDSFGE

SEQ ID NO: 2864596 - protein, 10 aa, Entamoeba invadens
IDGPPDQREG

SEQ ID NO: 2864597 - protein, 6 aa, Entamoeba invadens
IDGPSE

SEQ ID NO: 2864598 - protein, 10 aa, Entamoeba invadens
IDGQNNELEE

SEQ ID NO: 2864599 - protein, 5 aa, Entamoeba invadens
IDGRS

SEQ ID NO: 2864600 - protein, 8 aa, Entamoeba invadens
IDGSGFSD

SEQ ID NO: 2864601 - protein, 7 aa, Entamoeba invadens
IDGSPYS

SEQ ID NO: 2864602 - protein, 5 aa, Entamoeba invadens
IDGST

SEQ ID NO: 2864603 - protein, 10 aa, Entamoeba invadens
IDGSTGKVYQ

SEQ ID NO: 2864604 - protein, 9 aa, Entamoeba invadens
IDGTSPQDL

SEQ ID NO: 2864605 - protein, 4 aa, Entamoeba invadens
IDGV

SEQ ID NO: 2864606 - protein, 11 aa, Entamoeba invadens
IDIGNNDLTAP

SEQ ID NO: 2864607 - protein, 7 aa, Entamoeba invadens
IDIPKSV

SEQ ID NO: 2864608 - protein, 7 aa, Entamoeba invadens
IDIPQDI

SEQ ID NO: 2864609 - protein, 4 aa, Entamoeba invadens
IDKD

SEQ ID NO: 2864610 - protein, 9 aa, Entamoeba invadens
IDKDNSGDI

SEQ ID NO: 2864611 - protein, 8 aa, Entamoeba invadens
IDKDSHNR

SEQ ID NO: 2864612 - protein, 8 aa, Entamoeba invadens
IDKENLEK

SEQ ID NO: 2864613 - protein, 9 aa, Entamoeba invadens
IDKENLSKV

SEQ ID NO: 2864614 - protein, 8 aa, Entamoeba invadens
IDKESHNR

SEQ ID NO: 2864615 - protein, 4 aa, Entamoeba invadens
IDKG

SEQ ID NO: 2864616 - protein, 6 aa, Entamoeba invadens
IDKGGI

SEQ ID NO: 2864617 - protein, 11 aa, Entamoeba invadens
IDKIEKNKNFD

SEQ ID NO: 2864618 - protein, 8 aa, Entamoeba invadens
IDKKADLD

SEQ ID NO: 2864619 - protein, 25 aa, Entamoeba invadens
IDKKGKKNAKEKKEEVEDKQRKRKA

SEQ ID NO: 2864620 - protein, 10 aa, Entamoeba invadens
IDKKIESVGM

SEQ ID NO: 2864621 - protein, 8 aa, Entamoeba invadens
IDKKSDLD

SEQ ID NO: 2864622 - protein, 21 aa, Entamoeba invadens
IDKNQRPESVDNNGIAPISVP

SEQ ID NO: 2864623 - protein, 20 aa, Entamoeba invadens
IDKPKKSKKDAEQEEKPSEQ

SEQ ID NO: 2864624 - protein, 8 aa, Entamoeba invadens
IDKPSKGE

SEQ ID NO: 2864625 - protein, 6 aa, Entamoeba invadens
IDKQIQ

SEQ ID NO: 2864626 - protein, 12 aa, Entamoeba invadens
IDKRQPKKVTEP

SEQ ID NO: 2864627 - protein, 15 aa, Entamoeba invadens
IDKRSMEKAEREAQE

SEQ ID NO: 2864628 - protein, 4 aa, Entamoeba invadens
IDKS

SEQ ID NO: 2864629 - protein, 8 aa, Entamoeba invadens
IDKSGQWL

SEQ ID NO: 2864630 - protein, 6 aa, Entamoeba invadens
IDKTQN

SEQ ID NO: 2864631 - protein, 11 aa, Entamoeba invadens
IDLDKKKPEFK

SEQ ID NO: 2864632 - protein, 7 aa, Entamoeba invadens
IDLGEGR

SEQ ID NO: 2864633 - protein, 4 aa, Entamoeba invadens
IDMP

SEQ ID NO: 2864634 - protein, 6 aa, Entamoeba invadens
IDMQTG

SEQ ID NO: 2864635 - protein, 7 aa, Entamoeba invadens
IDNAAKN

SEQ ID NO: 2864636 - protein, 7 aa, Entamoeba invadens
IDNDSER

SEQ ID NO: 2864637 - protein, 11 aa, Entamoeba invadens
IDNEKSKARDA

SEQ ID NO: 2864638 - protein, 13 aa, Entamoeba invadens
IDNGHKPDSYGKE

SEQ ID NO: 2864639 - protein, 7 aa, Entamoeba invadens
IDNGSNE

SEQ ID NO: 2864640 - protein, 13 aa, Entamoeba invadens
IDNKEDQSDRAKE

SEQ ID NO: 2864641 - protein, 7 aa, Entamoeba invadens
IDNKNQF

SEQ ID NO: 2864642 - protein, 4 aa, Entamoeba invadens
IDNN

SEQ ID NO: 2864643 - protein, 12 aa, Entamoeba invadens
IDNNGKHDADRY

SEQ ID NO: 2864644 - protein, 10 aa, Entamoeba invadens
IDNNNDNSNT

SEQ ID NO: 2864645 - protein, 11 aa, Entamoeba invadens
IDNNPEQVTEL

SEQ ID NO: 2864646 - protein, 5 aa, Entamoeba invadens
IDNPS

SEQ ID NO: 2864647 - protein, 10 aa, Entamoeba invadens
IDNSSDTATS

SEQ ID NO: 2864648 - protein, 9 aa, Entamoeba invadens
IDNSYSDSQ

SEQ ID NO: 2864649 - protein, 20 aa, Entamoeba invadens
IDNTNTINNTINSTHQSPTI

SEQ ID NO: 2864650 - protein, 20 aa, Entamoeba invadens
IDNTTSQKKTSKRNKNRCII

SEQ ID NO: 2864651 - protein, 4 aa, Entamoeba invadens
IDNW

SEQ ID NO: 2864652 - protein, 15 aa, Entamoeba invadens
IDPEEELKKRRIAQG

SEQ ID NO: 2864653 - protein, 17 aa, Entamoeba invadens
IDPESFKKQQVDQNKRE

SEQ ID NO: 2864654 - protein, 9 aa, Entamoeba invadens
IDPGAQDTN

SEQ ID NO: 2864655 - protein, 10 aa, Entamoeba invadens
IDPGERSEIK

SEQ ID NO: 2864656 - protein, 4 aa, Entamoeba invadens
IDPK

SEQ ID NO: 2864657 - protein, 27 aa, Entamoeba invadens
IDPKATPTIVRESPTTAVLDGNNGLGH

SEQ ID NO: 2864658 - protein, 45 aa, Entamoeba invadens
IDPKGGVAPVNSATTSNNYSNTNTQVEQGRKLSDTQQALPTDRET

SEQ ID NO: 2864659 - protein, 20 aa, Entamoeba invadens
IDPKGIEVKPTTAYANPSLK

SEQ ID NO: 2864660 - protein, 10 aa, Entamoeba invadens
IDPKLRRKMG

SEQ ID NO: 2864661 - protein, 14 aa, Entamoeba invadens
IDPKTANTLSDETL

SEQ ID NO: 2864662 - protein, 13 aa, Entamoeba invadens
IDPKTGKTRTPIS

SEQ ID NO: 2864663 - protein, 4 aa, Entamoeba invadens
IDPN

SEQ ID NO: 2864664 - protein, 5 aa, Entamoeba invadens
IDPND

SEQ ID NO: 2864665 - protein, 8 aa, Entamoeba invadens
IDPNDKRK

SEQ ID NO: 2864666 - protein, 11 aa, Entamoeba invadens
IDPNKKSDPSE

SEQ ID NO: 2864667 - protein, 15 aa, Entamoeba invadens
IDPNNAEALSGVQTV

SEQ ID NO: 2864668 - protein, 8 aa, Entamoeba invadens
IDPNNKEV

SEQ ID NO: 2864669 - protein, 13 aa, Entamoeba invadens
IDPNSPAEKCGFE

SEQ ID NO: 2864670 - protein, 4 aa, Entamoeba invadens
IDPP

SEQ ID NO: 2864671 - protein, 7 aa, Entamoeba invadens
IDPPEEM

SEQ ID NO: 2864672 - protein, 9 aa, Entamoeba invadens
IDPPGCKDI

SEQ ID NO: 2864673 - protein, 5 aa, Entamoeba invadens
IDPPK

SEQ ID NO: 2864674 - protein, 4 aa, Entamoeba invadens
IDPQ

SEQ ID NO: 2864675 - protein, 12 aa, Entamoeba invadens
IDPQQWGQTDEH

SEQ ID NO: 2864676 - protein, 9 aa, Entamoeba invadens
IDPSDTVKS

SEQ ID NO: 2864677 - protein, 8 aa, Entamoeba invadens
IDPSSGRL

SEQ ID NO: 2864678 - protein, 10 aa, Entamoeba invadens
IDQEKQPLVQ

SEQ ID NO: 2864679 - protein, 4 aa, Entamoeba invadens
IDQG

SEQ ID NO: 2864680 - protein, 11 aa, Entamoeba invadens
IDQKAKTQPFS

SEQ ID NO: 2864681 - protein, 7 aa, Entamoeba invadens
IDQNAAQ

SEQ ID NO: 2864682 - protein, 11 aa, Entamoeba invadens
IDQNRKERLDK

SEQ ID NO: 2864683 - protein, 12 aa, Entamoeba invadens
IDQNSGDNVQNS

SEQ ID NO: 2864684 - protein, 13 aa, Entamoeba invadens
IDQNVDNDQGFNN

SEQ ID NO: 2864685 - protein, 6 aa, Entamoeba invadens
IDQPAI

SEQ ID NO: 2864686 - protein, 78 aa, Entamoeba invadens
IDQPEEHDKQLENTEQQYKEETPEVTISTNENVEPQKEVQQEDIPKGEEGVPKEEQSFVEDSEVKETYKRKYSNPNQQ

SEQ ID NO: 2864687 - protein, 7 aa, Entamoeba invadens
IDQPHEP

SEQ ID NO: 2864688 - protein, 7 aa, Entamoeba invadens
IDQPQYG

SEQ ID NO: 2864689 - protein, 6 aa, Entamoeba invadens
IDQPSR

SEQ ID NO: 2864690 - protein, 11 aa, Entamoeba invadens
IDQQKNPTEEV

SEQ ID NO: 2864691 - protein, 6 aa, Entamoeba invadens
IDQQQE

SEQ ID NO: 2864692 - protein, 12 aa, Entamoeba invadens
IDQRGDLDSLFH

SEQ ID NO: 2864693 - protein, 7 aa, Entamoeba invadens
IDQTKTS

SEQ ID NO: 2864694 - protein, 4 aa, Entamoeba invadens
IDQY

SEQ ID NO: 2864695 - protein, 5 aa, Entamoeba invadens
IDRDL

SEQ ID NO: 2864696 - protein, 17 aa, Entamoeba invadens
IDREERREVSKKEGKVL

SEQ ID NO: 2864697 - protein, 9 aa, Entamoeba invadens
IDRGNGYEK

SEQ ID NO: 2864698 - protein, 38 aa, Entamoeba invadens
IDRHTKNRKSEKAEKKKRKSTDGNLDETIEKESVPQSL

SEQ ID NO: 2864699 - protein, 4 aa, Entamoeba invadens
IDRN

SEQ ID NO: 2864700 - protein, 5 aa, Entamoeba invadens
IDRNH

SEQ ID NO: 2864701 - protein, 9 aa, Entamoeba invadens
IDRPNQGFK

SEQ ID NO: 2864702 - protein, 18 aa, Entamoeba invadens
IDRSSIGDEEKKKQLDDY

SEQ ID NO: 2864703 - protein, 8 aa, Entamoeba invadens
IDRTKGTT

SEQ ID NO: 2864704 - protein, 8 aa, Entamoeba invadens
IDRTVKDR

SEQ ID NO: 2864705 - protein, 9 aa, Entamoeba invadens
IDSAGKNYL

SEQ ID NO: 2864706 - protein, 7 aa, Entamoeba invadens
IDSDGRL

SEQ ID NO: 2864707 - protein, 6 aa, Entamoeba invadens
IDSDNA

SEQ ID NO: 2864708 - protein, 20 aa, Entamoeba invadens
IDSDQRNVTKEEGMKKSYQL

SEQ ID NO: 2864709 - protein, 9 aa, Entamoeba invadens
IDSEETMKR

SEQ ID NO: 2864710 - protein, 6 aa, Entamoeba invadens
IDSEKV

SEQ ID NO: 2864711 - protein, 7 aa, Entamoeba invadens
IDSGDGV

SEQ ID NO: 2864712 - protein, 13 aa, Entamoeba invadens
IDSGKPKHDTRRK

SEQ ID NO: 2864713 - protein, 8 aa, Entamoeba invadens
IDSKASKL

SEQ ID NO: 2864714 - protein, 8 aa, Entamoeba invadens
IDSKEKQR

SEQ ID NO: 2864715 - protein, 6 aa, Entamoeba invadens
IDSLND

SEQ ID NO: 2864716 - protein, 5 aa, Entamoeba invadens
IDSNN

SEQ ID NO: 2864717 - protein, 9 aa, Entamoeba invadens
IDSPNSQSL

SEQ ID NO: 2864718 - protein, 4 aa, Entamoeba invadens
IDSQ

SEQ ID NO: 2864719 - protein, 18 aa, Entamoeba invadens
IDSQKSEVDEIRKQHEKD

SEQ ID NO: 2864720 - protein, 65 aa, Entamoeba invadens
IDSRPVRKELEAQARKRKKLSSKMRELEQQATKIEGDGEINSREQLRSLQKKAQKLTKTFSTKNG

SEQ ID NO: 2864721 - protein, 6 aa, Entamoeba invadens
IDSSDS

SEQ ID NO: 2864722 - protein, 5 aa, Entamoeba invadens
IDSSE

SEQ ID NO: 2864723 - protein, 29 aa, Entamoeba invadens
IDSSEESSEDSESEPKKKKKAVKKAPKPK

SEQ ID NO: 2864724 - protein, 6 aa, Entamoeba invadens
IDSSEH

SEQ ID NO: 2864725 - protein, 7 aa, Entamoeba invadens
IDSSSFQ

SEQ ID NO: 2864726 - protein, 10 aa, Entamoeba invadens
IDSTAKAERI

SEQ ID NO: 2864727 - protein, 7 aa, Entamoeba invadens
IDSTEEE

SEQ ID NO: 2864728 - protein, 7 aa, Entamoeba invadens
IDSTMTD

SEQ ID NO: 2864729 - protein, 10 aa, Entamoeba invadens
IDSTSENREC

SEQ ID NO: 2864730 - protein, 8 aa, Entamoeba invadens
IDSTTTPN

SEQ ID NO: 2864731 - protein, 8 aa, Entamoeba invadens
IDSVGKKT

SEQ ID NO: 2864732 - protein, 9 aa, Entamoeba invadens
IDSYGSNYI

SEQ ID NO: 2864733 - protein, 10 aa, Entamoeba invadens
IDTDKSGTID

SEQ ID NO: 2864734 - protein, 17 aa, Entamoeba invadens
IDTDNENKEFAPIFIFD

SEQ ID NO: 2864735 - protein, 4 aa, Entamoeba invadens
IDTE

SEQ ID NO: 2864736 - protein, 7 aa, Entamoeba invadens
IDTEKKE

SEQ ID NO: 2864737 - protein, 8 aa, Entamoeba invadens
IDTEPPPI

SEQ ID NO: 2864738 - protein, 23 aa, Entamoeba invadens
IDTETAKKSVSQVKAKSRGRTLS

SEQ ID NO: 2864739 - protein, 4 aa, Entamoeba invadens
IDTI

SEQ ID NO: 2864740 - protein, 5 aa, Entamoeba invadens
IDTIG

SEQ ID NO: 2864741 - protein, 4 aa, Entamoeba invadens
IDTK

SEQ ID NO: 2864742 - protein, 24 aa, Entamoeba invadens
IDTKLEENKEKKETTMPQNKTPMT

SEQ ID NO: 2864743 - protein, 9 aa, Entamoeba invadens
IDTKPYQDK

SEQ ID NO: 2864744 - protein, 13 aa, Entamoeba invadens
IDTKSRTVSREEG

SEQ ID NO: 2864745 - protein, 12 aa, Entamoeba invadens
IDTNNDGKLQYE

SEQ ID NO: 2864746 - protein, 16 aa, Entamoeba invadens
IDTNNREVSMQDGKEI

SEQ ID NO: 2864747 - protein, 5 aa, Entamoeba invadens
IDTNS

SEQ ID NO: 2864748 - protein, 12 aa, Entamoeba invadens
IDTPAEHQESVP

SEQ ID NO: 2864749 - protein, 22 aa, Entamoeba invadens
IDTPFNTPSKREDKQKGTPKVS

SEQ ID NO: 2864750 - protein, 6 aa, Entamoeba invadens
IDTQPN

SEQ ID NO: 2864751 - protein, 6 aa, Entamoeba invadens
IDTQQS

SEQ ID NO: 2864752 - protein, 5 aa, Entamoeba invadens
IDTSD

SEQ ID NO: 2864753 - protein, 9 aa, Entamoeba invadens
IDTSEVNKD

SEQ ID NO: 2864754 - protein, 11 aa, Entamoeba invadens
IDTSGDGKIQR

SEQ ID NO: 2864755 - protein, 6 aa, Entamoeba invadens
IDTSNE

SEQ ID NO: 2864756 - protein, 5 aa, Entamoeba invadens
IDTSR

SEQ ID NO: 2864757 - protein, 11 aa, Entamoeba invadens
IDTSRKEQLET

SEQ ID NO: 2864758 - protein, 4 aa, Entamoeba invadens
IDTT

SEQ ID NO: 2864759 - protein, 7 aa, Entamoeba invadens
IDTTDDR

SEQ ID NO: 2864760 - protein, 9 aa, Entamoeba invadens
IDTTGAGDA

SEQ ID NO: 2864761 - protein, 24 aa, Entamoeba invadens
IDTTNEKNFLETNKDKQKEANCFI

SEQ ID NO: 2864762 - protein, 6 aa, Entamoeba invadens
IDTTRD

SEQ ID NO: 2864763 - protein, 9 aa, Entamoeba invadens
IDTTTMTQA

SEQ ID NO: 2864764 - protein, 12 aa, Entamoeba invadens
IDTTTQQTTKLN

SEQ ID NO: 2864765 - protein, 13 aa, Entamoeba invadens
IDVEGTSEKTDEL

SEQ ID NO: 2864766 - protein, 9 aa, Entamoeba invadens
IDVNEKVPD

SEQ ID NO: 2864767 - protein, 8 aa, Entamoeba invadens
IDVPEASS

SEQ ID NO: 2864768 - protein, 9 aa, Entamoeba invadens
IDVPNSITS

SEQ ID NO: 2864769 - protein, 16 aa, Entamoeba invadens
IDVTPDDTFRDEKRNR

SEQ ID NO: 2864770 - protein, 11 aa, Entamoeba invadens
IDVTRSQQQQL

SEQ ID NO: 2864771 - protein, 33 aa, Entamoeba invadens
IDYEKTEKVWGSEEKDKRVKSIKKNSEKIESEL

SEQ ID NO: 2864772 - protein, 6 aa, Entamoeba invadens
IEAEDV

SEQ ID NO: 2864773 - protein, 22 aa, Entamoeba invadens
IEAEEKKASSPKLVDTAKTDEV

SEQ ID NO: 2864774 - protein, 7 aa, Entamoeba invadens
IEAEFTG

SEQ ID NO: 2864775 - protein, 8 aa, Entamoeba invadens
IEAGAPNN

SEQ ID NO: 2864776 - protein, 12 aa, Entamoeba invadens
IEAGDVGGTSDG

SEQ ID NO: 2864777 - protein, 23 aa, Entamoeba invadens
IEAKDSPALRRKNEEKEKKRRNV

SEQ ID NO: 2864778 - protein, 10 aa, Entamoeba invadens
IEAKESPIEI

SEQ ID NO: 2864779 - protein, 7 aa, Entamoeba invadens
IEAKSQY

SEQ ID NO: 2864780 - protein, 4 aa, Entamoeba invadens
IEAL

SEQ ID NO: 2864781 - protein, 9 aa, Entamoeba invadens
IEALPDENK

SEQ ID NO: 2864782 - protein, 15 aa, Entamoeba invadens
IEANEQTDLKTDFDQ

SEQ ID NO: 2864783 - protein, 21 aa, Entamoeba invadens
IEAPKREKKARAAPSKPEDDL

SEQ ID NO: 2864784 - protein, 7 aa, Entamoeba invadens
IEAPQVP

SEQ ID NO: 2864785 - protein, 12 aa, Entamoeba invadens
IEASGAKGNPML

SEQ ID NO: 2864786 - protein, 20 aa, Entamoeba invadens
IEASKTKTKIPASQSLHGKM

SEQ ID NO: 2864787 - protein, 8 aa, Entamoeba invadens
IEASSGKV

SEQ ID NO: 2864788 - protein, 4 aa, Entamoeba invadens
IEAT

SEQ ID NO: 2864789 - protein, 8 aa, Entamoeba invadens
IEATNKNM

SEQ ID NO: 2864790 - protein, 32 aa, Entamoeba invadens
IECEKEKEIVEAKKEEKKAKKEKKEKRRRNTI

SEQ ID NO: 2864791 - protein, 18 aa, Entamoeba invadens
IEDANEKAQREENEGKRM

SEQ ID NO: 2864792 - protein, 5 aa, Entamoeba invadens
IEDAS

SEQ ID NO: 2864793 - protein, 15 aa, Entamoeba invadens
IEDDEEEGDESDEWS

SEQ ID NO: 2864794 - protein, 8 aa, Entamoeba invadens
IEDDIAKG

SEQ ID NO: 2864795 - protein, 11 aa, Entamoeba invadens
IEDDIPPHANE

SEQ ID NO: 2864796 - protein, 17 aa, Entamoeba invadens
IEDDKKEANTKEKGTVE

SEQ ID NO: 2864797 - protein, 12 aa, Entamoeba invadens
IEDDKKMPKPLK

SEQ ID NO: 2864798 - protein, 10 aa, Entamoeba invadens
IEDDKKYEVQ

SEQ ID NO: 2864799 - protein, 6 aa, Entamoeba invadens
IEDDRT

SEQ ID NO: 2864800 - protein, 14 aa, Entamoeba invadens
IEDEARKFTKGSGI

SEQ ID NO: 2864801 - protein, 82 aa, Entamoeba invadens
IEDEKQKELEEKKRAIEEERKAREEAERVRKENEDKEIARKEAEEKARREEFEKKRKDAEEERNKKAREDMERYQKEKAARL

SEQ ID NO: 2864802 - protein, 11 aa, Entamoeba invadens
IEDEQKEKERV

SEQ ID NO: 2864803 - protein, 11 aa, Entamoeba invadens
IEDERKAHADT

SEQ ID NO: 2864804 - protein, 10 aa, Entamoeba invadens
IEDGETHTLT

SEQ ID NO: 2864805 - protein, 6 aa, Entamoeba invadens
IEDGGD

SEQ ID NO: 2864806 - protein, 10 aa, Entamoeba invadens
IEDGGTEGRA

SEQ ID NO: 2864807 - protein, 35 aa, Entamoeba invadens
IEDGLNDSDKDAQEKQLSQLKADNDNLTKAKSVVD

SEQ ID NO: 2864808 - protein, 5 aa, Entamoeba invadens
IEDIE

SEQ ID NO: 2864809 - protein, 6 aa, Entamoeba invadens
IEDIGE

SEQ ID NO: 2864810 - protein, 17 aa, Entamoeba invadens
IEDKATKAKTPKKKCVI

SEQ ID NO: 2864811 - protein, 8 aa, Entamoeba invadens
IEDKDDTN

SEQ ID NO: 2864812 - protein, 11 aa, Entamoeba invadens
IEDKEGEISDL

SEQ ID NO: 2864813 - protein, 14 aa, Entamoeba invadens
IEDLTKENGELKKK

SEQ ID NO: 2864814 - protein, 10 aa, Entamoeba invadens
IEDMESEISD

SEQ ID NO: 2864815 - protein, 11 aa, Entamoeba invadens
IEDMESEISDL

SEQ ID NO: 2864816 - protein, 91 aa, Entamoeba invadens
IEDNNEESNDEDNESESIQKEEEEKEEEQQNDEEHEENEENEENEENEENEEEEMKSNEDNKSQSMEEEHQDETKEKHQKPNPKRGRRSKL

SEQ ID NO: 2864817 - protein, 6 aa, Entamoeba invadens
IEDNTA

SEQ ID NO: 2864818 - protein, 14 aa, Entamoeba invadens
IEDPKTFQLTRINW

SEQ ID NO: 2864819 - protein, 7 aa, Entamoeba invadens
IEDPPRR

SEQ ID NO: 2864820 - protein, 7 aa, Entamoeba invadens
IEDPTNT

SEQ ID NO: 2864821 - protein, 7 aa, Entamoeba invadens
IEDQGLR

SEQ ID NO: 2864822 - protein, 15 aa, Entamoeba invadens
IEDRNSIKDEVENKR

SEQ ID NO: 2864823 - protein, 16 aa, Entamoeba invadens
IEDSDTFIGNNASKLT

SEQ ID NO: 2864824 - protein, 9 aa, Entamoeba invadens
IEDSKYEAQ

SEQ ID NO: 2864825 - protein, 9 aa, Entamoeba invadens
IEDSSYENI

SEQ ID NO: 2864826 - protein, 19 aa, Entamoeba invadens
IEDTQKEIKDLKSQQKETE

SEQ ID NO: 2864827 - protein, 4 aa, Entamoeba invadens
IEDV

SEQ ID NO: 2864828 - protein, 7 aa, Entamoeba invadens
IEDYRTK

SEQ ID NO: 2864829 - protein, 7 aa, Entamoeba invadens
IEEARES

SEQ ID NO: 2864830 - protein, 25 aa, Entamoeba invadens
IEEARKHDARDTENERIEKEEKIKA

SEQ ID NO: 2864831 - protein, 5 aa, Entamoeba invadens
IEECE

SEQ ID NO: 2864832 - protein, 6 aa, Entamoeba invadens
IEEDDC

SEQ ID NO: 2864833 - protein, 12 aa, Entamoeba invadens
IEEDDGKREKKS

SEQ ID NO: 2864834 - protein, 5 aa, Entamoeba invadens
IEEDE

SEQ ID NO: 2864835 - protein, 10 aa, Entamoeba invadens
IEEDKGYTIE

SEQ ID NO: 2864836 - protein, 6 aa, Entamoeba invadens
IEEDPE

SEQ ID NO: 2864837 - protein, 9 aa, Entamoeba invadens
IEEDTQRRL

SEQ ID NO: 2864838 - protein, 26 aa, Entamoeba invadens
IEEDYKSPNTLNTRFQSSEDDVTQDE

SEQ ID NO: 2864839 - protein, 4 aa, Entamoeba invadens
IEEE

SEQ ID NO: 2864840 - protein, 26 aa, Entamoeba invadens
IEEEEAQKRAEKHRRSEVKTRRGGIT

SEQ ID NO: 2864841 - protein, 7 aa, Entamoeba invadens
IEEEEKE

SEQ ID NO: 2864842 - protein, 18 aa, Entamoeba invadens
IEEEERQAQEKEEQERRA

SEQ ID NO: 2864843 - protein, 6 aa, Entamoeba invadens
IEEEKA

SEQ ID NO: 2864844 - protein, 6 aa, Entamoeba invadens
IEEEKN

SEQ ID NO: 2864845 - protein, 6 aa, Entamoeba invadens
IEEEKS

SEQ ID NO: 2864846 - protein, 5 aa, Entamoeba invadens
IEEEN

SEQ ID NO: 2864847 - protein, 90 aa, Entamoeba invadens
IEEENSEESENNDEEEEEENDTSDMESSSSDEEENDKESKKQHKKVKKVDETAIEDKEEKLKPKKHQKRKQIEEESSDEENEAKNKRKLR

SEQ ID NO: 2864848 - protein, 10 aa, Entamoeba invadens
IEEEREKYSE

SEQ ID NO: 2864849 - protein, 11 aa, Entamoeba invadens
IEEETEEEQHQ

SEQ ID NO: 2864850 - protein, 8 aa, Entamoeba invadens
IEEETNKT

SEQ ID NO: 2864851 - protein, 17 aa, Entamoeba invadens
IEEETPKNVTPPMTPPI

SEQ ID NO: 2864852 - protein, 4 aa, Entamoeba invadens
IEEF

SEQ ID NO: 2864853 - protein, 6 aa, Entamoeba invadens
IEEGEK

SEQ ID NO: 2864854 - protein, 13 aa, Entamoeba invadens
IEEIEKEKKEAHE

SEQ ID NO: 2864855 - protein, 4 aa, Entamoeba invadens
IEEK

SEQ ID NO: 2864856 - protein, 7 aa, Entamoeba invadens
IEEKDKK

SEQ ID NO: 2864857 - protein, 15 aa, Entamoeba invadens
IEEKDKNIQSIYYCG

SEQ ID NO: 2864858 - protein, 27 aa, Entamoeba invadens
IEEKEGELKKATQKIEENEKIKKEFEE

SEQ ID NO: 2864859 - protein, 28 aa, Entamoeba invadens
IEEKEGELKKATQKIEESDKEKKEFEEK

SEQ ID NO: 2864860 - protein, 7 aa, Entamoeba invadens
IEEKEIR

SEQ ID NO: 2864861 - protein, 10 aa, Entamoeba invadens
IEEKEKSGWG

SEQ ID NO: 2864862 - protein, 7 aa, Entamoeba invadens
IEEKGVK

SEQ ID NO: 2864863 - protein, 6 aa, Entamoeba invadens
IEEKKR

SEQ ID NO: 2864864 - protein, 20 aa, Entamoeba invadens
IEEKPKRKRGRPRKVPKEEN

SEQ ID NO: 2864865 - protein, 7 aa, Entamoeba invadens
IEEKQKE

SEQ ID NO: 2864866 - protein, 9 aa, Entamoeba invadens
IEEKSREDI

SEQ ID NO: 2864867 - protein, 17 aa, Entamoeba invadens
IEEKTTSNTQRLEGAEG

SEQ ID NO: 2864868 - protein, 4 aa, Entamoeba invadens
IEEL

SEQ ID NO: 2864869 - protein, 9 aa, Entamoeba invadens
IEELDEKER

SEQ ID NO: 2864870 - protein, 15 aa, Entamoeba invadens
IEELENEPKNPRTMT

SEQ ID NO: 2864871 - protein, 5 aa, Entamoeba invadens
IEEND

SEQ ID NO: 2864872 - protein, 12 aa, Entamoeba invadens
IEENENKNLNGK

SEQ ID NO: 2864873 - protein, 6 aa, Entamoeba invadens
IEENER

SEQ ID NO: 2864874 - protein, 10 aa, Entamoeba invadens
IEENNEEKNH

SEQ ID NO: 2864875 - protein, 10 aa, Entamoeba invadens
IEEPKETSVE

SEQ ID NO: 2864876 - protein, 18 aa, Entamoeba invadens
IEEQEKLNAMKDGNIQNL

SEQ ID NO: 2864877 - protein, 20 aa, Entamoeba invadens
IEEQKQEEVIQPNAEQPLEE

SEQ ID NO: 2864878 - protein, 10 aa, Entamoeba invadens
IEEQRNKKII

SEQ ID NO: 2864879 - protein, 4 aa, Entamoeba invadens
IEER

SEQ ID NO: 2864880 - protein, 8 aa, Entamoeba invadens
IEERDGEI

SEQ ID NO: 2864881 - protein, 7 aa, Entamoeba invadens
IEEREEF

SEQ ID NO: 2864882 - protein, 16 aa, Entamoeba invadens
IEERGKKDKESQAEFE

SEQ ID NO: 2864883 - protein, 23 aa, Entamoeba invadens
IEERKDKVEVKEEKVSVENKMDE

SEQ ID NO: 2864884 - protein, 6 aa, Entamoeba invadens
IEERMK

SEQ ID NO: 2864885 - protein, 8 aa, Entamoeba invadens
IEERQNSL

SEQ ID NO: 2864886 - protein, 6 aa, Entamoeba invadens
IEERYS

SEQ ID NO: 2864887 - protein, 4 aa, Entamoeba invadens
IEES

SEQ ID NO: 2864888 - protein, 6 aa, Entamoeba invadens
IEESDI

SEQ ID NO: 2864889 - protein, 20 aa, Entamoeba invadens
IEESDKSSRISDENSEIRTN

SEQ ID NO: 2864890 - protein, 13 aa, Entamoeba invadens
IEESDSKDVIVID

SEQ ID NO: 2864891 - protein, 5 aa, Entamoeba invadens
IEESE

SEQ ID NO: 2864892 - protein, 13 aa, Entamoeba invadens
IEESENEKNRNDI

SEQ ID NO: 2864893 - protein, 9 aa, Entamoeba invadens
IEESGDVES

SEQ ID NO: 2864894 - protein, 22 aa, Entamoeba invadens
IEESKEQKEKRIKEWSEYVEKQ

SEQ ID NO: 2864895 - protein, 13 aa, Entamoeba invadens
IEESKKKREGFAT

SEQ ID NO: 2864896 - protein, 9 aa, Entamoeba invadens
IEESKPDRI

SEQ ID NO: 2864897 - protein, 44 aa, Entamoeba invadens
IEESKTPELIEDKNDSGDILEKSGDTNKTEKLEAEKEEKNEQQK

SEQ ID NO: 2864898 - protein, 5 aa, Entamoeba invadens
IEESS

SEQ ID NO: 2864899 - protein, 22 aa, Entamoeba invadens
IEESSEDYQTVEQIGEDNTLQN

SEQ ID NO: 2864900 - protein, 12 aa, Entamoeba invadens
IEESYKTSLTVD

SEQ ID NO: 2864901 - protein, 4 aa, Entamoeba invadens
IEET

SEQ ID NO: 2864902 - protein, 17 aa, Entamoeba invadens
IEETENKKTSHLEKEIN

SEQ ID NO: 2864903 - protein, 8 aa, Entamoeba invadens
IEETEPQF

SEQ ID NO: 2864904 - protein, 21 aa, Entamoeba invadens
IEETHKEEKGREEKLEEESHV

SEQ ID NO: 2864905 - protein, 5 aa, Entamoeba invadens
IEETK

SEQ ID NO: 2864906 - protein, 16 aa, Entamoeba invadens
IEETKKRNETTYLFPH

SEQ ID NO: 2864907 - protein, 7 aa, Entamoeba invadens
IEETKQK

SEQ ID NO: 2864908 - protein, 5 aa, Entamoeba invadens
IEETP

SEQ ID NO: 2864909 - protein, 13 aa, Entamoeba invadens
IEETPQEEKHGEV

SEQ ID NO: 2864910 - protein, 7 aa, Entamoeba invadens
IEETQKD

SEQ ID NO: 2864911 - protein, 12 aa, Entamoeba invadens
IEETRTNKVRPI

SEQ ID NO: 2864912 - protein, 5 aa, Entamoeba invadens
IEETV

SEQ ID NO: 2864913 - protein, 20 aa, Entamoeba invadens
IEEYQGDKKLEAKEDNSKYL

SEQ ID NO: 2864914 - protein, 5 aa, Entamoeba invadens
IEFGE

SEQ ID NO: 2864915 - protein, 12 aa, Entamoeba invadens
IEGCSAQPVEIQ

SEQ ID NO: 2864916 - protein, 4 aa, Entamoeba invadens
IEGD

SEQ ID NO: 2864917 - protein, 6 aa, Entamoeba invadens
IEGDEK

SEQ ID NO: 2864918 - protein, 16 aa, Entamoeba invadens
IEGDERFGTDGSAFPI

SEQ ID NO: 2864919 - protein, 10 aa, Entamoeba invadens
IEGEEEVCEE

SEQ ID NO: 2864920 - protein, 7 aa, Entamoeba invadens
IEGESTE

SEQ ID NO: 2864921 - protein, 4 aa, Entamoeba invadens
IEGG

SEQ ID NO: 2864922 - protein, 5 aa, Entamoeba invadens
IEGGE

SEQ ID NO: 2864923 - protein, 5 aa, Entamoeba invadens
IEGGI

SEQ ID NO: 2864924 - protein, 8 aa, Entamoeba invadens
IEGGNTNK

SEQ ID NO: 2864925 - protein, 5 aa, Entamoeba invadens
IEGGQ

SEQ ID NO: 2864926 - protein, 4 aa, Entamoeba invadens
IEGK

SEQ ID NO: 2864927 - protein, 27 aa, Entamoeba invadens
IEGKAQKNISPFPQKLGEKVEKEDKDD

SEQ ID NO: 2864928 - protein, 8 aa, Entamoeba invadens
IEGKGNGI

SEQ ID NO: 2864929 - protein, 8 aa, Entamoeba invadens
IEGKRERK

SEQ ID NO: 2864930 - protein, 4 aa, Entamoeba invadens
IEGL

SEQ ID NO: 2864931 - protein, 5 aa, Entamoeba invadens
IEGLE

SEQ ID NO: 2864932 - protein, 21 aa, Entamoeba invadens
IEGLKQSQPAQEKEQKPEENV

SEQ ID NO: 2864933 - protein, 7 aa, Entamoeba invadens
IEGLQEE

SEQ ID NO: 2864934 - protein, 10 aa, Entamoeba invadens
IEGMESEISD

SEQ ID NO: 2864935 - protein, 4 aa, Entamoeba invadens
IEGN

SEQ ID NO: 2864936 - protein, 5 aa, Entamoeba invadens
IEGNK

SEQ ID NO: 2864937 - protein, 8 aa, Entamoeba invadens
IEGNPSQG

SEQ ID NO: 2864938 - protein, 11 aa, Entamoeba invadens
IEGNYTDTVTP

SEQ ID NO: 2864939 - protein, 10 aa, Entamoeba invadens
IEGQNGKSLK

SEQ ID NO: 2864940 - protein, 4 aa, Entamoeba invadens
IEGR

SEQ ID NO: 2864941 - protein, 8 aa, Entamoeba invadens
IEGRRKEK

SEQ ID NO: 2864942 - protein, 10 aa, Entamoeba invadens
IEGSPDKPFE

SEQ ID NO: 2864943 - protein, 18 aa, Entamoeba invadens
IEGTTQEEECESDSYTIS

SEQ ID NO: 2864944 - protein, 21 aa, Entamoeba invadens
IEGVQAEQGQIPFKETNQEVE

SEQ ID NO: 2864945 - protein, 14 aa, Entamoeba invadens
IEHDQKDLQEKITE

SEQ ID NO: 2864946 - protein, 5 aa, Entamoeba invadens
IEHNK

SEQ ID NO: 2864947 - protein, 7 aa, Entamoeba invadens
IEHTNGR

SEQ ID NO: 2864948 - protein, 9 aa, Entamoeba invadens
IEIDGKDKT

SEQ ID NO: 2864949 - protein, 8 aa, Entamoeba invadens
IEIEESKP

SEQ ID NO: 2864950 - protein, 7 aa, Entamoeba invadens
IEIESGN

SEQ ID NO: 2864951 - protein, 11 aa, Entamoeba invadens
IEIPSSKENGY

SEQ ID NO: 2864952 - protein, 22 aa, Entamoeba invadens
IEIQRKKEEYERKIREEGGQVE

SEQ ID NO: 2864953 - protein, 21 aa, Entamoeba invadens
IEISKTQSVKDSIERDTLTTK

SEQ ID NO: 2864954 - protein, 9 aa, Entamoeba invadens
IEITPEQKN

SEQ ID NO: 2864955 - protein, 60 aa, Entamoeba invadens
IEKAEEEQSDNEEESFNNEQLEDDENRETKQPKKKVVKKRSTKKVAKCKKATKDESDSTS

SEQ ID NO: 2864956 - protein, 13 aa, Entamoeba invadens
IEKAEEKPAEKRV

SEQ ID NO: 2864957 - protein, 11 aa, Entamoeba invadens
IEKAPKEDKFK

SEQ ID NO: 2864958 - protein, 20 aa, Entamoeba invadens
IEKAQKDKKADKKKEKQNKK

SEQ ID NO: 2864959 - protein, 14 aa, Entamoeba invadens
IEKDGKRLCFLCSK

SEQ ID NO: 2864960 - protein, 7 aa, Entamoeba invadens
IEKDNTS

SEQ ID NO: 2864961 - protein, 9 aa, Entamoeba invadens
IEKDPTKKV

SEQ ID NO: 2864962 - protein, 11 aa, Entamoeba invadens
IEKDSEGKEVV

SEQ ID NO: 2864963 - protein, 38 aa, Entamoeba invadens
IEKDSEMQEVAPSKPKPKAKTQTHKGVSKIDDKKDDIR

SEQ ID NO: 2864964 - protein, 7 aa, Entamoeba invadens
IEKEDDL

SEQ ID NO: 2864965 - protein, 9 aa, Entamoeba invadens
IEKEEEKSI

SEQ ID NO: 2864966 - protein, 40 aa, Entamoeba invadens
IEKEEKPKKAAPSRKRKTKEKELEKVTTQPVPSQGDMEEQ

SEQ ID NO: 2864967 - protein, 10 aa, Entamoeba invadens
IEKEESEDIN

SEQ ID NO: 2864968 - protein, 25 aa, Entamoeba invadens
IEKEITAEMQNKTKISDKTETTQID

SEQ ID NO: 2864969 - protein, 9 aa, Entamoeba invadens
IEKELSEKC

SEQ ID NO: 2864970 - protein, 11 aa, Entamoeba invadens
IEKEQNKQLNT

SEQ ID NO: 2864971 - protein, 8 aa, Entamoeba invadens
IEKEQNNI

SEQ ID NO: 2864972 - protein, 7 aa, Entamoeba invadens
IEKERQQ

SEQ ID NO: 2864973 - protein, 7 aa, Entamoeba invadens
IEKETNA

SEQ ID NO: 2864974 - protein, 10 aa, Entamoeba invadens
IEKEYKKPHM

SEQ ID NO: 2864975 - protein, 7 aa, Entamoeba invadens
IEKGDDT

SEQ ID NO: 2864976 - protein, 7 aa, Entamoeba invadens
IEKGNAV

SEQ ID NO: 2864977 - protein, 6 aa, Entamoeba invadens
IEKGNG

SEQ ID NO: 2864978 - protein, 10 aa, Entamoeba invadens
IEKGPQPNYK

SEQ ID NO: 2864979 - protein, 10 aa, Entamoeba invadens
IEKGSGENGV

SEQ ID NO: 2864980 - protein, 8 aa, Entamoeba invadens
IEKGSQEP

SEQ ID NO: 2864981 - protein, 11 aa, Entamoeba invadens
IEKHKKKEFDA

SEQ ID NO: 2864982 - protein, 7 aa, Entamoeba invadens
IEKIGED

SEQ ID NO: 2864983 - protein, 8 aa, Entamoeba invadens
IEKKEQDN

SEQ ID NO: 2864984 - protein, 13 aa, Entamoeba invadens
IEKKKDKKMIPKN

SEQ ID NO: 2864985 - protein, 9 aa, Entamoeba invadens
IEKKNLGKE

SEQ ID NO: 2864986 - protein, 22 aa, Entamoeba invadens
IEKNEKVEKKAMEEDDKEEQNV

SEQ ID NO: 2864987 - protein, 8 aa, Entamoeba invadens
IEKNENRQ

SEQ ID NO: 2864988 - protein, 13 aa, Entamoeba invadens
IEKNKKVSDNKKA

SEQ ID NO: 2864989 - protein, 5 aa, Entamoeba invadens
IEKNN

SEQ ID NO: 2864990 - protein, 9 aa, Entamoeba invadens
IEKPKESSV

SEQ ID NO: 2864991 - protein, 4 aa, Entamoeba invadens
IEKQ

SEQ ID NO: 2864992 - protein, 8 aa, Entamoeba invadens
IEKQENVT

SEQ ID NO: 2864993 - protein, 32 aa, Entamoeba invadens
IEKQGEGSVTPSADKIEKKETQEETIQESPEM

SEQ ID NO: 2864994 - protein, 20 aa, Entamoeba invadens
IEKQGNIQTSSVDSFQGSEK

SEQ ID NO: 2864995 - protein, 10 aa, Entamoeba invadens
IEKQKNEATT

SEQ ID NO: 2864996 - protein, 7 aa, Entamoeba invadens
IEKQTIP

SEQ ID NO: 2864997 - protein, 9 aa, Entamoeba invadens
IEKSKEKYL

SEQ ID NO: 2864998 - protein, 11 aa, Entamoeba invadens
IEKSKTAKTFT

SEQ ID NO: 2864999 - protein, 33 aa, Entamoeba invadens
IEKSKTANAPEKKIKSLEEKRDHLKEKEEEQNK

SEQ ID NO: 2865000 - protein, 28 aa, Entamoeba invadens
IEKSQKNDEKRQRNEKRRKEGREQRKAR

SEQ ID NO: 2865001 - protein, 11 aa, Entamoeba invadens
IEKSSSEEETF

SEQ ID NO: 2865002 - protein, 16 aa, Entamoeba invadens
IEKSSTNDLDTSEIDT

SEQ ID NO: 2865003 - protein, 7 aa, Entamoeba invadens
IEKSTNN

SEQ ID NO: 2865004 - protein, 46 aa, Entamoeba invadens
IEKSTPSSVVQSKNYTPLPKKQPPAEPEWKRKQREAEEKKKEMQEK

SEQ ID NO: 2865005 - protein, 39 aa, Entamoeba invadens
IEKTATSKTPVPSSKTPFKPKTPVPKTPSPLPSTPRNMP

SEQ ID NO: 2865006 - protein, 11 aa, Entamoeba invadens
IEKTEKTETLV

SEQ ID NO: 2865007 - protein, 12 aa, Entamoeba invadens
IEKTGNPKEDLQ

SEQ ID NO: 2865008 - protein, 5 aa, Entamoeba invadens
IEKTT

SEQ ID NO: 2865009 - protein, 8 aa, Entamoeba invadens
IEKTTDKT

SEQ ID NO: 2865010 - protein, 10 aa, Entamoeba invadens
IEKTVKADSR

SEQ ID NO: 2865011 - protein, 14 aa, Entamoeba invadens
IEKVEAQKQNSSAV

SEQ ID NO: 2865012 - protein, 6 aa, Entamoeba invadens
IEKYAG

SEQ ID NO: 2865013 - protein, 9 aa, Entamoeba invadens
IEKYTSDGM

SEQ ID NO: 2865014 - protein, 4 aa, Entamoeba invadens
IELD

SEQ ID NO: 2865015 - protein, 4 aa, Entamoeba invadens
IELE

SEQ ID NO: 2865016 - protein, 4 aa, Entamoeba invadens
IELP

SEQ ID NO: 2865017 - protein, 7 aa, Entamoeba invadens
IELTEDT

SEQ ID NO: 2865018 - protein, 13 aa, Entamoeba invadens
IELTKQKKQSKLS

SEQ ID NO: 2865019 - protein, 5 aa, Entamoeba invadens
IEMKT

SEQ ID NO: 2865020 - protein, 5 aa, Entamoeba invadens
IENAK

SEQ ID NO: 2865021 - protein, 6 aa, Entamoeba invadens
IENAKG

SEQ ID NO: 2865022 - protein, 18 aa, Entamoeba invadens
IENAQNRNSELKRQIEYL

SEQ ID NO: 2865023 - protein, 6 aa, Entamoeba invadens
IENATP

SEQ ID NO: 2865024 - protein, 4 aa, Entamoeba invadens
IEND

SEQ ID NO: 2865025 - protein, 11 aa, Entamoeba invadens
IENDDKTATRR

SEQ ID NO: 2865026 - protein, 16 aa, Entamoeba invadens
IENDEEKSTNDTEKAK

SEQ ID NO: 2865027 - protein, 9 aa, Entamoeba invadens
IENDEKKNL

SEQ ID NO: 2865028 - protein, 15 aa, Entamoeba invadens
IENDIKKDKSVDTKQ

SEQ ID NO: 2865029 - protein, 13 aa, Entamoeba invadens
IENDQKREKREYP

SEQ ID NO: 2865030 - protein, 13 aa, Entamoeba invadens
IENEDGSTDSEDC

SEQ ID NO: 2865031 - protein, 20 aa, Entamoeba invadens
IENEDNENSDSLAEKAWKNK

SEQ ID NO: 2865032 - protein, 10 aa, Entamoeba invadens
IENEKTNDCI

SEQ ID NO: 2865033 - protein, 19 aa, Entamoeba invadens
IENELNDSDMLKAQKADYE

SEQ ID NO: 2865034 - protein, 11 aa, Entamoeba invadens
IENETKNKNIE

SEQ ID NO: 2865035 - protein, 4 aa, Entamoeba invadens
IENG

SEQ ID NO: 2865036 - protein, 7 aa, Entamoeba invadens
IENGDEN

SEQ ID NO: 2865037 - protein, 6 aa, Entamoeba invadens
IENGEK

SEQ ID NO: 2865038 - protein, 5 aa, Entamoeba invadens
IENGN

SEQ ID NO: 2865039 - protein, 14 aa, Entamoeba invadens
IENGNGVNHNNSQK

SEQ ID NO: 2865040 - protein, 12 aa, Entamoeba invadens
IENGRTNQCDNG

SEQ ID NO: 2865041 - protein, 10 aa, Entamoeba invadens
IENGSGSITG

SEQ ID NO: 2865042 - protein, 5 aa, Entamoeba invadens
IENGT

SEQ ID NO: 2865043 - protein, 5 aa, Entamoeba invadens
IENIP

SEQ ID NO: 2865044 - protein, 28 aa, Entamoeba invadens
IENKDTLKYSADSTDDKEHCKSPQNENS

SEQ ID NO: 2865045 - protein, 6 aa, Entamoeba invadens
IENKEN

SEQ ID NO: 2865046 - protein, 10 aa, Entamoeba invadens
IENKNEEALN

SEQ ID NO: 2865047 - protein, 13 aa, Entamoeba invadens
IENKTNEKLPSAF

SEQ ID NO: 2865048 - protein, 4 aa, Entamoeba invadens
IENM

SEQ ID NO: 2865049 - protein, 8 aa, Entamoeba invadens
IENNAPET

SEQ ID NO: 2865050 - protein, 7 aa, Entamoeba invadens
IENNESH

SEQ ID NO: 2865051 - protein, 6 aa, Entamoeba invadens
IENNKI

SEQ ID NO: 2865052 - protein, 11 aa, Entamoeba invadens
IENPDDKSKLR

SEQ ID NO: 2865053 - protein, 5 aa, Entamoeba invadens
IENPE

SEQ ID NO: 2865054 - protein, 7 aa, Entamoeba invadens
IENPSKC

SEQ ID NO: 2865055 - protein, 10 aa, Entamoeba invadens
IENPTSDANC

SEQ ID NO: 2865056 - protein, 20 aa, Entamoeba invadens
IENQDEDVENEEQFDPDNNF

SEQ ID NO: 2865057 - protein, 12 aa, Entamoeba invadens
IENSEVETDSLK

SEQ ID NO: 2865058 - protein, 7 aa, Entamoeba invadens
IENTDIA

SEQ ID NO: 2865059 - protein, 7 aa, Entamoeba invadens
IENTEEA

SEQ ID NO: 2865060 - protein, 26 aa, Entamoeba invadens
IENTQVKNDQHKVDSGLEEQKESDFS

SEQ ID NO: 2865061 - protein, 9 aa, Entamoeba invadens
IENTSNGYK

SEQ ID NO: 2865062 - protein, 5 aa, Entamoeba invadens
IENVN

SEQ ID NO: 2865063 - protein, 6 aa, Entamoeba invadens
IENVNE

SEQ ID NO: 2865064 - protein, 6 aa, Entamoeba invadens
IEPAKL

SEQ ID NO: 2865065 - protein, 13 aa, Entamoeba invadens
IEPDEAKWKVESI

SEQ ID NO: 2865066 - protein, 96 aa, Entamoeba invadens
IEPERAERDYTKIEKEKDRRDDRKDSRNRERTTRHSRSRERDRDRDRDRSSRRSRSRERDRDRSRRDRDRDHSRDRRRRSRSPPGRSSRSNRDRSR

SEQ ID NO: 2865067 - protein, 7 aa, Entamoeba invadens
IEPFQPD

SEQ ID NO: 2865068 - protein, 4 aa, Entamoeba invadens
IEPG

SEQ ID NO: 2865069 - protein, 4 aa, Entamoeba invadens
IEPK

SEQ ID NO: 2865070 - protein, 7 aa, Entamoeba invadens
IEPKDTA

SEQ ID NO: 2865071 - protein, 9 aa, Entamoeba invadens
IEPKQRTSF

SEQ ID NO: 2865072 - protein, 9 aa, Entamoeba invadens
IEPKSPRGI

SEQ ID NO: 2865073 - protein, 6 aa, Entamoeba invadens
IEPKTD

SEQ ID NO: 2865074 - protein, 9 aa, Entamoeba invadens
IEPKVEKKE

SEQ ID NO: 2865075 - protein, 17 aa, Entamoeba invadens
IEPLNDKPVTKRNNPNF

SEQ ID NO: 2865076 - protein, 4 aa, Entamoeba invadens
IEPN

SEQ ID NO: 2865077 - protein, 22 aa, Entamoeba invadens
IEPNDKFTKVEDAYKKEVEQEE

SEQ ID NO: 2865078 - protein, 6 aa, Entamoeba invadens
IEPNPH

SEQ ID NO: 2865079 - protein, 10 aa, Entamoeba invadens
IEPNPTHETC

SEQ ID NO: 2865080 - protein, 5 aa, Entamoeba invadens
IEPNT

SEQ ID NO: 2865081 - protein, 12 aa, Entamoeba invadens
IEPPKELQENKE

SEQ ID NO: 2865082 - protein, 9 aa, Entamoeba invadens
IEPPKTNGG

SEQ ID NO: 2865083 - protein, 9 aa, Entamoeba invadens
IEPPQVQPN

SEQ ID NO: 2865084 - protein, 4 aa, Entamoeba invadens
IEPQ

SEQ ID NO: 2865085 - protein, 6 aa, Entamoeba invadens
IEPRTF

SEQ ID NO: 2865086 - protein, 18 aa, Entamoeba invadens
IEPSKTKTHATLKNDDVG

SEQ ID NO: 2865087 - protein, 17 aa, Entamoeba invadens
IEPSKTKTRAKLKTENV

SEQ ID NO: 2865088 - protein, 6 aa, Entamoeba invadens
IEPSPI

SEQ ID NO: 2865089 - protein, 7 aa, Entamoeba invadens
IEPTSEL

SEQ ID NO: 2865090 - protein, 4 aa, Entamoeba invadens
IEPV

SEQ ID NO: 2865091 - protein, 15 aa, Entamoeba invadens
IEPVESYNTDKNKFY

SEQ ID NO: 2865092 - protein, 8 aa, Entamoeba invadens
IEQDNTLD

SEQ ID NO: 2865093 - protein, 28 aa, Entamoeba invadens
IEQEKDTKQTIEDQKKEVEKIQQEINEK

SEQ ID NO: 2865094 - protein, 13 aa, Entamoeba invadens
IEQEKNKSYDDLK

SEQ ID NO: 2865095 - protein, 6 aa, Entamoeba invadens
IEQGTE

SEQ ID NO: 2865096 - protein, 7 aa, Entamoeba invadens
IEQKNDD

SEQ ID NO: 2865097 - protein, 6 aa, Entamoeba invadens
IEQLTG

SEQ ID NO: 2865098 - protein, 4 aa, Entamoeba invadens
IEQM

SEQ ID NO: 2865099 - protein, 4 aa, Entamoeba invadens
IEQN

SEQ ID NO: 2865100 - protein, 6 aa, Entamoeba invadens
IEQNEP

SEQ ID NO: 2865101 - protein, 5 aa, Entamoeba invadens
IEQNG

SEQ ID NO: 2865102 - protein, 5 aa, Entamoeba invadens
IEQNT

SEQ ID NO: 2865103 - protein, 5 aa, Entamoeba invadens
IEQPS

SEQ ID NO: 2865104 - protein, 8 aa, Entamoeba invadens
IEQQSKYI

SEQ ID NO: 2865105 - protein, 10 aa, Entamoeba invadens
IEQRKSQGKK

SEQ ID NO: 2865106 - protein, 8 aa, Entamoeba invadens
IEQSETVK

SEQ ID NO: 2865107 - protein, 20 aa, Entamoeba invadens
IEQSPQQLHQSESVTNNTGT

SEQ ID NO: 2865108 - protein, 4 aa, Entamoeba invadens
IEQT

SEQ ID NO: 2865109 - protein, 7 aa, Entamoeba invadens
IEQTASQ

SEQ ID NO: 2865110 - protein, 9 aa, Entamoeba invadens
IEQTQFKES

SEQ ID NO: 2865111 - protein, 5 aa, Entamoeba invadens
IERAS

SEQ ID NO: 2865112 - protein, 14 aa, Entamoeba invadens
IERDKSDKDLLIYL

SEQ ID NO: 2865113 - protein, 5 aa, Entamoeba invadens
IERDT

SEQ ID NO: 2865114 - protein, 15 aa, Entamoeba invadens
IEREKGKSGIIKYVY

SEQ ID NO: 2865115 - protein, 12 aa, Entamoeba invadens
IERESKIKPYSI

SEQ ID NO: 2865116 - protein, 5 aa, Entamoeba invadens
IERGN

SEQ ID NO: 2865117 - protein, 12 aa, Entamoeba invadens
IERGQTGHVKAE

SEQ ID NO: 2865118 - protein, 6 aa, Entamoeba invadens
IERGRL

SEQ ID NO: 2865119 - protein, 4 aa, Entamoeba invadens
IERI

SEQ ID NO: 2865120 - protein, 10 aa, Entamoeba invadens
IERKDETKIE

SEQ ID NO: 2865121 - protein, 10 aa, Entamoeba invadens
IERKNNDFNT

SEQ ID NO: 2865122 - protein, 14 aa, Entamoeba invadens
IERNEEKSAVEVSE

SEQ ID NO: 2865123 - protein, 14 aa, Entamoeba invadens
IERNKQNKYKWCYL

SEQ ID NO: 2865124 - protein, 5 aa, Entamoeba invadens
IERPE

SEQ ID NO: 2865125 - protein, 10 aa, Entamoeba invadens
IERPKDVPQQ

SEQ ID NO: 2865126 - protein, 30 aa, Entamoeba invadens
IERPPVAAATLSQKQKERHPATATSANDDL

SEQ ID NO: 2865127 - protein, 10 aa, Entamoeba invadens
IERPTNSDEI

SEQ ID NO: 2865128 - protein, 4 aa, Entamoeba invadens
IERR

SEQ ID NO: 2865129 - protein, 5 aa, Entamoeba invadens
IERTG

SEQ ID NO: 2865130 - protein, 10 aa, Entamoeba invadens
IERTPARQGE

SEQ ID NO: 2865131 - protein, 5 aa, Entamoeba invadens
IESAE

SEQ ID NO: 2865132 - protein, 6 aa, Entamoeba invadens
IESAEL

SEQ ID NO: 2865133 - protein, 6 aa, Entamoeba invadens
IESAND

SEQ ID NO: 2865134 - protein, 7 aa, Entamoeba invadens
IESDADV

SEQ ID NO: 2865135 - protein, 10 aa, Entamoeba invadens
IESDERKNIN

SEQ ID NO: 2865136 - protein, 41 aa, Entamoeba invadens
IESDNEIKKEEENKKMAKTDLQHETGEGYDKSTQSTQIEKS

SEQ ID NO: 2865137 - protein, 9 aa, Entamoeba invadens
IESDNKTKM

SEQ ID NO: 2865138 - protein, 37 aa, Entamoeba invadens
IESDPQDKVGRLTTSGESSDFDKDSIESTFEWYKTLY

SEQ ID NO: 2865139 - protein, 5 aa, Entamoeba invadens
IESDS

SEQ ID NO: 2865140 - protein, 7 aa, Entamoeba invadens
IESEEKK

SEQ ID NO: 2865141 - protein, 10 aa, Entamoeba invadens
IESEGLSPYT

SEQ ID NO: 2865142 - protein, 35 aa, Entamoeba invadens
IESEIEKARNDAIEKAKSESEEKWKNENDELKQKE

SEQ ID NO: 2865143 - protein, 7 aa, Entamoeba invadens
IESELPE

SEQ ID NO: 2865144 - protein, 5 aa, Entamoeba invadens
IESEQ

SEQ ID NO: 2865145 - protein, 5 aa, Entamoeba invadens
IESES

SEQ ID NO: 2865146 - protein, 6 aa, Entamoeba invadens
IESESI

SEQ ID NO: 2865147 - protein, 29 aa, Entamoeba invadens
IESESPSSQTEKRLTKSEEQKDDKKEDKK

SEQ ID NO: 2865148 - protein, 31 aa, Entamoeba invadens
IESGKDESKVDEHKEEEKIGSALEDGEENIV

SEQ ID NO: 2865149 - protein, 19 aa, Entamoeba invadens
IESGKVTIPNSTEDPREGS

SEQ ID NO: 2865150 - protein, 8 aa, Entamoeba invadens
IESGNKEA

SEQ ID NO: 2865151 - protein, 9 aa, Entamoeba invadens
IESIKKTNQ

SEQ ID NO: 2865152 - protein, 8 aa, Entamoeba invadens
IESKKQDC

SEQ ID NO: 2865153 - protein, 9 aa, Entamoeba invadens
IESKSAGSM

SEQ ID NO: 2865154 - protein, 9 aa, Entamoeba invadens
IESLPDEMS

SEQ ID NO: 2865155 - protein, 9 aa, Entamoeba invadens
IESNETPSW

SEQ ID NO: 2865156 - protein, 12 aa, Entamoeba invadens
IESNKTTQIEQK

SEQ ID NO: 2865157 - protein, 12 aa, Entamoeba invadens
IESNQKEENVTK

SEQ ID NO: 2865158 - protein, 14 aa, Entamoeba invadens
IESNRTTQIEQKVT

SEQ ID NO: 2865159 - protein, 5 aa, Entamoeba invadens
IESPE

SEQ ID NO: 2865160 - protein, 17 aa, Entamoeba invadens
IESPKEEIKENTNVPEF

SEQ ID NO: 2865161 - protein, 14 aa, Entamoeba invadens
IESPVYKNNNTLRS

SEQ ID NO: 2865162 - protein, 6 aa, Entamoeba invadens
IESQER

SEQ ID NO: 2865163 - protein, 9 aa, Entamoeba invadens
IESRRNDGA

SEQ ID NO: 2865164 - protein, 15 aa, Entamoeba invadens
IESSEFEEANTDLEK

SEQ ID NO: 2865165 - protein, 9 aa, Entamoeba invadens
IESSKEVEF

SEQ ID NO: 2865166 - protein, 8 aa, Entamoeba invadens
IESSQNSL

SEQ ID NO: 2865167 - protein, 7 aa, Entamoeba invadens
IESSSSG

SEQ ID NO: 2865168 - protein, 20 aa, Entamoeba invadens
IESSSTCSPRHEKMTKSSTQ

SEQ ID NO: 2865169 - protein, 6 aa, Entamoeba invadens
IESSTK

SEQ ID NO: 2865170 - protein, 11 aa, Entamoeba invadens
IESSYKSDTSL

SEQ ID NO: 2865171 - protein, 10 aa, Entamoeba invadens
IESTGKTTFT

SEQ ID NO: 2865172 - protein, 17 aa, Entamoeba invadens
IESTPVQQNAQEKPQEE

SEQ ID NO: 2865173 - protein, 7 aa, Entamoeba invadens
IESTTKN

SEQ ID NO: 2865174 - protein, 4 aa, Entamoeba invadens
IESY

SEQ ID NO: 2865175 - protein, 17 aa, Entamoeba invadens
IETANDTINEKKAKKKR

SEQ ID NO: 2865176 - protein, 4 aa, Entamoeba invadens
IETD

SEQ ID NO: 2865177 - protein, 5 aa, Entamoeba invadens
IETDE

SEQ ID NO: 2865178 - protein, 13 aa, Entamoeba invadens
IETDTDAQHPREL

SEQ ID NO: 2865179 - protein, 11 aa, Entamoeba invadens
IETEDKPTKEL

SEQ ID NO: 2865180 - protein, 15 aa, Entamoeba invadens
IETELETQKKRITNI

SEQ ID NO: 2865181 - protein, 6 aa, Entamoeba invadens
IETETK

SEQ ID NO: 2865182 - protein, 6 aa, Entamoeba invadens
IETHGE

SEQ ID NO: 2865183 - protein, 14 aa, Entamoeba invadens
IETHQTDKNDIQKQ

SEQ ID NO: 2865184 - protein, 4 aa, Entamoeba invadens
IETI

SEQ ID NO: 2865185 - protein, 14 aa, Entamoeba invadens
IETKANVEQINSSS

SEQ ID NO: 2865186 - protein, 20 aa, Entamoeba invadens
IETKDEEKSLPPSTDPEYID

SEQ ID NO: 2865187 - protein, 28 aa, Entamoeba invadens
IETKDENDEEEEESEVKDVKQEDEMQDE

SEQ ID NO: 2865188 - protein, 12 aa, Entamoeba invadens
IETKSKGTQYER

SEQ ID NO: 2865189 - protein, 11 aa, Entamoeba invadens
IETKTENTTKL

SEQ ID NO: 2865190 - protein, 4 aa, Entamoeba invadens
IETL

SEQ ID NO: 2865191 - protein, 12 aa, Entamoeba invadens
IETLDKDKTCIT

SEQ ID NO: 2865192 - protein, 12 aa, Entamoeba invadens
IETLPTKNENCY

SEQ ID NO: 2865193 - protein, 13 aa, Entamoeba invadens
IETNAKQLPPDKY

SEQ ID NO: 2865194 - protein, 8 aa, Entamoeba invadens
IETNNAKI

SEQ ID NO: 2865195 - protein, 10 aa, Entamoeba invadens
IETNTENSTK

SEQ ID NO: 2865196 - protein, 25 aa, Entamoeba invadens
IETPLQSTTQHTQQMEEDEKYKTIK

SEQ ID NO: 2865197 - protein, 11 aa, Entamoeba invadens
IETPSPRNPRD

SEQ ID NO: 2865198 - protein, 13 aa, Entamoeba invadens
IETPTFAENEQGY

SEQ ID NO: 2865199 - protein, 7 aa, Entamoeba invadens
IETPTKG

SEQ ID NO: 2865200 - protein, 6 aa, Entamoeba invadens
IETPTS

SEQ ID NO: 2865201 - protein, 11 aa, Entamoeba invadens
IETQEEKEAQL

SEQ ID NO: 2865202 - protein, 18 aa, Entamoeba invadens
IETQEEQKEEIKEEQQTV

SEQ ID NO: 2865203 - protein, 5 aa, Entamoeba invadens
IETQK

SEQ ID NO: 2865204 - protein, 10 aa, Entamoeba invadens
IETSDGTKVY

SEQ ID NO: 2865205 - protein, 7 aa, Entamoeba invadens
IETSGKN

SEQ ID NO: 2865206 - protein, 5 aa, Entamoeba invadens
IETSP

SEQ ID NO: 2865207 - protein, 10 aa, Entamoeba invadens
IETSPKSRMK

SEQ ID NO: 2865208 - protein, 13 aa, Entamoeba invadens
IETSSKANTNVQE

SEQ ID NO: 2865209 - protein, 10 aa, Entamoeba invadens
IETSTSDRDA

SEQ ID NO: 2865210 - protein, 4 aa, Entamoeba invadens
IETT

SEQ ID NO: 2865211 - protein, 37 aa, Entamoeba invadens
IETTKKVKKEEKKESKPNTKPIRKITRENKEKKRETK

SEQ ID NO: 2865212 - protein, 8 aa, Entamoeba invadens
IETTPTVG

SEQ ID NO: 2865213 - protein, 7 aa, Entamoeba invadens
IETTQQN

SEQ ID NO: 2865214 - protein, 6 aa, Entamoeba invadens
IETVGE

SEQ ID NO: 2865215 - protein, 6 aa, Entamoeba invadens
IETVTE

SEQ ID NO: 2865216 - protein, 4 aa, Entamoeba invadens
IETY

SEQ ID NO: 2865217 - protein, 4 aa, Entamoeba invadens
IEVA

SEQ ID NO: 2865218 - protein, 7 aa, Entamoeba invadens
IEVDEKP

SEQ ID NO: 2865219 - protein, 5 aa, Entamoeba invadens
IEVEG

SEQ ID NO: 2865220 - protein, 4 aa, Entamoeba invadens
IEVP

SEQ ID NO: 2865221 - protein, 6 aa, Entamoeba invadens
IEVPPP

SEQ ID NO: 2865222 - protein, 6 aa, Entamoeba invadens
IEVPQR

SEQ ID NO: 2865223 - protein, 52 aa, Entamoeba invadens
IEVRNEENAIKSLDTQKEKQDEIEKEEKHEIKSEEKSPPNNQNENAEDSPKF

SEQ ID NO: 2865224 - protein, 14 aa, Entamoeba invadens
IEVTDKSIKPKTNN

SEQ ID NO: 2865225 - protein, 5 aa, Entamoeba invadens
IEVTE

SEQ ID NO: 2865226 - protein, 5 aa, Entamoeba invadens
IEYPP

SEQ ID NO: 2865227 - protein, 21 aa, Entamoeba invadens
IEYQTAKTKAQSKWSKLSDDK

SEQ ID NO: 2865228 - protein, 5 aa, Entamoeba invadens
IEYSR

SEQ ID NO: 2865229 - protein, 8 aa, Entamoeba invadens
IFEESENR

SEQ ID NO: 2865230 - protein, 7 aa, Entamoeba invadens
IFGEPKE

SEQ ID NO: 2865231 - protein, 8 aa, Entamoeba invadens
IFKKTKKT

SEQ ID NO: 2865232 - protein, 6 aa, Entamoeba invadens
IFPDEE

SEQ ID NO: 2865233 - protein, 6 aa, Entamoeba invadens
IFPKNK

SEQ ID NO: 2865234 - protein, 12 aa, Entamoeba invadens
IFPPTNGGAQKM

SEQ ID NO: 2865235 - protein, 15 aa, Entamoeba invadens
IFPSSSQLSKSDERI

SEQ ID NO: 2865236 - protein, 9 aa, Entamoeba invadens
IFPTTKPIS

SEQ ID NO: 2865237 - protein, 4 aa, Entamoeba invadens
IFRS

SEQ ID NO: 2865238 - protein, 14 aa, Entamoeba invadens
IFRTRDKTVSRPEK

SEQ ID NO: 2865239 - protein, 9 aa, Entamoeba invadens
IFSEEDKAK

SEQ ID NO: 2865240 - protein, 11 aa, Entamoeba invadens
IFSEKQKNHVN

SEQ ID NO: 2865241 - protein, 9 aa, Entamoeba invadens
IGAEEAKNW

SEQ ID NO: 2865242 - protein, 5 aa, Entamoeba invadens
IGAEK

SEQ ID NO: 2865243 - protein, 10 aa, Entamoeba invadens
IGAKAAPKSN

SEQ ID NO: 2865244 - protein, 4 aa, Entamoeba invadens
IGAN

SEQ ID NO: 2865245 - protein, 5 aa, Entamoeba invadens
IGANG

SEQ ID NO: 2865246 - protein, 4 aa, Entamoeba invadens
IGAP

SEQ ID NO: 2865247 - protein, 5 aa, Entamoeba invadens
IGAPQ

SEQ ID NO: 2865248 - protein, 4 aa, Entamoeba invadens
IGAQ

SEQ ID NO: 2865249 - protein, 8 aa, Entamoeba invadens
IGAQKPAA

SEQ ID NO: 2865250 - protein, 10 aa, Entamoeba invadens
IGATSEKADE

SEQ ID NO: 2865251 - protein, 4 aa, Entamoeba invadens
IGCD

SEQ ID NO: 2865252 - protein, 4 aa, Entamoeba invadens
IGDD

SEQ ID NO: 2865253 - protein, 5 aa, Entamoeba invadens
IGDED

SEQ ID NO: 2865254 - protein, 6 aa, Entamoeba invadens
IGDEHN

SEQ ID NO: 2865255 - protein, 11 aa, Entamoeba invadens
IGDEKNMKVSG

SEQ ID NO: 2865256 - protein, 15 aa, Entamoeba invadens
IGDENIDGVTTEVST

SEQ ID NO: 2865257 - protein, 12 aa, Entamoeba invadens
IGDESRRMNSGN

SEQ ID NO: 2865258 - protein, 36 aa, Entamoeba invadens
IGDHKRLTRQKETDKKKRKTMRCNSSDKIRESQDSI

SEQ ID NO: 2865259 - protein, 10 aa, Entamoeba invadens
IGDKESKKVK

SEQ ID NO: 2865260 - protein, 7 aa, Entamoeba invadens
IGDKGFN

SEQ ID NO: 2865261 - protein, 4 aa, Entamoeba invadens
IGDN

SEQ ID NO: 2865262 - protein, 9 aa, Entamoeba invadens
IGDNNFSEC

SEQ ID NO: 2865263 - protein, 6 aa, Entamoeba invadens
IGDSAF

SEQ ID NO: 2865264 - protein, 7 aa, Entamoeba invadens
IGDSEER

SEQ ID NO: 2865265 - protein, 8 aa, Entamoeba invadens
IGDTEEDM

SEQ ID NO: 2865266 - protein, 5 aa, Entamoeba invadens
IGDTQ

SEQ ID NO: 2865267 - protein, 44 aa, Entamoeba invadens
IGEDNDVESEEVDDVNKMEEEDAEVSQDDDKKMEEEESSKMEED

SEQ ID NO: 2865268 - protein, 5 aa, Entamoeba invadens
IGEDV

SEQ ID NO: 2865269 - protein, 9 aa, Entamoeba invadens
IGEEAKDWA

SEQ ID NO: 2865270 - protein, 9 aa, Entamoeba invadens
IGEEDEIEN

SEQ ID NO: 2865271 - protein, 11 aa, Entamoeba invadens
IGEEEEGGETL

SEQ ID NO: 2865272 - protein, 31 aa, Entamoeba invadens
IGEEELKNAMGDMDADKDGKVGCEDLLKYLL

SEQ ID NO: 2865273 - protein, 11 aa, Entamoeba invadens
IGEEGENAEGE

SEQ ID NO: 2865274 - protein, 5 aa, Entamoeba invadens
IGEET

SEQ ID NO: 2865275 - protein, 7 aa, Entamoeba invadens
IGEGAAG

SEQ ID NO: 2865276 - protein, 7 aa, Entamoeba invadens
IGEGEAS

SEQ ID NO: 2865277 - protein, 9 aa, Entamoeba invadens
IGEGGFDKI

SEQ ID NO: 2865278 - protein, 6 aa, Entamoeba invadens
IGEGGN

SEQ ID NO: 2865279 - protein, 12 aa, Entamoeba invadens
IGEGKEGQIYRA

SEQ ID NO: 2865280 - protein, 12 aa, Entamoeba invadens
IGEGKKDQERRI

SEQ ID NO: 2865281 - protein, 8 aa, Entamoeba invadens
IGEHEKEK

SEQ ID NO: 2865282 - protein, 5 aa, Entamoeba invadens
IGEIG

SEQ ID NO: 2865283 - protein, 12 aa, Entamoeba invadens
IGEKKETKCSRG

SEQ ID NO: 2865284 - protein, 8 aa, Entamoeba invadens
IGEKNEDV

SEQ ID NO: 2865285 - protein, 15 aa, Entamoeba invadens
IGEKRDVNVTTAAAK

SEQ ID NO: 2865286 - protein, 6 aa, Entamoeba invadens
IGELED

SEQ ID NO: 2865287 - protein, 7 aa, Entamoeba invadens
IGELGKE

SEQ ID NO: 2865288 - protein, 6 aa, Entamoeba invadens
IGENEK

SEQ ID NO: 2865289 - protein, 8 aa, Entamoeba invadens
IGENGEVS

SEQ ID NO: 2865290 - protein, 9 aa, Entamoeba invadens
IGENKDFSG

SEQ ID NO: 2865291 - protein, 8 aa, Entamoeba invadens
IGENSKDR

SEQ ID NO: 2865292 - protein, 7 aa, Entamoeba invadens
IGEPSTT

SEQ ID NO: 2865293 - protein, 5 aa, Entamoeba invadens
IGEQT

SEQ ID NO: 2865294 - protein, 8 aa, Entamoeba invadens
IGERDTEI

SEQ ID NO: 2865295 - protein, 5 aa, Entamoeba invadens
IGERP

SEQ ID NO: 2865296 - protein, 5 aa, Entamoeba invadens
IGESD

SEQ ID NO: 2865297 - protein, 14 aa, Entamoeba invadens
IGESSEEKGNIGSS

SEQ ID NO: 2865298 - protein, 7 aa, Entamoeba invadens
IGESTKA

SEQ ID NO: 2865299 - protein, 5 aa, Entamoeba invadens
IGETN

SEQ ID NO: 2865300 - protein, 10 aa, Entamoeba invadens
IGETQTPPWA

SEQ ID NO: 2865301 - protein, 4 aa, Entamoeba invadens
IGEY

SEQ ID NO: 2865302 - protein, 11 aa, Entamoeba invadens
IGGADKEELKK

SEQ ID NO: 2865303 - protein, 13 aa, Entamoeba invadens
IGGAEQPQTVDQE

SEQ ID NO: 2865304 - protein, 8 aa, Entamoeba invadens
IGGAESHP

SEQ ID NO: 2865305 - protein, 7 aa, Entamoeba invadens
IGGATNP

SEQ ID NO: 2865306 - protein, 8 aa, Entamoeba invadens
IGGEDEPL

SEQ ID NO: 2865307 - protein, 9 aa, Entamoeba invadens
IGGEDGSIY

SEQ ID NO: 2865308 - protein, 9 aa, Entamoeba invadens
IGGEEKAFS

SEQ ID NO: 2865309 - protein, 11 aa, Entamoeba invadens
IGGEKSTTEVG

SEQ ID NO: 2865310 - protein, 9 aa, Entamoeba invadens
IGGERDTLS

SEQ ID NO: 2865311 - protein, 10 aa, Entamoeba invadens
IGGGKSSNEI

SEQ ID NO: 2865312 - protein, 15 aa, Entamoeba invadens
IGGKDGKDKITSADE

SEQ ID NO: 2865313 - protein, 11 aa, Entamoeba invadens
IGGNEDTLNNA

SEQ ID NO: 2865314 - protein, 11 aa, Entamoeba invadens
IGGNEDVKNRL

SEQ ID NO: 2865315 - protein, 10 aa, Entamoeba invadens
IGGNKGIEKQ

SEQ ID NO: 2865316 - protein, 5 aa, Entamoeba invadens
IGGQS

SEQ ID NO: 2865317 - protein, 6 aa, Entamoeba invadens
IGGRRV

SEQ ID NO: 2865318 - protein, 15 aa, Entamoeba invadens
IGGSCGVPEKGKYPL

SEQ ID NO: 2865319 - protein, 6 aa, Entamoeba invadens
IGGSDL

SEQ ID NO: 2865320 - protein, 5 aa, Entamoeba invadens
IGGSS

SEQ ID NO: 2865321 - protein, 6 aa, Entamoeba invadens
IGGSSD

SEQ ID NO: 2865322 - protein, 5 aa, Entamoeba invadens
IGGTA

SEQ ID NO: 2865323 - protein, 4 aa, Entamoeba invadens
IGHG

SEQ ID NO: 2865324 - protein, 8 aa, Entamoeba invadens
IGHRDLKP

SEQ ID NO: 2865325 - protein, 4 aa, Entamoeba invadens
IGID

SEQ ID NO: 2865326 - protein, 8 aa, Entamoeba invadens
IGIHSDDG

SEQ ID NO: 2865327 - protein, 5 aa, Entamoeba invadens
IGIPQ

SEQ ID NO: 2865328 - protein, 16 aa, Entamoeba invadens
IGISPPPSNTKKETIQ

SEQ ID NO: 2865329 - protein, 18 aa, Entamoeba invadens
IGKARGGGAGDVGGSADR

SEQ ID NO: 2865330 - protein, 18 aa, Entamoeba invadens
IGKDGAVDIETGKAVKDR

SEQ ID NO: 2865331 - protein, 6 aa, Entamoeba invadens
IGKEAV

SEQ ID NO: 2865332 - protein, 25 aa, Entamoeba invadens
IGKGKRTKKSKSKNKSKKRQVRRNK

SEQ ID NO: 2865333 - protein, 11 aa, Entamoeba invadens
IGKGKSTNEEL

SEQ ID NO: 2865334 - protein, 9 aa, Entamoeba invadens
IGKGTSATV

SEQ ID NO: 2865335 - protein, 10 aa, Entamoeba invadens
IGKKGDIDGT

SEQ ID NO: 2865336 - protein, 4 aa, Entamoeba invadens
IGKN

SEQ ID NO: 2865337 - protein, 7 aa, Entamoeba invadens
IGKNKEE

SEQ ID NO: 2865338 - protein, 11 aa, Entamoeba invadens
IGKNSDSELEA

SEQ ID NO: 2865339 - protein, 5 aa, Entamoeba invadens
IGKPK

SEQ ID NO: 2865340 - protein, 6 aa, Entamoeba invadens
IGKPKV

SEQ ID NO: 2865341 - protein, 7 aa, Entamoeba invadens
IGKPNTF

SEQ ID NO: 2865342 - protein, 33 aa, Entamoeba invadens
IGKSDSDEQDKDQPYETDSKEKVDKKPAFKATV

SEQ ID NO: 2865343 - protein, 15 aa, Entamoeba invadens
IGKTAETKISPGDGV

SEQ ID NO: 2865344 - protein, 9 aa, Entamoeba invadens
IGKTQAEKF

SEQ ID NO: 2865345 - protein, 7 aa, Entamoeba invadens
IGLADTN

SEQ ID NO: 2865346 - protein, 20 aa, Entamoeba invadens
IGLHSDDGNLFKDGDNETVC

SEQ ID NO: 2865347 - protein, 4 aa, Entamoeba invadens
IGLN

SEQ ID NO: 2865348 - protein, 4 aa, Entamoeba invadens
IGNA

SEQ ID NO: 2865349 - protein, 9 aa, Entamoeba invadens
IGNDDSVDS

SEQ ID NO: 2865350 - protein, 7 aa, Entamoeba invadens
IGNDMSN

SEQ ID NO: 2865351 - protein, 6 aa, Entamoeba invadens
IGNDSL

SEQ ID NO: 2865352 - protein, 4 aa, Entamoeba invadens
IGNG

SEQ ID NO: 2865353 - protein, 15 aa, Entamoeba invadens
IGNGEYEEKTKARPL

SEQ ID NO: 2865354 - protein, 8 aa, Entamoeba invadens
IGNGVETI

SEQ ID NO: 2865355 - protein, 5 aa, Entamoeba invadens
IGNKA

SEQ ID NO: 2865356 - protein, 20 aa, Entamoeba invadens
IGNKRKRQVKNEFGKNRAEC

SEQ ID NO: 2865357 - protein, 6 aa, Entamoeba invadens
IGNNTF

SEQ ID NO: 2865358 - protein, 9 aa, Entamoeba invadens
IGNNTKEDF

SEQ ID NO: 2865359 - protein, 9 aa, Entamoeba invadens
IGNNTKEEF

SEQ ID NO: 2865360 - protein, 9 aa, Entamoeba invadens
IGNNTQNEF

SEQ ID NO: 2865361 - protein, 5 aa, Entamoeba invadens
IGNPN

SEQ ID NO: 2865362 - protein, 10 aa, Entamoeba invadens
IGNPTTTLNV

SEQ ID NO: 2865363 - protein, 4 aa, Entamoeba invadens
IGNQ

SEQ ID NO: 2865364 - protein, 5 aa, Entamoeba invadens
IGNRA

SEQ ID NO: 2865365 - protein, 5 aa, Entamoeba invadens
IGNSE

SEQ ID NO: 2865366 - protein, 9 aa, Entamoeba invadens
IGNSGNGSE

SEQ ID NO: 2865367 - protein, 16 aa, Entamoeba invadens
IGNTGKRGTLYLTIQF

SEQ ID NO: 2865368 - protein, 6 aa, Entamoeba invadens
IGNYYS

SEQ ID NO: 2865369 - protein, 6 aa, Entamoeba invadens
IGPDSQ

SEQ ID NO: 2865370 - protein, 10 aa, Entamoeba invadens
IGPGPSPVEK

SEQ ID NO: 2865371 - protein, 9 aa, Entamoeba invadens
IGPNATLES

SEQ ID NO: 2865372 - protein, 4 aa, Entamoeba invadens
IGPT

SEQ ID NO: 2865373 - protein, 5 aa, Entamoeba invadens
IGPVG

SEQ ID NO: 2865374 - protein, 8 aa, Entamoeba invadens
IGQDVKET

SEQ ID NO: 2865375 - protein, 4 aa, Entamoeba invadens
IGQE

SEQ ID NO: 2865376 - protein, 13 aa, Entamoeba invadens
IGQEQKKSALKTV

SEQ ID NO: 2865377 - protein, 8 aa, Entamoeba invadens
IGQESKDL

SEQ ID NO: 2865378 - protein, 6 aa, Entamoeba invadens
IGQESV

SEQ ID NO: 2865379 - protein, 10 aa, Entamoeba invadens
IGQGKSGYAN

SEQ ID NO: 2865380 - protein, 5 aa, Entamoeba invadens
IGQKE

SEQ ID NO: 2865381 - protein, 5 aa, Entamoeba invadens
IGQPD

SEQ ID NO: 2865382 - protein, 13 aa, Entamoeba invadens
IGQRPGTNFQQRY

SEQ ID NO: 2865383 - protein, 4 aa, Entamoeba invadens
IGQS

SEQ ID NO: 2865384 - protein, 6 aa, Entamoeba invadens
IGQSVA

SEQ ID NO: 2865385 - protein, 18 aa, Entamoeba invadens
IGQTKEREFYNNRNGSEH

SEQ ID NO: 2865386 - protein, 16 aa, Entamoeba invadens
IGQTSTKDSEDKKKVR

SEQ ID NO: 2865387 - protein, 28 aa, Entamoeba invadens
IGQVNELKQKNKEFEKSLQDEKEQKNQI

SEQ ID NO: 2865388 - protein, 6 aa, Entamoeba invadens
IGQYEA

SEQ ID NO: 2865389 - protein, 15 aa, Entamoeba invadens
IGREKPNDKKYKDAR

SEQ ID NO: 2865390 - protein, 5 aa, Entamoeba invadens
IGRGA

SEQ ID NO: 2865391 - protein, 9 aa, Entamoeba invadens
IGRINGDGT

SEQ ID NO: 2865392 - protein, 4 aa, Entamoeba invadens
IGRP

SEQ ID NO: 2865393 - protein, 8 aa, Entamoeba invadens
IGRPQSKQ

SEQ ID NO: 2865394 - protein, 8 aa, Entamoeba invadens
IGRSDGPS

SEQ ID NO: 2865395 - protein, 7 aa, Entamoeba invadens
IGRSPST

SEQ ID NO: 2865396 - protein, 10 aa, Entamoeba invadens
IGRTTEELEI

SEQ ID NO: 2865397 - protein, 12 aa, Entamoeba invadens
IGSAFSKEGDSC

SEQ ID NO: 2865398 - protein, 22 aa, Entamoeba invadens
IGSANNSDSDDLESDSESDSNS

SEQ ID NO: 2865399 - protein, 25 aa, Entamoeba invadens
IGSANNSDSDDLESDSESDSNSNYS

SEQ ID NO: 2865400 - protein, 20 aa, Entamoeba invadens
IGSAPKKAAWSAGQTAVSSL

SEQ ID NO: 2865401 - protein, 11 aa, Entamoeba invadens
IGSAPTGSGKT

SEQ ID NO: 2865402 - protein, 5 aa, Entamoeba invadens
IGSDD

SEQ ID NO: 2865403 - protein, 10 aa, Entamoeba invadens
IGSDNCSNDL

SEQ ID NO: 2865404 - protein, 9 aa, Entamoeba invadens
IGSDSSQFQ

SEQ ID NO: 2865405 - protein, 4 aa, Entamoeba invadens
IGSE

SEQ ID NO: 2865406 - protein, 9 aa, Entamoeba invadens
IGSEATRRT

SEQ ID NO: 2865407 - protein, 18 aa, Entamoeba invadens
IGSEDSSEDEERSSKGEV

SEQ ID NO: 2865408 - protein, 17 aa, Entamoeba invadens
IGSENKTKKTVSATTRQ

SEQ ID NO: 2865409 - protein, 18 aa, Entamoeba invadens
IGSENSDHPEDSKIKQSR

SEQ ID NO: 2865410 - protein, 4 aa, Entamoeba invadens
IGSF

SEQ ID NO: 2865411 - protein, 5 aa, Entamoeba invadens
IGSFD

SEQ ID NO: 2865412 - protein, 9 aa, Entamoeba invadens
IGSFENGKK

SEQ ID NO: 2865413 - protein, 10 aa, Entamoeba invadens
IGSGDVPNEV

SEQ ID NO: 2865414 - protein, 5 aa, Entamoeba invadens
IGSGG

SEQ ID NO: 2865415 - protein, 8 aa, Entamoeba invadens
IGSGNKSG

SEQ ID NO: 2865416 - protein, 6 aa, Entamoeba invadens
IGSGSF

SEQ ID NO: 2865417 - protein, 12 aa, Entamoeba invadens
IGSKGKQHEEDI

SEQ ID NO: 2865418 - protein, 9 aa, Entamoeba invadens
IGSKPGKNT

SEQ ID NO: 2865419 - protein, 6 aa, Entamoeba invadens
IGSLGE

SEQ ID NO: 2865420 - protein, 79 aa, Entamoeba invadens
IGSNDVTQHGGKEMAKEKNDVARMEEEPQGNEKQRKMEEEEKTKEYPVEADKSSETTSEDTSESEEDSYEREMRPKRSY

SEQ ID NO: 2865421 - protein, 5 aa, Entamoeba invadens
IGSNK

SEQ ID NO: 2865422 - protein, 12 aa, Entamoeba invadens
IGSNSKHRSRPV

SEQ ID NO: 2865423 - protein, 5 aa, Entamoeba invadens
IGSQI

SEQ ID NO: 2865424 - protein, 5 aa, Entamoeba invadens
IGSRR

SEQ ID NO: 2865425 - protein, 11 aa, Entamoeba invadens
IGSSKKQQNFK

SEQ ID NO: 2865426 - protein, 19 aa, Entamoeba invadens
IGSSTGSSYQPTVSDDKTE

SEQ ID NO: 2865427 - protein, 9 aa, Entamoeba invadens
IGSSTTEEV

SEQ ID NO: 2865428 - protein, 6 aa, Entamoeba invadens
IGSSVE

SEQ ID NO: 2865429 - protein, 9 aa, Entamoeba invadens
IGSTEKGQI

SEQ ID NO: 2865430 - protein, 7 aa, Entamoeba invadens
IGSTEMT

SEQ ID NO: 2865431 - protein, 6 aa, Entamoeba invadens
IGSTKI

SEQ ID NO: 2865432 - protein, 10 aa, Entamoeba invadens
IGSTSSRNVE

SEQ ID NO: 2865433 - protein, 7 aa, Entamoeba invadens
IGSTTQS

SEQ ID NO: 2865434 - protein, 4 aa, Entamoeba invadens
IGTD

SEQ ID NO: 2865435 - protein, 5 aa, Entamoeba invadens
IGTDF

SEQ ID NO: 2865436 - protein, 18 aa, Entamoeba invadens
IGTDFSSKTLTDEATQQT

SEQ ID NO: 2865437 - protein, 9 aa, Entamoeba invadens
IGTEAFSDS

SEQ ID NO: 2865438 - protein, 11 aa, Entamoeba invadens
IGTEDDSQKIE

SEQ ID NO: 2865439 - protein, 8 aa, Entamoeba invadens
IGTEDMKE

SEQ ID NO: 2865440 - protein, 10 aa, Entamoeba invadens
IGTESGLDAQ

SEQ ID NO: 2865441 - protein, 6 aa, Entamoeba invadens
IGTGAM

SEQ ID NO: 2865442 - protein, 11 aa, Entamoeba invadens
IGTGTSGKYGK

SEQ ID NO: 2865443 - protein, 6 aa, Entamoeba invadens
IGTIKE

SEQ ID NO: 2865444 - protein, 14 aa, Entamoeba invadens
IGTIKKDKNHDFSN

SEQ ID NO: 2865445 - protein, 4 aa, Entamoeba invadens
IGTK

SEQ ID NO: 2865446 - protein, 17 aa, Entamoeba invadens
IGTKRNDSEHSGDREIQ

SEQ ID NO: 2865447 - protein, 4 aa, Entamoeba invadens
IGTP

SEQ ID NO: 2865448 - protein, 8 aa, Entamoeba invadens
IGTPGYSL

SEQ ID NO: 2865449 - protein, 6 aa, Entamoeba invadens
IGTPKD

SEQ ID NO: 2865450 - protein, 10 aa, Entamoeba invadens
IGTPKYKSPE

SEQ ID NO: 2865451 - protein, 21 aa, Entamoeba invadens
IGTPNSMLSSESKKEGAMKKE

SEQ ID NO: 2865452 - protein, 14 aa, Entamoeba invadens
IGTPSLDKVVSLKT

SEQ ID NO: 2865453 - protein, 10 aa, Entamoeba invadens
IGTPTSMAPE

SEQ ID NO: 2865454 - protein, 4 aa, Entamoeba invadens
IGTT

SEQ ID NO: 2865455 - protein, 6 aa, Entamoeba invadens
IGTTDV

SEQ ID NO: 2865456 - protein, 5 aa, Entamoeba invadens
IGVDE

SEQ ID NO: 2865457 - protein, 4 aa, Entamoeba invadens
IGVE

SEQ ID NO: 2865458 - protein, 19 aa, Entamoeba invadens
IGVGKEADIYTATNQKGEE

SEQ ID NO: 2865459 - protein, 6 aa, Entamoeba invadens
IGVSES

SEQ ID NO: 2865460 - protein, 10 aa, Entamoeba invadens
IGVVGSADGN

SEQ ID NO: 2865461 - protein, 7 aa, Entamoeba invadens
IGYHSSS

SEQ ID NO: 2865462 - protein, 12 aa, Entamoeba invadens
IGYTETDAPNFT

SEQ ID NO: 2865463 - protein, 5 aa, Entamoeba invadens
IHDGT

SEQ ID NO: 2865464 - protein, 11 aa, Entamoeba invadens
IHDNEPDKVKL

SEQ ID NO: 2865465 - protein, 6 aa, Entamoeba invadens
IHDSNN

SEQ ID NO: 2865466 - protein, 12 aa, Entamoeba invadens
IHEKAETSEMLN

SEQ ID NO: 2865467 - protein, 52 aa, Entamoeba invadens
IHEKRTKKDKTENTDNSQHHKTSTQKGKFTKKGKQNTPEKFERPSMTSPELK

SEQ ID NO: 2865468 - protein, 5 aa, Entamoeba invadens
IHEPH

SEQ ID NO: 2865469 - protein, 4 aa, Entamoeba invadens
IHEQ

SEQ ID NO: 2865470 - protein, 6 aa, Entamoeba invadens
IHETTH

SEQ ID NO: 2865471 - protein, 4 aa, Entamoeba invadens
IHGD

SEQ ID NO: 2865472 - protein, 5 aa, Entamoeba invadens
IHGEG

SEQ ID NO: 2865473 - protein, 9 aa, Entamoeba invadens
IHGKNKKKI

SEQ ID NO: 2865474 - protein, 6 aa, Entamoeba invadens
IHGRPE

SEQ ID NO: 2865475 - protein, 6 aa, Entamoeba invadens
IHGTRS

SEQ ID NO: 2865476 - protein, 4 aa, Entamoeba invadens
IHKD

SEQ ID NO: 2865477 - protein, 7 aa, Entamoeba invadens
IHKGSEK

SEQ ID NO: 2865478 - protein, 8 aa, Entamoeba invadens
IHKRTKSD

SEQ ID NO: 2865479 - protein, 16 aa, Entamoeba invadens
IHNPETNSLKKQMDDM

SEQ ID NO: 2865480 - protein, 25 aa, Entamoeba invadens
IHNPQQVEQTLNQKKGQPQRATKKD

SEQ ID NO: 2865481 - protein, 7 aa, Entamoeba invadens
IHPDKTQ

SEQ ID NO: 2865482 - protein, 5 aa, Entamoeba invadens
IHPED

SEQ ID NO: 2865483 - protein, 5 aa, Entamoeba invadens
IHPEQ

SEQ ID NO: 2865484 - protein, 4 aa, Entamoeba invadens
IHPN

SEQ ID NO: 2865485 - protein, 8 aa, Entamoeba invadens
IHPPPVEE

SEQ ID NO: 2865486 - protein, 27 aa, Entamoeba invadens
IHPPTGKVKTKKWTGGSGKAKKEKKVK

SEQ ID NO: 2865487 - protein, 11 aa, Entamoeba invadens
IHQNDEKNVIP

SEQ ID NO: 2865488 - protein, 5 aa, Entamoeba invadens
IHRGG

SEQ ID NO: 2865489 - protein, 5 aa, Entamoeba invadens
IHRGN

SEQ ID NO: 2865490 - protein, 17 aa, Entamoeba invadens
IHSTKTKPSDSIQKKSF

SEQ ID NO: 2865491 - protein, 7 aa, Entamoeba invadens
IHTSTAP

SEQ ID NO: 2865492 - protein, 5 aa, Entamoeba invadens
IHTTA

SEQ ID NO: 2865493 - protein, 9 aa, Entamoeba invadens
IIDTSDSNI

SEQ ID NO: 2865494 - protein, 56 aa, Entamoeba invadens
IIEESQIGKMNEKTPEKSSEKHSEKLEKSEKSFSSYSKTSFRSKTSKTSNQSKTLS

SEQ ID NO: 2865495 - protein, 9 aa, Entamoeba invadens
IIEKGKKIN

SEQ ID NO: 2865496 - protein, 8 aa, Entamoeba invadens
IIESNNES

SEQ ID NO: 2865497 - protein, 34 aa, Entamoeba invadens
IIGEDSDEEEENGDVCNEDNQQISNNEGDKQKME

SEQ ID NO: 2865498 - protein, 11 aa, Entamoeba invadens
IIGGKSKNKNF

SEQ ID NO: 2865499 - protein, 8 aa, Entamoeba invadens
IIGPSQNE

SEQ ID NO: 2865500 - protein, 13 aa, Entamoeba invadens
IIKPNNKVHNDEI

SEQ ID NO: 2865501 - protein, 13 aa, Entamoeba invadens
IIKRGTKRHPTVG

SEQ ID NO: 2865502 - protein, 12 aa, Entamoeba invadens
IIKTEDTDNLFI

SEQ ID NO: 2865503 - protein, 7 aa, Entamoeba invadens
IINDEEN

SEQ ID NO: 2865504 - protein, 13 aa, Entamoeba invadens
IINSDNKITRISE

SEQ ID NO: 2865505 - protein, 11 aa, Entamoeba invadens
IIPNTTDNKSL

SEQ ID NO: 2865506 - protein, 5 aa, Entamoeba invadens
IIPPK

SEQ ID NO: 2865507 - protein, 5 aa, Entamoeba invadens
IIPPS

SEQ ID NO: 2865508 - protein, 14 aa, Entamoeba invadens
IIPQPNANTQNEQV

SEQ ID NO: 2865509 - protein, 6 aa, Entamoeba invadens
IIPSES

SEQ ID NO: 2865510 - protein, 5 aa, Entamoeba invadens
IIQGQ

SEQ ID NO: 2865511 - protein, 8 aa, Entamoeba invadens
IISASPSA

SEQ ID NO: 2865512 - protein, 11 aa, Entamoeba invadens
IISKQGGYNPY

SEQ ID NO: 2865513 - protein, 5 aa, Entamoeba invadens
IISPD

SEQ ID NO: 2865514 - protein, 97 aa, Entamoeba invadens
IISPNQPTAPRPSNLNQTTEVPQASTPQQQPKSSTPSLNPISSPTSSFNKMGSASYNTSSYKKGTHQSSIKEGEGSYTGSHDGSSHFSGTTQNPGIY

SEQ ID NO: 2865515 - protein, 7 aa, Entamoeba invadens
IISPPRV

SEQ ID NO: 2865516 - protein, 15 aa, Entamoeba invadens
IITEEEKKHTASEVA

SEQ ID NO: 2865517 - protein, 5 aa, Entamoeba invadens
IITEG

SEQ ID NO: 2865518 - protein, 14 aa, Entamoeba invadens
IITKSTKRETTENQ

SEQ ID NO: 2865519 - protein, 6 aa, Entamoeba invadens
IITPEE

SEQ ID NO: 2865520 - protein, 13 aa, Entamoeba invadens
IITQPPPPPTDHP

SEQ ID NO: 2865521 - protein, 9 aa, Entamoeba invadens
IITTDASNN

SEQ ID NO: 2865522 - protein, 4 aa, Entamoeba invadens
IKAD

SEQ ID NO: 2865523 - protein, 19 aa, Entamoeba invadens
IKAKENDKRKKYEAKTLTG

SEQ ID NO: 2865524 - protein, 10 aa, Entamoeba invadens
IKAKEREGKF

SEQ ID NO: 2865525 - protein, 9 aa, Entamoeba invadens
IKAKKPVSL

SEQ ID NO: 2865526 - protein, 14 aa, Entamoeba invadens
IKANGKLTDFGSSR

SEQ ID NO: 2865527 - protein, 7 aa, Entamoeba invadens
IKARRTQ

SEQ ID NO: 2865528 - protein, 22 aa, Entamoeba invadens
IKATEEELETLKNQKESEENRV

SEQ ID NO: 2865529 - protein, 44 aa, Entamoeba invadens
IKATNAAKKEAAKKEAKKEGKKEAHPKAKTASKQPKAGKTNFNS

SEQ ID NO: 2865530 - protein, 44 aa, Entamoeba invadens
IKATNAAKKEAAKKEAKKEGKKETHPKAKTASKQPKAGKTNFNS

SEQ ID NO: 2865531 - protein, 44 aa, Entamoeba invadens
IKATNAAKKEAAKKEAKKEGKKETHPKAKTGSKQPKAGKTNFNS

SEQ ID NO: 2865532 - protein, 7 aa, Entamoeba invadens
IKATNST

SEQ ID NO: 2865533 - protein, 6 aa, Entamoeba invadens
IKATSE

SEQ ID NO: 2865534 - protein, 6 aa, Entamoeba invadens
IKCGEK

SEQ ID NO: 2865535 - protein, 11 aa, Entamoeba invadens
IKCGGEVSQTA

SEQ ID NO: 2865536 - protein, 8 aa, Entamoeba invadens
IKDAEDKA

SEQ ID NO: 2865537 - protein, 6 aa, Entamoeba invadens
IKDAQR

SEQ ID NO: 2865538 - protein, 9 aa, Entamoeba invadens
IKDDKTREE

SEQ ID NO: 2865539 - protein, 5 aa, Entamoeba invadens
IKDDP

SEQ ID NO: 2865540 - protein, 11 aa, Entamoeba invadens
IKDDSDQSQKY

SEQ ID NO: 2865541 - protein, 5 aa, Entamoeba invadens
IKDET

SEQ ID NO: 2865542 - protein, 19 aa, Entamoeba invadens
IKDETKPKKEQQPKRHFSP

SEQ ID NO: 2865543 - protein, 4 aa, Entamoeba invadens
IKDG

SEQ ID NO: 2865544 - protein, 6 aa, Entamoeba invadens
IKDGEM

SEQ ID NO: 2865545 - protein, 8 aa, Entamoeba invadens
IKDGGRKV

SEQ ID NO: 2865546 - protein, 21 aa, Entamoeba invadens
IKDGIQAKTAQRRFETNKKTE

SEQ ID NO: 2865547 - protein, 9 aa, Entamoeba invadens
IKDGNKRVS

SEQ ID NO: 2865548 - protein, 5 aa, Entamoeba invadens
IKDIE

SEQ ID NO: 2865549 - protein, 8 aa, Entamoeba invadens
IKDIGEKV

SEQ ID NO: 2865550 - protein, 10 aa, Entamoeba invadens
IKDKERVGSK

SEQ ID NO: 2865551 - protein, 10 aa, Entamoeba invadens
IKDKESHRST

SEQ ID NO: 2865552 - protein, 15 aa, Entamoeba invadens
IKDKNDIENEKDETI

SEQ ID NO: 2865553 - protein, 13 aa, Entamoeba invadens
IKDKNDTNITKNK

SEQ ID NO: 2865554 - protein, 9 aa, Entamoeba invadens
IKDKTKSGT

SEQ ID NO: 2865555 - protein, 9 aa, Entamoeba invadens
IKDNSGCTS

SEQ ID NO: 2865556 - protein, 4 aa, Entamoeba invadens
IKDP

SEQ ID NO: 2865557 - protein, 5 aa, Entamoeba invadens
IKDPK

SEQ ID NO: 2865558 - protein, 19 aa, Entamoeba invadens
IKDPKKLEKSKPIGGVEEE

SEQ ID NO: 2865559 - protein, 6 aa, Entamoeba invadens
IKDPKL

SEQ ID NO: 2865560 - protein, 8 aa, Entamoeba invadens
IKDSNENS

SEQ ID NO: 2865561 - protein, 6 aa, Entamoeba invadens
IKDSPY

SEQ ID NO: 2865562 - protein, 10 aa, Entamoeba invadens
IKDSRLTKQQ

SEQ ID NO: 2865563 - protein, 10 aa, Entamoeba invadens
IKEANYGDDL

SEQ ID NO: 2865564 - protein, 6 aa, Entamoeba invadens
IKEDGN

SEQ ID NO: 2865565 - protein, 9 aa, Entamoeba invadens
IKEDQTDET

SEQ ID NO: 2865566 - protein, 8 aa, Entamoeba invadens
IKEEGRKI

SEQ ID NO: 2865567 - protein, 10 aa, Entamoeba invadens
IKEEIQKKSF

SEQ ID NO: 2865568 - protein, 23 aa, Entamoeba invadens
IKEEKEELKREKNNCKTEKRENL

SEQ ID NO: 2865569 - protein, 12 aa, Entamoeba invadens
IKEEKKEEKPNE

SEQ ID NO: 2865570 - protein, 45 aa, Entamoeba invadens
IKEEKNSEKNLEKKINKNEEEKKCETQDVKNRESQTPKNEEKQNE

SEQ ID NO: 2865571 - protein, 5 aa, Entamoeba invadens
IKEEM

SEQ ID NO: 2865572 - protein, 24 aa, Entamoeba invadens
IKEENEKLKKKKEENWEEEKREKV

SEQ ID NO: 2865573 - protein, 6 aa, Entamoeba invadens
IKEERL

SEQ ID NO: 2865574 - protein, 12 aa, Entamoeba invadens
IKEESDSNEGMT

SEQ ID NO: 2865575 - protein, 7 aa, Entamoeba invadens
IKEESTF

SEQ ID NO: 2865576 - protein, 5 aa, Entamoeba invadens
IKEFP

SEQ ID NO: 2865577 - protein, 5 aa, Entamoeba invadens
IKEGE

SEQ ID NO: 2865578 - protein, 9 aa, Entamoeba invadens
IKEGKLSAE

SEQ ID NO: 2865579 - protein, 7 aa, Entamoeba invadens
IKEGKNA

SEQ ID NO: 2865580 - protein, 18 aa, Entamoeba invadens
IKEGQTGDGKTKLNDLYG

SEQ ID NO: 2865581 - protein, 8 aa, Entamoeba invadens
IKEGVSKG

SEQ ID NO: 2865582 - protein, 8 aa, Entamoeba invadens
IKEHTQSP

SEQ ID NO: 2865583 - protein, 8 aa, Entamoeba invadens
IKEKESAS

SEQ ID NO: 2865584 - protein, 9 aa, Entamoeba invadens
IKEKGESVK

SEQ ID NO: 2865585 - protein, 11 aa, Entamoeba invadens
IKEKGTDNLGT

SEQ ID NO: 2865586 - protein, 9 aa, Entamoeba invadens
IKEKKPNPL

SEQ ID NO: 2865587 - protein, 6 aa, Entamoeba invadens
IKEKNS

SEQ ID NO: 2865588 - protein, 7 aa, Entamoeba invadens
IKEKSKT

SEQ ID NO: 2865589 - protein, 4 aa, Entamoeba invadens
IKEL

SEQ ID NO: 2865590 - protein, 5 aa, Entamoeba invadens
IKELP

SEQ ID NO: 2865591 - protein, 4 aa, Entamoeba invadens
IKEN

SEQ ID NO: 2865592 - protein, 6 aa, Entamoeba invadens
IKENDA

SEQ ID NO: 2865593 - protein, 15 aa, Entamoeba invadens
IKENEKQTQNEIEEC

SEQ ID NO: 2865594 - protein, 7 aa, Entamoeba invadens
IKENGGK

SEQ ID NO: 2865595 - protein, 10 aa, Entamoeba invadens
IKENGQKAEK

SEQ ID NO: 2865596 - protein, 10 aa, Entamoeba invadens
IKENKRKEVN

SEQ ID NO: 2865597 - protein, 8 aa, Entamoeba invadens
IKENPTDC

SEQ ID NO: 2865598 - protein, 12 aa, Entamoeba invadens
IKENQSDVEFHD

SEQ ID NO: 2865599 - protein, 18 aa, Entamoeba invadens
IKEQNDYEFDDEDYSFSE

SEQ ID NO: 2865600 - protein, 6 aa, Entamoeba invadens
IKEQNV

SEQ ID NO: 2865601 - protein, 15 aa, Entamoeba invadens
IKEQRRKVDEQTKRV

SEQ ID NO: 2865602 - protein, 6 aa, Entamoeba invadens
IKEQSL

SEQ ID NO: 2865603 - protein, 6 aa, Entamoeba invadens
IKEREG

SEQ ID NO: 2865604 - protein, 9 aa, Entamoeba invadens
IKERERKQK

SEQ ID NO: 2865605 - protein, 7 aa, Entamoeba invadens
IKERKET

SEQ ID NO: 2865606 - protein, 8 aa, Entamoeba invadens
IKERKSNG

SEQ ID NO: 2865607 - protein, 6 aa, Entamoeba invadens
IKERNA

SEQ ID NO: 2865608 - protein, 7 aa, Entamoeba invadens
IKERSGA

SEQ ID NO: 2865609 - protein, 9 aa, Entamoeba invadens
IKERSKEKQ

SEQ ID NO: 2865610 - protein, 12 aa, Entamoeba invadens
IKESHKADKALP

SEQ ID NO: 2865611 - protein, 7 aa, Entamoeba invadens
IKESPKF

SEQ ID NO: 2865612 - protein, 21 aa, Entamoeba invadens
IKESPKPKTRARQSVQPKVEQ

SEQ ID NO: 2865613 - protein, 6 aa, Entamoeba invadens
IKESQK

SEQ ID NO: 2865614 - protein, 5 aa, Entamoeba invadens
IKESR

SEQ ID NO: 2865615 - protein, 12 aa, Entamoeba invadens
IKESSDEYGDTL

SEQ ID NO: 2865616 - protein, 9 aa, Entamoeba invadens
IKESTGADV

SEQ ID NO: 2865617 - protein, 49 aa, Entamoeba invadens
IKETLRKESQARRKTRERLKERKEEQRRKAAAKENEKKKAQKKKIEEKI

SEQ ID NO: 2865618 - protein, 61 aa, Entamoeba invadens
IKETPKEDATNNVTQKETTGATIQRSTTPELLPQPETTETQPIIQSTDTPTRDEYDDPIPD

SEQ ID NO: 2865619 - protein, 13 aa, Entamoeba invadens
IKETPKPENPLQT

SEQ ID NO: 2865620 - protein, 13 aa, Entamoeba invadens
IKETSRTKDSNMT

SEQ ID NO: 2865621 - protein, 7 aa, Entamoeba invadens
IKETSSD

SEQ ID NO: 2865622 - protein, 16 aa, Entamoeba invadens
IKETTAKRRRTANRMT

SEQ ID NO: 2865623 - protein, 7 aa, Entamoeba invadens
IKEYTGG

SEQ ID NO: 2865624 - protein, 6 aa, Entamoeba invadens
IKGAED

SEQ ID NO: 2865625 - protein, 8 aa, Entamoeba invadens
IKGDEKKM

SEQ ID NO: 2865626 - protein, 16 aa, Entamoeba invadens
IKGDGKDAADKKYEVE

SEQ ID NO: 2865627 - protein, 10 aa, Entamoeba invadens
IKGEKERKNH

SEQ ID NO: 2865628 - protein, 7 aa, Entamoeba invadens
IKGEKKV

SEQ ID NO: 2865629 - protein, 22 aa, Entamoeba invadens
IKGENATETKELVEKKEASLAK

SEQ ID NO: 2865630 - protein, 6 aa, Entamoeba invadens
IKGGDT

SEQ ID NO: 2865631 - protein, 13 aa, Entamoeba invadens
IKGGLAQHTAQRR

SEQ ID NO: 2865632 - protein, 10 aa, Entamoeba invadens
IKGGPNGDVA

SEQ ID NO: 2865633 - protein, 19 aa, Entamoeba invadens
IKGHTREKFPPTNSQDDDL

SEQ ID NO: 2865634 - protein, 11 aa, Entamoeba invadens
IKGIPKKPQGV

SEQ ID NO: 2865635 - protein, 11 aa, Entamoeba invadens
IKGKANRVNVT

SEQ ID NO: 2865636 - protein, 8 aa, Entamoeba invadens
IKGKEVEQ

SEQ ID NO: 2865637 - protein, 11 aa, Entamoeba invadens
IKGKFSKNNLT

SEQ ID NO: 2865638 - protein, 43 aa, Entamoeba invadens
IKGKKEKDSKKKYTQDDIDKAVEKALKEKKAKHKVKKEAMQKQ

SEQ ID NO: 2865639 - protein, 10 aa, Entamoeba invadens
IKGKKGDKNA

SEQ ID NO: 2865640 - protein, 10 aa, Entamoeba invadens
IKGKKGDKNT

SEQ ID NO: 2865641 - protein, 8 aa, Entamoeba invadens
IKGKSQPI

SEQ ID NO: 2865642 - protein, 9 aa, Entamoeba invadens
IKGKTQHLS

SEQ ID NO: 2865643 - protein, 7 aa, Entamoeba invadens
IKGKTTK

SEQ ID NO: 2865644 - protein, 6 aa, Entamoeba invadens
IKGNNN

SEQ ID NO: 2865645 - protein, 6 aa, Entamoeba invadens
IKGPDA

SEQ ID NO: 2865646 - protein, 9 aa, Entamoeba invadens
IKGQSYANL

SEQ ID NO: 2865647 - protein, 7 aa, Entamoeba invadens
IKGRSKK

SEQ ID NO: 2865648 - protein, 5 aa, Entamoeba invadens
IKGSG

SEQ ID NO: 2865649 - protein, 9 aa, Entamoeba invadens
IKGSKGIDV

SEQ ID NO: 2865650 - protein, 11 aa, Entamoeba invadens
IKGSSANLPES

SEQ ID NO: 2865651 - protein, 12 aa, Entamoeba invadens
IKGSSSNNPIDK

SEQ ID NO: 2865652 - protein, 11 aa, Entamoeba invadens
IKKARSPSPLI

SEQ ID NO: 2865653 - protein, 6 aa, Entamoeba invadens
IKKATN

SEQ ID NO: 2865654 - protein, 8 aa, Entamoeba invadens
IKKDDRKI

SEQ ID NO: 2865655 - protein, 15 aa, Entamoeba invadens
IKKDQNEGKKVPQET

SEQ ID NO: 2865656 - protein, 7 aa, Entamoeba invadens
IKKDTEI

SEQ ID NO: 2865657 - protein, 4 aa, Entamoeba invadens
IKKE

SEQ ID NO: 2865658 - protein, 6 aa, Entamoeba invadens
IKKEDP

SEQ ID NO: 2865659 - protein, 17 aa, Entamoeba invadens
IKKEDVEAPEEQQRGID

SEQ ID NO: 2865660 - protein, 20 aa, Entamoeba invadens
IKKEKEENMARKQRRQTSDI

SEQ ID NO: 2865661 - protein, 7 aa, Entamoeba invadens
IKKENHS

SEQ ID NO: 2865662 - protein, 56 aa, Entamoeba invadens
IKKEPKVEKTQVKTEIKKEKKEEKKKESSSSSSSSSSSSSSASQSSDSSSDSSSDS

SEQ ID NO: 2865663 - protein, 7 aa, Entamoeba invadens
IKKGDNL

SEQ ID NO: 2865664 - protein, 7 aa, Entamoeba invadens
IKKGEKC

SEQ ID NO: 2865665 - protein, 8 aa, Entamoeba invadens
IKKGKKLP

SEQ ID NO: 2865666 - protein, 10 aa, Entamoeba invadens
IKKGLKAERE

SEQ ID NO: 2865667 - protein, 22 aa, Entamoeba invadens
IKKGTRNNKKKIKRNVKSTQYM

SEQ ID NO: 2865668 - protein, 4 aa, Entamoeba invadens
IKKI

SEQ ID NO: 2865669 - protein, 13 aa, Entamoeba invadens
IKKKKTPDEREAN

SEQ ID NO: 2865670 - protein, 10 aa, Entamoeba invadens
IKKKQNELTR

SEQ ID NO: 2865671 - protein, 20 aa, Entamoeba invadens
IKKKTGKLRTMKKDAEENLK

SEQ ID NO: 2865672 - protein, 6 aa, Entamoeba invadens
IKKPES

SEQ ID NO: 2865673 - protein, 8 aa, Entamoeba invadens
IKKPNSQL

SEQ ID NO: 2865674 - protein, 12 aa, Entamoeba invadens
IKKPQKKKLCLI

SEQ ID NO: 2865675 - protein, 7 aa, Entamoeba invadens
IKKQGNL

SEQ ID NO: 2865676 - protein, 32 aa, Entamoeba invadens
IKKQPAEKRVETPKECEKKEKSVVTENKGTTY

SEQ ID NO: 2865677 - protein, 26 aa, Entamoeba invadens
IKKQQDDNLSVKKKNHEETKKVQTKL

SEQ ID NO: 2865678 - protein, 23 aa, Entamoeba invadens
IKKQQKDDNLSVKKKGDEEIKKV

SEQ ID NO: 2865679 - protein, 4 aa, Entamoeba invadens
IKKR

SEQ ID NO: 2865680 - protein, 7 aa, Entamoeba invadens
IKKRDEV

SEQ ID NO: 2865681 - protein, 22 aa, Entamoeba invadens
IKKRERREKRSEKKKSEKKEKK

SEQ ID NO: 2865682 - protein, 8 aa, Entamoeba invadens
IKKRRDVD

SEQ ID NO: 2865683 - protein, 4 aa, Entamoeba invadens
IKKS

SEQ ID NO: 2865684 - protein, 9 aa, Entamoeba invadens
IKKSDQSLL

SEQ ID NO: 2865685 - protein, 9 aa, Entamoeba invadens
IKKSPGTYQ

SEQ ID NO: 2865686 - protein, 10 aa, Entamoeba invadens
IKKSPVRGGL

SEQ ID NO: 2865687 - protein, 10 aa, Entamoeba invadens
IKKSSKVKPM

SEQ ID NO: 2865688 - protein, 8 aa, Entamoeba invadens
IKKSSTAQ

SEQ ID NO: 2865689 - protein, 18 aa, Entamoeba invadens
IKKSYKEKKPRKDSDEVL

SEQ ID NO: 2865690 - protein, 7 aa, Entamoeba invadens
IKKTDVK

SEQ ID NO: 2865691 - protein, 12 aa, Entamoeba invadens
IKKTEWTSTEEE

SEQ ID NO: 2865692 - protein, 7 aa, Entamoeba invadens
IKKTGNG

SEQ ID NO: 2865693 - protein, 8 aa, Entamoeba invadens
IKKTSKKI

SEQ ID NO: 2865694 - protein, 9 aa, Entamoeba invadens
IKKTSQILS

SEQ ID NO: 2865695 - protein, 8 aa, Entamoeba invadens
IKKTYKDA

SEQ ID NO: 2865696 - protein, 9 aa, Entamoeba invadens
IKKVDEESF

SEQ ID NO: 2865697 - protein, 11 aa, Entamoeba invadens
IKLESTATIEI

SEQ ID NO: 2865698 - protein, 4 aa, Entamoeba invadens
IKLP

SEQ ID NO: 2865699 - protein, 11 aa, Entamoeba invadens
IKMSSGKLTVE

SEQ ID NO: 2865700 - protein, 9 aa, Entamoeba invadens
IKNAEKYYD

SEQ ID NO: 2865701 - protein, 8 aa, Entamoeba invadens
IKNAPLYN

SEQ ID NO: 2865702 - protein, 18 aa, Entamoeba invadens
IKNASQSEFTKFEDNTQL

SEQ ID NO: 2865703 - protein, 8 aa, Entamoeba invadens
IKNATGKQ

SEQ ID NO: 2865704 - protein, 10 aa, Entamoeba invadens
IKNATTETVE

SEQ ID NO: 2865705 - protein, 4 aa, Entamoeba invadens
IKND

SEQ ID NO: 2865706 - protein, 16 aa, Entamoeba invadens
IKNDEGTEKGKEKNNA

SEQ ID NO: 2865707 - protein, 18 aa, Entamoeba invadens
IKNDPAVTKCGTEYYSPP

SEQ ID NO: 2865708 - protein, 7 aa, Entamoeba invadens
IKNDRET

SEQ ID NO: 2865709 - protein, 4 aa, Entamoeba invadens
IKNE

SEQ ID NO: 2865710 - protein, 5 aa, Entamoeba invadens
IKNEE

SEQ ID NO: 2865711 - protein, 15 aa, Entamoeba invadens
IKNEEEDDKEEKELI

SEQ ID NO: 2865712 - protein, 14 aa, Entamoeba invadens
IKNEIKNLYLPVYF

SEQ ID NO: 2865713 - protein, 43 aa, Entamoeba invadens
IKNETSEMEEERLEEHDDQQYNYKNDKSMEEDEKQYSEEYRDL

SEQ ID NO: 2865714 - protein, 12 aa, Entamoeba invadens
IKNGDVNEEPET

SEQ ID NO: 2865715 - protein, 15 aa, Entamoeba invadens
IKNGEERKEDEENTG

SEQ ID NO: 2865716 - protein, 5 aa, Entamoeba invadens
IKNGT

SEQ ID NO: 2865717 - protein, 14 aa, Entamoeba invadens
IKNIEKEKKELLQK

SEQ ID NO: 2865718 - protein, 9 aa, Entamoeba invadens
IKNISEDMK

SEQ ID NO: 2865719 - protein, 5 aa, Entamoeba invadens
IKNKG

SEQ ID NO: 2865720 - protein, 10 aa, Entamoeba invadens
IKNKKGKQVF

SEQ ID NO: 2865721 - protein, 4 aa, Entamoeba invadens
IKNN

SEQ ID NO: 2865722 - protein, 7 aa, Entamoeba invadens
IKNNDEL

SEQ ID NO: 2865723 - protein, 8 aa, Entamoeba invadens
IKNNEELT

SEQ ID NO: 2865724 - protein, 6 aa, Entamoeba invadens
IKNNTK

SEQ ID NO: 2865725 - protein, 4 aa, Entamoeba invadens
IKNP

SEQ ID NO: 2865726 - protein, 7 aa, Entamoeba invadens
IKNPDNY

SEQ ID NO: 2865727 - protein, 8 aa, Entamoeba invadens
IKNPEFKT

SEQ ID NO: 2865728 - protein, 10 aa, Entamoeba invadens
IKNPSIPNTP

SEQ ID NO: 2865729 - protein, 9 aa, Entamoeba invadens
IKNQDRKYS

SEQ ID NO: 2865730 - protein, 6 aa, Entamoeba invadens
IKNRTE

SEQ ID NO: 2865731 - protein, 9 aa, Entamoeba invadens
IKNSDSDVQ

SEQ ID NO: 2865732 - protein, 8 aa, Entamoeba invadens
IKNTDNTI

SEQ ID NO: 2865733 - protein, 7 aa, Entamoeba invadens
IKNTGEH

SEQ ID NO: 2865734 - protein, 9 aa, Entamoeba invadens
IKPDTNFQN

SEQ ID NO: 2865735 - protein, 6 aa, Entamoeba invadens
IKPEKL

SEQ ID NO: 2865736 - protein, 5 aa, Entamoeba invadens
IKPEN

SEQ ID NO: 2865737 - protein, 9 aa, Entamoeba invadens
IKPEQTKTM

SEQ ID NO: 2865738 - protein, 5 aa, Entamoeba invadens
IKPEV

SEQ ID NO: 2865739 - protein, 4 aa, Entamoeba invadens
IKPF

SEQ ID NO: 2865740 - protein, 6 aa, Entamoeba invadens
IKPGSV

SEQ ID NO: 2865741 - protein, 4 aa, Entamoeba invadens
IKPI

SEQ ID NO: 2865742 - protein, 18 aa, Entamoeba invadens
IKPKEKKHEEEKEKDKKY

SEQ ID NO: 2865743 - protein, 7 aa, Entamoeba invadens
IKPNKVT

SEQ ID NO: 2865744 - protein, 7 aa, Entamoeba invadens
IKPNTSL

SEQ ID NO: 2865745 - protein, 6 aa, Entamoeba invadens
IKPPEN

SEQ ID NO: 2865746 - protein, 5 aa, Entamoeba invadens
IKPPK

SEQ ID NO: 2865747 - protein, 6 aa, Entamoeba invadens
IKPPKG

SEQ ID NO: 2865748 - protein, 5 aa, Entamoeba invadens
IKPPR

SEQ ID NO: 2865749 - protein, 6 aa, Entamoeba invadens
IKPQTA

SEQ ID NO: 2865750 - protein, 40 aa, Entamoeba invadens
IKPRKNSKPQMTAQRKGEGHKKEEETQDQNKLTTSVPNLQ

SEQ ID NO: 2865751 - protein, 4 aa, Entamoeba invadens
IKPS

SEQ ID NO: 2865752 - protein, 8 aa, Entamoeba invadens
IKPSKKTA

SEQ ID NO: 2865753 - protein, 8 aa, Entamoeba invadens
IKPSQNEV

SEQ ID NO: 2865754 - protein, 44 aa, Entamoeba invadens
IKPSVVEKKGEPKSEQKVEKKEVNVGKLEENKMNAQNKTSPSYC

SEQ ID NO: 2865755 - protein, 4 aa, Entamoeba invadens
IKPT

SEQ ID NO: 2865756 - protein, 7 aa, Entamoeba invadens
IKPTDKR

SEQ ID NO: 2865757 - protein, 12 aa, Entamoeba invadens
IKPTKVNNEEMA

SEQ ID NO: 2865758 - protein, 56 aa, Entamoeba invadens
IKPTNGSSGFSFGDTTNKGFDFDSQSEEKNASPVKQPESVETPQIKSADVKTKEDE

SEQ ID NO: 2865759 - protein, 7 aa, Entamoeba invadens
IKPTPLY

SEQ ID NO: 2865760 - protein, 22 aa, Entamoeba invadens
IKQCQDPEELEELKRKKQTISQ

SEQ ID NO: 2865761 - protein, 6 aa, Entamoeba invadens
IKQDPR

SEQ ID NO: 2865762 - protein, 8 aa, Entamoeba invadens
IKQEINKE

SEQ ID NO: 2865763 - protein, 6 aa, Entamoeba invadens
IKQEKV

SEQ ID NO: 2865764 - protein, 16 aa, Entamoeba invadens
IKQEPKEQNPEITQDQ

SEQ ID NO: 2865765 - protein, 21 aa, Entamoeba invadens
IKQEQPQNFDDDSATAEEPLP

SEQ ID NO: 2865766 - protein, 30 aa, Entamoeba invadens
IKQEQPQNFDDDSATAEEPLPKEMVNDAGI

SEQ ID NO: 2865767 - protein, 5 aa, Entamoeba invadens
IKQER

SEQ ID NO: 2865768 - protein, 12 aa, Entamoeba invadens
IKQEREEDGIPV

SEQ ID NO: 2865769 - protein, 9 aa, Entamoeba invadens
IKQFSRKKD

SEQ ID NO: 2865770 - protein, 9 aa, Entamoeba invadens
IKQGEPNCD

SEQ ID NO: 2865771 - protein, 7 aa, Entamoeba invadens
IKQGNGK

SEQ ID NO: 2865772 - protein, 17 aa, Entamoeba invadens
IKQKPTKPKKIKKEEQI

SEQ ID NO: 2865773 - protein, 139 aa, Entamoeba invadens
IKQKRDAEADAKRKENEEKRKEKERKEKAEKDRLENERLEKEKAEKLRAKMEEDKKIAEQKRQEELKRQEEAKKAEEMKRQEELKKQEEIRAQQEKARLQKIEEQKKIEEQKRKAEELKQLEERKKQEELKKAEEERQR

SEQ ID NO: 2865774 - protein, 6 aa, Entamoeba invadens
IKQLTG

SEQ ID NO: 2865775 - protein, 10 aa, Entamoeba invadens
IKQNGEKNKM

SEQ ID NO: 2865776 - protein, 10 aa, Entamoeba invadens
IKQNQTSSQE

SEQ ID NO: 2865777 - protein, 5 aa, Entamoeba invadens
IKQNR

SEQ ID NO: 2865778 - protein, 11 aa, Entamoeba invadens
IKQPAKKSVVT

SEQ ID NO: 2865779 - protein, 9 aa, Entamoeba invadens
IKQPVQSDS

SEQ ID NO: 2865780 - protein, 4 aa, Entamoeba invadens
IKQQ

SEQ ID NO: 2865781 - protein, 15 aa, Entamoeba invadens
IKQSNNKARVFLNEI

SEQ ID NO: 2865782 - protein, 7 aa, Entamoeba invadens
IKQSPNN

SEQ ID NO: 2865783 - protein, 9 aa, Entamoeba invadens
IKQSQEKIS

SEQ ID NO: 2865784 - protein, 20 aa, Entamoeba invadens
IKQSTDTINPRKDADIPQTT

SEQ ID NO: 2865785 - protein, 8 aa, Entamoeba invadens
IKQSTTPI

SEQ ID NO: 2865786 - protein, 11 aa, Entamoeba invadens
IKQTASEKSPI

SEQ ID NO: 2865787 - protein, 9 aa, Entamoeba invadens
IKQTNEREI

SEQ ID NO: 2865788 - protein, 18 aa, Entamoeba invadens
IKQYTDDEYGAGFPNEET

SEQ ID NO: 2865789 - protein, 6 aa, Entamoeba invadens
IKRDKL

SEQ ID NO: 2865790 - protein, 8 aa, Entamoeba invadens
IKRDQSFK

SEQ ID NO: 2865791 - protein, 9 aa, Entamoeba invadens
IKRDTSKVS

SEQ ID NO: 2865792 - protein, 4 aa, Entamoeba invadens
IKRE

SEQ ID NO: 2865793 - protein, 7 aa, Entamoeba invadens
IKREGDA

SEQ ID NO: 2865794 - protein, 8 aa, Entamoeba invadens
IKREGPQI

SEQ ID NO: 2865795 - protein, 6 aa, Entamoeba invadens
IKRESP

SEQ ID NO: 2865796 - protein, 9 aa, Entamoeba invadens
IKRETDTTP

SEQ ID NO: 2865797 - protein, 7 aa, Entamoeba invadens
IKRGMED

SEQ ID NO: 2865798 - protein, 5 aa, Entamoeba invadens
IKRGR

SEQ ID NO: 2865799 - protein, 10 aa, Entamoeba invadens
IKRGSSDEVS

SEQ ID NO: 2865800 - protein, 11 aa, Entamoeba invadens
IKRGTSLGQIP

SEQ ID NO: 2865801 - protein, 11 aa, Entamoeba invadens
IKRKDKITAKF

SEQ ID NO: 2865802 - protein, 8 aa, Entamoeba invadens
IKRKESEL

SEQ ID NO: 2865803 - protein, 10 aa, Entamoeba invadens
IKRKKEVEKD

SEQ ID NO: 2865804 - protein, 8 aa, Entamoeba invadens
IKRKQEEP

SEQ ID NO: 2865805 - protein, 4 aa, Entamoeba invadens
IKRN

SEQ ID NO: 2865806 - protein, 40 aa, Entamoeba invadens
IKRNDEDNNDNEDTSNDEKDENFDVNKDTEIDKSDKNTIN

SEQ ID NO: 2865807 - protein, 9 aa, Entamoeba invadens
IKRNPNDHL

SEQ ID NO: 2865808 - protein, 9 aa, Entamoeba invadens
IKRNQQPFG

SEQ ID NO: 2865809 - protein, 10 aa, Entamoeba invadens
IKRNTATMQP

SEQ ID NO: 2865810 - protein, 14 aa, Entamoeba invadens
IKRPKKYSSRTSTI

SEQ ID NO: 2865811 - protein, 13 aa, Entamoeba invadens
IKRPKKYSTHTST

SEQ ID NO: 2865812 - protein, 6 aa, Entamoeba invadens
IKRPTA

SEQ ID NO: 2865813 - protein, 10 aa, Entamoeba invadens
IKRPTKPQHL

SEQ ID NO: 2865814 - protein, 18 aa, Entamoeba invadens
IKRSDVKKRIAGSQKMSA

SEQ ID NO: 2865815 - protein, 7 aa, Entamoeba invadens
IKRSTDL

SEQ ID NO: 2865816 - protein, 9 aa, Entamoeba invadens
IKRTDEAQT

SEQ ID NO: 2865817 - protein, 7 aa, Entamoeba invadens
IKRTKLE

SEQ ID NO: 2865818 - protein, 9 aa, Entamoeba invadens
IKRTNTWVS

SEQ ID NO: 2865819 - protein, 8 aa, Entamoeba invadens
IKRTPTQL

SEQ ID NO: 2865820 - protein, 6 aa, Entamoeba invadens
IKSAYG

SEQ ID NO: 2865821 - protein, 4 aa, Entamoeba invadens
IKSD

SEQ ID NO: 2865822 - protein, 10 aa, Entamoeba invadens
IKSDEEKQNY

SEQ ID NO: 2865823 - protein, 8 aa, Entamoeba invadens
IKSDSDAM

SEQ ID NO: 2865824 - protein, 31 aa, Entamoeba invadens
IKSEKEGKVDSNEKKESESLSEIKADSSGID

SEQ ID NO: 2865825 - protein, 8 aa, Entamoeba invadens
IKSENETF

SEQ ID NO: 2865826 - protein, 8 aa, Entamoeba invadens
IKSEQGDN

SEQ ID NO: 2865827 - protein, 9 aa, Entamoeba invadens
IKSEQGDNY

SEQ ID NO: 2865828 - protein, 7 aa, Entamoeba invadens
IKSGETE

SEQ ID NO: 2865829 - protein, 10 aa, Entamoeba invadens
IKSGGGDLKT

SEQ ID NO: 2865830 - protein, 21 aa, Entamoeba invadens
IKSGKIDETTTYQGFQVFDQN

SEQ ID NO: 2865831 - protein, 6 aa, Entamoeba invadens
IKSGLT

SEQ ID NO: 2865832 - protein, 6 aa, Entamoeba invadens
IKSGQE

SEQ ID NO: 2865833 - protein, 4 aa, Entamoeba invadens
IKSI

SEQ ID NO: 2865834 - protein, 5 aa, Entamoeba invadens
IKSIN

SEQ ID NO: 2865835 - protein, 4 aa, Entamoeba invadens
IKSK

SEQ ID NO: 2865836 - protein, 15 aa, Entamoeba invadens
IKSKEVIEEKGSEGV

SEQ ID NO: 2865837 - protein, 9 aa, Entamoeba invadens
IKSKTAYEL

SEQ ID NO: 2865838 - protein, 5 aa, Entamoeba invadens
IKSLG

SEQ ID NO: 2865839 - protein, 5 aa, Entamoeba invadens
IKSNC

SEQ ID NO: 2865840 - protein, 14 aa, Entamoeba invadens
IKSNEDEKKNNAIQ

SEQ ID NO: 2865841 - protein, 12 aa, Entamoeba invadens
IKSPPSPDRMPN

SEQ ID NO: 2865842 - protein, 7 aa, Entamoeba invadens
IKSPQNL

SEQ ID NO: 2865843 - protein, 8 aa, Entamoeba invadens
IKSREDLV

SEQ ID NO: 2865844 - protein, 10 aa, Entamoeba invadens
IKSRNGNKRL

SEQ ID NO: 2865845 - protein, 8 aa, Entamoeba invadens
IKSRTNKL

SEQ ID NO: 2865846 - protein, 12 aa, Entamoeba invadens
IKSSELEKTNLE

SEQ ID NO: 2865847 - protein, 11 aa, Entamoeba invadens
IKSSGTPEKKI

SEQ ID NO: 2865848 - protein, 34 aa, Entamoeba invadens
IKSSQPQKPTPQPSGENVTVSANGQNQQPKKKGF

SEQ ID NO: 2865849 - protein, 5 aa, Entamoeba invadens
IKSSY

SEQ ID NO: 2865850 - protein, 36 aa, Entamoeba invadens
IKSTAKKSDDEVEESGTNTHLSDDGAEKKQNEHKEV

SEQ ID NO: 2865851 - protein, 8 aa, Entamoeba invadens
IKSTGDPD

SEQ ID NO: 2865852 - protein, 9 aa, Entamoeba invadens
IKSTKEHEN

SEQ ID NO: 2865853 - protein, 9 aa, Entamoeba invadens
IKSVRGNSL

SEQ ID NO: 2865854 - protein, 4 aa, Entamoeba invadens
IKSY

SEQ ID NO: 2865855 - protein, 4 aa, Entamoeba invadens
IKTA

SEQ ID NO: 2865856 - protein, 11 aa, Entamoeba invadens
IKTAEEQYDEK

SEQ ID NO: 2865857 - protein, 16 aa, Entamoeba invadens
IKTDEPKQEETKEDVK

SEQ ID NO: 2865858 - protein, 7 aa, Entamoeba invadens
IKTDPGV

SEQ ID NO: 2865859 - protein, 5 aa, Entamoeba invadens
IKTEK

SEQ ID NO: 2865860 - protein, 11 aa, Entamoeba invadens
IKTEKKLGEGS

SEQ ID NO: 2865861 - protein, 15 aa, Entamoeba invadens
IKTEKQVESEPDRYK

SEQ ID NO: 2865862 - protein, 9 aa, Entamoeba invadens
IKTGAPCRS

SEQ ID NO: 2865863 - protein, 9 aa, Entamoeba invadens
IKTGKERDM

SEQ ID NO: 2865864 - protein, 9 aa, Entamoeba invadens
IKTKELEQQ

SEQ ID NO: 2865865 - protein, 6 aa, Entamoeba invadens
IKTKEM

SEQ ID NO: 2865866 - protein, 8 aa, Entamoeba invadens
IKTKSKDE

SEQ ID NO: 2865867 - protein, 7 aa, Entamoeba invadens
IKTKSKE

SEQ ID NO: 2865868 - protein, 7 aa, Entamoeba invadens
IKTKSRE

SEQ ID NO: 2865869 - protein, 4 aa, Entamoeba invadens
IKTL

SEQ ID NO: 2865870 - protein, 6 aa, Entamoeba invadens
IKTMTN

SEQ ID NO: 2865871 - protein, 5 aa, Entamoeba invadens
IKTND

SEQ ID NO: 2865872 - protein, 7 aa, Entamoeba invadens
IKTNNRQ

SEQ ID NO: 2865873 - protein, 6 aa, Entamoeba invadens
IKTNPI

SEQ ID NO: 2865874 - protein, 7 aa, Entamoeba invadens
IKTNPQL

SEQ ID NO: 2865875 - protein, 8 aa, Entamoeba invadens
IKTNTFRK

SEQ ID NO: 2865876 - protein, 4 aa, Entamoeba invadens
IKTP

SEQ ID NO: 2865877 - protein, 14 aa, Entamoeba invadens
IKTPCEKCGTCGNY

SEQ ID NO: 2865878 - protein, 10 aa, Entamoeba invadens
IKTPKQEKEC

SEQ ID NO: 2865879 - protein, 7 aa, Entamoeba invadens
IKTPPNI

SEQ ID NO: 2865880 - protein, 6 aa, Entamoeba invadens
IKTPQQ

SEQ ID NO: 2865881 - protein, 8 aa, Entamoeba invadens
IKTPSEEA

SEQ ID NO: 2865882 - protein, 9 aa, Entamoeba invadens
IKTPSPRRV

SEQ ID NO: 2865883 - protein, 14 aa, Entamoeba invadens
IKTPTPPQNEPKQV

SEQ ID NO: 2865884 - protein, 4 aa, Entamoeba invadens
IKTQ

SEQ ID NO: 2865885 - protein, 15 aa, Entamoeba invadens
IKTQAIEKKEEKVKV

SEQ ID NO: 2865886 - protein, 9 aa, Entamoeba invadens
IKTQKDTEA

SEQ ID NO: 2865887 - protein, 5 aa, Entamoeba invadens
IKTQN

SEQ ID NO: 2865888 - protein, 6 aa, Entamoeba invadens
IKTQRI

SEQ ID NO: 2865889 - protein, 5 aa, Entamoeba invadens
IKTQT

SEQ ID NO: 2865890 - protein, 6 aa, Entamoeba invadens
IKTREQ

SEQ ID NO: 2865891 - protein, 7 aa, Entamoeba invadens
IKTSAQN

SEQ ID NO: 2865892 - protein, 9 aa, Entamoeba invadens
IKTSETGYI

SEQ ID NO: 2865893 - protein, 11 aa, Entamoeba invadens
IKTSETKLTED

SEQ ID NO: 2865894 - protein, 6 aa, Entamoeba invadens
IKTSGD

SEQ ID NO: 2865895 - protein, 9 aa, Entamoeba invadens
IKTSPQKSS

SEQ ID NO: 2865896 - protein, 8 aa, Entamoeba invadens
IKTSYEAS

SEQ ID NO: 2865897 - protein, 8 aa, Entamoeba invadens
IKTTEGFG

SEQ ID NO: 2865898 - protein, 16 aa, Entamoeba invadens
IKTTHDNNTSDPKWDQ

SEQ ID NO: 2865899 - protein, 8 aa, Entamoeba invadens
IKTTKEIE

SEQ ID NO: 2865900 - protein, 6 aa, Entamoeba invadens
IKTTSS

SEQ ID NO: 2865901 - protein, 5 aa, Entamoeba invadens
IKTTT

SEQ ID NO: 2865902 - protein, 10 aa, Entamoeba invadens
IKTVDDKDKR

SEQ ID NO: 2865903 - protein, 35 aa, Entamoeba invadens
IKTVNSTKLKAKDIKNKIGGTFGKAELSRNKTKAF

SEQ ID NO: 2865904 - protein, 17 aa, Entamoeba invadens
IKTVNTKALENADEVSV

SEQ ID NO: 2865905 - protein, 4 aa, Entamoeba invadens
IKTY

SEQ ID NO: 2865906 - protein, 17 aa, Entamoeba invadens
IKTYEGIDEVNKENKMK

SEQ ID NO: 2865907 - protein, 10 aa, Entamoeba invadens
IKVDEEKVEE

SEQ ID NO: 2865908 - protein, 5 aa, Entamoeba invadens
IKVED

SEQ ID NO: 2865909 - protein, 7 aa, Entamoeba invadens
IKVPSSV

SEQ ID NO: 2865910 - protein, 9 aa, Entamoeba invadens
IKVSTQKQA

SEQ ID NO: 2865911 - protein, 7 aa, Entamoeba invadens
IKVTTSV

SEQ ID NO: 2865912 - protein, 10 aa, Entamoeba invadens
IKYAPKTTIA

SEQ ID NO: 2865913 - protein, 10 aa, Entamoeba invadens
IKYDSSKHGL

SEQ ID NO: 2865914 - protein, 13 aa, Entamoeba invadens
IKYKEDEKENIGI

SEQ ID NO: 2865915 - protein, 8 aa, Entamoeba invadens
IKYPPSDC

SEQ ID NO: 2865916 - protein, 4 aa, Entamoeba invadens
IKYT

SEQ ID NO: 2865917 - protein, 8 aa, Entamoeba invadens
IKYTQKDR

SEQ ID NO: 2865918 - protein, 12 aa, Entamoeba invadens
ILEEKKKEEPVD

SEQ ID NO: 2865919 - protein, 8 aa, Entamoeba invadens
ILESSDKT

SEQ ID NO: 2865920 - protein, 15 aa, Entamoeba invadens
ILETKNKAKESKIGV

SEQ ID NO: 2865921 - protein, 10 aa, Entamoeba invadens
ILETPDGQLD

SEQ ID NO: 2865922 - protein, 7 aa, Entamoeba invadens
ILNNTDQ

SEQ ID NO: 2865923 - protein, 6 aa, Entamoeba invadens
ILPDDN

SEQ ID NO: 2865924 - protein, 22 aa, Entamoeba invadens
ILPDNKTREQIRQDIKNKENAI

SEQ ID NO: 2865925 - protein, 7 aa, Entamoeba invadens
ILPDSYD

SEQ ID NO: 2865926 - protein, 11 aa, Entamoeba invadens
ILPESTPTNTM

SEQ ID NO: 2865927 - protein, 4 aa, Entamoeba invadens
ILPK

SEQ ID NO: 2865928 - protein, 11 aa, Entamoeba invadens
ILPTPTPQQLH

SEQ ID NO: 2865929 - protein, 6 aa, Entamoeba invadens
ILQPDP

SEQ ID NO: 2865930 - protein, 5 aa, Entamoeba invadens
ILSGE

SEQ ID NO: 2865931 - protein, 5 aa, Entamoeba invadens
ILSQT

SEQ ID NO: 2865932 - protein, 13 aa, Entamoeba invadens
ILSSTNTLNPSEI

SEQ ID NO: 2865933 - protein, 13 aa, Entamoeba invadens
ILTDEKNSNLGKE

SEQ ID NO: 2865934 - protein, 9 aa, Entamoeba invadens
ILTETERKT

SEQ ID NO: 2865935 - protein, 5 aa, Entamoeba invadens
ILTQR

SEQ ID NO: 2865936 - protein, 8 aa, Entamoeba invadens
IMDGADSD

SEQ ID NO: 2865937 - protein, 12 aa, Entamoeba invadens
IMETDKQGELKE

SEQ ID NO: 2865938 - protein, 14 aa, Entamoeba invadens
IMNPPIPPQQGTTI

SEQ ID NO: 2865939 - protein, 7 aa, Entamoeba invadens
IMSGESI

SEQ ID NO: 2865940 - protein, 10 aa, Entamoeba invadens
IMTSSPDFIG

SEQ ID NO: 2865941 - protein, 6 aa, Entamoeba invadens
INAERK

SEQ ID NO: 2865942 - protein, 15 aa, Entamoeba invadens
INAERTKQKKELKKL

SEQ ID NO: 2865943 - protein, 11 aa, Entamoeba invadens
INAGQSYASFS

SEQ ID NO: 2865944 - protein, 4 aa, Entamoeba invadens
INAS

SEQ ID NO: 2865945 - protein, 9 aa, Entamoeba invadens
INASEQESV

SEQ ID NO: 2865946 - protein, 11 aa, Entamoeba invadens
INATDIPEGVD

SEQ ID NO: 2865947 - protein, 21 aa, Entamoeba invadens
INCPSKKRDNRCPTKGENCVS

SEQ ID NO: 2865948 - protein, 15 aa, Entamoeba invadens
INCPSKKRQSLSHKR

SEQ ID NO: 2865949 - protein, 15 aa, Entamoeba invadens
INCPSKKSQSLSHKR

SEQ ID NO: 2865950 - protein, 4 aa, Entamoeba invadens
INCS

SEQ ID NO: 2865951 - protein, 4 aa, Entamoeba invadens
INDA

SEQ ID NO: 2865952 - protein, 10 aa, Entamoeba invadens
INDDKIRDAH

SEQ ID NO: 2865953 - protein, 8 aa, Entamoeba invadens
INDDSGLT

SEQ ID NO: 2865954 - protein, 25 aa, Entamoeba invadens
INDEKEDKLKEAYKRISSAEKEKME

SEQ ID NO: 2865955 - protein, 5 aa, Entamoeba invadens
INDGD

SEQ ID NO: 2865956 - protein, 6 aa, Entamoeba invadens
INDGPF

SEQ ID NO: 2865957 - protein, 9 aa, Entamoeba invadens
INDKDDLRD

SEQ ID NO: 2865958 - protein, 9 aa, Entamoeba invadens
INDKSADPV

SEQ ID NO: 2865959 - protein, 5 aa, Entamoeba invadens
INDKT

SEQ ID NO: 2865960 - protein, 5 aa, Entamoeba invadens
INDNF

SEQ ID NO: 2865961 - protein, 10 aa, Entamoeba invadens
INDNGDISDE

SEQ ID NO: 2865962 - protein, 9 aa, Entamoeba invadens
INDNKTIER

SEQ ID NO: 2865963 - protein, 12 aa, Entamoeba invadens
INDPSVAKDFSP

SEQ ID NO: 2865964 - protein, 10 aa, Entamoeba invadens
INDRLKNQSD

SEQ ID NO: 2865965 - protein, 23 aa, Entamoeba invadens
INDRQEKKKVANEKRIDIVNMIY

SEQ ID NO: 2865966 - protein, 16 aa, Entamoeba invadens
INDSSKPFTSTTGEVI

SEQ ID NO: 2865967 - protein, 11 aa, Entamoeba invadens
INDTKSVETLS

SEQ ID NO: 2865968 - protein, 8 aa, Entamoeba invadens
INDTTGRQ

SEQ ID NO: 2865969 - protein, 10 aa, Entamoeba invadens
INEDGKENIM

SEQ ID NO: 2865970 - protein, 52 aa, Entamoeba invadens
INEELEKQVREEVENEMQKSQPDDDQKDQTSNNNSLNSENKMTQNDSCDKHC

SEQ ID NO: 2865971 - protein, 5 aa, Entamoeba invadens
INEEQ

SEQ ID NO: 2865972 - protein, 11 aa, Entamoeba invadens
INEESANTKKK

SEQ ID NO: 2865973 - protein, 7 aa, Entamoeba invadens
INEESVS

SEQ ID NO: 2865974 - protein, 16 aa, Entamoeba invadens
INEESVSRIIQKTITA

SEQ ID NO: 2865975 - protein, 7 aa, Entamoeba invadens
INEETIQ

SEQ ID NO: 2865976 - protein, 6 aa, Entamoeba invadens
INEETV

SEQ ID NO: 2865977 - protein, 4 aa, Entamoeba invadens
INEG

SEQ ID NO: 2865978 - protein, 4 aa, Entamoeba invadens
INEI

SEQ ID NO: 2865979 - protein, 5 aa, Entamoeba invadens
INEIE

SEQ ID NO: 2865980 - protein, 5 aa, Entamoeba invadens
INEIP

SEQ ID NO: 2865981 - protein, 20 aa, Entamoeba invadens
INEITKRRNLQKTQRKNERL

SEQ ID NO: 2865982 - protein, 4 aa, Entamoeba invadens
INEK

SEQ ID NO: 2865983 - protein, 9 aa, Entamoeba invadens
INEKEDTEK

SEQ ID NO: 2865984 - protein, 9 aa, Entamoeba invadens
INEKGKENI

SEQ ID NO: 2865985 - protein, 6 aa, Entamoeba invadens
INEKPS

SEQ ID NO: 2865986 - protein, 8 aa, Entamoeba invadens
INEKQSSL

SEQ ID NO: 2865987 - protein, 15 aa, Entamoeba invadens
INEKRRRLNSPNEDA

SEQ ID NO: 2865988 - protein, 10 aa, Entamoeba invadens
INEKTAESKL

SEQ ID NO: 2865989 - protein, 4 aa, Entamoeba invadens
INEL

SEQ ID NO: 2865990 - protein, 4 aa, Entamoeba invadens
INEN

SEQ ID NO: 2865991 - protein, 11 aa, Entamoeba invadens
INENEENDKNK

SEQ ID NO: 2865992 - protein, 8 aa, Entamoeba invadens
INENEIDP

SEQ ID NO: 2865993 - protein, 5 aa, Entamoeba invadens
INENN

SEQ ID NO: 2865994 - protein, 16 aa, Entamoeba invadens
INENPGWDSTPYTDNG

SEQ ID NO: 2865995 - protein, 17 aa, Entamoeba invadens
INENSNEHKSEVAAPAL

SEQ ID NO: 2865996 - protein, 24 aa, Entamoeba invadens
INEPSMKRINTEKKINPTPQMSST

SEQ ID NO: 2865997 - protein, 7 aa, Entamoeba invadens
INEPTAA

SEQ ID NO: 2865998 - protein, 17 aa, Entamoeba invadens
INEPTDRKFAAAIVKFL

SEQ ID NO: 2865999 - protein, 8 aa, Entamoeba invadens
INEPTEKK

SEQ ID NO: 2866000 - protein, 16 aa, Entamoeba invadens
INEQISTAGYEASGTS

SEQ ID NO: 2866001 - protein, 22 aa, Entamoeba invadens
INEQMQRKSKPTFDKPNRQVTP

SEQ ID NO: 2866002 - protein, 8 aa, Entamoeba invadens
INEQTSLN

SEQ ID NO: 2866003 - protein, 4 aa, Entamoeba invadens
INER

SEQ ID NO: 2866004 - protein, 13 aa, Entamoeba invadens
INERENVKQMENE

SEQ ID NO: 2866005 - protein, 4 aa, Entamoeba invadens
INES

SEQ ID NO: 2866006 - protein, 7 aa, Entamoeba invadens
INESDAD

SEQ ID NO: 2866007 - protein, 11 aa, Entamoeba invadens
INESDDTIKDN

SEQ ID NO: 2866008 - protein, 7 aa, Entamoeba invadens
INESEEP

SEQ ID NO: 2866009 - protein, 22 aa, Entamoeba invadens
INESFEKARKRYDEIKPDDDNL

SEQ ID NO: 2866010 - protein, 7 aa, Entamoeba invadens
INESPEL

SEQ ID NO: 2866011 - protein, 8 aa, Entamoeba invadens
INESQSEC

SEQ ID NO: 2866012 - protein, 11 aa, Entamoeba invadens
INESVDESKVK

SEQ ID NO: 2866013 - protein, 13 aa, Entamoeba invadens
INETDDANDITSC

SEQ ID NO: 2866014 - protein, 6 aa, Entamoeba invadens
INETNE

SEQ ID NO: 2866015 - protein, 8 aa, Entamoeba invadens
INETPTYD

SEQ ID NO: 2866016 - protein, 13 aa, Entamoeba invadens
INEVDAKKKSKGF

SEQ ID NO: 2866017 - protein, 4 aa, Entamoeba invadens
INGA

SEQ ID NO: 2866018 - protein, 8 aa, Entamoeba invadens
INGDFDKA

SEQ ID NO: 2866019 - protein, 15 aa, Entamoeba invadens
INGEEQQKVEVPLEQ

SEQ ID NO: 2866020 - protein, 4 aa, Entamoeba invadens
INGG

SEQ ID NO: 2866021 - protein, 4 aa, Entamoeba invadens
INGI

SEQ ID NO: 2866022 - protein, 6 aa, Entamoeba invadens
INGKKG

SEQ ID NO: 2866023 - protein, 5 aa, Entamoeba invadens
INGKS

SEQ ID NO: 2866024 - protein, 7 aa, Entamoeba invadens
INGPNGT

SEQ ID NO: 2866025 - protein, 9 aa, Entamoeba invadens
INGQEGHEL

SEQ ID NO: 2866026 - protein, 17 aa, Entamoeba invadens
INGQTYTPKSIHVFQLS

SEQ ID NO: 2866027 - protein, 7 aa, Entamoeba invadens
INGRKPE

SEQ ID NO: 2866028 - protein, 5 aa, Entamoeba invadens
INGRR

SEQ ID NO: 2866029 - protein, 5 aa, Entamoeba invadens
INGRS

SEQ ID NO: 2866030 - protein, 8 aa, Entamoeba invadens
INGRYGND

SEQ ID NO: 2866031 - protein, 8 aa, Entamoeba invadens
INGSPNSR

SEQ ID NO: 2866032 - protein, 8 aa, Entamoeba invadens
INGSSSTF

SEQ ID NO: 2866033 - protein, 9 aa, Entamoeba invadens
INGTSGQLS

SEQ ID NO: 2866034 - protein, 6 aa, Entamoeba invadens
INGTTN

SEQ ID NO: 2866035 - protein, 4 aa, Entamoeba invadens
INGV

SEQ ID NO: 2866036 - protein, 4 aa, Entamoeba invadens
INHT

SEQ ID NO: 2866037 - protein, 11 aa, Entamoeba invadens
INIEEREVEGV

SEQ ID NO: 2866038 - protein, 4 aa, Entamoeba invadens
INIP

SEQ ID NO: 2866039 - protein, 10 aa, Entamoeba invadens
INIPSSVTSI

SEQ ID NO: 2866040 - protein, 10 aa, Entamoeba invadens
INKANGGKVR

SEQ ID NO: 2866041 - protein, 12 aa, Entamoeba invadens
INKANGGKVRYT

SEQ ID NO: 2866042 - protein, 9 aa, Entamoeba invadens
INKATKENH

SEQ ID NO: 2866043 - protein, 9 aa, Entamoeba invadens
INKDETEEI

SEQ ID NO: 2866044 - protein, 9 aa, Entamoeba invadens
INKEDKENF

SEQ ID NO: 2866045 - protein, 7 aa, Entamoeba invadens
INKEDKT

SEQ ID NO: 2866046 - protein, 8 aa, Entamoeba invadens
INKEDKTV

SEQ ID NO: 2866047 - protein, 6 aa, Entamoeba invadens
INKESI

SEQ ID NO: 2866048 - protein, 10 aa, Entamoeba invadens
INKGKSFDHQ

SEQ ID NO: 2866049 - protein, 10 aa, Entamoeba invadens
INKGQLSKSE

SEQ ID NO: 2866050 - protein, 6 aa, Entamoeba invadens
INKKID

SEQ ID NO: 2866051 - protein, 9 aa, Entamoeba invadens
INKKKSRYV

SEQ ID NO: 2866052 - protein, 10 aa, Entamoeba invadens
INKKSSGAMP

SEQ ID NO: 2866053 - protein, 9 aa, Entamoeba invadens
INKNGDGTF

SEQ ID NO: 2866054 - protein, 8 aa, Entamoeba invadens
INKNGTID

SEQ ID NO: 2866055 - protein, 10 aa, Entamoeba invadens
INKNTPKEVE

SEQ ID NO: 2866056 - protein, 10 aa, Entamoeba invadens
INKNTREHVE

SEQ ID NO: 2866057 - protein, 7 aa, Entamoeba invadens
INKPADT

SEQ ID NO: 2866058 - protein, 7 aa, Entamoeba invadens
INKPAEV

SEQ ID NO: 2866059 - protein, 18 aa, Entamoeba invadens
INKPKTSEEVKNSDECLI

SEQ ID NO: 2866060 - protein, 6 aa, Entamoeba invadens
INKPLT

SEQ ID NO: 2866061 - protein, 15 aa, Entamoeba invadens
INKQEEDNKAKRYGD

SEQ ID NO: 2866062 - protein, 12 aa, Entamoeba invadens
INKQSSEEKKKC

SEQ ID NO: 2866063 - protein, 5 aa, Entamoeba invadens
INKRH

SEQ ID NO: 2866064 - protein, 8 aa, Entamoeba invadens
INKRNRHY

SEQ ID NO: 2866065 - protein, 8 aa, Entamoeba invadens
INKRPEYN

SEQ ID NO: 2866066 - protein, 6 aa, Entamoeba invadens
INKSDD

SEQ ID NO: 2866067 - protein, 8 aa, Entamoeba invadens
INKSGNAA

SEQ ID NO: 2866068 - protein, 5 aa, Entamoeba invadens
INKSK

SEQ ID NO: 2866069 - protein, 11 aa, Entamoeba invadens
INKSMNPDEAV

SEQ ID NO: 2866070 - protein, 11 aa, Entamoeba invadens
INKTKETMETA

SEQ ID NO: 2866071 - protein, 15 aa, Entamoeba invadens
INKTLEKGKVQASTI

SEQ ID NO: 2866072 - protein, 18 aa, Entamoeba invadens
INKTPTQIRDKVNNTRSS

SEQ ID NO: 2866073 - protein, 8 aa, Entamoeba invadens
INKTQRTY

SEQ ID NO: 2866074 - protein, 8 aa, Entamoeba invadens
INLPPEES

SEQ ID NO: 2866075 - protein, 4 aa, Entamoeba invadens
INNA

SEQ ID NO: 2866076 - protein, 4 aa, Entamoeba invadens
INND

SEQ ID NO: 2866077 - protein, 8 aa, Entamoeba invadens
INNDNKKL

SEQ ID NO: 2866078 - protein, 10 aa, Entamoeba invadens
INNDQEKAMK

SEQ ID NO: 2866079 - protein, 21 aa, Entamoeba invadens
INNETNGDKKQKKSSKGKIRN

SEQ ID NO: 2866080 - protein, 9 aa, Entamoeba invadens
INNKGEKTI

SEQ ID NO: 2866081 - protein, 6 aa, Entamoeba invadens
INNKGV

SEQ ID NO: 2866082 - protein, 11 aa, Entamoeba invadens
INNKVGSINDN

SEQ ID NO: 2866083 - protein, 19 aa, Entamoeba invadens
INNNNIQQSVEQKDEQMTT

SEQ ID NO: 2866084 - protein, 20 aa, Entamoeba invadens
INNNNIQQSVEQKDKQMTTI

SEQ ID NO: 2866085 - protein, 22 aa, Entamoeba invadens
INNNNTQQSVEQKDEQMTTTQN

SEQ ID NO: 2866086 - protein, 6 aa, Entamoeba invadens
INNPSL

SEQ ID NO: 2866087 - protein, 4 aa, Entamoeba invadens
INNR

SEQ ID NO: 2866088 - protein, 4 aa, Entamoeba invadens
INNS

SEQ ID NO: 2866089 - protein, 7 aa, Entamoeba invadens
INNSGKK

SEQ ID NO: 2866090 - protein, 13 aa, Entamoeba invadens
INNSGSYNKTMQP

SEQ ID NO: 2866091 - protein, 11 aa, Entamoeba invadens
INNSTDNPVEI

SEQ ID NO: 2866092 - protein, 11 aa, Entamoeba invadens
INNTKDRLMTE

SEQ ID NO: 2866093 - protein, 10 aa, Entamoeba invadens
INNTKTDEVI

SEQ ID NO: 2866094 - protein, 7 aa, Entamoeba invadens
INNTPKP

SEQ ID NO: 2866095 - protein, 9 aa, Entamoeba invadens
INNVGNKNV

SEQ ID NO: 2866096 - protein, 10 aa, Entamoeba invadens
INPDESDQVY

SEQ ID NO: 2866097 - protein, 24 aa, Entamoeba invadens
INPDGTCTQDKQSRQSVSTIADSA

SEQ ID NO: 2866098 - protein, 4 aa, Entamoeba invadens
INPE

SEQ ID NO: 2866099 - protein, 6 aa, Entamoeba invadens
INPEYG

SEQ ID NO: 2866100 - protein, 6 aa, Entamoeba invadens
INPKDG

SEQ ID NO: 2866101 - protein, 10 aa, Entamoeba invadens
INPKNKKTDE

SEQ ID NO: 2866102 - protein, 12 aa, Entamoeba invadens
INPNASVVTREG

SEQ ID NO: 2866103 - protein, 10 aa, Entamoeba invadens
INPNEEANSN

SEQ ID NO: 2866104 - protein, 10 aa, Entamoeba invadens
INPNTNSKHN

SEQ ID NO: 2866105 - protein, 4 aa, Entamoeba invadens
INPP

SEQ ID NO: 2866106 - protein, 18 aa, Entamoeba invadens
INPPQSKRGQKEFSQTTP

SEQ ID NO: 2866107 - protein, 8 aa, Entamoeba invadens
INPPSQIY

SEQ ID NO: 2866108 - protein, 5 aa, Entamoeba invadens
INPPT

SEQ ID NO: 2866109 - protein, 7 aa, Entamoeba invadens
INPQTDE

SEQ ID NO: 2866110 - protein, 14 aa, Entamoeba invadens
INPQTPLSQLGPSD

SEQ ID NO: 2866111 - protein, 6 aa, Entamoeba invadens
INPSDL

SEQ ID NO: 2866112 - protein, 15 aa, Entamoeba invadens
INPSHTSLKAPDGHF

SEQ ID NO: 2866113 - protein, 6 aa, Entamoeba invadens
INPTGE

SEQ ID NO: 2866114 - protein, 8 aa, Entamoeba invadens
INPTNNTK

SEQ ID NO: 2866115 - protein, 21 aa, Entamoeba invadens
INQDDKNKSITVTSDVSGKED

SEQ ID NO: 2866116 - protein, 6 aa, Entamoeba invadens
INQDTR

SEQ ID NO: 2866117 - protein, 47 aa, Entamoeba invadens
INQEPFKTDEHKSEKSSKEEKDDKPKEDIEVKSQGFRKSRNYQTEQQ

SEQ ID NO: 2866118 - protein, 6 aa, Entamoeba invadens
INQGEE

SEQ ID NO: 2866119 - protein, 9 aa, Entamoeba invadens
INQKGNEHI

SEQ ID NO: 2866120 - protein, 10 aa, Entamoeba invadens
INQNGYTQQQ

SEQ ID NO: 2866121 - protein, 12 aa, Entamoeba invadens
INQPKSKVAKES

SEQ ID NO: 2866122 - protein, 10 aa, Entamoeba invadens
INQQENDITA

SEQ ID NO: 2866123 - protein, 10 aa, Entamoeba invadens
INQQKGPKEL

SEQ ID NO: 2866124 - protein, 45 aa, Entamoeba invadens
INQQQTPSGQPVGVSAAPQQMQQQTEQTVDISKQKDADDDEAESC

SEQ ID NO: 2866125 - protein, 6 aa, Entamoeba invadens
INQSPA

SEQ ID NO: 2866126 - protein, 4 aa, Entamoeba invadens
INQV

SEQ ID NO: 2866127 - protein, 10 aa, Entamoeba invadens
INRENKYTVT

SEQ ID NO: 2866128 - protein, 7 aa, Entamoeba invadens
INRESGT

SEQ ID NO: 2866129 - protein, 18 aa, Entamoeba invadens
INRHGGRAKLKSNPSELY

SEQ ID NO: 2866130 - protein, 7 aa, Entamoeba invadens
INRKYGK

SEQ ID NO: 2866131 - protein, 9 aa, Entamoeba invadens
INRNKSRNI

SEQ ID NO: 2866132 - protein, 8 aa, Entamoeba invadens
INRNPLGA

SEQ ID NO: 2866133 - protein, 10 aa, Entamoeba invadens
INRPKADFDL

SEQ ID NO: 2866134 - protein, 11 aa, Entamoeba invadens
INRPPEPPAVS

SEQ ID NO: 2866135 - protein, 9 aa, Entamoeba invadens
INRQDSPNV

SEQ ID NO: 2866136 - protein, 6 aa, Entamoeba invadens
INRTGG

SEQ ID NO: 2866137 - protein, 4 aa, Entamoeba invadens
INRY

SEQ ID NO: 2866138 - protein, 8 aa, Entamoeba invadens
INSADRKQ

SEQ ID NO: 2866139 - protein, 10 aa, Entamoeba invadens
INSDDGDGYE

SEQ ID NO: 2866140 - protein, 15 aa, Entamoeba invadens
INSECPDTVNPSYHK

SEQ ID NO: 2866141 - protein, 11 aa, Entamoeba invadens
INSECPETMNP

SEQ ID NO: 2866142 - protein, 11 aa, Entamoeba invadens
INSEDKSYISS

SEQ ID NO: 2866143 - protein, 17 aa, Entamoeba invadens
INSENETNKQEDKMENI

SEQ ID NO: 2866144 - protein, 9 aa, Entamoeba invadens
INSESNTKI

SEQ ID NO: 2866145 - protein, 7 aa, Entamoeba invadens
INSETTK

SEQ ID NO: 2866146 - protein, 19 aa, Entamoeba invadens
INSFQTKETNKEKDTVGEK

SEQ ID NO: 2866147 - protein, 11 aa, Entamoeba invadens
INSGSPTDSIE

SEQ ID NO: 2866148 - protein, 6 aa, Entamoeba invadens
INSGTF

SEQ ID NO: 2866149 - protein, 6 aa, Entamoeba invadens
INSKDR

SEQ ID NO: 2866150 - protein, 7 aa, Entamoeba invadens
INSKNEK

SEQ ID NO: 2866151 - protein, 12 aa, Entamoeba invadens
INSLENSTEEKF

SEQ ID NO: 2866152 - protein, 18 aa, Entamoeba invadens
INSMGEDKKEKEKDEDLD

SEQ ID NO: 2866153 - protein, 4 aa, Entamoeba invadens
INSP

SEQ ID NO: 2866154 - protein, 5 aa, Entamoeba invadens
INSPA

SEQ ID NO: 2866155 - protein, 7 aa, Entamoeba invadens
INSPDDF

SEQ ID NO: 2866156 - protein, 8 aa, Entamoeba invadens
INSPDDQT

SEQ ID NO: 2866157 - protein, 10 aa, Entamoeba invadens
INSPDTQSQI

SEQ ID NO: 2866158 - protein, 5 aa, Entamoeba invadens
INSPK

SEQ ID NO: 2866159 - protein, 14 aa, Entamoeba invadens
INSPLDQENQEDVE

SEQ ID NO: 2866160 - protein, 40 aa, Entamoeba invadens
INSPNKTNSPDKLKISSPGYTVSELSDSADKETPHNEESE

SEQ ID NO: 2866161 - protein, 13 aa, Entamoeba invadens
INSPRQSKSMPLS

SEQ ID NO: 2866162 - protein, 27 aa, Entamoeba invadens
INSREHTTKPHKKSRSSFVPRSPKQTP

SEQ ID NO: 2866163 - protein, 11 aa, Entamoeba invadens
INSSEKKDVQK

SEQ ID NO: 2866164 - protein, 27 aa, Entamoeba invadens
INSSETNEIDEQWNEKREEIEKNAKYE

SEQ ID NO: 2866165 - protein, 4 aa, Entamoeba invadens
INST

SEQ ID NO: 2866166 - protein, 8 aa, Entamoeba invadens
INSTDGTA

SEQ ID NO: 2866167 - protein, 9 aa, Entamoeba invadens
INSTDLGST

SEQ ID NO: 2866168 - protein, 7 aa, Entamoeba invadens
INSTELR

SEQ ID NO: 2866169 - protein, 18 aa, Entamoeba invadens
INSTGGDKQNVGAENEDI

SEQ ID NO: 2866170 - protein, 8 aa, Entamoeba invadens
INSTPPAS

SEQ ID NO: 2866171 - protein, 5 aa, Entamoeba invadens
INSVS

SEQ ID NO: 2866172 - protein, 11 aa, Entamoeba invadens
INTAPWKQSED

SEQ ID NO: 2866173 - protein, 4 aa, Entamoeba invadens
INTD

SEQ ID NO: 2866174 - protein, 7 aa, Entamoeba invadens
INTDSAF

SEQ ID NO: 2866175 - protein, 5 aa, Entamoeba invadens
INTED

SEQ ID NO: 2866176 - protein, 8 aa, Entamoeba invadens
INTEDEDV

SEQ ID NO: 2866177 - protein, 7 aa, Entamoeba invadens
INTEVTQ

SEQ ID NO: 2866178 - protein, 11 aa, Entamoeba invadens
INTGDDSQKIE

SEQ ID NO: 2866179 - protein, 4 aa, Entamoeba invadens
INTH

SEQ ID NO: 2866180 - protein, 4 aa, Entamoeba invadens
INTI

SEQ ID NO: 2866181 - protein, 6 aa, Entamoeba invadens
INTIGD

SEQ ID NO: 2866182 - protein, 4 aa, Entamoeba invadens
INTK

SEQ ID NO: 2866183 - protein, 11 aa, Entamoeba invadens
INTKENENNAV

SEQ ID NO: 2866184 - protein, 30 aa, Entamoeba invadens
INTKNPNNIDVTNSTEIDTSEKEKIQHEER

SEQ ID NO: 2866185 - protein, 5 aa, Entamoeba invadens
INTKS

SEQ ID NO: 2866186 - protein, 7 aa, Entamoeba invadens
INTNERV

SEQ ID NO: 2866187 - protein, 7 aa, Entamoeba invadens
INTNKTK

SEQ ID NO: 2866188 - protein, 8 aa, Entamoeba invadens
INTNKTNY

SEQ ID NO: 2866189 - protein, 18 aa, Entamoeba invadens
INTNTDNENLLSTQREQT

SEQ ID NO: 2866190 - protein, 7 aa, Entamoeba invadens
INTNYNE

SEQ ID NO: 2866191 - protein, 27 aa, Entamoeba invadens
INTPKTSEAKQSTENRPHTPKKSYEQI

SEQ ID NO: 2866192 - protein, 17 aa, Entamoeba invadens
INTPNAQQPQQQQPQHS

SEQ ID NO: 2866193 - protein, 19 aa, Entamoeba invadens
INTPNAQQQPQQQSNSNSM

SEQ ID NO: 2866194 - protein, 6 aa, Entamoeba invadens
INTQPS

SEQ ID NO: 2866195 - protein, 9 aa, Entamoeba invadens
INTQQRVNE

SEQ ID NO: 2866196 - protein, 7 aa, Entamoeba invadens
INTSGNI

SEQ ID NO: 2866197 - protein, 18 aa, Entamoeba invadens
INTSKPTFSNPNDEEGKT

SEQ ID NO: 2866198 - protein, 12 aa, Entamoeba invadens
INTTNKTEYIEI

SEQ ID NO: 2866199 - protein, 43 aa, Entamoeba invadens
INTTPEGVTNTPPVFSTTDNQMTQTNGTQNAPMVPTPSNNMAT

SEQ ID NO: 2866200 - protein, 18 aa, Entamoeba invadens
INVPKGGEDKGDHPPITP

SEQ ID NO: 2866201 - protein, 6 aa, Entamoeba invadens
INYGGK

SEQ ID NO: 2866202 - protein, 11 aa, Entamoeba invadens
INYQGSAPVKS

SEQ ID NO: 2866203 - protein, 5 aa, Entamoeba invadens
IPAAP

SEQ ID NO: 2866204 - protein, 5 aa, Entamoeba invadens
IPADP

SEQ ID NO: 2866205 - protein, 21 aa, Entamoeba invadens
IPAEEPVEEEIKEVAEEVIEA

SEQ ID NO: 2866206 - protein, 6 aa, Entamoeba invadens
IPAEKN

SEQ ID NO: 2866207 - protein, 8 aa, Entamoeba invadens
IPAETSRK

SEQ ID NO: 2866208 - protein, 4 aa, Entamoeba invadens
IPAF

SEQ ID NO: 2866209 - protein, 16 aa, Entamoeba invadens
IPANDDQLEEISKKIP

SEQ ID NO: 2866210 - protein, 6 aa, Entamoeba invadens
IPANTS

SEQ ID NO: 2866211 - protein, 9 aa, Entamoeba invadens
IPATEGDKL

SEQ ID NO: 2866212 - protein, 9 aa, Entamoeba invadens
IPAVENQSI

SEQ ID NO: 2866213 - protein, 17 aa, Entamoeba invadens
IPCKESKTFVTDQDNQD

SEQ ID NO: 2866214 - protein, 4 aa, Entamoeba invadens
IPDA

SEQ ID NO: 2866215 - protein, 6 aa, Entamoeba invadens
IPDEEC

SEQ ID NO: 2866216 - protein, 7 aa, Entamoeba invadens
IPDEEGR

SEQ ID NO: 2866217 - protein, 8 aa, Entamoeba invadens
IPDEFSPS

SEQ ID NO: 2866218 - protein, 16 aa, Entamoeba invadens
IPDENPSETVSEEKKD

SEQ ID NO: 2866219 - protein, 8 aa, Entamoeba invadens
IPDFRSKG

SEQ ID NO: 2866220 - protein, 5 aa, Entamoeba invadens
IPDGP

SEQ ID NO: 2866221 - protein, 18 aa, Entamoeba invadens
IPDGPFDRAQIDSSNNQS

SEQ ID NO: 2866222 - protein, 60 aa, Entamoeba invadens
IPDGTEKGPKVKAEIEVKEKKQKKQTKDDKEDHPNRDLKKEKEAKEKKEQAKAQKKAQEK

SEQ ID NO: 2866223 - protein, 7 aa, Entamoeba invadens
IPDGVTT

SEQ ID NO: 2866224 - protein, 8 aa, Entamoeba invadens
IPDNQRSD

SEQ ID NO: 2866225 - protein, 6 aa, Entamoeba invadens
IPDNRR

SEQ ID NO: 2866226 - protein, 6 aa, Entamoeba invadens
IPDNTS

SEQ ID NO: 2866227 - protein, 5 aa, Entamoeba invadens
IPDNV

SEQ ID NO: 2866228 - protein, 4 aa, Entamoeba invadens
IPDS

SEQ ID NO: 2866229 - protein, 8 aa, Entamoeba invadens
IPDSPSRR

SEQ ID NO: 2866230 - protein, 7 aa, Entamoeba invadens
IPDSVTE

SEQ ID NO: 2866231 - protein, 15 aa, Entamoeba invadens
IPDTAFNDDTFGNGT

SEQ ID NO: 2866232 - protein, 9 aa, Entamoeba invadens
IPDTGTKIG

SEQ ID NO: 2866233 - protein, 21 aa, Entamoeba invadens
IPDTTEISQPQDQNTQPTTDQ

SEQ ID NO: 2866234 - protein, 5 aa, Entamoeba invadens
IPDTV

SEQ ID NO: 2866235 - protein, 6 aa, Entamoeba invadens
IPEAER

SEQ ID NO: 2866236 - protein, 5 aa, Entamoeba invadens
IPECG

SEQ ID NO: 2866237 - protein, 10 aa, Entamoeba invadens
IPEDKTVEDV

SEQ ID NO: 2866238 - protein, 5 aa, Entamoeba invadens
IPEDS

SEQ ID NO: 2866239 - protein, 9 aa, Entamoeba invadens
IPEDSGDKE

SEQ ID NO: 2866240 - protein, 8 aa, Entamoeba invadens
IPEEGKEG

SEQ ID NO: 2866241 - protein, 10 aa, Entamoeba invadens
IPEEKKSSIK

SEQ ID NO: 2866242 - protein, 5 aa, Entamoeba invadens
IPEEN

SEQ ID NO: 2866243 - protein, 6 aa, Entamoeba invadens
IPEERS

SEQ ID NO: 2866244 - protein, 15 aa, Entamoeba invadens
IPEETEKKEEKKTDL

SEQ ID NO: 2866245 - protein, 7 aa, Entamoeba invadens
IPEGDIP

SEQ ID NO: 2866246 - protein, 8 aa, Entamoeba invadens
IPEGETGQ

SEQ ID NO: 2866247 - protein, 9 aa, Entamoeba invadens
IPEGETQKE

SEQ ID NO: 2866248 - protein, 11 aa, Entamoeba invadens
IPEGKHYKTPL

SEQ ID NO: 2866249 - protein, 7 aa, Entamoeba invadens
IPEGPGR

SEQ ID NO: 2866250 - protein, 11 aa, Entamoeba invadens
IPEGSKPVDSP

SEQ ID NO: 2866251 - protein, 9 aa, Entamoeba invadens
IPEGVKSVG

SEQ ID NO: 2866252 - protein, 14 aa, Entamoeba invadens
IPEHRKRETKFFIR

SEQ ID NO: 2866253 - protein, 9 aa, Entamoeba invadens
IPEIQRTNL

SEQ ID NO: 2866254 - protein, 6 aa, Entamoeba invadens
IPEISQ

SEQ ID NO: 2866255 - protein, 19 aa, Entamoeba invadens
IPEKPETQNKESPKTTESM

SEQ ID NO: 2866256 - protein, 9 aa, Entamoeba invadens
IPEKQNTWV

SEQ ID NO: 2866257 - protein, 6 aa, Entamoeba invadens
IPEKVD

SEQ ID NO: 2866258 - protein, 4 aa, Entamoeba invadens
IPEL

SEQ ID NO: 2866259 - protein, 6 aa, Entamoeba invadens
IPELQK

SEQ ID NO: 2866260 - protein, 14 aa, Entamoeba invadens
IPELTKERENLTKH

SEQ ID NO: 2866261 - protein, 9 aa, Entamoeba invadens
IPENARLSK

SEQ ID NO: 2866262 - protein, 10 aa, Entamoeba invadens
IPENGKLDSI

SEQ ID NO: 2866263 - protein, 10 aa, Entamoeba invadens
IPENRATSDQ

SEQ ID NO: 2866264 - protein, 16 aa, Entamoeba invadens
IPENTTPKRPIPIPDQ

SEQ ID NO: 2866265 - protein, 11 aa, Entamoeba invadens
IPENVDTSPER

SEQ ID NO: 2866266 - protein, 6 aa, Entamoeba invadens
IPEQVN

SEQ ID NO: 2866267 - protein, 11 aa, Entamoeba invadens
IPEREDNRTYR

SEQ ID NO: 2866268 - protein, 6 aa, Entamoeba invadens
IPESAF

SEQ ID NO: 2866269 - protein, 5 aa, Entamoeba invadens
IPESD

SEQ ID NO: 2866270 - protein, 6 aa, Entamoeba invadens
IPESVT

SEQ ID NO: 2866271 - protein, 10 aa, Entamoeba invadens
IPETFQDEQP

SEQ ID NO: 2866272 - protein, 9 aa, Entamoeba invadens
IPETKQYTI

SEQ ID NO: 2866273 - protein, 5 aa, Entamoeba invadens
IPETQ

SEQ ID NO: 2866274 - protein, 23 aa, Entamoeba invadens
IPETTENESGSLVKGTPDSQKTF

SEQ ID NO: 2866275 - protein, 11 aa, Entamoeba invadens
IPETVKSGEWY

SEQ ID NO: 2866276 - protein, 4 aa, Entamoeba invadens
IPEV

SEQ ID NO: 2866277 - protein, 7 aa, Entamoeba invadens
IPEYDSN

SEQ ID NO: 2866278 - protein, 11 aa, Entamoeba invadens
IPEYRNKKKKY

SEQ ID NO: 2866279 - protein, 7 aa, Entamoeba invadens
IPFGPSK

SEQ ID NO: 2866280 - protein, 4 aa, Entamoeba invadens
IPFP

SEQ ID NO: 2866281 - protein, 69 aa, Entamoeba invadens
IPGESEAKIVQSQETNGEENETLQNERVEEKDEKMLEKREEKSDKNESEKIEEDEKKANKGVENAKEEE

SEQ ID NO: 2866282 - protein, 6 aa, Entamoeba invadens
IPGFKN

SEQ ID NO: 2866283 - protein, 9 aa, Entamoeba invadens
IPGGATAKP

SEQ ID NO: 2866284 - protein, 11 aa, Entamoeba invadens
IPGKKGTEWEG

SEQ ID NO: 2866285 - protein, 14 aa, Entamoeba invadens
IPGNGISVKGQDYV

SEQ ID NO: 2866286 - protein, 10 aa, Entamoeba invadens
IPGNKQASKF

SEQ ID NO: 2866287 - protein, 9 aa, Entamoeba invadens
IPGNPNTKY

SEQ ID NO: 2866288 - protein, 7 aa, Entamoeba invadens
IPGQNKL

SEQ ID NO: 2866289 - protein, 24 aa, Entamoeba invadens
IPGRFDPKKADSFDLTGEEKNQIM

SEQ ID NO: 2866290 - protein, 11 aa, Entamoeba invadens
IPGRTRKQCRE

SEQ ID NO: 2866291 - protein, 4 aa, Entamoeba invadens
IPGS

SEQ ID NO: 2866292 - protein, 8 aa, Entamoeba invadens
IPGSINDG

SEQ ID NO: 2866293 - protein, 7 aa, Entamoeba invadens
IPGSKTV

SEQ ID NO: 2866294 - protein, 5 aa, Entamoeba invadens
IPGSV

SEQ ID NO: 2866295 - protein, 10 aa, Entamoeba invadens
IPHNPSDTTF

SEQ ID NO: 2866296 - protein, 4 aa, Entamoeba invadens
IPHP

SEQ ID NO: 2866297 - protein, 24 aa, Entamoeba invadens
IPHPDTDKIEHQKQIEKNKGTVLG

SEQ ID NO: 2866298 - protein, 4 aa, Entamoeba invadens
IPHR

SEQ ID NO: 2866299 - protein, 6 aa, Entamoeba invadens
IPHSKV

SEQ ID NO: 2866300 - protein, 5 aa, Entamoeba invadens
IPIEE

SEQ ID NO: 2866301 - protein, 6 aa, Entamoeba invadens
IPIEEK

SEQ ID NO: 2866302 - protein, 13 aa, Entamoeba invadens
IPIEEKDKVQEKI

SEQ ID NO: 2866303 - protein, 6 aa, Entamoeba invadens
IPIGGA

SEQ ID NO: 2866304 - protein, 5 aa, Entamoeba invadens
IPINP

SEQ ID NO: 2866305 - protein, 11 aa, Entamoeba invadens
IPKAEPQKNGI

SEQ ID NO: 2866306 - protein, 16 aa, Entamoeba invadens
IPKDENEETNDETKIR

SEQ ID NO: 2866307 - protein, 12 aa, Entamoeba invadens
IPKDSKKSQIDE

SEQ ID NO: 2866308 - protein, 4 aa, Entamoeba invadens
IPKE

SEQ ID NO: 2866309 - protein, 6 aa, Entamoeba invadens
IPKEDP

SEQ ID NO: 2866310 - protein, 12 aa, Entamoeba invadens
IPKEKPKDKPCY

SEQ ID NO: 2866311 - protein, 15 aa, Entamoeba invadens
IPKEMKKETTPCKNS

SEQ ID NO: 2866312 - protein, 6 aa, Entamoeba invadens
IPKENV

SEQ ID NO: 2866313 - protein, 8 aa, Entamoeba invadens
IPKEPEST

SEQ ID NO: 2866314 - protein, 10 aa, Entamoeba invadens
IPKETEESTM

SEQ ID NO: 2866315 - protein, 12 aa, Entamoeba invadens
IPKGEYKGDSRL

SEQ ID NO: 2866316 - protein, 11 aa, Entamoeba invadens
IPKHPGKPLPS

SEQ ID NO: 2866317 - protein, 4 aa, Entamoeba invadens
IPKI

SEQ ID NO: 2866318 - protein, 16 aa, Entamoeba invadens
IPKKKEEDEKKEMKDN

SEQ ID NO: 2866319 - protein, 12 aa, Entamoeba invadens
IPKKKEVTYDNP

SEQ ID NO: 2866320 - protein, 9 aa, Entamoeba invadens
IPKNDSVPI

SEQ ID NO: 2866321 - protein, 8 aa, Entamoeba invadens
IPKNEKNL

SEQ ID NO: 2866322 - protein, 7 aa, Entamoeba invadens
IPKNGRT

SEQ ID NO: 2866323 - protein, 12 aa, Entamoeba invadens
IPKNRSDKEAHK

SEQ ID NO: 2866324 - protein, 8 aa, Entamoeba invadens
IPKNTTAL

SEQ ID NO: 2866325 - protein, 8 aa, Entamoeba invadens
IPKNTYQV

SEQ ID NO: 2866326 - protein, 5 aa, Entamoeba invadens
IPKNW

SEQ ID NO: 2866327 - protein, 9 aa, Entamoeba invadens
IPKPKRDEM

SEQ ID NO: 2866328 - protein, 21 aa, Entamoeba invadens
IPKPPTSAAKKDSNYTAITGD

SEQ ID NO: 2866329 - protein, 5 aa, Entamoeba invadens
IPKQD

SEQ ID NO: 2866330 - protein, 22 aa, Entamoeba invadens
IPKQGAPIEQPAFGQQTKQQSV

SEQ ID NO: 2866331 - protein, 4 aa, Entamoeba invadens
IPKR

SEQ ID NO: 2866332 - protein, 5 aa, Entamoeba invadens
IPKRK

SEQ ID NO: 2866333 - protein, 4 aa, Entamoeba invadens
IPKS

SEQ ID NO: 2866334 - protein, 8 aa, Entamoeba invadens
IPKSGGDM

SEQ ID NO: 2866335 - protein, 9 aa, Entamoeba invadens
IPKSSEVRP

SEQ ID NO: 2866336 - protein, 7 aa, Entamoeba invadens
IPKSVNS

SEQ ID NO: 2866337 - protein, 7 aa, Entamoeba invadens
IPKTDDI

SEQ ID NO: 2866338 - protein, 6 aa, Entamoeba invadens
IPKTDP

SEQ ID NO: 2866339 - protein, 20 aa, Entamoeba invadens
IPKTKTPPLEKQEECRKTAS

SEQ ID NO: 2866340 - protein, 6 aa, Entamoeba invadens
IPKTVP

SEQ ID NO: 2866341 - protein, 12 aa, Entamoeba invadens
IPLEESERSSRS

SEQ ID NO: 2866342 - protein, 11 aa, Entamoeba invadens
IPLGDAGNTVH

SEQ ID NO: 2866343 - protein, 31 aa, Entamoeba invadens
IPLKDPEEKEEKQEKIEKPSMAEAKKTEEDK

SEQ ID NO: 2866344 - protein, 10 aa, Entamoeba invadens
IPLKKSPISR

SEQ ID NO: 2866345 - protein, 12 aa, Entamoeba invadens
IPLPKSASDGLK

SEQ ID NO: 2866346 - protein, 11 aa, Entamoeba invadens
IPLPQGQDSSH

SEQ ID NO: 2866347 - protein, 6 aa, Entamoeba invadens
IPLTPQ

SEQ ID NO: 2866348 - protein, 12 aa, Entamoeba invadens
IPMEEEEDRPGT

SEQ ID NO: 2866349 - protein, 9 aa, Entamoeba invadens
IPMPQNVTQ

SEQ ID NO: 2866350 - protein, 5 aa, Entamoeba invadens
IPNAS

SEQ ID NO: 2866351 - protein, 5 aa, Entamoeba invadens
IPNDI

SEQ ID NO: 2866352 - protein, 5 aa, Entamoeba invadens
IPNDL

SEQ ID NO: 2866353 - protein, 4 aa, Entamoeba invadens
IPNE

SEQ ID NO: 2866354 - protein, 5 aa, Entamoeba invadens
IPNED

SEQ ID NO: 2866355 - protein, 10 aa, Entamoeba invadens
IPNERHEEIA

SEQ ID NO: 2866356 - protein, 6 aa, Entamoeba invadens
IPNEVQ

SEQ ID NO: 2866357 - protein, 10 aa, Entamoeba invadens
IPNFETPERA

SEQ ID NO: 2866358 - protein, 5 aa, Entamoeba invadens
IPNGI

SEQ ID NO: 2866359 - protein, 10 aa, Entamoeba invadens
IPNGNSNETV

SEQ ID NO: 2866360 - protein, 6 aa, Entamoeba invadens
IPNGVT

SEQ ID NO: 2866361 - protein, 9 aa, Entamoeba invadens
IPNGVTKVG

SEQ ID NO: 2866362 - protein, 9 aa, Entamoeba invadens
IPNKSNQLD

SEQ ID NO: 2866363 - protein, 4 aa, Entamoeba invadens
IPNN

SEQ ID NO: 2866364 - protein, 5 aa, Entamoeba invadens
IPNND

SEQ ID NO: 2866365 - protein, 10 aa, Entamoeba invadens
IPNNDSKLTP

SEQ ID NO: 2866366 - protein, 14 aa, Entamoeba invadens
IPNPEDKTDEVEYP

SEQ ID NO: 2866367 - protein, 7 aa, Entamoeba invadens
IPNPKTA

SEQ ID NO: 2866368 - protein, 6 aa, Entamoeba invadens
IPNPNY

SEQ ID NO: 2866369 - protein, 9 aa, Entamoeba invadens
IPNPPDAES

SEQ ID NO: 2866370 - protein, 6 aa, Entamoeba invadens
IPNPTS

SEQ ID NO: 2866371 - protein, 11 aa, Entamoeba invadens
IPNRAAMTSTY

SEQ ID NO: 2866372 - protein, 5 aa, Entamoeba invadens
IPNRD

SEQ ID NO: 2866373 - protein, 6 aa, Entamoeba invadens
IPNSRT

SEQ ID NO: 2866374 - protein, 5 aa, Entamoeba invadens
IPNSS

SEQ ID NO: 2866375 - protein, 9 aa, Entamoeba invadens
IPNSTSPEE

SEQ ID NO: 2866376 - protein, 5 aa, Entamoeba invadens
IPNSV

SEQ ID NO: 2866377 - protein, 8 aa, Entamoeba invadens
IPNSVSRI

SEQ ID NO: 2866378 - protein, 8 aa, Entamoeba invadens
IPNSVTKI

SEQ ID NO: 2866379 - protein, 8 aa, Entamoeba invadens
IPNSVTSI

SEQ ID NO: 2866380 - protein, 21 aa, Entamoeba invadens
IPNTEPPLPPPRTFPSQAERY

SEQ ID NO: 2866381 - protein, 9 aa, Entamoeba invadens
IPNTPSPSE

SEQ ID NO: 2866382 - protein, 9 aa, Entamoeba invadens
IPNTSQNAE

SEQ ID NO: 2866383 - protein, 5 aa, Entamoeba invadens
IPNTV

SEQ ID NO: 2866384 - protein, 6 aa, Entamoeba invadens
IPNTVS

SEQ ID NO: 2866385 - protein, 8 aa, Entamoeba invadens
IPPAKRGV

SEQ ID NO: 2866386 - protein, 8 aa, Entamoeba invadens
IPPAQKKD

SEQ ID NO: 2866387 - protein, 4 aa, Entamoeba invadens
IPPD

SEQ ID NO: 2866388 - protein, 5 aa, Entamoeba invadens
IPPDG

SEQ ID NO: 2866389 - protein, 5 aa, Entamoeba invadens
IPPDT

SEQ ID NO: 2866390 - protein, 18 aa, Entamoeba invadens
IPPEEEGGKIEKKELKKR

SEQ ID NO: 2866391 - protein, 6 aa, Entamoeba invadens
IPPEEM

SEQ ID NO: 2866392 - protein, 6 aa, Entamoeba invadens
IPPGDL

SEQ ID NO: 2866393 - protein, 5 aa, Entamoeba invadens
IPPGF

SEQ ID NO: 2866394 - protein, 5 aa, Entamoeba invadens
IPPGK

SEQ ID NO: 2866395 - protein, 7 aa, Entamoeba invadens
IPPGVKS

SEQ ID NO: 2866396 - protein, 6 aa, Entamoeba invadens
IPPHEA

SEQ ID NO: 2866397 - protein, 49 aa, Entamoeba invadens
IPPIPQPPSKKEKKEQQQGEKEKHDEKQNKTPQKKKSEKEVKPQSSQGS

SEQ ID NO: 2866398 - protein, 24 aa, Entamoeba invadens
IPPKEKHHKKKKHVHKQKEVQPTN

SEQ ID NO: 2866399 - protein, 33 aa, Entamoeba invadens
IPPKKTPPPPPKKPLPLAPTKIPPPPLKLPPQR

SEQ ID NO: 2866400 - protein, 15 aa, Entamoeba invadens
IPPKPKRIASKPDTM

SEQ ID NO: 2866401 - protein, 23 aa, Entamoeba invadens
IPPKQYLNTQQNIPMTQQEQQQH

SEQ ID NO: 2866402 - protein, 6 aa, Entamoeba invadens
IPPKRG

SEQ ID NO: 2866403 - protein, 9 aa, Entamoeba invadens
IPPKTPLEK

SEQ ID NO: 2866404 - protein, 13 aa, Entamoeba invadens
IPPLDTPNIPTGD

SEQ ID NO: 2866405 - protein, 4 aa, Entamoeba invadens
IPPN

SEQ ID NO: 2866406 - protein, 7 aa, Entamoeba invadens
IPPNANT

SEQ ID NO: 2866407 - protein, 15 aa, Entamoeba invadens
IPPPDKLISSKDDPK

SEQ ID NO: 2866408 - protein, 5 aa, Entamoeba invadens
IPPPF

SEQ ID NO: 2866409 - protein, 8 aa, Entamoeba invadens
IPPPPKFQ

SEQ ID NO: 2866410 - protein, 6 aa, Entamoeba invadens
IPPPQD

SEQ ID NO: 2866411 - protein, 8 aa, Entamoeba invadens
IPPPQPTI

SEQ ID NO: 2866412 - protein, 15 aa, Entamoeba invadens
IPPPTNLPPPKITTE

SEQ ID NO: 2866413 - protein, 4 aa, Entamoeba invadens
IPPQ

SEQ ID NO: 2866414 - protein, 5 aa, Entamoeba invadens
IPPQL

SEQ ID NO: 2866415 - protein, 5 aa, Entamoeba invadens
IPPQP

SEQ ID NO: 2866416 - protein, 8 aa, Entamoeba invadens
IPPQPKRQ

SEQ ID NO: 2866417 - protein, 11 aa, Entamoeba invadens
IPPQPTQEPLE

SEQ ID NO: 2866418 - protein, 8 aa, Entamoeba invadens
IPPQTTTL

SEQ ID NO: 2866419 - protein, 7 aa, Entamoeba invadens
IPPRSGI

SEQ ID NO: 2866420 - protein, 12 aa, Entamoeba invadens
IPPSPMEGDNGN

SEQ ID NO: 2866421 - protein, 9 aa, Entamoeba invadens
IPPSSLEDT

SEQ ID NO: 2866422 - protein, 7 aa, Entamoeba invadens
IPPSVKS

SEQ ID NO: 2866423 - protein, 7 aa, Entamoeba invadens
IPPSVTS

SEQ ID NO: 2866424 - protein, 7 aa, Entamoeba invadens
IPPTPVS

SEQ ID NO: 2866425 - protein, 6 aa, Entamoeba invadens
IPPTSI

SEQ ID NO: 2866426 - protein, 6 aa, Entamoeba invadens
IPPTST

SEQ ID NO: 2866427 - protein, 6 aa, Entamoeba invadens
IPPTVK

SEQ ID NO: 2866428 - protein, 8 aa, Entamoeba invadens
IPPYKTTQ

SEQ ID NO: 2866429 - protein, 41 aa, Entamoeba invadens
IPQEPPTKKKEKKEKKEKRERKGDNESEETPPKKKKGKPLK

SEQ ID NO: 2866430 - protein, 9 aa, Entamoeba invadens
IPQGGLEDP

SEQ ID NO: 2866431 - protein, 12 aa, Entamoeba invadens
IPQGKNSGTCTF

SEQ ID NO: 2866432 - protein, 8 aa, Entamoeba invadens
IPQGVESI

SEQ ID NO: 2866433 - protein, 9 aa, Entamoeba invadens
IPQIPEKSQ

SEQ ID NO: 2866434 - protein, 4 aa, Entamoeba invadens
IPQK

SEQ ID NO: 2866435 - protein, 52 aa, Entamoeba invadens
IPQKQNSKIDKQLKKEEERRKKEEAKRLKEQQKKKGKKEPEKAEKPIPPPVV

SEQ ID NO: 2866436 - protein, 5 aa, Entamoeba invadens
IPQND

SEQ ID NO: 2866437 - protein, 11 aa, Entamoeba invadens
IPQNESNPDNT

SEQ ID NO: 2866438 - protein, 22 aa, Entamoeba invadens
IPQNGQQNNTKIYPSMPQQNGF

SEQ ID NO: 2866439 - protein, 11 aa, Entamoeba invadens
IPQNKDPKKRL

SEQ ID NO: 2866440 - protein, 13 aa, Entamoeba invadens
IPQPDLDEKEEDV

SEQ ID NO: 2866441 - protein, 22 aa, Entamoeba invadens
IPQPTAKAAKKEEDGETISNDP

SEQ ID NO: 2866442 - protein, 46 aa, Entamoeba invadens
IPQQQSQQVPQQLSPQPNIPPQQEEIRNEVEQSRIDDNQQVPQQDI

SEQ ID NO: 2866443 - protein, 13 aa, Entamoeba invadens
IPQQSPQESEDVD

SEQ ID NO: 2866444 - protein, 10 aa, Entamoeba invadens
IPQQTHTQIR

SEQ ID NO: 2866445 - protein, 11 aa, Entamoeba invadens
IPQRDGGTHLT

SEQ ID NO: 2866446 - protein, 5 aa, Entamoeba invadens
IPQSK

SEQ ID NO: 2866447 - protein, 25 aa, Entamoeba invadens
IPQSQTVQYSQPQLPPPINTIPPVA

SEQ ID NO: 2866448 - protein, 20 aa, Entamoeba invadens
IPQSRKDPIKDDEKKSDQPI

SEQ ID NO: 2866449 - protein, 15 aa, Entamoeba invadens
IPQSTITQQIPTKAA

SEQ ID NO: 2866450 - protein, 15 aa, Entamoeba invadens
IPQTKKVVDSSSSTF

SEQ ID NO: 2866451 - protein, 5 aa, Entamoeba invadens
IPQTT

SEQ ID NO: 2866452 - protein, 5 aa, Entamoeba invadens
IPQYS

SEQ ID NO: 2866453 - protein, 5 aa, Entamoeba invadens
IPRET

SEQ ID NO: 2866454 - protein, 5 aa, Entamoeba invadens
IPRGE

SEQ ID NO: 2866455 - protein, 10 aa, Entamoeba invadens
IPRGETLPEN

SEQ ID NO: 2866456 - protein, 12 aa, Entamoeba invadens
IPRHNSNYDNDN

SEQ ID NO: 2866457 - protein, 10 aa, Entamoeba invadens
IPRKEDIEKT

SEQ ID NO: 2866458 - protein, 7 aa, Entamoeba invadens
IPRKPQP

SEQ ID NO: 2866459 - protein, 4 aa, Entamoeba invadens
IPRP

SEQ ID NO: 2866460 - protein, 19 aa, Entamoeba invadens
IPRSSPTNITGSVNPSGNE

SEQ ID NO: 2866461 - protein, 5 aa, Entamoeba invadens
IPRSV

SEQ ID NO: 2866462 - protein, 5 aa, Entamoeba invadens
IPSAD

SEQ ID NO: 2866463 - protein, 13 aa, Entamoeba invadens
IPSDNSTLPPPPF

SEQ ID NO: 2866464 - protein, 9 aa, Entamoeba invadens
IPSEATNFS

SEQ ID NO: 2866465 - protein, 9 aa, Entamoeba invadens
IPSEEQRRQ

SEQ ID NO: 2866466 - protein, 5 aa, Entamoeba invadens
IPSEL

SEQ ID NO: 2866467 - protein, 14 aa, Entamoeba invadens
IPSETKSKRSPAIT

SEQ ID NO: 2866468 - protein, 7 aa, Entamoeba invadens
IPSFPKE

SEQ ID NO: 2866469 - protein, 5 aa, Entamoeba invadens
IPSGE

SEQ ID NO: 2866470 - protein, 10 aa, Entamoeba invadens
IPSGKYKGDF

SEQ ID NO: 2866471 - protein, 13 aa, Entamoeba invadens
IPSGNDESETDRF

SEQ ID NO: 2866472 - protein, 7 aa, Entamoeba invadens
IPSGVTE

SEQ ID NO: 2866473 - protein, 9 aa, Entamoeba invadens
IPSIGTDQE

SEQ ID NO: 2866474 - protein, 28 aa, Entamoeba invadens
IPSINTKAKPPKKKKAKVVKKAKEKVDK

SEQ ID NO: 2866475 - protein, 9 aa, Entamoeba invadens
IPSKEASSD

SEQ ID NO: 2866476 - protein, 11 aa, Entamoeba invadens
IPSKECDENKI

SEQ ID NO: 2866477 - protein, 12 aa, Entamoeba invadens
IPSKFDTETPPS

SEQ ID NO: 2866478 - protein, 16 aa, Entamoeba invadens
IPSKTAQRRFETNKKT

SEQ ID NO: 2866479 - protein, 7 aa, Entamoeba invadens
IPSKTKS

SEQ ID NO: 2866480 - protein, 7 aa, Entamoeba invadens
IPSKTNP

SEQ ID NO: 2866481 - protein, 7 aa, Entamoeba invadens
IPSLPGD

SEQ ID NO: 2866482 - protein, 8 aa, Entamoeba invadens
IPSLPSFS

SEQ ID NO: 2866483 - protein, 10 aa, Entamoeba invadens
IPSNATSIEN

SEQ ID NO: 2866484 - protein, 10 aa, Entamoeba invadens
IPSNGNHPNK

SEQ ID NO: 2866485 - protein, 5 aa, Entamoeba invadens
IPSNS

SEQ ID NO: 2866486 - protein, 6 aa, Entamoeba invadens
IPSNTN

SEQ ID NO: 2866487 - protein, 5 aa, Entamoeba invadens
IPSNV

SEQ ID NO: 2866488 - protein, 12 aa, Entamoeba invadens
IPSNVEKLVIVV

SEQ ID NO: 2866489 - protein, 6 aa, Entamoeba invadens
IPSNVT

SEQ ID NO: 2866490 - protein, 8 aa, Entamoeba invadens
IPSNVTKI

SEQ ID NO: 2866491 - protein, 8 aa, Entamoeba invadens
IPSNVTSI

SEQ ID NO: 2866492 - protein, 26 aa, Entamoeba invadens
IPSPNSPRSCGSGDSPSSAKEDHSVF

SEQ ID NO: 2866493 - protein, 11 aa, Entamoeba invadens
IPSPTQQCKRS

SEQ ID NO: 2866494 - protein, 24 aa, Entamoeba invadens
IPSPTSSCSLEESPKNKHSESPIR

SEQ ID NO: 2866495 - protein, 4 aa, Entamoeba invadens
IPSS

SEQ ID NO: 2866496 - protein, 8 aa, Entamoeba invadens
IPSSISKL

SEQ ID NO: 2866497 - protein, 7 aa, Entamoeba invadens
IPSSITS

SEQ ID NO: 2866498 - protein, 5 aa, Entamoeba invadens
IPSSL

SEQ ID NO: 2866499 - protein, 11 aa, Entamoeba invadens
IPSSQLQKYKD

SEQ ID NO: 2866500 - protein, 5 aa, Entamoeba invadens
IPSSS

SEQ ID NO: 2866501 - protein, 6 aa, Entamoeba invadens
IPSSTN

SEQ ID NO: 2866502 - protein, 10 aa, Entamoeba invadens
IPSSVKSTGD

SEQ ID NO: 2866503 - protein, 9 aa, Entamoeba invadens
IPSSVRSIG

SEQ ID NO: 2866504 - protein, 8 aa, Entamoeba invadens
IPSSVTSL

SEQ ID NO: 2866505 - protein, 7 aa, Entamoeba invadens
IPSTEEM

SEQ ID NO: 2866506 - protein, 5 aa, Entamoeba invadens
IPSTI

SEQ ID NO: 2866507 - protein, 5 aa, Entamoeba invadens
IPSTL

SEQ ID NO: 2866508 - protein, 6 aa, Entamoeba invadens
IPSTMT

SEQ ID NO: 2866509 - protein, 26 aa, Entamoeba invadens
IPSTPTRSSLSSITNSQTSNTPTRVS

SEQ ID NO: 2866510 - protein, 6 aa, Entamoeba invadens
IPSTSS

SEQ ID NO: 2866511 - protein, 6 aa, Entamoeba invadens
IPSTVE

SEQ ID NO: 2866512 - protein, 16 aa, Entamoeba invadens
IPSTVSSLNSSTFEGC

SEQ ID NO: 2866513 - protein, 6 aa, Entamoeba invadens
IPSTVT

SEQ ID NO: 2866514 - protein, 7 aa, Entamoeba invadens
IPSTVTS

SEQ ID NO: 2866515 - protein, 5 aa, Entamoeba invadens
IPTDY

SEQ ID NO: 2866516 - protein, 7 aa, Entamoeba invadens
IPTEKSY

SEQ ID NO: 2866517 - protein, 13 aa, Entamoeba invadens
IPTELEGSNNLSA

SEQ ID NO: 2866518 - protein, 21 aa, Entamoeba invadens
IPTKKKKKVSTVSTNKQEDGQ

SEQ ID NO: 2866519 - protein, 114 aa, Entamoeba invadens
IPTKMSEDDEKLTSSSSEENSQKSSEESNNSDDNLSAEQKSEIEDNEESKESEESQSEKKNEDNEKSGTSATGKAENLPTAQSEFRAKKQQREKKDTKKFHQDGSDSEEYEAED

SEQ ID NO: 2866520 - protein, 11 aa, Entamoeba invadens
IPTKSEYDAEM

SEQ ID NO: 2866521 - protein, 16 aa, Entamoeba invadens
IPTKSKSRTFKRKPRN

SEQ ID NO: 2866522 - protein, 8 aa, Entamoeba invadens
IPTNDKGR

SEQ ID NO: 2866523 - protein, 6 aa, Entamoeba invadens
IPTNTK

SEQ ID NO: 2866524 - protein, 8 aa, Entamoeba invadens
IPTPASAG

SEQ ID NO: 2866525 - protein, 8 aa, Entamoeba invadens
IPTPLKNS

SEQ ID NO: 2866526 - protein, 9 aa, Entamoeba invadens
IPTPPTQQM

SEQ ID NO: 2866527 - protein, 14 aa, Entamoeba invadens
IPTQEEVTELNGEK

SEQ ID NO: 2866528 - protein, 12 aa, Entamoeba invadens
IPTQGSNNAAND

SEQ ID NO: 2866529 - protein, 8 aa, Entamoeba invadens
IPTQKDGA

SEQ ID NO: 2866530 - protein, 5 aa, Entamoeba invadens
IPTRE

SEQ ID NO: 2866531 - protein, 7 aa, Entamoeba invadens
IPTRGTP

SEQ ID NO: 2866532 - protein, 15 aa, Entamoeba invadens
IPTRQRDFSEESTAD

SEQ ID NO: 2866533 - protein, 4 aa, Entamoeba invadens
IPTS

SEQ ID NO: 2866534 - protein, 14 aa, Entamoeba invadens
IPTSAQMKNCNSRN

SEQ ID NO: 2866535 - protein, 11 aa, Entamoeba invadens
IPTSNGKEIAD

SEQ ID NO: 2866536 - protein, 6 aa, Entamoeba invadens
IPTSSV

SEQ ID NO: 2866537 - protein, 6 aa, Entamoeba invadens
IPTSTH

SEQ ID NO: 2866538 - protein, 9 aa, Entamoeba invadens
IPTSTTKPI

SEQ ID NO: 2866539 - protein, 8 aa, Entamoeba invadens
IPTSVSSL

SEQ ID NO: 2866540 - protein, 11 aa, Entamoeba invadens
IPTSVTSLSKN

SEQ ID NO: 2866541 - protein, 4 aa, Entamoeba invadens
IPTT

SEQ ID NO: 2866542 - protein, 12 aa, Entamoeba invadens
IPTTQQNQQQEI

SEQ ID NO: 2866543 - protein, 8 aa, Entamoeba invadens
IPTTTTSL

SEQ ID NO: 2866544 - protein, 11 aa, Entamoeba invadens
IPTTTTSLSIT

SEQ ID NO: 2866545 - protein, 17 aa, Entamoeba invadens
IPTYSNPMSQPSTTIPY

SEQ ID NO: 2866546 - protein, 12 aa, Entamoeba invadens
IPVDKTKGLMGS

SEQ ID NO: 2866547 - protein, 11 aa, Entamoeba invadens
IPVDPKTASEI

SEQ ID NO: 2866548 - protein, 4 aa, Entamoeba invadens
IPVN

SEQ ID NO: 2866549 - protein, 6 aa, Entamoeba invadens
IPVTES

SEQ ID NO: 2866550 - protein, 7 aa, Entamoeba invadens
IPWNQPE

SEQ ID NO: 2866551 - protein, 7 aa, Entamoeba invadens
IPYDEKN

SEQ ID NO: 2866552 - protein, 4 aa, Entamoeba invadens
IPYG

SEQ ID NO: 2866553 - protein, 5 aa, Entamoeba invadens
IPYNS

SEQ ID NO: 2866554 - protein, 12 aa, Entamoeba invadens
IPYNSNLTNDDI

SEQ ID NO: 2866555 - protein, 6 aa, Entamoeba invadens
IPYPSY

SEQ ID NO: 2866556 - protein, 5 aa, Entamoeba invadens
IPYSP

SEQ ID NO: 2866557 - protein, 5 aa, Entamoeba invadens
IQADT

SEQ ID NO: 2866558 - protein, 12 aa, Entamoeba invadens
IQAEEGKWDPAK

SEQ ID NO: 2866559 - protein, 10 aa, Entamoeba invadens
IQAKESAKGV

SEQ ID NO: 2866560 - protein, 6 aa, Entamoeba invadens
IQAKPD

SEQ ID NO: 2866561 - protein, 7 aa, Entamoeba invadens
IQAKPTD

SEQ ID NO: 2866562 - protein, 11 aa, Entamoeba invadens
IQANSNEEKMH

SEQ ID NO: 2866563 - protein, 9 aa, Entamoeba invadens
IQATDAGEL

SEQ ID NO: 2866564 - protein, 10 aa, Entamoeba invadens
IQATKNAATL

SEQ ID NO: 2866565 - protein, 6 aa, Entamoeba invadens
IQDDEC

SEQ ID NO: 2866566 - protein, 7 aa, Entamoeba invadens
IQDDENV

SEQ ID NO: 2866567 - protein, 21 aa, Entamoeba invadens
IQDDTPNSPEPKHPPSSQQTL

SEQ ID NO: 2866568 - protein, 6 aa, Entamoeba invadens
IQDDYN

SEQ ID NO: 2866569 - protein, 14 aa, Entamoeba invadens
IQDQDTPGYIKALL

SEQ ID NO: 2866570 - protein, 14 aa, Entamoeba invadens
IQDQETPGYIKALL

SEQ ID NO: 2866571 - protein, 8 aa, Entamoeba invadens
IQEATQKL

SEQ ID NO: 2866572 - protein, 36 aa, Entamoeba invadens
IQEDEDEEENEEKSDRAMSEEDEEKNAAPSKPVEQT

SEQ ID NO: 2866573 - protein, 5 aa, Entamoeba invadens
IQEDS

SEQ ID NO: 2866574 - protein, 7 aa, Entamoeba invadens
IQEEDEE

SEQ ID NO: 2866575 - protein, 11 aa, Entamoeba invadens
IQEEKNEEPNH

SEQ ID NO: 2866576 - protein, 6 aa, Entamoeba invadens
IQEENT

SEQ ID NO: 2866577 - protein, 7 aa, Entamoeba invadens
IQEGDAS

SEQ ID NO: 2866578 - protein, 6 aa, Entamoeba invadens
IQEIED

SEQ ID NO: 2866579 - protein, 7 aa, Entamoeba invadens
IQEKRKE

SEQ ID NO: 2866580 - protein, 8 aa, Entamoeba invadens
IQELPTGN

SEQ ID NO: 2866581 - protein, 33 aa, Entamoeba invadens
IQEPPETNQSEEKKEEQKADTKSEDKAKEDITY

SEQ ID NO: 2866582 - protein, 14 aa, Entamoeba invadens
IQEQKKVASAPKGW

SEQ ID NO: 2866583 - protein, 15 aa, Entamoeba invadens
IQEQPIRKTPSTHSK

SEQ ID NO: 2866584 - protein, 8 aa, Entamoeba invadens
IQETPGYQ

SEQ ID NO: 2866585 - protein, 18 aa, Entamoeba invadens
IQGAPETRKNLQSSDTME

SEQ ID NO: 2866586 - protein, 6 aa, Entamoeba invadens
IQGDSS

SEQ ID NO: 2866587 - protein, 25 aa, Entamoeba invadens
IQGEPDGSSFPNGGLRNTSQARGYS

SEQ ID NO: 2866588 - protein, 26 aa, Entamoeba invadens
IQGGEKNKATWGEATQAIKDAIKDEV

SEQ ID NO: 2866589 - protein, 6 aa, Entamoeba invadens
IQGGTQ

SEQ ID NO: 2866590 - protein, 5 aa, Entamoeba invadens
IQGQP

SEQ ID NO: 2866591 - protein, 7 aa, Entamoeba invadens
IQHASPK

SEQ ID NO: 2866592 - protein, 6 aa, Entamoeba invadens
IQIPST

SEQ ID NO: 2866593 - protein, 7 aa, Entamoeba invadens
IQKDETD

SEQ ID NO: 2866594 - protein, 9 aa, Entamoeba invadens
IQKDGWSGF

SEQ ID NO: 2866595 - protein, 4 aa, Entamoeba invadens
IQKE

SEQ ID NO: 2866596 - protein, 54 aa, Entamoeba invadens
IQKEKERLEEERKQKLEEERKKLEESERIRREEEDAKRKAADELRKKQEEERIK

SEQ ID NO: 2866597 - protein, 9 aa, Entamoeba invadens
IQKENNNNF

SEQ ID NO: 2866598 - protein, 9 aa, Entamoeba invadens
IQKERKVKS

SEQ ID NO: 2866599 - protein, 10 aa, Entamoeba invadens
IQKETRDTEI

SEQ ID NO: 2866600 - protein, 5 aa, Entamoeba invadens
IQKGE

SEQ ID NO: 2866601 - protein, 41 aa, Entamoeba invadens
IQKGKKLQKCETVDKSAPMIEGKKGSGGMGGGMGGMGGNPM

SEQ ID NO: 2866602 - protein, 29 aa, Entamoeba invadens
IQKKDESKKVKTSVDQESERLQKAKEKHK

SEQ ID NO: 2866603 - protein, 14 aa, Entamoeba invadens
IQKKEKKKKEEDII

SEQ ID NO: 2866604 - protein, 10 aa, Entamoeba invadens
IQKKKDEIEA

SEQ ID NO: 2866605 - protein, 12 aa, Entamoeba invadens
IQKKNKNSDCLI

SEQ ID NO: 2866606 - protein, 91 aa, Entamoeba invadens
IQKKRGRKTNVERAKTKKEKMMEEEESPKKLRPRRGRKAKKEVIEEVSDEEEESLEYSSEEEDSYQPEDTDSEDDRVKHKTRGRKAKREVT

SEQ ID NO: 2866607 - protein, 8 aa, Entamoeba invadens
IQKKRTND

SEQ ID NO: 2866608 - protein, 8 aa, Entamoeba invadens
IQKLPAEI

SEQ ID NO: 2866609 - protein, 11 aa, Entamoeba invadens
IQKNQNPLKPH

SEQ ID NO: 2866610 - protein, 6 aa, Entamoeba invadens
IQKPKK

SEQ ID NO: 2866611 - protein, 6 aa, Entamoeba invadens
IQKPTL

SEQ ID NO: 2866612 - protein, 4 aa, Entamoeba invadens
IQKQ

SEQ ID NO: 2866613 - protein, 5 aa, Entamoeba invadens
IQKQN

SEQ ID NO: 2866614 - protein, 8 aa, Entamoeba invadens
IQKRASEF

SEQ ID NO: 2866615 - protein, 16 aa, Entamoeba invadens
IQKRKKEREENTRRKH

SEQ ID NO: 2866616 - protein, 4 aa, Entamoeba invadens
IQKS

SEQ ID NO: 2866617 - protein, 34 aa, Entamoeba invadens
IQKSEERKDDIEKKCESNEKQENEILQKSGSVTD

SEQ ID NO: 2866618 - protein, 9 aa, Entamoeba invadens
IQKSEKKRC

SEQ ID NO: 2866619 - protein, 13 aa, Entamoeba invadens
IQKSETDGTIGNS

SEQ ID NO: 2866620 - protein, 17 aa, Entamoeba invadens
IQKSGTINEIIDELKTI

SEQ ID NO: 2866621 - protein, 15 aa, Entamoeba invadens
IQKSKNENNLVETEN

SEQ ID NO: 2866622 - protein, 12 aa, Entamoeba invadens
IQKSTDKEKLPF

SEQ ID NO: 2866623 - protein, 28 aa, Entamoeba invadens
IQLGQDNRQNYRSGREERVGNSPNFRER

SEQ ID NO: 2866624 - protein, 5 aa, Entamoeba invadens
IQLPT

SEQ ID NO: 2866625 - protein, 6 aa, Entamoeba invadens
IQLSEE

SEQ ID NO: 2866626 - protein, 41 aa, Entamoeba invadens
IQLSSSSSKVSSREFPDPISPKSDNSENGIKGQSPTPAHSS

SEQ ID NO: 2866627 - protein, 15 aa, Entamoeba invadens
IQNAGIGENTVRSKN

SEQ ID NO: 2866628 - protein, 11 aa, Entamoeba invadens
IQNDDKSYISS

SEQ ID NO: 2866629 - protein, 7 aa, Entamoeba invadens
IQNDSTL

SEQ ID NO: 2866630 - protein, 15 aa, Entamoeba invadens
IQNEDKEKSVQPKPT

SEQ ID NO: 2866631 - protein, 12 aa, Entamoeba invadens
IQNENSKVSGTT

SEQ ID NO: 2866632 - protein, 5 aa, Entamoeba invadens
IQNEQ

SEQ ID NO: 2866633 - protein, 4 aa, Entamoeba invadens
IQNK

SEQ ID NO: 2866634 - protein, 5 aa, Entamoeba invadens
IQNNH

SEQ ID NO: 2866635 - protein, 7 aa, Entamoeba invadens
IQNNIQT

SEQ ID NO: 2866636 - protein, 7 aa, Entamoeba invadens
IQNNPNT

SEQ ID NO: 2866637 - protein, 11 aa, Entamoeba invadens
IQNPNAPEKDD

SEQ ID NO: 2866638 - protein, 9 aa, Entamoeba invadens
IQNPTHYQD

SEQ ID NO: 2866639 - protein, 9 aa, Entamoeba invadens
IQNPTNQVE

SEQ ID NO: 2866640 - protein, 10 aa, Entamoeba invadens
IQNSREQRAI

SEQ ID NO: 2866641 - protein, 9 aa, Entamoeba invadens
IQNTQKSPA

SEQ ID NO: 2866642 - protein, 11 aa, Entamoeba invadens
IQNVQSDENFD

SEQ ID NO: 2866643 - protein, 7 aa, Entamoeba invadens
IQPDGKK

SEQ ID NO: 2866644 - protein, 30 aa, Entamoeba invadens
IQPEEKVQSSAKATTKQTTTTITPQQNRPS

SEQ ID NO: 2866645 - protein, 8 aa, Entamoeba invadens
IQPGQQQQ

SEQ ID NO: 2866646 - protein, 12 aa, Entamoeba invadens
IQPGTPRKTKHR

SEQ ID NO: 2866647 - protein, 18 aa, Entamoeba invadens
IQPHGTTTTIATYPPTNY

SEQ ID NO: 2866648 - protein, 16 aa, Entamoeba invadens
IQPKDNRETPSQVQPE

SEQ ID NO: 2866649 - protein, 40 aa, Entamoeba invadens
IQPNSHPPNSTHKDIRNETISSPQKQTRPSHTPSPSCVTP

SEQ ID NO: 2866650 - protein, 7 aa, Entamoeba invadens
IQPPDEE

SEQ ID NO: 2866651 - protein, 6 aa, Entamoeba invadens
IQPPEQ

SEQ ID NO: 2866652 - protein, 22 aa, Entamoeba invadens
IQPPIEKNEVKPISETNRKENF

SEQ ID NO: 2866653 - protein, 6 aa, Entamoeba invadens
IQPPPI

SEQ ID NO: 2866654 - protein, 10 aa, Entamoeba invadens
IQPPRITETY

SEQ ID NO: 2866655 - protein, 9 aa, Entamoeba invadens
IQPPSPDMA

SEQ ID NO: 2866656 - protein, 9 aa, Entamoeba invadens
IQPPSPEMA

SEQ ID NO: 2866657 - protein, 26 aa, Entamoeba invadens
IQPSETAKDSSEQIEKSEESKETQTE

SEQ ID NO: 2866658 - protein, 26 aa, Entamoeba invadens
IQPSLTTSRDRITKKRNSTKTRTIKS

SEQ ID NO: 2866659 - protein, 9 aa, Entamoeba invadens
IQPSPTTKI

SEQ ID NO: 2866660 - protein, 5 aa, Entamoeba invadens
IQPSS

SEQ ID NO: 2866661 - protein, 10 aa, Entamoeba invadens
IQPTPNVREK

SEQ ID NO: 2866662 - protein, 15 aa, Entamoeba invadens
IQPTSNDSKNDDQVA

SEQ ID NO: 2866663 - protein, 9 aa, Entamoeba invadens
IQPTTTQKV

SEQ ID NO: 2866664 - protein, 10 aa, Entamoeba invadens
IQPTTTQKVP

SEQ ID NO: 2866665 - protein, 6 aa, Entamoeba invadens
IQQDEP

SEQ ID NO: 2866666 - protein, 12 aa, Entamoeba invadens
IQQESAENFARE

SEQ ID NO: 2866667 - protein, 5 aa, Entamoeba invadens
IQQLE

SEQ ID NO: 2866668 - protein, 6 aa, Entamoeba invadens
IQQNED

SEQ ID NO: 2866669 - protein, 6 aa, Entamoeba invadens
IQQNGP

SEQ ID NO: 2866670 - protein, 9 aa, Entamoeba invadens
IQQNQKIRK

SEQ ID NO: 2866671 - protein, 11 aa, Entamoeba invadens
IQQPTTSSSER

SEQ ID NO: 2866672 - protein, 16 aa, Entamoeba invadens
IQQPVQQSDIPLNPNF

SEQ ID NO: 2866673 - protein, 45 aa, Entamoeba invadens
IQQQEVSQQPQPSAPQQSPQKPIEDLKPTQSAPKPRNKSAFASAR

SEQ ID NO: 2866674 - protein, 28 aa, Entamoeba invadens
IQQQQQQQQQQQYQQNQMQQQPQKTAYS

SEQ ID NO: 2866675 - protein, 26 aa, Entamoeba invadens
IQQQQQQQQQYQQNQMQQQPQKTAYS

SEQ ID NO: 2866676 - protein, 10 aa, Entamoeba invadens
IQQQQREQER

SEQ ID NO: 2866677 - protein, 11 aa, Entamoeba invadens
IQQSSDDEDQV

SEQ ID NO: 2866678 - protein, 14 aa, Entamoeba invadens
IQQTENNEETFFTN

SEQ ID NO: 2866679 - protein, 4 aa, Entamoeba invadens
IQQV

SEQ ID NO: 2866680 - protein, 9 aa, Entamoeba invadens
IQQVQPQNI

SEQ ID NO: 2866681 - protein, 4 aa, Entamoeba invadens
IQRA

SEQ ID NO: 2866682 - protein, 9 aa, Entamoeba invadens
IQRENPSQI

SEQ ID NO: 2866683 - protein, 26 aa, Entamoeba invadens
IQRGKKLKKVSTTEKAVAPNHPQNRG

SEQ ID NO: 2866684 - protein, 10 aa, Entamoeba invadens
IQRGTKVEGM

SEQ ID NO: 2866685 - protein, 10 aa, Entamoeba invadens
IQRKPALNQT

SEQ ID NO: 2866686 - protein, 26 aa, Entamoeba invadens
IQRPNYPAKSPSPNTPKEQKKPSIPI

SEQ ID NO: 2866687 - protein, 8 aa, Entamoeba invadens
IQRQNALA

SEQ ID NO: 2866688 - protein, 9 aa, Entamoeba invadens
IQRTKNVGD

SEQ ID NO: 2866689 - protein, 5 aa, Entamoeba invadens
IQRTN

SEQ ID NO: 2866690 - protein, 10 aa, Entamoeba invadens
IQSAMDKGSQ

SEQ ID NO: 2866691 - protein, 41 aa, Entamoeba invadens
IQSAREKARKDMEERRRQMEEDRMRKQKERLDARKQRELDD

SEQ ID NO: 2866692 - protein, 11 aa, Entamoeba invadens
IQSDPSSPIPQ

SEQ ID NO: 2866693 - protein, 7 aa, Entamoeba invadens
IQSDTNY

SEQ ID NO: 2866694 - protein, 10 aa, Entamoeba invadens
IQSDTSSPIP

SEQ ID NO: 2866695 - protein, 6 aa, Entamoeba invadens
IQSEKK

SEQ ID NO: 2866696 - protein, 41 aa, Entamoeba invadens
IQSETKRIENASVENTKMEEDEEKEFEQKKRERNEAVQRSI

SEQ ID NO: 2866697 - protein, 7 aa, Entamoeba invadens
IQSETSD

SEQ ID NO: 2866698 - protein, 9 aa, Entamoeba invadens
IQSGANPSV

SEQ ID NO: 2866699 - protein, 100 aa, Entamoeba invadens
IQSGQLKPSVNSLTPSEKAAYDAIEKTQKVNEKGFGDIEGAQKALTDRVESGGNDNFQSKELPKDQPDTSIKESGVNPTEVQRSTTPERKVEPKRPNPFK

SEQ ID NO: 2866700 - protein, 4 aa, Entamoeba invadens
IQSK

SEQ ID NO: 2866701 - protein, 10 aa, Entamoeba invadens
IQSKRDNKIH

SEQ ID NO: 2866702 - protein, 12 aa, Entamoeba invadens
IQSKSTKKDLEQ

SEQ ID NO: 2866703 - protein, 5 aa, Entamoeba invadens
IQSLG

SEQ ID NO: 2866704 - protein, 24 aa, Entamoeba invadens
IQSNPSVSSLYSQPPLSSSSTQKK

SEQ ID NO: 2866705 - protein, 16 aa, Entamoeba invadens
IQSPTEGRNKNSFKLP

SEQ ID NO: 2866706 - protein, 12 aa, Entamoeba invadens
IQSPYESPTGVF

SEQ ID NO: 2866707 - protein, 23 aa, Entamoeba invadens
IQSQSSRENSLKSEGVDSNSEKI

SEQ ID NO: 2866708 - protein, 10 aa, Entamoeba invadens
IQSSQRSDLE

SEQ ID NO: 2866709 - protein, 21 aa, Entamoeba invadens
IQSSSENDTEENEPSLTKKEN

SEQ ID NO: 2866710 - protein, 7 aa, Entamoeba invadens
IQSSTRD

SEQ ID NO: 2866711 - protein, 10 aa, Entamoeba invadens
IQSSTTSVQR

SEQ ID NO: 2866712 - protein, 5 aa, Entamoeba invadens
IQSTE

SEQ ID NO: 2866713 - protein, 13 aa, Entamoeba invadens
IQSTSSDVVRSAG

SEQ ID NO: 2866714 - protein, 9 aa, Entamoeba invadens
IQSTTGPSF

SEQ ID NO: 2866715 - protein, 5 aa, Entamoeba invadens
IQTAT

SEQ ID NO: 2866716 - protein, 4 aa, Entamoeba invadens
IQTD

SEQ ID NO: 2866717 - protein, 8 aa, Entamoeba invadens
IQTDENNE

SEQ ID NO: 2866718 - protein, 11 aa, Entamoeba invadens
IQTESEEESIG

SEQ ID NO: 2866719 - protein, 9 aa, Entamoeba invadens
IQTGFNGDN

SEQ ID NO: 2866720 - protein, 12 aa, Entamoeba invadens
IQTGKSTSFNPK

SEQ ID NO: 2866721 - protein, 10 aa, Entamoeba invadens
IQTKGRGISG

SEQ ID NO: 2866722 - protein, 4 aa, Entamoeba invadens
IQTL

SEQ ID NO: 2866723 - protein, 14 aa, Entamoeba invadens
IQTNKGGKSSAKND

SEQ ID NO: 2866724 - protein, 4 aa, Entamoeba invadens
IQTP

SEQ ID NO: 2866725 - protein, 5 aa, Entamoeba invadens
IQTPF

SEQ ID NO: 2866726 - protein, 5 aa, Entamoeba invadens
IQTPK

SEQ ID NO: 2866727 - protein, 17 aa, Entamoeba invadens
IQTPSKAVQPSNEDTIG

SEQ ID NO: 2866728 - protein, 44 aa, Entamoeba invadens
IQTQPDEERQKADSADAVRKADLQKELEKDRAMKQKPDKKTQKL

SEQ ID NO: 2866729 - protein, 12 aa, Entamoeba invadens
IQTSESPKYTLT

SEQ ID NO: 2866730 - protein, 20 aa, Entamoeba invadens
IQTSQKAQEASSLQVTPNGG

SEQ ID NO: 2866731 - protein, 8 aa, Entamoeba invadens
IQTSQKSF

SEQ ID NO: 2866732 - protein, 11 aa, Entamoeba invadens
IQTSSASFDDI

SEQ ID NO: 2866733 - protein, 7 aa, Entamoeba invadens
IQTSTAK

SEQ ID NO: 2866734 - protein, 5 aa, Entamoeba invadens
IQTTI

SEQ ID NO: 2866735 - protein, 6 aa, Entamoeba invadens
IQTTND

SEQ ID NO: 2866736 - protein, 6 aa, Entamoeba invadens
IQTTQR

SEQ ID NO: 2866737 - protein, 6 aa, Entamoeba invadens
IQTTTE

SEQ ID NO: 2866738 - protein, 5 aa, Entamoeba invadens
IQVEK

SEQ ID NO: 2866739 - protein, 36 aa, Entamoeba invadens
IQVGPQQQKMRPAQPLPSSRQSVQQNQPPKSLPTKA

SEQ ID NO: 2866740 - protein, 8 aa, Entamoeba invadens
IQVTPNNQ

SEQ ID NO: 2866741 - protein, 13 aa, Entamoeba invadens
IQYKDKNGYYPEH

SEQ ID NO: 2866742 - protein, 11 aa, Entamoeba invadens
IQYQQNPRRQQ

SEQ ID NO: 2866743 - protein, 11 aa, Entamoeba invadens
IRAEEEQLKQL

SEQ ID NO: 2866744 - protein, 10 aa, Entamoeba invadens
IRASKEYDCS

SEQ ID NO: 2866745 - protein, 8 aa, Entamoeba invadens
IRASNENQ

SEQ ID NO: 2866746 - protein, 8 aa, Entamoeba invadens
IRASSKEL

SEQ ID NO: 2866747 - protein, 4 aa, Entamoeba invadens
IRDA

SEQ ID NO: 2866748 - protein, 7 aa, Entamoeba invadens
IRDASQK

SEQ ID NO: 2866749 - protein, 4 aa, Entamoeba invadens
IRDD

SEQ ID NO: 2866750 - protein, 9 aa, Entamoeba invadens
IRDDGLKDG

SEQ ID NO: 2866751 - protein, 10 aa, Entamoeba invadens
IRDDPEQMKK

SEQ ID NO: 2866752 - protein, 12 aa, Entamoeba invadens
IRDDRDDDHANG

SEQ ID NO: 2866753 - protein, 4 aa, Entamoeba invadens
IRDE

SEQ ID NO: 2866754 - protein, 7 aa, Entamoeba invadens
IRDESNE

SEQ ID NO: 2866755 - protein, 6 aa, Entamoeba invadens
IRDGQG

SEQ ID NO: 2866756 - protein, 17 aa, Entamoeba invadens
IRDGQRAQSQIQREEAK

SEQ ID NO: 2866757 - protein, 14 aa, Entamoeba invadens
IRDKVKEEGSGCEA

SEQ ID NO: 2866758 - protein, 40 aa, Entamoeba invadens
IRDLQSEKETLEEKVSAANDATLQAKRDGQDAQDKLEQLQ

SEQ ID NO: 2866759 - protein, 13 aa, Entamoeba invadens
IRDNDEKKRQTLK

SEQ ID NO: 2866760 - protein, 6 aa, Entamoeba invadens
IRDQQP

SEQ ID NO: 2866761 - protein, 14 aa, Entamoeba invadens
IRDTGSRAEVEESA

SEQ ID NO: 2866762 - protein, 10 aa, Entamoeba invadens
IRDTKRSQML

SEQ ID NO: 2866763 - protein, 10 aa, Entamoeba invadens
IREAPSKKQH

SEQ ID NO: 2866764 - protein, 5 aa, Entamoeba invadens
IREDA

SEQ ID NO: 2866765 - protein, 38 aa, Entamoeba invadens
IREDPDNNCQMNSNVNEQEQQNNAQPIQPQQPQEIQQE

SEQ ID NO: 2866766 - protein, 8 aa, Entamoeba invadens
IREDSSLS

SEQ ID NO: 2866767 - protein, 20 aa, Entamoeba invadens
IREDYEKQQYEKVPKDQCII

SEQ ID NO: 2866768 - protein, 6 aa, Entamoeba invadens
IREEDA

SEQ ID NO: 2866769 - protein, 10 aa, Entamoeba invadens
IREENASDVK

SEQ ID NO: 2866770 - protein, 9 aa, Entamoeba invadens
IREGDNSIV

SEQ ID NO: 2866771 - protein, 8 aa, Entamoeba invadens
IREGKKGF

SEQ ID NO: 2866772 - protein, 9 aa, Entamoeba invadens
IREKATTSF

SEQ ID NO: 2866773 - protein, 19 aa, Entamoeba invadens
IREKEKKALDLETNNRQKA

SEQ ID NO: 2866774 - protein, 12 aa, Entamoeba invadens
IREKQNTSDPVT

SEQ ID NO: 2866775 - protein, 12 aa, Entamoeba invadens
IREKRKQDKLVK

SEQ ID NO: 2866776 - protein, 5 aa, Entamoeba invadens
IREKS

SEQ ID NO: 2866777 - protein, 11 aa, Entamoeba invadens
IREKYKEGAED

SEQ ID NO: 2866778 - protein, 9 aa, Entamoeba invadens
IRENRDTEL

SEQ ID NO: 2866779 - protein, 11 aa, Entamoeba invadens
IRESEKSSEMS

SEQ ID NO: 2866780 - protein, 11 aa, Entamoeba invadens
IRESKRENKIH

SEQ ID NO: 2866781 - protein, 4 aa, Entamoeba invadens
IRET

SEQ ID NO: 2866782 - protein, 8 aa, Entamoeba invadens
IRETPNKR

SEQ ID NO: 2866783 - protein, 7 aa, Entamoeba invadens
IRETSST

SEQ ID NO: 2866784 - protein, 6 aa, Entamoeba invadens
IRETTV

SEQ ID NO: 2866785 - protein, 8 aa, Entamoeba invadens
IRGEPSCS

SEQ ID NO: 2866786 - protein, 7 aa, Entamoeba invadens
IRGESGK

SEQ ID NO: 2866787 - protein, 8 aa, Entamoeba invadens
IRGGAAQN

SEQ ID NO: 2866788 - protein, 8 aa, Entamoeba invadens
IRGGANVN

SEQ ID NO: 2866789 - protein, 8 aa, Entamoeba invadens
IRGGNTAK

SEQ ID NO: 2866790 - protein, 4 aa, Entamoeba invadens
IRGN

SEQ ID NO: 2866791 - protein, 6 aa, Entamoeba invadens
IRGNPD

SEQ ID NO: 2866792 - protein, 15 aa, Entamoeba invadens
IRGNPQIAEVIKYKN

SEQ ID NO: 2866793 - protein, 5 aa, Entamoeba invadens
IRGQN

SEQ ID NO: 2866794 - protein, 16 aa, Entamoeba invadens
IRGTNSTSTTIPKTTK

SEQ ID NO: 2866795 - protein, 11 aa, Entamoeba invadens
IRGTPGYCSPE

SEQ ID NO: 2866796 - protein, 6 aa, Entamoeba invadens
IRGYEG

SEQ ID NO: 2866797 - protein, 12 aa, Entamoeba invadens
IRKAPDPVLPVG

SEQ ID NO: 2866798 - protein, 9 aa, Entamoeba invadens
IRKENTESV

SEQ ID NO: 2866799 - protein, 5 aa, Entamoeba invadens
IRKGD

SEQ ID NO: 2866800 - protein, 10 aa, Entamoeba invadens
IRKGGRDDVL

SEQ ID NO: 2866801 - protein, 11 aa, Entamoeba invadens
IRKGSEARSNK

SEQ ID NO: 2866802 - protein, 16 aa, Entamoeba invadens
IRKKREDSKKQERAAR

SEQ ID NO: 2866803 - protein, 8 aa, Entamoeba invadens
IRKKSSKM

SEQ ID NO: 2866804 - protein, 7 aa, Entamoeba invadens
IRKTEQT

SEQ ID NO: 2866805 - protein, 10 aa, Entamoeba invadens
IRKTSDKKPQ

SEQ ID NO: 2866806 - protein, 4 aa, Entamoeba invadens
IRLS

SEQ ID NO: 2866807 - protein, 8 aa, Entamoeba invadens
IRNEQYER

SEQ ID NO: 2866808 - protein, 8 aa, Entamoeba invadens
IRNNPKTS

SEQ ID NO: 2866809 - protein, 8 aa, Entamoeba invadens
IRNPSNEI

SEQ ID NO: 2866810 - protein, 7 aa, Entamoeba invadens
IRNSSEY

SEQ ID NO: 2866811 - protein, 11 aa, Entamoeba invadens
IRNTQLTPQEC

SEQ ID NO: 2866812 - protein, 5 aa, Entamoeba invadens
IRPDN

SEQ ID NO: 2866813 - protein, 10 aa, Entamoeba invadens
IRPKEDQEKM

SEQ ID NO: 2866814 - protein, 6 aa, Entamoeba invadens
IRPKTG

SEQ ID NO: 2866815 - protein, 9 aa, Entamoeba invadens
IRPNANEEE

SEQ ID NO: 2866816 - protein, 7 aa, Entamoeba invadens
IRPNNIK

SEQ ID NO: 2866817 - protein, 4 aa, Entamoeba invadens
IRPQ

SEQ ID NO: 2866818 - protein, 5 aa, Entamoeba invadens
IRPQK

SEQ ID NO: 2866819 - protein, 5 aa, Entamoeba invadens
IRPQP

SEQ ID NO: 2866820 - protein, 7 aa, Entamoeba invadens
IRPSVSQ

SEQ ID NO: 2866821 - protein, 15 aa, Entamoeba invadens
IRQAGKPINETQTPL

SEQ ID NO: 2866822 - protein, 4 aa, Entamoeba invadens
IRQD

SEQ ID NO: 2866823 - protein, 10 aa, Entamoeba invadens
IRQDDKMKTT

SEQ ID NO: 2866824 - protein, 10 aa, Entamoeba invadens
IRQDEPDFST

SEQ ID NO: 2866825 - protein, 4 aa, Entamoeba invadens
IRQE

SEQ ID NO: 2866826 - protein, 12 aa, Entamoeba invadens
IRQNDEQNETNN

SEQ ID NO: 2866827 - protein, 12 aa, Entamoeba invadens
IRQPPEGKRYSQ

SEQ ID NO: 2866828 - protein, 10 aa, Entamoeba invadens
IRQQKDQTNQ

SEQ ID NO: 2866829 - protein, 9 aa, Entamoeba invadens
IRQREEEKR

SEQ ID NO: 2866830 - protein, 5 aa, Entamoeba invadens
IRQVQ

SEQ ID NO: 2866831 - protein, 11 aa, Entamoeba invadens
IRRDEQDRGRI

SEQ ID NO: 2866832 - protein, 5 aa, Entamoeba invadens
IRREN

SEQ ID NO: 2866833 - protein, 9 aa, Entamoeba invadens
IRRPDGNYE

SEQ ID NO: 2866834 - protein, 22 aa, Entamoeba invadens
IRRPFTNEEYAEYEEQQIVDFE

SEQ ID NO: 2866835 - protein, 7 aa, Entamoeba invadens
IRRQTAN

SEQ ID NO: 2866836 - protein, 14 aa, Entamoeba invadens
IRRSEQDPSCYEYV

SEQ ID NO: 2866837 - protein, 12 aa, Entamoeba invadens
IRRTNRRYSESG

SEQ ID NO: 2866838 - protein, 8 aa, Entamoeba invadens
IRSDGKYL

SEQ ID NO: 2866839 - protein, 17 aa, Entamoeba invadens
IRSEECGHVSETEERTN

SEQ ID NO: 2866840 - protein, 9 aa, Entamoeba invadens
IRSEETKRV

SEQ ID NO: 2866841 - protein, 12 aa, Entamoeba invadens
IRSKDEAPPETI

SEQ ID NO: 2866842 - protein, 4 aa, Entamoeba invadens
IRSL

SEQ ID NO: 2866843 - protein, 8 aa, Entamoeba invadens
IRSSKEER

SEQ ID NO: 2866844 - protein, 4 aa, Entamoeba invadens
IRTD

SEQ ID NO: 2866845 - protein, 5 aa, Entamoeba invadens
IRTDA

SEQ ID NO: 2866846 - protein, 8 aa, Entamoeba invadens
IRTGKKDV

SEQ ID NO: 2866847 - protein, 6 aa, Entamoeba invadens
IRTGKS

SEQ ID NO: 2866848 - protein, 5 aa, Entamoeba invadens
IRTIG

SEQ ID NO: 2866849 - protein, 11 aa, Entamoeba invadens
IRTPEKVAKNR

SEQ ID NO: 2866850 - protein, 6 aa, Entamoeba invadens
IRTPTQ

SEQ ID NO: 2866851 - protein, 6 aa, Entamoeba invadens
IRTPYE

SEQ ID NO: 2866852 - protein, 11 aa, Entamoeba invadens
IRTSPKEDSDK

SEQ ID NO: 2866853 - protein, 12 aa, Entamoeba invadens
IRTTTMEDTSSS

SEQ ID NO: 2866854 - protein, 8 aa, Entamoeba invadens
IRYDAGEA

SEQ ID NO: 2866855 - protein, 12 aa, Entamoeba invadens
IRYGEKTGTRNV

SEQ ID NO: 2866856 - protein, 5 aa, Entamoeba invadens
ISAEQ

SEQ ID NO: 2866857 - protein, 14 aa, Entamoeba invadens
ISAESGINTFRDPE

SEQ ID NO: 2866858 - protein, 5 aa, Entamoeba invadens
ISAET

SEQ ID NO: 2866859 - protein, 6 aa, Entamoeba invadens
ISAEYK

SEQ ID NO: 2866860 - protein, 7 aa, Entamoeba invadens
ISAGNKE

SEQ ID NO: 2866861 - protein, 16 aa, Entamoeba invadens
ISALEEDKSIYIDRPT

SEQ ID NO: 2866862 - protein, 6 aa, Entamoeba invadens
ISAPTY

SEQ ID NO: 2866863 - protein, 13 aa, Entamoeba invadens
ISAQDLDNAIAGS

SEQ ID NO: 2866864 - protein, 11 aa, Entamoeba invadens
ISAQDSAPNAC

SEQ ID NO: 2866865 - protein, 14 aa, Entamoeba invadens
ISAQPGDESVSPGI

SEQ ID NO: 2866866 - protein, 4 aa, Entamoeba invadens
ISAR

SEQ ID NO: 2866867 - protein, 12 aa, Entamoeba invadens
ISARGNSGTSFD

SEQ ID NO: 2866868 - protein, 10 aa, Entamoeba invadens
ISASSHVDDL

SEQ ID NO: 2866869 - protein, 9 aa, Entamoeba invadens
ISCNNKKGF

SEQ ID NO: 2866870 - protein, 10 aa, Entamoeba invadens
ISCSKTNTEY

SEQ ID NO: 2866871 - protein, 13 aa, Entamoeba invadens
ISDAQAEGLQSVS

SEQ ID NO: 2866872 - protein, 7 aa, Entamoeba invadens
ISDATAE

SEQ ID NO: 2866873 - protein, 12 aa, Entamoeba invadens
ISDDEGKRYAKK

SEQ ID NO: 2866874 - protein, 7 aa, Entamoeba invadens
ISDDERD

SEQ ID NO: 2866875 - protein, 15 aa, Entamoeba invadens
ISDDTCGDGGEASAY

SEQ ID NO: 2866876 - protein, 9 aa, Entamoeba invadens
ISDEDSRQI

SEQ ID NO: 2866877 - protein, 10 aa, Entamoeba invadens
ISDEKTSQDG

SEQ ID NO: 2866878 - protein, 15 aa, Entamoeba invadens
ISDESARRKRDPRKR

SEQ ID NO: 2866879 - protein, 5 aa, Entamoeba invadens
ISDGV

SEQ ID NO: 2866880 - protein, 11 aa, Entamoeba invadens
ISDIEKRIGDN

SEQ ID NO: 2866881 - protein, 10 aa, Entamoeba invadens
ISDIGRKSIA

SEQ ID NO: 2866882 - protein, 4 aa, Entamoeba invadens
ISDL

SEQ ID NO: 2866883 - protein, 5 aa, Entamoeba invadens
ISDLE

SEQ ID NO: 2866884 - protein, 13 aa, Entamoeba invadens
ISDLKLEGVEFIN

SEQ ID NO: 2866885 - protein, 10 aa, Entamoeba invadens
ISDNGDEISN

SEQ ID NO: 2866886 - protein, 16 aa, Entamoeba invadens
ISDRDIKTAMRNTEGV

SEQ ID NO: 2866887 - protein, 15 aa, Entamoeba invadens
ISDSAQTNTQKYGLR

SEQ ID NO: 2866888 - protein, 17 aa, Entamoeba invadens
ISDSIEDKLMNKNDWDS

SEQ ID NO: 2866889 - protein, 17 aa, Entamoeba invadens
ISDSIEDKLTNKKDWDS

SEQ ID NO: 2866890 - protein, 17 aa, Entamoeba invadens
ISDSIEDKLTNKNDWDS

SEQ ID NO: 2866891 - protein, 18 aa, Entamoeba invadens
ISDSMSSSSNDSPIQESP

SEQ ID NO: 2866892 - protein, 12 aa, Entamoeba invadens
ISDSSQKRNELN

SEQ ID NO: 2866893 - protein, 16 aa, Entamoeba invadens
ISDTLTNSEETDEVKD

SEQ ID NO: 2866894 - protein, 4 aa, Entamoeba invadens
ISDV

SEQ ID NO: 2866895 - protein, 8 aa, Entamoeba invadens
ISEANQQL

SEQ ID NO: 2866896 - protein, 7 aa, Entamoeba invadens
ISEARSS

SEQ ID NO: 2866897 - protein, 24 aa, Entamoeba invadens
ISEDSINDGGDESENNNGNKDGSV

SEQ ID NO: 2866898 - protein, 8 aa, Entamoeba invadens
ISEDTELD

SEQ ID NO: 2866899 - protein, 9 aa, Entamoeba invadens
ISEDVKADL

SEQ ID NO: 2866900 - protein, 6 aa, Entamoeba invadens
ISEEAK

SEQ ID NO: 2866901 - protein, 11 aa, Entamoeba invadens
ISEEATQKALE

SEQ ID NO: 2866902 - protein, 6 aa, Entamoeba invadens
ISEEKQ

SEQ ID NO: 2866903 - protein, 10 aa, Entamoeba invadens
ISEEKRNAVR

SEQ ID NO: 2866904 - protein, 29 aa, Entamoeba invadens
ISEEPDSEKDEGSGSENDETSNSEGNGNG

SEQ ID NO: 2866905 - protein, 17 aa, Entamoeba invadens
ISEEPELKKKIEERVTS

SEQ ID NO: 2866906 - protein, 9 aa, Entamoeba invadens
ISEETNATD

SEQ ID NO: 2866907 - protein, 9 aa, Entamoeba invadens
ISEETSPSV

SEQ ID NO: 2866908 - protein, 10 aa, Entamoeba invadens
ISEGIPESTA

SEQ ID NO: 2866909 - protein, 14 aa, Entamoeba invadens
ISEGKINETKSQEE

SEQ ID NO: 2866910 - protein, 8 aa, Entamoeba invadens
ISEGKYSN

SEQ ID NO: 2866911 - protein, 7 aa, Entamoeba invadens
ISEGRTL

SEQ ID NO: 2866912 - protein, 11 aa, Entamoeba invadens
ISEGVERAGAS

SEQ ID NO: 2866913 - protein, 12 aa, Entamoeba invadens
ISEHSGNSKAKD

SEQ ID NO: 2866914 - protein, 4 aa, Entamoeba invadens
ISEI

SEQ ID NO: 2866915 - protein, 5 aa, Entamoeba invadens
ISEID

SEQ ID NO: 2866916 - protein, 14 aa, Entamoeba invadens
ISEIEEKENSTQIE

SEQ ID NO: 2866917 - protein, 10 aa, Entamoeba invadens
ISEKAKMEKE

SEQ ID NO: 2866918 - protein, 24 aa, Entamoeba invadens
ISEKDEAVKKVRNNVENESKTYPE

SEQ ID NO: 2866919 - protein, 8 aa, Entamoeba invadens
ISEKENEM

SEQ ID NO: 2866920 - protein, 8 aa, Entamoeba invadens
ISEKGKME

SEQ ID NO: 2866921 - protein, 6 aa, Entamoeba invadens
ISEKGY

SEQ ID NO: 2866922 - protein, 5 aa, Entamoeba invadens
ISEKK

SEQ ID NO: 2866923 - protein, 130 aa, Entamoeba invadens
ISEKKDDVEPVKEKPKEKIEEKKEVLKSETPTRTDFKDTQRDRNEDGRERKNDRKSYRSDRRQHEERFERRDRDRSFNERREDRRDDRRDERRDERGFTKNRRDDVYKRNSRNRSPRRSRSASRENSRRE

SEQ ID NO: 2866924 - protein, 11 aa, Entamoeba invadens
ISEKKKTVTRE

SEQ ID NO: 2866925 - protein, 7 aa, Entamoeba invadens
ISEKPDF

SEQ ID NO: 2866926 - protein, 9 aa, Entamoeba invadens
ISEKPERQM

SEQ ID NO: 2866927 - protein, 16 aa, Entamoeba invadens
ISEKRGRHGSEGFGPV

SEQ ID NO: 2866928 - protein, 8 aa, Entamoeba invadens
ISEKTENV

SEQ ID NO: 2866929 - protein, 14 aa, Entamoeba invadens
ISEKVADDQLKQKI

SEQ ID NO: 2866930 - protein, 4 aa, Entamoeba invadens
ISEL

SEQ ID NO: 2866931 - protein, 5 aa, Entamoeba invadens
ISELG

SEQ ID NO: 2866932 - protein, 5 aa, Entamoeba invadens
ISELP

SEQ ID NO: 2866933 - protein, 6 aa, Entamoeba invadens
ISENDG

SEQ ID NO: 2866934 - protein, 7 aa, Entamoeba invadens
ISENKAD

SEQ ID NO: 2866935 - protein, 8 aa, Entamoeba invadens
ISENPKKA

SEQ ID NO: 2866936 - protein, 5 aa, Entamoeba invadens
ISENT

SEQ ID NO: 2866937 - protein, 47 aa, Entamoeba invadens
ISEPLNPEGNEEETKQESFKMEEESPAQEEEVKTENGETTPSHTPQM

SEQ ID NO: 2866938 - protein, 5 aa, Entamoeba invadens
ISEPN

SEQ ID NO: 2866939 - protein, 4 aa, Entamoeba invadens
ISEQ

SEQ ID NO: 2866940 - protein, 11 aa, Entamoeba invadens
ISERAEEKMEQ

SEQ ID NO: 2866941 - protein, 8 aa, Entamoeba invadens
ISERGNDT

SEQ ID NO: 2866942 - protein, 9 aa, Entamoeba invadens
ISERKANID

SEQ ID NO: 2866943 - protein, 8 aa, Entamoeba invadens
ISERSAAT

SEQ ID NO: 2866944 - protein, 10 aa, Entamoeba invadens
ISERYTKIGQ

SEQ ID NO: 2866945 - protein, 5 aa, Entamoeba invadens
ISESD

SEQ ID NO: 2866946 - protein, 14 aa, Entamoeba invadens
ISESDNTSLKAPSV

SEQ ID NO: 2866947 - protein, 7 aa, Entamoeba invadens
ISESEKL

SEQ ID NO: 2866948 - protein, 14 aa, Entamoeba invadens
ISESNKKCEKNNEK

SEQ ID NO: 2866949 - protein, 9 aa, Entamoeba invadens
ISESPQKVT

SEQ ID NO: 2866950 - protein, 6 aa, Entamoeba invadens
ISESQI

SEQ ID NO: 2866951 - protein, 9 aa, Entamoeba invadens
ISETNSREA

SEQ ID NO: 2866952 - protein, 5 aa, Entamoeba invadens
ISEVE

SEQ ID NO: 2866953 - protein, 8 aa, Entamoeba invadens
ISEVTQSD

SEQ ID NO: 2866954 - protein, 5 aa, Entamoeba invadens
ISEYK

SEQ ID NO: 2866955 - protein, 18 aa, Entamoeba invadens
ISFDGSSSVKKEKSPEEV

SEQ ID NO: 2866956 - protein, 9 aa, Entamoeba invadens
ISFDTSSSN

SEQ ID NO: 2866957 - protein, 13 aa, Entamoeba invadens
ISFEDAESVKPTQ

SEQ ID NO: 2866958 - protein, 5 aa, Entamoeba invadens
ISFGD

SEQ ID NO: 2866959 - protein, 4 aa, Entamoeba invadens
ISFS

SEQ ID NO: 2866960 - protein, 5 aa, Entamoeba invadens
ISGCK

SEQ ID NO: 2866961 - protein, 9 aa, Entamoeba invadens
ISGDEESHR

SEQ ID NO: 2866962 - protein, 9 aa, Entamoeba invadens
ISGDEESKR

SEQ ID NO: 2866963 - protein, 6 aa, Entamoeba invadens
ISGDGE

SEQ ID NO: 2866964 - protein, 6 aa, Entamoeba invadens
ISGDTL

SEQ ID NO: 2866965 - protein, 20 aa, Entamoeba invadens
ISGEEQMKERVDLGGDGVIE

SEQ ID NO: 2866966 - protein, 6 aa, Entamoeba invadens
ISGEGE

SEQ ID NO: 2866967 - protein, 14 aa, Entamoeba invadens
ISGEMAERRDSKGE

SEQ ID NO: 2866968 - protein, 11 aa, Entamoeba invadens
ISGFSKARTYQ

SEQ ID NO: 2866969 - protein, 10 aa, Entamoeba invadens
ISGGNESNCG

SEQ ID NO: 2866970 - protein, 16 aa, Entamoeba invadens
ISGGSNIFGKTGGVAE

SEQ ID NO: 2866971 - protein, 8 aa, Entamoeba invadens
ISGHGKDR

SEQ ID NO: 2866972 - protein, 5 aa, Entamoeba invadens
ISGIE

SEQ ID NO: 2866973 - protein, 6 aa, Entamoeba invadens
ISGKGG

SEQ ID NO: 2866974 - protein, 12 aa, Entamoeba invadens
ISGKLSDDLNKA

SEQ ID NO: 2866975 - protein, 8 aa, Entamoeba invadens
ISGKSLSK

SEQ ID NO: 2866976 - protein, 7 aa, Entamoeba invadens
ISGLKDD

SEQ ID NO: 2866977 - protein, 9 aa, Entamoeba invadens
ISGMATANG

SEQ ID NO: 2866978 - protein, 11 aa, Entamoeba invadens
ISGNEDTLNNA

SEQ ID NO: 2866979 - protein, 12 aa, Entamoeba invadens
ISGNEDTLNNEF

SEQ ID NO: 2866980 - protein, 9 aa, Entamoeba invadens
ISGNGIANV

SEQ ID NO: 2866981 - protein, 20 aa, Entamoeba invadens
ISGPEDTKYFDENQTDDGYL

SEQ ID NO: 2866982 - protein, 5 aa, Entamoeba invadens
ISGQA

SEQ ID NO: 2866983 - protein, 5 aa, Entamoeba invadens
ISGQE

SEQ ID NO: 2866984 - protein, 31 aa, Entamoeba invadens
ISGRTDENRKRTEDSDQVENNTESINRAKKR

SEQ ID NO: 2866985 - protein, 7 aa, Entamoeba invadens
ISGSADR

SEQ ID NO: 2866986 - protein, 6 aa, Entamoeba invadens
ISGSDD

SEQ ID NO: 2866987 - protein, 14 aa, Entamoeba invadens
ISGSKVAKKKSNAL

SEQ ID NO: 2866988 - protein, 5 aa, Entamoeba invadens
ISGTI

SEQ ID NO: 2866989 - protein, 4 aa, Entamoeba invadens
ISGV

SEQ ID NO: 2866990 - protein, 10 aa, Entamoeba invadens
ISHGRTLDDQ

SEQ ID NO: 2866991 - protein, 10 aa, Entamoeba invadens
ISHNEATRHY

SEQ ID NO: 2866992 - protein, 4 aa, Entamoeba invadens
ISID

SEQ ID NO: 2866993 - protein, 6 aa, Entamoeba invadens
ISIDPN

SEQ ID NO: 2866994 - protein, 4 aa, Entamoeba invadens
ISIE

SEQ ID NO: 2866995 - protein, 13 aa, Entamoeba invadens
ISIEKDEKYNPVG

SEQ ID NO: 2866996 - protein, 9 aa, Entamoeba invadens
ISINGYPSN

SEQ ID NO: 2866997 - protein, 10 aa, Entamoeba invadens
ISIPKSVSSI

SEQ ID NO: 2866998 - protein, 11 aa, Entamoeba invadens
ISIPSNVTSLG

SEQ ID NO: 2866999 - protein, 10 aa, Entamoeba invadens
ISISNSKKLP

SEQ ID NO: 2867000 - protein, 9 aa, Entamoeba invadens
ISKDEAGVN

SEQ ID NO: 2867001 - protein, 13 aa, Entamoeba invadens
ISKDEEKEEFKKT

SEQ ID NO: 2867002 - protein, 9 aa, Entamoeba invadens
ISKDKEKLD

SEQ ID NO: 2867003 - protein, 16 aa, Entamoeba invadens
ISKDNVKTPNAQQNVQ

SEQ ID NO: 2867004 - protein, 10 aa, Entamoeba invadens
ISKDSELDEK

SEQ ID NO: 2867005 - protein, 27 aa, Entamoeba invadens
ISKDSPTEEKQQESEEKVQNSKNDSIQ

SEQ ID NO: 2867006 - protein, 6 aa, Entamoeba invadens
ISKEQL

SEQ ID NO: 2867007 - protein, 5 aa, Entamoeba invadens
ISKET

SEQ ID NO: 2867008 - protein, 11 aa, Entamoeba invadens
ISKETNKETIP

SEQ ID NO: 2867009 - protein, 4 aa, Entamoeba invadens
ISKG

SEQ ID NO: 2867010 - protein, 10 aa, Entamoeba invadens
ISKGHEESKI

SEQ ID NO: 2867011 - protein, 21 aa, Entamoeba invadens
ISKGVKESTATERMKKNRIKQ

SEQ ID NO: 2867012 - protein, 4 aa, Entamoeba invadens
ISKI

SEQ ID NO: 2867013 - protein, 12 aa, Entamoeba invadens
ISKKCDSAIKGK

SEQ ID NO: 2867014 - protein, 13 aa, Entamoeba invadens
ISKKEKTAKPDEL

SEQ ID NO: 2867015 - protein, 16 aa, Entamoeba invadens
ISKKERLKTKNRIPPE

SEQ ID NO: 2867016 - protein, 6 aa, Entamoeba invadens
ISKKEV

SEQ ID NO: 2867017 - protein, 7 aa, Entamoeba invadens
ISKKEVD

SEQ ID NO: 2867018 - protein, 20 aa, Entamoeba invadens
ISKKIEQKNIASESVDDQNK

SEQ ID NO: 2867019 - protein, 4 aa, Entamoeba invadens
ISKM

SEQ ID NO: 2867020 - protein, 6 aa, Entamoeba invadens
ISKNKS

SEQ ID NO: 2867021 - protein, 7 aa, Entamoeba invadens
ISKNNPK

SEQ ID NO: 2867022 - protein, 15 aa, Entamoeba invadens
ISKNQQFEAQKKKEE

SEQ ID NO: 2867023 - protein, 12 aa, Entamoeba invadens
ISKPQKKAENTK

SEQ ID NO: 2867024 - protein, 9 aa, Entamoeba invadens
ISKQSPEEV

SEQ ID NO: 2867025 - protein, 8 aa, Entamoeba invadens
ISKQTRKY

SEQ ID NO: 2867026 - protein, 10 aa, Entamoeba invadens
ISKREDKFKY

SEQ ID NO: 2867027 - protein, 21 aa, Entamoeba invadens
ISKRLKKREKLRKQLVEKEKE

SEQ ID NO: 2867028 - protein, 10 aa, Entamoeba invadens
ISKSGKDDLS

SEQ ID NO: 2867029 - protein, 8 aa, Entamoeba invadens
ISKSQRTE

SEQ ID NO: 2867030 - protein, 10 aa, Entamoeba invadens
ISKSQSVSRY

SEQ ID NO: 2867031 - protein, 15 aa, Entamoeba invadens
ISKTAATALKDLDGN

SEQ ID NO: 2867032 - protein, 47 aa, Entamoeba invadens
ISKTKKSVSIEKEKKKPKKEKPERKVKLQKKKEKIEPLEKTEKITNE

SEQ ID NO: 2867033 - protein, 13 aa, Entamoeba invadens
ISKTNEAEAETEF

SEQ ID NO: 2867034 - protein, 8 aa, Entamoeba invadens
ISKTRDPF

SEQ ID NO: 2867035 - protein, 9 aa, Entamoeba invadens
ISKYGNSIG

SEQ ID NO: 2867036 - protein, 4 aa, Entamoeba invadens
ISLN

SEQ ID NO: 2867037 - protein, 22 aa, Entamoeba invadens
ISLPSHSQPPVVAPPPPPKDIL

SEQ ID NO: 2867038 - protein, 6 aa, Entamoeba invadens
ISLPTN

SEQ ID NO: 2867039 - protein, 36 aa, Entamoeba invadens
ISLSTESLDLPSHKRVTSVDSKTEEDKFSTSSPRFL

SEQ ID NO: 2867040 - protein, 5 aa, Entamoeba invadens
ISLTD

SEQ ID NO: 2867041 - protein, 11 aa, Entamoeba invadens
ISNAEDGVSVT

SEQ ID NO: 2867042 - protein, 22 aa, Entamoeba invadens
ISNDATKDSNTRAASDQRLKNS

SEQ ID NO: 2867043 - protein, 17 aa, Entamoeba invadens
ISNDTGNNTEKITESQL

SEQ ID NO: 2867044 - protein, 6 aa, Entamoeba invadens
ISNENQ

SEQ ID NO: 2867045 - protein, 10 aa, Entamoeba invadens
ISNEPSNAND

SEQ ID NO: 2867046 - protein, 10 aa, Entamoeba invadens
ISNEQPTREK

SEQ ID NO: 2867047 - protein, 5 aa, Entamoeba invadens
ISNHP

SEQ ID NO: 2867048 - protein, 6 aa, Entamoeba invadens
ISNKNE

SEQ ID NO: 2867049 - protein, 4 aa, Entamoeba invadens
ISNN

SEQ ID NO: 2867050 - protein, 9 aa, Entamoeba invadens
ISNNNKLSA

SEQ ID NO: 2867051 - protein, 8 aa, Entamoeba invadens
ISNNPNML

SEQ ID NO: 2867052 - protein, 6 aa, Entamoeba invadens
ISNNQT

SEQ ID NO: 2867053 - protein, 13 aa, Entamoeba invadens
ISNPDINKKEKAV

SEQ ID NO: 2867054 - protein, 7 aa, Entamoeba invadens
ISNPQTF

SEQ ID NO: 2867055 - protein, 16 aa, Entamoeba invadens
ISNQQNTRLKDKAGKL

SEQ ID NO: 2867056 - protein, 8 aa, Entamoeba invadens
ISNRPFPS

SEQ ID NO: 2867057 - protein, 10 aa, Entamoeba invadens
ISNSNTKYEH

SEQ ID NO: 2867058 - protein, 11 aa, Entamoeba invadens
ISNSTDNPVEI

SEQ ID NO: 2867059 - protein, 6 aa, Entamoeba invadens
ISNSTG

SEQ ID NO: 2867060 - protein, 13 aa, Entamoeba invadens
ISNSTGKSFTPDS

SEQ ID NO: 2867061 - protein, 18 aa, Entamoeba invadens
ISNTAKRHFDEETQTPKV

SEQ ID NO: 2867062 - protein, 11 aa, Entamoeba invadens
ISNTGKTVNQQ

SEQ ID NO: 2867063 - protein, 5 aa, Entamoeba invadens
ISNTH

SEQ ID NO: 2867064 - protein, 10 aa, Entamoeba invadens
ISNTKDGVKA

SEQ ID NO: 2867065 - protein, 12 aa, Entamoeba invadens
ISNTKEINSSPE

SEQ ID NO: 2867066 - protein, 12 aa, Entamoeba invadens
ISNTKTNGMTKK

SEQ ID NO: 2867067 - protein, 27 aa, Entamoeba invadens
ISNTNDNKQERKVDKNVTKKKEVEKKK

SEQ ID NO: 2867068 - protein, 6 aa, Entamoeba invadens
ISNTSK

SEQ ID NO: 2867069 - protein, 8 aa, Entamoeba invadens
ISNTTTKH

SEQ ID NO: 2867070 - protein, 9 aa, Entamoeba invadens
ISNYPQKIQ

SEQ ID NO: 2867071 - protein, 9 aa, Entamoeba invadens
ISPDDEEGF

SEQ ID NO: 2867072 - protein, 6 aa, Entamoeba invadens
ISPDGK

SEQ ID NO: 2867073 - protein, 7 aa, Entamoeba invadens
ISPDGYE

SEQ ID NO: 2867074 - protein, 6 aa, Entamoeba invadens
ISPDLN

SEQ ID NO: 2867075 - protein, 8 aa, Entamoeba invadens
ISPDPNLD

SEQ ID NO: 2867076 - protein, 8 aa, Entamoeba invadens
ISPDPNLS

SEQ ID NO: 2867077 - protein, 6 aa, Entamoeba invadens
ISPDSL

SEQ ID NO: 2867078 - protein, 5 aa, Entamoeba invadens
ISPDT

SEQ ID NO: 2867079 - protein, 4 aa, Entamoeba invadens
ISPE

SEQ ID NO: 2867080 - protein, 6 aa, Entamoeba invadens
ISPELS

SEQ ID NO: 2867081 - protein, 5 aa, Entamoeba invadens
ISPEQ

SEQ ID NO: 2867082 - protein, 7 aa, Entamoeba invadens
ISPESKP

SEQ ID NO: 2867083 - protein, 15 aa, Entamoeba invadens
ISPETKNISVSDPVE

SEQ ID NO: 2867084 - protein, 4 aa, Entamoeba invadens
ISPH

SEQ ID NO: 2867085 - protein, 4 aa, Entamoeba invadens
ISPI

SEQ ID NO: 2867086 - protein, 10 aa, Entamoeba invadens
ISPKKPTIDL

SEQ ID NO: 2867087 - protein, 9 aa, Entamoeba invadens
ISPKSFKTA

SEQ ID NO: 2867088 - protein, 12 aa, Entamoeba invadens
ISPKSPRSPRGA

SEQ ID NO: 2867089 - protein, 11 aa, Entamoeba invadens
ISPKTGESFPT

SEQ ID NO: 2867090 - protein, 10 aa, Entamoeba invadens
ISPLPPPAGN

SEQ ID NO: 2867091 - protein, 4 aa, Entamoeba invadens
ISPN

SEQ ID NO: 2867092 - protein, 5 aa, Entamoeba invadens
ISPNL

SEQ ID NO: 2867093 - protein, 6 aa, Entamoeba invadens
ISPNLN

SEQ ID NO: 2867094 - protein, 7 aa, Entamoeba invadens
ISPNLNS

SEQ ID NO: 2867095 - protein, 8 aa, Entamoeba invadens
ISPNNRAV

SEQ ID NO: 2867096 - protein, 13 aa, Entamoeba invadens
ISPNRSVSSPTYN

SEQ ID NO: 2867097 - protein, 9 aa, Entamoeba invadens
ISPNSPFNN

SEQ ID NO: 2867098 - protein, 8 aa, Entamoeba invadens
ISPNVTRT

SEQ ID NO: 2867099 - protein, 9 aa, Entamoeba invadens
ISPPGTSEE

SEQ ID NO: 2867100 - protein, 7 aa, Entamoeba invadens
ISPPPYP

SEQ ID NO: 2867101 - protein, 6 aa, Entamoeba invadens
ISPQFA

SEQ ID NO: 2867102 - protein, 5 aa, Entamoeba invadens
ISPQL

SEQ ID NO: 2867103 - protein, 5 aa, Entamoeba invadens
ISPQS

SEQ ID NO: 2867104 - protein, 10 aa, Entamoeba invadens
ISPRDPTKRG

SEQ ID NO: 2867105 - protein, 24 aa, Entamoeba invadens
ISPRNVSKTSNGKRLKRNSVDNIG

SEQ ID NO: 2867106 - protein, 10 aa, Entamoeba invadens
ISPSDGDAVM

SEQ ID NO: 2867107 - protein, 5 aa, Entamoeba invadens
ISPSF

SEQ ID NO: 2867108 - protein, 20 aa, Entamoeba invadens
ISPSHRSTDTDHSGPLPKRQ

SEQ ID NO: 2867109 - protein, 10 aa, Entamoeba invadens
ISPSKRATMS

SEQ ID NO: 2867110 - protein, 6 aa, Entamoeba invadens
ISPSLN

SEQ ID NO: 2867111 - protein, 6 aa, Entamoeba invadens
ISPSLQ

SEQ ID NO: 2867112 - protein, 6 aa, Entamoeba invadens
ISPSMQ

SEQ ID NO: 2867113 - protein, 9 aa, Entamoeba invadens
ISPSNQTSL

SEQ ID NO: 2867114 - protein, 8 aa, Entamoeba invadens
ISPSNSKK

SEQ ID NO: 2867115 - protein, 15 aa, Entamoeba invadens
ISPSPSSWVSDSKQN

SEQ ID NO: 2867116 - protein, 12 aa, Entamoeba invadens
ISPSSTYTENRE

SEQ ID NO: 2867117 - protein, 4 aa, Entamoeba invadens
ISPT

SEQ ID NO: 2867118 - protein, 7 aa, Entamoeba invadens
ISPTDQT

SEQ ID NO: 2867119 - protein, 8 aa, Entamoeba invadens
ISPTEKLY

SEQ ID NO: 2867120 - protein, 6 aa, Entamoeba invadens
ISPTKT

SEQ ID NO: 2867121 - protein, 10 aa, Entamoeba invadens
ISPTPAKVGD

SEQ ID NO: 2867122 - protein, 9 aa, Entamoeba invadens
ISPTSPIQS

SEQ ID NO: 2867123 - protein, 11 aa, Entamoeba invadens
ISPTTQEHGAI

SEQ ID NO: 2867124 - protein, 7 aa, Entamoeba invadens
ISPYTNQ

SEQ ID NO: 2867125 - protein, 30 aa, Entamoeba invadens
ISQDESRQSRRERQKEIESEKISKAYEKVE

SEQ ID NO: 2867126 - protein, 17 aa, Entamoeba invadens
ISQDTAKQRITKNKTYE

SEQ ID NO: 2867127 - protein, 9 aa, Entamoeba invadens
ISQDTLRTT

SEQ ID NO: 2867128 - protein, 7 aa, Entamoeba invadens
ISQEAKL

SEQ ID NO: 2867129 - protein, 48 aa, Entamoeba invadens
ISQEENAMEEDDEELPALGSDNEDDEELKKKEKDSKAIKKPKEKKPKV

SEQ ID NO: 2867130 - protein, 7 aa, Entamoeba invadens
ISQEGAS

SEQ ID NO: 2867131 - protein, 8 aa, Entamoeba invadens
ISQEKAQV

SEQ ID NO: 2867132 - protein, 14 aa, Entamoeba invadens
ISQENEKSEVKGKV

SEQ ID NO: 2867133 - protein, 6 aa, Entamoeba invadens
ISQEQY

SEQ ID NO: 2867134 - protein, 10 aa, Entamoeba invadens
ISQFNATNQI

SEQ ID NO: 2867135 - protein, 8 aa, Entamoeba invadens
ISQFSKDD

SEQ ID NO: 2867136 - protein, 25 aa, Entamoeba invadens
ISQGEPAPKEDIPITSTSNKTTSND

SEQ ID NO: 2867137 - protein, 11 aa, Entamoeba invadens
ISQGGKSGKYS

SEQ ID NO: 2867138 - protein, 29 aa, Entamoeba invadens
ISQGTKLKKVTERVDPPKEQMTDQMKGDL

SEQ ID NO: 2867139 - protein, 4 aa, Entamoeba invadens
ISQI

SEQ ID NO: 2867140 - protein, 15 aa, Entamoeba invadens
ISQITATQVSGKEIG

SEQ ID NO: 2867141 - protein, 10 aa, Entamoeba invadens
ISQKNENEMV

SEQ ID NO: 2867142 - protein, 15 aa, Entamoeba invadens
ISQKTAKRRKNNNYT

SEQ ID NO: 2867143 - protein, 10 aa, Entamoeba invadens
ISQKTGNQII

SEQ ID NO: 2867144 - protein, 7 aa, Entamoeba invadens
ISQKTTV

SEQ ID NO: 2867145 - protein, 33 aa, Entamoeba invadens
ISQKVVPKQTHNEEDTVGSKVPPSVMPKNSITK

SEQ ID NO: 2867146 - protein, 11 aa, Entamoeba invadens
ISQNLSNQKTI

SEQ ID NO: 2867147 - protein, 5 aa, Entamoeba invadens
ISQNS

SEQ ID NO: 2867148 - protein, 4 aa, Entamoeba invadens
ISQP

SEQ ID NO: 2867149 - protein, 7 aa, Entamoeba invadens
ISQPKQN

SEQ ID NO: 2867150 - protein, 5 aa, Entamoeba invadens
ISQPN

SEQ ID NO: 2867151 - protein, 14 aa, Entamoeba invadens
ISQPNCYRVLDMFE

SEQ ID NO: 2867152 - protein, 14 aa, Entamoeba invadens
ISQPNCYRVLDVFE

SEQ ID NO: 2867153 - protein, 44 aa, Entamoeba invadens
ISQPQKDGQNSEKSIQNTPEVTRKLEKDRDEKISNAVNKNIQSG

SEQ ID NO: 2867154 - protein, 9 aa, Entamoeba invadens
ISQPQSPKL

SEQ ID NO: 2867155 - protein, 9 aa, Entamoeba invadens
ISQQEKKSF

SEQ ID NO: 2867156 - protein, 12 aa, Entamoeba invadens
ISQQNKQIEELE

SEQ ID NO: 2867157 - protein, 9 aa, Entamoeba invadens
ISQRVSSHS

SEQ ID NO: 2867158 - protein, 18 aa, Entamoeba invadens
ISQSKEKEQIYGGQNAEG

SEQ ID NO: 2867159 - protein, 17 aa, Entamoeba invadens
ISQSPTHSQQQTIPSTL

SEQ ID NO: 2867160 - protein, 13 aa, Entamoeba invadens
ISQTKTTSEGSSC

SEQ ID NO: 2867161 - protein, 21 aa, Entamoeba invadens
ISQTPEFKSQLEEEKTRLETR

SEQ ID NO: 2867162 - protein, 6 aa, Entamoeba invadens
ISREFS

SEQ ID NO: 2867163 - protein, 5 aa, Entamoeba invadens
ISREG

SEQ ID NO: 2867164 - protein, 9 aa, Entamoeba invadens
ISREGTDIT

SEQ ID NO: 2867165 - protein, 8 aa, Entamoeba invadens
ISRGETYK

SEQ ID NO: 2867166 - protein, 6 aa, Entamoeba invadens
ISRGKY

SEQ ID NO: 2867167 - protein, 4 aa, Entamoeba invadens
ISRK

SEQ ID NO: 2867168 - protein, 5 aa, Entamoeba invadens
ISRKG

SEQ ID NO: 2867169 - protein, 37 aa, Entamoeba invadens
ISRKGTDGDDDDPEFSDDEEEKNFRAKQKKQNNCAKK

SEQ ID NO: 2867170 - protein, 16 aa, Entamoeba invadens
ISRKRTSAEVSLENGA

SEQ ID NO: 2867171 - protein, 5 aa, Entamoeba invadens
ISRKS

SEQ ID NO: 2867172 - protein, 14 aa, Entamoeba invadens
ISRKTGLPMKPHKH

SEQ ID NO: 2867173 - protein, 5 aa, Entamoeba invadens
ISRSS

SEQ ID NO: 2867174 - protein, 15 aa, Entamoeba invadens
ISRTEEFEKPSFETT

SEQ ID NO: 2867175 - protein, 12 aa, Entamoeba invadens
ISRTMTQTTTDI

SEQ ID NO: 2867176 - protein, 9 aa, Entamoeba invadens
ISRTSQYAS

SEQ ID NO: 2867177 - protein, 8 aa, Entamoeba invadens
ISSAGTAF

SEQ ID NO: 2867178 - protein, 8 aa, Entamoeba invadens
ISSDDKKE

SEQ ID NO: 2867179 - protein, 60 aa, Entamoeba invadens
ISSEDINEIEEDQKLVENGTSVPPEKKSDPEKVGNVEPSQKIEKVEKPQKTKLKGLQSER

SEQ ID NO: 2867180 - protein, 8 aa, Entamoeba invadens
ISSEEEQE

SEQ ID NO: 2867181 - protein, 17 aa, Entamoeba invadens
ISSGGGERLVSASDDGT

SEQ ID NO: 2867182 - protein, 6 aa, Entamoeba invadens
ISSGMK

SEQ ID NO: 2867183 - protein, 8 aa, Entamoeba invadens
ISSGVKTI

SEQ ID NO: 2867184 - protein, 9 aa, Entamoeba invadens
ISSKDGRVD

SEQ ID NO: 2867185 - protein, 11 aa, Entamoeba invadens
ISSKDKTIKDL

SEQ ID NO: 2867186 - protein, 10 aa, Entamoeba invadens
ISSKGDPKFN

SEQ ID NO: 2867187 - protein, 10 aa, Entamoeba invadens
ISSKSDTTKN

SEQ ID NO: 2867188 - protein, 6 aa, Entamoeba invadens
ISSLKS

SEQ ID NO: 2867189 - protein, 6 aa, Entamoeba invadens
ISSLPY

SEQ ID NO: 2867190 - protein, 5 aa, Entamoeba invadens
ISSNA

SEQ ID NO: 2867191 - protein, 14 aa, Entamoeba invadens
ISSNASSSSSLTQS

SEQ ID NO: 2867192 - protein, 5 aa, Entamoeba invadens
ISSNG

SEQ ID NO: 2867193 - protein, 5 aa, Entamoeba invadens
ISSNK

SEQ ID NO: 2867194 - protein, 7 aa, Entamoeba invadens
ISSNSDL

SEQ ID NO: 2867195 - protein, 7 aa, Entamoeba invadens
ISSNVKS

SEQ ID NO: 2867196 - protein, 9 aa, Entamoeba invadens
ISSNVTSLG

SEQ ID NO: 2867197 - protein, 8 aa, Entamoeba invadens
ISSPEKNT

SEQ ID NO: 2867198 - protein, 10 aa, Entamoeba invadens
ISSPKQEPKK

SEQ ID NO: 2867199 - protein, 7 aa, Entamoeba invadens
ISSPKQL

SEQ ID NO: 2867200 - protein, 28 aa, Entamoeba invadens
ISSPLSPTIGSPELSPLKKHEKIKKDMK

SEQ ID NO: 2867201 - protein, 8 aa, Entamoeba invadens
ISSPTTRI

SEQ ID NO: 2867202 - protein, 9 aa, Entamoeba invadens
ISSQATQQF

SEQ ID NO: 2867203 - protein, 11 aa, Entamoeba invadens
ISSQEGVGTTT

SEQ ID NO: 2867204 - protein, 11 aa, Entamoeba invadens
ISSQLKKEDPE

SEQ ID NO: 2867205 - protein, 17 aa, Entamoeba invadens
ISSQNELKKSDKEKTEL

SEQ ID NO: 2867206 - protein, 11 aa, Entamoeba invadens
ISSQQTDNNSL

SEQ ID NO: 2867207 - protein, 8 aa, Entamoeba invadens
ISSQSTSQ

SEQ ID NO: 2867208 - protein, 4 aa, Entamoeba invadens
ISSR

SEQ ID NO: 2867209 - protein, 7 aa, Entamoeba invadens
ISSRSDV

SEQ ID NO: 2867210 - protein, 4 aa, Entamoeba invadens
ISSS

SEQ ID NO: 2867211 - protein, 6 aa, Entamoeba invadens
ISSSAL

SEQ ID NO: 2867212 - protein, 8 aa, Entamoeba invadens
ISSSISKL

SEQ ID NO: 2867213 - protein, 18 aa, Entamoeba invadens
ISSSKAEYFKQKQSACNT

SEQ ID NO: 2867214 - protein, 5 aa, Entamoeba invadens
ISSSV

SEQ ID NO: 2867215 - protein, 18 aa, Entamoeba invadens
ISSSVEELPQPNPNPINQ

SEQ ID NO: 2867216 - protein, 4 aa, Entamoeba invadens
ISST

SEQ ID NO: 2867217 - protein, 7 aa, Entamoeba invadens
ISSTEEI

SEQ ID NO: 2867218 - protein, 5 aa, Entamoeba invadens
ISSTG

SEQ ID NO: 2867219 - protein, 5 aa, Entamoeba invadens
ISSTQ

SEQ ID NO: 2867220 - protein, 5 aa, Entamoeba invadens
ISSTT

SEQ ID NO: 2867221 - protein, 10 aa, Entamoeba invadens
ISSTTTLTEE

SEQ ID NO: 2867222 - protein, 4 aa, Entamoeba invadens
ISSV

SEQ ID NO: 2867223 - protein, 16 aa, Entamoeba invadens
ISSVENDFKATKTDWE

SEQ ID NO: 2867224 - protein, 11 aa, Entamoeba invadens
ISSVTENKDGF

SEQ ID NO: 2867225 - protein, 7 aa, Entamoeba invadens
ISTASER

SEQ ID NO: 2867226 - protein, 11 aa, Entamoeba invadens
ISTDDGGKMDH

SEQ ID NO: 2867227 - protein, 8 aa, Entamoeba invadens
ISTDEVRN

SEQ ID NO: 2867228 - protein, 10 aa, Entamoeba invadens
ISTDSSTYGD

SEQ ID NO: 2867229 - protein, 11 aa, Entamoeba invadens
ISTDTSRPLNP

SEQ ID NO: 2867230 - protein, 5 aa, Entamoeba invadens
ISTEE

SEQ ID NO: 2867231 - protein, 7 aa, Entamoeba invadens
ISTEKNI

SEQ ID NO: 2867232 - protein, 13 aa, Entamoeba invadens
ISTENKVQAGGHD

SEQ ID NO: 2867233 - protein, 8 aa, Entamoeba invadens
ISTENSSL

SEQ ID NO: 2867234 - protein, 17 aa, Entamoeba invadens
ISTEPSNEETASEVEKK

SEQ ID NO: 2867235 - protein, 5 aa, Entamoeba invadens
ISTET

SEQ ID NO: 2867236 - protein, 6 aa, Entamoeba invadens
ISTEVQ

SEQ ID NO: 2867237 - protein, 28 aa, Entamoeba invadens
ISTFKDEDVTDSDNKVSTHKTSCEQDKY

SEQ ID NO: 2867238 - protein, 9 aa, Entamoeba invadens
ISTGNKSAT

SEQ ID NO: 2867239 - protein, 4 aa, Entamoeba invadens
ISTI

SEQ ID NO: 2867240 - protein, 13 aa, Entamoeba invadens
ISTISQSLTSMKG

SEQ ID NO: 2867241 - protein, 8 aa, Entamoeba invadens
ISTITTSA

SEQ ID NO: 2867242 - protein, 9 aa, Entamoeba invadens
ISTKSGVEM

SEQ ID NO: 2867243 - protein, 5 aa, Entamoeba invadens
ISTKT

SEQ ID NO: 2867244 - protein, 16 aa, Entamoeba invadens
ISTKTDTNKYTIRTEP

SEQ ID NO: 2867245 - protein, 8 aa, Entamoeba invadens
ISTLSKNA

SEQ ID NO: 2867246 - protein, 12 aa, Entamoeba invadens
ISTNDARSSDEV

SEQ ID NO: 2867247 - protein, 9 aa, Entamoeba invadens
ISTNDTSKC

SEQ ID NO: 2867248 - protein, 13 aa, Entamoeba invadens
ISTNIRDNNDSSL

SEQ ID NO: 2867249 - protein, 10 aa, Entamoeba invadens
ISTNLQPSNS

SEQ ID NO: 2867250 - protein, 8 aa, Entamoeba invadens
ISTNNYEG

SEQ ID NO: 2867251 - protein, 11 aa, Entamoeba invadens
ISTNYSPNGCQ

SEQ ID NO: 2867252 - protein, 5 aa, Entamoeba invadens
ISTPD

SEQ ID NO: 2867253 - protein, 19 aa, Entamoeba invadens
ISTPTSGEVRISKDAQQYM

SEQ ID NO: 2867254 - protein, 28 aa, Entamoeba invadens
ISTQDKEDTLNNTLQDDPEYIKFLETLK

SEQ ID NO: 2867255 - protein, 7 aa, Entamoeba invadens
ISTQQSF

SEQ ID NO: 2867256 - protein, 9 aa, Entamoeba invadens
ISTQTATTK

SEQ ID NO: 2867257 - protein, 4 aa, Entamoeba invadens
ISTR

SEQ ID NO: 2867258 - protein, 10 aa, Entamoeba invadens
ISTRLDPDEL

SEQ ID NO: 2867259 - protein, 10 aa, Entamoeba invadens
ISTRLDPDSL

SEQ ID NO: 2867260 - protein, 5 aa, Entamoeba invadens
ISTSA

SEQ ID NO: 2867261 - protein, 11 aa, Entamoeba invadens
ISTSGKSESLF

SEQ ID NO: 2867262 - protein, 8 aa, Entamoeba invadens
ISTSQQKQ

SEQ ID NO: 2867263 - protein, 10 aa, Entamoeba invadens
ISTSTKHNNQ

SEQ ID NO: 2867264 - protein, 4 aa, Entamoeba invadens
ISTT

SEQ ID NO: 2867265 - protein, 5 aa, Entamoeba invadens
ISTTF

SEQ ID NO: 2867266 - protein, 6 aa, Entamoeba invadens
ISTTNK

SEQ ID NO: 2867267 - protein, 15 aa, Entamoeba invadens
ISTTPNELEKELQTP

SEQ ID NO: 2867268 - protein, 10 aa, Entamoeba invadens
ISTTQTPKPF

SEQ ID NO: 2867269 - protein, 4 aa, Entamoeba invadens
ISVP

SEQ ID NO: 2867270 - protein, 8 aa, Entamoeba invadens
ISVSPNDD

SEQ ID NO: 2867271 - protein, 15 aa, Entamoeba invadens
ISVTDNGKITGTGEQ

SEQ ID NO: 2867272 - protein, 15 aa, Entamoeba invadens
ISVTDNGTITGTGEQ

SEQ ID NO: 2867273 - protein, 12 aa, Entamoeba invadens
ISYDEDKRQKFE

SEQ ID NO: 2867274 - protein, 10 aa, Entamoeba invadens
ISYPQLPDAS

SEQ ID NO: 2867275 - protein, 6 aa, Entamoeba invadens
ISYPSG

SEQ ID NO: 2867276 - protein, 13 aa, Entamoeba invadens
ISYQTGLRSERRN

SEQ ID NO: 2867277 - protein, 4 aa, Entamoeba invadens
ISYT

SEQ ID NO: 2867278 - protein, 11 aa, Entamoeba invadens
ITAAPDGSVRV

SEQ ID NO: 2867279 - protein, 4 aa, Entamoeba invadens
ITAE

SEQ ID NO: 2867280 - protein, 18 aa, Entamoeba invadens
ITAEETRKNEIKNKSEAD

SEQ ID NO: 2867281 - protein, 7 aa, Entamoeba invadens
ITAEPKD

SEQ ID NO: 2867282 - protein, 12 aa, Entamoeba invadens
ITAEPKDDNVAD

SEQ ID NO: 2867283 - protein, 11 aa, Entamoeba invadens
ITAEPKDRNVA

SEQ ID NO: 2867284 - protein, 4 aa, Entamoeba invadens
ITAG

SEQ ID NO: 2867285 - protein, 18 aa, Entamoeba invadens
ITAGNKTQFDRASEDYEG

SEQ ID NO: 2867286 - protein, 5 aa, Entamoeba invadens
ITAKI

SEQ ID NO: 2867287 - protein, 9 aa, Entamoeba invadens
ITAKRSGFA

SEQ ID NO: 2867288 - protein, 20 aa, Entamoeba invadens
ITAKRSGFAGRYFERKPVIL

SEQ ID NO: 2867289 - protein, 5 aa, Entamoeba invadens
ITANE

SEQ ID NO: 2867290 - protein, 6 aa, Entamoeba invadens
ITANTD

SEQ ID NO: 2867291 - protein, 10 aa, Entamoeba invadens
ITAPQDKKSA

SEQ ID NO: 2867292 - protein, 7 aa, Entamoeba invadens
ITASNDK

SEQ ID NO: 2867293 - protein, 13 aa, Entamoeba invadens
ITASQSSESLAAS

SEQ ID NO: 2867294 - protein, 8 aa, Entamoeba invadens
ITASSSNA

SEQ ID NO: 2867295 - protein, 7 aa, Entamoeba invadens
ITDAQTN

SEQ ID NO: 2867296 - protein, 9 aa, Entamoeba invadens
ITDASDRNT

SEQ ID NO: 2867297 - protein, 4 aa, Entamoeba invadens
ITDD

SEQ ID NO: 2867298 - protein, 7 aa, Entamoeba invadens
ITDDASE

SEQ ID NO: 2867299 - protein, 12 aa, Entamoeba invadens
ITDDNSQYKEIT

SEQ ID NO: 2867300 - protein, 25 aa, Entamoeba invadens
ITDDSSETTQNNKDVFSQTADPKIE

SEQ ID NO: 2867301 - protein, 13 aa, Entamoeba invadens
ITDEDAKNIQEKM

SEQ ID NO: 2867302 - protein, 5 aa, Entamoeba invadens
ITDEE

SEQ ID NO: 2867303 - protein, 15 aa, Entamoeba invadens
ITDEEVDTEYSSDAD

SEQ ID NO: 2867304 - protein, 5 aa, Entamoeba invadens
ITDEK

SEQ ID NO: 2867305 - protein, 5 aa, Entamoeba invadens
ITDER

SEQ ID NO: 2867306 - protein, 14 aa, Entamoeba invadens
ITDETTNSGFDNEE

SEQ ID NO: 2867307 - protein, 67 aa, Entamoeba invadens
ITDGKEEITKSNEDIQNLQSEKNKIQEEMKEQVDKNNKLEKQIEDQKEQIKTLEDKVEKVENEKAKV

SEQ ID NO: 2867308 - protein, 7 aa, Entamoeba invadens
ITDGQHE

SEQ ID NO: 2867309 - protein, 17 aa, Entamoeba invadens
ITDKPENHGMDADQIED

SEQ ID NO: 2867310 - protein, 7 aa, Entamoeba invadens
ITDKSGD

SEQ ID NO: 2867311 - protein, 10 aa, Entamoeba invadens
ITDKTQEQYE

SEQ ID NO: 2867312 - protein, 4 aa, Entamoeba invadens
ITDN

SEQ ID NO: 2867313 - protein, 7 aa, Entamoeba invadens
ITDNDEE

SEQ ID NO: 2867314 - protein, 8 aa, Entamoeba invadens
ITDNEKTF

SEQ ID NO: 2867315 - protein, 5 aa, Entamoeba invadens
ITDPS

SEQ ID NO: 2867316 - protein, 31 aa, Entamoeba invadens
ITDPSSNAQSQSASLNTSDNLPIKPLSQEKM

SEQ ID NO: 2867317 - protein, 9 aa, Entamoeba invadens
ITDSDKELR

SEQ ID NO: 2867318 - protein, 16 aa, Entamoeba invadens
ITDSEDDAKEKLSNLS

SEQ ID NO: 2867319 - protein, 5 aa, Entamoeba invadens
ITDSN

SEQ ID NO: 2867320 - protein, 7 aa, Entamoeba invadens
ITDSNDG

SEQ ID NO: 2867321 - protein, 23 aa, Entamoeba invadens
ITDTTIKSTSGTTENGGKDKGEV

SEQ ID NO: 2867322 - protein, 5 aa, Entamoeba invadens
ITDVS

SEQ ID NO: 2867323 - protein, 10 aa, Entamoeba invadens
ITDVTERSNV

SEQ ID NO: 2867324 - protein, 14 aa, Entamoeba invadens
ITEAEYDDDVKNNK

SEQ ID NO: 2867325 - protein, 5 aa, Entamoeba invadens
ITEDA

SEQ ID NO: 2867326 - protein, 6 aa, Entamoeba invadens
ITEDEM

SEQ ID NO: 2867327 - protein, 6 aa, Entamoeba invadens
ITEEAK

SEQ ID NO: 2867328 - protein, 16 aa, Entamoeba invadens
ITEEERKEVMKGSFNY

SEQ ID NO: 2867329 - protein, 12 aa, Entamoeba invadens
ITEEKKKDATLY

SEQ ID NO: 2867330 - protein, 9 aa, Entamoeba invadens
ITEESTPSV

SEQ ID NO: 2867331 - protein, 11 aa, Entamoeba invadens
ITEETNEPMDD

SEQ ID NO: 2867332 - protein, 15 aa, Entamoeba invadens
ITEGERSEVKSEDLT

SEQ ID NO: 2867333 - protein, 4 aa, Entamoeba invadens
ITEI

SEQ ID NO: 2867334 - protein, 7 aa, Entamoeba invadens
ITEKENK

SEQ ID NO: 2867335 - protein, 7 aa, Entamoeba invadens
ITEKETE

SEQ ID NO: 2867336 - protein, 6 aa, Entamoeba invadens
ITEKTE

SEQ ID NO: 2867337 - protein, 12 aa, Entamoeba invadens
ITEKVDKKKSCC

SEQ ID NO: 2867338 - protein, 5 aa, Entamoeba invadens
ITELK

SEQ ID NO: 2867339 - protein, 5 aa, Entamoeba invadens
ITELS

SEQ ID NO: 2867340 - protein, 15 aa, Entamoeba invadens
ITENERTNSFQSASQ

SEQ ID NO: 2867341 - protein, 9 aa, Entamoeba invadens
ITENKKSSY

SEQ ID NO: 2867342 - protein, 13 aa, Entamoeba invadens
ITENKQKELEPGY

SEQ ID NO: 2867343 - protein, 13 aa, Entamoeba invadens
ITENNRFDRQTKK

SEQ ID NO: 2867344 - protein, 5 aa, Entamoeba invadens
ITENP

SEQ ID NO: 2867345 - protein, 12 aa, Entamoeba invadens
ITEPNDNLRSGI

SEQ ID NO: 2867346 - protein, 21 aa, Entamoeba invadens
ITEPQKSAPQSTVSTNNPITN

SEQ ID NO: 2867347 - protein, 6 aa, Entamoeba invadens
ITEQRY

SEQ ID NO: 2867348 - protein, 30 aa, Entamoeba invadens
ITEQTAPADQQEMPNQTEELSARNTEVGST

SEQ ID NO: 2867349 - protein, 14 aa, Entamoeba invadens
ITERKTKFENRRNE

SEQ ID NO: 2867350 - protein, 18 aa, Entamoeba invadens
ITERNNEAAQSQAQIAQS

SEQ ID NO: 2867351 - protein, 21 aa, Entamoeba invadens
ITERTETDDVENVQKTPQVAL

SEQ ID NO: 2867352 - protein, 17 aa, Entamoeba invadens
ITERYTKNVETNKQLSD

SEQ ID NO: 2867353 - protein, 6 aa, Entamoeba invadens
ITESAQ

SEQ ID NO: 2867354 - protein, 14 aa, Entamoeba invadens
ITESKPKRLNKDNN

SEQ ID NO: 2867355 - protein, 7 aa, Entamoeba invadens
ITESPQT

SEQ ID NO: 2867356 - protein, 15 aa, Entamoeba invadens
ITESTKVLQLIAKSF

SEQ ID NO: 2867357 - protein, 7 aa, Entamoeba invadens
ITETEKG

SEQ ID NO: 2867358 - protein, 12 aa, Entamoeba invadens
ITETQVSKKNLD

SEQ ID NO: 2867359 - protein, 29 aa, Entamoeba invadens
ITETSVDKTTKAMTPKSTQSPSMLSPRTK

SEQ ID NO: 2867360 - protein, 10 aa, Entamoeba invadens
ITEVKEGEDL

SEQ ID NO: 2867361 - protein, 4 aa, Entamoeba invadens
ITFK

SEQ ID NO: 2867362 - protein, 16 aa, Entamoeba invadens
ITFSDDNKRKARTLST

SEQ ID NO: 2867363 - protein, 5 aa, Entamoeba invadens
ITGCS

SEQ ID NO: 2867364 - protein, 11 aa, Entamoeba invadens
ITGEAEKTPCR

SEQ ID NO: 2867365 - protein, 12 aa, Entamoeba invadens
ITGENKMEITNN

SEQ ID NO: 2867366 - protein, 11 aa, Entamoeba invadens
ITGGGNAVMKG

SEQ ID NO: 2867367 - protein, 11 aa, Entamoeba invadens
ITGGKDEKLEA

SEQ ID NO: 2867368 - protein, 11 aa, Entamoeba invadens
ITGGSTKLEIK

SEQ ID NO: 2867369 - protein, 5 aa, Entamoeba invadens
ITGLT

SEQ ID NO: 2867370 - protein, 4 aa, Entamoeba invadens
ITGN

SEQ ID NO: 2867371 - protein, 5 aa, Entamoeba invadens
ITGNH

SEQ ID NO: 2867372 - protein, 15 aa, Entamoeba invadens
ITGNNPAPGFFKSLL

SEQ ID NO: 2867373 - protein, 8 aa, Entamoeba invadens
ITGNNSEE

SEQ ID NO: 2867374 - protein, 6 aa, Entamoeba invadens
ITGPHT

SEQ ID NO: 2867375 - protein, 18 aa, Entamoeba invadens
ITGRDNNGKEVDHGGDKV

SEQ ID NO: 2867376 - protein, 17 aa, Entamoeba invadens
ITGRDNNGKEVKHGGDA

SEQ ID NO: 2867377 - protein, 6 aa, Entamoeba invadens
ITGRPD

SEQ ID NO: 2867378 - protein, 11 aa, Entamoeba invadens
ITGSNNGEFTT

SEQ ID NO: 2867379 - protein, 37 aa, Entamoeba invadens
ITGSPEQSHIQRDEKSKGRPTNEKKVLPKPEWMNFEL

SEQ ID NO: 2867380 - protein, 8 aa, Entamoeba invadens
ITGSRNPL

SEQ ID NO: 2867381 - protein, 5 aa, Entamoeba invadens
ITGSS

SEQ ID NO: 2867382 - protein, 8 aa, Entamoeba invadens
ITGTANKV

SEQ ID NO: 2867383 - protein, 13 aa, Entamoeba invadens
ITGTEGQSNNFPG

SEQ ID NO: 2867384 - protein, 6 aa, Entamoeba invadens
ITGTHQ

SEQ ID NO: 2867385 - protein, 10 aa, Entamoeba invadens
ITHANTSAGV

SEQ ID NO: 2867386 - protein, 9 aa, Entamoeba invadens
ITHEEEQEI

SEQ ID NO: 2867387 - protein, 5 aa, Entamoeba invadens
ITHGD

SEQ ID NO: 2867388 - protein, 12 aa, Entamoeba invadens
ITIETGPLNHQE

SEQ ID NO: 2867389 - protein, 8 aa, Entamoeba invadens
ITIPPSVT

SEQ ID NO: 2867390 - protein, 10 aa, Entamoeba invadens
ITIPPSVTSI

SEQ ID NO: 2867391 - protein, 11 aa, Entamoeba invadens
ITIPSNVTSIG

SEQ ID NO: 2867392 - protein, 23 aa, Entamoeba invadens
ITIPSSVKSIGNQCFPSSTVVHR

SEQ ID NO: 2867393 - protein, 10 aa, Entamoeba invadens
ITIPSSVRSI

SEQ ID NO: 2867394 - protein, 12 aa, Entamoeba invadens
ITIPSSVTSIDN

SEQ ID NO: 2867395 - protein, 25 aa, Entamoeba invadens
ITITSGERYYETPKTDLNDSSDDGV

SEQ ID NO: 2867396 - protein, 5 aa, Entamoeba invadens
ITITT

SEQ ID NO: 2867397 - protein, 20 aa, Entamoeba invadens
ITKAENLSKTKDNSEEDLKT

SEQ ID NO: 2867398 - protein, 22 aa, Entamoeba invadens
ITKARTDSENNIDRAATKFQNA

SEQ ID NO: 2867399 - protein, 6 aa, Entamoeba invadens
ITKDES

SEQ ID NO: 2867400 - protein, 8 aa, Entamoeba invadens
ITKDGVEG

SEQ ID NO: 2867401 - protein, 8 aa, Entamoeba invadens
ITKDNGNC

SEQ ID NO: 2867402 - protein, 4 aa, Entamoeba invadens
ITKE

SEQ ID NO: 2867403 - protein, 6 aa, Entamoeba invadens
ITKEAD

SEQ ID NO: 2867404 - protein, 29 aa, Entamoeba invadens
ITKEESKETFSENEITPKRKETAKDSILA

SEQ ID NO: 2867405 - protein, 10 aa, Entamoeba invadens
ITKEGSGSYK

SEQ ID NO: 2867406 - protein, 11 aa, Entamoeba invadens
ITKEQKQETEV

SEQ ID NO: 2867407 - protein, 4 aa, Entamoeba invadens
ITKG

SEQ ID NO: 2867408 - protein, 10 aa, Entamoeba invadens
ITKGQLPEKF

SEQ ID NO: 2867409 - protein, 14 aa, Entamoeba invadens
ITKGTTTKLSELYC

SEQ ID NO: 2867410 - protein, 9 aa, Entamoeba invadens
ITKKADSWE

SEQ ID NO: 2867411 - protein, 6 aa, Entamoeba invadens
ITKKEN

SEQ ID NO: 2867412 - protein, 88 aa, Entamoeba invadens
ITKKTATKKKKDDDTSASTSQTTEEKKPRVKKEKSESKDTSETKEKTKRSRVKKEVKEESGTEDVAPKKTRKRATKAKKIDLEDEDDG

SEQ ID NO: 2867413 - protein, 4 aa, Entamoeba invadens
ITKN

SEQ ID NO: 2867414 - protein, 10 aa, Entamoeba invadens
ITKNAGKKLK

SEQ ID NO: 2867415 - protein, 9 aa, Entamoeba invadens
ITKNDSKLF

SEQ ID NO: 2867416 - protein, 12 aa, Entamoeba invadens
ITKNSDDPNPNI

SEQ ID NO: 2867417 - protein, 5 aa, Entamoeba invadens
ITKNT

SEQ ID NO: 2867418 - protein, 8 aa, Entamoeba invadens
ITKPEKEK

SEQ ID NO: 2867419 - protein, 20 aa, Entamoeba invadens
ITKQAETSGVFENEDQKREY

SEQ ID NO: 2867420 - protein, 8 aa, Entamoeba invadens
ITKSEGQI

SEQ ID NO: 2867421 - protein, 10 aa, Entamoeba invadens
ITKSKKKKSV

SEQ ID NO: 2867422 - protein, 5 aa, Entamoeba invadens
ITKSR

SEQ ID NO: 2867423 - protein, 9 aa, Entamoeba invadens
ITKSSPSLV

SEQ ID NO: 2867424 - protein, 14 aa, Entamoeba invadens
ITKTDSEKTEDNGT

SEQ ID NO: 2867425 - protein, 5 aa, Entamoeba invadens
ITKTQ

SEQ ID NO: 2867426 - protein, 25 aa, Entamoeba invadens
ITKTQNKKSEKTEKVTKPPKSLKER

SEQ ID NO: 2867427 - protein, 8 aa, Entamoeba invadens
ITKTQRNK

SEQ ID NO: 2867428 - protein, 7 aa, Entamoeba invadens
ITKTREE

SEQ ID NO: 2867429 - protein, 4 aa, Entamoeba invadens
ITKV

SEQ ID NO: 2867430 - protein, 9 aa, Entamoeba invadens
ITKYGSGAL

SEQ ID NO: 2867431 - protein, 15 aa, Entamoeba invadens
ITLARNDRTLRSFLD

SEQ ID NO: 2867432 - protein, 11 aa, Entamoeba invadens
ITLNGNPTTGY

SEQ ID NO: 2867433 - protein, 34 aa, Entamoeba invadens
ITLPEENNNKKMDEIEDESSSEPSEEESSSEENY

SEQ ID NO: 2867434 - protein, 5 aa, Entamoeba invadens
ITLPK

SEQ ID NO: 2867435 - protein, 19 aa, Entamoeba invadens
ITLTGNNEEFDVTKTQTGF

SEQ ID NO: 2867436 - protein, 16 aa, Entamoeba invadens
ITNAPQGDNSEQLENA

SEQ ID NO: 2867437 - protein, 8 aa, Entamoeba invadens
ITNDDEKL

SEQ ID NO: 2867438 - protein, 5 aa, Entamoeba invadens
ITNEA

SEQ ID NO: 2867439 - protein, 5 aa, Entamoeba invadens
ITNEE

SEQ ID NO: 2867440 - protein, 7 aa, Entamoeba invadens
ITNEENR

SEQ ID NO: 2867441 - protein, 7 aa, Entamoeba invadens
ITNEKSP

SEQ ID NO: 2867442 - protein, 8 aa, Entamoeba invadens
ITNGAEGN

SEQ ID NO: 2867443 - protein, 19 aa, Entamoeba invadens
ITNGGAEERRYTNENESVQ

SEQ ID NO: 2867444 - protein, 6 aa, Entamoeba invadens
ITNGTE

SEQ ID NO: 2867445 - protein, 5 aa, Entamoeba invadens
ITNIE

SEQ ID NO: 2867446 - protein, 37 aa, Entamoeba invadens
ITNKDKTKTPKPKSAFTKQKVETTNKKRTNGTKPKVA

SEQ ID NO: 2867447 - protein, 7 aa, Entamoeba invadens
ITNKRKS

SEQ ID NO: 2867448 - protein, 8 aa, Entamoeba invadens
ITNKTPQL

SEQ ID NO: 2867449 - protein, 8 aa, Entamoeba invadens
ITNKVTED

SEQ ID NO: 2867450 - protein, 19 aa, Entamoeba invadens
ITNNKSEEVPSKESSEEIV

SEQ ID NO: 2867451 - protein, 10 aa, Entamoeba invadens
ITNNPEDVPT

SEQ ID NO: 2867452 - protein, 16 aa, Entamoeba invadens
ITNNPENDGCVNAVLL

SEQ ID NO: 2867453 - protein, 6 aa, Entamoeba invadens
ITNNTV

SEQ ID NO: 2867454 - protein, 16 aa, Entamoeba invadens
ITNPKSYYTVETDSGG

SEQ ID NO: 2867455 - protein, 5 aa, Entamoeba invadens
ITNPN

SEQ ID NO: 2867456 - protein, 7 aa, Entamoeba invadens
ITNPNLP

SEQ ID NO: 2867457 - protein, 5 aa, Entamoeba invadens
ITNPQ

SEQ ID NO: 2867458 - protein, 10 aa, Entamoeba invadens
ITNPQTRSES

SEQ ID NO: 2867459 - protein, 9 aa, Entamoeba invadens
ITNQDLEEV

SEQ ID NO: 2867460 - protein, 9 aa, Entamoeba invadens
ITNQNGING

SEQ ID NO: 2867461 - protein, 4 aa, Entamoeba invadens
ITNS

SEQ ID NO: 2867462 - protein, 12 aa, Entamoeba invadens
ITNSKFKDGSAA

SEQ ID NO: 2867463 - protein, 5 aa, Entamoeba invadens
ITNSN

SEQ ID NO: 2867464 - protein, 8 aa, Entamoeba invadens
ITNSSGDV

SEQ ID NO: 2867465 - protein, 6 aa, Entamoeba invadens
ITNTKK

SEQ ID NO: 2867466 - protein, 5 aa, Entamoeba invadens
ITNTS

SEQ ID NO: 2867467 - protein, 10 aa, Entamoeba invadens
ITNTSNRTEP

SEQ ID NO: 2867468 - protein, 6 aa, Entamoeba invadens
ITNVGR

SEQ ID NO: 2867469 - protein, 10 aa, Entamoeba invadens
ITNVNGAPPA

SEQ ID NO: 2867470 - protein, 4 aa, Entamoeba invadens
ITNY

SEQ ID NO: 2867471 - protein, 7 aa, Entamoeba invadens
ITPANTI

SEQ ID NO: 2867472 - protein, 5 aa, Entamoeba invadens
ITPDG

SEQ ID NO: 2867473 - protein, 9 aa, Entamoeba invadens
ITPDTTSTI

SEQ ID NO: 2867474 - protein, 4 aa, Entamoeba invadens
ITPE

SEQ ID NO: 2867475 - protein, 5 aa, Entamoeba invadens
ITPEA

SEQ ID NO: 2867476 - protein, 9 aa, Entamoeba invadens
ITPEQKESW

SEQ ID NO: 2867477 - protein, 9 aa, Entamoeba invadens
ITPEQNNYR

SEQ ID NO: 2867478 - protein, 6 aa, Entamoeba invadens
ITPERL

SEQ ID NO: 2867479 - protein, 6 aa, Entamoeba invadens
ITPGTP

SEQ ID NO: 2867480 - protein, 4 aa, Entamoeba invadens
ITPH

SEQ ID NO: 2867481 - protein, 10 aa, Entamoeba invadens
ITPKPDTKSV

SEQ ID NO: 2867482 - protein, 7 aa, Entamoeba invadens
ITPKTTV

SEQ ID NO: 2867483 - protein, 5 aa, Entamoeba invadens
ITPLN

SEQ ID NO: 2867484 - protein, 5 aa, Entamoeba invadens
ITPLR

SEQ ID NO: 2867485 - protein, 8 aa, Entamoeba invadens
ITPNAHDN

SEQ ID NO: 2867486 - protein, 11 aa, Entamoeba invadens
ITPNNNGESNV

SEQ ID NO: 2867487 - protein, 14 aa, Entamoeba invadens
ITPPKRTPSITKDF

SEQ ID NO: 2867488 - protein, 5 aa, Entamoeba invadens
ITPPT

SEQ ID NO: 2867489 - protein, 5 aa, Entamoeba invadens
ITPPY

SEQ ID NO: 2867490 - protein, 26 aa, Entamoeba invadens
ITPQNEGNDVVDQKTKDLENKPLNEE

SEQ ID NO: 2867491 - protein, 12 aa, Entamoeba invadens
ITPQTSRSNHSL

SEQ ID NO: 2867492 - protein, 4 aa, Entamoeba invadens
ITPR

SEQ ID NO: 2867493 - protein, 8 aa, Entamoeba invadens
ITPRTNNE

SEQ ID NO: 2867494 - protein, 9 aa, Entamoeba invadens
ITPSAPQIP

SEQ ID NO: 2867495 - protein, 6 aa, Entamoeba invadens
ITPSDR

SEQ ID NO: 2867496 - protein, 26 aa, Entamoeba invadens
ITPSISNKKRVESKPFKCDDKTEQRF

SEQ ID NO: 2867497 - protein, 6 aa, Entamoeba invadens
ITPSSL

SEQ ID NO: 2867498 - protein, 5 aa, Entamoeba invadens
ITPTG

SEQ ID NO: 2867499 - protein, 8 aa, Entamoeba invadens
ITPTPPLS

SEQ ID NO: 2867500 - protein, 6 aa, Entamoeba invadens
ITPTTS

SEQ ID NO: 2867501 - protein, 5 aa, Entamoeba invadens
ITPVE

SEQ ID NO: 2867502 - protein, 9 aa, Entamoeba invadens
ITPYSSNPF

SEQ ID NO: 2867503 - protein, 10 aa, Entamoeba invadens
ITQAGESRRV

SEQ ID NO: 2867504 - protein, 20 aa, Entamoeba invadens
ITQARTDSENNIDRAATKFQ

SEQ ID NO: 2867505 - protein, 11 aa, Entamoeba invadens
ITQDELDSKQI

SEQ ID NO: 2867506 - protein, 10 aa, Entamoeba invadens
ITQDGKKDNT

SEQ ID NO: 2867507 - protein, 18 aa, Entamoeba invadens
ITQDGTPDTRDFVDELDP

SEQ ID NO: 2867508 - protein, 4 aa, Entamoeba invadens
ITQE

SEQ ID NO: 2867509 - protein, 30 aa, Entamoeba invadens
ITQEQASKDKESTNGKIKGPKKPVIPRRKV

SEQ ID NO: 2867510 - protein, 7 aa, Entamoeba invadens
ITQGITS

SEQ ID NO: 2867511 - protein, 5 aa, Entamoeba invadens
ITQID

SEQ ID NO: 2867512 - protein, 18 aa, Entamoeba invadens
ITQITNEKNKLEKNNSEL

SEQ ID NO: 2867513 - protein, 7 aa, Entamoeba invadens
ITQKGQK

SEQ ID NO: 2867514 - protein, 4 aa, Entamoeba invadens
ITQM

SEQ ID NO: 2867515 - protein, 5 aa, Entamoeba invadens
ITQPE

SEQ ID NO: 2867516 - protein, 5 aa, Entamoeba invadens
ITQQE

SEQ ID NO: 2867517 - protein, 6 aa, Entamoeba invadens
ITQQNK

SEQ ID NO: 2867518 - protein, 5 aa, Entamoeba invadens
ITQRG

SEQ ID NO: 2867519 - protein, 11 aa, Entamoeba invadens
ITQRHAKNQWA

SEQ ID NO: 2867520 - protein, 11 aa, Entamoeba invadens
ITQRTEAFDAR

SEQ ID NO: 2867521 - protein, 6 aa, Entamoeba invadens
ITQSNI

SEQ ID NO: 2867522 - protein, 5 aa, Entamoeba invadens
ITQSR

SEQ ID NO: 2867523 - protein, 19 aa, Entamoeba invadens
ITQSSRSYCTPQHPFNVLS

SEQ ID NO: 2867524 - protein, 26 aa, Entamoeba invadens
ITQSVSKKSLESQTQIKNDKSPVTVG

SEQ ID NO: 2867525 - protein, 31 aa, Entamoeba invadens
ITQTPTKPTTQQQSEKQKEVQNPPVNTSNPF

SEQ ID NO: 2867526 - protein, 33 aa, Entamoeba invadens
ITQTQREQPISPKPTKQQKDKAKPKKSKKQIAP

SEQ ID NO: 2867527 - protein, 5 aa, Entamoeba invadens
ITQTR

SEQ ID NO: 2867528 - protein, 12 aa, Entamoeba invadens
ITRDDNAQVKEK

SEQ ID NO: 2867529 - protein, 8 aa, Entamoeba invadens
ITRDPQKL

SEQ ID NO: 2867530 - protein, 6 aa, Entamoeba invadens
ITRIPK

SEQ ID NO: 2867531 - protein, 5 aa, Entamoeba invadens
ITRIT

SEQ ID NO: 2867532 - protein, 10 aa, Entamoeba invadens
ITRKENSIYP

SEQ ID NO: 2867533 - protein, 14 aa, Entamoeba invadens
ITRKSELKPTGLDK

SEQ ID NO: 2867534 - protein, 10 aa, Entamoeba invadens
ITRKSKNPNK

SEQ ID NO: 2867535 - protein, 4 aa, Entamoeba invadens
ITRN

SEQ ID NO: 2867536 - protein, 5 aa, Entamoeba invadens
ITRNG

SEQ ID NO: 2867537 - protein, 40 aa, Entamoeba invadens
ITRPESVQRSGTISVTSPACSEGRGSPKPFEVKSPRKKDF

SEQ ID NO: 2867538 - protein, 5 aa, Entamoeba invadens
ITRPN

SEQ ID NO: 2867539 - protein, 12 aa, Entamoeba invadens
ITRPTKKSVLTQ

SEQ ID NO: 2867540 - protein, 10 aa, Entamoeba invadens
ITRQSEETNK

SEQ ID NO: 2867541 - protein, 16 aa, Entamoeba invadens
ITRSVERKGDTNTIKE

SEQ ID NO: 2867542 - protein, 19 aa, Entamoeba invadens
ITRTPQSAQISNDKSLERL

SEQ ID NO: 2867543 - protein, 10 aa, Entamoeba invadens
ITRTRGNTFP

SEQ ID NO: 2867544 - protein, 7 aa, Entamoeba invadens
ITSAEGK

SEQ ID NO: 2867545 - protein, 10 aa, Entamoeba invadens
ITSDEEKSVI

SEQ ID NO: 2867546 - protein, 7 aa, Entamoeba invadens
ITSDEGI

SEQ ID NO: 2867547 - protein, 8 aa, Entamoeba invadens
ITSEPPTV

SEQ ID NO: 2867548 - protein, 9 aa, Entamoeba invadens
ITSGDSGFT

SEQ ID NO: 2867549 - protein, 4 aa, Entamoeba invadens
ITSI

SEQ ID NO: 2867550 - protein, 19 aa, Entamoeba invadens
ITSKNNFNYDYKSKQDCVL

SEQ ID NO: 2867551 - protein, 5 aa, Entamoeba invadens
ITSKT

SEQ ID NO: 2867552 - protein, 4 aa, Entamoeba invadens
ITSL

SEQ ID NO: 2867553 - protein, 15 aa, Entamoeba invadens
ITSLEQKKDATAAEQ

SEQ ID NO: 2867554 - protein, 5 aa, Entamoeba invadens
ITSNE

SEQ ID NO: 2867555 - protein, 10 aa, Entamoeba invadens
ITSNNENETA

SEQ ID NO: 2867556 - protein, 5 aa, Entamoeba invadens
ITSNT

SEQ ID NO: 2867557 - protein, 6 aa, Entamoeba invadens
ITSNVK

SEQ ID NO: 2867558 - protein, 16 aa, Entamoeba invadens
ITSPPTPAHNDGKDNI

SEQ ID NO: 2867559 - protein, 5 aa, Entamoeba invadens
ITSPR

SEQ ID NO: 2867560 - protein, 5 aa, Entamoeba invadens
ITSQE

SEQ ID NO: 2867561 - protein, 5 aa, Entamoeba invadens
ITSQL

SEQ ID NO: 2867562 - protein, 10 aa, Entamoeba invadens
ITSQNDTVRV

SEQ ID NO: 2867563 - protein, 19 aa, Entamoeba invadens
ITSQQQISDKQQTQELKQC

SEQ ID NO: 2867564 - protein, 10 aa, Entamoeba invadens
ITSQSQPLSK

SEQ ID NO: 2867565 - protein, 7 aa, Entamoeba invadens
ITSRKSG

SEQ ID NO: 2867566 - protein, 14 aa, Entamoeba invadens
ITSRPMQKTTEVHD

SEQ ID NO: 2867567 - protein, 11 aa, Entamoeba invadens
ITSSDIKQQNI

SEQ ID NO: 2867568 - protein, 7 aa, Entamoeba invadens
ITSSSPI

SEQ ID NO: 2867569 - protein, 13 aa, Entamoeba invadens
ITSSTELQSNKNK

SEQ ID NO: 2867570 - protein, 4 aa, Entamoeba invadens
ITST

SEQ ID NO: 2867571 - protein, 24 aa, Entamoeba invadens
ITSTETNKEQNKEHLKNSKDVTKN

SEQ ID NO: 2867572 - protein, 34 aa, Entamoeba invadens
ITSTPRSNSSGVGSSPPETGDSPRDPRSSLSRKK

SEQ ID NO: 2867573 - protein, 13 aa, Entamoeba invadens
ITSTPSKEKEDYL

SEQ ID NO: 2867574 - protein, 17 aa, Entamoeba invadens
ITSTSNKRINAAHDEAN

SEQ ID NO: 2867575 - protein, 4 aa, Entamoeba invadens
ITTA

SEQ ID NO: 2867576 - protein, 9 aa, Entamoeba invadens
ITTARSGKV

SEQ ID NO: 2867577 - protein, 9 aa, Entamoeba invadens
ITTDGVSGV

SEQ ID NO: 2867578 - protein, 5 aa, Entamoeba invadens
ITTDQ

SEQ ID NO: 2867579 - protein, 7 aa, Entamoeba invadens
ITTEEGL

SEQ ID NO: 2867580 - protein, 5 aa, Entamoeba invadens
ITTEY

SEQ ID NO: 2867581 - protein, 4 aa, Entamoeba invadens
ITTF

SEQ ID NO: 2867582 - protein, 16 aa, Entamoeba invadens
ITTGEGDEICSQTGAE

SEQ ID NO: 2867583 - protein, 11 aa, Entamoeba invadens
ITTKATEDSTV

SEQ ID NO: 2867584 - protein, 16 aa, Entamoeba invadens
ITTKGKCDKYTIRTEP

SEQ ID NO: 2867585 - protein, 11 aa, Entamoeba invadens
ITTKKEEPQII

SEQ ID NO: 2867586 - protein, 7 aa, Entamoeba invadens
ITTKNDG

SEQ ID NO: 2867587 - protein, 10 aa, Entamoeba invadens
ITTKVDDEHS

SEQ ID NO: 2867588 - protein, 13 aa, Entamoeba invadens
ITTMTENKYDEQY

SEQ ID NO: 2867589 - protein, 4 aa, Entamoeba invadens
ITTN

SEQ ID NO: 2867590 - protein, 5 aa, Entamoeba invadens
ITTPP

SEQ ID NO: 2867591 - protein, 10 aa, Entamoeba invadens
ITTPQQPVSN

SEQ ID NO: 2867592 - protein, 5 aa, Entamoeba invadens
ITTPR

SEQ ID NO: 2867593 - protein, 39 aa, Entamoeba invadens
ITTPRHGKKDSAENKEKVGKTEKVEKDTIRNNKSKFTLP

SEQ ID NO: 2867594 - protein, 18 aa, Entamoeba invadens
ITTPSTPVKNNNKDNENN

SEQ ID NO: 2867595 - protein, 6 aa, Entamoeba invadens
ITTPTQ

SEQ ID NO: 2867596 - protein, 10 aa, Entamoeba invadens
ITTQENSDVA

SEQ ID NO: 2867597 - protein, 5 aa, Entamoeba invadens
ITTRD

SEQ ID NO: 2867598 - protein, 6 aa, Entamoeba invadens
ITTRQA

SEQ ID NO: 2867599 - protein, 6 aa, Entamoeba invadens
ITTSDP

SEQ ID NO: 2867600 - protein, 5 aa, Entamoeba invadens
ITTSL

SEQ ID NO: 2867601 - protein, 7 aa, Entamoeba invadens
ITTSPEY

SEQ ID NO: 2867602 - protein, 13 aa, Entamoeba invadens
ITTSSKKKTYSFD

SEQ ID NO: 2867603 - protein, 6 aa, Entamoeba invadens
ITTSTN

SEQ ID NO: 2867604 - protein, 4 aa, Entamoeba invadens
ITTT

SEQ ID NO: 2867605 - protein, 9 aa, Entamoeba invadens
ITTTNNTTI

SEQ ID NO: 2867606 - protein, 6 aa, Entamoeba invadens
ITTTQY

SEQ ID NO: 2867607 - protein, 32 aa, Entamoeba invadens
ITTTSTKQVTKTAIKKTSADARIKAKLRRNNN

SEQ ID NO: 2867608 - protein, 5 aa, Entamoeba invadens
ITTTY

SEQ ID NO: 2867609 - protein, 8 aa, Entamoeba invadens
ITTVPSKI

SEQ ID NO: 2867610 - protein, 5 aa, Entamoeba invadens
ITTYT

SEQ ID NO: 2867611 - protein, 4 aa, Entamoeba invadens
ITVD

SEQ ID NO: 2867612 - protein, 7 aa, Entamoeba invadens
ITVDTKT

SEQ ID NO: 2867613 - protein, 9 aa, Entamoeba invadens
ITVPSNVTK

SEQ ID NO: 2867614 - protein, 8 aa, Entamoeba invadens
ITVSSGQK

SEQ ID NO: 2867615 - protein, 9 aa, Entamoeba invadens
ITYGPGDGI

SEQ ID NO: 2867616 - protein, 14 aa, Entamoeba invadens
ITYQQDTEVNATST

SEQ ID NO: 2867617 - protein, 12 aa, Entamoeba invadens
IVDDPKDISMGG

SEQ ID NO: 2867618 - protein, 17 aa, Entamoeba invadens
IVDEEKNLQNLKNQKRD

SEQ ID NO: 2867619 - protein, 14 aa, Entamoeba invadens
IVDNTEPVSGSADF

SEQ ID NO: 2867620 - protein, 11 aa, Entamoeba invadens
IVEDEEEAPSF

SEQ ID NO: 2867621 - protein, 8 aa, Entamoeba invadens
IVEGTGSI

SEQ ID NO: 2867622 - protein, 6 aa, Entamoeba invadens
IVEPNE

SEQ ID NO: 2867623 - protein, 46 aa, Entamoeba invadens
IVEPQKDEKLQVEKHEEKMEVKKEEKSPVTPPKKKSTKKTKKEKNF

SEQ ID NO: 2867624 - protein, 24 aa, Entamoeba invadens
IVEQEDANEKMSEDDDEYNEEDAK

SEQ ID NO: 2867625 - protein, 23 aa, Entamoeba invadens
IVEQTQKMEEVPTNPEIKPDLPT

SEQ ID NO: 2867626 - protein, 4 aa, Entamoeba invadens
IVGK

SEQ ID NO: 2867627 - protein, 9 aa, Entamoeba invadens
IVGQPNKSV

SEQ ID NO: 2867628 - protein, 11 aa, Entamoeba invadens
IVGTSENEISQ

SEQ ID NO: 2867629 - protein, 11 aa, Entamoeba invadens
IVKPKRSQKVW

SEQ ID NO: 2867630 - protein, 12 aa, Entamoeba invadens
IVKSEKEKKDYI

SEQ ID NO: 2867631 - protein, 4 aa, Entamoeba invadens
IVNP

SEQ ID NO: 2867632 - protein, 6 aa, Entamoeba invadens
IVNPDD

SEQ ID NO: 2867633 - protein, 5 aa, Entamoeba invadens
IVNSP

SEQ ID NO: 2867634 - protein, 6 aa, Entamoeba invadens
IVNSTK

SEQ ID NO: 2867635 - protein, 9 aa, Entamoeba invadens
IVNTTSNDI

SEQ ID NO: 2867636 - protein, 7 aa, Entamoeba invadens
IVPDSAS

SEQ ID NO: 2867637 - protein, 22 aa, Entamoeba invadens
IVPQKKDDEDWGNDFATEGEDD

SEQ ID NO: 2867638 - protein, 4 aa, Entamoeba invadens
IVPT

SEQ ID NO: 2867639 - protein, 8 aa, Entamoeba invadens
IVQEQKTF

SEQ ID NO: 2867640 - protein, 5 aa, Entamoeba invadens
IVRED

SEQ ID NO: 2867641 - protein, 9 aa, Entamoeba invadens
IVSEQAGDR

SEQ ID NO: 2867642 - protein, 9 aa, Entamoeba invadens
IVSGNTGLA

SEQ ID NO: 2867643 - protein, 12 aa, Entamoeba invadens
IVSPPKSRWEEV

SEQ ID NO: 2867644 - protein, 5 aa, Entamoeba invadens
IVSSG

SEQ ID NO: 2867645 - protein, 8 aa, Entamoeba invadens
IVSTEKAN

SEQ ID NO: 2867646 - protein, 8 aa, Entamoeba invadens
IVTDDGQP

SEQ ID NO: 2867647 - protein, 14 aa, Entamoeba invadens
IVTTPDPLSNEHTT

SEQ ID NO: 2867648 - protein, 5 aa, Entamoeba invadens
IWSDT

SEQ ID NO: 2867649 - protein, 5 aa, Entamoeba invadens
IYDPN

SEQ ID NO: 2867650 - protein, 11 aa, Entamoeba invadens
IYDPQAQDLEV

SEQ ID NO: 2867651 - protein, 6 aa, Entamoeba invadens
IYDQNT

SEQ ID NO: 2867652 - protein, 8 aa, Entamoeba invadens
IYDSPNRI

SEQ ID NO: 2867653 - protein, 11 aa, Entamoeba invadens
IYEGERAFTER

SEQ ID NO: 2867654 - protein, 4 aa, Entamoeba invadens
IYEQ

SEQ ID NO: 2867655 - protein, 4 aa, Entamoeba invadens
IYGE

SEQ ID NO: 2867656 - protein, 6 aa, Entamoeba invadens
IYGGGE

SEQ ID NO: 2867657 - protein, 11 aa, Entamoeba invadens
IYGGTSSDEFT

SEQ ID NO: 2867658 - protein, 8 aa, Entamoeba invadens
IYKDNRTT

SEQ ID NO: 2867659 - protein, 26 aa, Entamoeba invadens
IYKPPTPSNIEDRQKEKLNEQPKEEN

SEQ ID NO: 2867660 - protein, 4 aa, Entamoeba invadens
IYKT

SEQ ID NO: 2867661 - protein, 5 aa, Entamoeba invadens
IYNSS

SEQ ID NO: 2867662 - protein, 4 aa, Entamoeba invadens
IYPH

SEQ ID NO: 2867663 - protein, 7 aa, Entamoeba invadens
IYPKNSD

SEQ ID NO: 2867664 - protein, 24 aa, Entamoeba invadens
IYPKQADALANPLDNPDLFVVNSE

SEQ ID NO: 2867665 - protein, 27 aa, Entamoeba invadens
IYPNKSGSSYLSTYQRTTCSSLSGEAT

SEQ ID NO: 2867666 - protein, 4 aa, Entamoeba invadens
IYPP

SEQ ID NO: 2867667 - protein, 21 aa, Entamoeba invadens
IYPSKSDFKRPNSVSYSHEKM

SEQ ID NO: 2867668 - protein, 11 aa, Entamoeba invadens
IYPTEDPYCED

SEQ ID NO: 2867669 - protein, 5 aa, Entamoeba invadens
IYQPE

SEQ ID NO: 2867670 - protein, 6 aa, Entamoeba invadens
IYQRSE

SEQ ID NO: 2867671 - protein, 7 aa, Entamoeba invadens
IYQRSEE

SEQ ID NO: 2867672 - protein, 8 aa, Entamoeba invadens
IYQSPSSV

SEQ ID NO: 2867673 - protein, 108 aa, Entamoeba invadens
IYRDRRDDYRDDRDSRRDERRDDRGYRRDDKDDYRRDDRDYRRDDRQSERRDDYRRDSRYDDRRDSRDSGRRDDYRRDTKYDDRRDDRDSHRDNDYRRDDKRDDRDRR

SEQ ID NO: 2867674 - protein, 4 aa, Entamoeba invadens
IYRG

SEQ ID NO: 2867675 - protein, 5 aa, Entamoeba invadens
IYSNN

SEQ ID NO: 2867676 - protein, 10 aa, Entamoeba invadens
IYSPEEKNES

SEQ ID NO: 2867677 - protein, 8 aa, Entamoeba invadens
IYSPSTNT

SEQ ID NO: 2867678 - protein, 8 aa, Entamoeba invadens
IYSSENGT

SEQ ID NO: 2867679 - protein, 6 aa, Entamoeba invadens
IYSSGQ

SEQ ID NO: 2867680 - protein, 11 aa, Entamoeba invadens
IYSSSNLSDPN

SEQ ID NO: 2867681 - protein, 11 aa, Entamoeba invadens
IYTNSKTSTYI

SEQ ID NO: 2867682 - protein, 4 aa, Entamoeba invadens
IYTQ

SEQ ID NO: 2867683 - protein, 11 aa, Entamoeba invadens
KAADPSKSYAA

SEQ ID NO: 2867684 - protein, 7 aa, Entamoeba invadens
KAAEDYE

SEQ ID NO: 2867685 - protein, 41 aa, Entamoeba invadens
KAAEKEEEEEEYEENEEEEDVEEEEEAEEDEEEEEEDSVDT

SEQ ID NO: 2867686 - protein, 23 aa, Entamoeba invadens
KAAEKERERVEAQKEEREQAIKE

SEQ ID NO: 2867687 - protein, 12 aa, Entamoeba invadens
KAAEKSEEKRIK

SEQ ID NO: 2867688 - protein, 7 aa, Entamoeba invadens
KAAERAV

SEQ ID NO: 2867689 - protein, 15 aa, Entamoeba invadens
KAAFEKAKEQAHRDA

SEQ ID NO: 2867690 - protein, 6 aa, Entamoeba invadens
KAAGKI

SEQ ID NO: 2867691 - protein, 19 aa, Entamoeba invadens
KAAKAEVENLKTRNKESDA

SEQ ID NO: 2867692 - protein, 7 aa, Entamoeba invadens
KAAKEGV

SEQ ID NO: 2867693 - protein, 17 aa, Entamoeba invadens
KAAKESSSKPLSLDNTK

SEQ ID NO: 2867694 - protein, 8 aa, Entamoeba invadens
KAAKIEAA

SEQ ID NO: 2867695 - protein, 7 aa, Entamoeba invadens
KAALGRA

SEQ ID NO: 2867696 - protein, 11 aa, Entamoeba invadens
KAAMSASDKKA

SEQ ID NO: 2867697 - protein, 17 aa, Entamoeba invadens
KAAMTQQNKTDRVTTER

SEQ ID NO: 2867698 - protein, 6 aa, Entamoeba invadens
KAANKT

SEQ ID NO: 2867699 - protein, 6 aa, Entamoeba invadens
KAAPNR

SEQ ID NO: 2867700 - protein, 6 aa, Entamoeba invadens
KAAPRI

SEQ ID NO: 2867701 - protein, 6 aa, Entamoeba invadens
KAAPTD

SEQ ID NO: 2867702 - protein, 7 aa, Entamoeba invadens
KAAQALN

SEQ ID NO: 2867703 - protein, 8 aa, Entamoeba invadens
KAAQDHNM

SEQ ID NO: 2867704 - protein, 12 aa, Entamoeba invadens
KAAQKHKDHILD

SEQ ID NO: 2867705 - protein, 6 aa, Entamoeba invadens
KAAQSE

SEQ ID NO: 2867706 - protein, 16 aa, Entamoeba invadens
KAARDAQSKEEYDEQK

SEQ ID NO: 2867707 - protein, 7 aa, Entamoeba invadens
KAARECR

SEQ ID NO: 2867708 - protein, 8 aa, Entamoeba invadens
KAARGEVT

SEQ ID NO: 2867709 - protein, 9 aa, Entamoeba invadens
KAASKTPNE

SEQ ID NO: 2867710 - protein, 14 aa, Entamoeba invadens
KAATEAEAVAEAAK

SEQ ID NO: 2867711 - protein, 8 aa, Entamoeba invadens
KAATENTD

SEQ ID NO: 2867712 - protein, 17 aa, Entamoeba invadens
KAATKQYKINKLHKQGA

SEQ ID NO: 2867713 - protein, 8 aa, Entamoeba invadens
KAATSYEN

SEQ ID NO: 2867714 - protein, 6 aa, Entamoeba invadens
KAATVT

SEQ ID NO: 2867715 - protein, 12 aa, Entamoeba invadens
KACEPPVNETLT

SEQ ID NO: 2867716 - protein, 10 aa, Entamoeba invadens
KACEPTVEKP

SEQ ID NO: 2867717 - protein, 8 aa, Entamoeba invadens
KACESKDD

SEQ ID NO: 2867718 - protein, 29 aa, Entamoeba invadens
KADALTEAELKRAEEDLRAKVDEQKYADG

SEQ ID NO: 2867719 - protein, 5 aa, Entamoeba invadens
KADAN

SEQ ID NO: 2867720 - protein, 8 aa, Entamoeba invadens
KADDAYAE

SEQ ID NO: 2867721 - protein, 29 aa, Entamoeba invadens
KADDEKLKKKRVERKDTKEESEKKGESLI

SEQ ID NO: 2867722 - protein, 18 aa, Entamoeba invadens
KADEDGNLVVDKDKQWFK

SEQ ID NO: 2867723 - protein, 9 aa, Entamoeba invadens
KADEDLKAA

SEQ ID NO: 2867724 - protein, 7 aa, Entamoeba invadens
KADEEEF

SEQ ID NO: 2867725 - protein, 4 aa, Entamoeba invadens
KADG

SEQ ID NO: 2867726 - protein, 36 aa, Entamoeba invadens
KADGKKKNLTKPPRLPPTHRPEQKAKPLTQPPIPSV

SEQ ID NO: 2867727 - protein, 19 aa, Entamoeba invadens
KADIEKDISKAKTKETMGK

SEQ ID NO: 2867728 - protein, 6 aa, Entamoeba invadens
KADIRD

SEQ ID NO: 2867729 - protein, 12 aa, Entamoeba invadens
KADKEDTTPITE

SEQ ID NO: 2867730 - protein, 11 aa, Entamoeba invadens
KADKPKPRQRF

SEQ ID NO: 2867731 - protein, 4 aa, Entamoeba invadens
KADL

SEQ ID NO: 2867732 - protein, 7 aa, Entamoeba invadens
KADLADA

SEQ ID NO: 2867733 - protein, 19 aa, Entamoeba invadens
KADLSQTREVDESTAKTFC

SEQ ID NO: 2867734 - protein, 4 aa, Entamoeba invadens
KADM

SEQ ID NO: 2867735 - protein, 8 aa, Entamoeba invadens
KADNDTHY

SEQ ID NO: 2867736 - protein, 9 aa, Entamoeba invadens
KADNPQEDL

SEQ ID NO: 2867737 - protein, 5 aa, Entamoeba invadens
KADNR

SEQ ID NO: 2867738 - protein, 11 aa, Entamoeba invadens
KADPKNKGRIS

SEQ ID NO: 2867739 - protein, 33 aa, Entamoeba invadens
KADPYAQTTEEKEAKTYKDKKANELKKRASNQF

SEQ ID NO: 2867740 - protein, 8 aa, Entamoeba invadens
KADQADET

SEQ ID NO: 2867741 - protein, 7 aa, Entamoeba invadens
KADQEGR

SEQ ID NO: 2867742 - protein, 8 aa, Entamoeba invadens
KADQKERK

SEQ ID NO: 2867743 - protein, 9 aa, Entamoeba invadens
KADQQDREI

SEQ ID NO: 2867744 - protein, 8 aa, Entamoeba invadens
KADSPGVD

SEQ ID NO: 2867745 - protein, 20 aa, Entamoeba invadens
KADSQTESDETIENEKNKNF

SEQ ID NO: 2867746 - protein, 11 aa, Entamoeba invadens
KADSSEKRKEA

SEQ ID NO: 2867747 - protein, 5 aa, Entamoeba invadens
KADTF

SEQ ID NO: 2867748 - protein, 11 aa, Entamoeba invadens
KADTPNPTVNK

SEQ ID NO: 2867749 - protein, 9 aa, Entamoeba invadens
KADTTSKYF

SEQ ID NO: 2867750 - protein, 5 aa, Entamoeba invadens
KADVD

SEQ ID NO: 2867751 - protein, 6 aa, Entamoeba invadens
KADYGK

SEQ ID NO: 2867752 - protein, 17 aa, Entamoeba invadens
KAEACHSTLRQKNRNDL

SEQ ID NO: 2867753 - protein, 5 aa, Entamoeba invadens
KAEAF

SEQ ID NO: 2867754 - protein, 12 aa, Entamoeba invadens
KAEAVKKADELG

SEQ ID NO: 2867755 - protein, 6 aa, Entamoeba invadens
KAEDDE

SEQ ID NO: 2867756 - protein, 7 aa, Entamoeba invadens
KAEDDVS

SEQ ID NO: 2867757 - protein, 15 aa, Entamoeba invadens
KAEDGSTPEKSNQKD

SEQ ID NO: 2867758 - protein, 8 aa, Entamoeba invadens
KAEDNKSH

SEQ ID NO: 2867759 - protein, 6 aa, Entamoeba invadens
KAEDRV

SEQ ID NO: 2867760 - protein, 7 aa, Entamoeba invadens
KAEDYAK

SEQ ID NO: 2867761 - protein, 8 aa, Entamoeba invadens
KAEELTAQ

SEQ ID NO: 2867762 - protein, 8 aa, Entamoeba invadens
KAEENARN

SEQ ID NO: 2867763 - protein, 6 aa, Entamoeba invadens
KAEERI

SEQ ID NO: 2867764 - protein, 10 aa, Entamoeba invadens
KAEERKSIQD

SEQ ID NO: 2867765 - protein, 6 aa, Entamoeba invadens
KAEEVI

SEQ ID NO: 2867766 - protein, 6 aa, Entamoeba invadens
KAEGAF

SEQ ID NO: 2867767 - protein, 8 aa, Entamoeba invadens
KAEGASFS

SEQ ID NO: 2867768 - protein, 7 aa, Entamoeba invadens
KAEGNSI

SEQ ID NO: 2867769 - protein, 8 aa, Entamoeba invadens
KAEGSDVS

SEQ ID NO: 2867770 - protein, 7 aa, Entamoeba invadens
KAEGTKC

SEQ ID NO: 2867771 - protein, 5 aa, Entamoeba invadens
KAEHM

SEQ ID NO: 2867772 - protein, 7 aa, Entamoeba invadens
KAEKAEL

SEQ ID NO: 2867773 - protein, 6 aa, Entamoeba invadens
KAEKDL

SEQ ID NO: 2867774 - protein, 10 aa, Entamoeba invadens
KAEKEDPENI

SEQ ID NO: 2867775 - protein, 8 aa, Entamoeba invadens
KAEKEKCD

SEQ ID NO: 2867776 - protein, 21 aa, Entamoeba invadens
KAEKENEEKKPRTDKEKEIAM

SEQ ID NO: 2867777 - protein, 20 aa, Entamoeba invadens
KAEKSRLEKIDEEKKPDIKR

SEQ ID NO: 2867778 - protein, 9 aa, Entamoeba invadens
KAEKTGKNN

SEQ ID NO: 2867779 - protein, 4 aa, Entamoeba invadens
KAEL

SEQ ID NO: 2867780 - protein, 6 aa, Entamoeba invadens
KAELDD

SEQ ID NO: 2867781 - protein, 13 aa, Entamoeba invadens
KAELNIKSKEDDL

SEQ ID NO: 2867782 - protein, 8 aa, Entamoeba invadens
KAELPPEI

SEQ ID NO: 2867783 - protein, 14 aa, Entamoeba invadens
KAENERKAAEAEHQ

SEQ ID NO: 2867784 - protein, 10 aa, Entamoeba invadens
KAENNEIKEK

SEQ ID NO: 2867785 - protein, 9 aa, Entamoeba invadens
KAENQNVTT

SEQ ID NO: 2867786 - protein, 8 aa, Entamoeba invadens
KAEQAVDE

SEQ ID NO: 2867787 - protein, 7 aa, Entamoeba invadens
KAEQEEL

SEQ ID NO: 2867788 - protein, 5 aa, Entamoeba invadens
KAEQG

SEQ ID NO: 2867789 - protein, 6 aa, Entamoeba invadens
KAEQKM

SEQ ID NO: 2867790 - protein, 7 aa, Entamoeba invadens
KAEQNNL

SEQ ID NO: 2867791 - protein, 24 aa, Entamoeba invadens
KAERHKNKKKGKKDSAKKVSTLED

SEQ ID NO: 2867792 - protein, 5 aa, Entamoeba invadens
KAESE

SEQ ID NO: 2867793 - protein, 12 aa, Entamoeba invadens
KAESEKGGDNKI

SEQ ID NO: 2867794 - protein, 10 aa, Entamoeba invadens
KAESKNFGRI

SEQ ID NO: 2867795 - protein, 7 aa, Entamoeba invadens
KAESNGV

SEQ ID NO: 2867796 - protein, 13 aa, Entamoeba invadens
KAESPKQDSEEAQ

SEQ ID NO: 2867797 - protein, 9 aa, Entamoeba invadens
KAESTEASL

SEQ ID NO: 2867798 - protein, 13 aa, Entamoeba invadens
KAESTGKASATTL

SEQ ID NO: 2867799 - protein, 9 aa, Entamoeba invadens
KAESVTQTK

SEQ ID NO: 2867800 - protein, 8 aa, Entamoeba invadens
KAEVKSEM

SEQ ID NO: 2867801 - protein, 20 aa, Entamoeba invadens
KAEYEEKGPSICRYNHVFMA

SEQ ID NO: 2867802 - protein, 8 aa, Entamoeba invadens
KAEYESNP

SEQ ID NO: 2867803 - protein, 10 aa, Entamoeba invadens
KAFADENRLN

SEQ ID NO: 2867804 - protein, 6 aa, Entamoeba invadens
KAFDPP

SEQ ID NO: 2867805 - protein, 6 aa, Entamoeba invadens
KAFDQQ

SEQ ID NO: 2867806 - protein, 4 aa, Entamoeba invadens
KAFE

SEQ ID NO: 2867807 - protein, 5 aa, Entamoeba invadens
KAFEK

SEQ ID NO: 2867808 - protein, 7 aa, Entamoeba invadens
KAFGDGP

SEQ ID NO: 2867809 - protein, 24 aa, Entamoeba invadens
KAFPATPTTTTSQGGLYGSGGLTG

SEQ ID NO: 2867810 - protein, 20 aa, Entamoeba invadens
KAFSDSSLQPKLKSKTKVSD

SEQ ID NO: 2867811 - protein, 9 aa, Entamoeba invadens
KAFSDTTSL

SEQ ID NO: 2867812 - protein, 7 aa, Entamoeba invadens
KAFTARS

SEQ ID NO: 2867813 - protein, 6 aa, Entamoeba invadens
KAGDER

SEQ ID NO: 2867814 - protein, 6 aa, Entamoeba invadens
KAGDYK

SEQ ID NO: 2867815 - protein, 4 aa, Entamoeba invadens
KAGE

SEQ ID NO: 2867816 - protein, 6 aa, Entamoeba invadens
KAGEAF

SEQ ID NO: 2867817 - protein, 13 aa, Entamoeba invadens
KAGEEDCAEMRSG

SEQ ID NO: 2867818 - protein, 8 aa, Entamoeba invadens
KAGEEHEQ

SEQ ID NO: 2867819 - protein, 6 aa, Entamoeba invadens
KAGEEL

SEQ ID NO: 2867820 - protein, 7 aa, Entamoeba invadens
KAGEGQI

SEQ ID NO: 2867821 - protein, 11 aa, Entamoeba invadens
KAGFGGDDAPI

SEQ ID NO: 2867822 - protein, 6 aa, Entamoeba invadens
KAGFYE

SEQ ID NO: 2867823 - protein, 6 aa, Entamoeba invadens
KAGGCG

SEQ ID NO: 2867824 - protein, 10 aa, Entamoeba invadens
KAGGSINSVG

SEQ ID NO: 2867825 - protein, 7 aa, Entamoeba invadens
KAGIKGD

SEQ ID NO: 2867826 - protein, 7 aa, Entamoeba invadens
KAGISGE

SEQ ID NO: 2867827 - protein, 6 aa, Entamoeba invadens
KAGISR

SEQ ID NO: 2867828 - protein, 4 aa, Entamoeba invadens
KAGK

SEQ ID NO: 2867829 - protein, 13 aa, Entamoeba invadens
KAGKDGNDTFPTS

SEQ ID NO: 2867830 - protein, 7 aa, Entamoeba invadens
KAGLESS

SEQ ID NO: 2867831 - protein, 6 aa, Entamoeba invadens
KAGLRP

SEQ ID NO: 2867832 - protein, 15 aa, Entamoeba invadens
KAGLSDNPFEGVNEK

SEQ ID NO: 2867833 - protein, 12 aa, Entamoeba invadens
KAGMGQRQSGAV

SEQ ID NO: 2867834 - protein, 6 aa, Entamoeba invadens
KAGNED

SEQ ID NO: 2867835 - protein, 16 aa, Entamoeba invadens
KAGPLDDSLNSKIRSG

SEQ ID NO: 2867836 - protein, 4 aa, Entamoeba invadens
KAGQ

SEQ ID NO: 2867837 - protein, 10 aa, Entamoeba invadens
KAGQTTENEM

SEQ ID NO: 2867838 - protein, 13 aa, Entamoeba invadens
KAGRPRKTEEKKN

SEQ ID NO: 2867839 - protein, 13 aa, Entamoeba invadens
KAGRSNNELDTTK

SEQ ID NO: 2867840 - protein, 5 aa, Entamoeba invadens
KAGSF

SEQ ID NO: 2867841 - protein, 7 aa, Entamoeba invadens
KAGSLKE

SEQ ID NO: 2867842 - protein, 8 aa, Entamoeba invadens
KAGTFPQD

SEQ ID NO: 2867843 - protein, 5 aa, Entamoeba invadens
KAGTN

SEQ ID NO: 2867844 - protein, 10 aa, Entamoeba invadens
KAGTNKDRRG

SEQ ID NO: 2867845 - protein, 7 aa, Entamoeba invadens
KAGVDAS

SEQ ID NO: 2867846 - protein, 4 aa, Entamoeba invadens
KAGY

SEQ ID NO: 2867847 - protein, 7 aa, Entamoeba invadens
KAGYTGK

SEQ ID NO: 2867848 - protein, 13 aa, Entamoeba invadens
KAGYYPQTNSPFT

SEQ ID NO: 2867849 - protein, 8 aa, Entamoeba invadens
KAHEDGDF

SEQ ID NO: 2867850 - protein, 8 aa, Entamoeba invadens
KAHETLPI

SEQ ID NO: 2867851 - protein, 6 aa, Entamoeba invadens
KAHGSD

SEQ ID NO: 2867852 - protein, 8 aa, Entamoeba invadens
KAHKNGVS

SEQ ID NO: 2867853 - protein, 6 aa, Entamoeba invadens
KAHNNS

SEQ ID NO: 2867854 - protein, 14 aa, Entamoeba invadens
KAHQNATDVKEMPD

SEQ ID NO: 2867855 - protein, 19 aa, Entamoeba invadens
KAHRPEKKEVKEKKQPTFL

SEQ ID NO: 2867856 - protein, 7 aa, Entamoeba invadens
KAIDPKK

SEQ ID NO: 2867857 - protein, 5 aa, Entamoeba invadens
KAIDR

SEQ ID NO: 2867858 - protein, 23 aa, Entamoeba invadens
KAIDSEKQIDTNEKTQNNDQSAE

SEQ ID NO: 2867859 - protein, 7 aa, Entamoeba invadens
KAIENGQ

SEQ ID NO: 2867860 - protein, 6 aa, Entamoeba invadens
KAIGTS

SEQ ID NO: 2867861 - protein, 8 aa, Entamoeba invadens
KAIKDAPY

SEQ ID NO: 2867862 - protein, 7 aa, Entamoeba invadens
KAIKREK

SEQ ID NO: 2867863 - protein, 36 aa, Entamoeba invadens
KAIKREKKRKTAVSDDSQMSEDSDYEEEENSEIAAR

SEQ ID NO: 2867864 - protein, 16 aa, Entamoeba invadens
KAINRPTKQQKINNPK

SEQ ID NO: 2867865 - protein, 4 aa, Entamoeba invadens
KAIP

SEQ ID NO: 2867866 - protein, 12 aa, Entamoeba invadens
KAIPSTDDQTDS

SEQ ID NO: 2867867 - protein, 14 aa, Entamoeba invadens
KAIPTQPLSDPQTF

SEQ ID NO: 2867868 - protein, 9 aa, Entamoeba invadens
KAIQDEDDL

SEQ ID NO: 2867869 - protein, 19 aa, Entamoeba invadens
KAIREKKGTRGTDKSSSIF

SEQ ID NO: 2867870 - protein, 8 aa, Entamoeba invadens
KAIRGDTS

SEQ ID NO: 2867871 - protein, 5 aa, Entamoeba invadens
KAISK

SEQ ID NO: 2867872 - protein, 13 aa, Entamoeba invadens
KAISNKESNLSSF

SEQ ID NO: 2867873 - protein, 22 aa, Entamoeba invadens
KAITKDSTSSMPGKKSRKQMTD

SEQ ID NO: 2867874 - protein, 11 aa, Entamoeba invadens
KAITSDDNSFV

SEQ ID NO: 2867875 - protein, 32 aa, Entamoeba invadens
KAIVDDRDLEKATEVELTKKKKTAAVKTTTVK

SEQ ID NO: 2867876 - protein, 8 aa, Entamoeba invadens
KAKCEKAR

SEQ ID NO: 2867877 - protein, 8 aa, Entamoeba invadens
KAKCKKAR

SEQ ID NO: 2867878 - protein, 8 aa, Entamoeba invadens
KAKDEDYS

SEQ ID NO: 2867879 - protein, 27 aa, Entamoeba invadens
KAKDKSKEVKDASKDKKGDTKDPKRRS

SEQ ID NO: 2867880 - protein, 10 aa, Entamoeba invadens
KAKDSGNTQL

SEQ ID NO: 2867881 - protein, 7 aa, Entamoeba invadens
KAKEAEM

SEQ ID NO: 2867882 - protein, 7 aa, Entamoeba invadens
KAKEALQ

SEQ ID NO: 2867883 - protein, 37 aa, Entamoeba invadens
KAKEDAEKKKAELEAQKQKDAADIKELPKDNNHVDDE

SEQ ID NO: 2867884 - protein, 25 aa, Entamoeba invadens
KAKEEAKKVGKKTDWTNGQKRAAGK

SEQ ID NO: 2867885 - protein, 7 aa, Entamoeba invadens
KAKEENI

SEQ ID NO: 2867886 - protein, 12 aa, Entamoeba invadens
KAKEENLSKEDL

SEQ ID NO: 2867887 - protein, 6 aa, Entamoeba invadens
KAKEMK

SEQ ID NO: 2867888 - protein, 6 aa, Entamoeba invadens
KAKERD

SEQ ID NO: 2867889 - protein, 8 aa, Entamoeba invadens
KAKESIKE

SEQ ID NO: 2867890 - protein, 14 aa, Entamoeba invadens
KAKETLKEKCPTEK

SEQ ID NO: 2867891 - protein, 4 aa, Entamoeba invadens
KAKG

SEQ ID NO: 2867892 - protein, 8 aa, Entamoeba invadens
KAKGNVQT

SEQ ID NO: 2867893 - protein, 6 aa, Entamoeba invadens
KAKGVG

SEQ ID NO: 2867894 - protein, 10 aa, Entamoeba invadens
KAKHPDDKTV

SEQ ID NO: 2867895 - protein, 17 aa, Entamoeba invadens
KAKKAKKSGKTPATTPA

SEQ ID NO: 2867896 - protein, 40 aa, Entamoeba invadens
KAKKDERKKRFRDKAYSQMGRSDGSSKLNDHKSGKSKGVF

SEQ ID NO: 2867897 - protein, 22 aa, Entamoeba invadens
KAKKDVKKEAVTDGKKKQGSLD

SEQ ID NO: 2867898 - protein, 10 aa, Entamoeba invadens
KAKKECYSLT

SEQ ID NO: 2867899 - protein, 31 aa, Entamoeba invadens
KAKKEMKLKKSDDSSDNNNDENSGDISDSFS

SEQ ID NO: 2867900 - protein, 40 aa, Entamoeba invadens
KAKKHQKDADKKCDKEVQKSDKMEEKRAEGDKEEKNVTNP

SEQ ID NO: 2867901 - protein, 7 aa, Entamoeba invadens
KAKKISV

SEQ ID NO: 2867902 - protein, 7 aa, Entamoeba invadens
KAKKPGF

SEQ ID NO: 2867903 - protein, 6 aa, Entamoeba invadens
KAKKQV

SEQ ID NO: 2867904 - protein, 25 aa, Entamoeba invadens
KAKLASKNEKFQKKQQAQAAAESGK

SEQ ID NO: 2867905 - protein, 28 aa, Entamoeba invadens
KAKLDKPSARGKFRTSSSKLTYSDNTKL

SEQ ID NO: 2867906 - protein, 4 aa, Entamoeba invadens
KAKN

SEQ ID NO: 2867907 - protein, 8 aa, Entamoeba invadens
KAKNDANS

SEQ ID NO: 2867908 - protein, 13 aa, Entamoeba invadens
KAKNEKQETEIQE

SEQ ID NO: 2867909 - protein, 6 aa, Entamoeba invadens
KAKPEM

SEQ ID NO: 2867910 - protein, 8 aa, Entamoeba invadens
KAKPEYKN

SEQ ID NO: 2867911 - protein, 8 aa, Entamoeba invadens
KAKPFEHH

SEQ ID NO: 2867912 - protein, 7 aa, Entamoeba invadens
KAKPNDK

SEQ ID NO: 2867913 - protein, 6 aa, Entamoeba invadens
KAKPTM

SEQ ID NO: 2867914 - protein, 16 aa, Entamoeba invadens
KAKQEKEREERREKNK

SEQ ID NO: 2867915 - protein, 15 aa, Entamoeba invadens
KAKQFEEKENERVAG

SEQ ID NO: 2867916 - protein, 6 aa, Entamoeba invadens
KAKQPS

SEQ ID NO: 2867917 - protein, 25 aa, Entamoeba invadens
KAKQTGKAEDMKEAEEKLEKLDSTC

SEQ ID NO: 2867918 - protein, 7 aa, Entamoeba invadens
KAKRCGF

SEQ ID NO: 2867919 - protein, 5 aa, Entamoeba invadens
KAKRE

SEQ ID NO: 2867920 - protein, 5 aa, Entamoeba invadens
KAKRY

SEQ ID NO: 2867921 - protein, 7 aa, Entamoeba invadens
KAKSFSK

SEQ ID NO: 2867922 - protein, 19 aa, Entamoeba invadens
KAKSLPKGFSEVNRTKNDI

SEQ ID NO: 2867923 - protein, 9 aa, Entamoeba invadens
KAKSPNTCK

SEQ ID NO: 2867924 - protein, 9 aa, Entamoeba invadens
KAKTENLKE

SEQ ID NO: 2867925 - protein, 19 aa, Entamoeba invadens
KAKTERAMNGEKTETPETE

SEQ ID NO: 2867926 - protein, 6 aa, Entamoeba invadens
KAKTQK

SEQ ID NO: 2867927 - protein, 7 aa, Entamoeba invadens
KAKTSEE

SEQ ID NO: 2867928 - protein, 44 aa, Entamoeba invadens
KAKTTLDHSMGSRSSLGKISPVPEMASSNTETSSSLPQSSYPPT

SEQ ID NO: 2867929 - protein, 8 aa, Entamoeba invadens
KAKVSGDY

SEQ ID NO: 2867930 - protein, 9 aa, Entamoeba invadens
KAKWEKDRK

SEQ ID NO: 2867931 - protein, 7 aa, Entamoeba invadens
KAKYEQA

SEQ ID NO: 2867932 - protein, 7 aa, Entamoeba invadens
KAKYGDV

SEQ ID NO: 2867933 - protein, 5 aa, Entamoeba invadens
KALAE

SEQ ID NO: 2867934 - protein, 6 aa, Entamoeba invadens
KALDDY

SEQ ID NO: 2867935 - protein, 12 aa, Entamoeba invadens
KALDKAKNNTFE

SEQ ID NO: 2867936 - protein, 16 aa, Entamoeba invadens
KALDKSNQNESEEVER

SEQ ID NO: 2867937 - protein, 16 aa, Entamoeba invadens
KALDNADSALKIDENN

SEQ ID NO: 2867938 - protein, 10 aa, Entamoeba invadens
KALEASTNGL

SEQ ID NO: 2867939 - protein, 7 aa, Entamoeba invadens
KALEDKD

SEQ ID NO: 2867940 - protein, 12 aa, Entamoeba invadens
KALEDSRKKREW

SEQ ID NO: 2867941 - protein, 8 aa, Entamoeba invadens
KALETRDE

SEQ ID NO: 2867942 - protein, 6 aa, Entamoeba invadens
KALGKR

SEQ ID NO: 2867943 - protein, 8 aa, Entamoeba invadens
KALHPPLS

SEQ ID NO: 2867944 - protein, 15 aa, Entamoeba invadens
KALKEYKKRDSIKAL

SEQ ID NO: 2867945 - protein, 11 aa, Entamoeba invadens
KALKKLNKKDL

SEQ ID NO: 2867946 - protein, 17 aa, Entamoeba invadens
KALKKQQKHDKKAARVA

SEQ ID NO: 2867947 - protein, 10 aa, Entamoeba invadens
KALKPKDSAV

SEQ ID NO: 2867948 - protein, 6 aa, Entamoeba invadens
KALNDE

SEQ ID NO: 2867949 - protein, 8 aa, Entamoeba invadens
KALNKDKK

SEQ ID NO: 2867950 - protein, 7 aa, Entamoeba invadens
KALNRPR

SEQ ID NO: 2867951 - protein, 4 aa, Entamoeba invadens
KALP

SEQ ID NO: 2867952 - protein, 16 aa, Entamoeba invadens
KALPEPENTENAKNEQ

SEQ ID NO: 2867953 - protein, 5 aa, Entamoeba invadens
KALPI

SEQ ID NO: 2867954 - protein, 9 aa, Entamoeba invadens
KALPKSLSK

SEQ ID NO: 2867955 - protein, 7 aa, Entamoeba invadens
KALPPKA

SEQ ID NO: 2867956 - protein, 8 aa, Entamoeba invadens
KALPSQSK

SEQ ID NO: 2867957 - protein, 25 aa, Entamoeba invadens
KALPTSEEKCEEKKSESVKKEESKL

SEQ ID NO: 2867958 - protein, 7 aa, Entamoeba invadens
KALPTSV

SEQ ID NO: 2867959 - protein, 11 aa, Entamoeba invadens
KALQSSEEEFD

SEQ ID NO: 2867960 - protein, 4 aa, Entamoeba invadens
KALR

SEQ ID NO: 2867961 - protein, 4 aa, Entamoeba invadens
KALS

SEQ ID NO: 2867962 - protein, 12 aa, Entamoeba invadens
KALSDKTRYLSQ

SEQ ID NO: 2867963 - protein, 7 aa, Entamoeba invadens
KALSPKA

SEQ ID NO: 2867964 - protein, 20 aa, Entamoeba invadens
KALSTGNWPQPGGKEARHGV

SEQ ID NO: 2867965 - protein, 6 aa, Entamoeba invadens
KALSTL

SEQ ID NO: 2867966 - protein, 11 aa, Entamoeba invadens
KALTDTIAKND

SEQ ID NO: 2867967 - protein, 6 aa, Entamoeba invadens
KALTES

SEQ ID NO: 2867968 - protein, 7 aa, Entamoeba invadens
KALTEYP

SEQ ID NO: 2867969 - protein, 9 aa, Entamoeba invadens
KALTSEQQK

SEQ ID NO: 2867970 - protein, 9 aa, Entamoeba invadens
KALTSQKDL

SEQ ID NO: 2867971 - protein, 12 aa, Entamoeba invadens
KALTTKLGDNEP

SEQ ID NO: 2867972 - protein, 6 aa, Entamoeba invadens
KAMEET

SEQ ID NO: 2867973 - protein, 12 aa, Entamoeba invadens
KAMEKGNDEKLS

SEQ ID NO: 2867974 - protein, 4 aa, Entamoeba invadens
KAMK

SEQ ID NO: 2867975 - protein, 6 aa, Entamoeba invadens
KAMKED

SEQ ID NO: 2867976 - protein, 11 aa, Entamoeba invadens
KAMKEERDGIE

SEQ ID NO: 2867977 - protein, 11 aa, Entamoeba invadens
KAMNQKGVKDV

SEQ ID NO: 2867978 - protein, 7 aa, Entamoeba invadens
KAMSTGV

SEQ ID NO: 2867979 - protein, 9 aa, Entamoeba invadens
KAMTGDPSL

SEQ ID NO: 2867980 - protein, 9 aa, Entamoeba invadens
KAMTKGEEL

SEQ ID NO: 2867981 - protein, 5 aa, Entamoeba invadens
KANAE

SEQ ID NO: 2867982 - protein, 6 aa, Entamoeba invadens
KANAKL

SEQ ID NO: 2867983 - protein, 5 aa, Entamoeba invadens
KANAM

SEQ ID NO: 2867984 - protein, 23 aa, Entamoeba invadens
KANASAGVPSDKTCGKCGKEIEG

SEQ ID NO: 2867985 - protein, 6 aa, Entamoeba invadens
KANCKD

SEQ ID NO: 2867986 - protein, 9 aa, Entamoeba invadens
KANDPINST

SEQ ID NO: 2867987 - protein, 6 aa, Entamoeba invadens
KANDTT

SEQ ID NO: 2867988 - protein, 138 aa, Entamoeba invadens
KANEDVEAAKKKEEQEKQEADKKKAEEEAAKKKEEEEAAAKKAEEERVEKEKAEIEKANKEAAEKEKKEAEEAKANEERIAKEKAEQEAKLEAERVEKERLEKEKLEQDRLAKEKEEAEKLEKERLEKEAAQKAEEER

SEQ ID NO: 2867989 - protein, 18 aa, Entamoeba invadens
KANEEATRALKTRNKMND

SEQ ID NO: 2867990 - protein, 7 aa, Entamoeba invadens
KANEGIE

SEQ ID NO: 2867991 - protein, 9 aa, Entamoeba invadens
KANESTKLL

SEQ ID NO: 2867992 - protein, 9 aa, Entamoeba invadens
KANESYKQQ

SEQ ID NO: 2867993 - protein, 20 aa, Entamoeba invadens
KANETQQKVTDKMETEEIDK

SEQ ID NO: 2867994 - protein, 12 aa, Entamoeba invadens
KANGDENCTDET

SEQ ID NO: 2867995 - protein, 7 aa, Entamoeba invadens
KANGEEM

SEQ ID NO: 2867996 - protein, 8 aa, Entamoeba invadens
KANGEMEE

SEQ ID NO: 2867997 - protein, 6 aa, Entamoeba invadens
KANGFD

SEQ ID NO: 2867998 - protein, 7 aa, Entamoeba invadens
KANGIET

SEQ ID NO: 2867999 - protein, 8 aa, Entamoeba invadens
KANGKAVA

SEQ ID NO: 2868000 - protein, 6 aa, Entamoeba invadens
KANGMH

SEQ ID NO: 2868001 - protein, 6 aa, Entamoeba invadens
KANGQC

SEQ ID NO: 2868002 - protein, 10 aa, Entamoeba invadens
KANGTDQLDV

SEQ ID NO: 2868003 - protein, 5 aa, Entamoeba invadens
KANGY

SEQ ID NO: 2868004 - protein, 4 aa, Entamoeba invadens
KANI

SEQ ID NO: 2868005 - protein, 7 aa, Entamoeba invadens
KANIPNK

SEQ ID NO: 2868006 - protein, 13 aa, Entamoeba invadens
KANIQTKNSKDKI

SEQ ID NO: 2868007 - protein, 7 aa, Entamoeba invadens
KANISEE

SEQ ID NO: 2868008 - protein, 4 aa, Entamoeba invadens
KANK

SEQ ID NO: 2868009 - protein, 7 aa, Entamoeba invadens
KANKCGE

SEQ ID NO: 2868010 - protein, 5 aa, Entamoeba invadens
KANKE

SEQ ID NO: 2868011 - protein, 6 aa, Entamoeba invadens
KANKPF

SEQ ID NO: 2868012 - protein, 6 aa, Entamoeba invadens
KANKQG

SEQ ID NO: 2868013 - protein, 13 aa, Entamoeba invadens
KANKSKPSVKSLK

SEQ ID NO: 2868014 - protein, 8 aa, Entamoeba invadens
KANKTTLN

SEQ ID NO: 2868015 - protein, 17 aa, Entamoeba invadens
KANNFTKPVAQQQPQQQ

SEQ ID NO: 2868016 - protein, 5 aa, Entamoeba invadens
KANNK

SEQ ID NO: 2868017 - protein, 6 aa, Entamoeba invadens
KANNRI

SEQ ID NO: 2868018 - protein, 8 aa, Entamoeba invadens
KANNTNRD

SEQ ID NO: 2868019 - protein, 7 aa, Entamoeba invadens
KANPDTL

SEQ ID NO: 2868020 - protein, 10 aa, Entamoeba invadens
KANPISATVG

SEQ ID NO: 2868021 - protein, 8 aa, Entamoeba invadens
KANPNLGQ

SEQ ID NO: 2868022 - protein, 12 aa, Entamoeba invadens
KANSGHPGVPTG

SEQ ID NO: 2868023 - protein, 7 aa, Entamoeba invadens
KANSNES

SEQ ID NO: 2868024 - protein, 6 aa, Entamoeba invadens
KANSQF

SEQ ID NO: 2868025 - protein, 10 aa, Entamoeba invadens
KANTCNTNNG

SEQ ID NO: 2868026 - protein, 9 aa, Entamoeba invadens
KANTESANN

SEQ ID NO: 2868027 - protein, 8 aa, Entamoeba invadens
KANTSDYK

SEQ ID NO: 2868028 - protein, 7 aa, Entamoeba invadens
KANVPDI

SEQ ID NO: 2868029 - protein, 6 aa, Entamoeba invadens
KANYDH

SEQ ID NO: 2868030 - protein, 8 aa, Entamoeba invadens
KANYPRRV

SEQ ID NO: 2868031 - protein, 8 aa, Entamoeba invadens
KAPACEGG

SEQ ID NO: 2868032 - protein, 14 aa, Entamoeba invadens
KAPAKTSEEENTAF

SEQ ID NO: 2868033 - protein, 4 aa, Entamoeba invadens
KAPD

SEQ ID NO: 2868034 - protein, 11 aa, Entamoeba invadens
KAPDGNLKRDD

SEQ ID NO: 2868035 - protein, 12 aa, Entamoeba invadens
KAPEDATFAEVE

SEQ ID NO: 2868036 - protein, 7 aa, Entamoeba invadens
KAPFDKQ

SEQ ID NO: 2868037 - protein, 6 aa, Entamoeba invadens
KAPFSF

SEQ ID NO: 2868038 - protein, 6 aa, Entamoeba invadens
KAPGHY

SEQ ID NO: 2868039 - protein, 7 aa, Entamoeba invadens
KAPGSTI

SEQ ID NO: 2868040 - protein, 6 aa, Entamoeba invadens
KAPITK

SEQ ID NO: 2868041 - protein, 10 aa, Entamoeba invadens
KAPKLGKKSI

SEQ ID NO: 2868042 - protein, 5 aa, Entamoeba invadens
KAPKN

SEQ ID NO: 2868043 - protein, 7 aa, Entamoeba invadens
KAPKSSV

SEQ ID NO: 2868044 - protein, 6 aa, Entamoeba invadens
KAPKTV

SEQ ID NO: 2868045 - protein, 9 aa, Entamoeba invadens
KAPKTVKTI

SEQ ID NO: 2868046 - protein, 25 aa, Entamoeba invadens
KAPLEKSSASKGVKRPGPKAKGGKK

SEQ ID NO: 2868047 - protein, 7 aa, Entamoeba invadens
KAPLESY

SEQ ID NO: 2868048 - protein, 13 aa, Entamoeba invadens
KAPLKRGRGYVPK

SEQ ID NO: 2868049 - protein, 13 aa, Entamoeba invadens
KAPPKEDNVDSTK

SEQ ID NO: 2868050 - protein, 9 aa, Entamoeba invadens
KAPPNPPEL

SEQ ID NO: 2868051 - protein, 9 aa, Entamoeba invadens
KAPPRHDEH

SEQ ID NO: 2868052 - protein, 8 aa, Entamoeba invadens
KAPQNKFT

SEQ ID NO: 2868053 - protein, 5 aa, Entamoeba invadens
KAPQT

SEQ ID NO: 2868054 - protein, 14 aa, Entamoeba invadens
KAPRKEEDGDVQTK

SEQ ID NO: 2868055 - protein, 7 aa, Entamoeba invadens
KAPRVNE

SEQ ID NO: 2868056 - protein, 7 aa, Entamoeba invadens
KAPRYFP

SEQ ID NO: 2868057 - protein, 8 aa, Entamoeba invadens
KAPSITSS

SEQ ID NO: 2868058 - protein, 6 aa, Entamoeba invadens
KAPSNY

SEQ ID NO: 2868059 - protein, 10 aa, Entamoeba invadens
KAPSSNFNNS

SEQ ID NO: 2868060 - protein, 7 aa, Entamoeba invadens
KAPTGVL

SEQ ID NO: 2868061 - protein, 30 aa, Entamoeba invadens
KAPTKGGLDLEGKKEAKKMLAEEDANQVFD

SEQ ID NO: 2868062 - protein, 17 aa, Entamoeba invadens
KAPTMDQELQSNSNIQR

SEQ ID NO: 2868063 - protein, 7 aa, Entamoeba invadens
KAPYSKC

SEQ ID NO: 2868064 - protein, 29 aa, Entamoeba invadens
KAQAEKNKYKEVTELTAGEYKTEVTEASK

SEQ ID NO: 2868065 - protein, 7 aa, Entamoeba invadens
KAQDGAK

SEQ ID NO: 2868066 - protein, 7 aa, Entamoeba invadens
KAQDGSS

SEQ ID NO: 2868067 - protein, 23 aa, Entamoeba invadens
KAQEEERKKAEQRKQEEERLAKE

SEQ ID NO: 2868068 - protein, 15 aa, Entamoeba invadens
KAQEEHKKEKEDTEI

SEQ ID NO: 2868069 - protein, 28 aa, Entamoeba invadens
KAQEGLNKESPSSLPNTIEQNDKKIIDQ

SEQ ID NO: 2868070 - protein, 7 aa, Entamoeba invadens
KAQEKGW

SEQ ID NO: 2868071 - protein, 5 aa, Entamoeba invadens
KAQEN

SEQ ID NO: 2868072 - protein, 12 aa, Entamoeba invadens
KAQENGVAPRKT

SEQ ID NO: 2868073 - protein, 28 aa, Entamoeba invadens
KAQERQENYDVEKDKNIKNDDDFNTKMT

SEQ ID NO: 2868074 - protein, 4 aa, Entamoeba invadens
KAQG

SEQ ID NO: 2868075 - protein, 8 aa, Entamoeba invadens
KAQKEQIE

SEQ ID NO: 2868076 - protein, 5 aa, Entamoeba invadens
KAQKG

SEQ ID NO: 2868077 - protein, 8 aa, Entamoeba invadens
KAQKKKRE

SEQ ID NO: 2868078 - protein, 9 aa, Entamoeba invadens
KAQKLERKR

SEQ ID NO: 2868079 - protein, 45 aa, Entamoeba invadens
KAQKQLDTAKDDKDGNEAMKQKYQDELKSVRTELDQEKKDHTKTQ

SEQ ID NO: 2868080 - protein, 28 aa, Entamoeba invadens
KAQKSDEKSPEKSDGKSEEKSEEKERKK

SEQ ID NO: 2868081 - protein, 7 aa, Entamoeba invadens
KAQKWMN

SEQ ID NO: 2868082 - protein, 6 aa, Entamoeba invadens
KAQLPE

SEQ ID NO: 2868083 - protein, 4 aa, Entamoeba invadens
KAQN

SEQ ID NO: 2868084 - protein, 6 aa, Entamoeba invadens
KAQNAL

SEQ ID NO: 2868085 - protein, 10 aa, Entamoeba invadens
KAQNTEEPTV

SEQ ID NO: 2868086 - protein, 8 aa, Entamoeba invadens
KAQPGEEI

SEQ ID NO: 2868087 - protein, 5 aa, Entamoeba invadens
KAQPI

SEQ ID NO: 2868088 - protein, 7 aa, Entamoeba invadens
KAQPYDE

SEQ ID NO: 2868089 - protein, 12 aa, Entamoeba invadens
KAQQSRKDSSHF

SEQ ID NO: 2868090 - protein, 5 aa, Entamoeba invadens
KAQQV

SEQ ID NO: 2868091 - protein, 7 aa, Entamoeba invadens
KAQRLSE

SEQ ID NO: 2868092 - protein, 17 aa, Entamoeba invadens
KAQRQNKQLTYKNTNIP

SEQ ID NO: 2868093 - protein, 11 aa, Entamoeba invadens
KAQSASAAKLN

SEQ ID NO: 2868094 - protein, 8 aa, Entamoeba invadens
KAQSASET

SEQ ID NO: 2868095 - protein, 22 aa, Entamoeba invadens
KAQSEKKNEDAKEKIKKPISPV

SEQ ID NO: 2868096 - protein, 15 aa, Entamoeba invadens
KAQSENTIVSSKNAN

SEQ ID NO: 2868097 - protein, 18 aa, Entamoeba invadens
KAQTARGREVSSYKTSVK

SEQ ID NO: 2868098 - protein, 30 aa, Entamoeba invadens
KAQTEEVPQQVEKKKRSKKSKLMKKLGCVV

SEQ ID NO: 2868099 - protein, 11 aa, Entamoeba invadens
KAQTENSTRLD

SEQ ID NO: 2868100 - protein, 5 aa, Entamoeba invadens
KAQTT

SEQ ID NO: 2868101 - protein, 12 aa, Entamoeba invadens
KAQVGEQAPTFK

SEQ ID NO: 2868102 - protein, 6 aa, Entamoeba invadens
KARAVS

SEQ ID NO: 2868103 - protein, 8 aa, Entamoeba invadens
KARDRGYS

SEQ ID NO: 2868104 - protein, 6 aa, Entamoeba invadens
KAREEK

SEQ ID NO: 2868105 - protein, 24 aa, Entamoeba invadens
KARENNPISTTLAPQKQEEQKESD

SEQ ID NO: 2868106 - protein, 25 aa, Entamoeba invadens
KARKEKKGVIKTRKNGIQKARDELK

SEQ ID NO: 2868107 - protein, 7 aa, Entamoeba invadens
KARKMDI

SEQ ID NO: 2868108 - protein, 7 aa, Entamoeba invadens
KARKQQI

SEQ ID NO: 2868109 - protein, 8 aa, Entamoeba invadens
KARMPPSQ

SEQ ID NO: 2868110 - protein, 9 aa, Entamoeba invadens
KARNEDDEY

SEQ ID NO: 2868111 - protein, 7 aa, Entamoeba invadens
KARNPEK

SEQ ID NO: 2868112 - protein, 18 aa, Entamoeba invadens
KARQQEVDKEHKKYVEGV

SEQ ID NO: 2868113 - protein, 9 aa, Entamoeba invadens
KARRPRLPR

SEQ ID NO: 2868114 - protein, 10 aa, Entamoeba invadens
KARSSITPQE

SEQ ID NO: 2868115 - protein, 9 aa, Entamoeba invadens
KARTGSGKT

SEQ ID NO: 2868116 - protein, 6 aa, Entamoeba invadens
KARTVK

SEQ ID NO: 2868117 - protein, 13 aa, Entamoeba invadens
KASAEENAKKVEM

SEQ ID NO: 2868118 - protein, 6 aa, Entamoeba invadens
KASAIG

SEQ ID NO: 2868119 - protein, 11 aa, Entamoeba invadens
KASALKSTFED

SEQ ID NO: 2868120 - protein, 9 aa, Entamoeba invadens
KASDDLKKS

SEQ ID NO: 2868121 - protein, 8 aa, Entamoeba invadens
KASDIATT

SEQ ID NO: 2868122 - protein, 6 aa, Entamoeba invadens
KASDTS

SEQ ID NO: 2868123 - protein, 7 aa, Entamoeba invadens
KASDTSV

SEQ ID NO: 2868124 - protein, 6 aa, Entamoeba invadens
KASDVQ

SEQ ID NO: 2868125 - protein, 8 aa, Entamoeba invadens
KASEAATN

SEQ ID NO: 2868126 - protein, 5 aa, Entamoeba invadens
KASEE

SEQ ID NO: 2868127 - protein, 13 aa, Entamoeba invadens
KASEEVKKKPVDS

SEQ ID NO: 2868128 - protein, 18 aa, Entamoeba invadens
KASEEVLRSESSKFDNTE

SEQ ID NO: 2868129 - protein, 16 aa, Entamoeba invadens
KASEGQKNTKKSEETE

SEQ ID NO: 2868130 - protein, 17 aa, Entamoeba invadens
KASEKRDKEKQVGKVNP

SEQ ID NO: 2868131 - protein, 7 aa, Entamoeba invadens
KASEYSN

SEQ ID NO: 2868132 - protein, 9 aa, Entamoeba invadens
KASGEERAV

SEQ ID NO: 2868133 - protein, 17 aa, Entamoeba invadens
KASGITKEEIKENPEAV

SEQ ID NO: 2868134 - protein, 19 aa, Entamoeba invadens
KASHQSDSNDAKESGNTQH

SEQ ID NO: 2868135 - protein, 7 aa, Entamoeba invadens
KASIEND

SEQ ID NO: 2868136 - protein, 16 aa, Entamoeba invadens
KASIERKECIAEREKP

SEQ ID NO: 2868137 - protein, 15 aa, Entamoeba invadens
KASIQGGKRFAQEGT

SEQ ID NO: 2868138 - protein, 9 aa, Entamoeba invadens
KASKANEVE

SEQ ID NO: 2868139 - protein, 10 aa, Entamoeba invadens
KASKDQQKDL

SEQ ID NO: 2868140 - protein, 5 aa, Entamoeba invadens
KASKH

SEQ ID NO: 2868141 - protein, 6 aa, Entamoeba invadens
KASKMS

SEQ ID NO: 2868142 - protein, 9 aa, Entamoeba invadens
KASKRNNEL

SEQ ID NO: 2868143 - protein, 7 aa, Entamoeba invadens
KASKRRW

SEQ ID NO: 2868144 - protein, 10 aa, Entamoeba invadens
KASKSVENDT

SEQ ID NO: 2868145 - protein, 19 aa, Entamoeba invadens
KASLALTSQGREILQQTTI

SEQ ID NO: 2868146 - protein, 8 aa, Entamoeba invadens
KASLDTGA

SEQ ID NO: 2868147 - protein, 30 aa, Entamoeba invadens
KASNDSNTKKMPSISKRIKDDHNAHKRGES

SEQ ID NO: 2868148 - protein, 17 aa, Entamoeba invadens
KASNSKCNKCTVNYKSS

SEQ ID NO: 2868149 - protein, 9 aa, Entamoeba invadens
KASNTPCNS

SEQ ID NO: 2868150 - protein, 12 aa, Entamoeba invadens
KASNTPNSNDKF

SEQ ID NO: 2868151 - protein, 11 aa, Entamoeba invadens
KASNYKSNKYS

SEQ ID NO: 2868152 - protein, 14 aa, Entamoeba invadens
KASPFDKETPVEVG

SEQ ID NO: 2868153 - protein, 6 aa, Entamoeba invadens
KASPRK

SEQ ID NO: 2868154 - protein, 12 aa, Entamoeba invadens
KASPSPLQTAKA

SEQ ID NO: 2868155 - protein, 10 aa, Entamoeba invadens
KASQERCTEA

SEQ ID NO: 2868156 - protein, 11 aa, Entamoeba invadens
KASQKKRNASV

SEQ ID NO: 2868157 - protein, 20 aa, Entamoeba invadens
KASQQQRPKTEKKKKEDTTK

SEQ ID NO: 2868158 - protein, 7 aa, Entamoeba invadens
KASRSLG

SEQ ID NO: 2868159 - protein, 10 aa, Entamoeba invadens
KASSAASAAK

SEQ ID NO: 2868160 - protein, 8 aa, Entamoeba invadens
KASSCEDS

SEQ ID NO: 2868161 - protein, 8 aa, Entamoeba invadens
KASSVTSI

SEQ ID NO: 2868162 - protein, 4 aa, Entamoeba invadens
KAST

SEQ ID NO: 2868163 - protein, 6 aa, Entamoeba invadens
KASTCA

SEQ ID NO: 2868164 - protein, 5 aa, Entamoeba invadens
KASTI

SEQ ID NO: 2868165 - protein, 9 aa, Entamoeba invadens
KASTTRGTL

SEQ ID NO: 2868166 - protein, 15 aa, Entamoeba invadens
KASYYGNTNTQNDEA

SEQ ID NO: 2868167 - protein, 26 aa, Entamoeba invadens
KATAPSTLNEGKEKTANTPSPTQFTN

SEQ ID NO: 2868168 - protein, 12 aa, Entamoeba invadens
KATAVQKKPKVV

SEQ ID NO: 2868169 - protein, 14 aa, Entamoeba invadens
KATDGNTHIGIKDF

SEQ ID NO: 2868170 - protein, 6 aa, Entamoeba invadens
KATDME

SEQ ID NO: 2868171 - protein, 16 aa, Entamoeba invadens
KATDSLTTIKSQYGGC

SEQ ID NO: 2868172 - protein, 4 aa, Entamoeba invadens
KATE

SEQ ID NO: 2868173 - protein, 6 aa, Entamoeba invadens
KATEED

SEQ ID NO: 2868174 - protein, 10 aa, Entamoeba invadens
KATEETRRNR

SEQ ID NO: 2868175 - protein, 7 aa, Entamoeba invadens
KATEETT

SEQ ID NO: 2868176 - protein, 6 aa, Entamoeba invadens
KATEHI

SEQ ID NO: 2868177 - protein, 7 aa, Entamoeba invadens
KATEKDL

SEQ ID NO: 2868178 - protein, 14 aa, Entamoeba invadens
KATEKQKEQKEAAE

SEQ ID NO: 2868179 - protein, 6 aa, Entamoeba invadens
KATEKV

SEQ ID NO: 2868180 - protein, 7 aa, Entamoeba invadens
KATENIA

SEQ ID NO: 2868181 - protein, 7 aa, Entamoeba invadens
KATEQGF

SEQ ID NO: 2868182 - protein, 7 aa, Entamoeba invadens
KATEREV

SEQ ID NO: 2868183 - protein, 16 aa, Entamoeba invadens
KATETLAKNHKASITQ

SEQ ID NO: 2868184 - protein, 6 aa, Entamoeba invadens
KATFEE

SEQ ID NO: 2868185 - protein, 7 aa, Entamoeba invadens
KATFPGK

SEQ ID NO: 2868186 - protein, 7 aa, Entamoeba invadens
KATGATV

SEQ ID NO: 2868187 - protein, 8 aa, Entamoeba invadens
KATGEATK

SEQ ID NO: 2868188 - protein, 4 aa, Entamoeba invadens
KATI

SEQ ID NO: 2868189 - protein, 12 aa, Entamoeba invadens
KATIEKLEADKK

SEQ ID NO: 2868190 - protein, 12 aa, Entamoeba invadens
KATKADEKPKIV

SEQ ID NO: 2868191 - protein, 16 aa, Entamoeba invadens
KATKADEKPKTVKTQC

SEQ ID NO: 2868192 - protein, 14 aa, Entamoeba invadens
KATKAFSQIENPSQ

SEQ ID NO: 2868193 - protein, 10 aa, Entamoeba invadens
KATKEINVDP

SEQ ID NO: 2868194 - protein, 5 aa, Entamoeba invadens
KATKG

SEQ ID NO: 2868195 - protein, 8 aa, Entamoeba invadens
KATKGEVF

SEQ ID NO: 2868196 - protein, 13 aa, Entamoeba invadens
KATKGMDGGGLSS

SEQ ID NO: 2868197 - protein, 5 aa, Entamoeba invadens
KATKH

SEQ ID NO: 2868198 - protein, 29 aa, Entamoeba invadens
KATKNTRKTSDRFEGASGSDNAEEAETNL

SEQ ID NO: 2868199 - protein, 44 aa, Entamoeba invadens
KATKQIEELQQEKTECDKKTKDLEEQLKNEQLSGNQLKDELSKT

SEQ ID NO: 2868200 - protein, 7 aa, Entamoeba invadens
KATKSNI

SEQ ID NO: 2868201 - protein, 5 aa, Entamoeba invadens
KATLN

SEQ ID NO: 2868202 - protein, 9 aa, Entamoeba invadens
KATLQDEDE

SEQ ID NO: 2868203 - protein, 6 aa, Entamoeba invadens
KATNDV

SEQ ID NO: 2868204 - protein, 8 aa, Entamoeba invadens
KATNGNTH

SEQ ID NO: 2868205 - protein, 17 aa, Entamoeba invadens
KATNGNTHLDGEDSDNR

SEQ ID NO: 2868206 - protein, 5 aa, Entamoeba invadens
KATNK

SEQ ID NO: 2868207 - protein, 6 aa, Entamoeba invadens
KATNMK

SEQ ID NO: 2868208 - protein, 7 aa, Entamoeba invadens
KATPDDL

SEQ ID NO: 2868209 - protein, 12 aa, Entamoeba invadens
KATPDQKKYFDK

SEQ ID NO: 2868210 - protein, 7 aa, Entamoeba invadens
KATPEEM

SEQ ID NO: 2868211 - protein, 12 aa, Entamoeba invadens
KATPQSSAASLD

SEQ ID NO: 2868212 - protein, 11 aa, Entamoeba invadens
KATPTKPPTKI

SEQ ID NO: 2868213 - protein, 9 aa, Entamoeba invadens
KATQAVHPS

SEQ ID NO: 2868214 - protein, 6 aa, Entamoeba invadens
KATQFA

SEQ ID NO: 2868215 - protein, 8 aa, Entamoeba invadens
KATQTNNV

SEQ ID NO: 2868216 - protein, 7 aa, Entamoeba invadens
KATQVEP

SEQ ID NO: 2868217 - protein, 13 aa, Entamoeba invadens
KATRNEDLPPKQK

SEQ ID NO: 2868218 - protein, 4 aa, Entamoeba invadens
KATS

SEQ ID NO: 2868219 - protein, 9 aa, Entamoeba invadens
KATSEVGGN

SEQ ID NO: 2868220 - protein, 5 aa, Entamoeba invadens
KATSK

SEQ ID NO: 2868221 - protein, 8 aa, Entamoeba invadens
KATSLQHE

SEQ ID NO: 2868222 - protein, 8 aa, Entamoeba invadens
KATSLSIG

SEQ ID NO: 2868223 - protein, 8 aa, Entamoeba invadens
KATSMENN

SEQ ID NO: 2868224 - protein, 12 aa, Entamoeba invadens
KATSPKLATQGG

SEQ ID NO: 2868225 - protein, 18 aa, Entamoeba invadens
KATSPKQLKRNKESQVSN

SEQ ID NO: 2868226 - protein, 32 aa, Entamoeba invadens
KATTAMTGNSKTGGRMTKEEWKQGKKIGKQGG

SEQ ID NO: 2868227 - protein, 8 aa, Entamoeba invadens
KATTDNEF

SEQ ID NO: 2868228 - protein, 5 aa, Entamoeba invadens
KATVD

SEQ ID NO: 2868229 - protein, 9 aa, Entamoeba invadens
KATVNSGIG

SEQ ID NO: 2868230 - protein, 5 aa, Entamoeba invadens
KATVQ

SEQ ID NO: 2868231 - protein, 9 aa, Entamoeba invadens
KATVSTETS

SEQ ID NO: 2868232 - protein, 7 aa, Entamoeba invadens
KAVDETV

SEQ ID NO: 2868233 - protein, 6 aa, Entamoeba invadens
KAVDQK

SEQ ID NO: 2868234 - protein, 20 aa, Entamoeba invadens
KAVEDKKEENKRESTATQPF

SEQ ID NO: 2868235 - protein, 13 aa, Entamoeba invadens
KAVEEKKEKNLGP

SEQ ID NO: 2868236 - protein, 14 aa, Entamoeba invadens
KAVEESASQGSEEL

SEQ ID NO: 2868237 - protein, 11 aa, Entamoeba invadens
KAVEKNKEEHV

SEQ ID NO: 2868238 - protein, 9 aa, Entamoeba invadens
KAVENSATS

SEQ ID NO: 2868239 - protein, 10 aa, Entamoeba invadens
KAVETEKRYT

SEQ ID NO: 2868240 - protein, 8 aa, Entamoeba invadens
KAVKRSKQ

SEQ ID NO: 2868241 - protein, 12 aa, Entamoeba invadens
KAVKSDRQNEQF

SEQ ID NO: 2868242 - protein, 6 aa, Entamoeba invadens
KAVQRG

SEQ ID NO: 2868243 - protein, 7 aa, Entamoeba invadens
KAVSSTN

SEQ ID NO: 2868244 - protein, 12 aa, Entamoeba invadens
KAVTEVKKGKVG

SEQ ID NO: 2868245 - protein, 8 aa, Entamoeba invadens
KAVTPPLD

SEQ ID NO: 2868246 - protein, 6 aa, Entamoeba invadens
KAVTTG

SEQ ID NO: 2868247 - protein, 7 aa, Entamoeba invadens
KAWKENT

SEQ ID NO: 2868248 - protein, 4 aa, Entamoeba invadens
KAYD

SEQ ID NO: 2868249 - protein, 8 aa, Entamoeba invadens
KAYDESLD

SEQ ID NO: 2868250 - protein, 7 aa, Entamoeba invadens
KAYDEYH

SEQ ID NO: 2868251 - protein, 21 aa, Entamoeba invadens
KAYGNSVNAVKERAQKDKTAF

SEQ ID NO: 2868252 - protein, 15 aa, Entamoeba invadens
KAYKDSVKDQQTSQE

SEQ ID NO: 2868253 - protein, 11 aa, Entamoeba invadens
KAYKKQQRLSS

SEQ ID NO: 2868254 - protein, 4 aa, Entamoeba invadens
KAYL

SEQ ID NO: 2868255 - protein, 9 aa, Entamoeba invadens
KAYNKKPKK

SEQ ID NO: 2868256 - protein, 11 aa, Entamoeba invadens
KAYPDKVKSIE

SEQ ID NO: 2868257 - protein, 7 aa, Entamoeba invadens
KAYPQDE

SEQ ID NO: 2868258 - protein, 13 aa, Entamoeba invadens
KAYQTTEGPLKER

SEQ ID NO: 2868259 - protein, 8 aa, Entamoeba invadens
KAYTDGEY

SEQ ID NO: 2868260 - protein, 6 aa, Entamoeba invadens
KAYTNH

SEQ ID NO: 2868261 - protein, 5 aa, Entamoeba invadens
KAYTP

SEQ ID NO: 2868262 - protein, 14 aa, Entamoeba invadens
KAYVSSKVSKVKAG

SEQ ID NO: 2868263 - protein, 10 aa, Entamoeba invadens
KCAKRGQPVV

SEQ ID NO: 2868264 - protein, 6 aa, Entamoeba invadens
KCANQG

SEQ ID NO: 2868265 - protein, 6 aa, Entamoeba invadens
KCASCN

SEQ ID NO: 2868266 - protein, 18 aa, Entamoeba invadens
KCATPNEKNTKTCLCLSD

SEQ ID NO: 2868267 - protein, 4 aa, Entamoeba invadens
KCDD

SEQ ID NO: 2868268 - protein, 16 aa, Entamoeba invadens
KCDDTCNNQCDSSTGF

SEQ ID NO: 2868269 - protein, 8 aa, Entamoeba invadens
KCDEEGRL

SEQ ID NO: 2868270 - protein, 5 aa, Entamoeba invadens
KCDES

SEQ ID NO: 2868271 - protein, 4 aa, Entamoeba invadens
KCDG

SEQ ID NO: 2868272 - protein, 10 aa, Entamoeba invadens
KCDGCDATNG

SEQ ID NO: 2868273 - protein, 9 aa, Entamoeba invadens
KCDGNTGYC

SEQ ID NO: 2868274 - protein, 9 aa, Entamoeba invadens
KCDTKTTEL

SEQ ID NO: 2868275 - protein, 12 aa, Entamoeba invadens
KCEASEQSNGVL

SEQ ID NO: 2868276 - protein, 43 aa, Entamoeba invadens
KCEDDDEDDEDDDEDEEEPKQQTEGGDQAQDETKPPAPQNCPQ

SEQ ID NO: 2868277 - protein, 6 aa, Entamoeba invadens
KCEDEY

SEQ ID NO: 2868278 - protein, 6 aa, Entamoeba invadens
KCEDPN

SEQ ID NO: 2868279 - protein, 8 aa, Entamoeba invadens
KCEEDGKH

SEQ ID NO: 2868280 - protein, 7 aa, Entamoeba invadens
KCEENDE

SEQ ID NO: 2868281 - protein, 8 aa, Entamoeba invadens
KCEESASS

SEQ ID NO: 2868282 - protein, 6 aa, Entamoeba invadens
KCEGDP

SEQ ID NO: 2868283 - protein, 8 aa, Entamoeba invadens
KCEGGCDK

SEQ ID NO: 2868284 - protein, 8 aa, Entamoeba invadens
KCEGSENC

SEQ ID NO: 2868285 - protein, 9 aa, Entamoeba invadens
KCEKCSENF

SEQ ID NO: 2868286 - protein, 7 aa, Entamoeba invadens
KCEKDTS

SEQ ID NO: 2868287 - protein, 10 aa, Entamoeba invadens
KCEKNDENGC

SEQ ID NO: 2868288 - protein, 9 aa, Entamoeba invadens
KCENCGKEI

SEQ ID NO: 2868289 - protein, 26 aa, Entamoeba invadens
KCEPNKTGLRSSQRIGSQTQLQQNQI

SEQ ID NO: 2868290 - protein, 7 aa, Entamoeba invadens
KCEQGPC

SEQ ID NO: 2868291 - protein, 8 aa, Entamoeba invadens
KCEQNVSP

SEQ ID NO: 2868292 - protein, 8 aa, Entamoeba invadens
KCESSSHP

SEQ ID NO: 2868293 - protein, 9 aa, Entamoeba invadens
KCETKEEIG

SEQ ID NO: 2868294 - protein, 5 aa, Entamoeba invadens
KCGEC

SEQ ID NO: 2868295 - protein, 6 aa, Entamoeba invadens
KCGGLP

SEQ ID NO: 2868296 - protein, 17 aa, Entamoeba invadens
KCGGQSGITISGGEPML

SEQ ID NO: 2868297 - protein, 8 aa, Entamoeba invadens
KCGKCTSN

SEQ ID NO: 2868298 - protein, 22 aa, Entamoeba invadens
KCGKKRDEFGKITKSEKCERQH

SEQ ID NO: 2868299 - protein, 19 aa, Entamoeba invadens
KCGKVTKTATRAQNEAPEV

SEQ ID NO: 2868300 - protein, 5 aa, Entamoeba invadens
KCGNK

SEQ ID NO: 2868301 - protein, 15 aa, Entamoeba invadens
KCGNNCTDCSATNTE

SEQ ID NO: 2868302 - protein, 8 aa, Entamoeba invadens
KCGSDGRL

SEQ ID NO: 2868303 - protein, 11 aa, Entamoeba invadens
KCGSSSTTKEF

SEQ ID NO: 2868304 - protein, 6 aa, Entamoeba invadens
KCGTAA

SEQ ID NO: 2868305 - protein, 15 aa, Entamoeba invadens
KCGTSRTSSENSSSI

SEQ ID NO: 2868306 - protein, 4 aa, Entamoeba invadens
KCHN

SEQ ID NO: 2868307 - protein, 4 aa, Entamoeba invadens
KCKD

SEQ ID NO: 2868308 - protein, 11 aa, Entamoeba invadens
KCKDNEERIEG

SEQ ID NO: 2868309 - protein, 7 aa, Entamoeba invadens
KCKEEKF

SEQ ID NO: 2868310 - protein, 12 aa, Entamoeba invadens
KCKEGVPSTFEE

SEQ ID NO: 2868311 - protein, 9 aa, Entamoeba invadens
KCKESEERV

SEQ ID NO: 2868312 - protein, 4 aa, Entamoeba invadens
KCKG

SEQ ID NO: 2868313 - protein, 41 aa, Entamoeba invadens
KCKGNKDKQEKQKMTKKNPSKKIKESNDYVSESTTTLTKEQ

SEQ ID NO: 2868314 - protein, 73 aa, Entamoeba invadens
KCKKCKKCKKCKKCKKCKKCKKCKKCKKCKKCKKCKKCKKCKKCKKCKKCKKCKKCKKCKKCKKCKKCKKCKK

SEQ ID NO: 2868315 - protein, 18 aa, Entamoeba invadens
KCKKEGNSAIKKYLKYVS

SEQ ID NO: 2868316 - protein, 5 aa, Entamoeba invadens
KCKKS

SEQ ID NO: 2868317 - protein, 13 aa, Entamoeba invadens
KCKQQEAGNCERG

SEQ ID NO: 2868318 - protein, 7 aa, Entamoeba invadens
KCKQSIE

SEQ ID NO: 2868319 - protein, 6 aa, Entamoeba invadens
KCKRTE

SEQ ID NO: 2868320 - protein, 6 aa, Entamoeba invadens
KCKRYS

SEQ ID NO: 2868321 - protein, 5 aa, Entamoeba invadens
KCKTG

SEQ ID NO: 2868322 - protein, 8 aa, Entamoeba invadens
KCKTGRGD

SEQ ID NO: 2868323 - protein, 11 aa, Entamoeba invadens
KCKTSSKASKR

SEQ ID NO: 2868324 - protein, 9 aa, Entamoeba invadens
KCLKTSQKD

SEQ ID NO: 2868325 - protein, 9 aa, Entamoeba invadens
KCNETTGNA

SEQ ID NO: 2868326 - protein, 4 aa, Entamoeba invadens
KCNK

SEQ ID NO: 2868327 - protein, 5 aa, Entamoeba invadens
KCNPF

SEQ ID NO: 2868328 - protein, 14 aa, Entamoeba invadens
KCNPTCDGNCNGTN

SEQ ID NO: 2868329 - protein, 12 aa, Entamoeba invadens
KCNRMEKGKAMD

SEQ ID NO: 2868330 - protein, 8 aa, Entamoeba invadens
KCNSEKGI

SEQ ID NO: 2868331 - protein, 8 aa, Entamoeba invadens
KCNSNNVD

SEQ ID NO: 2868332 - protein, 10 aa, Entamoeba invadens
KCNSNSNYYI

SEQ ID NO: 2868333 - protein, 7 aa, Entamoeba invadens
KCNSSCD

SEQ ID NO: 2868334 - protein, 10 aa, Entamoeba invadens
KCNSTTEQEV

SEQ ID NO: 2868335 - protein, 6 aa, Entamoeba invadens
KCNTSV

SEQ ID NO: 2868336 - protein, 7 aa, Entamoeba invadens
KCNTTAS

SEQ ID NO: 2868337 - protein, 6 aa, Entamoeba invadens
KCPEEM

SEQ ID NO: 2868338 - protein, 6 aa, Entamoeba invadens
KCPENN

SEQ ID NO: 2868339 - protein, 5 aa, Entamoeba invadens
KCPET

SEQ ID NO: 2868340 - protein, 12 aa, Entamoeba invadens
KCPLDENGQRDW

SEQ ID NO: 2868341 - protein, 11 aa, Entamoeba invadens
KCPMDKERRQM

SEQ ID NO: 2868342 - protein, 5 aa, Entamoeba invadens
KCPPA

SEQ ID NO: 2868343 - protein, 35 aa, Entamoeba invadens
KCPQSPNELDDISESLKESPKRLSDDKNDKNRYYT

SEQ ID NO: 2868344 - protein, 6 aa, Entamoeba invadens
KCPQYA

SEQ ID NO: 2868345 - protein, 12 aa, Entamoeba invadens
KCPSGQYPNSNK

SEQ ID NO: 2868346 - protein, 6 aa, Entamoeba invadens
KCPTCP

SEQ ID NO: 2868347 - protein, 6 aa, Entamoeba invadens
KCQESI

SEQ ID NO: 2868348 - protein, 14 aa, Entamoeba invadens
KCQNCGSMSHNTRD

SEQ ID NO: 2868349 - protein, 13 aa, Entamoeba invadens
KCQNSFKKELDEK

SEQ ID NO: 2868350 - protein, 8 aa, Entamoeba invadens
KCQPTLEQ

SEQ ID NO: 2868351 - protein, 7 aa, Entamoeba invadens
KCQQTAP

SEQ ID NO: 2868352 - protein, 7 aa, Entamoeba invadens
KCQQTSP

SEQ ID NO: 2868353 - protein, 5 aa, Entamoeba invadens
KCQTA

SEQ ID NO: 2868354 - protein, 12 aa, Entamoeba invadens
KCQTPQLVSGSG

SEQ ID NO: 2868355 - protein, 12 aa, Entamoeba invadens
KCRNENGTKLSE

SEQ ID NO: 2868356 - protein, 6 aa, Entamoeba invadens
KCRPSR

SEQ ID NO: 2868357 - protein, 17 aa, Entamoeba invadens
KCRQTLEEDLKSGVNRQ

SEQ ID NO: 2868358 - protein, 14 aa, Entamoeba invadens
KCRSAKDIQTVIDK

SEQ ID NO: 2868359 - protein, 7 aa, Entamoeba invadens
KCSDDVN

SEQ ID NO: 2868360 - protein, 11 aa, Entamoeba invadens
KCSDEEFTNEL

SEQ ID NO: 2868361 - protein, 7 aa, Entamoeba invadens
KCSEEAA

SEQ ID NO: 2868362 - protein, 6 aa, Entamoeba invadens
KCSEQI

SEQ ID NO: 2868363 - protein, 7 aa, Entamoeba invadens
KCSEQNQ

SEQ ID NO: 2868364 - protein, 9 aa, Entamoeba invadens
KCSKCNNEF

SEQ ID NO: 2868365 - protein, 11 aa, Entamoeba invadens
KCSKKRKNSLD

SEQ ID NO: 2868366 - protein, 17 aa, Entamoeba invadens
KCSNERYDDELDETRGC

SEQ ID NO: 2868367 - protein, 5 aa, Entamoeba invadens
KCSPC

SEQ ID NO: 2868368 - protein, 65 aa, Entamoeba invadens
KCSPSNTSSTQKEDSSPIPDITPDIQTNTKGRSRRGGNAPVSPQPVEVTSTSSPLPNARTRGRRE

SEQ ID NO: 2868369 - protein, 10 aa, Entamoeba invadens
KCSRNVSKTC

SEQ ID NO: 2868370 - protein, 15 aa, Entamoeba invadens
KCSSESGSCSSDFTR

SEQ ID NO: 2868371 - protein, 5 aa, Entamoeba invadens
KCSTA

SEQ ID NO: 2868372 - protein, 7 aa, Entamoeba invadens
KCSTDKE

SEQ ID NO: 2868373 - protein, 11 aa, Entamoeba invadens
KCTAPQNKNGV

SEQ ID NO: 2868374 - protein, 14 aa, Entamoeba invadens
KCTAPQNKTKNGVD

SEQ ID NO: 2868375 - protein, 6 aa, Entamoeba invadens
KCTEAK

SEQ ID NO: 2868376 - protein, 8 aa, Entamoeba invadens
KCTECGNK

SEQ ID NO: 2868377 - protein, 24 aa, Entamoeba invadens
KCTEDEERIDGSCTRKCTESEERI

SEQ ID NO: 2868378 - protein, 7 aa, Entamoeba invadens
KCTENEV

SEQ ID NO: 2868379 - protein, 9 aa, Entamoeba invadens
KCTKGGDEF

SEQ ID NO: 2868380 - protein, 11 aa, Entamoeba invadens
KCTKTKDSKCS

SEQ ID NO: 2868381 - protein, 4 aa, Entamoeba invadens
KCTP

SEQ ID NO: 2868382 - protein, 7 aa, Entamoeba invadens
KCTPPEK

SEQ ID NO: 2868383 - protein, 7 aa, Entamoeba invadens
KCTRENC

SEQ ID NO: 2868384 - protein, 7 aa, Entamoeba invadens
KCTSGDA

SEQ ID NO: 2868385 - protein, 12 aa, Entamoeba invadens
KCTTPTVSESSY

SEQ ID NO: 2868386 - protein, 5 aa, Entamoeba invadens
KCTTS

SEQ ID NO: 2868387 - protein, 5 aa, Entamoeba invadens
KCTYG

SEQ ID NO: 2868388 - protein, 4 aa, Entamoeba invadens
KCVE

SEQ ID NO: 2868389 - protein, 7 aa, Entamoeba invadens
KCVKGNC

SEQ ID NO: 2868390 - protein, 4 aa, Entamoeba invadens
KCVN

SEQ ID NO: 2868391 - protein, 8 aa, Entamoeba invadens
KCVSYSKD

SEQ ID NO: 2868392 - protein, 5 aa, Entamoeba invadens
KCVTT

SEQ ID NO: 2868393 - protein, 8 aa, Entamoeba invadens
KDAAELQQ

SEQ ID NO: 2868394 - protein, 7 aa, Entamoeba invadens
KDADFPP

SEQ ID NO: 2868395 - protein, 8 aa, Entamoeba invadens
KDAEALED

SEQ ID NO: 2868396 - protein, 6 aa, Entamoeba invadens
KDAEMT

SEQ ID NO: 2868397 - protein, 6 aa, Entamoeba invadens
KDAENF

SEQ ID NO: 2868398 - protein, 14 aa, Entamoeba invadens
KDAFGESKTTNVVF

SEQ ID NO: 2868399 - protein, 8 aa, Entamoeba invadens
KDAGGNYH

SEQ ID NO: 2868400 - protein, 6 aa, Entamoeba invadens
KDAHAE

SEQ ID NO: 2868401 - protein, 9 aa, Entamoeba invadens
KDAIERDAK

SEQ ID NO: 2868402 - protein, 14 aa, Entamoeba invadens
KDAIKRQHEDTQNI

SEQ ID NO: 2868403 - protein, 15 aa, Entamoeba invadens
KDAINKTNKMGTQGK

SEQ ID NO: 2868404 - protein, 9 aa, Entamoeba invadens
KDAKAIVSS

SEQ ID NO: 2868405 - protein, 29 aa, Entamoeba invadens
KDAKDELEIAEKENKGLKTQMSNEDIQKQ

SEQ ID NO: 2868406 - protein, 8 aa, Entamoeba invadens
KDAKEDRT

SEQ ID NO: 2868407 - protein, 4 aa, Entamoeba invadens
KDAL

SEQ ID NO: 2868408 - protein, 10 aa, Entamoeba invadens
KDALGSRTLP

SEQ ID NO: 2868409 - protein, 6 aa, Entamoeba invadens
KDALQN

SEQ ID NO: 2868410 - protein, 5 aa, Entamoeba invadens
KDALT

SEQ ID NO: 2868411 - protein, 20 aa, Entamoeba invadens
KDANETKAKSDEEDGQTVRL

SEQ ID NO: 2868412 - protein, 6 aa, Entamoeba invadens
KDAPFE

SEQ ID NO: 2868413 - protein, 8 aa, Entamoeba invadens
KDAPKVYE

SEQ ID NO: 2868414 - protein, 6 aa, Entamoeba invadens
KDARVQ

SEQ ID NO: 2868415 - protein, 11 aa, Entamoeba invadens
KDARVSELEES

SEQ ID NO: 2868416 - protein, 6 aa, Entamoeba invadens
KDASDD

SEQ ID NO: 2868417 - protein, 13 aa, Entamoeba invadens
KDASRGKRTYPEV

SEQ ID NO: 2868418 - protein, 6 aa, Entamoeba invadens
KDASVK

SEQ ID NO: 2868419 - protein, 8 aa, Entamoeba invadens
KDATDLQE

SEQ ID NO: 2868420 - protein, 18 aa, Entamoeba invadens
KDATKPKKPENELSEKGK

SEQ ID NO: 2868421 - protein, 5 aa, Entamoeba invadens
KDATL

SEQ ID NO: 2868422 - protein, 6 aa, Entamoeba invadens
KDATNM

SEQ ID NO: 2868423 - protein, 7 aa, Entamoeba invadens
KDATNNN

SEQ ID NO: 2868424 - protein, 9 aa, Entamoeba invadens
KDATPTERT

SEQ ID NO: 2868425 - protein, 12 aa, Entamoeba invadens
KDATTDQSKQLK

SEQ ID NO: 2868426 - protein, 4 aa, Entamoeba invadens
KDAV

SEQ ID NO: 2868427 - protein, 18 aa, Entamoeba invadens
KDAVNAKKFLQRNRSMVW

SEQ ID NO: 2868428 - protein, 4 aa, Entamoeba invadens
KDAY

SEQ ID NO: 2868429 - protein, 7 aa, Entamoeba invadens
KDAYHEI

SEQ ID NO: 2868430 - protein, 5 aa, Entamoeba invadens
KDCFE

SEQ ID NO: 2868431 - protein, 5 aa, Entamoeba invadens
KDCGK

SEQ ID NO: 2868432 - protein, 6 aa, Entamoeba invadens
KDDASY

SEQ ID NO: 2868433 - protein, 8 aa, Entamoeba invadens
KDDAVATL

SEQ ID NO: 2868434 - protein, 6 aa, Entamoeba invadens
KDDCET

SEQ ID NO: 2868435 - protein, 13 aa, Entamoeba invadens
KDDDKKPESKGTK

SEQ ID NO: 2868436 - protein, 8 aa, Entamoeba invadens
KDDDTREL

SEQ ID NO: 2868437 - protein, 7 aa, Entamoeba invadens
KDDEEKI

SEQ ID NO: 2868438 - protein, 11 aa, Entamoeba invadens
KDDEESSSKFC

SEQ ID NO: 2868439 - protein, 7 aa, Entamoeba invadens
KDDEFTT

SEQ ID NO: 2868440 - protein, 17 aa, Entamoeba invadens
KDDEKVLGTKMSENVRS

SEQ ID NO: 2868441 - protein, 6 aa, Entamoeba invadens
KDDENF

SEQ ID NO: 2868442 - protein, 7 aa, Entamoeba invadens
KDDENFG

SEQ ID NO: 2868443 - protein, 12 aa, Entamoeba invadens
KDDENRAASEQI

SEQ ID NO: 2868444 - protein, 9 aa, Entamoeba invadens
KDDERRNRI

SEQ ID NO: 2868445 - protein, 8 aa, Entamoeba invadens
KDDETFGN

SEQ ID NO: 2868446 - protein, 17 aa, Entamoeba invadens
KDDFTDKQQANYEPQPN

SEQ ID NO: 2868447 - protein, 7 aa, Entamoeba invadens
KDDGSTL

SEQ ID NO: 2868448 - protein, 7 aa, Entamoeba invadens
KDDGTQH

SEQ ID NO: 2868449 - protein, 8 aa, Entamoeba invadens
KDDGTYEV

SEQ ID NO: 2868450 - protein, 6 aa, Entamoeba invadens
KDDIDK

SEQ ID NO: 2868451 - protein, 15 aa, Entamoeba invadens
KDDIDSDDERKISSE

SEQ ID NO: 2868452 - protein, 11 aa, Entamoeba invadens
KDDIEKEPQRK

SEQ ID NO: 2868453 - protein, 12 aa, Entamoeba invadens
KDDIEKKGERIN

SEQ ID NO: 2868454 - protein, 5 aa, Entamoeba invadens
KDDKD

SEQ ID NO: 2868455 - protein, 6 aa, Entamoeba invadens
KDDKDF

SEQ ID NO: 2868456 - protein, 9 aa, Entamoeba invadens
KDDKGSAQL

SEQ ID NO: 2868457 - protein, 22 aa, Entamoeba invadens
KDDKKKKTPSDRDRDLSKKIGR

SEQ ID NO: 2868458 - protein, 6 aa, Entamoeba invadens
KDDKMG

SEQ ID NO: 2868459 - protein, 21 aa, Entamoeba invadens
KDDKSDKKKGKSVTEKISEKN

SEQ ID NO: 2868460 - protein, 9 aa, Entamoeba invadens
KDDKSFSTE

SEQ ID NO: 2868461 - protein, 10 aa, Entamoeba invadens
KDDKTQLKDA

SEQ ID NO: 2868462 - protein, 5 aa, Entamoeba invadens
KDDKV

SEQ ID NO: 2868463 - protein, 6 aa, Entamoeba invadens
KDDKVN

SEQ ID NO: 2868464 - protein, 5 aa, Entamoeba invadens
KDDLA

SEQ ID NO: 2868465 - protein, 6 aa, Entamoeba invadens
KDDLQN

SEQ ID NO: 2868466 - protein, 4 aa, Entamoeba invadens
KDDM

SEQ ID NO: 2868467 - protein, 11 aa, Entamoeba invadens
KDDMKKTYDGS

SEQ ID NO: 2868468 - protein, 13 aa, Entamoeba invadens
KDDNAETKAAEFA

SEQ ID NO: 2868469 - protein, 5 aa, Entamoeba invadens
KDDPC

SEQ ID NO: 2868470 - protein, 5 aa, Entamoeba invadens
KDDPL

SEQ ID NO: 2868471 - protein, 7 aa, Entamoeba invadens
KDDPNKY

SEQ ID NO: 2868472 - protein, 8 aa, Entamoeba invadens
KDDPQINT

SEQ ID NO: 2868473 - protein, 4 aa, Entamoeba invadens
KDDQ

SEQ ID NO: 2868474 - protein, 15 aa, Entamoeba invadens
KDDQKEISQKEKQIE

SEQ ID NO: 2868475 - protein, 12 aa, Entamoeba invadens
KDDQKKTKTPIP

SEQ ID NO: 2868476 - protein, 8 aa, Entamoeba invadens
KDDQLQEA

SEQ ID NO: 2868477 - protein, 8 aa, Entamoeba invadens
KDDQPITG

SEQ ID NO: 2868478 - protein, 11 aa, Entamoeba invadens
KDDQYTKVDEE

SEQ ID NO: 2868479 - protein, 9 aa, Entamoeba invadens
KDDRALYEK

SEQ ID NO: 2868480 - protein, 6 aa, Entamoeba invadens
KDDRKI

SEQ ID NO: 2868481 - protein, 10 aa, Entamoeba invadens
KDDRKSPVSF

SEQ ID NO: 2868482 - protein, 7 aa, Entamoeba invadens
KDDRTKF

SEQ ID NO: 2868483 - protein, 6 aa, Entamoeba invadens
KDDSGD

SEQ ID NO: 2868484 - protein, 15 aa, Entamoeba invadens
KDDSKTQLSTFSEES

SEQ ID NO: 2868485 - protein, 7 aa, Entamoeba invadens
KDDSKYD

SEQ ID NO: 2868486 - protein, 8 aa, Entamoeba invadens
KDDSLGDA

SEQ ID NO: 2868487 - protein, 6 aa, Entamoeba invadens
KDDTFG

SEQ ID NO: 2868488 - protein, 5 aa, Entamoeba invadens
KDDTI

SEQ ID NO: 2868489 - protein, 9 aa, Entamoeba invadens
KDDTQRTWY

SEQ ID NO: 2868490 - protein, 8 aa, Entamoeba invadens
KDDTQTIQ

SEQ ID NO: 2868491 - protein, 5 aa, Entamoeba invadens
KDDTT

SEQ ID NO: 2868492 - protein, 6 aa, Entamoeba invadens
KDDVDN

SEQ ID NO: 2868493 - protein, 50 aa, Entamoeba invadens
KDDVKKNEPNFETKKVQKHEEKDQKKEDKRKGEVRKNFSADKKKGNTKKR

SEQ ID NO: 2868494 - protein, 12 aa, Entamoeba invadens
KDDVKTAPRKTT

SEQ ID NO: 2868495 - protein, 21 aa, Entamoeba invadens
KDDVNEGNDDTKKGQVPSSTV

SEQ ID NO: 2868496 - protein, 7 aa, Entamoeba invadens
KDDVPKF

SEQ ID NO: 2868497 - protein, 15 aa, Entamoeba invadens
KDDVPPKMSKDERIS

SEQ ID NO: 2868498 - protein, 7 aa, Entamoeba invadens
KDDVRNN

SEQ ID NO: 2868499 - protein, 5 aa, Entamoeba invadens
KDDWE

SEQ ID NO: 2868500 - protein, 13 aa, Entamoeba invadens
KDDYKTEVSLSPK

SEQ ID NO: 2868501 - protein, 6 aa, Entamoeba invadens
KDDYNY

SEQ ID NO: 2868502 - protein, 11 aa, Entamoeba invadens
KDDYSQGSPTF

SEQ ID NO: 2868503 - protein, 6 aa, Entamoeba invadens
KDDYVK

SEQ ID NO: 2868504 - protein, 4 aa, Entamoeba invadens
KDEA

SEQ ID NO: 2868505 - protein, 17 aa, Entamoeba invadens
KDEAHDNMDGLSDAAKA

SEQ ID NO: 2868506 - protein, 5 aa, Entamoeba invadens
KDEAM

SEQ ID NO: 2868507 - protein, 22 aa, Entamoeba invadens
KDEASKEKERIKDKNKGNADEE

SEQ ID NO: 2868508 - protein, 7 aa, Entamoeba invadens
KDEDDEI

SEQ ID NO: 2868509 - protein, 15 aa, Entamoeba invadens
KDEDDIENKSTENVF

SEQ ID NO: 2868510 - protein, 8 aa, Entamoeba invadens
KDEDDTDM

SEQ ID NO: 2868511 - protein, 20 aa, Entamoeba invadens
KDEDEKGEKENESGSESEED

SEQ ID NO: 2868512 - protein, 15 aa, Entamoeba invadens
KDEDEKNSNNFGEED

SEQ ID NO: 2868513 - protein, 16 aa, Entamoeba invadens
KDEDGKTNAEWQQNKS

SEQ ID NO: 2868514 - protein, 8 aa, Entamoeba invadens
KDEDSHKK

SEQ ID NO: 2868515 - protein, 5 aa, Entamoeba invadens
KDEDT

SEQ ID NO: 2868516 - protein, 8 aa, Entamoeba invadens
KDEDTKKQ

SEQ ID NO: 2868517 - protein, 18 aa, Entamoeba invadens
KDEDVDCYPGETIEQAKR

SEQ ID NO: 2868518 - protein, 9 aa, Entamoeba invadens
KDEDVSKKK

SEQ ID NO: 2868519 - protein, 5 aa, Entamoeba invadens
KDEED

SEQ ID NO: 2868520 - protein, 12 aa, Entamoeba invadens
KDEEDYGKPADV

SEQ ID NO: 2868521 - protein, 9 aa, Entamoeba invadens
KDEEEAKDR

SEQ ID NO: 2868522 - protein, 23 aa, Entamoeba invadens
KDEEEDDEDEEKITEEAKVENQF

SEQ ID NO: 2868523 - protein, 33 aa, Entamoeba invadens
KDEEEIKSESKEKIESDEKKEKVSTAAKKMQER

SEQ ID NO: 2868524 - protein, 8 aa, Entamoeba invadens
KDEEEINR

SEQ ID NO: 2868525 - protein, 17 aa, Entamoeba invadens
KDEEINNDEEEKTAPEW

SEQ ID NO: 2868526 - protein, 11 aa, Entamoeba invadens
KDEEKRKNVNV

SEQ ID NO: 2868527 - protein, 11 aa, Entamoeba invadens
KDEEKYPDETL

SEQ ID NO: 2868528 - protein, 7 aa, Entamoeba invadens
KDEEMQQ

SEQ ID NO: 2868529 - protein, 7 aa, Entamoeba invadens
KDEEQTV

SEQ ID NO: 2868530 - protein, 21 aa, Entamoeba invadens
KDEETNEISNEKNCSANSEKG

SEQ ID NO: 2868531 - protein, 6 aa, Entamoeba invadens
KDEEVN

SEQ ID NO: 2868532 - protein, 9 aa, Entamoeba invadens
KDEEVSPEK

SEQ ID NO: 2868533 - protein, 5 aa, Entamoeba invadens
KDEEY

SEQ ID NO: 2868534 - protein, 5 aa, Entamoeba invadens
KDEGF

SEQ ID NO: 2868535 - protein, 13 aa, Entamoeba invadens
KDEGNWKGELGLS

SEQ ID NO: 2868536 - protein, 10 aa, Entamoeba invadens
KDEGSAPFTV

SEQ ID NO: 2868537 - protein, 6 aa, Entamoeba invadens
KDEGSK

SEQ ID NO: 2868538 - protein, 9 aa, Entamoeba invadens
KDEGSKIDI

SEQ ID NO: 2868539 - protein, 7 aa, Entamoeba invadens
KDEHRKL

SEQ ID NO: 2868540 - protein, 8 aa, Entamoeba invadens
KDEIEDEA

SEQ ID NO: 2868541 - protein, 9 aa, Entamoeba invadens
KDEIGETTE

SEQ ID NO: 2868542 - protein, 7 aa, Entamoeba invadens
KDEIKKI

SEQ ID NO: 2868543 - protein, 5 aa, Entamoeba invadens
KDEKC

SEQ ID NO: 2868544 - protein, 17 aa, Entamoeba invadens
KDEKIEQNKSDISKQSV

SEQ ID NO: 2868545 - protein, 29 aa, Entamoeba invadens
KDEKNEGSVVESTQSKNDEKCELKKREEY

SEQ ID NO: 2868546 - protein, 8 aa, Entamoeba invadens
KDEKNPIT

SEQ ID NO: 2868547 - protein, 11 aa, Entamoeba invadens
KDEKRKKTFEE

SEQ ID NO: 2868548 - protein, 9 aa, Entamoeba invadens
KDEKSIVNT

SEQ ID NO: 2868549 - protein, 8 aa, Entamoeba invadens
KDEKTAEK

SEQ ID NO: 2868550 - protein, 20 aa, Entamoeba invadens
KDEKYTSTESSISVDPQQKL

SEQ ID NO: 2868551 - protein, 4 aa, Entamoeba invadens
KDEL

SEQ ID NO: 2868552 - protein, 6 aa, Entamoeba invadens
KDELES

SEQ ID NO: 2868553 - protein, 17 aa, Entamoeba invadens
KDELPQETVNNKQDEKV

SEQ ID NO: 2868554 - protein, 10 aa, Entamoeba invadens
KDEMGGDEDF

SEQ ID NO: 2868555 - protein, 8 aa, Entamoeba invadens
KDENFGNT

SEQ ID NO: 2868556 - protein, 7 aa, Entamoeba invadens
KDENIDE

SEQ ID NO: 2868557 - protein, 27 aa, Entamoeba invadens
KDENKRVKNENESLKKKINEMSEETNI

SEQ ID NO: 2868558 - protein, 5 aa, Entamoeba invadens
KDENN

SEQ ID NO: 2868559 - protein, 5 aa, Entamoeba invadens
KDENV

SEQ ID NO: 2868560 - protein, 5 aa, Entamoeba invadens
KDENY

SEQ ID NO: 2868561 - protein, 6 aa, Entamoeba invadens
KDEQFN

SEQ ID NO: 2868562 - protein, 8 aa, Entamoeba invadens
KDEQNEVK

SEQ ID NO: 2868563 - protein, 7 aa, Entamoeba invadens
KDEQRRN

SEQ ID NO: 2868564 - protein, 4 aa, Entamoeba invadens
KDES

SEQ ID NO: 2868565 - protein, 6 aa, Entamoeba invadens
KDESAL

SEQ ID NO: 2868566 - protein, 8 aa, Entamoeba invadens
KDESDGIV

SEQ ID NO: 2868567 - protein, 10 aa, Entamoeba invadens
KDESEKPQNY

SEQ ID NO: 2868568 - protein, 7 aa, Entamoeba invadens
KDESGLT

SEQ ID NO: 2868569 - protein, 13 aa, Entamoeba invadens
KDESNQPTSSYKN

SEQ ID NO: 2868570 - protein, 11 aa, Entamoeba invadens
KDESPMNTKPI

SEQ ID NO: 2868571 - protein, 7 aa, Entamoeba invadens
KDESSGW

SEQ ID NO: 2868572 - protein, 10 aa, Entamoeba invadens
KDESTKERAT

SEQ ID NO: 2868573 - protein, 4 aa, Entamoeba invadens
KDET

SEQ ID NO: 2868574 - protein, 7 aa, Entamoeba invadens
KDETANK

SEQ ID NO: 2868575 - protein, 7 aa, Entamoeba invadens
KDETLDA

SEQ ID NO: 2868576 - protein, 6 aa, Entamoeba invadens
KDETRM

SEQ ID NO: 2868577 - protein, 111 aa, Entamoeba invadens
KDETSAERKEKKKHNKIEKGGKKEDLGEESEEENQESEQDEEIKTELEAERKSEKKEKKSKKEKAEKKPVTQEDKKEMQEKKKDEEKKETHVEKDDDSEDDGRVKIEQDSD

SEQ ID NO: 2868578 - protein, 8 aa, Entamoeba invadens
KDEVGKTN

SEQ ID NO: 2868579 - protein, 104 aa, Entamoeba invadens
KDEWTTVEKGRSFRKAKSKPSKHVGNKETEGESSETDNSAKDDLVRTKSDETSESEKLEKSEINEKSSEKYEERDEKRDRKSRKDQERQRLKEQEEKRLERERI

SEQ ID NO: 2868580 - protein, 6 aa, Entamoeba invadens
KDEYAK

SEQ ID NO: 2868581 - protein, 9 aa, Entamoeba invadens
KDEYNENVT

SEQ ID NO: 2868582 - protein, 34 aa, Entamoeba invadens
KDEYPGAEEKYQKAKNEKEKREEESKLKTPVVTP

SEQ ID NO: 2868583 - protein, 7 aa, Entamoeba invadens
KDEYPTA

SEQ ID NO: 2868584 - protein, 22 aa, Entamoeba invadens
KDFAKKKSTIGRPEYKPNSPMV

SEQ ID NO: 2868585 - protein, 12 aa, Entamoeba invadens
KDFDEHSSLGWN

SEQ ID NO: 2868586 - protein, 5 aa, Entamoeba invadens
KDFDN

SEQ ID NO: 2868587 - protein, 4 aa, Entamoeba invadens
KDFE

SEQ ID NO: 2868588 - protein, 7 aa, Entamoeba invadens
KDFEERS

SEQ ID NO: 2868589 - protein, 8 aa, Entamoeba invadens
KDFEGKDE

SEQ ID NO: 2868590 - protein, 23 aa, Entamoeba invadens
KDFEKECDKIDKDASKEFSSQIK

SEQ ID NO: 2868591 - protein, 16 aa, Entamoeba invadens
KDFEKKTGLEASMTDN

SEQ ID NO: 2868592 - protein, 6 aa, Entamoeba invadens
KDFEPL

SEQ ID NO: 2868593 - protein, 5 aa, Entamoeba invadens
KDFET

SEQ ID NO: 2868594 - protein, 12 aa, Entamoeba invadens
KDFGDKERLDKD

SEQ ID NO: 2868595 - protein, 7 aa, Entamoeba invadens
KDFGSSK

SEQ ID NO: 2868596 - protein, 19 aa, Entamoeba invadens
KDFKDNKGFEDFLDGLTRF

SEQ ID NO: 2868597 - protein, 6 aa, Entamoeba invadens
KDFKNL

SEQ ID NO: 2868598 - protein, 15 aa, Entamoeba invadens
KDFNTIKKKKKKCIL

SEQ ID NO: 2868599 - protein, 7 aa, Entamoeba invadens
KDFPKSK

SEQ ID NO: 2868600 - protein, 6 aa, Entamoeba invadens
KDFRPQ

SEQ ID NO: 2868601 - protein, 11 aa, Entamoeba invadens
KDFSEKLRGKN

SEQ ID NO: 2868602 - protein, 8 aa, Entamoeba invadens
KDFSGDRK

SEQ ID NO: 2868603 - protein, 8 aa, Entamoeba invadens
KDFSGEDY

SEQ ID NO: 2868604 - protein, 5 aa, Entamoeba invadens
KDFSR

SEQ ID NO: 2868605 - protein, 7 aa, Entamoeba invadens
KDFSTQY

SEQ ID NO: 2868606 - protein, 4 aa, Entamoeba invadens
KDFT

SEQ ID NO: 2868607 - protein, 6 aa, Entamoeba invadens
KDFTPE

SEQ ID NO: 2868608 - protein, 4 aa, Entamoeba invadens
KDFY

SEQ ID NO: 2868609 - protein, 5 aa, Entamoeba invadens
KDGAD

SEQ ID NO: 2868610 - protein, 8 aa, Entamoeba invadens
KDGARQIE

SEQ ID NO: 2868611 - protein, 7 aa, Entamoeba invadens
KDGATNI

SEQ ID NO: 2868612 - protein, 4 aa, Entamoeba invadens
KDGD

SEQ ID NO: 2868613 - protein, 7 aa, Entamoeba invadens
KDGDIRR

SEQ ID NO: 2868614 - protein, 6 aa, Entamoeba invadens
KDGDQL

SEQ ID NO: 2868615 - protein, 9 aa, Entamoeba invadens
KDGDQNGDD

SEQ ID NO: 2868616 - protein, 14 aa, Entamoeba invadens
KDGDWIEEGTAPVE

SEQ ID NO: 2868617 - protein, 6 aa, Entamoeba invadens
KDGEIR

SEQ ID NO: 2868618 - protein, 13 aa, Entamoeba invadens
KDGEQQKDEIEKL

SEQ ID NO: 2868619 - protein, 6 aa, Entamoeba invadens
KDGESG

SEQ ID NO: 2868620 - protein, 6 aa, Entamoeba invadens
KDGEYG

SEQ ID NO: 2868621 - protein, 6 aa, Entamoeba invadens
KDGFKG

SEQ ID NO: 2868622 - protein, 7 aa, Entamoeba invadens
KDGGDVE

SEQ ID NO: 2868623 - protein, 8 aa, Entamoeba invadens
KDGGIGGC

SEQ ID NO: 2868624 - protein, 14 aa, Entamoeba invadens
KDGHLQRRDEEEEI

SEQ ID NO: 2868625 - protein, 8 aa, Entamoeba invadens
KDGHQDPE

SEQ ID NO: 2868626 - protein, 14 aa, Entamoeba invadens
KDGIAPSTQKIEED

SEQ ID NO: 2868627 - protein, 9 aa, Entamoeba invadens
KDGITNNNQ

SEQ ID NO: 2868628 - protein, 8 aa, Entamoeba invadens
KDGKCRTC

SEQ ID NO: 2868629 - protein, 5 aa, Entamoeba invadens
KDGKD

SEQ ID NO: 2868630 - protein, 14 aa, Entamoeba invadens
KDGKEEYLYPPSSG

SEQ ID NO: 2868631 - protein, 15 aa, Entamoeba invadens
KDGKFEVPNYEGNYT

SEQ ID NO: 2868632 - protein, 9 aa, Entamoeba invadens
KDGKIDPNS

SEQ ID NO: 2868633 - protein, 13 aa, Entamoeba invadens
KDGKIEQSTSSDL

SEQ ID NO: 2868634 - protein, 10 aa, Entamoeba invadens
KDGKLSRKEF

SEQ ID NO: 2868635 - protein, 6 aa, Entamoeba invadens
KDGKMQ

SEQ ID NO: 2868636 - protein, 9 aa, Entamoeba invadens
KDGKNGKSY

SEQ ID NO: 2868637 - protein, 10 aa, Entamoeba invadens
KDGKNSVDSF

SEQ ID NO: 2868638 - protein, 17 aa, Entamoeba invadens
KDGKRLEKPEWTKEVGY

SEQ ID NO: 2868639 - protein, 5 aa, Entamoeba invadens
KDGKS

SEQ ID NO: 2868640 - protein, 9 aa, Entamoeba invadens
KDGKTLYSG

SEQ ID NO: 2868641 - protein, 6 aa, Entamoeba invadens
KDGKTM

SEQ ID NO: 2868642 - protein, 14 aa, Entamoeba invadens
KDGLGGVTREYDAN

SEQ ID NO: 2868643 - protein, 9 aa, Entamoeba invadens
KDGLSGSED

SEQ ID NO: 2868644 - protein, 11 aa, Entamoeba invadens
KDGNGTVDEGE

SEQ ID NO: 2868645 - protein, 5 aa, Entamoeba invadens
KDGNI

SEQ ID NO: 2868646 - protein, 8 aa, Entamoeba invadens
KDGNIECK

SEQ ID NO: 2868647 - protein, 34 aa, Entamoeba invadens
KDGNIKPKNERKKIDKEKKPRPPVTSVKRTKALD

SEQ ID NO: 2868648 - protein, 6 aa, Entamoeba invadens
KDGNNP

SEQ ID NO: 2868649 - protein, 7 aa, Entamoeba invadens
KDGNPYC

SEQ ID NO: 2868650 - protein, 9 aa, Entamoeba invadens
KDGNQDPGQ

SEQ ID NO: 2868651 - protein, 12 aa, Entamoeba invadens
KDGNQDPGQIVV

SEQ ID NO: 2868652 - protein, 5 aa, Entamoeba invadens
KDGNT

SEQ ID NO: 2868653 - protein, 9 aa, Entamoeba invadens
KDGQGQSSV

SEQ ID NO: 2868654 - protein, 8 aa, Entamoeba invadens
KDGQQTSS

SEQ ID NO: 2868655 - protein, 25 aa, Entamoeba invadens
KDGQTKLTNGATSNRIANAQNYPTS

SEQ ID NO: 2868656 - protein, 9 aa, Entamoeba invadens
KDGRISDEN

SEQ ID NO: 2868657 - protein, 10 aa, Entamoeba invadens
KDGRNAIEAR

SEQ ID NO: 2868658 - protein, 10 aa, Entamoeba invadens
KDGRNTFTEY

SEQ ID NO: 2868659 - protein, 5 aa, Entamoeba invadens
KDGSD

SEQ ID NO: 2868660 - protein, 7 aa, Entamoeba invadens
KDGSETI

SEQ ID NO: 2868661 - protein, 7 aa, Entamoeba invadens
KDGSGLG

SEQ ID NO: 2868662 - protein, 7 aa, Entamoeba invadens
KDGSNIT

SEQ ID NO: 2868663 - protein, 4 aa, Entamoeba invadens
KDGT

SEQ ID NO: 2868664 - protein, 8 aa, Entamoeba invadens
KDGTNEAQ

SEQ ID NO: 2868665 - protein, 6 aa, Entamoeba invadens
KDGTNI

SEQ ID NO: 2868666 - protein, 6 aa, Entamoeba invadens
KDGTVV

SEQ ID NO: 2868667 - protein, 4 aa, Entamoeba invadens
KDGV

SEQ ID NO: 2868668 - protein, 5 aa, Entamoeba invadens
KDGVK

SEQ ID NO: 2868669 - protein, 6 aa, Entamoeba invadens
KDGVPN

SEQ ID NO: 2868670 - protein, 7 aa, Entamoeba invadens
KDGVSTQ

SEQ ID NO: 2868671 - protein, 5 aa, Entamoeba invadens
KDHIE

SEQ ID NO: 2868672 - protein, 7 aa, Entamoeba invadens
KDHKEDD

SEQ ID NO: 2868673 - protein, 21 aa, Entamoeba invadens
KDHMDNPQHRGEITEEEAKKM

SEQ ID NO: 2868674 - protein, 5 aa, Entamoeba invadens
KDHMG

SEQ ID NO: 2868675 - protein, 18 aa, Entamoeba invadens
KDHNISDTIKAKAAAVKN

SEQ ID NO: 2868676 - protein, 8 aa, Entamoeba invadens
KDHNPGDE

SEQ ID NO: 2868677 - protein, 9 aa, Entamoeba invadens
KDHNPSDRP

SEQ ID NO: 2868678 - protein, 6 aa, Entamoeba invadens
KDHPGV

SEQ ID NO: 2868679 - protein, 4 aa, Entamoeba invadens
KDHQ

SEQ ID NO: 2868680 - protein, 5 aa, Entamoeba invadens
KDIAE

SEQ ID NO: 2868681 - protein, 9 aa, Entamoeba invadens
KDIDDPRAK

SEQ ID NO: 2868682 - protein, 6 aa, Entamoeba invadens
KDIDPS

SEQ ID NO: 2868683 - protein, 16 aa, Entamoeba invadens
KDIDQYRSSYSHDSEV

SEQ ID NO: 2868684 - protein, 5 aa, Entamoeba invadens
KDIDS

SEQ ID NO: 2868685 - protein, 22 aa, Entamoeba invadens
KDIDVTKKPNKTSSKKKINNYN

SEQ ID NO: 2868686 - protein, 12 aa, Entamoeba invadens
KDIEDEEGEISD

SEQ ID NO: 2868687 - protein, 12 aa, Entamoeba invadens
KDIEDKEGEISD

SEQ ID NO: 2868688 - protein, 13 aa, Entamoeba invadens
KDIEDNEGEISDL

SEQ ID NO: 2868689 - protein, 46 aa, Entamoeba invadens
KDIEKKESDTNTLTKPEKVENKQDGEKKKEEQVTEKPMESENNAPS

SEQ ID NO: 2868690 - protein, 5 aa, Entamoeba invadens
KDIEN

SEQ ID NO: 2868691 - protein, 7 aa, Entamoeba invadens
KDIENEC

SEQ ID NO: 2868692 - protein, 13 aa, Entamoeba invadens
KDIENKEGEISDL

SEQ ID NO: 2868693 - protein, 8 aa, Entamoeba invadens
KDIENKKG

SEQ ID NO: 2868694 - protein, 21 aa, Entamoeba invadens
KDIEPPKTQLIPPQKSDKKNF

SEQ ID NO: 2868695 - protein, 9 aa, Entamoeba invadens
KDIEREKTT

SEQ ID NO: 2868696 - protein, 7 aa, Entamoeba invadens
KDIESKK

SEQ ID NO: 2868697 - protein, 6 aa, Entamoeba invadens
KDIESV

SEQ ID NO: 2868698 - protein, 23 aa, Entamoeba invadens
KDIETHKKPLKRPLKKSKKKTKK

SEQ ID NO: 2868699 - protein, 15 aa, Entamoeba invadens
KDIGPKRYVELGQRV

SEQ ID NO: 2868700 - protein, 5 aa, Entamoeba invadens
KDIGQ

SEQ ID NO: 2868701 - protein, 5 aa, Entamoeba invadens
KDIIK

SEQ ID NO: 2868702 - protein, 4 aa, Entamoeba invadens
KDIK

SEQ ID NO: 2868703 - protein, 10 aa, Entamoeba invadens
KDIKEARESA

SEQ ID NO: 2868704 - protein, 12 aa, Entamoeba invadens
KDIKQAENVKEH

SEQ ID NO: 2868705 - protein, 21 aa, Entamoeba invadens
KDIKTKETDIQTKEKQVEEDG

SEQ ID NO: 2868706 - protein, 6 aa, Entamoeba invadens
KDINDE

SEQ ID NO: 2868707 - protein, 6 aa, Entamoeba invadens
KDINKD

SEQ ID NO: 2868708 - protein, 4 aa, Entamoeba invadens
KDIP

SEQ ID NO: 2868709 - protein, 36 aa, Entamoeba invadens
KDIPNSNGINTNHSTSNSEEDQMRKVEKEEGEDNDT

SEQ ID NO: 2868710 - protein, 6 aa, Entamoeba invadens
KDIPYA

SEQ ID NO: 2868711 - protein, 4 aa, Entamoeba invadens
KDIQ

SEQ ID NO: 2868712 - protein, 11 aa, Entamoeba invadens
KDIQKSHSEAM

SEQ ID NO: 2868713 - protein, 8 aa, Entamoeba invadens
KDIQTRTE

SEQ ID NO: 2868714 - protein, 12 aa, Entamoeba invadens
KDISEEKRVKTT

SEQ ID NO: 2868715 - protein, 13 aa, Entamoeba invadens
KDISEKRDTLDKD

SEQ ID NO: 2868716 - protein, 5 aa, Entamoeba invadens
KDISI

SEQ ID NO: 2868717 - protein, 6 aa, Entamoeba invadens
KDISSE

SEQ ID NO: 2868718 - protein, 9 aa, Entamoeba invadens
KDISTSDMK

SEQ ID NO: 2868719 - protein, 6 aa, Entamoeba invadens
KDITKE

SEQ ID NO: 2868720 - protein, 6 aa, Entamoeba invadens
KDITKV

SEQ ID NO: 2868721 - protein, 5 aa, Entamoeba invadens
KDITR

SEQ ID NO: 2868722 - protein, 6 aa, Entamoeba invadens
KDITTR

SEQ ID NO: 2868723 - protein, 4 aa, Entamoeba invadens
KDIY

SEQ ID NO: 2868724 - protein, 8 aa, Entamoeba invadens
KDIYGQDT

SEQ ID NO: 2868725 - protein, 17 aa, Entamoeba invadens
KDIYSKKTKLNETQKNA

SEQ ID NO: 2868726 - protein, 8 aa, Entamoeba invadens
KDKAEEVD

SEQ ID NO: 2868727 - protein, 104 aa, Entamoeba invadens
KDKAEKKDFEKERKRTELQSKTDNSQVSSSAVEKTETEESVEVQDKSSKVENAEIGDKESKTGKSEKSEKEDDPEKAEEKVSDIEELRKEKRKKLDKRREHLAS

SEQ ID NO: 2868728 - protein, 7 aa, Entamoeba invadens
KDKAHKI

SEQ ID NO: 2868729 - protein, 10 aa, Entamoeba invadens
KDKDGKYVGY

SEQ ID NO: 2868730 - protein, 8 aa, Entamoeba invadens
KDKDNEIS

SEQ ID NO: 2868731 - protein, 8 aa, Entamoeba invadens
KDKDTHNK

SEQ ID NO: 2868732 - protein, 5 aa, Entamoeba invadens
KDKEA

SEQ ID NO: 2868733 - protein, 32 aa, Entamoeba invadens
KDKECKTLDTENYEEDTFRECSGSGSYRTKYY

SEQ ID NO: 2868734 - protein, 8 aa, Entamoeba invadens
KDKEDDKK

SEQ ID NO: 2868735 - protein, 12 aa, Entamoeba invadens
KDKEEVVGDGKK

SEQ ID NO: 2868736 - protein, 7 aa, Entamoeba invadens
KDKEGMK

SEQ ID NO: 2868737 - protein, 16 aa, Entamoeba invadens
KDKEIRDAEAKRNEYA

SEQ ID NO: 2868738 - protein, 10 aa, Entamoeba invadens
KDKEKSIRNS

SEQ ID NO: 2868739 - protein, 13 aa, Entamoeba invadens
KDKELGKEKKEVM

SEQ ID NO: 2868740 - protein, 7 aa, Entamoeba invadens
KDKELNE

SEQ ID NO: 2868741 - protein, 9 aa, Entamoeba invadens
KDKEMSEEQ

SEQ ID NO: 2868742 - protein, 11 aa, Entamoeba invadens
KDKENEAETSF

SEQ ID NO: 2868743 - protein, 7 aa, Entamoeba invadens
KDKENPR

SEQ ID NO: 2868744 - protein, 6 aa, Entamoeba invadens
KDKETF

SEQ ID NO: 2868745 - protein, 9 aa, Entamoeba invadens
KDKETGKEC

SEQ ID NO: 2868746 - protein, 8 aa, Entamoeba invadens
KDKETLEK

SEQ ID NO: 2868747 - protein, 8 aa, Entamoeba invadens
KDKETLTP

SEQ ID NO: 2868748 - protein, 23 aa, Entamoeba invadens
KDKFAKEKEAKKLKAENDEIKEK

SEQ ID NO: 2868749 - protein, 7 aa, Entamoeba invadens
KDKGEKL

SEQ ID NO: 2868750 - protein, 9 aa, Entamoeba invadens
KDKGTFSIK

SEQ ID NO: 2868751 - protein, 4 aa, Entamoeba invadens
KDKH

SEQ ID NO: 2868752 - protein, 8 aa, Entamoeba invadens
KDKHADED

SEQ ID NO: 2868753 - protein, 4 aa, Entamoeba invadens
KDKI

SEQ ID NO: 2868754 - protein, 5 aa, Entamoeba invadens
KDKIH

SEQ ID NO: 2868755 - protein, 7 aa, Entamoeba invadens
KDKISDV

SEQ ID NO: 2868756 - protein, 8 aa, Entamoeba invadens
KDKITAKF

SEQ ID NO: 2868757 - protein, 13 aa, Entamoeba invadens
KDKKATDKDHDIE

SEQ ID NO: 2868758 - protein, 6 aa, Entamoeba invadens
KDKKDA

SEQ ID NO: 2868759 - protein, 9 aa, Entamoeba invadens
KDKKETKQK

SEQ ID NO: 2868760 - protein, 9 aa, Entamoeba invadens
KDKKGNRNV

SEQ ID NO: 2868761 - protein, 10 aa, Entamoeba invadens
KDKKILKDTS

SEQ ID NO: 2868762 - protein, 8 aa, Entamoeba invadens
KDKKIRKK

SEQ ID NO: 2868763 - protein, 8 aa, Entamoeba invadens
KDKKKEVG

SEQ ID NO: 2868764 - protein, 7 aa, Entamoeba invadens
KDKKNNK

SEQ ID NO: 2868765 - protein, 8 aa, Entamoeba invadens
KDKKRAEL

SEQ ID NO: 2868766 - protein, 9 aa, Entamoeba invadens
KDKKSDLAS

SEQ ID NO: 2868767 - protein, 9 aa, Entamoeba invadens
KDKKSGNSQ

SEQ ID NO: 2868768 - protein, 16 aa, Entamoeba invadens
KDKKYELDIDDSTSTL

SEQ ID NO: 2868769 - protein, 12 aa, Entamoeba invadens
KDKLPNEEEDEN

SEQ ID NO: 2868770 - protein, 4 aa, Entamoeba invadens
KDKN

SEQ ID NO: 2868771 - protein, 7 aa, Entamoeba invadens
KDKNEYV

SEQ ID NO: 2868772 - protein, 16 aa, Entamoeba invadens
KDKNGHKPGESEYDPT

SEQ ID NO: 2868773 - protein, 6 aa, Entamoeba invadens
KDKNGM

SEQ ID NO: 2868774 - protein, 8 aa, Entamoeba invadens
KDKNIAEK

SEQ ID NO: 2868775 - protein, 9 aa, Entamoeba invadens
KDKNLDASN

SEQ ID NO: 2868776 - protein, 9 aa, Entamoeba invadens
KDKNLKEEI

SEQ ID NO: 2868777 - protein, 7 aa, Entamoeba invadens
KDKNNKD

SEQ ID NO: 2868778 - protein, 9 aa, Entamoeba invadens
KDKNNKIDF

SEQ ID NO: 2868779 - protein, 4 aa, Entamoeba invadens
KDKP

SEQ ID NO: 2868780 - protein, 7 aa, Entamoeba invadens
KDKPDTN

SEQ ID NO: 2868781 - protein, 8 aa, Entamoeba invadens
KDKPPKKF

SEQ ID NO: 2868782 - protein, 4 aa, Entamoeba invadens
KDKQ

SEQ ID NO: 2868783 - protein, 9 aa, Entamoeba invadens
KDKQKAIKT

SEQ ID NO: 2868784 - protein, 19 aa, Entamoeba invadens
KDKQLEKDNQLKKVKKDTF

SEQ ID NO: 2868785 - protein, 19 aa, Entamoeba invadens
KDKQPDSLPPLSETKSVND

SEQ ID NO: 2868786 - protein, 7 aa, Entamoeba invadens
KDKQVNT

SEQ ID NO: 2868787 - protein, 4 aa, Entamoeba invadens
KDKR

SEQ ID NO: 2868788 - protein, 11 aa, Entamoeba invadens
KDKRDEKQAIN

SEQ ID NO: 2868789 - protein, 25 aa, Entamoeba invadens
KDKRGDLPKSVKDLERNDFEDTPTY

SEQ ID NO: 2868790 - protein, 15 aa, Entamoeba invadens
KDKRNELNKTMRKNK

SEQ ID NO: 2868791 - protein, 15 aa, Entamoeba invadens
KDKRVTQQKYDNPSV

SEQ ID NO: 2868792 - protein, 7 aa, Entamoeba invadens
KDKSADV

SEQ ID NO: 2868793 - protein, 10 aa, Entamoeba invadens
KDKSATVRET

SEQ ID NO: 2868794 - protein, 7 aa, Entamoeba invadens
KDKSDEH

SEQ ID NO: 2868795 - protein, 8 aa, Entamoeba invadens
KDKSKTIT

SEQ ID NO: 2868796 - protein, 13 aa, Entamoeba invadens
KDKSLTYLLEQEQ

SEQ ID NO: 2868797 - protein, 9 aa, Entamoeba invadens
KDKSSDNKL

SEQ ID NO: 2868798 - protein, 13 aa, Entamoeba invadens
KDKSSSSETYSGL

SEQ ID NO: 2868799 - protein, 9 aa, Entamoeba invadens
KDKTDKLSK

SEQ ID NO: 2868800 - protein, 7 aa, Entamoeba invadens
KDKTELF

SEQ ID NO: 2868801 - protein, 18 aa, Entamoeba invadens
KDKTGNHNTNEPCVMRTI

SEQ ID NO: 2868802 - protein, 12 aa, Entamoeba invadens
KDKTIAEVLHTF

SEQ ID NO: 2868803 - protein, 5 aa, Entamoeba invadens
KDKTL

SEQ ID NO: 2868804 - protein, 8 aa, Entamoeba invadens
KDKTLESG

SEQ ID NO: 2868805 - protein, 9 aa, Entamoeba invadens
KDKTLGRNH

SEQ ID NO: 2868806 - protein, 8 aa, Entamoeba invadens
KDKTTANN

SEQ ID NO: 2868807 - protein, 9 aa, Entamoeba invadens
KDKTTFSQS

SEQ ID NO: 2868808 - protein, 14 aa, Entamoeba invadens
KDKVAEAGEKKPIL

SEQ ID NO: 2868809 - protein, 8 aa, Entamoeba invadens
KDKVPDLS

SEQ ID NO: 2868810 - protein, 19 aa, Entamoeba invadens
KDKVTLSTSPSTKVVMYNS

SEQ ID NO: 2868811 - protein, 23 aa, Entamoeba invadens
KDKYETPCQDDECKQCTENKNVS

SEQ ID NO: 2868812 - protein, 6 aa, Entamoeba invadens
KDKYGL

SEQ ID NO: 2868813 - protein, 7 aa, Entamoeba invadens
KDKYGLG

SEQ ID NO: 2868814 - protein, 8 aa, Entamoeba invadens
KDKYREAS

SEQ ID NO: 2868815 - protein, 18 aa, Entamoeba invadens
KDKYTAKKKTVKADSSTK

SEQ ID NO: 2868816 - protein, 7 aa, Entamoeba invadens
KDKYYGY

SEQ ID NO: 2868817 - protein, 24 aa, Entamoeba invadens
KDLAEEKEHRAKEIRSRCDKNEKK

SEQ ID NO: 2868818 - protein, 4 aa, Entamoeba invadens
KDLD

SEQ ID NO: 2868819 - protein, 10 aa, Entamoeba invadens
KDLDDKSVTT

SEQ ID NO: 2868820 - protein, 5 aa, Entamoeba invadens
KDLDE

SEQ ID NO: 2868821 - protein, 12 aa, Entamoeba invadens
KDLDKQNEKINE

SEQ ID NO: 2868822 - protein, 7 aa, Entamoeba invadens
KDLEDTR

SEQ ID NO: 2868823 - protein, 16 aa, Entamoeba invadens
KDLEELQTKKSSAAIR

SEQ ID NO: 2868824 - protein, 7 aa, Entamoeba invadens
KDLENGI

SEQ ID NO: 2868825 - protein, 8 aa, Entamoeba invadens
KDLENGYT

SEQ ID NO: 2868826 - protein, 17 aa, Entamoeba invadens
KDLENQIKEYEKQAKGL

SEQ ID NO: 2868827 - protein, 6 aa, Entamoeba invadens
KDLETA

SEQ ID NO: 2868828 - protein, 21 aa, Entamoeba invadens
KDLGTVKNTRGKDSKIKREPD

SEQ ID NO: 2868829 - protein, 7 aa, Entamoeba invadens
KDLGYTD

SEQ ID NO: 2868830 - protein, 4 aa, Entamoeba invadens
KDLK

SEQ ID NO: 2868831 - protein, 10 aa, Entamoeba invadens
KDLKASKEHK

SEQ ID NO: 2868832 - protein, 9 aa, Entamoeba invadens
KDLKCKTEN

SEQ ID NO: 2868833 - protein, 8 aa, Entamoeba invadens
KDLKNEEI

SEQ ID NO: 2868834 - protein, 15 aa, Entamoeba invadens
KDLKNEKLTEESKEN

SEQ ID NO: 2868835 - protein, 9 aa, Entamoeba invadens
KDLKQKKIV

SEQ ID NO: 2868836 - protein, 8 aa, Entamoeba invadens
KDLKQPQV

SEQ ID NO: 2868837 - protein, 5 aa, Entamoeba invadens
KDLND

SEQ ID NO: 2868838 - protein, 36 aa, Entamoeba invadens
KDLNEDSESDDVEEVTNNNKKMETEKSSPRESSSDD

SEQ ID NO: 2868839 - protein, 6 aa, Entamoeba invadens
KDLNYP

SEQ ID NO: 2868840 - protein, 7 aa, Entamoeba invadens
KDLPNEM

SEQ ID NO: 2868841 - protein, 14 aa, Entamoeba invadens
KDLPPPTDSQAYED

SEQ ID NO: 2868842 - protein, 8 aa, Entamoeba invadens
KDLPRTEI

SEQ ID NO: 2868843 - protein, 13 aa, Entamoeba invadens
KDLPSGPRVLPQE

SEQ ID NO: 2868844 - protein, 9 aa, Entamoeba invadens
KDLPSSLST

SEQ ID NO: 2868845 - protein, 4 aa, Entamoeba invadens
KDLQ

SEQ ID NO: 2868846 - protein, 8 aa, Entamoeba invadens
KDLQAANN

SEQ ID NO: 2868847 - protein, 5 aa, Entamoeba invadens
KDLQG

SEQ ID NO: 2868848 - protein, 10 aa, Entamoeba invadens
KDLQGTAYES

SEQ ID NO: 2868849 - protein, 8 aa, Entamoeba invadens
KDLQKEEG

SEQ ID NO: 2868850 - protein, 9 aa, Entamoeba invadens
KDLQSKDVE

SEQ ID NO: 2868851 - protein, 8 aa, Entamoeba invadens
KDLSELDN

SEQ ID NO: 2868852 - protein, 13 aa, Entamoeba invadens
KDLSGVKSEIEGW

SEQ ID NO: 2868853 - protein, 8 aa, Entamoeba invadens
KDLSKSRE

SEQ ID NO: 2868854 - protein, 4 aa, Entamoeba invadens
KDLT

SEQ ID NO: 2868855 - protein, 6 aa, Entamoeba invadens
KDLTDL

SEQ ID NO: 2868856 - protein, 9 aa, Entamoeba invadens
KDLTDYSPL

SEQ ID NO: 2868857 - protein, 9 aa, Entamoeba invadens
KDLTGEIEK

SEQ ID NO: 2868858 - protein, 9 aa, Entamoeba invadens
KDLTKDQRK

SEQ ID NO: 2868859 - protein, 8 aa, Entamoeba invadens
KDLTNRPE

SEQ ID NO: 2868860 - protein, 6 aa, Entamoeba invadens
KDLTPE

SEQ ID NO: 2868861 - protein, 11 aa, Entamoeba invadens
KDLTPEERKSM

SEQ ID NO: 2868862 - protein, 7 aa, Entamoeba invadens
KDLTPKL

SEQ ID NO: 2868863 - protein, 5 aa, Entamoeba invadens
KDMEG

SEQ ID NO: 2868864 - protein, 9 aa, Entamoeba invadens
KDMEGQTYE

SEQ ID NO: 2868865 - protein, 22 aa, Entamoeba invadens
KDMKEKALKAKEDKKKASKVAK

SEQ ID NO: 2868866 - protein, 23 aa, Entamoeba invadens
KDMKEKALKAKEDKKKSSKVAKK

SEQ ID NO: 2868867 - protein, 5 aa, Entamoeba invadens
KDMKG

SEQ ID NO: 2868868 - protein, 11 aa, Entamoeba invadens
KDMKKDRARDL

SEQ ID NO: 2868869 - protein, 5 aa, Entamoeba invadens
KDMKN

SEQ ID NO: 2868870 - protein, 8 aa, Entamoeba invadens
KDMSEEEE

SEQ ID NO: 2868871 - protein, 7 aa, Entamoeba invadens
KDNADPK

SEQ ID NO: 2868872 - protein, 7 aa, Entamoeba invadens
KDNAEAK

SEQ ID NO: 2868873 - protein, 8 aa, Entamoeba invadens
KDNASQDK

SEQ ID NO: 2868874 - protein, 7 aa, Entamoeba invadens
KDNATDF

SEQ ID NO: 2868875 - protein, 5 aa, Entamoeba invadens
KDNAY

SEQ ID NO: 2868876 - protein, 8 aa, Entamoeba invadens
KDNDDELS

SEQ ID NO: 2868877 - protein, 12 aa, Entamoeba invadens
KDNDGKITAEEL

SEQ ID NO: 2868878 - protein, 9 aa, Entamoeba invadens
KDNDKLVSK

SEQ ID NO: 2868879 - protein, 11 aa, Entamoeba invadens
KDNDKSAGEIT

SEQ ID NO: 2868880 - protein, 12 aa, Entamoeba invadens
KDNDNKDGAGED

SEQ ID NO: 2868881 - protein, 12 aa, Entamoeba invadens
KDNEGLVQSTES

SEQ ID NO: 2868882 - protein, 5 aa, Entamoeba invadens
KDNEM

SEQ ID NO: 2868883 - protein, 9 aa, Entamoeba invadens
KDNERAQEG

SEQ ID NO: 2868884 - protein, 19 aa, Entamoeba invadens
KDNESRFVESKSGEGKEEF

SEQ ID NO: 2868885 - protein, 5 aa, Entamoeba invadens
KDNET

SEQ ID NO: 2868886 - protein, 6 aa, Entamoeba invadens
KDNGAE

SEQ ID NO: 2868887 - protein, 40 aa, Entamoeba invadens
KDNGSKTENVTSDSSDTGENSPLARRTVSPRGMNGSSHMS

SEQ ID NO: 2868888 - protein, 4 aa, Entamoeba invadens
KDNI

SEQ ID NO: 2868889 - protein, 7 aa, Entamoeba invadens
KDNIENN

SEQ ID NO: 2868890 - protein, 6 aa, Entamoeba invadens
KDNIKI

SEQ ID NO: 2868891 - protein, 14 aa, Entamoeba invadens
KDNISDGTDSIDCD

SEQ ID NO: 2868892 - protein, 11 aa, Entamoeba invadens
KDNKDEKVDDE

SEQ ID NO: 2868893 - protein, 11 aa, Entamoeba invadens
KDNKDEKVDNQ

SEQ ID NO: 2868894 - protein, 7 aa, Entamoeba invadens
KDNKHAE

SEQ ID NO: 2868895 - protein, 7 aa, Entamoeba invadens
KDNKKDI

SEQ ID NO: 2868896 - protein, 16 aa, Entamoeba invadens
KDNKNIEQTTKVSSSD

SEQ ID NO: 2868897 - protein, 5 aa, Entamoeba invadens
KDNKS

SEQ ID NO: 2868898 - protein, 9 aa, Entamoeba invadens
KDNLERGNA

SEQ ID NO: 2868899 - protein, 5 aa, Entamoeba invadens
KDNLG

SEQ ID NO: 2868900 - protein, 5 aa, Entamoeba invadens
KDNME

SEQ ID NO: 2868901 - protein, 7 aa, Entamoeba invadens
KDNMSTT

SEQ ID NO: 2868902 - protein, 12 aa, Entamoeba invadens
KDNNEDDRVKRI

SEQ ID NO: 2868903 - protein, 30 aa, Entamoeba invadens
KDNNQSVIGKTESEKKNLEDTLNERTTELE

SEQ ID NO: 2868904 - protein, 8 aa, Entamoeba invadens
KDNNSKIG

SEQ ID NO: 2868905 - protein, 4 aa, Entamoeba invadens
KDNP

SEQ ID NO: 2868906 - protein, 5 aa, Entamoeba invadens
KDNPE

SEQ ID NO: 2868907 - protein, 11 aa, Entamoeba invadens
KDNPIPEGYEG

SEQ ID NO: 2868908 - protein, 9 aa, Entamoeba invadens
KDNPNFPDH

SEQ ID NO: 2868909 - protein, 6 aa, Entamoeba invadens
KDNPRV

SEQ ID NO: 2868910 - protein, 8 aa, Entamoeba invadens
KDNPSELK

SEQ ID NO: 2868911 - protein, 19 aa, Entamoeba invadens
KDNPTSRKERRQTRNDERD

SEQ ID NO: 2868912 - protein, 4 aa, Entamoeba invadens
KDNQ

SEQ ID NO: 2868913 - protein, 10 aa, Entamoeba invadens
KDNQSEEDYT

SEQ ID NO: 2868914 - protein, 8 aa, Entamoeba invadens
KDNREAEL

SEQ ID NO: 2868915 - protein, 5 aa, Entamoeba invadens
KDNRF

SEQ ID NO: 2868916 - protein, 6 aa, Entamoeba invadens
KDNSDV

SEQ ID NO: 2868917 - protein, 9 aa, Entamoeba invadens
KDNSFKGDH

SEQ ID NO: 2868918 - protein, 10 aa, Entamoeba invadens
KDNSKEEIDA

SEQ ID NO: 2868919 - protein, 6 aa, Entamoeba invadens
KDNSRI

SEQ ID NO: 2868920 - protein, 4 aa, Entamoeba invadens
KDNT

SEQ ID NO: 2868921 - protein, 9 aa, Entamoeba invadens
KDNTCTKNG

SEQ ID NO: 2868922 - protein, 18 aa, Entamoeba invadens
KDNTLSDEEILKKGIIEL

SEQ ID NO: 2868923 - protein, 5 aa, Entamoeba invadens
KDNTN

SEQ ID NO: 2868924 - protein, 8 aa, Entamoeba invadens
KDNTNGNY

SEQ ID NO: 2868925 - protein, 19 aa, Entamoeba invadens
KDNTQQSKTPSKTPSKKHR

SEQ ID NO: 2868926 - protein, 9 aa, Entamoeba invadens
KDNTTGKQQ

SEQ ID NO: 2868927 - protein, 38 aa, Entamoeba invadens
KDNTTSISSNEVQKKEVKKEVSGVEPSKKKFKDKKRPM

SEQ ID NO: 2868928 - protein, 16 aa, Entamoeba invadens
KDPAKRLTDPNNIKSE

SEQ ID NO: 2868929 - protein, 8 aa, Entamoeba invadens
KDPAQTNM

SEQ ID NO: 2868930 - protein, 6 aa, Entamoeba invadens
KDPAVD

SEQ ID NO: 2868931 - protein, 5 aa, Entamoeba invadens
KDPDL

SEQ ID NO: 2868932 - protein, 6 aa, Entamoeba invadens
KDPDLS

SEQ ID NO: 2868933 - protein, 5 aa, Entamoeba invadens
KDPDS

SEQ ID NO: 2868934 - protein, 9 aa, Entamoeba invadens
KDPEHPEEF

SEQ ID NO: 2868935 - protein, 8 aa, Entamoeba invadens
KDPEHPSV

SEQ ID NO: 2868936 - protein, 5 aa, Entamoeba invadens
KDPEI

SEQ ID NO: 2868937 - protein, 5 aa, Entamoeba invadens
KDPEL

SEQ ID NO: 2868938 - protein, 21 aa, Entamoeba invadens
KDPENKAKKEKARKSVEKAME

SEQ ID NO: 2868939 - protein, 10 aa, Entamoeba invadens
KDPENPEEFK

SEQ ID NO: 2868940 - protein, 9 aa, Entamoeba invadens
KDPETGDFN

SEQ ID NO: 2868941 - protein, 4 aa, Entamoeba invadens
KDPF

SEQ ID NO: 2868942 - protein, 6 aa, Entamoeba invadens
KDPFGK

SEQ ID NO: 2868943 - protein, 7 aa, Entamoeba invadens
KDPFTTA

SEQ ID NO: 2868944 - protein, 9 aa, Entamoeba invadens
KDPHKQQVD

SEQ ID NO: 2868945 - protein, 7 aa, Entamoeba invadens
KDPHPRV

SEQ ID NO: 2868946 - protein, 6 aa, Entamoeba invadens
KDPHVV

SEQ ID NO: 2868947 - protein, 7 aa, Entamoeba invadens
KDPIAAN

SEQ ID NO: 2868948 - protein, 7 aa, Entamoeba invadens
KDPKDEQ

SEQ ID NO: 2868949 - protein, 23 aa, Entamoeba invadens
KDPKGKTQKPKVIDRNNGKYDVK

SEQ ID NO: 2868950 - protein, 6 aa, Entamoeba invadens
KDPKNM

SEQ ID NO: 2868951 - protein, 8 aa, Entamoeba invadens
KDPKSPSC

SEQ ID NO: 2868952 - protein, 10 aa, Entamoeba invadens
KDPKVDTDEL

SEQ ID NO: 2868953 - protein, 4 aa, Entamoeba invadens
KDPL

SEQ ID NO: 2868954 - protein, 9 aa, Entamoeba invadens
KDPLATKDK

SEQ ID NO: 2868955 - protein, 6 aa, Entamoeba invadens
KDPLEL

SEQ ID NO: 2868956 - protein, 12 aa, Entamoeba invadens
KDPNADEDTITE

SEQ ID NO: 2868957 - protein, 14 aa, Entamoeba invadens
KDPNAEPIPPPPFP

SEQ ID NO: 2868958 - protein, 10 aa, Entamoeba invadens
KDPNDRLEGK

SEQ ID NO: 2868959 - protein, 10 aa, Entamoeba invadens
KDPNLKQAKE

SEQ ID NO: 2868960 - protein, 25 aa, Entamoeba invadens
KDPQAPPNATDIRDKTNYAGVSTSD

SEQ ID NO: 2868961 - protein, 5 aa, Entamoeba invadens
KDPQF

SEQ ID NO: 2868962 - protein, 5 aa, Entamoeba invadens
KDPQS

SEQ ID NO: 2868963 - protein, 6 aa, Entamoeba invadens
KDPRFR

SEQ ID NO: 2868964 - protein, 17 aa, Entamoeba invadens
KDPRGVAGRKRAFTTKK

SEQ ID NO: 2868965 - protein, 6 aa, Entamoeba invadens
KDPRYI

SEQ ID NO: 2868966 - protein, 6 aa, Entamoeba invadens
KDPSAG

SEQ ID NO: 2868967 - protein, 7 aa, Entamoeba invadens
KDPSIEP

SEQ ID NO: 2868968 - protein, 7 aa, Entamoeba invadens
KDPSSHV

SEQ ID NO: 2868969 - protein, 7 aa, Entamoeba invadens
KDPSVPI

SEQ ID NO: 2868970 - protein, 10 aa, Entamoeba invadens
KDPTDRLTDP

SEQ ID NO: 2868971 - protein, 5 aa, Entamoeba invadens
KDPTF

SEQ ID NO: 2868972 - protein, 6 aa, Entamoeba invadens
KDPTFS

SEQ ID NO: 2868973 - protein, 7 aa, Entamoeba invadens
KDPTHAN

SEQ ID NO: 2868974 - protein, 5 aa, Entamoeba invadens
KDPTI

SEQ ID NO: 2868975 - protein, 10 aa, Entamoeba invadens
KDPTKRPTAD

SEQ ID NO: 2868976 - protein, 12 aa, Entamoeba invadens
KDPTLTEKTVQR

SEQ ID NO: 2868977 - protein, 5 aa, Entamoeba invadens
KDPTN

SEQ ID NO: 2868978 - protein, 13 aa, Entamoeba invadens
KDPTTDKSKCEEA

SEQ ID NO: 2868979 - protein, 14 aa, Entamoeba invadens
KDPVAKLETKGKRV

SEQ ID NO: 2868980 - protein, 6 aa, Entamoeba invadens
KDPVAT

SEQ ID NO: 2868981 - protein, 5 aa, Entamoeba invadens
KDPVD

SEQ ID NO: 2868982 - protein, 5 aa, Entamoeba invadens
KDPVE

SEQ ID NO: 2868983 - protein, 8 aa, Entamoeba invadens
KDPVNAES

SEQ ID NO: 2868984 - protein, 14 aa, Entamoeba invadens
KDPVQRLTDPDQMK

SEQ ID NO: 2868985 - protein, 4 aa, Entamoeba invadens
KDPY

SEQ ID NO: 2868986 - protein, 4 aa, Entamoeba invadens
KDQA

SEQ ID NO: 2868987 - protein, 5 aa, Entamoeba invadens
KDQAE

SEQ ID NO: 2868988 - protein, 4 aa, Entamoeba invadens
KDQD

SEQ ID NO: 2868989 - protein, 22 aa, Entamoeba invadens
KDQDPMTVGSPQLNSPDSKQKL

SEQ ID NO: 2868990 - protein, 4 aa, Entamoeba invadens
KDQE

SEQ ID NO: 2868991 - protein, 17 aa, Entamoeba invadens
KDQEELKMSNPETLTKP

SEQ ID NO: 2868992 - protein, 8 aa, Entamoeba invadens
KDQERTSN

SEQ ID NO: 2868993 - protein, 6 aa, Entamoeba invadens
KDQFSD

SEQ ID NO: 2868994 - protein, 19 aa, Entamoeba invadens
KDQGGSGCNYNRTENTPEN

SEQ ID NO: 2868995 - protein, 17 aa, Entamoeba invadens
KDQGKSVTDLEESITTY

SEQ ID NO: 2868996 - protein, 6 aa, Entamoeba invadens
KDQGND

SEQ ID NO: 2868997 - protein, 14 aa, Entamoeba invadens
KDQHPKGSGNTLNM

SEQ ID NO: 2868998 - protein, 7 aa, Entamoeba invadens
KDQHQQT

SEQ ID NO: 2868999 - protein, 9 aa, Entamoeba invadens
KDQIGQVEP

SEQ ID NO: 2869000 - protein, 14 aa, Entamoeba invadens
KDQKEEIDVNGDTP

SEQ ID NO: 2869001 - protein, 10 aa, Entamoeba invadens
KDQKEKVKRA

SEQ ID NO: 2869002 - protein, 8 aa, Entamoeba invadens
KDQKQRVT

SEQ ID NO: 2869003 - protein, 8 aa, Entamoeba invadens
KDQKRNRC

SEQ ID NO: 2869004 - protein, 7 aa, Entamoeba invadens
KDQKSLN

SEQ ID NO: 2869005 - protein, 14 aa, Entamoeba invadens
KDQKSSFDSIRSTE

SEQ ID NO: 2869006 - protein, 15 aa, Entamoeba invadens
KDQLATQKKELEKLE

SEQ ID NO: 2869007 - protein, 12 aa, Entamoeba invadens
KDQLDQNEKTQF

SEQ ID NO: 2869008 - protein, 7 aa, Entamoeba invadens
KDQLGNT

SEQ ID NO: 2869009 - protein, 8 aa, Entamoeba invadens
KDQLNSQY

SEQ ID NO: 2869010 - protein, 5 aa, Entamoeba invadens
KDQNA

SEQ ID NO: 2869011 - protein, 8 aa, Entamoeba invadens
KDQNEENA

SEQ ID NO: 2869012 - protein, 17 aa, Entamoeba invadens
KDQNTQLDAANKDIKKQ

SEQ ID NO: 2869013 - protein, 7 aa, Entamoeba invadens
KDQNVRA

SEQ ID NO: 2869014 - protein, 9 aa, Entamoeba invadens
KDQQGSRKI

SEQ ID NO: 2869015 - protein, 9 aa, Entamoeba invadens
KDQQGSRRI

SEQ ID NO: 2869016 - protein, 19 aa, Entamoeba invadens
KDQRGKEKCPNKNSKCEQY

SEQ ID NO: 2869017 - protein, 13 aa, Entamoeba invadens
KDQRRLLANYAGS

SEQ ID NO: 2869018 - protein, 4 aa, Entamoeba invadens
KDQS

SEQ ID NO: 2869019 - protein, 19 aa, Entamoeba invadens
KDQSADLDTSKVKEIAEKK

SEQ ID NO: 2869020 - protein, 9 aa, Entamoeba invadens
KDQTNEDDM

SEQ ID NO: 2869021 - protein, 25 aa, Entamoeba invadens
KDQTSITEYREPNDYPPVKFQDELN

SEQ ID NO: 2869022 - protein, 7 aa, Entamoeba invadens
KDQVRNK

SEQ ID NO: 2869023 - protein, 14 aa, Entamoeba invadens
KDRATYYSTTEGNK

SEQ ID NO: 2869024 - protein, 6 aa, Entamoeba invadens
KDRCEK

SEQ ID NO: 2869025 - protein, 6 aa, Entamoeba invadens
KDRDAL

SEQ ID NO: 2869026 - protein, 5 aa, Entamoeba invadens
KDRDI

SEQ ID NO: 2869027 - protein, 6 aa, Entamoeba invadens
KDRDQV

SEQ ID NO: 2869028 - protein, 18 aa, Entamoeba invadens
KDRDSKDIPDTKKGGLSK

SEQ ID NO: 2869029 - protein, 13 aa, Entamoeba invadens
KDREGSKSDETCT

SEQ ID NO: 2869030 - protein, 6 aa, Entamoeba invadens
KDREKM

SEQ ID NO: 2869031 - protein, 7 aa, Entamoeba invadens
KDRENSG

SEQ ID NO: 2869032 - protein, 9 aa, Entamoeba invadens
KDRETTVQP

SEQ ID NO: 2869033 - protein, 7 aa, Entamoeba invadens
KDRGETD

SEQ ID NO: 2869034 - protein, 25 aa, Entamoeba invadens
KDRHEEQKKGKELRQKKAEQRMRKK

SEQ ID NO: 2869035 - protein, 10 aa, Entamoeba invadens
KDRKAETEKI

SEQ ID NO: 2869036 - protein, 10 aa, Entamoeba invadens
KDRKDSQDQL

SEQ ID NO: 2869037 - protein, 6 aa, Entamoeba invadens
KDRKRR

SEQ ID NO: 2869038 - protein, 17 aa, Entamoeba invadens
KDRLTKKKKKTETVKTS

SEQ ID NO: 2869039 - protein, 14 aa, Entamoeba invadens
KDRPVGTSNIDQTE

SEQ ID NO: 2869040 - protein, 10 aa, Entamoeba invadens
KDRRKPGRRG

SEQ ID NO: 2869041 - protein, 8 aa, Entamoeba invadens
KDRRTADD

SEQ ID NO: 2869042 - protein, 8 aa, Entamoeba invadens
KDRRTVTK

SEQ ID NO: 2869043 - protein, 6 aa, Entamoeba invadens
KDRSDA

SEQ ID NO: 2869044 - protein, 7 aa, Entamoeba invadens
KDRSQQK

SEQ ID NO: 2869045 - protein, 25 aa, Entamoeba invadens
KDRTPATPKDLSTLRKDTSQLPTNC

SEQ ID NO: 2869046 - protein, 7 aa, Entamoeba invadens
KDRVDNA

SEQ ID NO: 2869047 - protein, 15 aa, Entamoeba invadens
KDRVDSVNNVNSVNT

SEQ ID NO: 2869048 - protein, 47 aa, Entamoeba invadens
KDRYRDVRDDRRDDRREPSDKKPLRPLRDDDDRRSVHRNSPDYREPR

SEQ ID NO: 2869049 - protein, 15 aa, Entamoeba invadens
KDSAPRRSAKEISRP

SEQ ID NO: 2869050 - protein, 5 aa, Entamoeba invadens
KDSDI

SEQ ID NO: 2869051 - protein, 70 aa, Entamoeba invadens
KDSDKDEEEEDDFSDGEDLLDQSEKTKEVAEGDCESEKKDREDGKIEQIKEEKSEKKTVVSQEPSKGSHI

SEQ ID NO: 2869052 - protein, 8 aa, Entamoeba invadens
KDSDPYVR

SEQ ID NO: 2869053 - protein, 24 aa, Entamoeba invadens
KDSEELKKQQTKEDSEEQKKTIPT

SEQ ID NO: 2869054 - protein, 8 aa, Entamoeba invadens
KDSEKDTI

SEQ ID NO: 2869055 - protein, 23 aa, Entamoeba invadens
KDSEQKIKSPRNSDKAKQKPLKV

SEQ ID NO: 2869056 - protein, 10 aa, Entamoeba invadens
KDSETNGKPD

SEQ ID NO: 2869057 - protein, 6 aa, Entamoeba invadens
KDSFNG

SEQ ID NO: 2869058 - protein, 5 aa, Entamoeba invadens
KDSGV

SEQ ID NO: 2869059 - protein, 13 aa, Entamoeba invadens
KDSIKQLNKFFKI

SEQ ID NO: 2869060 - protein, 25 aa, Entamoeba invadens
KDSITKATDNTTGKKNEINTSFPYS

SEQ ID NO: 2869061 - protein, 8 aa, Entamoeba invadens
KDSKKRPL

SEQ ID NO: 2869062 - protein, 21 aa, Entamoeba invadens
KDSKQGFIKKENKKKNIRTAP

SEQ ID NO: 2869063 - protein, 8 aa, Entamoeba invadens
KDSKQQKV

SEQ ID NO: 2869064 - protein, 10 aa, Entamoeba invadens
KDSKRGEQWR

SEQ ID NO: 2869065 - protein, 19 aa, Entamoeba invadens
KDSKRNSELPSDAATEAGY

SEQ ID NO: 2869066 - protein, 13 aa, Entamoeba invadens
KDSKTMKMTSNYN

SEQ ID NO: 2869067 - protein, 13 aa, Entamoeba invadens
KDSLGDKKDTIDD

SEQ ID NO: 2869068 - protein, 6 aa, Entamoeba invadens
KDSLNS

SEQ ID NO: 2869069 - protein, 13 aa, Entamoeba invadens
KDSLRKNTLSDDN

SEQ ID NO: 2869070 - protein, 17 aa, Entamoeba invadens
KDSMTDLDKNKPTEEMC

SEQ ID NO: 2869071 - protein, 54 aa, Entamoeba invadens
KDSNAKVDKAQKQLDTTNDDKDGNEAMKQKYQDELKSVRTELDQEKKDHSKTQL

SEQ ID NO: 2869072 - protein, 8 aa, Entamoeba invadens
KDSNDQKV

SEQ ID NO: 2869073 - protein, 8 aa, Entamoeba invadens
KDSNDYDS

SEQ ID NO: 2869074 - protein, 13 aa, Entamoeba invadens
KDSNEALGEVGEG

SEQ ID NO: 2869075 - protein, 8 aa, Entamoeba invadens
KDSNEIQS

SEQ ID NO: 2869076 - protein, 6 aa, Entamoeba invadens
KDSNEL

SEQ ID NO: 2869077 - protein, 5 aa, Entamoeba invadens
KDSNF

SEQ ID NO: 2869078 - protein, 7 aa, Entamoeba invadens
KDSNFKD

SEQ ID NO: 2869079 - protein, 6 aa, Entamoeba invadens
KDSNRA

SEQ ID NO: 2869080 - protein, 9 aa, Entamoeba invadens
KDSNSNSEV

SEQ ID NO: 2869081 - protein, 7 aa, Entamoeba invadens
KDSNVDL

SEQ ID NO: 2869082 - protein, 5 aa, Entamoeba invadens
KDSPN

SEQ ID NO: 2869083 - protein, 8 aa, Entamoeba invadens
KDSPPFED

SEQ ID NO: 2869084 - protein, 9 aa, Entamoeba invadens
KDSPPGEFN

SEQ ID NO: 2869085 - protein, 6 aa, Entamoeba invadens
KDSQDM

SEQ ID NO: 2869086 - protein, 13 aa, Entamoeba invadens
KDSQHEVLRWLRG

SEQ ID NO: 2869087 - protein, 11 aa, Entamoeba invadens
KDSQIDQKPTM

SEQ ID NO: 2869088 - protein, 7 aa, Entamoeba invadens
KDSQQRA

SEQ ID NO: 2869089 - protein, 6 aa, Entamoeba invadens
KDSQRS

SEQ ID NO: 2869090 - protein, 11 aa, Entamoeba invadens
KDSRTPSQTSS

SEQ ID NO: 2869091 - protein, 4 aa, Entamoeba invadens
KDSS

SEQ ID NO: 2869092 - protein, 9 aa, Entamoeba invadens
KDSSNSLEL

SEQ ID NO: 2869093 - protein, 18 aa, Entamoeba invadens
KDSSVKLSKSEADLRTYS

SEQ ID NO: 2869094 - protein, 8 aa, Entamoeba invadens
KDSSVPQL

SEQ ID NO: 2869095 - protein, 8 aa, Entamoeba invadens
KDSSVVDP

SEQ ID NO: 2869096 - protein, 5 aa, Entamoeba invadens
KDSSY

SEQ ID NO: 2869097 - protein, 9 aa, Entamoeba invadens
KDSTADLKD

SEQ ID NO: 2869098 - protein, 9 aa, Entamoeba invadens
KDSTDTNPL

SEQ ID NO: 2869099 - protein, 7 aa, Entamoeba invadens
KDSTLNG

SEQ ID NO: 2869100 - protein, 6 aa, Entamoeba invadens
KDSTNA

SEQ ID NO: 2869101 - protein, 26 aa, Entamoeba invadens
KDSTPKNSSLRPKTLLSPKKDDVPPL

SEQ ID NO: 2869102 - protein, 7 aa, Entamoeba invadens
KDSTQKM

SEQ ID NO: 2869103 - protein, 4 aa, Entamoeba invadens
KDSV

SEQ ID NO: 2869104 - protein, 14 aa, Entamoeba invadens
KDSVDDDDAANVEK

SEQ ID NO: 2869105 - protein, 7 aa, Entamoeba invadens
KDSVDDE

SEQ ID NO: 2869106 - protein, 8 aa, Entamoeba invadens
KDTAGQTA

SEQ ID NO: 2869107 - protein, 7 aa, Entamoeba invadens
KDTAQTV

SEQ ID NO: 2869108 - protein, 6 aa, Entamoeba invadens
KDTASA

SEQ ID NO: 2869109 - protein, 8 aa, Entamoeba invadens
KDTDEPTT

SEQ ID NO: 2869110 - protein, 11 aa, Entamoeba invadens
KDTEKKHIDDY

SEQ ID NO: 2869111 - protein, 7 aa, Entamoeba invadens
KDTEKVE

SEQ ID NO: 2869112 - protein, 6 aa, Entamoeba invadens
KDTELG

SEQ ID NO: 2869113 - protein, 9 aa, Entamoeba invadens
KDTEQSKRS

SEQ ID NO: 2869114 - protein, 12 aa, Entamoeba invadens
KDTGSKAPLMKR

SEQ ID NO: 2869115 - protein, 11 aa, Entamoeba invadens
KDTHVDPEIQS

SEQ ID NO: 2869116 - protein, 4 aa, Entamoeba invadens
KDTK

SEQ ID NO: 2869117 - protein, 5 aa, Entamoeba invadens
KDTKA

SEQ ID NO: 2869118 - protein, 7 aa, Entamoeba invadens
KDTKEEE

SEQ ID NO: 2869119 - protein, 8 aa, Entamoeba invadens
KDTKEERN

SEQ ID NO: 2869120 - protein, 6 aa, Entamoeba invadens
KDTKEH

SEQ ID NO: 2869121 - protein, 7 aa, Entamoeba invadens
KDTKGRV

SEQ ID NO: 2869122 - protein, 8 aa, Entamoeba invadens
KDTKRAEL

SEQ ID NO: 2869123 - protein, 17 aa, Entamoeba invadens
KDTKRAELRERAGRTDQ

SEQ ID NO: 2869124 - protein, 9 aa, Entamoeba invadens
KDTKTSADF

SEQ ID NO: 2869125 - protein, 11 aa, Entamoeba invadens
KDTLDTIPEDT

SEQ ID NO: 2869126 - protein, 6 aa, Entamoeba invadens
KDTLQT

SEQ ID NO: 2869127 - protein, 5 aa, Entamoeba invadens
KDTMY

SEQ ID NO: 2869128 - protein, 5 aa, Entamoeba invadens
KDTNA

SEQ ID NO: 2869129 - protein, 7 aa, Entamoeba invadens
KDTNESY

SEQ ID NO: 2869130 - protein, 6 aa, Entamoeba invadens
KDTNET

SEQ ID NO: 2869131 - protein, 5 aa, Entamoeba invadens
KDTNG

SEQ ID NO: 2869132 - protein, 7 aa, Entamoeba invadens
KDTNISG

SEQ ID NO: 2869133 - protein, 7 aa, Entamoeba invadens
KDTNKLI

SEQ ID NO: 2869134 - protein, 8 aa, Entamoeba invadens
KDTPDGPV

SEQ ID NO: 2869135 - protein, 7 aa, Entamoeba invadens
KDTPEEA

SEQ ID NO: 2869136 - protein, 7 aa, Entamoeba invadens
KDTPEEY

SEQ ID NO: 2869137 - protein, 8 aa, Entamoeba invadens
KDTPEVDE

SEQ ID NO: 2869138 - protein, 8 aa, Entamoeba invadens
KDTPIEQT

SEQ ID NO: 2869139 - protein, 16 aa, Entamoeba invadens
KDTPNGRAIPEQKQED

SEQ ID NO: 2869140 - protein, 48 aa, Entamoeba invadens
KDTPPTKPTRSRSYSAERHRANSRHSSAGSSRTRTKSRPLSPSPSFDF

SEQ ID NO: 2869141 - protein, 6 aa, Entamoeba invadens
KDTQDL

SEQ ID NO: 2869142 - protein, 11 aa, Entamoeba invadens
KDTQEDERQKI

SEQ ID NO: 2869143 - protein, 6 aa, Entamoeba invadens
KDTQRR

SEQ ID NO: 2869144 - protein, 16 aa, Entamoeba invadens
KDTRSALSKKKEAENI

SEQ ID NO: 2869145 - protein, 5 aa, Entamoeba invadens
KDTSA

SEQ ID NO: 2869146 - protein, 7 aa, Entamoeba invadens
KDTTENS

SEQ ID NO: 2869147 - protein, 21 aa, Entamoeba invadens
KDTTENSSSDVGNVTDTRKEC

SEQ ID NO: 2869148 - protein, 22 aa, Entamoeba invadens
KDTTGLNENKELRAKRLMVVQM

SEQ ID NO: 2869149 - protein, 10 aa, Entamoeba invadens
KDTTGNGFGD

SEQ ID NO: 2869150 - protein, 5 aa, Entamoeba invadens
KDTTI

SEQ ID NO: 2869151 - protein, 10 aa, Entamoeba invadens
KDTTLSTTKN

SEQ ID NO: 2869152 - protein, 7 aa, Entamoeba invadens
KDTTPQY

SEQ ID NO: 2869153 - protein, 5 aa, Entamoeba invadens
KDTTQ

SEQ ID NO: 2869154 - protein, 8 aa, Entamoeba invadens
KDTVGRTY

SEQ ID NO: 2869155 - protein, 8 aa, Entamoeba invadens
KDTVRNQD

SEQ ID NO: 2869156 - protein, 7 aa, Entamoeba invadens
KDTWKNV

SEQ ID NO: 2869157 - protein, 7 aa, Entamoeba invadens
KDVADRL

SEQ ID NO: 2869158 - protein, 12 aa, Entamoeba invadens
KDVANKDEQTEL

SEQ ID NO: 2869159 - protein, 12 aa, Entamoeba invadens
KDVARTDNTHPK

SEQ ID NO: 2869160 - protein, 18 aa, Entamoeba invadens
KDVDDTNSMNGETSFKSD

SEQ ID NO: 2869161 - protein, 7 aa, Entamoeba invadens
KDVEEGE

SEQ ID NO: 2869162 - protein, 7 aa, Entamoeba invadens
KDVEERV

SEQ ID NO: 2869163 - protein, 13 aa, Entamoeba invadens
KDVEFDASRSYTI

SEQ ID NO: 2869164 - protein, 17 aa, Entamoeba invadens
KDVEGGCSEKTAARRQE

SEQ ID NO: 2869165 - protein, 5 aa, Entamoeba invadens
KDVEK

SEQ ID NO: 2869166 - protein, 8 aa, Entamoeba invadens
KDVENKTL

SEQ ID NO: 2869167 - protein, 16 aa, Entamoeba invadens
KDVESEVNDSQNDTFE

SEQ ID NO: 2869168 - protein, 37 aa, Entamoeba invadens
KDVFGEGGPELLDEEKQKKDVDDEDDSKTPKSKDDLQ

SEQ ID NO: 2869169 - protein, 4 aa, Entamoeba invadens
KDVG

SEQ ID NO: 2869170 - protein, 6 aa, Entamoeba invadens
KDVGKT

SEQ ID NO: 2869171 - protein, 7 aa, Entamoeba invadens
KDVGKTT

SEQ ID NO: 2869172 - protein, 5 aa, Entamoeba invadens
KDVGN

SEQ ID NO: 2869173 - protein, 9 aa, Entamoeba invadens
KDVGRTPIE

SEQ ID NO: 2869174 - protein, 8 aa, Entamoeba invadens
KDVGTPKY

SEQ ID NO: 2869175 - protein, 5 aa, Entamoeba invadens
KDVID

SEQ ID NO: 2869176 - protein, 7 aa, Entamoeba invadens
KDVIEPR

SEQ ID NO: 2869177 - protein, 20 aa, Entamoeba invadens
KDVKKMEEEKVKKDEDDVVK

SEQ ID NO: 2869178 - protein, 19 aa, Entamoeba invadens
KDVKNRSSDTTISSRRTRA

SEQ ID NO: 2869179 - protein, 7 aa, Entamoeba invadens
KDVKSLR

SEQ ID NO: 2869180 - protein, 4 aa, Entamoeba invadens
KDVN

SEQ ID NO: 2869181 - protein, 6 aa, Entamoeba invadens
KDVNSL

SEQ ID NO: 2869182 - protein, 32 aa, Entamoeba invadens
KDVNTTNDRLKDLKKKTKKATKAHNEKKAKKS

SEQ ID NO: 2869183 - protein, 4 aa, Entamoeba invadens
KDVP

SEQ ID NO: 2869184 - protein, 5 aa, Entamoeba invadens
KDVPL

SEQ ID NO: 2869185 - protein, 23 aa, Entamoeba invadens
KDVPNAQTTQTETSTQPQPNTQV

SEQ ID NO: 2869186 - protein, 6 aa, Entamoeba invadens
KDVPSD

SEQ ID NO: 2869187 - protein, 6 aa, Entamoeba invadens
KDVQIA

SEQ ID NO: 2869188 - protein, 28 aa, Entamoeba invadens
KDVQKALSQLEKKEKELAEMKEESDKHI

SEQ ID NO: 2869189 - protein, 17 aa, Entamoeba invadens
KDVQKKDKKDDKKEKKK

SEQ ID NO: 2869190 - protein, 7 aa, Entamoeba invadens
KDVQTKI

SEQ ID NO: 2869191 - protein, 10 aa, Entamoeba invadens
KDVQTRNNKD

SEQ ID NO: 2869192 - protein, 4 aa, Entamoeba invadens
KDVR

SEQ ID NO: 2869193 - protein, 5 aa, Entamoeba invadens
KDVRE

SEQ ID NO: 2869194 - protein, 6 aa, Entamoeba invadens
KDVREE

SEQ ID NO: 2869195 - protein, 22 aa, Entamoeba invadens
KDVRRTDSKLEKFKNPRNTEKL

SEQ ID NO: 2869196 - protein, 8 aa, Entamoeba invadens
KDVSKNAL

SEQ ID NO: 2869197 - protein, 6 aa, Entamoeba invadens
KDVSRM

SEQ ID NO: 2869198 - protein, 18 aa, Entamoeba invadens
KDVTNDDTHFSRNVCKMY

SEQ ID NO: 2869199 - protein, 13 aa, Entamoeba invadens
KDVTRDLQTEQEI

SEQ ID NO: 2869200 - protein, 10 aa, Entamoeba invadens
KDVTRTDNNK

SEQ ID NO: 2869201 - protein, 9 aa, Entamoeba invadens
KDVTSGWGK

SEQ ID NO: 2869202 - protein, 9 aa, Entamoeba invadens
KDVVPESPR

SEQ ID NO: 2869203 - protein, 13 aa, Entamoeba invadens
KDVVRNQNKAKAE

SEQ ID NO: 2869204 - protein, 5 aa, Entamoeba invadens
KDVYG

SEQ ID NO: 2869205 - protein, 9 aa, Entamoeba invadens
KDWNSGDTL

SEQ ID NO: 2869206 - protein, 15 aa, Entamoeba invadens
KDYEENGIGIVDRRC

SEQ ID NO: 2869207 - protein, 6 aa, Entamoeba invadens
KDYEGK

SEQ ID NO: 2869208 - protein, 10 aa, Entamoeba invadens
KDYERKDYNG

SEQ ID NO: 2869209 - protein, 14 aa, Entamoeba invadens
KDYGVKEEKYDPTR

SEQ ID NO: 2869210 - protein, 13 aa, Entamoeba invadens
KDYKPSEADPEQA

SEQ ID NO: 2869211 - protein, 6 aa, Entamoeba invadens
KDYLET

SEQ ID NO: 2869212 - protein, 17 aa, Entamoeba invadens
KDYLETGDFKYDKSKKL

SEQ ID NO: 2869213 - protein, 6 aa, Entamoeba invadens
KDYMTP

SEQ ID NO: 2869214 - protein, 5 aa, Entamoeba invadens
KDYPK

SEQ ID NO: 2869215 - protein, 10 aa, Entamoeba invadens
KDYPNNPPKM

SEQ ID NO: 2869216 - protein, 8 aa, Entamoeba invadens
KDYSNALN

SEQ ID NO: 2869217 - protein, 7 aa, Entamoeba invadens
KDYSTAH

SEQ ID NO: 2869218 - protein, 5 aa, Entamoeba invadens
KDYVE

SEQ ID NO: 2869219 - protein, 6 aa, Entamoeba invadens
KDYYNY

SEQ ID NO: 2869220 - protein, 30 aa, Entamoeba invadens
KEAADEAKKKQSEVERNQLTSVRSKEPQLR

SEQ ID NO: 2869221 - protein, 15 aa, Entamoeba invadens
KEAAENDWFGSKNKS

SEQ ID NO: 2869222 - protein, 17 aa, Entamoeba invadens
KEAAKKSKVPKSSQPVI

SEQ ID NO: 2869223 - protein, 7 aa, Entamoeba invadens
KEAAQAL

SEQ ID NO: 2869224 - protein, 15 aa, Entamoeba invadens
KEADDSIHFRSFSSS

SEQ ID NO: 2869225 - protein, 22 aa, Entamoeba invadens
KEADEAMKTPEDAVVDSSKQEV

SEQ ID NO: 2869226 - protein, 18 aa, Entamoeba invadens
KEADEAMKTPENMTAKRQ

SEQ ID NO: 2869227 - protein, 12 aa, Entamoeba invadens
KEADEVSANAYA

SEQ ID NO: 2869228 - protein, 7 aa, Entamoeba invadens
KEADGHL

SEQ ID NO: 2869229 - protein, 5 aa, Entamoeba invadens
KEADK

SEQ ID NO: 2869230 - protein, 7 aa, Entamoeba invadens
KEADPMD

SEQ ID NO: 2869231 - protein, 6 aa, Entamoeba invadens
KEADTL

SEQ ID NO: 2869232 - protein, 7 aa, Entamoeba invadens
KEAEGYD

SEQ ID NO: 2869233 - protein, 7 aa, Entamoeba invadens
KEAEKVN

SEQ ID NO: 2869234 - protein, 17 aa, Entamoeba invadens
KEAERTDTKALKIEKES

SEQ ID NO: 2869235 - protein, 16 aa, Entamoeba invadens
KEAESTLSSLKANYDT

SEQ ID NO: 2869236 - protein, 65 aa, Entamoeba invadens
KEAFGYSDDEMSEDEEPYSSNESNEKKMSEDDENDENDENESENNEEEEGNGEIKENEEEDEADQ

SEQ ID NO: 2869237 - protein, 12 aa, Entamoeba invadens
KEAGLDGMTGSS

SEQ ID NO: 2869238 - protein, 6 aa, Entamoeba invadens
KEAGSL

SEQ ID NO: 2869239 - protein, 10 aa, Entamoeba invadens
KEAIKAKDDN

SEQ ID NO: 2869240 - protein, 11 aa, Entamoeba invadens
KEAIKQSTTPV

SEQ ID NO: 2869241 - protein, 21 aa, Entamoeba invadens
KEAINTAEEPTESPPQKRGVV

SEQ ID NO: 2869242 - protein, 6 aa, Entamoeba invadens
KEAKKH

SEQ ID NO: 2869243 - protein, 10 aa, Entamoeba invadens
KEAKNSVDEQ

SEQ ID NO: 2869244 - protein, 11 aa, Entamoeba invadens
KEAKQQQEKQK

SEQ ID NO: 2869245 - protein, 103 aa, Entamoeba invadens
KEAKRAELKAQRASERKERDDLEKKRKKVQPEETETDGKKPKYEKDERVPKKPTKREDYKKSDFKPSYNDRKSDFKERGGYKEKAPNKEHYDTKPKKERKVIK

SEQ ID NO: 2869246 - protein, 15 aa, Entamoeba invadens
KEAKRAKRESDIIEE

SEQ ID NO: 2869247 - protein, 14 aa, Entamoeba invadens
KEAKTIKKEDEDIE

SEQ ID NO: 2869248 - protein, 6 aa, Entamoeba invadens
KEALNI

SEQ ID NO: 2869249 - protein, 13 aa, Entamoeba invadens
KEANKTKARDETV

SEQ ID NO: 2869250 - protein, 9 aa, Entamoeba invadens
KEANLSSDN

SEQ ID NO: 2869251 - protein, 6 aa, Entamoeba invadens
KEANNV

SEQ ID NO: 2869252 - protein, 12 aa, Entamoeba invadens
KEAPIEKTEEYK

SEQ ID NO: 2869253 - protein, 16 aa, Entamoeba invadens
KEAPKFQTASQKRTIN

SEQ ID NO: 2869254 - protein, 14 aa, Entamoeba invadens
KEAPPRLSKDNCSV

SEQ ID NO: 2869255 - protein, 11 aa, Entamoeba invadens
KEAQAKLNGCT

SEQ ID NO: 2869256 - protein, 8 aa, Entamoeba invadens
KEAQPSTK

SEQ ID NO: 2869257 - protein, 6 aa, Entamoeba invadens
KEARKV

SEQ ID NO: 2869258 - protein, 29 aa, Entamoeba invadens
KEASPSSPSTNSPSTDNSHNTSFSKNPMG

SEQ ID NO: 2869259 - protein, 6 aa, Entamoeba invadens
KEASQQ

SEQ ID NO: 2869260 - protein, 34 aa, Entamoeba invadens
KEASSGRQIAGRKKSSSDANETTEPNASHGSHLC

SEQ ID NO: 2869261 - protein, 12 aa, Entamoeba invadens
KEATDKLTGYKD

SEQ ID NO: 2869262 - protein, 14 aa, Entamoeba invadens
KEATENNNCGDSDE

SEQ ID NO: 2869263 - protein, 12 aa, Entamoeba invadens
KEATKSENKGKT

SEQ ID NO: 2869264 - protein, 20 aa, Entamoeba invadens
KEATRTNTKKVGGRKPRLPF

SEQ ID NO: 2869265 - protein, 24 aa, Entamoeba invadens
KEAVPKIKSKSKDPVVNAKADTLQ

SEQ ID NO: 2869266 - protein, 7 aa, Entamoeba invadens
KEAVPPN

SEQ ID NO: 2869267 - protein, 5 aa, Entamoeba invadens
KEAVQ

SEQ ID NO: 2869268 - protein, 5 aa, Entamoeba invadens
KEAVR

SEQ ID NO: 2869269 - protein, 10 aa, Entamoeba invadens
KEAVSDARKR

SEQ ID NO: 2869270 - protein, 7 aa, Entamoeba invadens
KEAVTKS

SEQ ID NO: 2869271 - protein, 7 aa, Entamoeba invadens
KEAWSNS

SEQ ID NO: 2869272 - protein, 8 aa, Entamoeba invadens
KECAGNDI

SEQ ID NO: 2869273 - protein, 8 aa, Entamoeba invadens
KECENSNE

SEQ ID NO: 2869274 - protein, 15 aa, Entamoeba invadens
KECERPTHAASAEPK

SEQ ID NO: 2869275 - protein, 4 aa, Entamoeba invadens
KECG

SEQ ID NO: 2869276 - protein, 6 aa, Entamoeba invadens
KECKEI

SEQ ID NO: 2869277 - protein, 8 aa, Entamoeba invadens
KECNKDIE

SEQ ID NO: 2869278 - protein, 9 aa, Entamoeba invadens
KECPAKKAY

SEQ ID NO: 2869279 - protein, 11 aa, Entamoeba invadens
KECRERLPEQL

SEQ ID NO: 2869280 - protein, 4 aa, Entamoeba invadens
KECS

SEQ ID NO: 2869281 - protein, 12 aa, Entamoeba invadens
KECSERKTQKEY

SEQ ID NO: 2869282 - protein, 5 aa, Entamoeba invadens
KECVT

SEQ ID NO: 2869283 - protein, 17 aa, Entamoeba invadens
KEDAGCDEVSNGKCASC

SEQ ID NO: 2869284 - protein, 23 aa, Entamoeba invadens
KEDAKVGTAVVPKGEKVTIGAKP

SEQ ID NO: 2869285 - protein, 23 aa, Entamoeba invadens
KEDARKSGRKHTDELKKADTELA

SEQ ID NO: 2869286 - protein, 9 aa, Entamoeba invadens
KEDDDVNGT

SEQ ID NO: 2869287 - protein, 8 aa, Entamoeba invadens
KEDDEDLD

SEQ ID NO: 2869288 - protein, 7 aa, Entamoeba invadens
KEDDEKV

SEQ ID NO: 2869289 - protein, 16 aa, Entamoeba invadens
KEDDFESEGVDEGECQ

SEQ ID NO: 2869290 - protein, 6 aa, Entamoeba invadens
KEDDNK

SEQ ID NO: 2869291 - protein, 7 aa, Entamoeba invadens
KEDDTDV

SEQ ID NO: 2869292 - protein, 7 aa, Entamoeba invadens
KEDDTND

SEQ ID NO: 2869293 - protein, 8 aa, Entamoeba invadens
KEDEAGEE

SEQ ID NO: 2869294 - protein, 8 aa, Entamoeba invadens
KEDEAREE

SEQ ID NO: 2869295 - protein, 8 aa, Entamoeba invadens
KEDEEATV

SEQ ID NO: 2869296 - protein, 10 aa, Entamoeba invadens
KEDEEKMEQR

SEQ ID NO: 2869297 - protein, 12 aa, Entamoeba invadens
KEDEHEDNKYPH

SEQ ID NO: 2869298 - protein, 5 aa, Entamoeba invadens
KEDEI

SEQ ID NO: 2869299 - protein, 8 aa, Entamoeba invadens
KEDEIQIS

SEQ ID NO: 2869300 - protein, 18 aa, Entamoeba invadens
KEDEKAAEKGNSDKTTLF

SEQ ID NO: 2869301 - protein, 23 aa, Entamoeba invadens
KEDEKKGEKKYSLTDTSTNGTYL

SEQ ID NO: 2869302 - protein, 12 aa, Entamoeba invadens
KEDEKKSREMWE

SEQ ID NO: 2869303 - protein, 11 aa, Entamoeba invadens
KEDEKVNKQRR

SEQ ID NO: 2869304 - protein, 5 aa, Entamoeba invadens
KEDEL

SEQ ID NO: 2869305 - protein, 6 aa, Entamoeba invadens
KEDENR

SEQ ID NO: 2869306 - protein, 7 aa, Entamoeba invadens
KEDENRF

SEQ ID NO: 2869307 - protein, 6 aa, Entamoeba invadens
KEDEPF

SEQ ID NO: 2869308 - protein, 12 aa, Entamoeba invadens
KEDEQEDKATKV

SEQ ID NO: 2869309 - protein, 6 aa, Entamoeba invadens
KEDESF

SEQ ID NO: 2869310 - protein, 21 aa, Entamoeba invadens
KEDESLSNVMSDDDDESQKYY

SEQ ID NO: 2869311 - protein, 7 aa, Entamoeba invadens
KEDETFG

SEQ ID NO: 2869312 - protein, 6 aa, Entamoeba invadens
KEDETV

SEQ ID NO: 2869313 - protein, 7 aa, Entamoeba invadens
KEDETYE

SEQ ID NO: 2869314 - protein, 7 aa, Entamoeba invadens
KEDEVKE

SEQ ID NO: 2869315 - protein, 6 aa, Entamoeba invadens
KEDFDA

SEQ ID NO: 2869316 - protein, 8 aa, Entamoeba invadens
KEDGDEEQ

SEQ ID NO: 2869317 - protein, 6 aa, Entamoeba invadens
KEDGEI

SEQ ID NO: 2869318 - protein, 10 aa, Entamoeba invadens
KEDGLDDAKD

SEQ ID NO: 2869319 - protein, 106 aa, Entamoeba invadens
KEDGNGKEESDEEERKLKEEEEELAREEERIKKEEEEIERQKEEQIKAEEQKREAERVEKEAFEEAERVKQEEVEKERLEKEKIEEEERLAQEKAEKERLENERIA

SEQ ID NO: 2869320 - protein, 5 aa, Entamoeba invadens
KEDIE

SEQ ID NO: 2869321 - protein, 25 aa, Entamoeba invadens
KEDIESKKVSLEEADMKSREDQEHI

SEQ ID NO: 2869322 - protein, 45 aa, Entamoeba invadens
KEDIESKNVSLDKADMKSQKIKNTLRNSKKKLEAEEDNSKDLETQ

SEQ ID NO: 2869323 - protein, 10 aa, Entamoeba invadens
KEDIKGNTPL

SEQ ID NO: 2869324 - protein, 8 aa, Entamoeba invadens
KEDINDRG

SEQ ID NO: 2869325 - protein, 9 aa, Entamoeba invadens
KEDIQTKGY

SEQ ID NO: 2869326 - protein, 11 aa, Entamoeba invadens
KEDIRHSPAYG

SEQ ID NO: 2869327 - protein, 7 aa, Entamoeba invadens
KEDITDL

SEQ ID NO: 2869328 - protein, 7 aa, Entamoeba invadens
KEDKDEL

SEQ ID NO: 2869329 - protein, 7 aa, Entamoeba invadens
KEDKEIV

SEQ ID NO: 2869330 - protein, 6 aa, Entamoeba invadens
KEDKLQ

SEQ ID NO: 2869331 - protein, 16 aa, Entamoeba invadens
KEDKNKDFKEGRLDEK

SEQ ID NO: 2869332 - protein, 9 aa, Entamoeba invadens
KEDKNNSGF

SEQ ID NO: 2869333 - protein, 4 aa, Entamoeba invadens
KEDL

SEQ ID NO: 2869334 - protein, 5 aa, Entamoeba invadens
KEDLA

SEQ ID NO: 2869335 - protein, 7 aa, Entamoeba invadens
KEDLATN

SEQ ID NO: 2869336 - protein, 5 aa, Entamoeba invadens
KEDLE

SEQ ID NO: 2869337 - protein, 21 aa, Entamoeba invadens
KEDLKQDETAQQKVETQQEKV

SEQ ID NO: 2869338 - protein, 10 aa, Entamoeba invadens
KEDLTRKKPI

SEQ ID NO: 2869339 - protein, 6 aa, Entamoeba invadens
KEDLVE

SEQ ID NO: 2869340 - protein, 7 aa, Entamoeba invadens
KEDMTIE

SEQ ID NO: 2869341 - protein, 9 aa, Entamoeba invadens
KEDMTPKEI

SEQ ID NO: 2869342 - protein, 4 aa, Entamoeba invadens
KEDN

SEQ ID NO: 2869343 - protein, 14 aa, Entamoeba invadens
KEDNEENEEENKED

SEQ ID NO: 2869344 - protein, 7 aa, Entamoeba invadens
KEDNLKG

SEQ ID NO: 2869345 - protein, 11 aa, Entamoeba invadens
KEDNVTKGGKV

SEQ ID NO: 2869346 - protein, 8 aa, Entamoeba invadens
KEDPENNE

SEQ ID NO: 2869347 - protein, 7 aa, Entamoeba invadens
KEDPERD

SEQ ID NO: 2869348 - protein, 6 aa, Entamoeba invadens
KEDPKG

SEQ ID NO: 2869349 - protein, 7 aa, Entamoeba invadens
KEDPQAY

SEQ ID NO: 2869350 - protein, 7 aa, Entamoeba invadens
KEDPQKY

SEQ ID NO: 2869351 - protein, 8 aa, Entamoeba invadens
KEDPSQKF

SEQ ID NO: 2869352 - protein, 17 aa, Entamoeba invadens
KEDQKKRGTSPGRVQPT

SEQ ID NO: 2869353 - protein, 6 aa, Entamoeba invadens
KEDQTE

SEQ ID NO: 2869354 - protein, 7 aa, Entamoeba invadens
KEDQTYF

SEQ ID NO: 2869355 - protein, 6 aa, Entamoeba invadens
KEDRIT

SEQ ID NO: 2869356 - protein, 5 aa, Entamoeba invadens
KEDRL

SEQ ID NO: 2869357 - protein, 15 aa, Entamoeba invadens
KEDRLGKESSLFNTE

SEQ ID NO: 2869358 - protein, 18 aa, Entamoeba invadens
KEDRQQYGSQLPKSTNSI

SEQ ID NO: 2869359 - protein, 16 aa, Entamoeba invadens
KEDRVDKARAEKAERM

SEQ ID NO: 2869360 - protein, 9 aa, Entamoeba invadens
KEDSALYDD

SEQ ID NO: 2869361 - protein, 18 aa, Entamoeba invadens
KEDSALYDEYGKLKAVAE

SEQ ID NO: 2869362 - protein, 6 aa, Entamoeba invadens
KEDSFK

SEQ ID NO: 2869363 - protein, 8 aa, Entamoeba invadens
KEDSPSIS

SEQ ID NO: 2869364 - protein, 6 aa, Entamoeba invadens
KEDTCH

SEQ ID NO: 2869365 - protein, 6 aa, Entamoeba invadens
KEDTFT

SEQ ID NO: 2869366 - protein, 16 aa, Entamoeba invadens
KEDTKMSYNKHEMYCF

SEQ ID NO: 2869367 - protein, 15 aa, Entamoeba invadens
KEDTLGYSNTSTITN

SEQ ID NO: 2869368 - protein, 5 aa, Entamoeba invadens
KEDTP

SEQ ID NO: 2869369 - protein, 7 aa, Entamoeba invadens
KEDTQSF

SEQ ID NO: 2869370 - protein, 8 aa, Entamoeba invadens
KEDVEKEM

SEQ ID NO: 2869371 - protein, 20 aa, Entamoeba invadens
KEDVISSKSIEDGFFESVGG

SEQ ID NO: 2869372 - protein, 5 aa, Entamoeba invadens
KEDVR

SEQ ID NO: 2869373 - protein, 4 aa, Entamoeba invadens
KEDW

SEQ ID NO: 2869374 - protein, 5 aa, Entamoeba invadens
KEDWQ

SEQ ID NO: 2869375 - protein, 6 aa, Entamoeba invadens
KEDYVS

SEQ ID NO: 2869376 - protein, 11 aa, Entamoeba invadens
KEEAEKQNYTI

SEQ ID NO: 2869377 - protein, 9 aa, Entamoeba invadens
KEEAFSNTS

SEQ ID NO: 2869378 - protein, 7 aa, Entamoeba invadens
KEEAIDT

SEQ ID NO: 2869379 - protein, 11 aa, Entamoeba invadens
KEEAKASLQKY

SEQ ID NO: 2869380 - protein, 7 aa, Entamoeba invadens
KEEAKNA

SEQ ID NO: 2869381 - protein, 8 aa, Entamoeba invadens
KEEAPLTQ

SEQ ID NO: 2869382 - protein, 5 aa, Entamoeba invadens
KEEAQ

SEQ ID NO: 2869383 - protein, 6 aa, Entamoeba invadens
KEEARR

SEQ ID NO: 2869384 - protein, 5 aa, Entamoeba invadens
KEEDE

SEQ ID NO: 2869385 - protein, 89 aa, Entamoeba invadens
KEEDEAKDEKEKKMEEEEEEEKPKKTPKKTRKTTKSAKKEVEPEEEKEEKSEESDEEKDKKGKTTTKAPKKSLKEDQLYDKEKDNDEYW

SEQ ID NO: 2869386 - protein, 12 aa, Entamoeba invadens
KEEDEEGGGVKK

SEQ ID NO: 2869387 - protein, 6 aa, Entamoeba invadens
KEEDEK

SEQ ID NO: 2869388 - protein, 6 aa, Entamoeba invadens
KEEDIY

SEQ ID NO: 2869389 - protein, 7 aa, Entamoeba invadens
KEEDKQV

SEQ ID NO: 2869390 - protein, 13 aa, Entamoeba invadens
KEEDPKKKYDGVE

SEQ ID NO: 2869391 - protein, 7 aa, Entamoeba invadens
KEEDRIN

SEQ ID NO: 2869392 - protein, 33 aa, Entamoeba invadens
KEEDSEDLQPRSFGSPNLSVASSPRKIVTTNQS

SEQ ID NO: 2869393 - protein, 4 aa, Entamoeba invadens
KEEE

SEQ ID NO: 2869394 - protein, 12 aa, Entamoeba invadens
KEEEAVTKLETE

SEQ ID NO: 2869395 - protein, 11 aa, Entamoeba invadens
KEEEEEEAGGY

SEQ ID NO: 2869396 - protein, 16 aa, Entamoeba invadens
KEEEEKKKREEEEQAK

SEQ ID NO: 2869397 - protein, 13 aa, Entamoeba invadens
KEEEENGGPQKKY

SEQ ID NO: 2869398 - protein, 10 aa, Entamoeba invadens
KEEEEQSLRQ

SEQ ID NO: 2869399 - protein, 7 aa, Entamoeba invadens
KEEEERL

SEQ ID NO: 2869400 - protein, 19 aa, Entamoeba invadens
KEEEESEEEEKEEEVDEGK

SEQ ID NO: 2869401 - protein, 11 aa, Entamoeba invadens
KEEEETTQNNQ

SEQ ID NO: 2869402 - protein, 11 aa, Entamoeba invadens
KEEEKEEFKKT

SEQ ID NO: 2869403 - protein, 22 aa, Entamoeba invadens
KEEEKEHEVQSLTSSPTTSSIT

SEQ ID NO: 2869404 - protein, 7 aa, Entamoeba invadens
KEEELSV

SEQ ID NO: 2869405 - protein, 39 aa, Entamoeba invadens
KEEEMKEAKEKETKEKEAKDVKSPGKSKRKKLDKKEKKK

SEQ ID NO: 2869406 - protein, 21 aa, Entamoeba invadens
KEEEMNKPKAAGPVYNEQNVD

SEQ ID NO: 2869407 - protein, 7 aa, Entamoeba invadens
KEEENIE

SEQ ID NO: 2869408 - protein, 6 aa, Entamoeba invadens
KEEENR

SEQ ID NO: 2869409 - protein, 6 aa, Entamoeba invadens
KEEEST

SEQ ID NO: 2869410 - protein, 6 aa, Entamoeba invadens
KEEETK

SEQ ID NO: 2869411 - protein, 18 aa, Entamoeba invadens
KEEETLQNTLTEDEKKKI

SEQ ID NO: 2869412 - protein, 8 aa, Entamoeba invadens
KEEEVKGW

SEQ ID NO: 2869413 - protein, 6 aa, Entamoeba invadens
KEEEVN

SEQ ID NO: 2869414 - protein, 4 aa, Entamoeba invadens
KEEF

SEQ ID NO: 2869415 - protein, 6 aa, Entamoeba invadens
KEEFDK

SEQ ID NO: 2869416 - protein, 7 aa, Entamoeba invadens
KEEFDQK

SEQ ID NO: 2869417 - protein, 7 aa, Entamoeba invadens
KEEFYTR

SEQ ID NO: 2869418 - protein, 4 aa, Entamoeba invadens
KEEG

SEQ ID NO: 2869419 - protein, 9 aa, Entamoeba invadens
KEEGEGIDG

SEQ ID NO: 2869420 - protein, 5 aa, Entamoeba invadens
KEEGI

SEQ ID NO: 2869421 - protein, 8 aa, Entamoeba invadens
KEEGIQDE

SEQ ID NO: 2869422 - protein, 9 aa, Entamoeba invadens
KEEGKKPVD

SEQ ID NO: 2869423 - protein, 20 aa, Entamoeba invadens
KEEGKPVKESAKHSKKLKEK

SEQ ID NO: 2869424 - protein, 6 aa, Entamoeba invadens
KEEGKS

SEQ ID NO: 2869425 - protein, 7 aa, Entamoeba invadens
KEEHDNV

SEQ ID NO: 2869426 - protein, 5 aa, Entamoeba invadens
KEEHK

SEQ ID NO: 2869427 - protein, 7 aa, Entamoeba invadens
KEEHKKQ

SEQ ID NO: 2869428 - protein, 14 aa, Entamoeba invadens
KEEHKVRDSEEQKI

SEQ ID NO: 2869429 - protein, 19 aa, Entamoeba invadens
KEEIDRVKEEKKKAASERV

SEQ ID NO: 2869430 - protein, 5 aa, Entamoeba invadens
KEEIE

SEQ ID NO: 2869431 - protein, 9 aa, Entamoeba invadens
KEEIEQQKK

SEQ ID NO: 2869432 - protein, 7 aa, Entamoeba invadens
KEEIESK

SEQ ID NO: 2869433 - protein, 8 aa, Entamoeba invadens
KEEIESKK

SEQ ID NO: 2869434 - protein, 11 aa, Entamoeba invadens
KEEIKSNQKEA

SEQ ID NO: 2869435 - protein, 18 aa, Entamoeba invadens
KEEIKSTESAEKACKEMT

SEQ ID NO: 2869436 - protein, 6 aa, Entamoeba invadens
KEEIPV

SEQ ID NO: 2869437 - protein, 14 aa, Entamoeba invadens
KEEIQYKKDSYASE

SEQ ID NO: 2869438 - protein, 8 aa, Entamoeba invadens
KEEISNEE

SEQ ID NO: 2869439 - protein, 4 aa, Entamoeba invadens
KEEK

SEQ ID NO: 2869440 - protein, 17 aa, Entamoeba invadens
KEEKDEEVNRKKGRITG

SEQ ID NO: 2869441 - protein, 41 aa, Entamoeba invadens
KEEKDKERLKDKLNEKRKDVKQKKTLFRSRDKTMSKPENIN

SEQ ID NO: 2869442 - protein, 83 aa, Entamoeba invadens
KEEKDNEEKKEEKVVESVGDKKEQKVEEQIQEKGQVQAKESNEEKKEVMQSEVKPEEEKVEDKEDDGKIKTEGTQKKSRWGSA

SEQ ID NO: 2869443 - protein, 16 aa, Entamoeba invadens
KEEKENAEKKPRKIEA

SEQ ID NO: 2869444 - protein, 35 aa, Entamoeba invadens
KEEKGEAKEQEEEKKQKPLESDDVKETSSEEEENK

SEQ ID NO: 2869445 - protein, 15 aa, Entamoeba invadens
KEEKGVEGEKKKYVP

SEQ ID NO: 2869446 - protein, 12 aa, Entamoeba invadens
KEEKGVESEKKK

SEQ ID NO: 2869447 - protein, 5 aa, Entamoeba invadens
KEEKI

SEQ ID NO: 2869448 - protein, 12 aa, Entamoeba invadens
KEEKIEEKNEDE

SEQ ID NO: 2869449 - protein, 11 aa, Entamoeba invadens
KEEKKDEKIDP

SEQ ID NO: 2869450 - protein, 42 aa, Entamoeba invadens
KEEKKEEKKEEPKKEVKKATKEVKKEIKEPIKEQKENSNTLP

SEQ ID NO: 2869451 - protein, 5 aa, Entamoeba invadens
KEEKL

SEQ ID NO: 2869452 - protein, 9 aa, Entamoeba invadens
KEEKLKEEL

SEQ ID NO: 2869453 - protein, 11 aa, Entamoeba invadens
KEEKMTKDEEI

SEQ ID NO: 2869454 - protein, 10 aa, Entamoeba invadens
KEEKNLRKAM

SEQ ID NO: 2869455 - protein, 16 aa, Entamoeba invadens
KEEKPKSTETQQNEIT

SEQ ID NO: 2869456 - protein, 7 aa, Entamoeba invadens
KEEKPTI

SEQ ID NO: 2869457 - protein, 15 aa, Entamoeba invadens
KEEKQHQEDLKNDPF

SEQ ID NO: 2869458 - protein, 17 aa, Entamoeba invadens
KEEKSEKKETEERKRFE

SEQ ID NO: 2869459 - protein, 9 aa, Entamoeba invadens
KEEKSEKKQ

SEQ ID NO: 2869460 - protein, 21 aa, Entamoeba invadens
KEEKSEMKNNTTTTKGTKQGV

SEQ ID NO: 2869461 - protein, 29 aa, Entamoeba invadens
KEEKTKLDSLKKTLSRDISPLADTEVPQF

SEQ ID NO: 2869462 - protein, 8 aa, Entamoeba invadens
KEEKTLSK

SEQ ID NO: 2869463 - protein, 28 aa, Entamoeba invadens
KEEKVEKVENDKIESVNRRKSEEKRQRE

SEQ ID NO: 2869464 - protein, 10 aa, Entamoeba invadens
KEELDEEQKY

SEQ ID NO: 2869465 - protein, 20 aa, Entamoeba invadens
KEELDEVEGETITKKVREKR

SEQ ID NO: 2869466 - protein, 15 aa, Entamoeba invadens
KEELENQKKSNVNTI

SEQ ID NO: 2869467 - protein, 8 aa, Entamoeba invadens
KEELGGVK

SEQ ID NO: 2869468 - protein, 6 aa, Entamoeba invadens
KEELHE

SEQ ID NO: 2869469 - protein, 7 aa, Entamoeba invadens
KEELQAQ

SEQ ID NO: 2869470 - protein, 13 aa, Entamoeba invadens
KEELQETDETTLE

SEQ ID NO: 2869471 - protein, 8 aa, Entamoeba invadens
KEEMKKQQ

SEQ ID NO: 2869472 - protein, 11 aa, Entamoeba invadens
KEEMKNESPKV

SEQ ID NO: 2869473 - protein, 11 aa, Entamoeba invadens
KEENCENQKRA

SEQ ID NO: 2869474 - protein, 7 aa, Entamoeba invadens
KEENIPA

SEQ ID NO: 2869475 - protein, 6 aa, Entamoeba invadens
KEENKS

SEQ ID NO: 2869476 - protein, 7 aa, Entamoeba invadens
KEENKTV

SEQ ID NO: 2869477 - protein, 18 aa, Entamoeba invadens
KEENNAKREKRKQETIRK

SEQ ID NO: 2869478 - protein, 6 aa, Entamoeba invadens
KEENNV

SEQ ID NO: 2869479 - protein, 10 aa, Entamoeba invadens
KEENPNVTTR

SEQ ID NO: 2869480 - protein, 7 aa, Entamoeba invadens
KEENSLP

SEQ ID NO: 2869481 - protein, 6 aa, Entamoeba invadens
KEENSQ

SEQ ID NO: 2869482 - protein, 7 aa, Entamoeba invadens
KEENSTL

SEQ ID NO: 2869483 - protein, 4 aa, Entamoeba invadens
KEEP

SEQ ID NO: 2869484 - protein, 22 aa, Entamoeba invadens
KEEPKSELDSQSCPTHTEHSQH

SEQ ID NO: 2869485 - protein, 62 aa, Entamoeba invadens
KEEPPQTLPTQQDELPPTEPPHLDQQQQQPSPNDGQHPPTDKKQFERPNKPAPSATSRPKKG

SEQ ID NO: 2869486 - protein, 8 aa, Entamoeba invadens
KEEPPTLQ

SEQ ID NO: 2869487 - protein, 11 aa, Entamoeba invadens
KEEPSLKNTPD

SEQ ID NO: 2869488 - protein, 11 aa, Entamoeba invadens
KEEPTTHRENN

SEQ ID NO: 2869489 - protein, 4 aa, Entamoeba invadens
KEEQ

SEQ ID NO: 2869490 - protein, 11 aa, Entamoeba invadens
KEEQDNNKKLT

SEQ ID NO: 2869491 - protein, 39 aa, Entamoeba invadens
KEEQNEGVNESEDKNSQSSSPLHSTNEDDTQIKKEDDIT

SEQ ID NO: 2869492 - protein, 19 aa, Entamoeba invadens
KEEQNSSCELKEEKEKVQM

SEQ ID NO: 2869493 - protein, 8 aa, Entamoeba invadens
KEEQRSLY

SEQ ID NO: 2869494 - protein, 8 aa, Entamoeba invadens
KEEQYSKM

SEQ ID NO: 2869495 - protein, 4 aa, Entamoeba invadens
KEER

SEQ ID NO: 2869496 - protein, 5 aa, Entamoeba invadens
KEERE

SEQ ID NO: 2869497 - protein, 22 aa, Entamoeba invadens
KEEREANGEDTGDEEEDAKTIK

SEQ ID NO: 2869498 - protein, 22 aa, Entamoeba invadens
KEEREEAKSESEKATDEESIEK

SEQ ID NO: 2869499 - protein, 6 aa, Entamoeba invadens
KEEREN

SEQ ID NO: 2869500 - protein, 7 aa, Entamoeba invadens
KEERGSL

SEQ ID NO: 2869501 - protein, 6 aa, Entamoeba invadens
KEERIT

SEQ ID NO: 2869502 - protein, 10 aa, Entamoeba invadens
KEERKGTSDI

SEQ ID NO: 2869503 - protein, 15 aa, Entamoeba invadens
KEERKHQLRTTTDLR

SEQ ID NO: 2869504 - protein, 7 aa, Entamoeba invadens
KEERNDA

SEQ ID NO: 2869505 - protein, 13 aa, Entamoeba invadens
KEERRTNERKSTK

SEQ ID NO: 2869506 - protein, 45 aa, Entamoeba invadens
KEERSESVEESQPVSVPQTEEDKDVEKNSEKKETNEREEKGKEDI

SEQ ID NO: 2869507 - protein, 7 aa, Entamoeba invadens
KEERVQK

SEQ ID NO: 2869508 - protein, 6 aa, Entamoeba invadens
KEESFE

SEQ ID NO: 2869509 - protein, 17 aa, Entamoeba invadens
KEESFTVDQSSPPLSNT

SEQ ID NO: 2869510 - protein, 6 aa, Entamoeba invadens
KEESGV

SEQ ID NO: 2869511 - protein, 16 aa, Entamoeba invadens
KEESHQKKSSFTEEDD

SEQ ID NO: 2869512 - protein, 46 aa, Entamoeba invadens
KEESKGDNKSAISSSSKKHRSTSAETTKRRNERNLAPLTERSNTQI

SEQ ID NO: 2869513 - protein, 12 aa, Entamoeba invadens
KEESPESENATV

SEQ ID NO: 2869514 - protein, 8 aa, Entamoeba invadens
KEESSDGV

SEQ ID NO: 2869515 - protein, 5 aa, Entamoeba invadens
KEEST

SEQ ID NO: 2869516 - protein, 27 aa, Entamoeba invadens
KEESTININRSEDSTRPRLDLEHNKSQ

SEQ ID NO: 2869517 - protein, 15 aa, Entamoeba invadens
KEESTNNTSENTTQQ

SEQ ID NO: 2869518 - protein, 6 aa, Entamoeba invadens
KEETDN

SEQ ID NO: 2869519 - protein, 7 aa, Entamoeba invadens
KEETESL

SEQ ID NO: 2869520 - protein, 8 aa, Entamoeba invadens
KEETFGND

SEQ ID NO: 2869521 - protein, 7 aa, Entamoeba invadens
KEETGDL

SEQ ID NO: 2869522 - protein, 8 aa, Entamoeba invadens
KEETGKGV

SEQ ID NO: 2869523 - protein, 6 aa, Entamoeba invadens
KEETGV

SEQ ID NO: 2869524 - protein, 7 aa, Entamoeba invadens
KEETGYV

SEQ ID NO: 2869525 - protein, 7 aa, Entamoeba invadens
KEETISR

SEQ ID NO: 2869526 - protein, 7 aa, Entamoeba invadens
KEETKKI

SEQ ID NO: 2869527 - protein, 14 aa, Entamoeba invadens
KEETKKSYGDIPKV

SEQ ID NO: 2869528 - protein, 7 aa, Entamoeba invadens
KEETKQG

SEQ ID NO: 2869529 - protein, 21 aa, Entamoeba invadens
KEETKQKKVRKIGETNFPVDA

SEQ ID NO: 2869530 - protein, 20 aa, Entamoeba invadens
KEETKRAIESGEYARCIEFY

SEQ ID NO: 2869531 - protein, 7 aa, Entamoeba invadens
KEETLDI

SEQ ID NO: 2869532 - protein, 66 aa, Entamoeba invadens
KEETQMTEANEISEEDQEGNIIEKENKNEEKRMQEENGLDENKLSYTEQNRRNEDLKCNKEKELSE

SEQ ID NO: 2869533 - protein, 8 aa, Entamoeba invadens
KEETVEEA

SEQ ID NO: 2869534 - protein, 8 aa, Entamoeba invadens
KEETVKEN

SEQ ID NO: 2869535 - protein, 6 aa, Entamoeba invadens
KEEVEK

SEQ ID NO: 2869536 - protein, 32 aa, Entamoeba invadens
KEEVEKESVPVVSSGKVAKKVVKGATSGKLGK

SEQ ID NO: 2869537 - protein, 7 aa, Entamoeba invadens
KEEVENA

SEQ ID NO: 2869538 - protein, 113 aa, Entamoeba invadens
KEEVGLEEGQTKEEHTEQNMSQSKEKEEPKIEEKGESKVESTETIQEDNEEKLEEAYHSNDEMPTFGDDAKSDDEDTHQNTTIKETENKPIKEETEENIADKESHGNNIDDFI

SEQ ID NO: 2869539 - protein, 21 aa, Entamoeba invadens
KEEVKESNENGLQNYTQSTNE

SEQ ID NO: 2869540 - protein, 7 aa, Entamoeba invadens
KEEVKEV

SEQ ID NO: 2869541 - protein, 10 aa, Entamoeba invadens
KEEVNRSRSE

SEQ ID NO: 2869542 - protein, 19 aa, Entamoeba invadens
KEEVSGQVKPNTQGKTLEK

SEQ ID NO: 2869543 - protein, 5 aa, Entamoeba invadens
KEEYL

SEQ ID NO: 2869544 - protein, 9 aa, Entamoeba invadens
KEFDENEAK

SEQ ID NO: 2869545 - protein, 4 aa, Entamoeba invadens
KEFE

SEQ ID NO: 2869546 - protein, 11 aa, Entamoeba invadens
KEFEDEKLTQK

SEQ ID NO: 2869547 - protein, 14 aa, Entamoeba invadens
KEFEDSKLEAHRGA

SEQ ID NO: 2869548 - protein, 12 aa, Entamoeba invadens
KEFEEQEKEREH

SEQ ID NO: 2869549 - protein, 12 aa, Entamoeba invadens
KEFEERRKQLET

SEQ ID NO: 2869550 - protein, 5 aa, Entamoeba invadens
KEFEK

SEQ ID NO: 2869551 - protein, 24 aa, Entamoeba invadens
KEFEKQEDEIQDRYAKKRTSPLEN

SEQ ID NO: 2869552 - protein, 12 aa, Entamoeba invadens
KEFESKSNEGDY

SEQ ID NO: 2869553 - protein, 16 aa, Entamoeba invadens
KEFESLNKSPKNGIDK

SEQ ID NO: 2869554 - protein, 22 aa, Entamoeba invadens
KEFETENSSPQKVKSQGQNDNL

SEQ ID NO: 2869555 - protein, 6 aa, Entamoeba invadens
KEFGTT

SEQ ID NO: 2869556 - protein, 15 aa, Entamoeba invadens
KEFKEGKMNAYDRRK

SEQ ID NO: 2869557 - protein, 5 aa, Entamoeba invadens
KEFLT

SEQ ID NO: 2869558 - protein, 8 aa, Entamoeba invadens
KEFNTDDL

SEQ ID NO: 2869559 - protein, 6 aa, Entamoeba invadens
KEFPKI

SEQ ID NO: 2869560 - protein, 14 aa, Entamoeba invadens
KEFPNAKDLDRQGR

SEQ ID NO: 2869561 - protein, 4 aa, Entamoeba invadens
KEFQ

SEQ ID NO: 2869562 - protein, 6 aa, Entamoeba invadens
KEFQDK

SEQ ID NO: 2869563 - protein, 4 aa, Entamoeba invadens
KEFS

SEQ ID NO: 2869564 - protein, 6 aa, Entamoeba invadens
KEFSHS

SEQ ID NO: 2869565 - protein, 6 aa, Entamoeba invadens
KEFSNK

SEQ ID NO: 2869566 - protein, 6 aa, Entamoeba invadens
KEFTES

SEQ ID NO: 2869567 - protein, 11 aa, Entamoeba invadens
KEFTKEPPKEL

SEQ ID NO: 2869568 - protein, 20 aa, Entamoeba invadens
KEFTKTLEETKNSTKTTRTY

SEQ ID NO: 2869569 - protein, 4 aa, Entamoeba invadens
KEFV

SEQ ID NO: 2869570 - protein, 6 aa, Entamoeba invadens
KEFVGS

SEQ ID NO: 2869571 - protein, 22 aa, Entamoeba invadens
KEGAAGSADKVGNLTLGTDGQR

SEQ ID NO: 2869572 - protein, 17 aa, Entamoeba invadens
KEGDDESEEVNEEATGA

SEQ ID NO: 2869573 - protein, 7 aa, Entamoeba invadens
KEGDFTT

SEQ ID NO: 2869574 - protein, 5 aa, Entamoeba invadens
KEGDG

SEQ ID NO: 2869575 - protein, 6 aa, Entamoeba invadens
KEGDKK

SEQ ID NO: 2869576 - protein, 6 aa, Entamoeba invadens
KEGDKY

SEQ ID NO: 2869577 - protein, 15 aa, Entamoeba invadens
KEGDLEVNESNKKEY

SEQ ID NO: 2869578 - protein, 10 aa, Entamoeba invadens
KEGDSYKEDL

SEQ ID NO: 2869579 - protein, 8 aa, Entamoeba invadens
KEGDTSSA

SEQ ID NO: 2869580 - protein, 9 aa, Entamoeba invadens
KEGEAPKIS

SEQ ID NO: 2869581 - protein, 30 aa, Entamoeba invadens
KEGEAPKSSRHFKASPDPTYSFDPKGSNLT

SEQ ID NO: 2869582 - protein, 30 aa, Entamoeba invadens
KEGEAPKSSRHVKASPAPTYSFDPKGSNLT

SEQ ID NO: 2869583 - protein, 29 aa, Entamoeba invadens
KEGEAPKSSRHVKASPDPTYSFDPKGKIT

SEQ ID NO: 2869584 - protein, 48 aa, Entamoeba invadens
KEGEAPKSSRHVKASPDPTYSFDPKGSNLTEVESKEHKTDDNKLSKTS

SEQ ID NO: 2869585 - protein, 30 aa, Entamoeba invadens
KEGEAPKSSRHVKPSPAPTYSFDPKGSNLT

SEQ ID NO: 2869586 - protein, 5 aa, Entamoeba invadens
KEGEE

SEQ ID NO: 2869587 - protein, 6 aa, Entamoeba invadens
KEGEEM

SEQ ID NO: 2869588 - protein, 8 aa, Entamoeba invadens
KEGEHPSE

SEQ ID NO: 2869589 - protein, 11 aa, Entamoeba invadens
KEGEKFPPSPC

SEQ ID NO: 2869590 - protein, 7 aa, Entamoeba invadens
KEGEKYV

SEQ ID NO: 2869591 - protein, 5 aa, Entamoeba invadens
KEGEL

SEQ ID NO: 2869592 - protein, 30 aa, Entamoeba invadens
KEGESQKGSRPVKASHNPTYSFDPKRSNLT

SEQ ID NO: 2869593 - protein, 13 aa, Entamoeba invadens
KEGETSCPLAKTS

SEQ ID NO: 2869594 - protein, 41 aa, Entamoeba invadens
KEGEVNQQIEQDKDKKVEQNVMPQSTENDENDDTQTSPLKR

SEQ ID NO: 2869595 - protein, 9 aa, Entamoeba invadens
KEGFNGKVQ

SEQ ID NO: 2869596 - protein, 8 aa, Entamoeba invadens
KEGGAPLT

SEQ ID NO: 2869597 - protein, 11 aa, Entamoeba invadens
KEGGKAKSTAY

SEQ ID NO: 2869598 - protein, 7 aa, Entamoeba invadens
KEGGLTS

SEQ ID NO: 2869599 - protein, 9 aa, Entamoeba invadens
KEGGPGSGF

SEQ ID NO: 2869600 - protein, 6 aa, Entamoeba invadens
KEGIGE

SEQ ID NO: 2869601 - protein, 14 aa, Entamoeba invadens
KEGIKEAEKVVKEA

SEQ ID NO: 2869602 - protein, 11 aa, Entamoeba invadens
KEGINGTKSDI

SEQ ID NO: 2869603 - protein, 5 aa, Entamoeba invadens
KEGIT

SEQ ID NO: 2869604 - protein, 8 aa, Entamoeba invadens
KEGKALGI

SEQ ID NO: 2869605 - protein, 30 aa, Entamoeba invadens
KEGKEKWKKGGIQTEEQHSKKGNSWTRPKE

SEQ ID NO: 2869606 - protein, 9 aa, Entamoeba invadens
KEGKGSEYT

SEQ ID NO: 2869607 - protein, 6 aa, Entamoeba invadens
KEGKIG

SEQ ID NO: 2869608 - protein, 9 aa, Entamoeba invadens
KEGKKSLKT

SEQ ID NO: 2869609 - protein, 11 aa, Entamoeba invadens
KEGKLEKSPIV

SEQ ID NO: 2869610 - protein, 62 aa, Entamoeba invadens
KEGKSFSRHSPPPLRDYDRDDRDFERGRREDRDSYRPLSPRNRSRSTERPMRREQRDERDDY

SEQ ID NO: 2869611 - protein, 31 aa, Entamoeba invadens
KEGKTYFDSSKNRDPTVDQKTRRRNADALTN

SEQ ID NO: 2869612 - protein, 7 aa, Entamoeba invadens
KEGLKDS

SEQ ID NO: 2869613 - protein, 7 aa, Entamoeba invadens
KEGLKEA

SEQ ID NO: 2869614 - protein, 6 aa, Entamoeba invadens
KEGLPK

SEQ ID NO: 2869615 - protein, 19 aa, Entamoeba invadens
KEGLSTKHIQPQEQERAQL

SEQ ID NO: 2869616 - protein, 4 aa, Entamoeba invadens
KEGM

SEQ ID NO: 2869617 - protein, 6 aa, Entamoeba invadens
KEGMRK

SEQ ID NO: 2869618 - protein, 7 aa, Entamoeba invadens
KEGMSHK

SEQ ID NO: 2869619 - protein, 6 aa, Entamoeba invadens
KEGNIR

SEQ ID NO: 2869620 - protein, 8 aa, Entamoeba invadens
KEGNPLQN

SEQ ID NO: 2869621 - protein, 6 aa, Entamoeba invadens
KEGNWA

SEQ ID NO: 2869622 - protein, 21 aa, Entamoeba invadens
KEGPDLDNESHSDEDEEDVKQ

SEQ ID NO: 2869623 - protein, 10 aa, Entamoeba invadens
KEGPTRCPDS

SEQ ID NO: 2869624 - protein, 6 aa, Entamoeba invadens
KEGREI

SEQ ID NO: 2869625 - protein, 6 aa, Entamoeba invadens
KEGSDT

SEQ ID NO: 2869626 - protein, 8 aa, Entamoeba invadens
KEGSEPAE

SEQ ID NO: 2869627 - protein, 6 aa, Entamoeba invadens
KEGSIV

SEQ ID NO: 2869628 - protein, 8 aa, Entamoeba invadens
KEGSNVKN

SEQ ID NO: 2869629 - protein, 16 aa, Entamoeba invadens
KEGSSAKDKSDDKDEL

SEQ ID NO: 2869630 - protein, 22 aa, Entamoeba invadens
KEGSYSFGGSQGSKTTTLFFRK

SEQ ID NO: 2869631 - protein, 5 aa, Entamoeba invadens
KEGTE

SEQ ID NO: 2869632 - protein, 15 aa, Entamoeba invadens
KEGTLTDSIKKSNCD

SEQ ID NO: 2869633 - protein, 8 aa, Entamoeba invadens
KEGTSQVG

SEQ ID NO: 2869634 - protein, 6 aa, Entamoeba invadens
KEGTVD

SEQ ID NO: 2869635 - protein, 6 aa, Entamoeba invadens
KEGVAD

SEQ ID NO: 2869636 - protein, 16 aa, Entamoeba invadens
KEGVTGKSKNAIRERR

SEQ ID NO: 2869637 - protein, 37 aa, Entamoeba invadens
KEGVTTQRTPAQVPQEGATQQRRRADQPLRQEQIQQQ

SEQ ID NO: 2869638 - protein, 120 aa, Entamoeba invadens
KEGWYSKKEAKKPTPTTAKNTSVPSFTSRGSSSPYGRTGDTQQRTTSAYQPPRAQGGMGDRYQPPSSGRRDIYGTNTPSTGGYAPSRTQGTTQRNTSGVPSFSSGSGVPSFSSGKRGGRK

SEQ ID NO: 2869639 - protein, 8 aa, Entamoeba invadens
KEGYDEKG

SEQ ID NO: 2869640 - protein, 21 aa, Entamoeba invadens
KEHADNEKSEEVDVAQTENFT

SEQ ID NO: 2869641 - protein, 8 aa, Entamoeba invadens
KEHADREA

SEQ ID NO: 2869642 - protein, 4 aa, Entamoeba invadens
KEHD

SEQ ID NO: 2869643 - protein, 6 aa, Entamoeba invadens
KEHDGG

SEQ ID NO: 2869644 - protein, 5 aa, Entamoeba invadens
KEHDK

SEQ ID NO: 2869645 - protein, 13 aa, Entamoeba invadens
KEHERMQREKNTL

SEQ ID NO: 2869646 - protein, 6 aa, Entamoeba invadens
KEHGNK

SEQ ID NO: 2869647 - protein, 21 aa, Entamoeba invadens
KEHHGSRSVQQNIEKGTADER

SEQ ID NO: 2869648 - protein, 21 aa, Entamoeba invadens
KEHHKRNSCEMDRATEGNQDD

SEQ ID NO: 2869649 - protein, 5 aa, Entamoeba invadens
KEHIE

SEQ ID NO: 2869650 - protein, 9 aa, Entamoeba invadens
KEHKEGSSI

SEQ ID NO: 2869651 - protein, 7 aa, Entamoeba invadens
KEHKESV

SEQ ID NO: 2869652 - protein, 11 aa, Entamoeba invadens
KEHKSDSSRIS

SEQ ID NO: 2869653 - protein, 14 aa, Entamoeba invadens
KEHKTDDNKLSKTS

SEQ ID NO: 2869654 - protein, 7 aa, Entamoeba invadens
KEHKVGA

SEQ ID NO: 2869655 - protein, 4 aa, Entamoeba invadens
KEHL

SEQ ID NO: 2869656 - protein, 6 aa, Entamoeba invadens
KEHLDP

SEQ ID NO: 2869657 - protein, 5 aa, Entamoeba invadens
KEHLK

SEQ ID NO: 2869658 - protein, 5 aa, Entamoeba invadens
KEHNG

SEQ ID NO: 2869659 - protein, 4 aa, Entamoeba invadens
KEHP

SEQ ID NO: 2869660 - protein, 7 aa, Entamoeba invadens
KEHPERV

SEQ ID NO: 2869661 - protein, 7 aa, Entamoeba invadens
KEHREGR

SEQ ID NO: 2869662 - protein, 11 aa, Entamoeba invadens
KEHSKKKEPVD

SEQ ID NO: 2869663 - protein, 5 aa, Entamoeba invadens
KEIAE

SEQ ID NO: 2869664 - protein, 8 aa, Entamoeba invadens
KEIAETNE

SEQ ID NO: 2869665 - protein, 6 aa, Entamoeba invadens
KEIAGQ

SEQ ID NO: 2869666 - protein, 7 aa, Entamoeba invadens
KEIAKKR

SEQ ID NO: 2869667 - protein, 5 aa, Entamoeba invadens
KEIAS

SEQ ID NO: 2869668 - protein, 7 aa, Entamoeba invadens
KEIDCDK

SEQ ID NO: 2869669 - protein, 33 aa, Entamoeba invadens
KEIDEESEECETPKISEKIKTVPSRKKNPNLKV

SEQ ID NO: 2869670 - protein, 16 aa, Entamoeba invadens
KEIDEIKTSNKEKEEL

SEQ ID NO: 2869671 - protein, 9 aa, Entamoeba invadens
KEIDGGMST

SEQ ID NO: 2869672 - protein, 12 aa, Entamoeba invadens
KEIDKLSERLNS

SEQ ID NO: 2869673 - protein, 10 aa, Entamoeba invadens
KEIDNDQSQI

SEQ ID NO: 2869674 - protein, 23 aa, Entamoeba invadens
KEIDQIKEETRANREAKEDTTMK

SEQ ID NO: 2869675 - protein, 7 aa, Entamoeba invadens
KEIDTAA

SEQ ID NO: 2869676 - protein, 12 aa, Entamoeba invadens
KEIEEAKDKDIK

SEQ ID NO: 2869677 - protein, 20 aa, Entamoeba invadens
KEIEEEERREKESSQEKKEE

SEQ ID NO: 2869678 - protein, 6 aa, Entamoeba invadens
KEIEEN

SEQ ID NO: 2869679 - protein, 33 aa, Entamoeba invadens
KEIEERKKAEEEEKRRKEEEEIEKEKERVRFNE

SEQ ID NO: 2869680 - protein, 5 aa, Entamoeba invadens
KEIEK

SEQ ID NO: 2869681 - protein, 28 aa, Entamoeba invadens
KEIEKARKATLQAEQVKEAAYAAAQEAH

SEQ ID NO: 2869682 - protein, 21 aa, Entamoeba invadens
KEIEKEEKESPELTKHTQQEF

SEQ ID NO: 2869683 - protein, 7 aa, Entamoeba invadens
KEIENET

SEQ ID NO: 2869684 - protein, 7 aa, Entamoeba invadens
KEIESNK

SEQ ID NO: 2869685 - protein, 16 aa, Entamoeba invadens
KEIESQEGDKKDTTQY

SEQ ID NO: 2869686 - protein, 21 aa, Entamoeba invadens
KEIETKEKLEIKRGNELSKIT

SEQ ID NO: 2869687 - protein, 14 aa, Entamoeba invadens
KEIETKVKEQRELE

SEQ ID NO: 2869688 - protein, 4 aa, Entamoeba invadens
KEIG

SEQ ID NO: 2869689 - protein, 6 aa, Entamoeba invadens
KEIGAE

SEQ ID NO: 2869690 - protein, 6 aa, Entamoeba invadens
KEIGDE

SEQ ID NO: 2869691 - protein, 7 aa, Entamoeba invadens
KEIGDNA

SEQ ID NO: 2869692 - protein, 7 aa, Entamoeba invadens
KEIGEME

SEQ ID NO: 2869693 - protein, 6 aa, Entamoeba invadens
KEIGES

SEQ ID NO: 2869694 - protein, 9 aa, Entamoeba invadens
KEIGGEERH

SEQ ID NO: 2869695 - protein, 5 aa, Entamoeba invadens
KEIGR

SEQ ID NO: 2869696 - protein, 16 aa, Entamoeba invadens
KEIGRECDRNSSDEER

SEQ ID NO: 2869697 - protein, 10 aa, Entamoeba invadens
KEIKDTPEKH

SEQ ID NO: 2869698 - protein, 10 aa, Entamoeba invadens
KEIKENEQFT

SEQ ID NO: 2869699 - protein, 14 aa, Entamoeba invadens
KEIKENSIKREETF

SEQ ID NO: 2869700 - protein, 27 aa, Entamoeba invadens
KEIKETEEGKDEKKTETVKLEKMEEEQ

SEQ ID NO: 2869701 - protein, 10 aa, Entamoeba invadens
KEIKGAGCSE

SEQ ID NO: 2869702 - protein, 8 aa, Entamoeba invadens
KEIKKKGK

SEQ ID NO: 2869703 - protein, 8 aa, Entamoeba invadens
KEIKSTNY

SEQ ID NO: 2869704 - protein, 7 aa, Entamoeba invadens
KEIKTVG

SEQ ID NO: 2869705 - protein, 73 aa, Entamoeba invadens
KEINDQTKGTTSDVHKNKESDSGSNNSTSTKKEKNKKSQFTKPLQNESEKERVSKEIQEDKSGEEETKEAQPK

SEQ ID NO: 2869706 - protein, 6 aa, Entamoeba invadens
KEINEY

SEQ ID NO: 2869707 - protein, 5 aa, Entamoeba invadens
KEINN

SEQ ID NO: 2869708 - protein, 5 aa, Entamoeba invadens
KEINS

SEQ ID NO: 2869709 - protein, 27 aa, Entamoeba invadens
KEINTASYIGGTPEADDAEDLKNRSPS

SEQ ID NO: 2869710 - protein, 18 aa, Entamoeba invadens
KEINTPKFSAKLDNQKFT

SEQ ID NO: 2869711 - protein, 4 aa, Entamoeba invadens
KEIP

SEQ ID NO: 2869712 - protein, 6 aa, Entamoeba invadens
KEIPLP

SEQ ID NO: 2869713 - protein, 20 aa, Entamoeba invadens
KEIPNKPLPQPKLKETTNKQ

SEQ ID NO: 2869714 - protein, 6 aa, Entamoeba invadens
KEIPTW

SEQ ID NO: 2869715 - protein, 8 aa, Entamoeba invadens
KEIQNDID

SEQ ID NO: 2869716 - protein, 5 aa, Entamoeba invadens
KEIRG

SEQ ID NO: 2869717 - protein, 10 aa, Entamoeba invadens
KEIRKEKNPF

SEQ ID NO: 2869718 - protein, 4 aa, Entamoeba invadens
KEIS

SEQ ID NO: 2869719 - protein, 5 aa, Entamoeba invadens
KEISD

SEQ ID NO: 2869720 - protein, 9 aa, Entamoeba invadens
KEISDDNSL

SEQ ID NO: 2869721 - protein, 11 aa, Entamoeba invadens
KEISDSESETI

SEQ ID NO: 2869722 - protein, 8 aa, Entamoeba invadens
KEISFEGS

SEQ ID NO: 2869723 - protein, 18 aa, Entamoeba invadens
KEISKQLQNDNEKVKGEI

SEQ ID NO: 2869724 - protein, 5 aa, Entamoeba invadens
KEISN

SEQ ID NO: 2869725 - protein, 12 aa, Entamoeba invadens
KEISPNRLNSSH

SEQ ID NO: 2869726 - protein, 10 aa, Entamoeba invadens
KEITAGRAFE

SEQ ID NO: 2869727 - protein, 16 aa, Entamoeba invadens
KEITEGVPQQTADRRF

SEQ ID NO: 2869728 - protein, 6 aa, Entamoeba invadens
KEITNA

SEQ ID NO: 2869729 - protein, 18 aa, Entamoeba invadens
KEITNKDGNIDPEKEEKL

SEQ ID NO: 2869730 - protein, 5 aa, Entamoeba invadens
KEITP

SEQ ID NO: 2869731 - protein, 6 aa, Entamoeba invadens
KEITPK

SEQ ID NO: 2869732 - protein, 8 aa, Entamoeba invadens
KEITPQTA

SEQ ID NO: 2869733 - protein, 31 aa, Entamoeba invadens
KEITQKLDDENESLKSAKEVTEKEKNELMTQ

SEQ ID NO: 2869734 - protein, 6 aa, Entamoeba invadens
KEITSG

SEQ ID NO: 2869735 - protein, 7 aa, Entamoeba invadens
KEITSTV

SEQ ID NO: 2869736 - protein, 9 aa, Entamoeba invadens
KEITTAEDI

SEQ ID NO: 2869737 - protein, 7 aa, Entamoeba invadens
KEITYEG

SEQ ID NO: 2869738 - protein, 7 aa, Entamoeba invadens
KEITYQD

SEQ ID NO: 2869739 - protein, 22 aa, Entamoeba invadens
KEIVPSKEMGNLDTNTVQPQND

SEQ ID NO: 2869740 - protein, 22 aa, Entamoeba invadens
KEKAEAEAQAAQLAKEKAEAEV

SEQ ID NO: 2869741 - protein, 19 aa, Entamoeba invadens
KEKAEEAERRKKDFENVAG

SEQ ID NO: 2869742 - protein, 59 aa, Entamoeba invadens
KEKAEKERLEKERIEKEKAIAAAKKAEEERLAEEKRKKEEDLKKAKEAEVAKAKSANAY

SEQ ID NO: 2869743 - protein, 10 aa, Entamoeba invadens
KEKAETYAKS

SEQ ID NO: 2869744 - protein, 25 aa, Entamoeba invadens
KEKAHNVQFDTNNNEIQEKEKPHND

SEQ ID NO: 2869745 - protein, 8 aa, Entamoeba invadens
KEKAKEVQ

SEQ ID NO: 2869746 - protein, 6 aa, Entamoeba invadens
KEKAKT

SEQ ID NO: 2869747 - protein, 8 aa, Entamoeba invadens
KEKANPYT

SEQ ID NO: 2869748 - protein, 10 aa, Entamoeba invadens
KEKAQSNEEI

SEQ ID NO: 2869749 - protein, 9 aa, Entamoeba invadens
KEKASEKTL

SEQ ID NO: 2869750 - protein, 10 aa, Entamoeba invadens
KEKASPDGYN

SEQ ID NO: 2869751 - protein, 4 aa, Entamoeba invadens
KEKC

SEQ ID NO: 2869752 - protein, 8 aa, Entamoeba invadens
KEKCDLED

SEQ ID NO: 2869753 - protein, 6 aa, Entamoeba invadens
KEKCQA

SEQ ID NO: 2869754 - protein, 7 aa, Entamoeba invadens
KEKCSAK

SEQ ID NO: 2869755 - protein, 4 aa, Entamoeba invadens
KEKD

SEQ ID NO: 2869756 - protein, 12 aa, Entamoeba invadens
KEKDASGNVSDG

SEQ ID NO: 2869757 - protein, 9 aa, Entamoeba invadens
KEKDDAKMS

SEQ ID NO: 2869758 - protein, 7 aa, Entamoeba invadens
KEKDDEV

SEQ ID NO: 2869759 - protein, 19 aa, Entamoeba invadens
KEKDGIKEKTLSRRYSKNK

SEQ ID NO: 2869760 - protein, 7 aa, Entamoeba invadens
KEKDIPA

SEQ ID NO: 2869761 - protein, 14 aa, Entamoeba invadens
KEKDKKKKEEEELR

SEQ ID NO: 2869762 - protein, 8 aa, Entamoeba invadens
KEKDQTEM

SEQ ID NO: 2869763 - protein, 23 aa, Entamoeba invadens
KEKDRIAPKYTKEMNDDGETKEL

SEQ ID NO: 2869764 - protein, 10 aa, Entamoeba invadens
KEKDRNTNDE

SEQ ID NO: 2869765 - protein, 9 aa, Entamoeba invadens
KEKDSENSI

SEQ ID NO: 2869766 - protein, 17 aa, Entamoeba invadens
KEKDVVKAQDKAKEDYM

SEQ ID NO: 2869767 - protein, 17 aa, Entamoeba invadens
KEKDVVKAQNKAKEDYI

SEQ ID NO: 2869768 - protein, 4 aa, Entamoeba invadens
KEKE

SEQ ID NO: 2869769 - protein, 10 aa, Entamoeba invadens
KEKEAEKVRK

SEQ ID NO: 2869770 - protein, 19 aa, Entamoeba invadens
KEKEAKKLKTENDEIKEEV

SEQ ID NO: 2869771 - protein, 8 aa, Entamoeba invadens
KEKEANEL

SEQ ID NO: 2869772 - protein, 30 aa, Entamoeba invadens
KEKEAPKSSRHVKASPDPTYSFDPKGSNLT

SEQ ID NO: 2869773 - protein, 29 aa, Entamoeba invadens
KEKEAPKSSRHVKPSPAPTYSFDPKGKIT

SEQ ID NO: 2869774 - protein, 16 aa, Entamoeba invadens
KEKEEKMKKVQEKVEN

SEQ ID NO: 2869775 - protein, 26 aa, Entamoeba invadens
KEKEEQERIEKENVEKERIEKERLEA

SEQ ID NO: 2869776 - protein, 73 aa, Entamoeba invadens
KEKEEQERIEREAKERIEKENEEARIAKEKAEEEERQKEKEIEEEERRLREEEERVERELREEEERMKREEEE

SEQ ID NO: 2869777 - protein, 17 aa, Entamoeba invadens
KEKEERFKTQNTGQYRG

SEQ ID NO: 2869778 - protein, 69 aa, Entamoeba invadens
KEKEESERLEKERLEQEKIAKEKAEKEEQEKAVAEQKKKEEEEKAKKAAEEAQKKSQPIPTLGNQPGLG

SEQ ID NO: 2869779 - protein, 13 aa, Entamoeba invadens
KEKEGLRENTTDG

SEQ ID NO: 2869780 - protein, 8 aa, Entamoeba invadens
KEKEHPSV

SEQ ID NO: 2869781 - protein, 14 aa, Entamoeba invadens
KEKEIQDTIKSATH

SEQ ID NO: 2869782 - protein, 8 aa, Entamoeba invadens
KEKEKCDE

SEQ ID NO: 2869783 - protein, 23 aa, Entamoeba invadens
KEKEKIAEEVGGLKEQSQHKEDL

SEQ ID NO: 2869784 - protein, 12 aa, Entamoeba invadens
KEKEKRNENEKT

SEQ ID NO: 2869785 - protein, 7 aa, Entamoeba invadens
KEKEKTE

SEQ ID NO: 2869786 - protein, 7 aa, Entamoeba invadens
KEKELGE

SEQ ID NO: 2869787 - protein, 8 aa, Entamoeba invadens
KEKELQRI

SEQ ID NO: 2869788 - protein, 17 aa, Entamoeba invadens
KEKENFEVSTSTSSSIE

SEQ ID NO: 2869789 - protein, 8 aa, Entamoeba invadens
KEKENNKR

SEQ ID NO: 2869790 - protein, 7 aa, Entamoeba invadens
KEKEQIH

SEQ ID NO: 2869791 - protein, 6 aa, Entamoeba invadens
KEKERI

SEQ ID NO: 2869792 - protein, 8 aa, Entamoeba invadens
KEKESFER

SEQ ID NO: 2869793 - protein, 62 aa, Entamoeba invadens
KEKETENEKEQEKTPERHEEVERNEEVERQKELELEKQKQLEAEKQKELARKKKIEEEIENA

SEQ ID NO: 2869794 - protein, 8 aa, Entamoeba invadens
KEKETGKV

SEQ ID NO: 2869795 - protein, 7 aa, Entamoeba invadens
KEKETKR

SEQ ID NO: 2869796 - protein, 9 aa, Entamoeba invadens
KEKETNLTT

SEQ ID NO: 2869797 - protein, 8 aa, Entamoeba invadens
KEKEVNEL

SEQ ID NO: 2869798 - protein, 10 aa, Entamoeba invadens
KEKEYQDAER

SEQ ID NO: 2869799 - protein, 4 aa, Entamoeba invadens
KEKF

SEQ ID NO: 2869800 - protein, 14 aa, Entamoeba invadens
KEKFQFSKQQNKIL

SEQ ID NO: 2869801 - protein, 11 aa, Entamoeba invadens
KEKFSDKGDIQ

SEQ ID NO: 2869802 - protein, 6 aa, Entamoeba invadens
KEKFSS

SEQ ID NO: 2869803 - protein, 6 aa, Entamoeba invadens
KEKGAK

SEQ ID NO: 2869804 - protein, 9 aa, Entamoeba invadens
KEKGKGFKY

SEQ ID NO: 2869805 - protein, 8 aa, Entamoeba invadens
KEKGKTYV

SEQ ID NO: 2869806 - protein, 6 aa, Entamoeba invadens
KEKGLS

SEQ ID NO: 2869807 - protein, 9 aa, Entamoeba invadens
KEKGNTKYG

SEQ ID NO: 2869808 - protein, 7 aa, Entamoeba invadens
KEKGSKI

SEQ ID NO: 2869809 - protein, 8 aa, Entamoeba invadens
KEKGSSIA

SEQ ID NO: 2869810 - protein, 16 aa, Entamoeba invadens
KEKGSVTSFTTRRPAT

SEQ ID NO: 2869811 - protein, 28 aa, Entamoeba invadens
KEKGTVNEQVRGGADQRKNTGALGTTDT

SEQ ID NO: 2869812 - protein, 7 aa, Entamoeba invadens
KEKHEAQ

SEQ ID NO: 2869813 - protein, 8 aa, Entamoeba invadens
KEKHHTTN

SEQ ID NO: 2869814 - protein, 15 aa, Entamoeba invadens
KEKHLEQQKTNTENV

SEQ ID NO: 2869815 - protein, 10 aa, Entamoeba invadens
KEKHQKAHDT

SEQ ID NO: 2869816 - protein, 7 aa, Entamoeba invadens
KEKHTKY

SEQ ID NO: 2869817 - protein, 9 aa, Entamoeba invadens
KEKIGSDNF

SEQ ID NO: 2869818 - protein, 7 aa, Entamoeba invadens
KEKIGTE

SEQ ID NO: 2869819 - protein, 8 aa, Entamoeba invadens
KEKIGTEK

SEQ ID NO: 2869820 - protein, 7 aa, Entamoeba invadens
KEKISEN

SEQ ID NO: 2869821 - protein, 8 aa, Entamoeba invadens
KEKITTDQ

SEQ ID NO: 2869822 - protein, 6 aa, Entamoeba invadens
KEKKCA

SEQ ID NO: 2869823 - protein, 6 aa, Entamoeba invadens
KEKKCK

SEQ ID NO: 2869824 - protein, 17 aa, Entamoeba invadens
KEKKDKVEKLKKEYQDL

SEQ ID NO: 2869825 - protein, 17 aa, Entamoeba invadens
KEKKEKRDASLAGSNCR

SEQ ID NO: 2869826 - protein, 15 aa, Entamoeba invadens
KEKKEMNDENGSAEC

SEQ ID NO: 2869827 - protein, 12 aa, Entamoeba invadens
KEKKGEKDEEMA

SEQ ID NO: 2869828 - protein, 13 aa, Entamoeba invadens
KEKKKCGDKAVSK

SEQ ID NO: 2869829 - protein, 19 aa, Entamoeba invadens
KEKKKSMKKEDEEKNGANE

SEQ ID NO: 2869830 - protein, 11 aa, Entamoeba invadens
KEKKNKMKYTD

SEQ ID NO: 2869831 - protein, 13 aa, Entamoeba invadens
KEKKQKTRSPAER

SEQ ID NO: 2869832 - protein, 5 aa, Entamoeba invadens
KEKKR

SEQ ID NO: 2869833 - protein, 7 aa, Entamoeba invadens
KEKKRKS

SEQ ID NO: 2869834 - protein, 7 aa, Entamoeba invadens
KEKKSIT

SEQ ID NO: 2869835 - protein, 7 aa, Entamoeba invadens
KEKKTNV

SEQ ID NO: 2869836 - protein, 4 aa, Entamoeba invadens
KEKL

SEQ ID NO: 2869837 - protein, 10 aa, Entamoeba invadens
KEKLESKTKR

SEQ ID NO: 2869838 - protein, 24 aa, Entamoeba invadens
KEKLKGYDRYAGGLDTKGDVTGTH

SEQ ID NO: 2869839 - protein, 12 aa, Entamoeba invadens
KEKLNKRKAKKT

SEQ ID NO: 2869840 - protein, 13 aa, Entamoeba invadens
KEKLYEKGQSKRI

SEQ ID NO: 2869841 - protein, 7 aa, Entamoeba invadens
KEKMDRD

SEQ ID NO: 2869842 - protein, 6 aa, Entamoeba invadens
KEKMDV

SEQ ID NO: 2869843 - protein, 7 aa, Entamoeba invadens
KEKMEAD

SEQ ID NO: 2869844 - protein, 62 aa, Entamoeba invadens
KEKMKQAREEQKRIKQQKEEEKRKKEQEQYEREALEEKNRKESISKAISDSKMKRQQEEEER

SEQ ID NO: 2869845 - protein, 10 aa, Entamoeba invadens
KEKMLKPKRM

SEQ ID NO: 2869846 - protein, 5 aa, Entamoeba invadens
KEKMT

SEQ ID NO: 2869847 - protein, 4 aa, Entamoeba invadens
KEKN

SEQ ID NO: 2869848 - protein, 10 aa, Entamoeba invadens
KEKNAKKLAQ

SEQ ID NO: 2869849 - protein, 10 aa, Entamoeba invadens
KEKNDEDTTK

SEQ ID NO: 2869850 - protein, 10 aa, Entamoeba invadens
KEKNDSEWDG

SEQ ID NO: 2869851 - protein, 42 aa, Entamoeba invadens
KEKNEKRKSQKVEEKKVKEEAKKEKKEDAQSEDKEKKKRFGL

SEQ ID NO: 2869852 - protein, 12 aa, Entamoeba invadens
KEKNEKTTEKTQ

SEQ ID NO: 2869853 - protein, 6 aa, Entamoeba invadens
KEKNGI

SEQ ID NO: 2869854 - protein, 9 aa, Entamoeba invadens
KEKNGSEWD

SEQ ID NO: 2869855 - protein, 10 aa, Entamoeba invadens
KEKNGSEWDG

SEQ ID NO: 2869856 - protein, 11 aa, Entamoeba invadens
KEKNKTKYNGA

SEQ ID NO: 2869857 - protein, 7 aa, Entamoeba invadens
KEKNPDR

SEQ ID NO: 2869858 - protein, 7 aa, Entamoeba invadens
KEKNSLE

SEQ ID NO: 2869859 - protein, 5 aa, Entamoeba invadens
KEKNV

SEQ ID NO: 2869860 - protein, 8 aa, Entamoeba invadens
KEKNVADD

SEQ ID NO: 2869861 - protein, 35 aa, Entamoeba invadens
KEKPISPSKSPQPPAQSSPTTSPKRSNDLSITSGY

SEQ ID NO: 2869862 - protein, 7 aa, Entamoeba invadens
KEKPKGV

SEQ ID NO: 2869863 - protein, 9 aa, Entamoeba invadens
KEKPSQPIF

SEQ ID NO: 2869864 - protein, 8 aa, Entamoeba invadens
KEKPTEEI

SEQ ID NO: 2869865 - protein, 8 aa, Entamoeba invadens
KEKPTEEV

SEQ ID NO: 2869866 - protein, 16 aa, Entamoeba invadens
KEKPTQQSEVVEQGQI

SEQ ID NO: 2869867 - protein, 12 aa, Entamoeba invadens
KEKQDTTTITEA

SEQ ID NO: 2869868 - protein, 42 aa, Entamoeba invadens
KEKQEALAKRKAEAEKKRAERAAELERRKKELEEKKAKLAEG

SEQ ID NO: 2869869 - protein, 43 aa, Entamoeba invadens
KEKQEEERRAEEKRKRELENQEREEQERLRKEAERKKNEIELA

SEQ ID NO: 2869870 - protein, 5 aa, Entamoeba invadens
KEKQF

SEQ ID NO: 2869871 - protein, 8 aa, Entamoeba invadens
KEKQNAFE

SEQ ID NO: 2869872 - protein, 25 aa, Entamoeba invadens
KEKQNEEVDEKGCTNEEENVNEKVE

SEQ ID NO: 2869873 - protein, 9 aa, Entamoeba invadens
KEKQRHYNR

SEQ ID NO: 2869874 - protein, 25 aa, Entamoeba invadens
KEKQSELEIKEKKEEKKKKKRTVSY

SEQ ID NO: 2869875 - protein, 7 aa, Entamoeba invadens
KEKQSEV

SEQ ID NO: 2869876 - protein, 8 aa, Entamoeba invadens
KEKQTPLV

SEQ ID NO: 2869877 - protein, 4 aa, Entamoeba invadens
KEKR

SEQ ID NO: 2869878 - protein, 21 aa, Entamoeba invadens
KEKREAEKQRIENEKKLETDF

SEQ ID NO: 2869879 - protein, 6 aa, Entamoeba invadens
KEKRKN

SEQ ID NO: 2869880 - protein, 29 aa, Entamoeba invadens
KEKRKSRQFSPSKNIVSSKSNIENPKNVI

SEQ ID NO: 2869881 - protein, 15 aa, Entamoeba invadens
KEKRRSPSNVGTPSA

SEQ ID NO: 2869882 - protein, 5 aa, Entamoeba invadens
KEKRV

SEQ ID NO: 2869883 - protein, 29 aa, Entamoeba invadens
KEKRVTKPKTADTDKKAAPKHFFQPLLKM

SEQ ID NO: 2869884 - protein, 28 aa, Entamoeba invadens
KEKRVVKPKTADADKKAPKHFFKPIYKM

SEQ ID NO: 2869885 - protein, 4 aa, Entamoeba invadens
KEKS

SEQ ID NO: 2869886 - protein, 7 aa, Entamoeba invadens
KEKSDKV

SEQ ID NO: 2869887 - protein, 7 aa, Entamoeba invadens
KEKSFEQ

SEQ ID NO: 2869888 - protein, 9 aa, Entamoeba invadens
KEKSGFEAE

SEQ ID NO: 2869889 - protein, 6 aa, Entamoeba invadens
KEKSKY

SEQ ID NO: 2869890 - protein, 7 aa, Entamoeba invadens
KEKSLTR

SEQ ID NO: 2869891 - protein, 9 aa, Entamoeba invadens
KEKSPVEKI

SEQ ID NO: 2869892 - protein, 6 aa, Entamoeba invadens
KEKSQK

SEQ ID NO: 2869893 - protein, 7 aa, Entamoeba invadens
KEKSRKL

SEQ ID NO: 2869894 - protein, 19 aa, Entamoeba invadens
KEKSTPPPQAVTTEKKEKM

SEQ ID NO: 2869895 - protein, 8 aa, Entamoeba invadens
KEKSTVKP

SEQ ID NO: 2869896 - protein, 4 aa, Entamoeba invadens
KEKT

SEQ ID NO: 2869897 - protein, 9 aa, Entamoeba invadens
KEKTGKHSY

SEQ ID NO: 2869898 - protein, 10 aa, Entamoeba invadens
KEKTGKNTPV

SEQ ID NO: 2869899 - protein, 10 aa, Entamoeba invadens
KEKTKMTEEL

SEQ ID NO: 2869900 - protein, 7 aa, Entamoeba invadens
KEKTPGG

SEQ ID NO: 2869901 - protein, 9 aa, Entamoeba invadens
KEKTSPTYV

SEQ ID NO: 2869902 - protein, 8 aa, Entamoeba invadens
KEKTTTKK

SEQ ID NO: 2869903 - protein, 7 aa, Entamoeba invadens
KEKVAAL

SEQ ID NO: 2869904 - protein, 7 aa, Entamoeba invadens
KEKVEEI

SEQ ID NO: 2869905 - protein, 41 aa, Entamoeba invadens
KEKVEEKEEEKENTKVEQKVQEEKIEKIGSPKEKEGEDYSS

SEQ ID NO: 2869906 - protein, 12 aa, Entamoeba invadens
KEKVEQEARELA

SEQ ID NO: 2869907 - protein, 10 aa, Entamoeba invadens
KEKVGRKTTP

SEQ ID NO: 2869908 - protein, 11 aa, Entamoeba invadens
KEKVKDKEALE

SEQ ID NO: 2869909 - protein, 5 aa, Entamoeba invadens
KEKVR

SEQ ID NO: 2869910 - protein, 9 aa, Entamoeba invadens
KEKYKETNN

SEQ ID NO: 2869911 - protein, 9 aa, Entamoeba invadens
KEKYKKAAD

SEQ ID NO: 2869912 - protein, 9 aa, Entamoeba invadens
KEKYKKRAD

SEQ ID NO: 2869913 - protein, 10 aa, Entamoeba invadens
KEKYKKSSDI

SEQ ID NO: 2869914 - protein, 9 aa, Entamoeba invadens
KEKYKTHEF

SEQ ID NO: 2869915 - protein, 8 aa, Entamoeba invadens
KEKYTKSA

SEQ ID NO: 2869916 - protein, 8 aa, Entamoeba invadens
KELAEEDY

SEQ ID NO: 2869917 - protein, 7 aa, Entamoeba invadens
KELDKSI

SEQ ID NO: 2869918 - protein, 48 aa, Entamoeba invadens
KELDSNRVTHEASDMSVQRDKEKVEQEEVKAESQLDTTKQQESGIEVP

SEQ ID NO: 2869919 - protein, 14 aa, Entamoeba invadens
KELDSSAQDSIKEV

SEQ ID NO: 2869920 - protein, 6 aa, Entamoeba invadens
KELDTS

SEQ ID NO: 2869921 - protein, 6 aa, Entamoeba invadens
KELDTT

SEQ ID NO: 2869922 - protein, 14 aa, Entamoeba invadens
KELDTTEKSLTSKM

SEQ ID NO: 2869923 - protein, 14 aa, Entamoeba invadens
KELEATREKDMPPE

SEQ ID NO: 2869924 - protein, 18 aa, Entamoeba invadens
KELEGKAKKVEEDNKSLE

SEQ ID NO: 2869925 - protein, 41 aa, Entamoeba invadens
KELESEKIEEFADKEKIKEMTSEIDKRRNEATFKGKKIEAL

SEQ ID NO: 2869926 - protein, 4 aa, Entamoeba invadens
KELG

SEQ ID NO: 2869927 - protein, 6 aa, Entamoeba invadens
KELGDE

SEQ ID NO: 2869928 - protein, 6 aa, Entamoeba invadens
KELGDS

SEQ ID NO: 2869929 - protein, 16 aa, Entamoeba invadens
KELGQGKETKTFCGTP

SEQ ID NO: 2869930 - protein, 7 aa, Entamoeba invadens
KELGSEE

SEQ ID NO: 2869931 - protein, 10 aa, Entamoeba invadens
KELGTKASRY

SEQ ID NO: 2869932 - protein, 5 aa, Entamoeba invadens
KELIS

SEQ ID NO: 2869933 - protein, 24 aa, Entamoeba invadens
KELKEKGLSAHSKDNGASEDQIKK

SEQ ID NO: 2869934 - protein, 18 aa, Entamoeba invadens
KELKEQNALKTNEETQQM

SEQ ID NO: 2869935 - protein, 10 aa, Entamoeba invadens
KELKESDTLE

SEQ ID NO: 2869936 - protein, 17 aa, Entamoeba invadens
KELKKGLKKVKESEVEL

SEQ ID NO: 2869937 - protein, 5 aa, Entamoeba invadens
KELKN

SEQ ID NO: 2869938 - protein, 6 aa, Entamoeba invadens
KELKSA

SEQ ID NO: 2869939 - protein, 4 aa, Entamoeba invadens
KELL

SEQ ID NO: 2869940 - protein, 5 aa, Entamoeba invadens
KELNE

SEQ ID NO: 2869941 - protein, 13 aa, Entamoeba invadens
KELNEEKKIGEGS

SEQ ID NO: 2869942 - protein, 16 aa, Entamoeba invadens
KELNGDVTVKPKPFKV

SEQ ID NO: 2869943 - protein, 5 aa, Entamoeba invadens
KELNK

SEQ ID NO: 2869944 - protein, 26 aa, Entamoeba invadens
KELNTQKKEQQTSQVQPAQQNAMTSS

SEQ ID NO: 2869945 - protein, 4 aa, Entamoeba invadens
KELP

SEQ ID NO: 2869946 - protein, 7 aa, Entamoeba invadens
KELPDEA

SEQ ID NO: 2869947 - protein, 17 aa, Entamoeba invadens
KELPDEAKASKGRTPDT

SEQ ID NO: 2869948 - protein, 17 aa, Entamoeba invadens
KELPDEEKTIKGRTPDT

SEQ ID NO: 2869949 - protein, 18 aa, Entamoeba invadens
KELPDKAKAIKGRTPDTT

SEQ ID NO: 2869950 - protein, 8 aa, Entamoeba invadens
KELPEQNR

SEQ ID NO: 2869951 - protein, 17 aa, Entamoeba invadens
KELPERLQTEEVGQKKD

SEQ ID NO: 2869952 - protein, 13 aa, Entamoeba invadens
KELPGGRTSDSGW

SEQ ID NO: 2869953 - protein, 16 aa, Entamoeba invadens
KELPKPPRSDAQKEDM

SEQ ID NO: 2869954 - protein, 10 aa, Entamoeba invadens
KELPNELSSL

SEQ ID NO: 2869955 - protein, 16 aa, Entamoeba invadens
KELPPPKQSTKPIQKQ

SEQ ID NO: 2869956 - protein, 5 aa, Entamoeba invadens
KELPY

SEQ ID NO: 2869957 - protein, 10 aa, Entamoeba invadens
KELQKSQKIR

SEQ ID NO: 2869958 - protein, 11 aa, Entamoeba invadens
KELQNDSINAM

SEQ ID NO: 2869959 - protein, 8 aa, Entamoeba invadens
KELQSEKT

SEQ ID NO: 2869960 - protein, 7 aa, Entamoeba invadens
KELRDPE

SEQ ID NO: 2869961 - protein, 6 aa, Entamoeba invadens
KELREK

SEQ ID NO: 2869962 - protein, 7 aa, Entamoeba invadens
KELREKY

SEQ ID NO: 2869963 - protein, 8 aa, Entamoeba invadens
KELRTNAN

SEQ ID NO: 2869964 - protein, 14 aa, Entamoeba invadens
KELSAKRESGEVLS

SEQ ID NO: 2869965 - protein, 8 aa, Entamoeba invadens
KELSDTLS

SEQ ID NO: 2869966 - protein, 5 aa, Entamoeba invadens
KELSE

SEQ ID NO: 2869967 - protein, 7 aa, Entamoeba invadens
KELSEKC

SEQ ID NO: 2869968 - protein, 105 aa, Entamoeba invadens
KELSEKEKRAKRREEREKERLKKAGRDSDKGEESKEITPSESSDKSEEKSTNSALSSYEERRRKREEERKAKEEERKAKTSALTKPKDKKEEPQKEEKKEPVDRA

SEQ ID NO: 2869969 - protein, 16 aa, Entamoeba invadens
KELSKHVKTNTPQNLE

SEQ ID NO: 2869970 - protein, 7 aa, Entamoeba invadens
KELSPEL

SEQ ID NO: 2869971 - protein, 13 aa, Entamoeba invadens
KELSSMESSLNRQ

SEQ ID NO: 2869972 - protein, 9 aa, Entamoeba invadens
KELTAEQKQ

SEQ ID NO: 2869973 - protein, 22 aa, Entamoeba invadens
KELTEENAKEELRLKEKEEELL

SEQ ID NO: 2869974 - protein, 14 aa, Entamoeba invadens
KELTNPEDRANSFK

SEQ ID NO: 2869975 - protein, 10 aa, Entamoeba invadens
KELTNTYNEG

SEQ ID NO: 2869976 - protein, 12 aa, Entamoeba invadens
KELTSEAARQAG

SEQ ID NO: 2869977 - protein, 13 aa, Entamoeba invadens
KELTSVNSQLKTK

SEQ ID NO: 2869978 - protein, 5 aa, Entamoeba invadens
KELYE

SEQ ID NO: 2869979 - protein, 5 aa, Entamoeba invadens
KEMAK

SEQ ID NO: 2869980 - protein, 8 aa, Entamoeba invadens
KEMDKDEV

SEQ ID NO: 2869981 - protein, 26 aa, Entamoeba invadens
KEMDPAKVEKTMESLRENNEKSHEVG

SEQ ID NO: 2869982 - protein, 8 aa, Entamoeba invadens
KEMDPEKE

SEQ ID NO: 2869983 - protein, 4 aa, Entamoeba invadens
KEME

SEQ ID NO: 2869984 - protein, 6 aa, Entamoeba invadens
KEMEDK

SEQ ID NO: 2869985 - protein, 7 aa, Entamoeba invadens
KEMEEDL

SEQ ID NO: 2869986 - protein, 9 aa, Entamoeba invadens
KEMEGEKDA

SEQ ID NO: 2869987 - protein, 10 aa, Entamoeba invadens
KEMERAKPPL

SEQ ID NO: 2869988 - protein, 5 aa, Entamoeba invadens
KEMGE

SEQ ID NO: 2869989 - protein, 36 aa, Entamoeba invadens
KEMITSKKKKESETSQKLKPSQNVSMSSTQRNSIQN

SEQ ID NO: 2869990 - protein, 29 aa, Entamoeba invadens
KEMKKSSSDTKLQTEKKPRSSQSTLSPKT

SEQ ID NO: 2869991 - protein, 10 aa, Entamoeba invadens
KEMKSEQFKQ

SEQ ID NO: 2869992 - protein, 8 aa, Entamoeba invadens
KEMNEEDV

SEQ ID NO: 2869993 - protein, 19 aa, Entamoeba invadens
KEMNSEKEQTQQPTENKQD

SEQ ID NO: 2869994 - protein, 10 aa, Entamoeba invadens
KEMNSQTGFN

SEQ ID NO: 2869995 - protein, 4 aa, Entamoeba invadens
KEMP

SEQ ID NO: 2869996 - protein, 11 aa, Entamoeba invadens
KEMPKPTPTAM

SEQ ID NO: 2869997 - protein, 8 aa, Entamoeba invadens
KEMQKDNE

SEQ ID NO: 2869998 - protein, 13 aa, Entamoeba invadens
KEMQSNPIGKLTF

SEQ ID NO: 2869999 - protein, 13 aa, Entamoeba invadens
KEMRAQNQANHEA

SEQ ID NO: 2870000 - protein, 7 aa, Entamoeba invadens
KEMSQNS

SEQ ID NO: 2870001 - protein, 34 aa, Entamoeba invadens
KEMSTESPLKNDNKEDRKRYVEDTDNTTKEMEKR

SEQ ID NO: 2870002 - protein, 6 aa, Entamoeba invadens
KEMSTI

SEQ ID NO: 2870003 - protein, 25 aa, Entamoeba invadens
KEMTAQKPDVQDQRQDQSLKDEMDE

SEQ ID NO: 2870004 - protein, 5 aa, Entamoeba invadens
KEMTE

SEQ ID NO: 2870005 - protein, 7 aa, Entamoeba invadens
KEMTGED

SEQ ID NO: 2870006 - protein, 5 aa, Entamoeba invadens
KEMTL

SEQ ID NO: 2870007 - protein, 7 aa, Entamoeba invadens
KEMTTTG

SEQ ID NO: 2870008 - protein, 5 aa, Entamoeba invadens
KEMYA

SEQ ID NO: 2870009 - protein, 11 aa, Entamoeba invadens
KENACGAHDDI

SEQ ID NO: 2870010 - protein, 14 aa, Entamoeba invadens
KENADPQNDSVKQT

SEQ ID NO: 2870011 - protein, 6 aa, Entamoeba invadens
KENANC

SEQ ID NO: 2870012 - protein, 6 aa, Entamoeba invadens
KENANR

SEQ ID NO: 2870013 - protein, 7 aa, Entamoeba invadens
KENAVSQ

SEQ ID NO: 2870014 - protein, 7 aa, Entamoeba invadens
KENAVTT

SEQ ID NO: 2870015 - protein, 4 aa, Entamoeba invadens
KEND

SEQ ID NO: 2870016 - protein, 15 aa, Entamoeba invadens
KENDNLHEELKYITQ

SEQ ID NO: 2870017 - protein, 7 aa, Entamoeba invadens
KENDVEV

SEQ ID NO: 2870018 - protein, 10 aa, Entamoeba invadens
KENEDSENEV

SEQ ID NO: 2870019 - protein, 9 aa, Entamoeba invadens
KENEEEWAE

SEQ ID NO: 2870020 - protein, 9 aa, Entamoeba invadens
KENEESETF

SEQ ID NO: 2870021 - protein, 9 aa, Entamoeba invadens
KENEEYATE

SEQ ID NO: 2870022 - protein, 7 aa, Entamoeba invadens
KENEEYE

SEQ ID NO: 2870023 - protein, 7 aa, Entamoeba invadens
KENEGPH

SEQ ID NO: 2870024 - protein, 5 aa, Entamoeba invadens
KENEI

SEQ ID NO: 2870025 - protein, 9 aa, Entamoeba invadens
KENEKGDFE

SEQ ID NO: 2870026 - protein, 5 aa, Entamoeba invadens
KENEL

SEQ ID NO: 2870027 - protein, 13 aa, Entamoeba invadens
KENEQLRNFIWGN

SEQ ID NO: 2870028 - protein, 8 aa, Entamoeba invadens
KENEQNME

SEQ ID NO: 2870029 - protein, 11 aa, Entamoeba invadens
KENESGDEPIN

SEQ ID NO: 2870030 - protein, 26 aa, Entamoeba invadens
KENESNKTLQNDTQIKPLDEKQISEL

SEQ ID NO: 2870031 - protein, 20 aa, Entamoeba invadens
KENETLKTALTTTKNENTEL

SEQ ID NO: 2870032 - protein, 6 aa, Entamoeba invadens
KENGEC

SEQ ID NO: 2870033 - protein, 12 aa, Entamoeba invadens
KENGENVGEVPN

SEQ ID NO: 2870034 - protein, 5 aa, Entamoeba invadens
KENGF

SEQ ID NO: 2870035 - protein, 10 aa, Entamoeba invadens
KENGKSKGTA

SEQ ID NO: 2870036 - protein, 6 aa, Entamoeba invadens
KENGNT

SEQ ID NO: 2870037 - protein, 8 aa, Entamoeba invadens
KENGQGNV

SEQ ID NO: 2870038 - protein, 6 aa, Entamoeba invadens
KENGSA

SEQ ID NO: 2870039 - protein, 13 aa, Entamoeba invadens
KENGSDCINEDDE

SEQ ID NO: 2870040 - protein, 7 aa, Entamoeba invadens
KENGTYD

SEQ ID NO: 2870041 - protein, 7 aa, Entamoeba invadens
KENGYTS

SEQ ID NO: 2870042 - protein, 10 aa, Entamoeba invadens
KENHSVSPQM

SEQ ID NO: 2870043 - protein, 5 aa, Entamoeba invadens
KENID

SEQ ID NO: 2870044 - protein, 27 aa, Entamoeba invadens
KENIEKSKEGMVESELSRQESIRQRTQ

SEQ ID NO: 2870045 - protein, 16 aa, Entamoeba invadens
KENIENDKFDGNHKDV

SEQ ID NO: 2870046 - protein, 6 aa, Entamoeba invadens
KENIET

SEQ ID NO: 2870047 - protein, 7 aa, Entamoeba invadens
KENIRTH

SEQ ID NO: 2870048 - protein, 8 aa, Entamoeba invadens
KENISNNT

SEQ ID NO: 2870049 - protein, 5 aa, Entamoeba invadens
KENIT

SEQ ID NO: 2870050 - protein, 10 aa, Entamoeba invadens
KENKDRQRKE

SEQ ID NO: 2870051 - protein, 11 aa, Entamoeba invadens
KENKGTKIKDV

SEQ ID NO: 2870052 - protein, 8 aa, Entamoeba invadens
KENKKIDD

SEQ ID NO: 2870053 - protein, 9 aa, Entamoeba invadens
KENKYSQKE

SEQ ID NO: 2870054 - protein, 4 aa, Entamoeba invadens
KENL

SEQ ID NO: 2870055 - protein, 19 aa, Entamoeba invadens
KENLDNSVHPNQNETNGNV

SEQ ID NO: 2870056 - protein, 25 aa, Entamoeba invadens
KENLGKMSERDGISSTEEARNRGEL

SEQ ID NO: 2870057 - protein, 37 aa, Entamoeba invadens
KENLSGEDKKEKVSEEEKAGKELAKSAQKTKGAISKT

SEQ ID NO: 2870058 - protein, 6 aa, Entamoeba invadens
KENMKC

SEQ ID NO: 2870059 - protein, 5 aa, Entamoeba invadens
KENND

SEQ ID NO: 2870060 - protein, 8 aa, Entamoeba invadens
KENNDTGV

SEQ ID NO: 2870061 - protein, 8 aa, Entamoeba invadens
KENNEGVK

SEQ ID NO: 2870062 - protein, 8 aa, Entamoeba invadens
KENNESRP

SEQ ID NO: 2870063 - protein, 21 aa, Entamoeba invadens
KENNFRESTRRPVSLFPTWKV

SEQ ID NO: 2870064 - protein, 6 aa, Entamoeba invadens
KENNIS

SEQ ID NO: 2870065 - protein, 8 aa, Entamoeba invadens
KENNNKTD

SEQ ID NO: 2870066 - protein, 11 aa, Entamoeba invadens
KENNQMTTSIG

SEQ ID NO: 2870067 - protein, 9 aa, Entamoeba invadens
KENNQQDSI

SEQ ID NO: 2870068 - protein, 7 aa, Entamoeba invadens
KENNSDT

SEQ ID NO: 2870069 - protein, 13 aa, Entamoeba invadens
KENNSEQQKEDIT

SEQ ID NO: 2870070 - protein, 19 aa, Entamoeba invadens
KENNTDDKLNGWNPLTNEK

SEQ ID NO: 2870071 - protein, 6 aa, Entamoeba invadens
KENPKK

SEQ ID NO: 2870072 - protein, 31 aa, Entamoeba invadens
KENPLNLNQNDGITKEEESDDKEINKLINFE

SEQ ID NO: 2870073 - protein, 9 aa, Entamoeba invadens
KENPNEDRK

SEQ ID NO: 2870074 - protein, 8 aa, Entamoeba invadens
KENPTDVE

SEQ ID NO: 2870075 - protein, 5 aa, Entamoeba invadens
KENPY

SEQ ID NO: 2870076 - protein, 21 aa, Entamoeba invadens
KENQHLSTSLEQKKDEVSQLQ

SEQ ID NO: 2870077 - protein, 12 aa, Entamoeba invadens
KENQIEKGKTVD

SEQ ID NO: 2870078 - protein, 20 aa, Entamoeba invadens
KENQIREERRLQKSATPKFE

SEQ ID NO: 2870079 - protein, 6 aa, Entamoeba invadens
KENQMK

SEQ ID NO: 2870080 - protein, 11 aa, Entamoeba invadens
KENQSEATKAV

SEQ ID NO: 2870081 - protein, 7 aa, Entamoeba invadens
KENREGI

SEQ ID NO: 2870082 - protein, 8 aa, Entamoeba invadens
KENREGIV

SEQ ID NO: 2870083 - protein, 9 aa, Entamoeba invadens
KENRENKGV

SEQ ID NO: 2870084 - protein, 6 aa, Entamoeba invadens
KENRPK

SEQ ID NO: 2870085 - protein, 6 aa, Entamoeba invadens
KENSIQ

SEQ ID NO: 2870086 - protein, 6 aa, Entamoeba invadens
KENSKH

SEQ ID NO: 2870087 - protein, 6 aa, Entamoeba invadens
KENSKI

SEQ ID NO: 2870088 - protein, 10 aa, Entamoeba invadens
KENSPRQTVN

SEQ ID NO: 2870089 - protein, 7 aa, Entamoeba invadens
KENSQKK

SEQ ID NO: 2870090 - protein, 8 aa, Entamoeba invadens
KENSRKHL

SEQ ID NO: 2870091 - protein, 7 aa, Entamoeba invadens
KENSTNG

SEQ ID NO: 2870092 - protein, 8 aa, Entamoeba invadens
KENTDTRL

SEQ ID NO: 2870093 - protein, 12 aa, Entamoeba invadens
KENTFSTVNGRN

SEQ ID NO: 2870094 - protein, 6 aa, Entamoeba invadens
KENTIE

SEQ ID NO: 2870095 - protein, 7 aa, Entamoeba invadens
KENTMPG

SEQ ID NO: 2870096 - protein, 12 aa, Entamoeba invadens
KENTTKTPQNMA

SEQ ID NO: 2870097 - protein, 7 aa, Entamoeba invadens
KENVAEY

SEQ ID NO: 2870098 - protein, 7 aa, Entamoeba invadens
KENVISK

SEQ ID NO: 2870099 - protein, 13 aa, Entamoeba invadens
KENVPPESILTPT

SEQ ID NO: 2870100 - protein, 5 aa, Entamoeba invadens
KENVS

SEQ ID NO: 2870101 - protein, 6 aa, Entamoeba invadens
KENVSK

SEQ ID NO: 2870102 - protein, 15 aa, Entamoeba invadens
KENVTDQSKTSTFCG

SEQ ID NO: 2870103 - protein, 13 aa, Entamoeba invadens
KENVTSTNTTNTF

SEQ ID NO: 2870104 - protein, 19 aa, Entamoeba invadens
KENWEDDDDSEDDTKISSK

SEQ ID NO: 2870105 - protein, 22 aa, Entamoeba invadens
KENWQNKTSTAYKTPSYGRNLS

SEQ ID NO: 2870106 - protein, 6 aa, Entamoeba invadens
KENYTE

SEQ ID NO: 2870107 - protein, 7 aa, Entamoeba invadens
KEPANQF

SEQ ID NO: 2870108 - protein, 4 aa, Entamoeba invadens
KEPE

SEQ ID NO: 2870109 - protein, 10 aa, Entamoeba invadens
KEPEERLTGE

SEQ ID NO: 2870110 - protein, 9 aa, Entamoeba invadens
KEPEKTNAH

SEQ ID NO: 2870111 - protein, 74 aa, Entamoeba invadens
KEPENQGQDPRKWTPETKTPQTPPPVVKADPPKRVDATPPQIQQKPPPTTQKEKEKEKKVDPPKETHTQNTVEA

SEQ ID NO: 2870112 - protein, 8 aa, Entamoeba invadens
KEPEPDPL

SEQ ID NO: 2870113 - protein, 6 aa, Entamoeba invadens
KEPEPF

SEQ ID NO: 2870114 - protein, 10 aa, Entamoeba invadens
KEPESVEELE

SEQ ID NO: 2870115 - protein, 15 aa, Entamoeba invadens
KEPETITKMETENTP

SEQ ID NO: 2870116 - protein, 7 aa, Entamoeba invadens
KEPFGDA

SEQ ID NO: 2870117 - protein, 5 aa, Entamoeba invadens
KEPFK

SEQ ID NO: 2870118 - protein, 5 aa, Entamoeba invadens
KEPFP

SEQ ID NO: 2870119 - protein, 23 aa, Entamoeba invadens
KEPIENNSSLVEEGVSDGNTIEN

SEQ ID NO: 2870120 - protein, 10 aa, Entamoeba invadens
KEPIGEPTYD

SEQ ID NO: 2870121 - protein, 25 aa, Entamoeba invadens
KEPIKTEKKTTSKIETTTLKTATKV

SEQ ID NO: 2870122 - protein, 16 aa, Entamoeba invadens
KEPKKEEKVQLKSSSV

SEQ ID NO: 2870123 - protein, 27 aa, Entamoeba invadens
KEPKKGEQGQKQQEEKKEMTETERGRK

SEQ ID NO: 2870124 - protein, 9 aa, Entamoeba invadens
KEPKQENDF

SEQ ID NO: 2870125 - protein, 7 aa, Entamoeba invadens
KEPLAAN

SEQ ID NO: 2870126 - protein, 6 aa, Entamoeba invadens
KEPLDK

SEQ ID NO: 2870127 - protein, 7 aa, Entamoeba invadens
KEPLPVT

SEQ ID NO: 2870128 - protein, 5 aa, Entamoeba invadens
KEPLT

SEQ ID NO: 2870129 - protein, 13 aa, Entamoeba invadens
KEPLYHQSTSQTY

SEQ ID NO: 2870130 - protein, 4 aa, Entamoeba invadens
KEPN

SEQ ID NO: 2870131 - protein, 42 aa, Entamoeba invadens
KEPNASKAKNIESKTSGKKTSKSASFGSANEMEKLGSSHSVN

SEQ ID NO: 2870132 - protein, 5 aa, Entamoeba invadens
KEPNE

SEQ ID NO: 2870133 - protein, 7 aa, Entamoeba invadens
KEPNFQT

SEQ ID NO: 2870134 - protein, 8 aa, Entamoeba invadens
KEPNIQKL

SEQ ID NO: 2870135 - protein, 7 aa, Entamoeba invadens
KEPNQQT

SEQ ID NO: 2870136 - protein, 5 aa, Entamoeba invadens
KEPNY

SEQ ID NO: 2870137 - protein, 18 aa, Entamoeba invadens
KEPPKDRKKNKGVPTVHS

SEQ ID NO: 2870138 - protein, 24 aa, Entamoeba invadens
KEPQKDPVKDEVNKTAEKPVNNEQ

SEQ ID NO: 2870139 - protein, 12 aa, Entamoeba invadens
KEPQKKPKVTRA

SEQ ID NO: 2870140 - protein, 12 aa, Entamoeba invadens
KEPQTKEVKDSK

SEQ ID NO: 2870141 - protein, 5 aa, Entamoeba invadens
KEPRV

SEQ ID NO: 2870142 - protein, 33 aa, Entamoeba invadens
KEPSKDLSKDSKDFKSFSKNSTEDQKEETEGVD

SEQ ID NO: 2870143 - protein, 24 aa, Entamoeba invadens
KEPSNVVETKMDDKDEPKYSDEEA

SEQ ID NO: 2870144 - protein, 10 aa, Entamoeba invadens
KEPTSDAEIR

SEQ ID NO: 2870145 - protein, 6 aa, Entamoeba invadens
KEPTYE

SEQ ID NO: 2870146 - protein, 4 aa, Entamoeba invadens
KEPY

SEQ ID NO: 2870147 - protein, 7 aa, Entamoeba invadens
KEPYPQN

SEQ ID NO: 2870148 - protein, 6 aa, Entamoeba invadens
KEPYSA

SEQ ID NO: 2870149 - protein, 27 aa, Entamoeba invadens
KEQDAKDQENEKKMNKLRTQKDTAINN

SEQ ID NO: 2870150 - protein, 9 aa, Entamoeba invadens
KEQDKNSQI

SEQ ID NO: 2870151 - protein, 5 aa, Entamoeba invadens
KEQDT

SEQ ID NO: 2870152 - protein, 10 aa, Entamoeba invadens
KEQEDKDGVV

SEQ ID NO: 2870153 - protein, 8 aa, Entamoeba invadens
KEQEEKEI

SEQ ID NO: 2870154 - protein, 25 aa, Entamoeba invadens
KEQEFAGANEELETVKKDKFAKEIE

SEQ ID NO: 2870155 - protein, 5 aa, Entamoeba invadens
KEQFN

SEQ ID NO: 2870156 - protein, 7 aa, Entamoeba invadens
KEQFSSL

SEQ ID NO: 2870157 - protein, 24 aa, Entamoeba invadens
KEQGEFKDKITESLKEGLKEGIKQ

SEQ ID NO: 2870158 - protein, 6 aa, Entamoeba invadens
KEQGGI

SEQ ID NO: 2870159 - protein, 10 aa, Entamoeba invadens
KEQGGSLEDS

SEQ ID NO: 2870160 - protein, 5 aa, Entamoeba invadens
KEQGH

SEQ ID NO: 2870161 - protein, 9 aa, Entamoeba invadens
KEQGITRHD

SEQ ID NO: 2870162 - protein, 6 aa, Entamoeba invadens
KEQGLE

SEQ ID NO: 2870163 - protein, 7 aa, Entamoeba invadens
KEQGQNI

SEQ ID NO: 2870164 - protein, 5 aa, Entamoeba invadens
KEQGV

SEQ ID NO: 2870165 - protein, 15 aa, Entamoeba invadens
KEQIESEKKSVETTM

SEQ ID NO: 2870166 - protein, 14 aa, Entamoeba invadens
KEQIKEGKLFIVIK

SEQ ID NO: 2870167 - protein, 6 aa, Entamoeba invadens
KEQIKS

SEQ ID NO: 2870168 - protein, 15 aa, Entamoeba invadens
KEQKDSQTPRRDRSL

SEQ ID NO: 2870169 - protein, 5 aa, Entamoeba invadens
KEQKL

SEQ ID NO: 2870170 - protein, 16 aa, Entamoeba invadens
KEQKNIQDISRKAQKH

SEQ ID NO: 2870171 - protein, 6 aa, Entamoeba invadens
KEQKNW

SEQ ID NO: 2870172 - protein, 8 aa, Entamoeba invadens
KEQKPYVK

SEQ ID NO: 2870173 - protein, 9 aa, Entamoeba invadens
KEQKRDVAN

SEQ ID NO: 2870174 - protein, 13 aa, Entamoeba invadens
KEQKRESDEATDL

SEQ ID NO: 2870175 - protein, 4 aa, Entamoeba invadens
KEQL

SEQ ID NO: 2870176 - protein, 11 aa, Entamoeba invadens
KEQLEEKKKEY

SEQ ID NO: 2870177 - protein, 12 aa, Entamoeba invadens
KEQLEGLDESTF

SEQ ID NO: 2870178 - protein, 8 aa, Entamoeba invadens
KEQLTEEL

SEQ ID NO: 2870179 - protein, 17 aa, Entamoeba invadens
KEQNDYEFDDEDYSFSE

SEQ ID NO: 2870180 - protein, 10 aa, Entamoeba invadens
KEQNEGVQWT

SEQ ID NO: 2870181 - protein, 24 aa, Entamoeba invadens
KEQNENNGKQSPLLTQTEKQLPIE

SEQ ID NO: 2870182 - protein, 6 aa, Entamoeba invadens
KEQNHQ

SEQ ID NO: 2870183 - protein, 12 aa, Entamoeba invadens
KEQNKLDTMTEK

SEQ ID NO: 2870184 - protein, 14 aa, Entamoeba invadens
KEQNKSENEKIENE

SEQ ID NO: 2870185 - protein, 12 aa, Entamoeba invadens
KEQNMSKAQELY

SEQ ID NO: 2870186 - protein, 11 aa, Entamoeba invadens
KEQNPEISGKN

SEQ ID NO: 2870187 - protein, 5 aa, Entamoeba invadens
KEQNV

SEQ ID NO: 2870188 - protein, 7 aa, Entamoeba invadens
KEQNYEE

SEQ ID NO: 2870189 - protein, 16 aa, Entamoeba invadens
KEQPERVSELDAATKE

SEQ ID NO: 2870190 - protein, 14 aa, Entamoeba invadens
KEQPKTTEKVKTPL

SEQ ID NO: 2870191 - protein, 7 aa, Entamoeba invadens
KEQPNAK

SEQ ID NO: 2870192 - protein, 6 aa, Entamoeba invadens
KEQPVG

SEQ ID NO: 2870193 - protein, 13 aa, Entamoeba invadens
KEQQAAAGGSGQG

SEQ ID NO: 2870194 - protein, 8 aa, Entamoeba invadens
KEQQDDLN

SEQ ID NO: 2870195 - protein, 6 aa, Entamoeba invadens
KEQQDE

SEQ ID NO: 2870196 - protein, 9 aa, Entamoeba invadens
KEQQDSNDF

SEQ ID NO: 2870197 - protein, 13 aa, Entamoeba invadens
KEQQESAGGNGQG

SEQ ID NO: 2870198 - protein, 8 aa, Entamoeba invadens
KEQQGSRR

SEQ ID NO: 2870199 - protein, 5 aa, Entamoeba invadens
KEQQK

SEQ ID NO: 2870200 - protein, 9 aa, Entamoeba invadens
KEQQNIQND

SEQ ID NO: 2870201 - protein, 22 aa, Entamoeba invadens
KEQREEQRDYREQEKTGAPLKM

SEQ ID NO: 2870202 - protein, 6 aa, Entamoeba invadens
KEQRRQ

SEQ ID NO: 2870203 - protein, 6 aa, Entamoeba invadens
KEQRTD

SEQ ID NO: 2870204 - protein, 24 aa, Entamoeba invadens
KEQSEGKEPLPSLQKSSPQMSEST

SEQ ID NO: 2870205 - protein, 8 aa, Entamoeba invadens
KEQSLAHP

SEQ ID NO: 2870206 - protein, 16 aa, Entamoeba invadens
KEQSPPPKVPQKSPKL

SEQ ID NO: 2870207 - protein, 15 aa, Entamoeba invadens
KEQSQQTVDETTITT

SEQ ID NO: 2870208 - protein, 8 aa, Entamoeba invadens
KEQSTQSA

SEQ ID NO: 2870209 - protein, 19 aa, Entamoeba invadens
KEQTAEKSGVTDEQLSEIE

SEQ ID NO: 2870210 - protein, 7 aa, Entamoeba invadens
KEQTGFK

SEQ ID NO: 2870211 - protein, 7 aa, Entamoeba invadens
KEQTNEK

SEQ ID NO: 2870212 - protein, 8 aa, Entamoeba invadens
KEQTPTKK

SEQ ID NO: 2870213 - protein, 4 aa, Entamoeba invadens
KEQV

SEQ ID NO: 2870214 - protein, 21 aa, Entamoeba invadens
KERAEEEKYLKQQQEQLRKQA

SEQ ID NO: 2870215 - protein, 29 aa, Entamoeba invadens
KERAEKAALNEKKRLEREVKEKEEEEKRK

SEQ ID NO: 2870216 - protein, 23 aa, Entamoeba invadens
KERANRTSDDSGIEIEDDQNSVI

SEQ ID NO: 2870217 - protein, 23 aa, Entamoeba invadens
KERANRTSDDSGIEIENDQNSVI

SEQ ID NO: 2870218 - protein, 5 aa, Entamoeba invadens
KERCA

SEQ ID NO: 2870219 - protein, 4 aa, Entamoeba invadens
KERD

SEQ ID NO: 2870220 - protein, 6 aa, Entamoeba invadens
KERDRD

SEQ ID NO: 2870221 - protein, 23 aa, Entamoeba invadens
KEREEKLRKLREKKQSQKAEKIE

SEQ ID NO: 2870222 - protein, 7 aa, Entamoeba invadens
KEREETN

SEQ ID NO: 2870223 - protein, 7 aa, Entamoeba invadens
KEREKEC

SEQ ID NO: 2870224 - protein, 10 aa, Entamoeba invadens
KEREKFEKEK

SEQ ID NO: 2870225 - protein, 10 aa, Entamoeba invadens
KEREKQINEL

SEQ ID NO: 2870226 - protein, 8 aa, Entamoeba invadens
KERENSER

SEQ ID NO: 2870227 - protein, 25 aa, Entamoeba invadens
KEREQEPEKTKNMESNPREIKPPTA

SEQ ID NO: 2870228 - protein, 15 aa, Entamoeba invadens
KEREREMEEKKTQLE

SEQ ID NO: 2870229 - protein, 8 aa, Entamoeba invadens
KERERKEH

SEQ ID NO: 2870230 - protein, 8 aa, Entamoeba invadens
KERESDKV

SEQ ID NO: 2870231 - protein, 6 aa, Entamoeba invadens
KERESR

SEQ ID NO: 2870232 - protein, 11 aa, Entamoeba invadens
KEREVNAKKQI

SEQ ID NO: 2870233 - protein, 16 aa, Entamoeba invadens
KERGFVDPNGRTNGMA

SEQ ID NO: 2870234 - protein, 5 aa, Entamoeba invadens
KERGG

SEQ ID NO: 2870235 - protein, 4 aa, Entamoeba invadens
KERI

SEQ ID NO: 2870236 - protein, 14 aa, Entamoeba invadens
KERIDANVNPSKTA

SEQ ID NO: 2870237 - protein, 8 aa, Entamoeba invadens
KERIEETG

SEQ ID NO: 2870238 - protein, 83 aa, Entamoeba invadens
KERIEREKNEKLERERIEKERLDKEKKSKEKAKDDDSKDEQKSLKKNKLKNKKKNNKKKQTKRTTEKKEPIDEAQKPPTRELP

SEQ ID NO: 2870239 - protein, 6 aa, Entamoeba invadens
KERILS

SEQ ID NO: 2870240 - protein, 6 aa, Entamoeba invadens
KERIQD

SEQ ID NO: 2870241 - protein, 4 aa, Entamoeba invadens
KERK

SEQ ID NO: 2870242 - protein, 6 aa, Entamoeba invadens
KERKDL

SEQ ID NO: 2870243 - protein, 5 aa, Entamoeba invadens
KERKI

SEQ ID NO: 2870244 - protein, 8 aa, Entamoeba invadens
KERKKDLD

SEQ ID NO: 2870245 - protein, 7 aa, Entamoeba invadens
KERKKSG

SEQ ID NO: 2870246 - protein, 15 aa, Entamoeba invadens
KERKQPNGLKGTLQR

SEQ ID NO: 2870247 - protein, 19 aa, Entamoeba invadens
KERKQVKALEKKEAEDKRK

SEQ ID NO: 2870248 - protein, 37 aa, Entamoeba invadens
KERKREEKEQKKEDKKKSLPSSKPESRDQSQERPDKK

SEQ ID NO: 2870249 - protein, 9 aa, Entamoeba invadens
KERKREYQL

SEQ ID NO: 2870250 - protein, 7 aa, Entamoeba invadens
KERKSTS

SEQ ID NO: 2870251 - protein, 7 aa, Entamoeba invadens
KERLETL

SEQ ID NO: 2870252 - protein, 9 aa, Entamoeba invadens
KERLNIDPK

SEQ ID NO: 2870253 - protein, 4 aa, Entamoeba invadens
KERN

SEQ ID NO: 2870254 - protein, 6 aa, Entamoeba invadens
KERNDV

SEQ ID NO: 2870255 - protein, 8 aa, Entamoeba invadens
KERNENDS

SEQ ID NO: 2870256 - protein, 18 aa, Entamoeba invadens
KERNEREGAEEDREQRRM

SEQ ID NO: 2870257 - protein, 5 aa, Entamoeba invadens
KERNG

SEQ ID NO: 2870258 - protein, 17 aa, Entamoeba invadens
KERNQLNSQLTDNNSKL

SEQ ID NO: 2870259 - protein, 15 aa, Entamoeba invadens
KERPAEKDGVATTRQ

SEQ ID NO: 2870260 - protein, 4 aa, Entamoeba invadens
KERQ

SEQ ID NO: 2870261 - protein, 11 aa, Entamoeba invadens
KERQGLGAPRT

SEQ ID NO: 2870262 - protein, 6 aa, Entamoeba invadens
KERQKD

SEQ ID NO: 2870263 - protein, 5 aa, Entamoeba invadens
KERQN

SEQ ID NO: 2870264 - protein, 7 aa, Entamoeba invadens
KERQSGV

SEQ ID NO: 2870265 - protein, 10 aa, Entamoeba invadens
KERQSKKKSI

SEQ ID NO: 2870266 - protein, 21 aa, Entamoeba invadens
KERQTINTTRLSGSRNEKKNG

SEQ ID NO: 2870267 - protein, 4 aa, Entamoeba invadens
KERR

SEQ ID NO: 2870268 - protein, 9 aa, Entamoeba invadens
KERRGAQKI

SEQ ID NO: 2870269 - protein, 5 aa, Entamoeba invadens
KERRI

SEQ ID NO: 2870270 - protein, 11 aa, Entamoeba invadens
KERRPPGLRES

SEQ ID NO: 2870271 - protein, 12 aa, Entamoeba invadens
KERSAKSRKTPP

SEQ ID NO: 2870272 - protein, 6 aa, Entamoeba invadens
KERSGD

SEQ ID NO: 2870273 - protein, 23 aa, Entamoeba invadens
KERSGTPEKKLDDDLKSQDKEVQ

SEQ ID NO: 2870274 - protein, 6 aa, Entamoeba invadens
KERSIN

SEQ ID NO: 2870275 - protein, 6 aa, Entamoeba invadens
KERSTK

SEQ ID NO: 2870276 - protein, 25 aa, Entamoeba invadens
KERSYDLERAEKKAEKRWKKETAEV

SEQ ID NO: 2870277 - protein, 14 aa, Entamoeba invadens
KERTEAVEQAEKEL

SEQ ID NO: 2870278 - protein, 8 aa, Entamoeba invadens
KERTERVE

SEQ ID NO: 2870279 - protein, 9 aa, Entamoeba invadens
KERTGANPP

SEQ ID NO: 2870280 - protein, 24 aa, Entamoeba invadens
KERTHERSLSSERTRRNTISDSGL

SEQ ID NO: 2870281 - protein, 11 aa, Entamoeba invadens
KERTKNEGKEH

SEQ ID NO: 2870282 - protein, 12 aa, Entamoeba invadens
KERTPLKEKSPD

SEQ ID NO: 2870283 - protein, 6 aa, Entamoeba invadens
KERTRN

SEQ ID NO: 2870284 - protein, 15 aa, Entamoeba invadens
KERTRYDKEVETNAF

SEQ ID NO: 2870285 - protein, 8 aa, Entamoeba invadens
KERTTPLP

SEQ ID NO: 2870286 - protein, 5 aa, Entamoeba invadens
KERYE

SEQ ID NO: 2870287 - protein, 6 aa, Entamoeba invadens
KERYEA

SEQ ID NO: 2870288 - protein, 14 aa, Entamoeba invadens
KERYEEAKKRTIEQ

SEQ ID NO: 2870289 - protein, 12 aa, Entamoeba invadens
KERYEGSDVEQK

SEQ ID NO: 2870290 - protein, 7 aa, Entamoeba invadens
KESAACD

SEQ ID NO: 2870291 - protein, 9 aa, Entamoeba invadens
KESADDAKV

SEQ ID NO: 2870292 - protein, 9 aa, Entamoeba invadens
KESAEEKRI

SEQ ID NO: 2870293 - protein, 8 aa, Entamoeba invadens
KESALKKM

SEQ ID NO: 2870294 - protein, 14 aa, Entamoeba invadens
KESAMTESPLNGET

SEQ ID NO: 2870295 - protein, 5 aa, Entamoeba invadens
KESAP

SEQ ID NO: 2870296 - protein, 14 aa, Entamoeba invadens
KESATQTNNFGALL

SEQ ID NO: 2870297 - protein, 15 aa, Entamoeba invadens
KESDEKKPRKNTADH

SEQ ID NO: 2870298 - protein, 6 aa, Entamoeba invadens
KESDGK

SEQ ID NO: 2870299 - protein, 5 aa, Entamoeba invadens
KESDI

SEQ ID NO: 2870300 - protein, 48 aa, Entamoeba invadens
KESDKAKAKKAKEAKEAKKKEEKKDDSSSSSSSDSSSDEEKEDDGAED

SEQ ID NO: 2870301 - protein, 5 aa, Entamoeba invadens
KESDL

SEQ ID NO: 2870302 - protein, 13 aa, Entamoeba invadens
KESDNIKDKTQTI

SEQ ID NO: 2870303 - protein, 10 aa, Entamoeba invadens
KESDSDSAKN

SEQ ID NO: 2870304 - protein, 10 aa, Entamoeba invadens
KESDVEKKGF

SEQ ID NO: 2870305 - protein, 9 aa, Entamoeba invadens
KESDYDKTR

SEQ ID NO: 2870306 - protein, 9 aa, Entamoeba invadens
KESEEVKEK

SEQ ID NO: 2870307 - protein, 5 aa, Entamoeba invadens
KESEF

SEQ ID NO: 2870308 - protein, 9 aa, Entamoeba invadens
KESEGIQKI

SEQ ID NO: 2870309 - protein, 8 aa, Entamoeba invadens
KESEIHKD

SEQ ID NO: 2870310 - protein, 12 aa, Entamoeba invadens
KESEKLDRDIKP

SEQ ID NO: 2870311 - protein, 25 aa, Entamoeba invadens
KESEQNSPTSTSVPSTSPRPPISPM

SEQ ID NO: 2870312 - protein, 7 aa, Entamoeba invadens
KESESKE

SEQ ID NO: 2870313 - protein, 11 aa, Entamoeba invadens
KESEVEASSLA

SEQ ID NO: 2870314 - protein, 4 aa, Entamoeba invadens
KESF

SEQ ID NO: 2870315 - protein, 6 aa, Entamoeba invadens
KESFED

SEQ ID NO: 2870316 - protein, 8 aa, Entamoeba invadens
KESFESVE

SEQ ID NO: 2870317 - protein, 10 aa, Entamoeba invadens
KESFETKEKT

SEQ ID NO: 2870318 - protein, 7 aa, Entamoeba invadens
KESFQDE

SEQ ID NO: 2870319 - protein, 5 aa, Entamoeba invadens
KESFT

SEQ ID NO: 2870320 - protein, 6 aa, Entamoeba invadens
KESGEH

SEQ ID NO: 2870321 - protein, 8 aa, Entamoeba invadens
KESGESEL

SEQ ID NO: 2870322 - protein, 7 aa, Entamoeba invadens
KESGKIR

SEQ ID NO: 2870323 - protein, 7 aa, Entamoeba invadens
KESGKVG

SEQ ID NO: 2870324 - protein, 9 aa, Entamoeba invadens
KESGPKGID

SEQ ID NO: 2870325 - protein, 11 aa, Entamoeba invadens
KESGTKTVPET

SEQ ID NO: 2870326 - protein, 12 aa, Entamoeba invadens
KESHQNNIQAGE

SEQ ID NO: 2870327 - protein, 5 aa, Entamoeba invadens
KESID

SEQ ID NO: 2870328 - protein, 12 aa, Entamoeba invadens
KESIGTTEGASR

SEQ ID NO: 2870329 - protein, 10 aa, Entamoeba invadens
KESIKSTSPI

SEQ ID NO: 2870330 - protein, 9 aa, Entamoeba invadens
KESISTSPL

SEQ ID NO: 2870331 - protein, 4 aa, Entamoeba invadens
KESK

SEQ ID NO: 2870332 - protein, 11 aa, Entamoeba invadens
KESKKEKTLQL

SEQ ID NO: 2870333 - protein, 7 aa, Entamoeba invadens
KESKKYC

SEQ ID NO: 2870334 - protein, 10 aa, Entamoeba invadens
KESKNEKESL

SEQ ID NO: 2870335 - protein, 7 aa, Entamoeba invadens
KESKNIE

SEQ ID NO: 2870336 - protein, 9 aa, Entamoeba invadens
KESKNSTNI

SEQ ID NO: 2870337 - protein, 9 aa, Entamoeba invadens
KESKRMASK

SEQ ID NO: 2870338 - protein, 8 aa, Entamoeba invadens
KESKSVTK

SEQ ID NO: 2870339 - protein, 6 aa, Entamoeba invadens
KESKTM

SEQ ID NO: 2870340 - protein, 6 aa, Entamoeba invadens
KESKYY

SEQ ID NO: 2870341 - protein, 17 aa, Entamoeba invadens
KESLETQQKEFKEEQIE

SEQ ID NO: 2870342 - protein, 7 aa, Entamoeba invadens
KESLGKI

SEQ ID NO: 2870343 - protein, 9 aa, Entamoeba invadens
KESLKENGD

SEQ ID NO: 2870344 - protein, 12 aa, Entamoeba invadens
KESLKESEEELI

SEQ ID NO: 2870345 - protein, 8 aa, Entamoeba invadens
KESLTTTQ

SEQ ID NO: 2870346 - protein, 49 aa, Entamoeba invadens
KESMDPSKPKKKSVEEMKAEGLRKKAEREAQRLAEQSALPPQQEEDFTP

SEQ ID NO: 2870347 - protein, 6 aa, Entamoeba invadens
KESMKN

SEQ ID NO: 2870348 - protein, 9 aa, Entamoeba invadens
KESMNPDQS

SEQ ID NO: 2870349 - protein, 27 aa, Entamoeba invadens
KESMNQDIQRGISETTACRRYTNNKIA

SEQ ID NO: 2870350 - protein, 7 aa, Entamoeba invadens
KESNEER

SEQ ID NO: 2870351 - protein, 28 aa, Entamoeba invadens
KESNESSNSASSVSTEAVQQNSPQPSEV

SEQ ID NO: 2870352 - protein, 8 aa, Entamoeba invadens
KESNGDVK

SEQ ID NO: 2870353 - protein, 12 aa, Entamoeba invadens
KESNGSVVQGDM

SEQ ID NO: 2870354 - protein, 7 aa, Entamoeba invadens
KESNMNK

SEQ ID NO: 2870355 - protein, 9 aa, Entamoeba invadens
KESNNTQIF

SEQ ID NO: 2870356 - protein, 5 aa, Entamoeba invadens
KESNR

SEQ ID NO: 2870357 - protein, 6 aa, Entamoeba invadens
KESNTI

SEQ ID NO: 2870358 - protein, 16 aa, Entamoeba invadens
KESNYTHLTPSDVDSI

SEQ ID NO: 2870359 - protein, 5 aa, Entamoeba invadens
KESPD

SEQ ID NO: 2870360 - protein, 11 aa, Entamoeba invadens
KESPLQTPSNL

SEQ ID NO: 2870361 - protein, 6 aa, Entamoeba invadens
KESPNF

SEQ ID NO: 2870362 - protein, 9 aa, Entamoeba invadens
KESPPHNEV

SEQ ID NO: 2870363 - protein, 7 aa, Entamoeba invadens
KESPSEA

SEQ ID NO: 2870364 - protein, 8 aa, Entamoeba invadens
KESPSKKK

SEQ ID NO: 2870365 - protein, 28 aa, Entamoeba invadens
KESQEWSRQEKQNKKMRTFAETEKGVEI

SEQ ID NO: 2870366 - protein, 30 aa, Entamoeba invadens
KESQKAQSIPLNSQNQRRSQKDQLKSQQEE

SEQ ID NO: 2870367 - protein, 6 aa, Entamoeba invadens
KESQLL

SEQ ID NO: 2870368 - protein, 11 aa, Entamoeba invadens
KESQPINFSQT

SEQ ID NO: 2870369 - protein, 7 aa, Entamoeba invadens
KESQQPI

SEQ ID NO: 2870370 - protein, 6 aa, Entamoeba invadens
KESRES

SEQ ID NO: 2870371 - protein, 8 aa, Entamoeba invadens
KESRLEES

SEQ ID NO: 2870372 - protein, 7 aa, Entamoeba invadens
KESSCRN

SEQ ID NO: 2870373 - protein, 7 aa, Entamoeba invadens
KESSEIV

SEQ ID NO: 2870374 - protein, 9 aa, Entamoeba invadens
KESSEPKQI

SEQ ID NO: 2870375 - protein, 7 aa, Entamoeba invadens
KESSERI

SEQ ID NO: 2870376 - protein, 6 aa, Entamoeba invadens
KESSFK

SEQ ID NO: 2870377 - protein, 6 aa, Entamoeba invadens
KESSFL

SEQ ID NO: 2870378 - protein, 7 aa, Entamoeba invadens
KESSKTH

SEQ ID NO: 2870379 - protein, 6 aa, Entamoeba invadens
KESSNK

SEQ ID NO: 2870380 - protein, 15 aa, Entamoeba invadens
KESSSDERKEYGKGI

SEQ ID NO: 2870381 - protein, 12 aa, Entamoeba invadens
KESSVVKQTDYI

SEQ ID NO: 2870382 - protein, 4 aa, Entamoeba invadens
KEST

SEQ ID NO: 2870383 - protein, 5 aa, Entamoeba invadens
KESTN

SEQ ID NO: 2870384 - protein, 7 aa, Entamoeba invadens
KESTNAT

SEQ ID NO: 2870385 - protein, 15 aa, Entamoeba invadens
KESTPKLSDKSTYNN

SEQ ID NO: 2870386 - protein, 11 aa, Entamoeba invadens
KESTSDEKGKM

SEQ ID NO: 2870387 - protein, 5 aa, Entamoeba invadens
KESVD

SEQ ID NO: 2870388 - protein, 11 aa, Entamoeba invadens
KESVKQEGKKA

SEQ ID NO: 2870389 - protein, 9 aa, Entamoeba invadens
KESVSNAGV

SEQ ID NO: 2870390 - protein, 7 aa, Entamoeba invadens
KESVTKL

SEQ ID NO: 2870391 - protein, 5 aa, Entamoeba invadens
KESYD

SEQ ID NO: 2870392 - protein, 7 aa, Entamoeba invadens
KESYDKI

SEQ ID NO: 2870393 - protein, 9 aa, Entamoeba invadens
KESYESGEY

SEQ ID NO: 2870394 - protein, 5 aa, Entamoeba invadens
KESYN

SEQ ID NO: 2870395 - protein, 6 aa, Entamoeba invadens
KESYPK

SEQ ID NO: 2870396 - protein, 24 aa, Entamoeba invadens
KETAEAGNRERRSIEKKAHKDALK

SEQ ID NO: 2870397 - protein, 7 aa, Entamoeba invadens
KETAKNV

SEQ ID NO: 2870398 - protein, 8 aa, Entamoeba invadens
KETAKSIN

SEQ ID NO: 2870399 - protein, 11 aa, Entamoeba invadens
KETAKTDLERS

SEQ ID NO: 2870400 - protein, 8 aa, Entamoeba invadens
KETAQSRV

SEQ ID NO: 2870401 - protein, 28 aa, Entamoeba invadens
KETCDTNDNLNKQLDELKTQKASVENTI

SEQ ID NO: 2870402 - protein, 7 aa, Entamoeba invadens
KETDAEM

SEQ ID NO: 2870403 - protein, 6 aa, Entamoeba invadens
KETDEH

SEQ ID NO: 2870404 - protein, 6 aa, Entamoeba invadens
KETDKN

SEQ ID NO: 2870405 - protein, 36 aa, Entamoeba invadens
KETEEKKEVKVETKDLKETELKTPQPNQSSEKQETS

SEQ ID NO: 2870406 - protein, 44 aa, Entamoeba invadens
KETEGENEAEPVESEHTSDDDWGEKKDPSDVKKTSRVTSIQTSL

SEQ ID NO: 2870407 - protein, 6 aa, Entamoeba invadens
KETEHT

SEQ ID NO: 2870408 - protein, 7 aa, Entamoeba invadens
KETEIKE

SEQ ID NO: 2870409 - protein, 17 aa, Entamoeba invadens
KETEKATGTSDLEENHN

SEQ ID NO: 2870410 - protein, 10 aa, Entamoeba invadens
KETEKELDEF

SEQ ID NO: 2870411 - protein, 6 aa, Entamoeba invadens
KETEKF

SEQ ID NO: 2870412 - protein, 17 aa, Entamoeba invadens
KETEKLLGSGGQITTTE

SEQ ID NO: 2870413 - protein, 7 aa, Entamoeba invadens
KETEKLQ

SEQ ID NO: 2870414 - protein, 18 aa, Entamoeba invadens
KETEKNIEKIAPGTYYTP

SEQ ID NO: 2870415 - protein, 20 aa, Entamoeba invadens
KETEKTEWLSEGKREDEKVS

SEQ ID NO: 2870416 - protein, 5 aa, Entamoeba invadens
KETEN

SEQ ID NO: 2870417 - protein, 14 aa, Entamoeba invadens
KETENTKNDETGDA

SEQ ID NO: 2870418 - protein, 24 aa, Entamoeba invadens
KETEQQITGRQKSHVSTSSDSYTV

SEQ ID NO: 2870419 - protein, 7 aa, Entamoeba invadens
KETESLP

SEQ ID NO: 2870420 - protein, 8 aa, Entamoeba invadens
KETESTPV

SEQ ID NO: 2870421 - protein, 9 aa, Entamoeba invadens
KETESTTKF

SEQ ID NO: 2870422 - protein, 7 aa, Entamoeba invadens
KETEYYD

SEQ ID NO: 2870423 - protein, 4 aa, Entamoeba invadens
KETF

SEQ ID NO: 2870424 - protein, 6 aa, Entamoeba invadens
KETGEI

SEQ ID NO: 2870425 - protein, 8 aa, Entamoeba invadens
KETGEKYA

SEQ ID NO: 2870426 - protein, 9 aa, Entamoeba invadens
KETGESKSD

SEQ ID NO: 2870427 - protein, 10 aa, Entamoeba invadens
KETGEVEPAK

SEQ ID NO: 2870428 - protein, 21 aa, Entamoeba invadens
KETGKPAKKYNKAPKSEIHDR

SEQ ID NO: 2870429 - protein, 11 aa, Entamoeba invadens
KETGQKTVTLD

SEQ ID NO: 2870430 - protein, 7 aa, Entamoeba invadens
KETGYLK

SEQ ID NO: 2870431 - protein, 7 aa, Entamoeba invadens
KETHNPN

SEQ ID NO: 2870432 - protein, 4 aa, Entamoeba invadens
KETI

SEQ ID NO: 2870433 - protein, 9 aa, Entamoeba invadens
KETIDDSTK

SEQ ID NO: 2870434 - protein, 8 aa, Entamoeba invadens
KETIEETG

SEQ ID NO: 2870435 - protein, 11 aa, Entamoeba invadens
KETIENESKPL

SEQ ID NO: 2870436 - protein, 8 aa, Entamoeba invadens
KETIKKAR

SEQ ID NO: 2870437 - protein, 11 aa, Entamoeba invadens
KETIKTSEIKN

SEQ ID NO: 2870438 - protein, 8 aa, Entamoeba invadens
KETIRTPA

SEQ ID NO: 2870439 - protein, 7 aa, Entamoeba invadens
KETKAVS

SEQ ID NO: 2870440 - protein, 10 aa, Entamoeba invadens
KETKDTDLPM

SEQ ID NO: 2870441 - protein, 71 aa, Entamoeba invadens
KETKEAKIQKEQQKVFSPPKKRKQKTHIKSEDGDDENSDAPIKNNEVEPPKTLEKSQDQKQEEKHQENQIQ

SEQ ID NO: 2870442 - protein, 11 aa, Entamoeba invadens
KETKEALSQEI

SEQ ID NO: 2870443 - protein, 17 aa, Entamoeba invadens
KETKEESDKKTTETSYD

SEQ ID NO: 2870444 - protein, 25 aa, Entamoeba invadens
KETKETEESPELKEQKSPETPQAVH

SEQ ID NO: 2870445 - protein, 7 aa, Entamoeba invadens
KETKKNE

SEQ ID NO: 2870446 - protein, 10 aa, Entamoeba invadens
KETKNEKDKI

SEQ ID NO: 2870447 - protein, 10 aa, Entamoeba invadens
KETKNGVKEN

SEQ ID NO: 2870448 - protein, 6 aa, Entamoeba invadens
KETKPF

SEQ ID NO: 2870449 - protein, 20 aa, Entamoeba invadens
KETKQKSTRQNSRETNSPQL

SEQ ID NO: 2870450 - protein, 5 aa, Entamoeba invadens
KETKR

SEQ ID NO: 2870451 - protein, 6 aa, Entamoeba invadens
KETKSK

SEQ ID NO: 2870452 - protein, 8 aa, Entamoeba invadens
KETKVERN

SEQ ID NO: 2870453 - protein, 5 aa, Entamoeba invadens
KETLA

SEQ ID NO: 2870454 - protein, 24 aa, Entamoeba invadens
KETLPPTVPDVTPYQVKENNKTYN

SEQ ID NO: 2870455 - protein, 6 aa, Entamoeba invadens
KETLQN

SEQ ID NO: 2870456 - protein, 8 aa, Entamoeba invadens
KETMQKEQ

SEQ ID NO: 2870457 - protein, 7 aa, Entamoeba invadens
KETNDRI

SEQ ID NO: 2870458 - protein, 10 aa, Entamoeba invadens
KETNKKKFTT

SEQ ID NO: 2870459 - protein, 18 aa, Entamoeba invadens
KETNKQLTAEKLTDGTTA

SEQ ID NO: 2870460 - protein, 5 aa, Entamoeba invadens
KETNV

SEQ ID NO: 2870461 - protein, 8 aa, Entamoeba invadens
KETPENKG

SEQ ID NO: 2870462 - protein, 7 aa, Entamoeba invadens
KETPKIG

SEQ ID NO: 2870463 - protein, 6 aa, Entamoeba invadens
KETPNI

SEQ ID NO: 2870464 - protein, 8 aa, Entamoeba invadens
KETPREPL

SEQ ID NO: 2870465 - protein, 52 aa, Entamoeba invadens
KETPSQDSLKKEEKEVKPLNTKSEKEENKEIKIEEKEMKETTETKENKDIPI

SEQ ID NO: 2870466 - protein, 5 aa, Entamoeba invadens
KETPV

SEQ ID NO: 2870467 - protein, 6 aa, Entamoeba invadens
KETQAQ

SEQ ID NO: 2870468 - protein, 11 aa, Entamoeba invadens
KETQEAKTLGV

SEQ ID NO: 2870469 - protein, 12 aa, Entamoeba invadens
KETQETEHRTDV

SEQ ID NO: 2870470 - protein, 6 aa, Entamoeba invadens
KETQEV

SEQ ID NO: 2870471 - protein, 17 aa, Entamoeba invadens
KETQKPLQTETKEERPK

SEQ ID NO: 2870472 - protein, 15 aa, Entamoeba invadens
KETQKRGNLILVLEI

SEQ ID NO: 2870473 - protein, 15 aa, Entamoeba invadens
KETQKRGNLVMILKI

SEQ ID NO: 2870474 - protein, 15 aa, Entamoeba invadens
KETQKRGNLVMVLEI

SEQ ID NO: 2870475 - protein, 32 aa, Entamoeba invadens
KETQNGTQTLTSVTAKSSTKFRSVESNTSELT

SEQ ID NO: 2870476 - protein, 11 aa, Entamoeba invadens
KETQNKKEETD

SEQ ID NO: 2870477 - protein, 7 aa, Entamoeba invadens
KETQNNN

SEQ ID NO: 2870478 - protein, 7 aa, Entamoeba invadens
KETQQSA

SEQ ID NO: 2870479 - protein, 5 aa, Entamoeba invadens
KETQS

SEQ ID NO: 2870480 - protein, 8 aa, Entamoeba invadens
KETRKTAD

SEQ ID NO: 2870481 - protein, 7 aa, Entamoeba invadens
KETRLSV

SEQ ID NO: 2870482 - protein, 8 aa, Entamoeba invadens
KETRNGKI

SEQ ID NO: 2870483 - protein, 6 aa, Entamoeba invadens
KETRPY

SEQ ID NO: 2870484 - protein, 5 aa, Entamoeba invadens
KETSC

SEQ ID NO: 2870485 - protein, 12 aa, Entamoeba invadens
KETSHKKEITPR

SEQ ID NO: 2870486 - protein, 9 aa, Entamoeba invadens
KETSKETIE

SEQ ID NO: 2870487 - protein, 6 aa, Entamoeba invadens
KETSLN

SEQ ID NO: 2870488 - protein, 14 aa, Entamoeba invadens
KETSNDNWNEITNG

SEQ ID NO: 2870489 - protein, 7 aa, Entamoeba invadens
KETSNSK

SEQ ID NO: 2870490 - protein, 9 aa, Entamoeba invadens
KETSPSRKM

SEQ ID NO: 2870491 - protein, 6 aa, Entamoeba invadens
KETSRE

SEQ ID NO: 2870492 - protein, 5 aa, Entamoeba invadens
KETSS

SEQ ID NO: 2870493 - protein, 5 aa, Entamoeba invadens
KETST

SEQ ID NO: 2870494 - protein, 12 aa, Entamoeba invadens
KETTEDIESNFS

SEQ ID NO: 2870495 - protein, 25 aa, Entamoeba invadens
KETTEPPKLPHKSLPPKLPQKQSEV

SEQ ID NO: 2870496 - protein, 9 aa, Entamoeba invadens
KETTEQSSK

SEQ ID NO: 2870497 - protein, 7 aa, Entamoeba invadens
KETTERF

SEQ ID NO: 2870498 - protein, 8 aa, Entamoeba invadens
KETTGNKN

SEQ ID NO: 2870499 - protein, 26 aa, Entamoeba invadens
KETTHPEIDTEQESHSAGTPRKVGSR

SEQ ID NO: 2870500 - protein, 12 aa, Entamoeba invadens
KETTKELLEDIQ

SEQ ID NO: 2870501 - protein, 7 aa, Entamoeba invadens
KETTKLE

SEQ ID NO: 2870502 - protein, 8 aa, Entamoeba invadens
KETTNGGF

SEQ ID NO: 2870503 - protein, 9 aa, Entamoeba invadens
KETTPVITE

SEQ ID NO: 2870504 - protein, 9 aa, Entamoeba invadens
KETTRDPLE

SEQ ID NO: 2870505 - protein, 21 aa, Entamoeba invadens
KETTSSEQSKPAEKTKQADDL

SEQ ID NO: 2870506 - protein, 9 aa, Entamoeba invadens
KETTTEDDG

SEQ ID NO: 2870507 - protein, 4 aa, Entamoeba invadens
KETV

SEQ ID NO: 2870508 - protein, 17 aa, Entamoeba invadens
KETVDKLKNAGNDVQRL

SEQ ID NO: 2870509 - protein, 19 aa, Entamoeba invadens
KETVDSDEMKEAARTHARK

SEQ ID NO: 2870510 - protein, 6 aa, Entamoeba invadens
KETVEL

SEQ ID NO: 2870511 - protein, 8 aa, Entamoeba invadens
KETVESQN

SEQ ID NO: 2870512 - protein, 5 aa, Entamoeba invadens
KETWN

SEQ ID NO: 2870513 - protein, 4 aa, Entamoeba invadens
KETY

SEQ ID NO: 2870514 - protein, 5 aa, Entamoeba invadens
KETYY

SEQ ID NO: 2870515 - protein, 5 aa, Entamoeba invadens
KEVAD

SEQ ID NO: 2870516 - protein, 17 aa, Entamoeba invadens
KEVADSYRKNSSKISNM

SEQ ID NO: 2870517 - protein, 8 aa, Entamoeba invadens
KEVAKKTE

SEQ ID NO: 2870518 - protein, 13 aa, Entamoeba invadens
KEVDAQKKQIYTE

SEQ ID NO: 2870519 - protein, 19 aa, Entamoeba invadens
KEVDEVEGETITKKVREKS

SEQ ID NO: 2870520 - protein, 14 aa, Entamoeba invadens
KEVDKRKASNIQEK

SEQ ID NO: 2870521 - protein, 17 aa, Entamoeba invadens
KEVDNLKGQAEVNAQTN

SEQ ID NO: 2870522 - protein, 11 aa, Entamoeba invadens
KEVDPDGERTI

SEQ ID NO: 2870523 - protein, 6 aa, Entamoeba invadens
KEVDSR

SEQ ID NO: 2870524 - protein, 4 aa, Entamoeba invadens
KEVE

SEQ ID NO: 2870525 - protein, 7 aa, Entamoeba invadens
KEVEDGE

SEQ ID NO: 2870526 - protein, 15 aa, Entamoeba invadens
KEVEDTKVSEGQITS

SEQ ID NO: 2870527 - protein, 5 aa, Entamoeba invadens
KEVEE

SEQ ID NO: 2870528 - protein, 8 aa, Entamoeba invadens
KEVEEGLK

SEQ ID NO: 2870529 - protein, 11 aa, Entamoeba invadens
KEVEEKAGGLK

SEQ ID NO: 2870530 - protein, 13 aa, Entamoeba invadens
KEVEELKKKDQAI

SEQ ID NO: 2870531 - protein, 5 aa, Entamoeba invadens
KEVEF

SEQ ID NO: 2870532 - protein, 9 aa, Entamoeba invadens
KEVEGRKSL

SEQ ID NO: 2870533 - protein, 15 aa, Entamoeba invadens
KEVENQTNSEREVEK

SEQ ID NO: 2870534 - protein, 6 aa, Entamoeba invadens
KEVETT

SEQ ID NO: 2870535 - protein, 5 aa, Entamoeba invadens
KEVEY

SEQ ID NO: 2870536 - protein, 39 aa, Entamoeba invadens
KEVEYSKVDTQNQKIAPCDTQKVTESYKKDDTQISEKDD

SEQ ID NO: 2870537 - protein, 7 aa, Entamoeba invadens
KEVGKFN

SEQ ID NO: 2870538 - protein, 6 aa, Entamoeba invadens
KEVGNR

SEQ ID NO: 2870539 - protein, 13 aa, Entamoeba invadens
KEVGRKVEELTSE

SEQ ID NO: 2870540 - protein, 6 aa, Entamoeba invadens
KEVGSG

SEQ ID NO: 2870541 - protein, 8 aa, Entamoeba invadens
KEVGYGGS

SEQ ID NO: 2870542 - protein, 53 aa, Entamoeba invadens
KEVKATDKKAAEEVKKAKKEKVEKKPRKSTEKKTKKVDEEGKKNTLSKKAGLQ

SEQ ID NO: 2870543 - protein, 7 aa, Entamoeba invadens
KEVKGGK

SEQ ID NO: 2870544 - protein, 7 aa, Entamoeba invadens
KEVKGVK

SEQ ID NO: 2870545 - protein, 9 aa, Entamoeba invadens
KEVKKNGEL

SEQ ID NO: 2870546 - protein, 7 aa, Entamoeba invadens
KEVKNSD

SEQ ID NO: 2870547 - protein, 7 aa, Entamoeba invadens
KEVKQNA

SEQ ID NO: 2870548 - protein, 8 aa, Entamoeba invadens
KEVKSHDA

SEQ ID NO: 2870549 - protein, 10 aa, Entamoeba invadens
KEVKTDNSLF

SEQ ID NO: 2870550 - protein, 16 aa, Entamoeba invadens
KEVKTNKEKEERINDE

SEQ ID NO: 2870551 - protein, 30 aa, Entamoeba invadens
KEVNDEFKDNKKSEEGGVVEDENSENDEEI

SEQ ID NO: 2870552 - protein, 16 aa, Entamoeba invadens
KEVNDRTKETEKKSAV

SEQ ID NO: 2870553 - protein, 6 aa, Entamoeba invadens
KEVNEN

SEQ ID NO: 2870554 - protein, 16 aa, Entamoeba invadens
KEVNSAEVTDEEEGCP

SEQ ID NO: 2870555 - protein, 9 aa, Entamoeba invadens
KEVNSSPTF

SEQ ID NO: 2870556 - protein, 18 aa, Entamoeba invadens
KEVNTEETKEKKDEKPME

SEQ ID NO: 2870557 - protein, 10 aa, Entamoeba invadens
KEVNVSRKNE

SEQ ID NO: 2870558 - protein, 4 aa, Entamoeba invadens
KEVP

SEQ ID NO: 2870559 - protein, 18 aa, Entamoeba invadens
KEVPAEAKDVKKRSSDTT

SEQ ID NO: 2870560 - protein, 7 aa, Entamoeba invadens
KEVPKEP

SEQ ID NO: 2870561 - protein, 6 aa, Entamoeba invadens
KEVPNE

SEQ ID NO: 2870562 - protein, 31 aa, Entamoeba invadens
KEVPSKVTEIEKEEPKEQEYSEVSDEEPKVP

SEQ ID NO: 2870563 - protein, 17 aa, Entamoeba invadens
KEVQHKKEVADASEDPK

SEQ ID NO: 2870564 - protein, 14 aa, Entamoeba invadens
KEVQQTPKNTKKSG

SEQ ID NO: 2870565 - protein, 12 aa, Entamoeba invadens
KEVRKTTTASIE

SEQ ID NO: 2870566 - protein, 8 aa, Entamoeba invadens
KEVSAYKK

SEQ ID NO: 2870567 - protein, 10 aa, Entamoeba invadens
KEVSDDPRYY

SEQ ID NO: 2870568 - protein, 8 aa, Entamoeba invadens
KEVSDEEY

SEQ ID NO: 2870569 - protein, 9 aa, Entamoeba invadens
KEVSDNAKS

SEQ ID NO: 2870570 - protein, 7 aa, Entamoeba invadens
KEVSDNR

SEQ ID NO: 2870571 - protein, 10 aa, Entamoeba invadens
KEVSEDNVNG

SEQ ID NO: 2870572 - protein, 6 aa, Entamoeba invadens
KEVSEM

SEQ ID NO: 2870573 - protein, 8 aa, Entamoeba invadens
KEVSGAEE

SEQ ID NO: 2870574 - protein, 6 aa, Entamoeba invadens
KEVSGE

SEQ ID NO: 2870575 - protein, 12 aa, Entamoeba invadens
KEVSNKRTKNDQ

SEQ ID NO: 2870576 - protein, 27 aa, Entamoeba invadens
KEVSNNPNAAKALRNTMKPQKKIPEGM

SEQ ID NO: 2870577 - protein, 10 aa, Entamoeba invadens
KEVSSDPVHS

SEQ ID NO: 2870578 - protein, 5 aa, Entamoeba invadens
KEVSY

SEQ ID NO: 2870579 - protein, 7 aa, Entamoeba invadens
KEVTDTI

SEQ ID NO: 2870580 - protein, 5 aa, Entamoeba invadens
KEVTE

SEQ ID NO: 2870581 - protein, 7 aa, Entamoeba invadens
KEVTEDQ

SEQ ID NO: 2870582 - protein, 10 aa, Entamoeba invadens
KEVTKGISSQ

SEQ ID NO: 2870583 - protein, 6 aa, Entamoeba invadens
KEVTKL

SEQ ID NO: 2870584 - protein, 8 aa, Entamoeba invadens
KEVTSAQE

SEQ ID NO: 2870585 - protein, 8 aa, Entamoeba invadens
KEVTSRET

SEQ ID NO: 2870586 - protein, 25 aa, Entamoeba invadens
KEWAEGKEQLVDKGKRLEEENTKLH

SEQ ID NO: 2870587 - protein, 7 aa, Entamoeba invadens
KEWNPSS

SEQ ID NO: 2870588 - protein, 6 aa, Entamoeba invadens
KEWPRD

SEQ ID NO: 2870589 - protein, 7 aa, Entamoeba invadens
KEWSGKA

SEQ ID NO: 2870590 - protein, 8 aa, Entamoeba invadens
KEWSGKNV

SEQ ID NO: 2870591 - protein, 4 aa, Entamoeba invadens
KEYD

SEQ ID NO: 2870592 - protein, 8 aa, Entamoeba invadens
KEYDEDQM

SEQ ID NO: 2870593 - protein, 15 aa, Entamoeba invadens
KEYDGSGPAIVHRKC

SEQ ID NO: 2870594 - protein, 6 aa, Entamoeba invadens
KEYDTW

SEQ ID NO: 2870595 - protein, 15 aa, Entamoeba invadens
KEYEKKRKNNDLDTT

SEQ ID NO: 2870596 - protein, 6 aa, Entamoeba invadens
KEYETD

SEQ ID NO: 2870597 - protein, 4 aa, Entamoeba invadens
KEYH

SEQ ID NO: 2870598 - protein, 5 aa, Entamoeba invadens
KEYKQ

SEQ ID NO: 2870599 - protein, 4 aa, Entamoeba invadens
KEYN

SEQ ID NO: 2870600 - protein, 8 aa, Entamoeba invadens
KEYNDTMK

SEQ ID NO: 2870601 - protein, 5 aa, Entamoeba invadens
KEYPE

SEQ ID NO: 2870602 - protein, 6 aa, Entamoeba invadens
KEYQEL

SEQ ID NO: 2870603 - protein, 16 aa, Entamoeba invadens
KEYQSVHSKNDGTVPV

SEQ ID NO: 2870604 - protein, 5 aa, Entamoeba invadens
KEYSE

SEQ ID NO: 2870605 - protein, 7 aa, Entamoeba invadens
KEYSEDV

SEQ ID NO: 2870606 - protein, 5 aa, Entamoeba invadens
KEYTE

SEQ ID NO: 2870607 - protein, 13 aa, Entamoeba invadens
KEYTGNYEKEDTV

SEQ ID NO: 2870608 - protein, 5 aa, Entamoeba invadens
KEYTN

SEQ ID NO: 2870609 - protein, 8 aa, Entamoeba invadens
KEYTPEKY

SEQ ID NO: 2870610 - protein, 6 aa, Entamoeba invadens
KEYTQF

SEQ ID NO: 2870611 - protein, 29 aa, Entamoeba invadens
KEYVEKEEQKRNDAERDQLVDQRNNAIQA

SEQ ID NO: 2870612 - protein, 4 aa, Entamoeba invadens
KEYY

SEQ ID NO: 2870613 - protein, 6 aa, Entamoeba invadens
KEYYSQ

SEQ ID NO: 2870614 - protein, 5 aa, Entamoeba invadens
KFAAS

SEQ ID NO: 2870615 - protein, 8 aa, Entamoeba invadens
KFAGSGTR

SEQ ID NO: 2870616 - protein, 7 aa, Entamoeba invadens
KFANEDE

SEQ ID NO: 2870617 - protein, 7 aa, Entamoeba invadens
KFANTNG

SEQ ID NO: 2870618 - protein, 10 aa, Entamoeba invadens
KFAPDKTKNV

SEQ ID NO: 2870619 - protein, 6 aa, Entamoeba invadens
KFAQGK

SEQ ID NO: 2870620 - protein, 12 aa, Entamoeba invadens
KFASKGTDAVQK

SEQ ID NO: 2870621 - protein, 5 aa, Entamoeba invadens
KFATA

SEQ ID NO: 2870622 - protein, 6 aa, Entamoeba invadens
KFATNT

SEQ ID NO: 2870623 - protein, 4 aa, Entamoeba invadens
KFDD

SEQ ID NO: 2870624 - protein, 8 aa, Entamoeba invadens
KFDEIEDT

SEQ ID NO: 2870625 - protein, 9 aa, Entamoeba invadens
KFDEKAGPI

SEQ ID NO: 2870626 - protein, 5 aa, Entamoeba invadens
KFDES

SEQ ID NO: 2870627 - protein, 7 aa, Entamoeba invadens
KFDGEKK

SEQ ID NO: 2870628 - protein, 10 aa, Entamoeba invadens
KFDGKQSRFL

SEQ ID NO: 2870629 - protein, 11 aa, Entamoeba invadens
KFDKDGKGNTL

SEQ ID NO: 2870630 - protein, 7 aa, Entamoeba invadens
KFDSDNI

SEQ ID NO: 2870631 - protein, 7 aa, Entamoeba invadens
KFDTTKP

SEQ ID NO: 2870632 - protein, 10 aa, Entamoeba invadens
KFEAEKDERD

SEQ ID NO: 2870633 - protein, 5 aa, Entamoeba invadens
KFEAK

SEQ ID NO: 2870634 - protein, 4 aa, Entamoeba invadens
KFEE

SEQ ID NO: 2870635 - protein, 9 aa, Entamoeba invadens
KFEERGDPF

SEQ ID NO: 2870636 - protein, 7 aa, Entamoeba invadens
KFEGDSN

SEQ ID NO: 2870637 - protein, 5 aa, Entamoeba invadens
KFEHQ

SEQ ID NO: 2870638 - protein, 5 aa, Entamoeba invadens
KFEKA

SEQ ID NO: 2870639 - protein, 9 aa, Entamoeba invadens
KFEKQTENP

SEQ ID NO: 2870640 - protein, 6 aa, Entamoeba invadens
KFENQN

SEQ ID NO: 2870641 - protein, 30 aa, Entamoeba invadens
KFEQKESTFNTQIGKTQSDLKKTQQSVRDE

SEQ ID NO: 2870642 - protein, 18 aa, Entamoeba invadens
KFEQKESTINTQISKIQA

SEQ ID NO: 2870643 - protein, 5 aa, Entamoeba invadens
KFERK

SEQ ID NO: 2870644 - protein, 10 aa, Entamoeba invadens
KFESKAPNVT

SEQ ID NO: 2870645 - protein, 10 aa, Entamoeba invadens
KFESNYGGTN

SEQ ID NO: 2870646 - protein, 24 aa, Entamoeba invadens
KFETEKTKIEEQIDASDNLSSLQS

SEQ ID NO: 2870647 - protein, 15 aa, Entamoeba invadens
KFETPAEFRRSEGEI

SEQ ID NO: 2870648 - protein, 5 aa, Entamoeba invadens
KFETS

SEQ ID NO: 2870649 - protein, 17 aa, Entamoeba invadens
KFGDGKSLKIREGKYKE

SEQ ID NO: 2870650 - protein, 5 aa, Entamoeba invadens
KFGDQ

SEQ ID NO: 2870651 - protein, 7 aa, Entamoeba invadens
KFGEISQ

SEQ ID NO: 2870652 - protein, 7 aa, Entamoeba invadens
KFGEYKE

SEQ ID NO: 2870653 - protein, 6 aa, Entamoeba invadens
KFGGDR

SEQ ID NO: 2870654 - protein, 6 aa, Entamoeba invadens
KFGGNT

SEQ ID NO: 2870655 - protein, 7 aa, Entamoeba invadens
KFGKDQD

SEQ ID NO: 2870656 - protein, 5 aa, Entamoeba invadens
KFGKK

SEQ ID NO: 2870657 - protein, 22 aa, Entamoeba invadens
KFGKKTVKRSPTPGIENNQPQL

SEQ ID NO: 2870658 - protein, 6 aa, Entamoeba invadens
KFGKPI

SEQ ID NO: 2870659 - protein, 16 aa, Entamoeba invadens
KFGLKGTKKLCPNCVN

SEQ ID NO: 2870660 - protein, 12 aa, Entamoeba invadens
KFGNNIPSSVTS

SEQ ID NO: 2870661 - protein, 13 aa, Entamoeba invadens
KFGNNIPSSVTSI

SEQ ID NO: 2870662 - protein, 8 aa, Entamoeba invadens
KFGNSKAQ

SEQ ID NO: 2870663 - protein, 9 aa, Entamoeba invadens
KFGNTSPDL

SEQ ID NO: 2870664 - protein, 6 aa, Entamoeba invadens
KFGPDM

SEQ ID NO: 2870665 - protein, 8 aa, Entamoeba invadens
KFGPNGDE

SEQ ID NO: 2870666 - protein, 10 aa, Entamoeba invadens
KFGSTTDSQV

SEQ ID NO: 2870667 - protein, 8 aa, Entamoeba invadens
KFKDEQSK

SEQ ID NO: 2870668 - protein, 9 aa, Entamoeba invadens
KFKKDNSKV

SEQ ID NO: 2870669 - protein, 8 aa, Entamoeba invadens
KFKKPEYA

SEQ ID NO: 2870670 - protein, 5 aa, Entamoeba invadens
KFKNR

SEQ ID NO: 2870671 - protein, 7 aa, Entamoeba invadens
KFKPSSP

SEQ ID NO: 2870672 - protein, 11 aa, Entamoeba invadens
KFKQSKSPLNE

SEQ ID NO: 2870673 - protein, 4 aa, Entamoeba invadens
KFKR

SEQ ID NO: 2870674 - protein, 6 aa, Entamoeba invadens
KFKSGG

SEQ ID NO: 2870675 - protein, 9 aa, Entamoeba invadens
KFKSGNESA

SEQ ID NO: 2870676 - protein, 11 aa, Entamoeba invadens
KFKSKSRPITL

SEQ ID NO: 2870677 - protein, 5 aa, Entamoeba invadens
KFKTM

SEQ ID NO: 2870678 - protein, 21 aa, Entamoeba invadens
KFKTTKHDKTNSEVREESKQQ

SEQ ID NO: 2870679 - protein, 14 aa, Entamoeba invadens
KFKVTTKVSNTLEN

SEQ ID NO: 2870680 - protein, 7 aa, Entamoeba invadens
KFLKTGT

SEQ ID NO: 2870681 - protein, 7 aa, Entamoeba invadens
KFNEYGK

SEQ ID NO: 2870682 - protein, 22 aa, Entamoeba invadens
KFNKHKAGCPDNPAKNPTFGKS

SEQ ID NO: 2870683 - protein, 27 aa, Entamoeba invadens
KFNKVEADKIEKMSGMKKSIETFILKN

SEQ ID NO: 2870684 - protein, 10 aa, Entamoeba invadens
KFNNSTKCTA

SEQ ID NO: 2870685 - protein, 10 aa, Entamoeba invadens
KFNNSTKFTA

SEQ ID NO: 2870686 - protein, 17 aa, Entamoeba invadens
KFNNYKKTKKNKSALLI

SEQ ID NO: 2870687 - protein, 12 aa, Entamoeba invadens
KFNQDKNKTITK

SEQ ID NO: 2870688 - protein, 5 aa, Entamoeba invadens
KFNQN

SEQ ID NO: 2870689 - protein, 10 aa, Entamoeba invadens
KFNSEREDTY

SEQ ID NO: 2870690 - protein, 5 aa, Entamoeba invadens
KFNTD

SEQ ID NO: 2870691 - protein, 7 aa, Entamoeba invadens
KFPASSM

SEQ ID NO: 2870692 - protein, 6 aa, Entamoeba invadens
KFPDNV

SEQ ID NO: 2870693 - protein, 7 aa, Entamoeba invadens
KFPDVSL

SEQ ID NO: 2870694 - protein, 9 aa, Entamoeba invadens
KFPEMETRT

SEQ ID NO: 2870695 - protein, 12 aa, Entamoeba invadens
KFPERRDARCKD

SEQ ID NO: 2870696 - protein, 5 aa, Entamoeba invadens
KFPGD

SEQ ID NO: 2870697 - protein, 6 aa, Entamoeba invadens
KFPHPQ

SEQ ID NO: 2870698 - protein, 7 aa, Entamoeba invadens
KFPKGMR

SEQ ID NO: 2870699 - protein, 7 aa, Entamoeba invadens
KFPKNEE

SEQ ID NO: 2870700 - protein, 6 aa, Entamoeba invadens
KFPKNP

SEQ ID NO: 2870701 - protein, 12 aa, Entamoeba invadens
KFPKSTQKPDLR

SEQ ID NO: 2870702 - protein, 5 aa, Entamoeba invadens
KFPNC

SEQ ID NO: 2870703 - protein, 10 aa, Entamoeba invadens
KFPNPGCSAE

SEQ ID NO: 2870704 - protein, 6 aa, Entamoeba invadens
KFPPEL

SEQ ID NO: 2870705 - protein, 5 aa, Entamoeba invadens
KFPPV

SEQ ID NO: 2870706 - protein, 9 aa, Entamoeba invadens
KFPQTEATR

SEQ ID NO: 2870707 - protein, 9 aa, Entamoeba invadens
KFQEEEAKR

SEQ ID NO: 2870708 - protein, 8 aa, Entamoeba invadens
KFQEESQR

SEQ ID NO: 2870709 - protein, 6 aa, Entamoeba invadens
KFQETT

SEQ ID NO: 2870710 - protein, 20 aa, Entamoeba invadens
KFQGDNGLQVDGKAGPQTIK

SEQ ID NO: 2870711 - protein, 20 aa, Entamoeba invadens
KFQGDNGLSVDGRAGPSTVS

SEQ ID NO: 2870712 - protein, 7 aa, Entamoeba invadens
KFQKNNK

SEQ ID NO: 2870713 - protein, 4 aa, Entamoeba invadens
KFQN

SEQ ID NO: 2870714 - protein, 14 aa, Entamoeba invadens
KFQNDEKENETQID

SEQ ID NO: 2870715 - protein, 9 aa, Entamoeba invadens
KFQPQKGVP

SEQ ID NO: 2870716 - protein, 5 aa, Entamoeba invadens
KFQSI

SEQ ID NO: 2870717 - protein, 8 aa, Entamoeba invadens
KFQSIKDT

SEQ ID NO: 2870718 - protein, 5 aa, Entamoeba invadens
KFQST

SEQ ID NO: 2870719 - protein, 8 aa, Entamoeba invadens
KFRGNTSK

SEQ ID NO: 2870720 - protein, 12 aa, Entamoeba invadens
KFRKGVNKSFYC

SEQ ID NO: 2870721 - protein, 6 aa, Entamoeba invadens
KFRNEA

SEQ ID NO: 2870722 - protein, 8 aa, Entamoeba invadens
KFRSTKEE

SEQ ID NO: 2870723 - protein, 5 aa, Entamoeba invadens
KFSEG

SEQ ID NO: 2870724 - protein, 8 aa, Entamoeba invadens
KFSENSLR

SEQ ID NO: 2870725 - protein, 5 aa, Entamoeba invadens
KFSKD

SEQ ID NO: 2870726 - protein, 7 aa, Entamoeba invadens
KFSKDEM

SEQ ID NO: 2870727 - protein, 8 aa, Entamoeba invadens
KFSKENRT

SEQ ID NO: 2870728 - protein, 8 aa, Entamoeba invadens
KFSKGGLT

SEQ ID NO: 2870729 - protein, 6 aa, Entamoeba invadens
KFSKGS

SEQ ID NO: 2870730 - protein, 10 aa, Entamoeba invadens
KFSKQQPEEY

SEQ ID NO: 2870731 - protein, 10 aa, Entamoeba invadens
KFSKSKQDMI

SEQ ID NO: 2870732 - protein, 9 aa, Entamoeba invadens
KFSNETKMG

SEQ ID NO: 2870733 - protein, 13 aa, Entamoeba invadens
KFSNNGTKFKVSD

SEQ ID NO: 2870734 - protein, 13 aa, Entamoeba invadens
KFSPSDLVTLLLS

SEQ ID NO: 2870735 - protein, 10 aa, Entamoeba invadens
KFSRKTKHGL

SEQ ID NO: 2870736 - protein, 6 aa, Entamoeba invadens
KFSRPK

SEQ ID NO: 2870737 - protein, 10 aa, Entamoeba invadens
KFSSDRSMSE

SEQ ID NO: 2870738 - protein, 10 aa, Entamoeba invadens
KFTDTPLTPE

SEQ ID NO: 2870739 - protein, 10 aa, Entamoeba invadens
KFTEEEKATI

SEQ ID NO: 2870740 - protein, 7 aa, Entamoeba invadens
KFTEKEK

SEQ ID NO: 2870741 - protein, 12 aa, Entamoeba invadens
KFTERGSPEHES

SEQ ID NO: 2870742 - protein, 5 aa, Entamoeba invadens
KFTGT

SEQ ID NO: 2870743 - protein, 5 aa, Entamoeba invadens
KFTHK

SEQ ID NO: 2870744 - protein, 6 aa, Entamoeba invadens
KFTHKN

SEQ ID NO: 2870745 - protein, 6 aa, Entamoeba invadens
KFTKDG

SEQ ID NO: 2870746 - protein, 7 aa, Entamoeba invadens
KFTNGSS

SEQ ID NO: 2870747 - protein, 8 aa, Entamoeba invadens
KFTNPTPI

SEQ ID NO: 2870748 - protein, 7 aa, Entamoeba invadens
KFTPEEI

SEQ ID NO: 2870749 - protein, 19 aa, Entamoeba invadens
KFTPESAKISVTAPKNRDI

SEQ ID NO: 2870750 - protein, 7 aa, Entamoeba invadens
KFTQNPS

SEQ ID NO: 2870751 - protein, 7 aa, Entamoeba invadens
KFTQTND

SEQ ID NO: 2870752 - protein, 8 aa, Entamoeba invadens
KFTRRSAG

SEQ ID NO: 2870753 - protein, 13 aa, Entamoeba invadens
KFTSTIDKKTFTA

SEQ ID NO: 2870754 - protein, 7 aa, Entamoeba invadens
KFTTSAQ

SEQ ID NO: 2870755 - protein, 4 aa, Entamoeba invadens
KFTY

SEQ ID NO: 2870756 - protein, 8 aa, Entamoeba invadens
KFVDSTES

SEQ ID NO: 2870757 - protein, 35 aa, Entamoeba invadens
KFVESTRTKFDSIDPDADINEFSTTKATNGHPPED

SEQ ID NO: 2870758 - protein, 36 aa, Entamoeba invadens
KFVKEKEAKKLKVENDEIKEKLQRDLEANNTELTEL

SEQ ID NO: 2870759 - protein, 12 aa, Entamoeba invadens
KFVPTKSNTFEV

SEQ ID NO: 2870760 - protein, 7 aa, Entamoeba invadens
KFVSSKD

SEQ ID NO: 2870761 - protein, 48 aa, Entamoeba invadens
KGAATLPANVDRAKRESTESLEASFEDNKSTSEKQNAWGTNEANEGYW

SEQ ID NO: 2870762 - protein, 11 aa, Entamoeba invadens
KGACHQNGCTQ

SEQ ID NO: 2870763 - protein, 29 aa, Entamoeba invadens
KGACSTKAPQNTKSEKAPSTKMSRNSSIS

SEQ ID NO: 2870764 - protein, 14 aa, Entamoeba invadens
KGADVNSANTNGTT

SEQ ID NO: 2870765 - protein, 6 aa, Entamoeba invadens
KGAESA

SEQ ID NO: 2870766 - protein, 12 aa, Entamoeba invadens
KGAFAASEKAED

SEQ ID NO: 2870767 - protein, 15 aa, Entamoeba invadens
KGAFSFSNPKEKRVK

SEQ ID NO: 2870768 - protein, 7 aa, Entamoeba invadens
KGAGVGP

SEQ ID NO: 2870769 - protein, 4 aa, Entamoeba invadens
KGAH

SEQ ID NO: 2870770 - protein, 13 aa, Entamoeba invadens
KGAIGEIKTGEGK

SEQ ID NO: 2870771 - protein, 6 aa, Entamoeba invadens
KGAIGG

SEQ ID NO: 2870772 - protein, 15 aa, Entamoeba invadens
KGAISSTLNDVTDDL

SEQ ID NO: 2870773 - protein, 18 aa, Entamoeba invadens
KGAKDGGISGFGKGIGKG

SEQ ID NO: 2870774 - protein, 10 aa, Entamoeba invadens
KGAKKEERNV

SEQ ID NO: 2870775 - protein, 17 aa, Entamoeba invadens
KGAKQQKKKTTKKTHID

SEQ ID NO: 2870776 - protein, 7 aa, Entamoeba invadens
KGAKTSK

SEQ ID NO: 2870777 - protein, 8 aa, Entamoeba invadens
KGALSEEN

SEQ ID NO: 2870778 - protein, 8 aa, Entamoeba invadens
KGANNNDQ

SEQ ID NO: 2870779 - protein, 13 aa, Entamoeba invadens
KGANVNATTLRQS

SEQ ID NO: 2870780 - protein, 6 aa, Entamoeba invadens
KGAPNL

SEQ ID NO: 2870781 - protein, 7 aa, Entamoeba invadens
KGAPRKY

SEQ ID NO: 2870782 - protein, 10 aa, Entamoeba invadens
KGAQKEEEKS

SEQ ID NO: 2870783 - protein, 10 aa, Entamoeba invadens
KGAQKEKITN

SEQ ID NO: 2870784 - protein, 8 aa, Entamoeba invadens
KGAQRYKD

SEQ ID NO: 2870785 - protein, 8 aa, Entamoeba invadens
KGARQYAN

SEQ ID NO: 2870786 - protein, 10 aa, Entamoeba invadens
KGASEGEGLG

SEQ ID NO: 2870787 - protein, 5 aa, Entamoeba invadens
KGASR

SEQ ID NO: 2870788 - protein, 4 aa, Entamoeba invadens
KGAT

SEQ ID NO: 2870789 - protein, 6 aa, Entamoeba invadens
KGATLK

SEQ ID NO: 2870790 - protein, 5 aa, Entamoeba invadens
KGCFE

SEQ ID NO: 2870791 - protein, 4 aa, Entamoeba invadens
KGCG

SEQ ID NO: 2870792 - protein, 6 aa, Entamoeba invadens
KGCKDA

SEQ ID NO: 2870793 - protein, 14 aa, Entamoeba invadens
KGCKLSRSETYIEQ

SEQ ID NO: 2870794 - protein, 8 aa, Entamoeba invadens
KGCSSPTT

SEQ ID NO: 2870795 - protein, 8 aa, Entamoeba invadens
KGDAPTKI

SEQ ID NO: 2870796 - protein, 7 aa, Entamoeba invadens
KGDCPNS

SEQ ID NO: 2870797 - protein, 6 aa, Entamoeba invadens
KGDDGI

SEQ ID NO: 2870798 - protein, 10 aa, Entamoeba invadens
KGDDGKELNP

SEQ ID NO: 2870799 - protein, 9 aa, Entamoeba invadens
KGDEEEEER

SEQ ID NO: 2870800 - protein, 21 aa, Entamoeba invadens
KGDEFYSASSYGRLAAHRFTH

SEQ ID NO: 2870801 - protein, 6 aa, Entamoeba invadens
KGDEIT

SEQ ID NO: 2870802 - protein, 7 aa, Entamoeba invadens
KGDEKHV

SEQ ID NO: 2870803 - protein, 8 aa, Entamoeba invadens
KGDESLDD

SEQ ID NO: 2870804 - protein, 9 aa, Entamoeba invadens
KGDETSQIE

SEQ ID NO: 2870805 - protein, 29 aa, Entamoeba invadens
KGDFEDRVKQTTAQLHTETAKDSNSGTTA

SEQ ID NO: 2870806 - protein, 7 aa, Entamoeba invadens
KGDGERI

SEQ ID NO: 2870807 - protein, 6 aa, Entamoeba invadens
KGDGHY

SEQ ID NO: 2870808 - protein, 7 aa, Entamoeba invadens
KGDGLKD

SEQ ID NO: 2870809 - protein, 14 aa, Entamoeba invadens
KGDGNGKKYGPAFG

SEQ ID NO: 2870810 - protein, 5 aa, Entamoeba invadens
KGDGV

SEQ ID NO: 2870811 - protein, 5 aa, Entamoeba invadens
KGDGW

SEQ ID NO: 2870812 - protein, 24 aa, Entamoeba invadens
KGDIKTEENAKKMSELKEYKRSED

SEQ ID NO: 2870813 - protein, 14 aa, Entamoeba invadens
KGDINKTSKKYWTN

SEQ ID NO: 2870814 - protein, 13 aa, Entamoeba invadens
KGDKKLQPEDLPH

SEQ ID NO: 2870815 - protein, 8 aa, Entamoeba invadens
KGDKRLKS

SEQ ID NO: 2870816 - protein, 15 aa, Entamoeba invadens
KGDKRTEFELKHKKI

SEQ ID NO: 2870817 - protein, 15 aa, Entamoeba invadens
KGDKRTEFELKHKKV

SEQ ID NO: 2870818 - protein, 19 aa, Entamoeba invadens
KGDKSSQVSIESSATGPMR

SEQ ID NO: 2870819 - protein, 6 aa, Entamoeba invadens
KGDLSQ

SEQ ID NO: 2870820 - protein, 6 aa, Entamoeba invadens
KGDMRE

SEQ ID NO: 2870821 - protein, 6 aa, Entamoeba invadens
KGDNGR

SEQ ID NO: 2870822 - protein, 8 aa, Entamoeba invadens
KGDNPSYE

SEQ ID NO: 2870823 - protein, 9 aa, Entamoeba invadens
KGDNSQADF

SEQ ID NO: 2870824 - protein, 15 aa, Entamoeba invadens
KGDPEIVAILKGLNK

SEQ ID NO: 2870825 - protein, 6 aa, Entamoeba invadens
KGDPII

SEQ ID NO: 2870826 - protein, 10 aa, Entamoeba invadens
KGDPNKQNVN

SEQ ID NO: 2870827 - protein, 9 aa, Entamoeba invadens
KGDSKDDTT

SEQ ID NO: 2870828 - protein, 9 aa, Entamoeba invadens
KGDSPVNDD

SEQ ID NO: 2870829 - protein, 5 aa, Entamoeba invadens
KGDSQ

SEQ ID NO: 2870830 - protein, 4 aa, Entamoeba invadens
KGDT

SEQ ID NO: 2870831 - protein, 6 aa, Entamoeba invadens
KGDTCG

SEQ ID NO: 2870832 - protein, 9 aa, Entamoeba invadens
KGDTKDDTT

SEQ ID NO: 2870833 - protein, 19 aa, Entamoeba invadens
KGDTPKQRIETLSGGQKSR

SEQ ID NO: 2870834 - protein, 7 aa, Entamoeba invadens
KGDTRIN

SEQ ID NO: 2870835 - protein, 4 aa, Entamoeba invadens
KGDV

SEQ ID NO: 2870836 - protein, 4 aa, Entamoeba invadens
KGEA

SEQ ID NO: 2870837 - protein, 6 aa, Entamoeba invadens
KGEAER

SEQ ID NO: 2870838 - protein, 9 aa, Entamoeba invadens
KGEAIGKEK

SEQ ID NO: 2870839 - protein, 20 aa, Entamoeba invadens
KGEAPKSSRHVKASPDPTYS

SEQ ID NO: 2870840 - protein, 8 aa, Entamoeba invadens
KGECTPCN

SEQ ID NO: 2870841 - protein, 13 aa, Entamoeba invadens
KGEDDEVNNEAHT

SEQ ID NO: 2870842 - protein, 11 aa, Entamoeba invadens
KGEDGKTNAEK

SEQ ID NO: 2870843 - protein, 18 aa, Entamoeba invadens
KGEDGKTNAEWQQNKSSY

SEQ ID NO: 2870844 - protein, 8 aa, Entamoeba invadens
KGEDYTVE

SEQ ID NO: 2870845 - protein, 93 aa, Entamoeba invadens
KGEEDEESTEKSVVKEKKERKPRKTTKKSRTVKSGKVVKKERAKKKEDEEKEKQRPKEKFVKKSSKKKEETKEESSSEEKEEKHSNSGNELSD

SEQ ID NO: 2870846 - protein, 5 aa, Entamoeba invadens
KGEEF

SEQ ID NO: 2870847 - protein, 6 aa, Entamoeba invadens
KGEEID

SEQ ID NO: 2870848 - protein, 15 aa, Entamoeba invadens
KGEEKLRRLLEDEIV

SEQ ID NO: 2870849 - protein, 6 aa, Entamoeba invadens
KGEEKR

SEQ ID NO: 2870850 - protein, 6 aa, Entamoeba invadens
KGEEQY

SEQ ID NO: 2870851 - protein, 19 aa, Entamoeba invadens
KGEFETGFDKGGQTKEHSQ

SEQ ID NO: 2870852 - protein, 6 aa, Entamoeba invadens
KGEFTR

SEQ ID NO: 2870853 - protein, 5 aa, Entamoeba invadens
KGEGL

SEQ ID NO: 2870854 - protein, 8 aa, Entamoeba invadens
KGEGYEFK

SEQ ID NO: 2870855 - protein, 12 aa, Entamoeba invadens
KGEKESESKLES

SEQ ID NO: 2870856 - protein, 9 aa, Entamoeba invadens
KGEKPPTCP

SEQ ID NO: 2870857 - protein, 11 aa, Entamoeba invadens
KGEKQMKPIPS

SEQ ID NO: 2870858 - protein, 6 aa, Entamoeba invadens
KGEKRE

SEQ ID NO: 2870859 - protein, 12 aa, Entamoeba invadens
KGEKTEKKPTEC

SEQ ID NO: 2870860 - protein, 9 aa, Entamoeba invadens
KGEKTPDSS

SEQ ID NO: 2870861 - protein, 15 aa, Entamoeba invadens
KGEKTRSEATKDIEE

SEQ ID NO: 2870862 - protein, 9 aa, Entamoeba invadens
KGEKTSVND

SEQ ID NO: 2870863 - protein, 7 aa, Entamoeba invadens
KGEKTVL

SEQ ID NO: 2870864 - protein, 5 aa, Entamoeba invadens
KGEKV

SEQ ID NO: 2870865 - protein, 13 aa, Entamoeba invadens
KGELKEGKKKTPV

SEQ ID NO: 2870866 - protein, 11 aa, Entamoeba invadens
KGEMDEPTEWE

SEQ ID NO: 2870867 - protein, 7 aa, Entamoeba invadens
KGEMEKT

SEQ ID NO: 2870868 - protein, 7 aa, Entamoeba invadens
KGEMPNV

SEQ ID NO: 2870869 - protein, 5 aa, Entamoeba invadens
KGEMR

SEQ ID NO: 2870870 - protein, 6 aa, Entamoeba invadens
KGENQL

SEQ ID NO: 2870871 - protein, 9 aa, Entamoeba invadens
KGENTLKEG

SEQ ID NO: 2870872 - protein, 5 aa, Entamoeba invadens
KGEPC

SEQ ID NO: 2870873 - protein, 19 aa, Entamoeba invadens
KGEQDLSKSGGRKTARITG

SEQ ID NO: 2870874 - protein, 5 aa, Entamoeba invadens
KGEQI

SEQ ID NO: 2870875 - protein, 7 aa, Entamoeba invadens
KGEQITN

SEQ ID NO: 2870876 - protein, 5 aa, Entamoeba invadens
KGEQM

SEQ ID NO: 2870877 - protein, 6 aa, Entamoeba invadens
KGEQTA

SEQ ID NO: 2870878 - protein, 10 aa, Entamoeba invadens
KGEQTGLVPT

SEQ ID NO: 2870879 - protein, 4 aa, Entamoeba invadens
KGER

SEQ ID NO: 2870880 - protein, 16 aa, Entamoeba invadens
KGERNEESAAKPTQRI

SEQ ID NO: 2870881 - protein, 9 aa, Entamoeba invadens
KGESAGECW

SEQ ID NO: 2870882 - protein, 8 aa, Entamoeba invadens
KGESEGDV

SEQ ID NO: 2870883 - protein, 19 aa, Entamoeba invadens
KGESGSACYSNRTADTPDN

SEQ ID NO: 2870884 - protein, 14 aa, Entamoeba invadens
KGESNDVNTNNVQM

SEQ ID NO: 2870885 - protein, 6 aa, Entamoeba invadens
KGESNG

SEQ ID NO: 2870886 - protein, 6 aa, Entamoeba invadens
KGESVE

SEQ ID NO: 2870887 - protein, 5 aa, Entamoeba invadens
KGETA

SEQ ID NO: 2870888 - protein, 8 aa, Entamoeba invadens
KGETLNKN

SEQ ID NO: 2870889 - protein, 32 aa, Entamoeba invadens
KGETPKIEKKRKCGAKMEQQVEEKFERNKEEV

SEQ ID NO: 2870890 - protein, 34 aa, Entamoeba invadens
KGETPLKKRKPKYVKKDQQLEQPEKKAETKEKLT

SEQ ID NO: 2870891 - protein, 7 aa, Entamoeba invadens
KGETTEY

SEQ ID NO: 2870892 - protein, 4 aa, Entamoeba invadens
KGEV

SEQ ID NO: 2870893 - protein, 9 aa, Entamoeba invadens
KGEVAQKNE

SEQ ID NO: 2870894 - protein, 13 aa, Entamoeba invadens
KGEVEVAKSELKN

SEQ ID NO: 2870895 - protein, 6 aa, Entamoeba invadens
KGEVGE

SEQ ID NO: 2870896 - protein, 23 aa, Entamoeba invadens
KGEVSKDKLPAVGKEKKLEQLDE

SEQ ID NO: 2870897 - protein, 4 aa, Entamoeba invadens
KGEY

SEQ ID NO: 2870898 - protein, 10 aa, Entamoeba invadens
KGEYKKEAYD

SEQ ID NO: 2870899 - protein, 9 aa, Entamoeba invadens
KGEYNKTNV

SEQ ID NO: 2870900 - protein, 7 aa, Entamoeba invadens
KGFDDRR

SEQ ID NO: 2870901 - protein, 7 aa, Entamoeba invadens
KGFDGAQ

SEQ ID NO: 2870902 - protein, 8 aa, Entamoeba invadens
KGFDKKTA

SEQ ID NO: 2870903 - protein, 6 aa, Entamoeba invadens
KGFEAK

SEQ ID NO: 2870904 - protein, 12 aa, Entamoeba invadens
KGFEDTKEELEK

SEQ ID NO: 2870905 - protein, 10 aa, Entamoeba invadens
KGFGRSTDEI

SEQ ID NO: 2870906 - protein, 17 aa, Entamoeba invadens
KGFGYDPAATTSAPINY

SEQ ID NO: 2870907 - protein, 5 aa, Entamoeba invadens
KGFNE

SEQ ID NO: 2870908 - protein, 7 aa, Entamoeba invadens
KGFNEKV

SEQ ID NO: 2870909 - protein, 12 aa, Entamoeba invadens
KGFPKKKSGDIS

SEQ ID NO: 2870910 - protein, 11 aa, Entamoeba invadens
KGFQKKEEFYK

SEQ ID NO: 2870911 - protein, 4 aa, Entamoeba invadens
KGGA

SEQ ID NO: 2870912 - protein, 9 aa, Entamoeba invadens
KGGAGKTSM

SEQ ID NO: 2870913 - protein, 11 aa, Entamoeba invadens
KGGAISPPQLD

SEQ ID NO: 2870914 - protein, 4 aa, Entamoeba invadens
KGGC

SEQ ID NO: 2870915 - protein, 10 aa, Entamoeba invadens
KGGDDVSTAR

SEQ ID NO: 2870916 - protein, 11 aa, Entamoeba invadens
KGGDKNMTSRE

SEQ ID NO: 2870917 - protein, 7 aa, Entamoeba invadens
KGGDQIK

SEQ ID NO: 2870918 - protein, 8 aa, Entamoeba invadens
KGGESKAV

SEQ ID NO: 2870919 - protein, 5 aa, Entamoeba invadens
KGGET

SEQ ID NO: 2870920 - protein, 5 aa, Entamoeba invadens
KGGGF

SEQ ID NO: 2870921 - protein, 4 aa, Entamoeba invadens
KGGH

SEQ ID NO: 2870922 - protein, 6 aa, Entamoeba invadens
KGGHGI

SEQ ID NO: 2870923 - protein, 6 aa, Entamoeba invadens
KGGHRH

SEQ ID NO: 2870924 - protein, 7 aa, Entamoeba invadens
KGGHSLS

SEQ ID NO: 2870925 - protein, 4 aa, Entamoeba invadens
KGGI

SEQ ID NO: 2870926 - protein, 5 aa, Entamoeba invadens
KGGKC

SEQ ID NO: 2870927 - protein, 5 aa, Entamoeba invadens
KGGKH

SEQ ID NO: 2870928 - protein, 10 aa, Entamoeba invadens
KGGKIEKGGV

SEQ ID NO: 2870929 - protein, 9 aa, Entamoeba invadens
KGGKKAGTE

SEQ ID NO: 2870930 - protein, 6 aa, Entamoeba invadens
KGGKMD

SEQ ID NO: 2870931 - protein, 9 aa, Entamoeba invadens
KGGKQNTTL

SEQ ID NO: 2870932 - protein, 16 aa, Entamoeba invadens
KGGKSTESGGKNNERA

SEQ ID NO: 2870933 - protein, 13 aa, Entamoeba invadens
KGGKVTVEDNEHE

SEQ ID NO: 2870934 - protein, 7 aa, Entamoeba invadens
KGGLDTA

SEQ ID NO: 2870935 - protein, 15 aa, Entamoeba invadens
KGGLDVTNNENGEYS

SEQ ID NO: 2870936 - protein, 7 aa, Entamoeba invadens
KGGLRYS

SEQ ID NO: 2870937 - protein, 4 aa, Entamoeba invadens
KGGM

SEQ ID NO: 2870938 - protein, 5 aa, Entamoeba invadens
KGGME

SEQ ID NO: 2870939 - protein, 5 aa, Entamoeba invadens
KGGMK

SEQ ID NO: 2870940 - protein, 7 aa, Entamoeba invadens
KGGMRPA

SEQ ID NO: 2870941 - protein, 6 aa, Entamoeba invadens
KGGNEF

SEQ ID NO: 2870942 - protein, 9 aa, Entamoeba invadens
KGGNGSQAA

SEQ ID NO: 2870943 - protein, 5 aa, Entamoeba invadens
KGGNL

SEQ ID NO: 2870944 - protein, 6 aa, Entamoeba invadens
KGGNYG

SEQ ID NO: 2870945 - protein, 7 aa, Entamoeba invadens
KGGQTHE

SEQ ID NO: 2870946 - protein, 20 aa, Entamoeba invadens
KGGRPFMPGEATEDTDPQHY

SEQ ID NO: 2870947 - protein, 17 aa, Entamoeba invadens
KGGRRAAPNGSVMRTST

SEQ ID NO: 2870948 - protein, 12 aa, Entamoeba invadens
KGGRRASNGSVM

SEQ ID NO: 2870949 - protein, 14 aa, Entamoeba invadens
KGGRYKTTLRNGDS

SEQ ID NO: 2870950 - protein, 6 aa, Entamoeba invadens
KGGSGA

SEQ ID NO: 2870951 - protein, 6 aa, Entamoeba invadens
KGGTFD

SEQ ID NO: 2870952 - protein, 4 aa, Entamoeba invadens
KGGV

SEQ ID NO: 2870953 - protein, 11 aa, Entamoeba invadens
KGGVGKTTTAC

SEQ ID NO: 2870954 - protein, 6 aa, Entamoeba invadens
KGGVGS

SEQ ID NO: 2870955 - protein, 7 aa, Entamoeba invadens
KGGVKTP

SEQ ID NO: 2870956 - protein, 5 aa, Entamoeba invadens
KGGVP

SEQ ID NO: 2870957 - protein, 6 aa, Entamoeba invadens
KGGVVE

SEQ ID NO: 2870958 - protein, 9 aa, Entamoeba invadens
KGGWTTSGG

SEQ ID NO: 2870959 - protein, 7 aa, Entamoeba invadens
KGHDSEV

SEQ ID NO: 2870960 - protein, 5 aa, Entamoeba invadens
KGHEG

SEQ ID NO: 2870961 - protein, 4 aa, Entamoeba invadens
KGHK

SEQ ID NO: 2870962 - protein, 5 aa, Entamoeba invadens
KGHKT

SEQ ID NO: 2870963 - protein, 10 aa, Entamoeba invadens
KGHSNPVDKQ

SEQ ID NO: 2870964 - protein, 6 aa, Entamoeba invadens
KGHTQT

SEQ ID NO: 2870965 - protein, 8 aa, Entamoeba invadens
KGHTQTPN

SEQ ID NO: 2870966 - protein, 6 aa, Entamoeba invadens
KGIEGD

SEQ ID NO: 2870967 - protein, 31 aa, Entamoeba invadens
KGIEKGSPDDVEEGKMKRKDDTIDFLEKRRN

SEQ ID NO: 2870968 - protein, 14 aa, Entamoeba invadens
KGIFNKKDSKINYS

SEQ ID NO: 2870969 - protein, 8 aa, Entamoeba invadens
KGIGTSKY

SEQ ID NO: 2870970 - protein, 7 aa, Entamoeba invadens
KGIHTST

SEQ ID NO: 2870971 - protein, 7 aa, Entamoeba invadens
KGIKDNE

SEQ ID NO: 2870972 - protein, 5 aa, Entamoeba invadens
KGILE

SEQ ID NO: 2870973 - protein, 7 aa, Entamoeba invadens
KGINDSL

SEQ ID NO: 2870974 - protein, 17 aa, Entamoeba invadens
KGINPDKPRNLAKAVTV

SEQ ID NO: 2870975 - protein, 16 aa, Entamoeba invadens
KGIPKETAKQRKKTNR

SEQ ID NO: 2870976 - protein, 10 aa, Entamoeba invadens
KGIPKKLKGV

SEQ ID NO: 2870977 - protein, 8 aa, Entamoeba invadens
KGIPNSNK

SEQ ID NO: 2870978 - protein, 19 aa, Entamoeba invadens
KGIPTEAKGKKGKKGGCTL

SEQ ID NO: 2870979 - protein, 6 aa, Entamoeba invadens
KGIPVE

SEQ ID NO: 2870980 - protein, 12 aa, Entamoeba invadens
KGISGNKCSPTC

SEQ ID NO: 2870981 - protein, 12 aa, Entamoeba invadens
KGISPIDTQNFA

SEQ ID NO: 2870982 - protein, 7 aa, Entamoeba invadens
KGISQDV

SEQ ID NO: 2870983 - protein, 8 aa, Entamoeba invadens
KGISTANY

SEQ ID NO: 2870984 - protein, 7 aa, Entamoeba invadens
KGISTEG

SEQ ID NO: 2870985 - protein, 5 aa, Entamoeba invadens
KGITL

SEQ ID NO: 2870986 - protein, 6 aa, Entamoeba invadens
KGITQK

SEQ ID NO: 2870987 - protein, 11 aa, Entamoeba invadens
KGITRSKSPQL

SEQ ID NO: 2870988 - protein, 12 aa, Entamoeba invadens
KGITSDKEKISP

SEQ ID NO: 2870989 - protein, 6 aa, Entamoeba invadens
KGITSE

SEQ ID NO: 2870990 - protein, 5 aa, Entamoeba invadens
KGITT

SEQ ID NO: 2870991 - protein, 7 aa, Entamoeba invadens
KGIVTKS

SEQ ID NO: 2870992 - protein, 5 aa, Entamoeba invadens
KGKAC

SEQ ID NO: 2870993 - protein, 19 aa, Entamoeba invadens
KGKADTHKPIKLNGRKTIK

SEQ ID NO: 2870994 - protein, 12 aa, Entamoeba invadens
KGKAKDSATSQT

SEQ ID NO: 2870995 - protein, 8 aa, Entamoeba invadens
KGKALTGP

SEQ ID NO: 2870996 - protein, 7 aa, Entamoeba invadens
KGKAQKC

SEQ ID NO: 2870997 - protein, 18 aa, Entamoeba invadens
KGKAYLEGEPEREAFANT

SEQ ID NO: 2870998 - protein, 6 aa, Entamoeba invadens
KGKDFS

SEQ ID NO: 2870999 - protein, 5 aa, Entamoeba invadens
KGKDI

SEQ ID NO: 2871000 - protein, 7 aa, Entamoeba invadens
KGKDITT

SEQ ID NO: 2871001 - protein, 7 aa, Entamoeba invadens
KGKDNSV

SEQ ID NO: 2871002 - protein, 7 aa, Entamoeba invadens
KGKDQGG

SEQ ID NO: 2871003 - protein, 9 aa, Entamoeba invadens
KGKDTSAVL

SEQ ID NO: 2871004 - protein, 9 aa, Entamoeba invadens
KGKDVSSEI

SEQ ID NO: 2871005 - protein, 4 aa, Entamoeba invadens
KGKE

SEQ ID NO: 2871006 - protein, 8 aa, Entamoeba invadens
KGKEAKNG

SEQ ID NO: 2871007 - protein, 6 aa, Entamoeba invadens
KGKEDP

SEQ ID NO: 2871008 - protein, 18 aa, Entamoeba invadens
KGKEELRKQADDDKYNWG

SEQ ID NO: 2871009 - protein, 5 aa, Entamoeba invadens
KGKEI

SEQ ID NO: 2871010 - protein, 24 aa, Entamoeba invadens
KGKEKKSEINEPEAKTGKDGEKVY

SEQ ID NO: 2871011 - protein, 19 aa, Entamoeba invadens
KGKEQLDFGEEKKEIDDED

SEQ ID NO: 2871012 - protein, 8 aa, Entamoeba invadens
KGKESEDQ

SEQ ID NO: 2871013 - protein, 9 aa, Entamoeba invadens
KGKETLNGV

SEQ ID NO: 2871014 - protein, 34 aa, Entamoeba invadens
KGKFDGSVESIQQDEQDFPPISESHDESESKNVE

SEQ ID NO: 2871015 - protein, 4 aa, Entamoeba invadens
KGKG

SEQ ID NO: 2871016 - protein, 7 aa, Entamoeba invadens
KGKGEQR

SEQ ID NO: 2871017 - protein, 8 aa, Entamoeba invadens
KGKGESRI

SEQ ID NO: 2871018 - protein, 5 aa, Entamoeba invadens
KGKGL

SEQ ID NO: 2871019 - protein, 5 aa, Entamoeba invadens
KGKGT

SEQ ID NO: 2871020 - protein, 12 aa, Entamoeba invadens
KGKGTKSGKELK

SEQ ID NO: 2871021 - protein, 15 aa, Entamoeba invadens
KGKGWFSGKSEKNNL

SEQ ID NO: 2871022 - protein, 14 aa, Entamoeba invadens
KGKHPLHSSRPTVI

SEQ ID NO: 2871023 - protein, 9 aa, Entamoeba invadens
KGKIEGNPK

SEQ ID NO: 2871024 - protein, 8 aa, Entamoeba invadens
KGKIGEKE

SEQ ID NO: 2871025 - protein, 8 aa, Entamoeba invadens
KGKIKGAS

SEQ ID NO: 2871026 - protein, 13 aa, Entamoeba invadens
KGKIPLPPKNDIE

SEQ ID NO: 2871027 - protein, 12 aa, Entamoeba invadens
KGKITKKSTNAS

SEQ ID NO: 2871028 - protein, 4 aa, Entamoeba invadens
KGKK

SEQ ID NO: 2871029 - protein, 6 aa, Entamoeba invadens
KGKKAF

SEQ ID NO: 2871030 - protein, 33 aa, Entamoeba invadens
KGKKDKKKEDDTSAGTDSKTEEQTTEEDTLPFN

SEQ ID NO: 2871031 - protein, 19 aa, Entamoeba invadens
KGKKDNKKKFTQEDLDTAI

SEQ ID NO: 2871032 - protein, 11 aa, Entamoeba invadens
KGKKERRRESM

SEQ ID NO: 2871033 - protein, 8 aa, Entamoeba invadens
KGKKINVP

SEQ ID NO: 2871034 - protein, 8 aa, Entamoeba invadens
KGKKKENM

SEQ ID NO: 2871035 - protein, 6 aa, Entamoeba invadens
KGKKKY

SEQ ID NO: 2871036 - protein, 14 aa, Entamoeba invadens
KGKKLQRAQEEKVQ

SEQ ID NO: 2871037 - protein, 8 aa, Entamoeba invadens
KGKKPATL

SEQ ID NO: 2871038 - protein, 11 aa, Entamoeba invadens
KGKKSKTTDLL

SEQ ID NO: 2871039 - protein, 10 aa, Entamoeba invadens
KGKKSPGGCN

SEQ ID NO: 2871040 - protein, 10 aa, Entamoeba invadens
KGKKTEGNLE

SEQ ID NO: 2871041 - protein, 8 aa, Entamoeba invadens
KGKLSVSE

SEQ ID NO: 2871042 - protein, 7 aa, Entamoeba invadens
KGKNTGD

SEQ ID NO: 2871043 - protein, 8 aa, Entamoeba invadens
KGKNTREL

SEQ ID NO: 2871044 - protein, 4 aa, Entamoeba invadens
KGKP

SEQ ID NO: 2871045 - protein, 10 aa, Entamoeba invadens
KGKPKCPPQV

SEQ ID NO: 2871046 - protein, 24 aa, Entamoeba invadens
KGKPKSPPQVHATRPNPEQQNTDL

SEQ ID NO: 2871047 - protein, 6 aa, Entamoeba invadens
KGKPME

SEQ ID NO: 2871048 - protein, 6 aa, Entamoeba invadens
KGKQHE

SEQ ID NO: 2871049 - protein, 7 aa, Entamoeba invadens
KGKRCKQ

SEQ ID NO: 2871050 - protein, 20 aa, Entamoeba invadens
KGKRLRNVTKKKKGESSDGN

SEQ ID NO: 2871051 - protein, 25 aa, Entamoeba invadens
KGKRNRTKPRNVKNKKIVEEDDGMI

SEQ ID NO: 2871052 - protein, 9 aa, Entamoeba invadens
KGKRPDDKC

SEQ ID NO: 2871053 - protein, 9 aa, Entamoeba invadens
KGKRPSALL

SEQ ID NO: 2871054 - protein, 6 aa, Entamoeba invadens
KGKSDS

SEQ ID NO: 2871055 - protein, 8 aa, Entamoeba invadens
KGKSECSL

SEQ ID NO: 2871056 - protein, 6 aa, Entamoeba invadens
KGKSKK

SEQ ID NO: 2871057 - protein, 6 aa, Entamoeba invadens
KGKSKL

SEQ ID NO: 2871058 - protein, 5 aa, Entamoeba invadens
KGKSN

SEQ ID NO: 2871059 - protein, 11 aa, Entamoeba invadens
KGKSNGKISIE

SEQ ID NO: 2871060 - protein, 6 aa, Entamoeba invadens
KGKSPI

SEQ ID NO: 2871061 - protein, 7 aa, Entamoeba invadens
KGKSRIT

SEQ ID NO: 2871062 - protein, 17 aa, Entamoeba invadens
KGKSTREASKQLKVSPS

SEQ ID NO: 2871063 - protein, 9 aa, Entamoeba invadens
KGKSVPKNM

SEQ ID NO: 2871064 - protein, 7 aa, Entamoeba invadens
KGKTEVS

SEQ ID NO: 2871065 - protein, 6 aa, Entamoeba invadens
KGKTIK

SEQ ID NO: 2871066 - protein, 7 aa, Entamoeba invadens
KGKTKEF

SEQ ID NO: 2871067 - protein, 8 aa, Entamoeba invadens
KGKTKQDG

SEQ ID NO: 2871068 - protein, 17 aa, Entamoeba invadens
KGKTKSGVTGIFPSNYV

SEQ ID NO: 2871069 - protein, 7 aa, Entamoeba invadens
KGKTKYF

SEQ ID NO: 2871070 - protein, 8 aa, Entamoeba invadens
KGKTPDEV

SEQ ID NO: 2871071 - protein, 6 aa, Entamoeba invadens
KGKTRE

SEQ ID NO: 2871072 - protein, 6 aa, Entamoeba invadens
KGKTRR

SEQ ID NO: 2871073 - protein, 6 aa, Entamoeba invadens
KGKTWD

SEQ ID NO: 2871074 - protein, 11 aa, Entamoeba invadens
KGKVKDKDNEL

SEQ ID NO: 2871075 - protein, 7 aa, Entamoeba invadens
KGKVSDS

SEQ ID NO: 2871076 - protein, 9 aa, Entamoeba invadens
KGKYEVPNT

SEQ ID NO: 2871077 - protein, 7 aa, Entamoeba invadens
KGKYGLG

SEQ ID NO: 2871078 - protein, 9 aa, Entamoeba invadens
KGKYGTKAE

SEQ ID NO: 2871079 - protein, 7 aa, Entamoeba invadens
KGKYTQN

SEQ ID NO: 2871080 - protein, 5 aa, Entamoeba invadens
KGLAK

SEQ ID NO: 2871081 - protein, 7 aa, Entamoeba invadens
KGLDEAT

SEQ ID NO: 2871082 - protein, 6 aa, Entamoeba invadens
KGLDEK

SEQ ID NO: 2871083 - protein, 5 aa, Entamoeba invadens
KGLDS

SEQ ID NO: 2871084 - protein, 14 aa, Entamoeba invadens
KGLEDKKAKKYREK

SEQ ID NO: 2871085 - protein, 5 aa, Entamoeba invadens
KGLFS

SEQ ID NO: 2871086 - protein, 4 aa, Entamoeba invadens
KGLG

SEQ ID NO: 2871087 - protein, 7 aa, Entamoeba invadens
KGLGPKK

SEQ ID NO: 2871088 - protein, 15 aa, Entamoeba invadens
KGLKEEKNKKNAKNI

SEQ ID NO: 2871089 - protein, 58 aa, Entamoeba invadens
KGLKKAATGKIKNKLGSLKKSFKDKVKSVKSVGKKFTSKIGKISTKFTSGIKKSMSGM

SEQ ID NO: 2871090 - protein, 6 aa, Entamoeba invadens
KGLNEK

SEQ ID NO: 2871091 - protein, 9 aa, Entamoeba invadens
KGLNSPSLS

SEQ ID NO: 2871092 - protein, 5 aa, Entamoeba invadens
KGLPE

SEQ ID NO: 2871093 - protein, 7 aa, Entamoeba invadens
KGLPEGT

SEQ ID NO: 2871094 - protein, 14 aa, Entamoeba invadens
KGLPTKYGENYPDA

SEQ ID NO: 2871095 - protein, 11 aa, Entamoeba invadens
KGLPVGGETEE

SEQ ID NO: 2871096 - protein, 10 aa, Entamoeba invadens
KGLQPSSCKK

SEQ ID NO: 2871097 - protein, 9 aa, Entamoeba invadens
KGLRPSTIE

SEQ ID NO: 2871098 - protein, 16 aa, Entamoeba invadens
KGLSDLSKKQDIGQKQ

SEQ ID NO: 2871099 - protein, 6 aa, Entamoeba invadens
KGLSEV

SEQ ID NO: 2871100 - protein, 8 aa, Entamoeba invadens
KGLSKEYI

SEQ ID NO: 2871101 - protein, 15 aa, Entamoeba invadens
KGLSPDEISAVLREI

SEQ ID NO: 2871102 - protein, 8 aa, Entamoeba invadens
KGLSRNKR

SEQ ID NO: 2871103 - protein, 13 aa, Entamoeba invadens
KGLSTSGTNSSKI

SEQ ID NO: 2871104 - protein, 18 aa, Entamoeba invadens
KGLTDDLAKGVSHDERND

SEQ ID NO: 2871105 - protein, 7 aa, Entamoeba invadens
KGLTENT

SEQ ID NO: 2871106 - protein, 6 aa, Entamoeba invadens
KGLTGD

SEQ ID NO: 2871107 - protein, 13 aa, Entamoeba invadens
KGLTHNGALDDAK

SEQ ID NO: 2871108 - protein, 13 aa, Entamoeba invadens
KGLTKSKKERKNL

SEQ ID NO: 2871109 - protein, 5 aa, Entamoeba invadens
KGLVP

SEQ ID NO: 2871110 - protein, 12 aa, Entamoeba invadens
KGLYSKYTTPNL

SEQ ID NO: 2871111 - protein, 9 aa, Entamoeba invadens
KGMENSQKT

SEQ ID NO: 2871112 - protein, 8 aa, Entamoeba invadens
KGMGHNDN

SEQ ID NO: 2871113 - protein, 15 aa, Entamoeba invadens
KGMGSENTKNYANST

SEQ ID NO: 2871114 - protein, 11 aa, Entamoeba invadens
KGMKDGSQPKK

SEQ ID NO: 2871115 - protein, 38 aa, Entamoeba invadens
KGMKNIADKTVKFGKKATAAIKSVGKKVKEKGKAIGKE

SEQ ID NO: 2871116 - protein, 11 aa, Entamoeba invadens
KGMPDLEGQWS

SEQ ID NO: 2871117 - protein, 6 aa, Entamoeba invadens
KGMPGA

SEQ ID NO: 2871118 - protein, 9 aa, Entamoeba invadens
KGMSDEEIK

SEQ ID NO: 2871119 - protein, 12 aa, Entamoeba invadens
KGMSRKEQIERA

SEQ ID NO: 2871120 - protein, 13 aa, Entamoeba invadens
KGMSTSQAAKEMV

SEQ ID NO: 2871121 - protein, 6 aa, Entamoeba invadens
KGMTAY

SEQ ID NO: 2871122 - protein, 10 aa, Entamoeba invadens
KGNAEDPETK

SEQ ID NO: 2871123 - protein, 20 aa, Entamoeba invadens
KGNATKTRAQQLTYLFNSIK

SEQ ID NO: 2871124 - protein, 16 aa, Entamoeba invadens
KGNATKTRRQQIVMLF

SEQ ID NO: 2871125 - protein, 5 aa, Entamoeba invadens
KGNDF

SEQ ID NO: 2871126 - protein, 5 aa, Entamoeba invadens
KGNDH

SEQ ID NO: 2871127 - protein, 7 aa, Entamoeba invadens
KGNDQRL

SEQ ID NO: 2871128 - protein, 34 aa, Entamoeba invadens
KGNEDKAKQLEAEKDKITKELNATKKEKNKFENE

SEQ ID NO: 2871129 - protein, 8 aa, Entamoeba invadens
KGNGPAYY

SEQ ID NO: 2871130 - protein, 5 aa, Entamoeba invadens
KGNGS

SEQ ID NO: 2871131 - protein, 7 aa, Entamoeba invadens
KGNKEIG

SEQ ID NO: 2871132 - protein, 7 aa, Entamoeba invadens
KGNKENK

SEQ ID NO: 2871133 - protein, 5 aa, Entamoeba invadens
KGNKF

SEQ ID NO: 2871134 - protein, 12 aa, Entamoeba invadens
KGNKITKSKEEL

SEQ ID NO: 2871135 - protein, 10 aa, Entamoeba invadens
KGNKVRSGKQ

SEQ ID NO: 2871136 - protein, 8 aa, Entamoeba invadens
KGNLARGN

SEQ ID NO: 2871137 - protein, 4 aa, Entamoeba invadens
KGNM

SEQ ID NO: 2871138 - protein, 5 aa, Entamoeba invadens
KGNME

SEQ ID NO: 2871139 - protein, 14 aa, Entamoeba invadens
KGNPEIEAIVFANV

SEQ ID NO: 2871140 - protein, 9 aa, Entamoeba invadens
KGNPQAEHY

SEQ ID NO: 2871141 - protein, 16 aa, Entamoeba invadens
KGNPRGKCTSKIPGMP

SEQ ID NO: 2871142 - protein, 5 aa, Entamoeba invadens
KGNRF

SEQ ID NO: 2871143 - protein, 9 aa, Entamoeba invadens
KGNSDAKTL

SEQ ID NO: 2871144 - protein, 11 aa, Entamoeba invadens
KGNSDDKISKG

SEQ ID NO: 2871145 - protein, 5 aa, Entamoeba invadens
KGNSF

SEQ ID NO: 2871146 - protein, 6 aa, Entamoeba invadens
KGNSFG

SEQ ID NO: 2871147 - protein, 10 aa, Entamoeba invadens
KGNSGVKGKN

SEQ ID NO: 2871148 - protein, 8 aa, Entamoeba invadens
KGNSNEFD

SEQ ID NO: 2871149 - protein, 4 aa, Entamoeba invadens
KGNT

SEQ ID NO: 2871150 - protein, 7 aa, Entamoeba invadens
KGNTNLS

SEQ ID NO: 2871151 - protein, 6 aa, Entamoeba invadens
KGNTNN

SEQ ID NO: 2871152 - protein, 4 aa, Entamoeba invadens
KGNV

SEQ ID NO: 2871153 - protein, 7 aa, Entamoeba invadens
KGNVSKE

SEQ ID NO: 2871154 - protein, 14 aa, Entamoeba invadens
KGNYDAKMPRGQSM

SEQ ID NO: 2871155 - protein, 6 aa, Entamoeba invadens
KGNYGT

SEQ ID NO: 2871156 - protein, 6 aa, Entamoeba invadens
KGNYSP

SEQ ID NO: 2871157 - protein, 14 aa, Entamoeba invadens
KGNYTSRHNRVAPS

SEQ ID NO: 2871158 - protein, 6 aa, Entamoeba invadens
KGPEKF

SEQ ID NO: 2871159 - protein, 13 aa, Entamoeba invadens
KGPFDKDGKPDMK

SEQ ID NO: 2871160 - protein, 6 aa, Entamoeba invadens
KGPGIA

SEQ ID NO: 2871161 - protein, 58 aa, Entamoeba invadens
KGPIDTSTTTERTSIQPPQLTKQASNPNLLEPPQNLKPPTFDTPKNATTTTQSTGRQD

SEQ ID NO: 2871162 - protein, 15 aa, Entamoeba invadens
KGPKAGKMSKSIPDS

SEQ ID NO: 2871163 - protein, 7 aa, Entamoeba invadens
KGPKGGL

SEQ ID NO: 2871164 - protein, 6 aa, Entamoeba invadens
KGPLGL

SEQ ID NO: 2871165 - protein, 7 aa, Entamoeba invadens
KGPNNDA

SEQ ID NO: 2871166 - protein, 5 aa, Entamoeba invadens
KGPNV

SEQ ID NO: 2871167 - protein, 4 aa, Entamoeba invadens
KGPQ

SEQ ID NO: 2871168 - protein, 6 aa, Entamoeba invadens
KGPRYS

SEQ ID NO: 2871169 - protein, 7 aa, Entamoeba invadens
KGQADRV

SEQ ID NO: 2871170 - protein, 7 aa, Entamoeba invadens
KGQAGCP

SEQ ID NO: 2871171 - protein, 6 aa, Entamoeba invadens
KGQDAV

SEQ ID NO: 2871172 - protein, 8 aa, Entamoeba invadens
KGQEEDGS

SEQ ID NO: 2871173 - protein, 7 aa, Entamoeba invadens
KGQFTSP

SEQ ID NO: 2871174 - protein, 4 aa, Entamoeba invadens
KGQI

SEQ ID NO: 2871175 - protein, 15 aa, Entamoeba invadens
KGQKEGREYPVTENG

SEQ ID NO: 2871176 - protein, 5 aa, Entamoeba invadens
KGQRS

SEQ ID NO: 2871177 - protein, 6 aa, Entamoeba invadens
KGQSDQ

SEQ ID NO: 2871178 - protein, 13 aa, Entamoeba invadens
KGQSHTKEEVQNV

SEQ ID NO: 2871179 - protein, 6 aa, Entamoeba invadens
KGQSVV

SEQ ID NO: 2871180 - protein, 7 aa, Entamoeba invadens
KGQTDQL

SEQ ID NO: 2871181 - protein, 8 aa, Entamoeba invadens
KGQTSHHK

SEQ ID NO: 2871182 - protein, 5 aa, Entamoeba invadens
KGQYS

SEQ ID NO: 2871183 - protein, 15 aa, Entamoeba invadens
KGRADEKKANEKCVV

SEQ ID NO: 2871184 - protein, 11 aa, Entamoeba invadens
KGRAPAHVKDE

SEQ ID NO: 2871185 - protein, 6 aa, Entamoeba invadens
KGRAVE

SEQ ID NO: 2871186 - protein, 7 aa, Entamoeba invadens
KGREGKF

SEQ ID NO: 2871187 - protein, 10 aa, Entamoeba invadens
KGRESENEPL

SEQ ID NO: 2871188 - protein, 8 aa, Entamoeba invadens
KGRETSYD

SEQ ID NO: 2871189 - protein, 6 aa, Entamoeba invadens
KGREVK

SEQ ID NO: 2871190 - protein, 17 aa, Entamoeba invadens
KGRFADDEAAKYVKQTT

SEQ ID NO: 2871191 - protein, 7 aa, Entamoeba invadens
KGRFKKP

SEQ ID NO: 2871192 - protein, 6 aa, Entamoeba invadens
KGRGCI

SEQ ID NO: 2871193 - protein, 7 aa, Entamoeba invadens
KGRGEPL

SEQ ID NO: 2871194 - protein, 8 aa, Entamoeba invadens
KGRKAGQK

SEQ ID NO: 2871195 - protein, 11 aa, Entamoeba invadens
KGRKIGAHQDI

SEQ ID NO: 2871196 - protein, 15 aa, Entamoeba invadens
KGRKLADLSGHDAPV

SEQ ID NO: 2871197 - protein, 5 aa, Entamoeba invadens
KGRLE

SEQ ID NO: 2871198 - protein, 8 aa, Entamoeba invadens
KGRLENEP

SEQ ID NO: 2871199 - protein, 15 aa, Entamoeba invadens
KGRMPINEGNTTQER

SEQ ID NO: 2871200 - protein, 61 aa, Entamoeba invadens
KGRNSGNGMKTPDQASSPKLEEKKEKSEKEKVDKGDDKKTKKEKKEKTEKTTSALYERQKD

SEQ ID NO: 2871201 - protein, 6 aa, Entamoeba invadens
KGRPFT

SEQ ID NO: 2871202 - protein, 6 aa, Entamoeba invadens
KGRPIS

SEQ ID NO: 2871203 - protein, 6 aa, Entamoeba invadens
KGRQGD

SEQ ID NO: 2871204 - protein, 5 aa, Entamoeba invadens
KGRRD

SEQ ID NO: 2871205 - protein, 6 aa, Entamoeba invadens
KGRRED

SEQ ID NO: 2871206 - protein, 9 aa, Entamoeba invadens
KGRSPNSVK

SEQ ID NO: 2871207 - protein, 12 aa, Entamoeba invadens
KGRTETPTEWSQ

SEQ ID NO: 2871208 - protein, 8 aa, Entamoeba invadens
KGRTPDTT

SEQ ID NO: 2871209 - protein, 9 aa, Entamoeba invadens
KGRTSVVPS

SEQ ID NO: 2871210 - protein, 23 aa, Entamoeba invadens
KGRVDVKSTGGRLGPVNGEYPDL

SEQ ID NO: 2871211 - protein, 6 aa, Entamoeba invadens
KGRWKK

SEQ ID NO: 2871212 - protein, 6 aa, Entamoeba invadens
KGRYHT

SEQ ID NO: 2871213 - protein, 7 aa, Entamoeba invadens
KGSADAF

SEQ ID NO: 2871214 - protein, 8 aa, Entamoeba invadens
KGSAGIES

SEQ ID NO: 2871215 - protein, 8 aa, Entamoeba invadens
KGSAKSQT

SEQ ID NO: 2871216 - protein, 16 aa, Entamoeba invadens
KGSANNKTNKDGTRKK

SEQ ID NO: 2871217 - protein, 6 aa, Entamoeba invadens
KGSDKI

SEQ ID NO: 2871218 - protein, 6 aa, Entamoeba invadens
KGSEDF

SEQ ID NO: 2871219 - protein, 9 aa, Entamoeba invadens
KGSEEENYT

SEQ ID NO: 2871220 - protein, 9 aa, Entamoeba invadens
KGSEEKLAK

SEQ ID NO: 2871221 - protein, 5 aa, Entamoeba invadens
KGSEL

SEQ ID NO: 2871222 - protein, 7 aa, Entamoeba invadens
KGSEPVR

SEQ ID NO: 2871223 - protein, 6 aa, Entamoeba invadens
KGSFDE

SEQ ID NO: 2871224 - protein, 7 aa, Entamoeba invadens
KGSFNNN

SEQ ID NO: 2871225 - protein, 15 aa, Entamoeba invadens
KGSGNNKSMKDGTKR

SEQ ID NO: 2871226 - protein, 6 aa, Entamoeba invadens
KGSGQC

SEQ ID NO: 2871227 - protein, 6 aa, Entamoeba invadens
KGSGRV

SEQ ID NO: 2871228 - protein, 15 aa, Entamoeba invadens
KGSGTVVGNDDSEVT

SEQ ID NO: 2871229 - protein, 12 aa, Entamoeba invadens
KGSHKQQKDTCK

SEQ ID NO: 2871230 - protein, 9 aa, Entamoeba invadens
KGSITHGGA

SEQ ID NO: 2871231 - protein, 10 aa, Entamoeba invadens
KGSKDLADKM

SEQ ID NO: 2871232 - protein, 18 aa, Entamoeba invadens
KGSKDNRKHFDDTYKQNN

SEQ ID NO: 2871233 - protein, 7 aa, Entamoeba invadens
KGSKNFT

SEQ ID NO: 2871234 - protein, 8 aa, Entamoeba invadens
KGSLDEKE

SEQ ID NO: 2871235 - protein, 7 aa, Entamoeba invadens
KGSLNGY

SEQ ID NO: 2871236 - protein, 8 aa, Entamoeba invadens
KGSLSDPL

SEQ ID NO: 2871237 - protein, 6 aa, Entamoeba invadens
KGSLTV

SEQ ID NO: 2871238 - protein, 4 aa, Entamoeba invadens
KGSN

SEQ ID NO: 2871239 - protein, 6 aa, Entamoeba invadens
KGSNEV

SEQ ID NO: 2871240 - protein, 13 aa, Entamoeba invadens
KGSNNDEIDAKAN

SEQ ID NO: 2871241 - protein, 4 aa, Entamoeba invadens
KGSP

SEQ ID NO: 2871242 - protein, 7 aa, Entamoeba invadens
KGSPFTR

SEQ ID NO: 2871243 - protein, 10 aa, Entamoeba invadens
KGSPKTFDVD

SEQ ID NO: 2871244 - protein, 51 aa, Entamoeba invadens
KGSPQKTGSEEKTIEYEAEKDHYSEQKGGQTQCVKEDKETTEKDEKEYSKS

SEQ ID NO: 2871245 - protein, 8 aa, Entamoeba invadens
KGSPYTPE

SEQ ID NO: 2871246 - protein, 7 aa, Entamoeba invadens
KGSQDIE

SEQ ID NO: 2871247 - protein, 12 aa, Entamoeba invadens
KGSQKNPHSPIR

SEQ ID NO: 2871248 - protein, 6 aa, Entamoeba invadens
KGSQLT

SEQ ID NO: 2871249 - protein, 8 aa, Entamoeba invadens
KGSRFGDG

SEQ ID NO: 2871250 - protein, 13 aa, Entamoeba invadens
KGSRQNQNASGSL

SEQ ID NO: 2871251 - protein, 8 aa, Entamoeba invadens
KGSRSTVK

SEQ ID NO: 2871252 - protein, 5 aa, Entamoeba invadens
KGSRV

SEQ ID NO: 2871253 - protein, 5 aa, Entamoeba invadens
KGSSF

SEQ ID NO: 2871254 - protein, 12 aa, Entamoeba invadens
KGSVNDIDGNGR

SEQ ID NO: 2871255 - protein, 7 aa, Entamoeba invadens
KGSYKKK

SEQ ID NO: 2871256 - protein, 38 aa, Entamoeba invadens
KGSYTGDKLSVNGGLSSGKNGNDKTKSLSVDGKYKVND

SEQ ID NO: 2871257 - protein, 17 aa, Entamoeba invadens
KGSYTSPTRFYPKEGKI

SEQ ID NO: 2871258 - protein, 6 aa, Entamoeba invadens
KGTAEL

SEQ ID NO: 2871259 - protein, 5 aa, Entamoeba invadens
KGTAI

SEQ ID NO: 2871260 - protein, 10 aa, Entamoeba invadens
KGTDEGFSAE

SEQ ID NO: 2871261 - protein, 10 aa, Entamoeba invadens
KGTDLDTNMG

SEQ ID NO: 2871262 - protein, 7 aa, Entamoeba invadens
KGTECDS

SEQ ID NO: 2871263 - protein, 9 aa, Entamoeba invadens
KGTEKNDIY

SEQ ID NO: 2871264 - protein, 21 aa, Entamoeba invadens
KGTEKYEETTNQYDTFLNVQC

SEQ ID NO: 2871265 - protein, 10 aa, Entamoeba invadens
KGTESSSEQN

SEQ ID NO: 2871266 - protein, 6 aa, Entamoeba invadens
KGTFEY

SEQ ID NO: 2871267 - protein, 13 aa, Entamoeba invadens
KGTFNETQQATVG

SEQ ID NO: 2871268 - protein, 14 aa, Entamoeba invadens
KGTFQKNQRKTMDN

SEQ ID NO: 2871269 - protein, 11 aa, Entamoeba invadens
KGTGEDITERF

SEQ ID NO: 2871270 - protein, 7 aa, Entamoeba invadens
KGTGENI

SEQ ID NO: 2871271 - protein, 14 aa, Entamoeba invadens
KGTGENITERIKNG

SEQ ID NO: 2871272 - protein, 7 aa, Entamoeba invadens
KGTGHGA

SEQ ID NO: 2871273 - protein, 5 aa, Entamoeba invadens
KGTHH

SEQ ID NO: 2871274 - protein, 4 aa, Entamoeba invadens
KGTI

SEQ ID NO: 2871275 - protein, 7 aa, Entamoeba invadens
KGTIEEI

SEQ ID NO: 2871276 - protein, 11 aa, Entamoeba invadens
KGTKEPSKEVY

SEQ ID NO: 2871277 - protein, 7 aa, Entamoeba invadens
KGTKEYD

SEQ ID NO: 2871278 - protein, 6 aa, Entamoeba invadens
KGTKGE

SEQ ID NO: 2871279 - protein, 10 aa, Entamoeba invadens
KGTKLPTKKR

SEQ ID NO: 2871280 - protein, 15 aa, Entamoeba invadens
KGTKSAVKGDASAKD

SEQ ID NO: 2871281 - protein, 15 aa, Entamoeba invadens
KGTKTDKYYNMTQKG

SEQ ID NO: 2871282 - protein, 7 aa, Entamoeba invadens
KGTKYTV

SEQ ID NO: 2871283 - protein, 5 aa, Entamoeba invadens
KGTLP

SEQ ID NO: 2871284 - protein, 5 aa, Entamoeba invadens
KGTLS

SEQ ID NO: 2871285 - protein, 7 aa, Entamoeba invadens
KGTNESV

SEQ ID NO: 2871286 - protein, 8 aa, Entamoeba invadens
KGTNPESA

SEQ ID NO: 2871287 - protein, 8 aa, Entamoeba invadens
KGTNQAEG

SEQ ID NO: 2871288 - protein, 5 aa, Entamoeba invadens
KGTPL

SEQ ID NO: 2871289 - protein, 4 aa, Entamoeba invadens
KGTQ

SEQ ID NO: 2871290 - protein, 10 aa, Entamoeba invadens
KGTQASCRDA

SEQ ID NO: 2871291 - protein, 10 aa, Entamoeba invadens
KGTRQTKKEL

SEQ ID NO: 2871292 - protein, 9 aa, Entamoeba invadens
KGTRSARKT

SEQ ID NO: 2871293 - protein, 8 aa, Entamoeba invadens
KGTSERDQ

SEQ ID NO: 2871294 - protein, 6 aa, Entamoeba invadens
KGTSVS

SEQ ID NO: 2871295 - protein, 6 aa, Entamoeba invadens
KGTTET

SEQ ID NO: 2871296 - protein, 6 aa, Entamoeba invadens
KGTTGL

SEQ ID NO: 2871297 - protein, 14 aa, Entamoeba invadens
KGTTPHSHKKQETA

SEQ ID NO: 2871298 - protein, 7 aa, Entamoeba invadens
KGTTQVN

SEQ ID NO: 2871299 - protein, 7 aa, Entamoeba invadens
KGTTSSQ

SEQ ID NO: 2871300 - protein, 5 aa, Entamoeba invadens
KGTTT

SEQ ID NO: 2871301 - protein, 13 aa, Entamoeba invadens
KGTTTGWAGFQHQ

SEQ ID NO: 2871302 - protein, 10 aa, Entamoeba invadens
KGTVKKQNKR

SEQ ID NO: 2871303 - protein, 13 aa, Entamoeba invadens
KGTVKTERIPAED

SEQ ID NO: 2871304 - protein, 20 aa, Entamoeba invadens
KGTVTHGEDEDGPYLHIIFQ

SEQ ID NO: 2871305 - protein, 4 aa, Entamoeba invadens
KGVA

SEQ ID NO: 2871306 - protein, 8 aa, Entamoeba invadens
KGVAENPI

SEQ ID NO: 2871307 - protein, 10 aa, Entamoeba invadens
KGVAKPTAFR

SEQ ID NO: 2871308 - protein, 13 aa, Entamoeba invadens
KGVATTSSWHQTS

SEQ ID NO: 2871309 - protein, 12 aa, Entamoeba invadens
KGVDKDSYQNDI

SEQ ID NO: 2871310 - protein, 7 aa, Entamoeba invadens
KGVDKNH

SEQ ID NO: 2871311 - protein, 57 aa, Entamoeba invadens
KGVDTEITTVKDNDIKEATVKKKKKEEYEDLKKPKPNIEEKAETKQKMANKGKEVIT

SEQ ID NO: 2871312 - protein, 5 aa, Entamoeba invadens
KGVEF

SEQ ID NO: 2871313 - protein, 6 aa, Entamoeba invadens
KGVEIK

SEQ ID NO: 2871314 - protein, 5 aa, Entamoeba invadens
KGVES

SEQ ID NO: 2871315 - protein, 15 aa, Entamoeba invadens
KGVGNAKGAKDMKEM

SEQ ID NO: 2871316 - protein, 6 aa, Entamoeba invadens
KGVGSP

SEQ ID NO: 2871317 - protein, 6 aa, Entamoeba invadens
KGVGSS

SEQ ID NO: 2871318 - protein, 7 aa, Entamoeba invadens
KGVGTPK

SEQ ID NO: 2871319 - protein, 9 aa, Entamoeba invadens
KGVGTPSYM

SEQ ID NO: 2871320 - protein, 4 aa, Entamoeba invadens
KGVL

SEQ ID NO: 2871321 - protein, 14 aa, Entamoeba invadens
KGVNPANAEQLPQD

SEQ ID NO: 2871322 - protein, 7 aa, Entamoeba invadens
KGVNSKE

SEQ ID NO: 2871323 - protein, 4 aa, Entamoeba invadens
KGVP

SEQ ID NO: 2871324 - protein, 11 aa, Entamoeba invadens
KGVPDEVTAGL

SEQ ID NO: 2871325 - protein, 10 aa, Entamoeba invadens
KGVPPITGGN

SEQ ID NO: 2871326 - protein, 18 aa, Entamoeba invadens
KGVPQSTAFRKSMDKKKR

SEQ ID NO: 2871327 - protein, 10 aa, Entamoeba invadens
KGVPSQTVER

SEQ ID NO: 2871328 - protein, 5 aa, Entamoeba invadens
KGVRG

SEQ ID NO: 2871329 - protein, 8 aa, Entamoeba invadens
KGVRPPLP

SEQ ID NO: 2871330 - protein, 15 aa, Entamoeba invadens
KGVRVKKTTYTERDY

SEQ ID NO: 2871331 - protein, 7 aa, Entamoeba invadens
KGVSAGG

SEQ ID NO: 2871332 - protein, 14 aa, Entamoeba invadens
KGVSDVKKYTRKSV

SEQ ID NO: 2871333 - protein, 4 aa, Entamoeba invadens
KGVT

SEQ ID NO: 2871334 - protein, 10 aa, Entamoeba invadens
KGVTAKASRM

SEQ ID NO: 2871335 - protein, 12 aa, Entamoeba invadens
KGVTKISDPIKQ

SEQ ID NO: 2871336 - protein, 18 aa, Entamoeba invadens
KGVTMKTAKRRLQAKKRK

SEQ ID NO: 2871337 - protein, 5 aa, Entamoeba invadens
KGVTS

SEQ ID NO: 2871338 - protein, 7 aa, Entamoeba invadens
KGVTSEI

SEQ ID NO: 2871339 - protein, 19 aa, Entamoeba invadens
KGVVEKQNFDTKDDDTEWL

SEQ ID NO: 2871340 - protein, 13 aa, Entamoeba invadens
KGWSYSTDTNDYD

SEQ ID NO: 2871341 - protein, 9 aa, Entamoeba invadens
KGYASSEEI

SEQ ID NO: 2871342 - protein, 5 aa, Entamoeba invadens
KGYDI

SEQ ID NO: 2871343 - protein, 5 aa, Entamoeba invadens
KGYDP

SEQ ID NO: 2871344 - protein, 13 aa, Entamoeba invadens
KGYDTDPSAIARN

SEQ ID NO: 2871345 - protein, 7 aa, Entamoeba invadens
KGYEEER

SEQ ID NO: 2871346 - protein, 7 aa, Entamoeba invadens
KGYENEK

SEQ ID NO: 2871347 - protein, 12 aa, Entamoeba invadens
KGYGGGHAPEGY

SEQ ID NO: 2871348 - protein, 5 aa, Entamoeba invadens
KGYHT

SEQ ID NO: 2871349 - protein, 11 aa, Entamoeba invadens
KGYKENKVTNN

SEQ ID NO: 2871350 - protein, 9 aa, Entamoeba invadens
KGYKSALDK

SEQ ID NO: 2871351 - protein, 9 aa, Entamoeba invadens
KGYPKEVYS

SEQ ID NO: 2871352 - protein, 5 aa, Entamoeba invadens
KGYPW

SEQ ID NO: 2871353 - protein, 18 aa, Entamoeba invadens
KGYRPDPNKMAGGDLDGD

SEQ ID NO: 2871354 - protein, 4 aa, Entamoeba invadens
KGYS

SEQ ID NO: 2871355 - protein, 7 aa, Entamoeba invadens
KGYSANA

SEQ ID NO: 2871356 - protein, 5 aa, Entamoeba invadens
KGYSS

SEQ ID NO: 2871357 - protein, 7 aa, Entamoeba invadens
KGYSSKD

SEQ ID NO: 2871358 - protein, 4 aa, Entamoeba invadens
KGYT

SEQ ID NO: 2871359 - protein, 14 aa, Entamoeba invadens
KHAAKEYKGKGSKK

SEQ ID NO: 2871360 - protein, 14 aa, Entamoeba invadens
KHAAKEYKGKGTKK

SEQ ID NO: 2871361 - protein, 9 aa, Entamoeba invadens
KHANKDEQV

SEQ ID NO: 2871362 - protein, 4 aa, Entamoeba invadens
KHAP

SEQ ID NO: 2871363 - protein, 8 aa, Entamoeba invadens
KHARGGLR

SEQ ID NO: 2871364 - protein, 18 aa, Entamoeba invadens
KHARQSETPNMNSTNPFA

SEQ ID NO: 2871365 - protein, 11 aa, Entamoeba invadens
KHARSKGVPGY

SEQ ID NO: 2871366 - protein, 24 aa, Entamoeba invadens
KHAVSEGQSAVKRAQGQPTSGSKS

SEQ ID NO: 2871367 - protein, 13 aa, Entamoeba invadens
KHDDAKEYKSNGA

SEQ ID NO: 2871368 - protein, 29 aa, Entamoeba invadens
KHDDRKDEEGEEETQQNVEEDKRKQYETN

SEQ ID NO: 2871369 - protein, 8 aa, Entamoeba invadens
KHDDSGAT

SEQ ID NO: 2871370 - protein, 6 aa, Entamoeba invadens
KHDKQG

SEQ ID NO: 2871371 - protein, 5 aa, Entamoeba invadens
KHDMK

SEQ ID NO: 2871372 - protein, 4 aa, Entamoeba invadens
KHDP

SEQ ID NO: 2871373 - protein, 5 aa, Entamoeba invadens
KHEAQ

SEQ ID NO: 2871374 - protein, 5 aa, Entamoeba invadens
KHEEC

SEQ ID NO: 2871375 - protein, 17 aa, Entamoeba invadens
KHEEEEQENREKRSFKG

SEQ ID NO: 2871376 - protein, 12 aa, Entamoeba invadens
KHEEEGNVFDFA

SEQ ID NO: 2871377 - protein, 13 aa, Entamoeba invadens
KHEEITEEKEKSF

SEQ ID NO: 2871378 - protein, 5 aa, Entamoeba invadens
KHEEP

SEQ ID NO: 2871379 - protein, 8 aa, Entamoeba invadens
KHEERKNQ

SEQ ID NO: 2871380 - protein, 6 aa, Entamoeba invadens
KHEGAT

SEQ ID NO: 2871381 - protein, 16 aa, Entamoeba invadens
KHEHVSKNIQSKNTKA

SEQ ID NO: 2871382 - protein, 6 aa, Entamoeba invadens
KHEKEG

SEQ ID NO: 2871383 - protein, 34 aa, Entamoeba invadens
KHEKKENEVVQDTRPKITQSASPLVTQSASTPLM

SEQ ID NO: 2871384 - protein, 5 aa, Entamoeba invadens
KHEKS

SEQ ID NO: 2871385 - protein, 8 aa, Entamoeba invadens
KHEPKDDD

SEQ ID NO: 2871386 - protein, 10 aa, Entamoeba invadens
KHESEDGEFS

SEQ ID NO: 2871387 - protein, 8 aa, Entamoeba invadens
KHETRGAE

SEQ ID NO: 2871388 - protein, 5 aa, Entamoeba invadens
KHEYA

SEQ ID NO: 2871389 - protein, 8 aa, Entamoeba invadens
KHGAKEKI

SEQ ID NO: 2871390 - protein, 4 aa, Entamoeba invadens
KHGK

SEQ ID NO: 2871391 - protein, 7 aa, Entamoeba invadens
KHGKNWE

SEQ ID NO: 2871392 - protein, 10 aa, Entamoeba invadens
KHGPNRQNPI

SEQ ID NO: 2871393 - protein, 6 aa, Entamoeba invadens
KHGSCA

SEQ ID NO: 2871394 - protein, 11 aa, Entamoeba invadens
KHGSEVPEYVP

SEQ ID NO: 2871395 - protein, 5 aa, Entamoeba invadens
KHGSL

SEQ ID NO: 2871396 - protein, 7 aa, Entamoeba invadens
KHGTGHG

SEQ ID NO: 2871397 - protein, 6 aa, Entamoeba invadens
KHGTPM

SEQ ID NO: 2871398 - protein, 18 aa, Entamoeba invadens
KHGYSEKTSTPPRVVNIH

SEQ ID NO: 2871399 - protein, 7 aa, Entamoeba invadens
KHHGDSA

SEQ ID NO: 2871400 - protein, 12 aa, Entamoeba invadens
KHHGESNDSWGL

SEQ ID NO: 2871401 - protein, 6 aa, Entamoeba invadens
KHHPLT

SEQ ID NO: 2871402 - protein, 6 aa, Entamoeba invadens
KHIKTQ

SEQ ID NO: 2871403 - protein, 8 aa, Entamoeba invadens
KHIQDKEA

SEQ ID NO: 2871404 - protein, 42 aa, Entamoeba invadens
KHKAQTSAKPFETKGNTPQNTGTNQNGHVPSMPNGPIAIPQK

SEQ ID NO: 2871405 - protein, 4 aa, Entamoeba invadens
KHKD

SEQ ID NO: 2871406 - protein, 10 aa, Entamoeba invadens
KHKDACPDKQ

SEQ ID NO: 2871407 - protein, 9 aa, Entamoeba invadens
KHKDENKMT

SEQ ID NO: 2871408 - protein, 7 aa, Entamoeba invadens
KHKDNNF

SEQ ID NO: 2871409 - protein, 35 aa, Entamoeba invadens
KHKEEKRDEPELKKNLNKSDPPPKFENLEKSDKVE

SEQ ID NO: 2871410 - protein, 10 aa, Entamoeba invadens
KHKEGYQTKD

SEQ ID NO: 2871411 - protein, 70 aa, Entamoeba invadens
KHKEKKRTMKQLEKEKKKERPDSSEKKFKKSEKSQPKELKKELKEELKVEDKQKEEVKPIEKKTKKEDYE

SEQ ID NO: 2871412 - protein, 20 aa, Entamoeba invadens
KHKEQDTIEIDEKPKKKGGC

SEQ ID NO: 2871413 - protein, 5 aa, Entamoeba invadens
KHKGK

SEQ ID NO: 2871414 - protein, 10 aa, Entamoeba invadens
KHKKAVRSSQ

SEQ ID NO: 2871415 - protein, 12 aa, Entamoeba invadens
KHKKDISGNARA

SEQ ID NO: 2871416 - protein, 43 aa, Entamoeba invadens
KHKKKRSTSVGDECQSSLYAPKRAESVGVSQRQKLTKGNLNAA

SEQ ID NO: 2871417 - protein, 6 aa, Entamoeba invadens
KHKMET

SEQ ID NO: 2871418 - protein, 7 aa, Entamoeba invadens
KHKNELA

SEQ ID NO: 2871419 - protein, 6 aa, Entamoeba invadens
KHKNKE

SEQ ID NO: 2871420 - protein, 9 aa, Entamoeba invadens
KHKPSGLSE

SEQ ID NO: 2871421 - protein, 15 aa, Entamoeba invadens
KHKPSQMSGGEQQRV

SEQ ID NO: 2871422 - protein, 8 aa, Entamoeba invadens
KHKSDEDV

SEQ ID NO: 2871423 - protein, 12 aa, Entamoeba invadens
KHKSFSPERRSV

SEQ ID NO: 2871424 - protein, 15 aa, Entamoeba invadens
KHKSKFKGIRESTKK

SEQ ID NO: 2871425 - protein, 16 aa, Entamoeba invadens
KHKSNQKETEETKREI

SEQ ID NO: 2871426 - protein, 9 aa, Entamoeba invadens
KHKSPLHKK

SEQ ID NO: 2871427 - protein, 7 aa, Entamoeba invadens
KHKVPSE

SEQ ID NO: 2871428 - protein, 7 aa, Entamoeba invadens
KHLNERM

SEQ ID NO: 2871429 - protein, 19 aa, Entamoeba invadens
KHLNKKSTPALNSKELNQE

SEQ ID NO: 2871430 - protein, 12 aa, Entamoeba invadens
KHLSENNFNQYE

SEQ ID NO: 2871431 - protein, 13 aa, Entamoeba invadens
KHLSENNVNQYET

SEQ ID NO: 2871432 - protein, 12 aa, Entamoeba invadens
KHMKDKSHCKYH

SEQ ID NO: 2871433 - protein, 6 aa, Entamoeba invadens
KHMTSE

SEQ ID NO: 2871434 - protein, 6 aa, Entamoeba invadens
KHNGAV

SEQ ID NO: 2871435 - protein, 8 aa, Entamoeba invadens
KHNKTYTN

SEQ ID NO: 2871436 - protein, 16 aa, Entamoeba invadens
KHNNNLETLPESVSDK

SEQ ID NO: 2871437 - protein, 10 aa, Entamoeba invadens
KHNPKTKTQI

SEQ ID NO: 2871438 - protein, 6 aa, Entamoeba invadens
KHNPLR

SEQ ID NO: 2871439 - protein, 10 aa, Entamoeba invadens
KHNPWPRKNR

SEQ ID NO: 2871440 - protein, 4 aa, Entamoeba invadens
KHNT

SEQ ID NO: 2871441 - protein, 7 aa, Entamoeba invadens
KHNTSYP

SEQ ID NO: 2871442 - protein, 4 aa, Entamoeba invadens
KHPD

SEQ ID NO: 2871443 - protein, 8 aa, Entamoeba invadens
KHPDGIDK

SEQ ID NO: 2871444 - protein, 5 aa, Entamoeba invadens
KHPDP

SEQ ID NO: 2871445 - protein, 20 aa, Entamoeba invadens
KHPGRTSKTSFGSYTSESIT

SEQ ID NO: 2871446 - protein, 12 aa, Entamoeba invadens
KHPHDKSNPEGY

SEQ ID NO: 2871447 - protein, 6 aa, Entamoeba invadens
KHPHGP

SEQ ID NO: 2871448 - protein, 4 aa, Entamoeba invadens
KHPK

SEQ ID NO: 2871449 - protein, 7 aa, Entamoeba invadens
KHPKDPI

SEQ ID NO: 2871450 - protein, 7 aa, Entamoeba invadens
KHPKEKN

SEQ ID NO: 2871451 - protein, 28 aa, Entamoeba invadens
KHPKPSSAPPVVQPPQQRQSAPGDERAK

SEQ ID NO: 2871452 - protein, 7 aa, Entamoeba invadens
KHPMGSG

SEQ ID NO: 2871453 - protein, 37 aa, Entamoeba invadens
KHPNAVKGIQRQQQSNPTITPPQREIATQSESVQVPS

SEQ ID NO: 2871454 - protein, 5 aa, Entamoeba invadens
KHPNL

SEQ ID NO: 2871455 - protein, 9 aa, Entamoeba invadens
KHPNTKNDV

SEQ ID NO: 2871456 - protein, 13 aa, Entamoeba invadens
KHPNTKNDVADRI

SEQ ID NO: 2871457 - protein, 4 aa, Entamoeba invadens
KHPP

SEQ ID NO: 2871458 - protein, 8 aa, Entamoeba invadens
KHPRSNEK

SEQ ID NO: 2871459 - protein, 5 aa, Entamoeba invadens
KHPTQ

SEQ ID NO: 2871460 - protein, 5 aa, Entamoeba invadens
KHPVL

SEQ ID NO: 2871461 - protein, 8 aa, Entamoeba invadens
KHQDEEEV

SEQ ID NO: 2871462 - protein, 5 aa, Entamoeba invadens
KHQIT

SEQ ID NO: 2871463 - protein, 9 aa, Entamoeba invadens
KHQKMPRST

SEQ ID NO: 2871464 - protein, 8 aa, Entamoeba invadens
KHQTNAGL

SEQ ID NO: 2871465 - protein, 5 aa, Entamoeba invadens
KHQTP

SEQ ID NO: 2871466 - protein, 11 aa, Entamoeba invadens
KHRGGNKMDER

SEQ ID NO: 2871467 - protein, 6 aa, Entamoeba invadens
KHRGSL

SEQ ID NO: 2871468 - protein, 8 aa, Entamoeba invadens
KHRKSQIE

SEQ ID NO: 2871469 - protein, 23 aa, Entamoeba invadens
KHRRDKEDRPERVDGNEKIRDGD

SEQ ID NO: 2871470 - protein, 7 aa, Entamoeba invadens
KHRRERN

SEQ ID NO: 2871471 - protein, 5 aa, Entamoeba invadens
KHRRL

SEQ ID NO: 2871472 - protein, 16 aa, Entamoeba invadens
KHRSEKTSQVSVAQQN

SEQ ID NO: 2871473 - protein, 6 aa, Entamoeba invadens
KHRTHY

SEQ ID NO: 2871474 - protein, 7 aa, Entamoeba invadens
KHSDGFK

SEQ ID NO: 2871475 - protein, 7 aa, Entamoeba invadens
KHSEGGK

SEQ ID NO: 2871476 - protein, 6 aa, Entamoeba invadens
KHSESV

SEQ ID NO: 2871477 - protein, 11 aa, Entamoeba invadens
KHSGLQKDEEF

SEQ ID NO: 2871478 - protein, 6 aa, Entamoeba invadens
KHSKDE

SEQ ID NO: 2871479 - protein, 49 aa, Entamoeba invadens
KHSKDSENSEELKNSKELEELKKSKNLKQSEDSKELKNLEDSKNLQNFN

SEQ ID NO: 2871480 - protein, 8 aa, Entamoeba invadens
KHSKGLDK

SEQ ID NO: 2871481 - protein, 10 aa, Entamoeba invadens
KHSKGYDFQN

SEQ ID NO: 2871482 - protein, 15 aa, Entamoeba invadens
KHSKSYQSNSSPFTQ

SEQ ID NO: 2871483 - protein, 8 aa, Entamoeba invadens
KHSPSDVA

SEQ ID NO: 2871484 - protein, 94 aa, Entamoeba invadens
KHSPVSSESSESSDNDKHKNSSSAMSEDSSDSSSSSSQSSKEVQPTTKEMSEDSSSSEDPDSDETTKNLKELEKDEEKDEKKEMSEGSSSYEPL

SEQ ID NO: 2871485 - protein, 17 aa, Entamoeba invadens
KHSQKLLTDGEDEGEYW

SEQ ID NO: 2871486 - protein, 4 aa, Entamoeba invadens
KHSR

SEQ ID NO: 2871487 - protein, 5 aa, Entamoeba invadens
KHSRA

SEQ ID NO: 2871488 - protein, 18 aa, Entamoeba invadens
KHSSEYKKETNEEKQKVS

SEQ ID NO: 2871489 - protein, 7 aa, Entamoeba invadens
KHSSLTK

SEQ ID NO: 2871490 - protein, 7 aa, Entamoeba invadens
KHSTEDL

SEQ ID NO: 2871491 - protein, 5 aa, Entamoeba invadens
KHSYN

SEQ ID NO: 2871492 - protein, 17 aa, Entamoeba invadens
KHTARDENEKKRMKAKG

SEQ ID NO: 2871493 - protein, 9 aa, Entamoeba invadens
KHTDGSRFE

SEQ ID NO: 2871494 - protein, 7 aa, Entamoeba invadens
KHTDRSK

SEQ ID NO: 2871495 - protein, 4 aa, Entamoeba invadens
KHTI

SEQ ID NO: 2871496 - protein, 39 aa, Entamoeba invadens
KHTKKSHKSDDHNHSKEFKKSQDVKRTSDMKERGEEYQT

SEQ ID NO: 2871497 - protein, 5 aa, Entamoeba invadens
KHTKT

SEQ ID NO: 2871498 - protein, 6 aa, Entamoeba invadens
KHTNKK

SEQ ID NO: 2871499 - protein, 7 aa, Entamoeba invadens
KHTPGWT

SEQ ID NO: 2871500 - protein, 6 aa, Entamoeba invadens
KHTPRT

SEQ ID NO: 2871501 - protein, 19 aa, Entamoeba invadens
KHTPVKNKRRKTLSESCCI

SEQ ID NO: 2871502 - protein, 4 aa, Entamoeba invadens
KHTQ

SEQ ID NO: 2871503 - protein, 67 aa, Entamoeba invadens
KHTSSDSKSDTKKEEKKKAKEAKEKEKKDKKDKKSHTRTESVQKKDDKSPSTTTPVVDPKTNGYAAG

SEQ ID NO: 2871504 - protein, 12 aa, Entamoeba invadens
KHVATPPPEIET

SEQ ID NO: 2871505 - protein, 13 aa, Entamoeba invadens
KHVSRNPRGTNPY

SEQ ID NO: 2871506 - protein, 13 aa, Entamoeba invadens
KHVSRTPRGTNPY

SEQ ID NO: 2871507 - protein, 12 aa, Entamoeba invadens
KHYAAQKKEEKC

SEQ ID NO: 2871508 - protein, 22 aa, Entamoeba invadens
KHYDPNDDKKATTREADSTEVC

SEQ ID NO: 2871509 - protein, 13 aa, Entamoeba invadens
KHYKESKRGSIPD

SEQ ID NO: 2871510 - protein, 7 aa, Entamoeba invadens
KHYPDST

SEQ ID NO: 2871511 - protein, 8 aa, Entamoeba invadens
KHYSAQSV

SEQ ID NO: 2871512 - protein, 7 aa, Entamoeba invadens
KIADPEY

SEQ ID NO: 2871513 - protein, 12 aa, Entamoeba invadens
KIAEKTGVTNND

SEQ ID NO: 2871514 - protein, 12 aa, Entamoeba invadens
KIAEPQQQKVEP

SEQ ID NO: 2871515 - protein, 15 aa, Entamoeba invadens
KIAESLSGRTARSIR

SEQ ID NO: 2871516 - protein, 5 aa, Entamoeba invadens
KIAGA

SEQ ID NO: 2871517 - protein, 9 aa, Entamoeba invadens
KIAGGDSSA

SEQ ID NO: 2871518 - protein, 7 aa, Entamoeba invadens
KIAGKCG

SEQ ID NO: 2871519 - protein, 12 aa, Entamoeba invadens
KIAKATSDGYQT

SEQ ID NO: 2871520 - protein, 17 aa, Entamoeba invadens
KIAKEQKTDDNKLSKTS

SEQ ID NO: 2871521 - protein, 13 aa, Entamoeba invadens
KIAKGKGKKVGKY

SEQ ID NO: 2871522 - protein, 10 aa, Entamoeba invadens
KIAKGYNNTT

SEQ ID NO: 2871523 - protein, 10 aa, Entamoeba invadens
KIANKQKKGT

SEQ ID NO: 2871524 - protein, 7 aa, Entamoeba invadens
KIANKSK

SEQ ID NO: 2871525 - protein, 13 aa, Entamoeba invadens
KIANPQKKTTYSS

SEQ ID NO: 2871526 - protein, 6 aa, Entamoeba invadens
KIAPND

SEQ ID NO: 2871527 - protein, 5 aa, Entamoeba invadens
KIAQG

SEQ ID NO: 2871528 - protein, 81 aa, Entamoeba invadens
KIATETKEKAIETAKKADEAKTAAEEAKVQADEALEVSNKAKEESEKAKQEAEEAEKQAVEAQEEAEKAVQEANDKVAEAE

SEQ ID NO: 2871529 - protein, 7 aa, Entamoeba invadens
KIATSTR

SEQ ID NO: 2871530 - protein, 9 aa, Entamoeba invadens
KIDASELNT

SEQ ID NO: 2871531 - protein, 16 aa, Entamoeba invadens
KIDDENLKKSVAEQQY

SEQ ID NO: 2871532 - protein, 5 aa, Entamoeba invadens
KIDDR

SEQ ID NO: 2871533 - protein, 10 aa, Entamoeba invadens
KIDEDGKDVG

SEQ ID NO: 2871534 - protein, 5 aa, Entamoeba invadens
KIDEG

SEQ ID NO: 2871535 - protein, 6 aa, Entamoeba invadens
KIDEGL

SEQ ID NO: 2871536 - protein, 19 aa, Entamoeba invadens
KIDENKDIKKDDDDEIDSL

SEQ ID NO: 2871537 - protein, 26 aa, Entamoeba invadens
KIDEPKVTKKSKTKLAKKSLKKSTKL

SEQ ID NO: 2871538 - protein, 6 aa, Entamoeba invadens
KIDESD

SEQ ID NO: 2871539 - protein, 20 aa, Entamoeba invadens
KIDESETTERTMGKSEIPNI

SEQ ID NO: 2871540 - protein, 5 aa, Entamoeba invadens
KIDEV

SEQ ID NO: 2871541 - protein, 11 aa, Entamoeba invadens
KIDGDTTDIEK

SEQ ID NO: 2871542 - protein, 9 aa, Entamoeba invadens
KIDISGHTQ

SEQ ID NO: 2871543 - protein, 12 aa, Entamoeba invadens
KIDKQKEEPLNE

SEQ ID NO: 2871544 - protein, 6 aa, Entamoeba invadens
KIDPEN

SEQ ID NO: 2871545 - protein, 20 aa, Entamoeba invadens
KIDPQQNLDEGTQRKEDEAV

SEQ ID NO: 2871546 - protein, 10 aa, Entamoeba invadens
KIDPSSTIPK

SEQ ID NO: 2871547 - protein, 8 aa, Entamoeba invadens
KIDQSEKF

SEQ ID NO: 2871548 - protein, 7 aa, Entamoeba invadens
KIDQTNL

SEQ ID NO: 2871549 - protein, 9 aa, Entamoeba invadens
KIDRYDTEH

SEQ ID NO: 2871550 - protein, 7 aa, Entamoeba invadens
KIDSADA

SEQ ID NO: 2871551 - protein, 6 aa, Entamoeba invadens
KIDSDK

SEQ ID NO: 2871552 - protein, 6 aa, Entamoeba invadens
KIDSKT

SEQ ID NO: 2871553 - protein, 11 aa, Entamoeba invadens
KIDTAKSMAEM

SEQ ID NO: 2871554 - protein, 5 aa, Entamoeba invadens
KIDTD

SEQ ID NO: 2871555 - protein, 7 aa, Entamoeba invadens
KIDTSGC

SEQ ID NO: 2871556 - protein, 6 aa, Entamoeba invadens
KIDTTT

SEQ ID NO: 2871557 - protein, 129 aa, Entamoeba invadens
KIEAEKKRRLEAEKQKRIEAENKRKADEERQRAALEEARKREEEIAKRNEQERIAKEAEEQRRLEEEQKRLEEEAKKLEEEQKRREEQTRIEKEKREAEEKKRLEEVRRQKEREEKERKALEEKQRIEL

SEQ ID NO: 2871558 - protein, 16 aa, Entamoeba invadens
KIEAKKPEKQKGLDVE

SEQ ID NO: 2871559 - protein, 6 aa, Entamoeba invadens
KIEDAL

SEQ ID NO: 2871560 - protein, 50 aa, Entamoeba invadens
KIEDDINVSDDDLPPLPIETTKNKEVFKPRKEPSVEAKRITRKVTTDTCR

SEQ ID NO: 2871561 - protein, 9 aa, Entamoeba invadens
KIEDEENSV

SEQ ID NO: 2871562 - protein, 10 aa, Entamoeba invadens
KIEDENMDTE

SEQ ID NO: 2871563 - protein, 20 aa, Entamoeba invadens
KIEDKKKELEKKAASGSGVA

SEQ ID NO: 2871564 - protein, 8 aa, Entamoeba invadens
KIEEAARE

SEQ ID NO: 2871565 - protein, 10 aa, Entamoeba invadens
KIEEAPAPYV

SEQ ID NO: 2871566 - protein, 14 aa, Entamoeba invadens
KIEEDKKKTEEERL

SEQ ID NO: 2871567 - protein, 19 aa, Entamoeba invadens
KIEEEKSLSENKIKELNNE

SEQ ID NO: 2871568 - protein, 6 aa, Entamoeba invadens
KIEEER

SEQ ID NO: 2871569 - protein, 24 aa, Entamoeba invadens
KIEEESDDAPLEVSSKKDAQKMEE

SEQ ID NO: 2871570 - protein, 11 aa, Entamoeba invadens
KIEEETTDQKV

SEQ ID NO: 2871571 - protein, 22 aa, Entamoeba invadens
KIEEGKNQTSTKLTDTQDEKKC

SEQ ID NO: 2871572 - protein, 5 aa, Entamoeba invadens
KIEEI

SEQ ID NO: 2871573 - protein, 13 aa, Entamoeba invadens
KIEEIAKKSHGDV

SEQ ID NO: 2871574 - protein, 15 aa, Entamoeba invadens
KIEEIEKEAQEKIEQ

SEQ ID NO: 2871575 - protein, 17 aa, Entamoeba invadens
KIEEKEDDVPLSEQLSK

SEQ ID NO: 2871576 - protein, 6 aa, Entamoeba invadens
KIEEMQ

SEQ ID NO: 2871577 - protein, 7 aa, Entamoeba invadens
KIEEQKN

SEQ ID NO: 2871578 - protein, 6 aa, Entamoeba invadens
KIEESL

SEQ ID NO: 2871579 - protein, 22 aa, Entamoeba invadens
KIEESPQCDFNKDSEHKDERDH

SEQ ID NO: 2871580 - protein, 6 aa, Entamoeba invadens
KIEEST

SEQ ID NO: 2871581 - protein, 21 aa, Entamoeba invadens
KIEETKNRLEREERADATEAI

SEQ ID NO: 2871582 - protein, 7 aa, Entamoeba invadens
KIEETSA

SEQ ID NO: 2871583 - protein, 8 aa, Entamoeba invadens
KIEGDDVS

SEQ ID NO: 2871584 - protein, 16 aa, Entamoeba invadens
KIEGGYEVTAANGKTF

SEQ ID NO: 2871585 - protein, 6 aa, Entamoeba invadens
KIEGKS

SEQ ID NO: 2871586 - protein, 7 aa, Entamoeba invadens
KIEGMED

SEQ ID NO: 2871587 - protein, 17 aa, Entamoeba invadens
KIEGNEDSLNVGNNLNK

SEQ ID NO: 2871588 - protein, 26 aa, Entamoeba invadens
KIEGQVGTLEKTGITAPQTSGSLNNE

SEQ ID NO: 2871589 - protein, 24 aa, Entamoeba invadens
KIEGTQGTANAAPSAGACEGECKA

SEQ ID NO: 2871590 - protein, 4 aa, Entamoeba invadens
KIEK

SEQ ID NO: 2871591 - protein, 40 aa, Entamoeba invadens
KIEKAEKVEKKEKPEKSEKTDEEKTKDEKIEAEIAEEDEN

SEQ ID NO: 2871592 - protein, 7 aa, Entamoeba invadens
KIEKEEA

SEQ ID NO: 2871593 - protein, 19 aa, Entamoeba invadens
KIEKEEEEPQEKKEEVTME

SEQ ID NO: 2871594 - protein, 5 aa, Entamoeba invadens
KIEKH

SEQ ID NO: 2871595 - protein, 5 aa, Entamoeba invadens
KIEKS

SEQ ID NO: 2871596 - protein, 9 aa, Entamoeba invadens
KIEKSQEDL

SEQ ID NO: 2871597 - protein, 7 aa, Entamoeba invadens
KIEKTDA

SEQ ID NO: 2871598 - protein, 21 aa, Entamoeba invadens
KIEKTEEAGDVQKDEKKTQRV

SEQ ID NO: 2871599 - protein, 11 aa, Entamoeba invadens
KIENGISKEEV

SEQ ID NO: 2871600 - protein, 5 aa, Entamoeba invadens
KIENK

SEQ ID NO: 2871601 - protein, 14 aa, Entamoeba invadens
KIENMKGDSMNNPL

SEQ ID NO: 2871602 - protein, 10 aa, Entamoeba invadens
KIENNDNVGV

SEQ ID NO: 2871603 - protein, 6 aa, Entamoeba invadens
KIENNT

SEQ ID NO: 2871604 - protein, 7 aa, Entamoeba invadens
KIENPPE

SEQ ID NO: 2871605 - protein, 10 aa, Entamoeba invadens
KIENSKTKEI

SEQ ID NO: 2871606 - protein, 4 aa, Entamoeba invadens
KIEP

SEQ ID NO: 2871607 - protein, 10 aa, Entamoeba invadens
KIEPDEKRDW

SEQ ID NO: 2871608 - protein, 14 aa, Entamoeba invadens
KIEPDNEALKTTQS

SEQ ID NO: 2871609 - protein, 12 aa, Entamoeba invadens
KIEPKTESVPER

SEQ ID NO: 2871610 - protein, 35 aa, Entamoeba invadens
KIEPNSKHEDLKKRKRKGVNDKTSLLSNPEKKDDL

SEQ ID NO: 2871611 - protein, 7 aa, Entamoeba invadens
KIEPNSY

SEQ ID NO: 2871612 - protein, 4 aa, Entamoeba invadens
KIEQ

SEQ ID NO: 2871613 - protein, 9 aa, Entamoeba invadens
KIEQNDNDI

SEQ ID NO: 2871614 - protein, 26 aa, Entamoeba invadens
KIEQPVKVDTEPKNEGRAEPKPDMKE

SEQ ID NO: 2871615 - protein, 22 aa, Entamoeba invadens
KIERDRLKKEKREKEEAEEAER

SEQ ID NO: 2871616 - protein, 4 aa, Entamoeba invadens
KIES

SEQ ID NO: 2871617 - protein, 20 aa, Entamoeba invadens
KIESARQLSHQKSQRNWRTA

SEQ ID NO: 2871618 - protein, 18 aa, Entamoeba invadens
KIESGNKSDSICGEGLVS

SEQ ID NO: 2871619 - protein, 11 aa, Entamoeba invadens
KIESGRAKGEL

SEQ ID NO: 2871620 - protein, 7 aa, Entamoeba invadens
KIESLEQ

SEQ ID NO: 2871621 - protein, 6 aa, Entamoeba invadens
KIESNA

SEQ ID NO: 2871622 - protein, 8 aa, Entamoeba invadens
KIESTQNM

SEQ ID NO: 2871623 - protein, 4 aa, Entamoeba invadens
KIET

SEQ ID NO: 2871624 - protein, 6 aa, Entamoeba invadens
KIETEK

SEQ ID NO: 2871625 - protein, 7 aa, Entamoeba invadens
KIETPED

SEQ ID NO: 2871626 - protein, 7 aa, Entamoeba invadens
KIETPHR

SEQ ID NO: 2871627 - protein, 6 aa, Entamoeba invadens
KIETQY

SEQ ID NO: 2871628 - protein, 14 aa, Entamoeba invadens
KIETRQKQISDEKK

SEQ ID NO: 2871629 - protein, 13 aa, Entamoeba invadens
KIETSSSKESEKI

SEQ ID NO: 2871630 - protein, 5 aa, Entamoeba invadens
KIEVP

SEQ ID NO: 2871631 - protein, 7 aa, Entamoeba invadens
KIEVPSA

SEQ ID NO: 2871632 - protein, 4 aa, Entamoeba invadens
KIFG

SEQ ID NO: 2871633 - protein, 12 aa, Entamoeba invadens
KIFPSGDVSDYG

SEQ ID NO: 2871634 - protein, 23 aa, Entamoeba invadens
KIGADDEEFDPTKPNFPKYTPED

SEQ ID NO: 2871635 - protein, 10 aa, Entamoeba invadens
KIGASTKYAN

SEQ ID NO: 2871636 - protein, 40 aa, Entamoeba invadens
KIGAYAKSLRAKENALKNENGEKEVKRRETIGEDDTPVKQ

SEQ ID NO: 2871637 - protein, 7 aa, Entamoeba invadens
KIGDAED

SEQ ID NO: 2871638 - protein, 12 aa, Entamoeba invadens
KIGDDKFKRTRK

SEQ ID NO: 2871639 - protein, 51 aa, Entamoeba invadens
KIGDKSIERPWSKYSAGSSAHDKATTTEQPKKKEKKKVEEQPKKPSKSLEA

SEQ ID NO: 2871640 - protein, 7 aa, Entamoeba invadens
KIGDSDI

SEQ ID NO: 2871641 - protein, 6 aa, Entamoeba invadens
KIGEDA

SEQ ID NO: 2871642 - protein, 11 aa, Entamoeba invadens
KIGEGASGEVF

SEQ ID NO: 2871643 - protein, 5 aa, Entamoeba invadens
KIGEY

SEQ ID NO: 2871644 - protein, 4 aa, Entamoeba invadens
KIGG

SEQ ID NO: 2871645 - protein, 9 aa, Entamoeba invadens
KIGGDAKEF

SEQ ID NO: 2871646 - protein, 5 aa, Entamoeba invadens
KIGGE

SEQ ID NO: 2871647 - protein, 9 aa, Entamoeba invadens
KIGGEEAKN

SEQ ID NO: 2871648 - protein, 16 aa, Entamoeba invadens
KIGGETNYEVDSENSF

SEQ ID NO: 2871649 - protein, 16 aa, Entamoeba invadens
KIGGGNYQLTSTEQIE

SEQ ID NO: 2871650 - protein, 11 aa, Entamoeba invadens
KIGGTTDDTSL

SEQ ID NO: 2871651 - protein, 59 aa, Entamoeba invadens
KIGGVDTEITTVKDNDIKEATVKKKKKEEYEDLKKPKPNIEEKAETKQKMANKGKEVIT

SEQ ID NO: 2871652 - protein, 4 aa, Entamoeba invadens
KIGK

SEQ ID NO: 2871653 - protein, 8 aa, Entamoeba invadens
KIGKEESE

SEQ ID NO: 2871654 - protein, 9 aa, Entamoeba invadens
KIGKEQNDM

SEQ ID NO: 2871655 - protein, 37 aa, Entamoeba invadens
KIGKIEKEAEDKSKQLEEEKEKITKKLDSVEKEKEKI

SEQ ID NO: 2871656 - protein, 16 aa, Entamoeba invadens
KIGKIEKEKKEAHEKI

SEQ ID NO: 2871657 - protein, 7 aa, Entamoeba invadens
KIGNTTE

SEQ ID NO: 2871658 - protein, 6 aa, Entamoeba invadens
KIGPNE

SEQ ID NO: 2871659 - protein, 5 aa, Entamoeba invadens
KIGQS

SEQ ID NO: 2871660 - protein, 7 aa, Entamoeba invadens
KIGRDEY

SEQ ID NO: 2871661 - protein, 8 aa, Entamoeba invadens
KIGSTSTD

SEQ ID NO: 2871662 - protein, 5 aa, Entamoeba invadens
KIGSV

SEQ ID NO: 2871663 - protein, 7 aa, Entamoeba invadens
KIGTGAF

SEQ ID NO: 2871664 - protein, 7 aa, Entamoeba invadens
KIGTPKY

SEQ ID NO: 2871665 - protein, 9 aa, Entamoeba invadens
KIGTSQNAR

SEQ ID NO: 2871666 - protein, 13 aa, Entamoeba invadens
KIGYANKEAPEEV

SEQ ID NO: 2871667 - protein, 6 aa, Entamoeba invadens
KIHEGE

SEQ ID NO: 2871668 - protein, 15 aa, Entamoeba invadens
KIHQKKQRKKSSNYR

SEQ ID NO: 2871669 - protein, 12 aa, Entamoeba invadens
KIIPNEAYTSLE

SEQ ID NO: 2871670 - protein, 6 aa, Entamoeba invadens
KIIPPR

SEQ ID NO: 2871671 - protein, 13 aa, Entamoeba invadens
KIITSSGNTLLGA

SEQ ID NO: 2871672 - protein, 7 aa, Entamoeba invadens
KIKAEDD

SEQ ID NO: 2871673 - protein, 8 aa, Entamoeba invadens
KIKASNQL

SEQ ID NO: 2871674 - protein, 11 aa, Entamoeba invadens
KIKDDSKNPEL

SEQ ID NO: 2871675 - protein, 12 aa, Entamoeba invadens
KIKDNGDFEYGS

SEQ ID NO: 2871676 - protein, 9 aa, Entamoeba invadens
KIKDNKIDE

SEQ ID NO: 2871677 - protein, 7 aa, Entamoeba invadens
KIKDNNT

SEQ ID NO: 2871678 - protein, 13 aa, Entamoeba invadens
KIKDQVEKSNRKL

SEQ ID NO: 2871679 - protein, 17 aa, Entamoeba invadens
KIKDQVEKSNRKLNGFK

SEQ ID NO: 2871680 - protein, 10 aa, Entamoeba invadens
KIKDTRERIT

SEQ ID NO: 2871681 - protein, 5 aa, Entamoeba invadens
KIKEE

SEQ ID NO: 2871682 - protein, 6 aa, Entamoeba invadens
KIKEEK

SEQ ID NO: 2871683 - protein, 23 aa, Entamoeba invadens
KIKEERKTDESEHPKQNNNEEKV

SEQ ID NO: 2871684 - protein, 22 aa, Entamoeba invadens
KIKEKEKHDAKKPEKFEQTPYE

SEQ ID NO: 2871685 - protein, 10 aa, Entamoeba invadens
KIKESNARPI

SEQ ID NO: 2871686 - protein, 8 aa, Entamoeba invadens
KIKGDPEQ

SEQ ID NO: 2871687 - protein, 6 aa, Entamoeba invadens
KIKGDV

SEQ ID NO: 2871688 - protein, 6 aa, Entamoeba invadens
KIKGKG

SEQ ID NO: 2871689 - protein, 6 aa, Entamoeba invadens
KIKGKS

SEQ ID NO: 2871690 - protein, 8 aa, Entamoeba invadens
KIKKNSKY

SEQ ID NO: 2871691 - protein, 5 aa, Entamoeba invadens
KIKKQ

SEQ ID NO: 2871692 - protein, 13 aa, Entamoeba invadens
KIKNDAEKHREEK

SEQ ID NO: 2871693 - protein, 10 aa, Entamoeba invadens
KIKNEKTEDN

SEQ ID NO: 2871694 - protein, 10 aa, Entamoeba invadens
KIKNERAKME

SEQ ID NO: 2871695 - protein, 8 aa, Entamoeba invadens
KIKNGAEN

SEQ ID NO: 2871696 - protein, 9 aa, Entamoeba invadens
KIKNSDKKC

SEQ ID NO: 2871697 - protein, 11 aa, Entamoeba invadens
KIKNSGNAAGR

SEQ ID NO: 2871698 - protein, 8 aa, Entamoeba invadens
KIKPTNCE

SEQ ID NO: 2871699 - protein, 7 aa, Entamoeba invadens
KIKPTSI

SEQ ID NO: 2871700 - protein, 17 aa, Entamoeba invadens
KIKQTEDEIATLRARLD

SEQ ID NO: 2871701 - protein, 17 aa, Entamoeba invadens
KIKQTKRIGQKLSRQEV

SEQ ID NO: 2871702 - protein, 12 aa, Entamoeba invadens
KIKRENDTSKTI

SEQ ID NO: 2871703 - protein, 15 aa, Entamoeba invadens
KIKRSAKRKMTDKDY

SEQ ID NO: 2871704 - protein, 7 aa, Entamoeba invadens
KIKSQTS

SEQ ID NO: 2871705 - protein, 7 aa, Entamoeba invadens
KIKSSFG

SEQ ID NO: 2871706 - protein, 5 aa, Entamoeba invadens
KIKTD

SEQ ID NO: 2871707 - protein, 7 aa, Entamoeba invadens
KIKTKNS

SEQ ID NO: 2871708 - protein, 6 aa, Entamoeba invadens
KIKTPL

SEQ ID NO: 2871709 - protein, 8 aa, Entamoeba invadens
KIKTPRKI

SEQ ID NO: 2871710 - protein, 24 aa, Entamoeba invadens
KILQPENRGEDTINKAEDIPDDID

SEQ ID NO: 2871711 - protein, 32 aa, Entamoeba invadens
KIMTSKRSQTYESSAGNLSPRLGKQSASMRRS

SEQ ID NO: 2871712 - protein, 16 aa, Entamoeba invadens
KINANSESAKIPEESA

SEQ ID NO: 2871713 - protein, 6 aa, Entamoeba invadens
KINAPD

SEQ ID NO: 2871714 - protein, 7 aa, Entamoeba invadens
KINDRAK

SEQ ID NO: 2871715 - protein, 8 aa, Entamoeba invadens
KINEDTKK

SEQ ID NO: 2871716 - protein, 20 aa, Entamoeba invadens
KINEKTKGTRKRRSKKTGCP

SEQ ID NO: 2871717 - protein, 8 aa, Entamoeba invadens
KINENAKN

SEQ ID NO: 2871718 - protein, 8 aa, Entamoeba invadens
KINENENL

SEQ ID NO: 2871719 - protein, 7 aa, Entamoeba invadens
KINEREK

SEQ ID NO: 2871720 - protein, 7 aa, Entamoeba invadens
KINESSF

SEQ ID NO: 2871721 - protein, 6 aa, Entamoeba invadens
KINGDE

SEQ ID NO: 2871722 - protein, 22 aa, Entamoeba invadens
KINGENLRDDVAEQINTELRES

SEQ ID NO: 2871723 - protein, 11 aa, Entamoeba invadens
KINGEYAGERR

SEQ ID NO: 2871724 - protein, 6 aa, Entamoeba invadens
KINGTF

SEQ ID NO: 2871725 - protein, 6 aa, Entamoeba invadens
KINKIS

SEQ ID NO: 2871726 - protein, 6 aa, Entamoeba invadens
KINNKT

SEQ ID NO: 2871727 - protein, 4 aa, Entamoeba invadens
KINP

SEQ ID NO: 2871728 - protein, 10 aa, Entamoeba invadens
KINPPSDQIG

SEQ ID NO: 2871729 - protein, 7 aa, Entamoeba invadens
KINQEQV

SEQ ID NO: 2871730 - protein, 18 aa, Entamoeba invadens
KINSETEDLSGNVTSNQD

SEQ ID NO: 2871731 - protein, 7 aa, Entamoeba invadens
KINSGND

SEQ ID NO: 2871732 - protein, 11 aa, Entamoeba invadens
KINSPDSRSCA

SEQ ID NO: 2871733 - protein, 11 aa, Entamoeba invadens
KINSPNKEENV

SEQ ID NO: 2871734 - protein, 6 aa, Entamoeba invadens
KINSTI

SEQ ID NO: 2871735 - protein, 4 aa, Entamoeba invadens
KINT

SEQ ID NO: 2871736 - protein, 16 aa, Entamoeba invadens
KINTGKEPFLFDVGSI

SEQ ID NO: 2871737 - protein, 7 aa, Entamoeba invadens
KINTKED

SEQ ID NO: 2871738 - protein, 12 aa, Entamoeba invadens
KINTSDKSRKRT

SEQ ID NO: 2871739 - protein, 7 aa, Entamoeba invadens
KINTTNI

SEQ ID NO: 2871740 - protein, 12 aa, Entamoeba invadens
KINTTQKSQQNE

SEQ ID NO: 2871741 - protein, 7 aa, Entamoeba invadens
KINVTEK

SEQ ID NO: 2871742 - protein, 7 aa, Entamoeba invadens
KIPDDDY

SEQ ID NO: 2871743 - protein, 14 aa, Entamoeba invadens
KIPDENPPQPAANM

SEQ ID NO: 2871744 - protein, 7 aa, Entamoeba invadens
KIPDGDL

SEQ ID NO: 2871745 - protein, 13 aa, Entamoeba invadens
KIPDGVKQVEDSA

SEQ ID NO: 2871746 - protein, 15 aa, Entamoeba invadens
KIPDINSKRRLSTIK

SEQ ID NO: 2871747 - protein, 5 aa, Entamoeba invadens
KIPED

SEQ ID NO: 2871748 - protein, 5 aa, Entamoeba invadens
KIPEN

SEQ ID NO: 2871749 - protein, 12 aa, Entamoeba invadens
KIPGGDFSESEV

SEQ ID NO: 2871750 - protein, 9 aa, Entamoeba invadens
KIPGGTDDE

SEQ ID NO: 2871751 - protein, 7 aa, Entamoeba invadens
KIPIKNP

SEQ ID NO: 2871752 - protein, 5 aa, Entamoeba invadens
KIPKA

SEQ ID NO: 2871753 - protein, 13 aa, Entamoeba invadens
KIPKAAGSPSTLS

SEQ ID NO: 2871754 - protein, 10 aa, Entamoeba invadens
KIPKAGKSYK

SEQ ID NO: 2871755 - protein, 5 aa, Entamoeba invadens
KIPKD

SEQ ID NO: 2871756 - protein, 14 aa, Entamoeba invadens
KIPKEKEATEAVKN

SEQ ID NO: 2871757 - protein, 49 aa, Entamoeba invadens
KIPKEKNKKKEISTTDEKTDSDTSKGNESENAKPTQQNTDTTNKAQTAD

SEQ ID NO: 2871758 - protein, 9 aa, Entamoeba invadens
KIPKGTPRH

SEQ ID NO: 2871759 - protein, 6 aa, Entamoeba invadens
KIPKKN

SEQ ID NO: 2871760 - protein, 10 aa, Entamoeba invadens
KIPLQDTTYP

SEQ ID NO: 2871761 - protein, 5 aa, Entamoeba invadens
KIPNC

SEQ ID NO: 2871762 - protein, 8 aa, Entamoeba invadens
KIPNGVKS

SEQ ID NO: 2871763 - protein, 9 aa, Entamoeba invadens
KIPNNISSL

SEQ ID NO: 2871764 - protein, 8 aa, Entamoeba invadens
KIPNSVTS

SEQ ID NO: 2871765 - protein, 4 aa, Entamoeba invadens
KIPP

SEQ ID NO: 2871766 - protein, 8 aa, Entamoeba invadens
KIPPGDSV

SEQ ID NO: 2871767 - protein, 9 aa, Entamoeba invadens
KIPPKSDNI

SEQ ID NO: 2871768 - protein, 5 aa, Entamoeba invadens
KIPPN

SEQ ID NO: 2871769 - protein, 7 aa, Entamoeba invadens
KIPPNPF

SEQ ID NO: 2871770 - protein, 8 aa, Entamoeba invadens
KIPPNVTT

SEQ ID NO: 2871771 - protein, 33 aa, Entamoeba invadens
KIPPQKRKPSDKVPEESKTKRKTTESTFEEDKE

SEQ ID NO: 2871772 - protein, 8 aa, Entamoeba invadens
KIPPQPTD

SEQ ID NO: 2871773 - protein, 8 aa, Entamoeba invadens
KIPPQYPT

SEQ ID NO: 2871774 - protein, 10 aa, Entamoeba invadens
KIPPRSGQEE

SEQ ID NO: 2871775 - protein, 7 aa, Entamoeba invadens
KIPPSSI

SEQ ID NO: 2871776 - protein, 5 aa, Entamoeba invadens
KIPPT

SEQ ID NO: 2871777 - protein, 18 aa, Entamoeba invadens
KIPPTLQPRLSASSPHVI

SEQ ID NO: 2871778 - protein, 7 aa, Entamoeba invadens
KIPPVRA

SEQ ID NO: 2871779 - protein, 10 aa, Entamoeba invadens
KIPQAKKEIQ

SEQ ID NO: 2871780 - protein, 6 aa, Entamoeba invadens
KIPQNR

SEQ ID NO: 2871781 - protein, 15 aa, Entamoeba invadens
KIPQQDKMKKDIDED

SEQ ID NO: 2871782 - protein, 13 aa, Entamoeba invadens
KIPRPFDSKECSK

SEQ ID NO: 2871783 - protein, 4 aa, Entamoeba invadens
KIPS

SEQ ID NO: 2871784 - protein, 5 aa, Entamoeba invadens
KIPSS

SEQ ID NO: 2871785 - protein, 7 aa, Entamoeba invadens
KIPSSVR

SEQ ID NO: 2871786 - protein, 9 aa, Entamoeba invadens
KIPSSVSSI

SEQ ID NO: 2871787 - protein, 7 aa, Entamoeba invadens
KIPSSVT

SEQ ID NO: 2871788 - protein, 6 aa, Entamoeba invadens
KIPTDG

SEQ ID NO: 2871789 - protein, 5 aa, Entamoeba invadens
KIPTM

SEQ ID NO: 2871790 - protein, 7 aa, Entamoeba invadens
KIPTSTH

SEQ ID NO: 2871791 - protein, 4 aa, Entamoeba invadens
KIPV

SEQ ID NO: 2871792 - protein, 5 aa, Entamoeba invadens
KIPYK

SEQ ID NO: 2871793 - protein, 12 aa, Entamoeba invadens
KIQEETQRELQE

SEQ ID NO: 2871794 - protein, 8 aa, Entamoeba invadens
KIQETDEF

SEQ ID NO: 2871795 - protein, 10 aa, Entamoeba invadens
KIQGKSEKGV

SEQ ID NO: 2871796 - protein, 6 aa, Entamoeba invadens
KIQGRT

SEQ ID NO: 2871797 - protein, 22 aa, Entamoeba invadens
KIQKRSPGIENDPIRRNEYNSL

SEQ ID NO: 2871798 - protein, 6 aa, Entamoeba invadens
KIQKTE

SEQ ID NO: 2871799 - protein, 4 aa, Entamoeba invadens
KIQM

SEQ ID NO: 2871800 - protein, 8 aa, Entamoeba invadens
KIQNPEEF

SEQ ID NO: 2871801 - protein, 8 aa, Entamoeba invadens
KIQNPEKF

SEQ ID NO: 2871802 - protein, 12 aa, Entamoeba invadens
KIQNVQKTLEDS

SEQ ID NO: 2871803 - protein, 41 aa, Entamoeba invadens
KIQSGLENNDQEKVKEGSSKLQKDMDKLKKEKEKDGQNVDQ

SEQ ID NO: 2871804 - protein, 23 aa, Entamoeba invadens
KIQTDKQNTTEDKASSPKSPPIE

SEQ ID NO: 2871805 - protein, 4 aa, Entamoeba invadens
KIQY

SEQ ID NO: 2871806 - protein, 21 aa, Entamoeba invadens
KIRDKTSDTQKKAKNEKTERI

SEQ ID NO: 2871807 - protein, 37 aa, Entamoeba invadens
KIRENPAAAKHDAKKEYKKRPQNKKLTLEQRKANIQA

SEQ ID NO: 2871808 - protein, 9 aa, Entamoeba invadens
KIRENSEKY

SEQ ID NO: 2871809 - protein, 6 aa, Entamoeba invadens
KIRESL

SEQ ID NO: 2871810 - protein, 6 aa, Entamoeba invadens
KIRKGK

SEQ ID NO: 2871811 - protein, 11 aa, Entamoeba invadens
KIRKSTPPDMV

SEQ ID NO: 2871812 - protein, 7 aa, Entamoeba invadens
KIRQVDP

SEQ ID NO: 2871813 - protein, 26 aa, Entamoeba invadens
KIRTNESGDKIVSEDEDIENEYNEKS

SEQ ID NO: 2871814 - protein, 12 aa, Entamoeba invadens
KIRTQSDIEDER

SEQ ID NO: 2871815 - protein, 9 aa, Entamoeba invadens
KISADEADE

SEQ ID NO: 2871816 - protein, 5 aa, Entamoeba invadens
KISCE

SEQ ID NO: 2871817 - protein, 14 aa, Entamoeba invadens
KISDFEKTSKNSLE

SEQ ID NO: 2871818 - protein, 5 aa, Entamoeba invadens
KISDN

SEQ ID NO: 2871819 - protein, 9 aa, Entamoeba invadens
KISDSQSYK

SEQ ID NO: 2871820 - protein, 10 aa, Entamoeba invadens
KISEDTEGQI

SEQ ID NO: 2871821 - protein, 9 aa, Entamoeba invadens
KISEEKEAA

SEQ ID NO: 2871822 - protein, 11 aa, Entamoeba invadens
KISEGEANKDD

SEQ ID NO: 2871823 - protein, 11 aa, Entamoeba invadens
KISEGIDSFNR

SEQ ID NO: 2871824 - protein, 16 aa, Entamoeba invadens
KISEKAKVELSRNSEV

SEQ ID NO: 2871825 - protein, 10 aa, Entamoeba invadens
KISESEDLED

SEQ ID NO: 2871826 - protein, 7 aa, Entamoeba invadens
KISGDSA

SEQ ID NO: 2871827 - protein, 21 aa, Entamoeba invadens
KISGGFGNLDGKPICKECNAK

SEQ ID NO: 2871828 - protein, 12 aa, Entamoeba invadens
KISGSVAKQPFY

SEQ ID NO: 2871829 - protein, 8 aa, Entamoeba invadens
KISKEEKA

SEQ ID NO: 2871830 - protein, 6 aa, Entamoeba invadens
KISKKI

SEQ ID NO: 2871831 - protein, 12 aa, Entamoeba invadens
KISKNKKAKYEK

SEQ ID NO: 2871832 - protein, 9 aa, Entamoeba invadens
KISKNTQRI

SEQ ID NO: 2871833 - protein, 15 aa, Entamoeba invadens
KISKSKKPLEPESST

SEQ ID NO: 2871834 - protein, 4 aa, Entamoeba invadens
KISN

SEQ ID NO: 2871835 - protein, 12 aa, Entamoeba invadens
KISNKNKFPEDK

SEQ ID NO: 2871836 - protein, 10 aa, Entamoeba invadens
KISNSTYDGF

SEQ ID NO: 2871837 - protein, 5 aa, Entamoeba invadens
KISPN

SEQ ID NO: 2871838 - protein, 9 aa, Entamoeba invadens
KISPNEDDA

SEQ ID NO: 2871839 - protein, 7 aa, Entamoeba invadens
KISPNEV

SEQ ID NO: 2871840 - protein, 7 aa, Entamoeba invadens
KISPQAI

SEQ ID NO: 2871841 - protein, 9 aa, Entamoeba invadens
KISPSGRSI

SEQ ID NO: 2871842 - protein, 8 aa, Entamoeba invadens
KISPTNDL

SEQ ID NO: 2871843 - protein, 6 aa, Entamoeba invadens
KISPVE

SEQ ID NO: 2871844 - protein, 10 aa, Entamoeba invadens
KISQEKAYLS

SEQ ID NO: 2871845 - protein, 10 aa, Entamoeba invadens
KISQEKESKE

SEQ ID NO: 2871846 - protein, 5 aa, Entamoeba invadens
KISRA

SEQ ID NO: 2871847 - protein, 8 aa, Entamoeba invadens
KISRNSTM

SEQ ID NO: 2871848 - protein, 28 aa, Entamoeba invadens
KISSNSEEKDRNKKGEISMGNNTIARET

SEQ ID NO: 2871849 - protein, 9 aa, Entamoeba invadens
KISSNSKFL

SEQ ID NO: 2871850 - protein, 12 aa, Entamoeba invadens
KISSSDTTHVEQ

SEQ ID NO: 2871851 - protein, 6 aa, Entamoeba invadens
KISTVT

SEQ ID NO: 2871852 - protein, 4 aa, Entamoeba invadens
KITA

SEQ ID NO: 2871853 - protein, 4 aa, Entamoeba invadens
KITD

SEQ ID NO: 2871854 - protein, 17 aa, Entamoeba invadens
KITDDDGVQRPALPEGD

SEQ ID NO: 2871855 - protein, 6 aa, Entamoeba invadens
KITDGD

SEQ ID NO: 2871856 - protein, 8 aa, Entamoeba invadens
KITDGSGD

SEQ ID NO: 2871857 - protein, 5 aa, Entamoeba invadens
KITDK

SEQ ID NO: 2871858 - protein, 7 aa, Entamoeba invadens
KITDKNK

SEQ ID NO: 2871859 - protein, 6 aa, Entamoeba invadens
KITDNM

SEQ ID NO: 2871860 - protein, 4 aa, Entamoeba invadens
KITE

SEQ ID NO: 2871861 - protein, 13 aa, Entamoeba invadens
KITEDNNNTNPFN

SEQ ID NO: 2871862 - protein, 28 aa, Entamoeba invadens
KITEEEKKDETREDSKETITEGTSATLE

SEQ ID NO: 2871863 - protein, 8 aa, Entamoeba invadens
KITENNRN

SEQ ID NO: 2871864 - protein, 4 aa, Entamoeba invadens
KITG

SEQ ID NO: 2871865 - protein, 9 aa, Entamoeba invadens
KITGNDNEF

SEQ ID NO: 2871866 - protein, 7 aa, Entamoeba invadens
KITGNNI

SEQ ID NO: 2871867 - protein, 11 aa, Entamoeba invadens
KITGRSDSLGK

SEQ ID NO: 2871868 - protein, 19 aa, Entamoeba invadens
KITKENSDPLTGTINADAE

SEQ ID NO: 2871869 - protein, 10 aa, Entamoeba invadens
KITKPKNEPE

SEQ ID NO: 2871870 - protein, 9 aa, Entamoeba invadens
KITKSTEQI

SEQ ID NO: 2871871 - protein, 6 aa, Entamoeba invadens
KITNAE

SEQ ID NO: 2871872 - protein, 9 aa, Entamoeba invadens
KITNDDADY

SEQ ID NO: 2871873 - protein, 37 aa, Entamoeba invadens
KITNEEKKTIQQEFNTSKEHIDELTKENDEQKEENLK

SEQ ID NO: 2871874 - protein, 13 aa, Entamoeba invadens
KITNKGGSICSKG

SEQ ID NO: 2871875 - protein, 7 aa, Entamoeba invadens
KITPDKT

SEQ ID NO: 2871876 - protein, 6 aa, Entamoeba invadens
KITPKQ

SEQ ID NO: 2871877 - protein, 5 aa, Entamoeba invadens
KITPR

SEQ ID NO: 2871878 - protein, 4 aa, Entamoeba invadens
KITQ

SEQ ID NO: 2871879 - protein, 7 aa, Entamoeba invadens
KITREDA

SEQ ID NO: 2871880 - protein, 5 aa, Entamoeba invadens
KITRI

SEQ ID NO: 2871881 - protein, 8 aa, Entamoeba invadens
KITSATGD

SEQ ID NO: 2871882 - protein, 7 aa, Entamoeba invadens
KITSENS

SEQ ID NO: 2871883 - protein, 5 aa, Entamoeba invadens
KITSF

SEQ ID NO: 2871884 - protein, 9 aa, Entamoeba invadens
KITSGVETA

SEQ ID NO: 2871885 - protein, 7 aa, Entamoeba invadens
KITSNGK

SEQ ID NO: 2871886 - protein, 7 aa, Entamoeba invadens
KITSPSD

SEQ ID NO: 2871887 - protein, 10 aa, Entamoeba invadens
KITTEGKAGC

SEQ ID NO: 2871888 - protein, 17 aa, Entamoeba invadens
KITTKETGEKSKTGSSL

SEQ ID NO: 2871889 - protein, 17 aa, Entamoeba invadens
KITTQTNKLSRQSSLTN

SEQ ID NO: 2871890 - protein, 4 aa, Entamoeba invadens
KITV

SEQ ID NO: 2871891 - protein, 9 aa, Entamoeba invadens
KIVATTENL

SEQ ID NO: 2871892 - protein, 7 aa, Entamoeba invadens
KKAAAAA

SEQ ID NO: 2871893 - protein, 5 aa, Entamoeba invadens
KKAAD

SEQ ID NO: 2871894 - protein, 7 aa, Entamoeba invadens
KKAAEKK

SEQ ID NO: 2871895 - protein, 7 aa, Entamoeba invadens
KKAAENF

SEQ ID NO: 2871896 - protein, 4 aa, Entamoeba invadens
KKAD

SEQ ID NO: 2871897 - protein, 7 aa, Entamoeba invadens
KKADEWI

SEQ ID NO: 2871898 - protein, 19 aa, Entamoeba invadens
KKADLDELEKEPKNPRKMN

SEQ ID NO: 2871899 - protein, 8 aa, Entamoeba invadens
KKAEATPQ

SEQ ID NO: 2871900 - protein, 6 aa, Entamoeba invadens
KKAECD

SEQ ID NO: 2871901 - protein, 51 aa, Entamoeba invadens
KKAEDEKQRIANEESERKKKLEEEKERKELEEKQKRELEEFEKKQKADMKA

SEQ ID NO: 2871902 - protein, 10 aa, Entamoeba invadens
KKAEDLYTSS

SEQ ID NO: 2871903 - protein, 8 aa, Entamoeba invadens
KKAEEDVK

SEQ ID NO: 2871904 - protein, 7 aa, Entamoeba invadens
KKAEEEK

SEQ ID NO: 2871905 - protein, 41 aa, Entamoeba invadens
KKAEEENKEQTPGIEETKKIDVEDKAPELPPKRKSSSTNRP

SEQ ID NO: 2871906 - protein, 6 aa, Entamoeba invadens
KKAEKA

SEQ ID NO: 2871907 - protein, 7 aa, Entamoeba invadens
KKAEKEF

SEQ ID NO: 2871908 - protein, 8 aa, Entamoeba invadens
KKAEKELG

SEQ ID NO: 2871909 - protein, 21 aa, Entamoeba invadens
KKAEKEMKEVEKRNAEEKERI

SEQ ID NO: 2871910 - protein, 8 aa, Entamoeba invadens
KKAEKGTI

SEQ ID NO: 2871911 - protein, 22 aa, Entamoeba invadens
KKAEKIEKKEEKEDAKQIRPPK

SEQ ID NO: 2871912 - protein, 9 aa, Entamoeba invadens
KKAELTRKG

SEQ ID NO: 2871913 - protein, 10 aa, Entamoeba invadens
KKAENEDGGT

SEQ ID NO: 2871914 - protein, 19 aa, Entamoeba invadens
KKAENEKDGLKKKELQNEI

SEQ ID NO: 2871915 - protein, 14 aa, Entamoeba invadens
KKAEVERSKSVKEK

SEQ ID NO: 2871916 - protein, 7 aa, Entamoeba invadens
KKAFDEN

SEQ ID NO: 2871917 - protein, 6 aa, Entamoeba invadens
KKAFNT

SEQ ID NO: 2871918 - protein, 68 aa, Entamoeba invadens
KKAGAAAPSEGTPIHTQKQDQPTASPFGGFNPAAAKLKKTTKKVVEPKKEEKKEDDVPEFMRMKLKKK

SEQ ID NO: 2871919 - protein, 7 aa, Entamoeba invadens
KKAGESA

SEQ ID NO: 2871920 - protein, 7 aa, Entamoeba invadens
KKAGEWP

SEQ ID NO: 2871921 - protein, 6 aa, Entamoeba invadens
KKAGHG

SEQ ID NO: 2871922 - protein, 26 aa, Entamoeba invadens
KKAGIERNERQSQPSVENQNSVGQEK

SEQ ID NO: 2871923 - protein, 6 aa, Entamoeba invadens
KKAGLE

SEQ ID NO: 2871924 - protein, 9 aa, Entamoeba invadens
KKAGNATPE

SEQ ID NO: 2871925 - protein, 4 aa, Entamoeba invadens
KKAK

SEQ ID NO: 2871926 - protein, 6 aa, Entamoeba invadens
KKAKGF

SEQ ID NO: 2871927 - protein, 8 aa, Entamoeba invadens
KKAKKAGF

SEQ ID NO: 2871928 - protein, 27 aa, Entamoeba invadens
KKAKKDPKDKEARQKAEEKLDKYTESL

SEQ ID NO: 2871929 - protein, 10 aa, Entamoeba invadens
KKAKKRVKKS

SEQ ID NO: 2871930 - protein, 12 aa, Entamoeba invadens
KKAKKRWETDDD

SEQ ID NO: 2871931 - protein, 5 aa, Entamoeba invadens
KKAKL

SEQ ID NO: 2871932 - protein, 5 aa, Entamoeba invadens
KKAKR

SEQ ID NO: 2871933 - protein, 13 aa, Entamoeba invadens
KKAKTEALRGRRR

SEQ ID NO: 2871934 - protein, 39 aa, Entamoeba invadens
KKAKVEKMEEESESQKQPKVTPIDDENKEDDDEDNGGFV

SEQ ID NO: 2871935 - protein, 16 aa, Entamoeba invadens
KKALEGDQLTTEEKDM

SEQ ID NO: 2871936 - protein, 8 aa, Entamoeba invadens
KKALEHKK

SEQ ID NO: 2871937 - protein, 9 aa, Entamoeba invadens
KKANCKEKN

SEQ ID NO: 2871938 - protein, 13 aa, Entamoeba invadens
KKANELETDSDDL

SEQ ID NO: 2871939 - protein, 5 aa, Entamoeba invadens
KKANF

SEQ ID NO: 2871940 - protein, 9 aa, Entamoeba invadens
KKANHSRPN

SEQ ID NO: 2871941 - protein, 25 aa, Entamoeba invadens
KKANKEQKKLEKKLKKDKKKHDEPL

SEQ ID NO: 2871942 - protein, 8 aa, Entamoeba invadens
KKANKKPQ

SEQ ID NO: 2871943 - protein, 7 aa, Entamoeba invadens
KKANLNE

SEQ ID NO: 2871944 - protein, 5 aa, Entamoeba invadens
KKANM

SEQ ID NO: 2871945 - protein, 13 aa, Entamoeba invadens
KKANQSGNSSETF

SEQ ID NO: 2871946 - protein, 7 aa, Entamoeba invadens
KKANTIE

SEQ ID NO: 2871947 - protein, 9 aa, Entamoeba invadens
KKAPEDGLT

SEQ ID NO: 2871948 - protein, 17 aa, Entamoeba invadens
KKAPGIPDALKEIIGMS

SEQ ID NO: 2871949 - protein, 5 aa, Entamoeba invadens
KKAPI

SEQ ID NO: 2871950 - protein, 7 aa, Entamoeba invadens
KKAQAKL

SEQ ID NO: 2871951 - protein, 6 aa, Entamoeba invadens
KKAQDA

SEQ ID NO: 2871952 - protein, 5 aa, Entamoeba invadens
KKAQQ

SEQ ID NO: 2871953 - protein, 8 aa, Entamoeba invadens
KKAQQEKQ

SEQ ID NO: 2871954 - protein, 8 aa, Entamoeba invadens
KKARDQYK

SEQ ID NO: 2871955 - protein, 10 aa, Entamoeba invadens
KKARKENGPV

SEQ ID NO: 2871956 - protein, 7 aa, Entamoeba invadens
KKARTDC

SEQ ID NO: 2871957 - protein, 19 aa, Entamoeba invadens
KKARTTKKKTTKRTRQPKS

SEQ ID NO: 2871958 - protein, 48 aa, Entamoeba invadens
KKASANWEEHHGEEPKKVEKKEELKVEPKKEEPKVEKKEEQKVEPKVE

SEQ ID NO: 2871959 - protein, 6 aa, Entamoeba invadens
KKASDV

SEQ ID NO: 2871960 - protein, 9 aa, Entamoeba invadens
KKASEIETK

SEQ ID NO: 2871961 - protein, 20 aa, Entamoeba invadens
KKASGDANEWSSYDTTETHN

SEQ ID NO: 2871962 - protein, 6 aa, Entamoeba invadens
KKASGL

SEQ ID NO: 2871963 - protein, 8 aa, Entamoeba invadens
KKASTNKL

SEQ ID NO: 2871964 - protein, 20 aa, Entamoeba invadens
KKATEEDDKGHNKEAVENYK

SEQ ID NO: 2871965 - protein, 17 aa, Entamoeba invadens
KKATGSSEVLEEILKMV

SEQ ID NO: 2871966 - protein, 7 aa, Entamoeba invadens
KKATIGV

SEQ ID NO: 2871967 - protein, 11 aa, Entamoeba invadens
KKATKDLAPNT

SEQ ID NO: 2871968 - protein, 13 aa, Entamoeba invadens
KKATKKVTETKEK

SEQ ID NO: 2871969 - protein, 7 aa, Entamoeba invadens
KKATKLA

SEQ ID NO: 2871970 - protein, 10 aa, Entamoeba invadens
KKATKSAKEY

SEQ ID NO: 2871971 - protein, 11 aa, Entamoeba invadens
KKATSTTNRDR

SEQ ID NO: 2871972 - protein, 13 aa, Entamoeba invadens
KKATTFKEARDKV

SEQ ID NO: 2871973 - protein, 8 aa, Entamoeba invadens
KKAVANDS

SEQ ID NO: 2871974 - protein, 9 aa, Entamoeba invadens
KKAVEEAKV

SEQ ID NO: 2871975 - protein, 10 aa, Entamoeba invadens
KKAVESPKKL

SEQ ID NO: 2871976 - protein, 5 aa, Entamoeba invadens
KKAVG

SEQ ID NO: 2871977 - protein, 14 aa, Entamoeba invadens
KKAVPAEKKPEFKK

SEQ ID NO: 2871978 - protein, 8 aa, Entamoeba invadens
KKAWKSNT

SEQ ID NO: 2871979 - protein, 4 aa, Entamoeba invadens
KKAY

SEQ ID NO: 2871980 - protein, 5 aa, Entamoeba invadens
KKAYK

SEQ ID NO: 2871981 - protein, 11 aa, Entamoeba invadens
KKCASDEKIAE

SEQ ID NO: 2871982 - protein, 9 aa, Entamoeba invadens
KKCDTKEVE

SEQ ID NO: 2871983 - protein, 4 aa, Entamoeba invadens
KKCE

SEQ ID NO: 2871984 - protein, 5 aa, Entamoeba invadens
KKCEE

SEQ ID NO: 2871985 - protein, 6 aa, Entamoeba invadens
KKCEGH

SEQ ID NO: 2871986 - protein, 11 aa, Entamoeba invadens
KKCESDEKIAE

SEQ ID NO: 2871987 - protein, 5 aa, Entamoeba invadens
KKCGN

SEQ ID NO: 2871988 - protein, 7 aa, Entamoeba invadens
KKCKENL

SEQ ID NO: 2871989 - protein, 28 aa, Entamoeba invadens
KKCKSETGSFISSRKASEVLETSEQPQL

SEQ ID NO: 2871990 - protein, 5 aa, Entamoeba invadens
KKCND

SEQ ID NO: 2871991 - protein, 9 aa, Entamoeba invadens
KKCSNACPT

SEQ ID NO: 2871992 - protein, 7 aa, Entamoeba invadens
KKCSNDC

SEQ ID NO: 2871993 - protein, 10 aa, Entamoeba invadens
KKCSNDCPTG

SEQ ID NO: 2871994 - protein, 40 aa, Entamoeba invadens
KKCSPKTSKKSKQDKYKNKEVTKKVTKKKHQSDFNGEENL

SEQ ID NO: 2871995 - protein, 9 aa, Entamoeba invadens
KKCSQEDAH

SEQ ID NO: 2871996 - protein, 7 aa, Entamoeba invadens
KKCSRKE

SEQ ID NO: 2871997 - protein, 17 aa, Entamoeba invadens
KKCTVTGQGIERPNDQV

SEQ ID NO: 2871998 - protein, 4 aa, Entamoeba invadens
KKCV

SEQ ID NO: 2871999 - protein, 31 aa, Entamoeba invadens
KKCVEKPKSPTSPSVQAQNNTNSNSDEKIDA

SEQ ID NO: 2872000 - protein, 7 aa, Entamoeba invadens
KKCVGQP

SEQ ID NO: 2872001 - protein, 5 aa, Entamoeba invadens
KKDAA

SEQ ID NO: 2872002 - protein, 5 aa, Entamoeba invadens
KKDAI

SEQ ID NO: 2872003 - protein, 16 aa, Entamoeba invadens
KKDAIEEKMKEKDKLA

SEQ ID NO: 2872004 - protein, 8 aa, Entamoeba invadens
KKDAVDET

SEQ ID NO: 2872005 - protein, 18 aa, Entamoeba invadens
KKDAVNGKLTDFGASRNI

SEQ ID NO: 2872006 - protein, 7 aa, Entamoeba invadens
KKDDAGR

SEQ ID NO: 2872007 - protein, 18 aa, Entamoeba invadens
KKDDEANDLVKDDDTFKN

SEQ ID NO: 2872008 - protein, 7 aa, Entamoeba invadens
KKDDGEF

SEQ ID NO: 2872009 - protein, 16 aa, Entamoeba invadens
KKDDGPKAIPVEQQKS

SEQ ID NO: 2872010 - protein, 6 aa, Entamoeba invadens
KKDDKE

SEQ ID NO: 2872011 - protein, 15 aa, Entamoeba invadens
KKDDKEQQPTSHNDI

SEQ ID NO: 2872012 - protein, 7 aa, Entamoeba invadens
KKDDKKY

SEQ ID NO: 2872013 - protein, 9 aa, Entamoeba invadens
KKDDSDTFR

SEQ ID NO: 2872014 - protein, 10 aa, Entamoeba invadens
KKDDSSRKEA

SEQ ID NO: 2872015 - protein, 19 aa, Entamoeba invadens
KKDDSSSTQDDVEKRKKKQ

SEQ ID NO: 2872016 - protein, 5 aa, Entamoeba invadens
KKDDV

SEQ ID NO: 2872017 - protein, 8 aa, Entamoeba invadens
KKDEDKSW

SEQ ID NO: 2872018 - protein, 13 aa, Entamoeba invadens
KKDEEKNSENRKI

SEQ ID NO: 2872019 - protein, 8 aa, Entamoeba invadens
KKDEELQK

SEQ ID NO: 2872020 - protein, 10 aa, Entamoeba invadens
KKDEERKTEL

SEQ ID NO: 2872021 - protein, 89 aa, Entamoeba invadens
KKDEKAEAEQTKKQEKKDKKDKKKADKKNKKNEDSKKIKANKEEEENEKQSKKEAKKLKKAQKKEEKKSKKDKKSKKDKKKDKKKDKKK

SEQ ID NO: 2872022 - protein, 38 aa, Entamoeba invadens
KKDEKEEEKENRKSKVRLGKREEKKLKEEEKRKSEMIE

SEQ ID NO: 2872023 - protein, 10 aa, Entamoeba invadens
KKDEKEQLKE

SEQ ID NO: 2872024 - protein, 10 aa, Entamoeba invadens
KKDEKHVPKG

SEQ ID NO: 2872025 - protein, 8 aa, Entamoeba invadens
KKDEKNEI

SEQ ID NO: 2872026 - protein, 7 aa, Entamoeba invadens
KKDEPAL

SEQ ID NO: 2872027 - protein, 8 aa, Entamoeba invadens
KKDEPSDI

SEQ ID NO: 2872028 - protein, 16 aa, Entamoeba invadens
KKDEQKENKSEGNTMN

SEQ ID NO: 2872029 - protein, 10 aa, Entamoeba invadens
KKDEQLNEDI

SEQ ID NO: 2872030 - protein, 7 aa, Entamoeba invadens
KKDESFG

SEQ ID NO: 2872031 - protein, 11 aa, Entamoeba invadens
KKDETAKGIPV

SEQ ID NO: 2872032 - protein, 45 aa, Entamoeba invadens
KKDEVETKPKKDNKKPVTKEEKDTKKTPRKSTKTSKPQETEEEFK

SEQ ID NO: 2872033 - protein, 7 aa, Entamoeba invadens
KKDEYTF

SEQ ID NO: 2872034 - protein, 5 aa, Entamoeba invadens
KKDFR

SEQ ID NO: 2872035 - protein, 33 aa, Entamoeba invadens
KKDGANWDNLTKGKESHHQESALNANRKDWDAI

SEQ ID NO: 2872036 - protein, 7 aa, Entamoeba invadens
KKDGCKN

SEQ ID NO: 2872037 - protein, 9 aa, Entamoeba invadens
KKDGDETNP

SEQ ID NO: 2872038 - protein, 7 aa, Entamoeba invadens
KKDGDIW

SEQ ID NO: 2872039 - protein, 7 aa, Entamoeba invadens
KKDGEDI

SEQ ID NO: 2872040 - protein, 18 aa, Entamoeba invadens
KKDGHSEDIKTSPRSVQI

SEQ ID NO: 2872041 - protein, 5 aa, Entamoeba invadens
KKDGK

SEQ ID NO: 2872042 - protein, 7 aa, Entamoeba invadens
KKDGNPF

SEQ ID NO: 2872043 - protein, 7 aa, Entamoeba invadens
KKDGNTK

SEQ ID NO: 2872044 - protein, 5 aa, Entamoeba invadens
KKDGV

SEQ ID NO: 2872045 - protein, 6 aa, Entamoeba invadens
KKDIGV

SEQ ID NO: 2872046 - protein, 15 aa, Entamoeba invadens
KKDINKMDSKNLSLS

SEQ ID NO: 2872047 - protein, 7 aa, Entamoeba invadens
KKDKEME

SEQ ID NO: 2872048 - protein, 16 aa, Entamoeba invadens
KKDKKPPKPSSFIGKD

SEQ ID NO: 2872049 - protein, 8 aa, Entamoeba invadens
KKDKNKKK

SEQ ID NO: 2872050 - protein, 9 aa, Entamoeba invadens
KKDKQHVTK

SEQ ID NO: 2872051 - protein, 9 aa, Entamoeba invadens
KKDKTGKLE

SEQ ID NO: 2872052 - protein, 9 aa, Entamoeba invadens
KKDKTKKTL

SEQ ID NO: 2872053 - protein, 5 aa, Entamoeba invadens
KKDKV

SEQ ID NO: 2872054 - protein, 9 aa, Entamoeba invadens
KKDKVGAVT

SEQ ID NO: 2872055 - protein, 6 aa, Entamoeba invadens
KKDKVS

SEQ ID NO: 2872056 - protein, 31 aa, Entamoeba invadens
KKDKVTKVKEPKKVKEPKVKKEKIPKPKKEV

SEQ ID NO: 2872057 - protein, 20 aa, Entamoeba invadens
KKDLAANQNVSPHEAEELAR

SEQ ID NO: 2872058 - protein, 6 aa, Entamoeba invadens
KKDLDV

SEQ ID NO: 2872059 - protein, 6 aa, Entamoeba invadens
KKDLKD

SEQ ID NO: 2872060 - protein, 12 aa, Entamoeba invadens
KKDLKKNSTIER

SEQ ID NO: 2872061 - protein, 13 aa, Entamoeba invadens
KKDLRAKPQENQL

SEQ ID NO: 2872062 - protein, 15 aa, Entamoeba invadens
KKDLSHKEVNTDQAL

SEQ ID NO: 2872063 - protein, 5 aa, Entamoeba invadens
KKDLT

SEQ ID NO: 2872064 - protein, 25 aa, Entamoeba invadens
KKDMKKEEERITSGKTTRRPKQFAG

SEQ ID NO: 2872065 - protein, 6 aa, Entamoeba invadens
KKDMNH

SEQ ID NO: 2872066 - protein, 4 aa, Entamoeba invadens
KKDN

SEQ ID NO: 2872067 - protein, 6 aa, Entamoeba invadens
KKDNDS

SEQ ID NO: 2872068 - protein, 11 aa, Entamoeba invadens
KKDNKGDNNVN

SEQ ID NO: 2872069 - protein, 24 aa, Entamoeba invadens
KKDNTSQDHHSQSDKTQEENQQDF

SEQ ID NO: 2872070 - protein, 8 aa, Entamoeba invadens
KKDPASRD

SEQ ID NO: 2872071 - protein, 6 aa, Entamoeba invadens
KKDPKF

SEQ ID NO: 2872072 - protein, 9 aa, Entamoeba invadens
KKDPKRADR

SEQ ID NO: 2872073 - protein, 6 aa, Entamoeba invadens
KKDPMT

SEQ ID NO: 2872074 - protein, 7 aa, Entamoeba invadens
KKDPNLT

SEQ ID NO: 2872075 - protein, 7 aa, Entamoeba invadens
KKDPSRL

SEQ ID NO: 2872076 - protein, 19 aa, Entamoeba invadens
KKDQDSLGDKQFCEELSEL

SEQ ID NO: 2872077 - protein, 9 aa, Entamoeba invadens
KKDQEEGEV

SEQ ID NO: 2872078 - protein, 8 aa, Entamoeba invadens
KKDQRSAT

SEQ ID NO: 2872079 - protein, 7 aa, Entamoeba invadens
KKDRDTW

SEQ ID NO: 2872080 - protein, 13 aa, Entamoeba invadens
KKDRGKPGKITPK

SEQ ID NO: 2872081 - protein, 7 aa, Entamoeba invadens
KKDRGTV

SEQ ID NO: 2872082 - protein, 4 aa, Entamoeba invadens
KKDS

SEQ ID NO: 2872083 - protein, 11 aa, Entamoeba invadens
KKDSIAKARIR

SEQ ID NO: 2872084 - protein, 14 aa, Entamoeba invadens
KKDSKTKEKSFDEQ

SEQ ID NO: 2872085 - protein, 9 aa, Entamoeba invadens
KKDSNGDLK

SEQ ID NO: 2872086 - protein, 11 aa, Entamoeba invadens
KKDSNRKGSFS

SEQ ID NO: 2872087 - protein, 8 aa, Entamoeba invadens
KKDSNTLK

SEQ ID NO: 2872088 - protein, 28 aa, Entamoeba invadens
KKDSSDDEENEEMEKDEKKPRKSDTAKQ

SEQ ID NO: 2872089 - protein, 12 aa, Entamoeba invadens
KKDTEDQTTEMQ

SEQ ID NO: 2872090 - protein, 15 aa, Entamoeba invadens
KKDTFGSKNMKRKRR

SEQ ID NO: 2872091 - protein, 6 aa, Entamoeba invadens
KKDTFT

SEQ ID NO: 2872092 - protein, 7 aa, Entamoeba invadens
KKDTGEI

SEQ ID NO: 2872093 - protein, 6 aa, Entamoeba invadens
KKDTGK

SEQ ID NO: 2872094 - protein, 7 aa, Entamoeba invadens
KKDTGML

SEQ ID NO: 2872095 - protein, 24 aa, Entamoeba invadens
KKDTKKEKKEKKDKKEKKDSSESS

SEQ ID NO: 2872096 - protein, 9 aa, Entamoeba invadens
KKDTNQGKS

SEQ ID NO: 2872097 - protein, 7 aa, Entamoeba invadens
KKDTPLT

SEQ ID NO: 2872098 - protein, 11 aa, Entamoeba invadens
KKDTSSQPPIA

SEQ ID NO: 2872099 - protein, 7 aa, Entamoeba invadens
KKDVAEQ

SEQ ID NO: 2872100 - protein, 21 aa, Entamoeba invadens
KKDVENTLENVEKDKSELERQ

SEQ ID NO: 2872101 - protein, 8 aa, Entamoeba invadens
KKDVESDE

SEQ ID NO: 2872102 - protein, 8 aa, Entamoeba invadens
KKDVGGEW

SEQ ID NO: 2872103 - protein, 7 aa, Entamoeba invadens
KKDVKGK

SEQ ID NO: 2872104 - protein, 16 aa, Entamoeba invadens
KKDVNNRSVTSNECSN

SEQ ID NO: 2872105 - protein, 10 aa, Entamoeba invadens
KKEAEERKMS

SEQ ID NO: 2872106 - protein, 11 aa, Entamoeba invadens
KKEAISQSDIK

SEQ ID NO: 2872107 - protein, 7 aa, Entamoeba invadens
KKEANTL

SEQ ID NO: 2872108 - protein, 13 aa, Entamoeba invadens
KKEAVKKAREIGL

SEQ ID NO: 2872109 - protein, 10 aa, Entamoeba invadens
KKEAVTEEEV

SEQ ID NO: 2872110 - protein, 5 aa, Entamoeba invadens
KKECE

SEQ ID NO: 2872111 - protein, 7 aa, Entamoeba invadens
KKECEER

SEQ ID NO: 2872112 - protein, 5 aa, Entamoeba invadens
KKECG

SEQ ID NO: 2872113 - protein, 6 aa, Entamoeba invadens
KKECGG

SEQ ID NO: 2872114 - protein, 4 aa, Entamoeba invadens
KKED

SEQ ID NO: 2872115 - protein, 9 aa, Entamoeba invadens
KKEDADACE

SEQ ID NO: 2872116 - protein, 19 aa, Entamoeba invadens
KKEDEDLSMSSNSNQVSSV

SEQ ID NO: 2872117 - protein, 7 aa, Entamoeba invadens
KKEDEMN

SEQ ID NO: 2872118 - protein, 10 aa, Entamoeba invadens
KKEDGEAQGN

SEQ ID NO: 2872119 - protein, 12 aa, Entamoeba invadens
KKEDKKSLARSV

SEQ ID NO: 2872120 - protein, 7 aa, Entamoeba invadens
KKEDKPL

SEQ ID NO: 2872121 - protein, 9 aa, Entamoeba invadens
KKEDKTTVV

SEQ ID NO: 2872122 - protein, 8 aa, Entamoeba invadens
KKEDLDET

SEQ ID NO: 2872123 - protein, 6 aa, Entamoeba invadens
KKEDLE

SEQ ID NO: 2872124 - protein, 25 aa, Entamoeba invadens
KKEDLTTDGMSEKQQKRSVEAEMSN

SEQ ID NO: 2872125 - protein, 8 aa, Entamoeba invadens
KKEDMGSW

SEQ ID NO: 2872126 - protein, 7 aa, Entamoeba invadens
KKEDPVA

SEQ ID NO: 2872127 - protein, 19 aa, Entamoeba invadens
KKEDRESFINGDNSKKQFI

SEQ ID NO: 2872128 - protein, 8 aa, Entamoeba invadens
KKEDRNTI

SEQ ID NO: 2872129 - protein, 14 aa, Entamoeba invadens
KKEDSKESQIPPVK

SEQ ID NO: 2872130 - protein, 6 aa, Entamoeba invadens
KKEDVT

SEQ ID NO: 2872131 - protein, 25 aa, Entamoeba invadens
KKEEALTARRELNGTNPFGSDGQNI

SEQ ID NO: 2872132 - protein, 11 aa, Entamoeba invadens
KKEEANPKTHI

SEQ ID NO: 2872133 - protein, 11 aa, Entamoeba invadens
KKEEDIGAGDQ

SEQ ID NO: 2872134 - protein, 7 aa, Entamoeba invadens
KKEEDTK

SEQ ID NO: 2872135 - protein, 7 aa, Entamoeba invadens
KKEEEAK

SEQ ID NO: 2872136 - protein, 11 aa, Entamoeba invadens
KKEEEDEPQVS

SEQ ID NO: 2872137 - protein, 20 aa, Entamoeba invadens
KKEEEERKAQEQYEKEEREL

SEQ ID NO: 2872138 - protein, 28 aa, Entamoeba invadens
KKEEEKPTTYTSQGPNVNELETNNELKT

SEQ ID NO: 2872139 - protein, 8 aa, Entamoeba invadens
KKEEEMKK

SEQ ID NO: 2872140 - protein, 31 aa, Entamoeba invadens
KKEEENMSPEEKLKRKEAWKQSRKARKAEWK

SEQ ID NO: 2872141 - protein, 9 aa, Entamoeba invadens
KKEEENSLD

SEQ ID NO: 2872142 - protein, 10 aa, Entamoeba invadens
KKEEEPKGVE

SEQ ID NO: 2872143 - protein, 20 aa, Entamoeba invadens
KKEEERDDEKTLIDNYRLYD

SEQ ID NO: 2872144 - protein, 13 aa, Entamoeba invadens
KKEEFAQVVAETH

SEQ ID NO: 2872145 - protein, 8 aa, Entamoeba invadens
KKEEGNAF

SEQ ID NO: 2872146 - protein, 6 aa, Entamoeba invadens
KKEEIN

SEQ ID NO: 2872147 - protein, 8 aa, Entamoeba invadens
KKEEKDAI

SEQ ID NO: 2872148 - protein, 49 aa, Entamoeba invadens
KKEEKFERKEAKCPLTANSKDAEIGGHDDFDPNEQFTEQTSTDETDEGW

SEQ ID NO: 2872149 - protein, 8 aa, Entamoeba invadens
KKEEKPLQ

SEQ ID NO: 2872150 - protein, 11 aa, Entamoeba invadens
KKEEKTTTKMK

SEQ ID NO: 2872151 - protein, 91 aa, Entamoeba invadens
KKEEKVESQQQPERQERRGYGDRNNRERGYGGERGDRNNRYGDRNNRERRYGDQQGREQHDGKDQRGGYKRGGAYKKSNYQNADVAEPDWG

SEQ ID NO: 2872152 - protein, 7 aa, Entamoeba invadens
KKEELKQ

SEQ ID NO: 2872153 - protein, 19 aa, Entamoeba invadens
KKEENEDEESKMKISESLR

SEQ ID NO: 2872154 - protein, 9 aa, Entamoeba invadens
KKEENERKA

SEQ ID NO: 2872155 - protein, 11 aa, Entamoeba invadens
KKEENETEAVT

SEQ ID NO: 2872156 - protein, 13 aa, Entamoeba invadens
KKEENSKNQRSSF

SEQ ID NO: 2872157 - protein, 9 aa, Entamoeba invadens
KKEENSLSE

SEQ ID NO: 2872158 - protein, 8 aa, Entamoeba invadens
KKEEQHLS

SEQ ID NO: 2872159 - protein, 24 aa, Entamoeba invadens
KKEEQIPQQQNSEQDKENEVEEKH

SEQ ID NO: 2872160 - protein, 9 aa, Entamoeba invadens
KKEEQTREL

SEQ ID NO: 2872161 - protein, 83 aa, Entamoeba invadens
KKEEREKEKEREKAAAADESEPISTHRSHHSRTSDVSSRRKRDSPTDTTPATTSSAPVLEKSAAERAKERLAARERERKEKKA

SEQ ID NO: 2872162 - protein, 9 aa, Entamoeba invadens
KKEERSRHT

SEQ ID NO: 2872163 - protein, 8 aa, Entamoeba invadens
KKEERTDD

SEQ ID NO: 2872164 - protein, 8 aa, Entamoeba invadens
KKEESLNK

SEQ ID NO: 2872165 - protein, 34 aa, Entamoeba invadens
KKEETDFNNKTEELKQRIEKETGVVKKNRAQAEL

SEQ ID NO: 2872166 - protein, 9 aa, Entamoeba invadens
KKEETIETK

SEQ ID NO: 2872167 - protein, 7 aa, Entamoeba invadens
KKEEYAK

SEQ ID NO: 2872168 - protein, 6 aa, Entamoeba invadens
KKEFEE

SEQ ID NO: 2872169 - protein, 10 aa, Entamoeba invadens
KKEFKKNKKM

SEQ ID NO: 2872170 - protein, 11 aa, Entamoeba invadens
KKEFNDRKEEL

SEQ ID NO: 2872171 - protein, 7 aa, Entamoeba invadens
KKEFNDS

SEQ ID NO: 2872172 - protein, 18 aa, Entamoeba invadens
KKEFRAKKRIEKKPRKGK

SEQ ID NO: 2872173 - protein, 7 aa, Entamoeba invadens
KKEFSKW

SEQ ID NO: 2872174 - protein, 9 aa, Entamoeba invadens
KKEFTAPTL

SEQ ID NO: 2872175 - protein, 15 aa, Entamoeba invadens
KKEGDNNCDSNKNEI

SEQ ID NO: 2872176 - protein, 7 aa, Entamoeba invadens
KKEGDPE

SEQ ID NO: 2872177 - protein, 6 aa, Entamoeba invadens
KKEGEI

SEQ ID NO: 2872178 - protein, 7 aa, Entamoeba invadens
KKEGEKL

SEQ ID NO: 2872179 - protein, 11 aa, Entamoeba invadens
KKEGEQTPKIE

SEQ ID NO: 2872180 - protein, 10 aa, Entamoeba invadens
KKEGKGPAIT

SEQ ID NO: 2872181 - protein, 32 aa, Entamoeba invadens
KKEGKPKVGETKESEKQQKLNKSDGTKLENTK

SEQ ID NO: 2872182 - protein, 9 aa, Entamoeba invadens
KKEGLKEPN

SEQ ID NO: 2872183 - protein, 7 aa, Entamoeba invadens
KKEGNDY

SEQ ID NO: 2872184 - protein, 15 aa, Entamoeba invadens
KKEGNYVTDSGKLNG

SEQ ID NO: 2872185 - protein, 11 aa, Entamoeba invadens
KKEGQETPKIE

SEQ ID NO: 2872186 - protein, 6 aa, Entamoeba invadens
KKEGSL

SEQ ID NO: 2872187 - protein, 6 aa, Entamoeba invadens
KKEGTY

SEQ ID NO: 2872188 - protein, 5 aa, Entamoeba invadens
KKEHF

SEQ ID NO: 2872189 - protein, 19 aa, Entamoeba invadens
KKEIEELDEKSNATGLSPE

SEQ ID NO: 2872190 - protein, 28 aa, Entamoeba invadens
KKEIEKRNTVEQLKNQTSQYHADASTLE

SEQ ID NO: 2872191 - protein, 20 aa, Entamoeba invadens
KKEIKEKKNMRGEKETQIGA

SEQ ID NO: 2872192 - protein, 13 aa, Entamoeba invadens
KKEILQKNKDFNT

SEQ ID NO: 2872193 - protein, 7 aa, Entamoeba invadens
KKEINKM

SEQ ID NO: 2872194 - protein, 5 aa, Entamoeba invadens
KKEIS

SEQ ID NO: 2872195 - protein, 12 aa, Entamoeba invadens
KKEITKETQTNI

SEQ ID NO: 2872196 - protein, 9 aa, Entamoeba invadens
KKEKAEEQT

SEQ ID NO: 2872197 - protein, 8 aa, Entamoeba invadens
KKEKDGER

SEQ ID NO: 2872198 - protein, 18 aa, Entamoeba invadens
KKEKDNAEVRIDDPTQYQ

SEQ ID NO: 2872199 - protein, 27 aa, Entamoeba invadens
KKEKEEHKSEEKNTDKDPLLGSPEVQQ

SEQ ID NO: 2872200 - protein, 12 aa, Entamoeba invadens
KKEKEEKEKQLK

SEQ ID NO: 2872201 - protein, 63 aa, Entamoeba invadens
KKEKEEKKVENLKSEKTPKLQSSEEEKKSPKKVTRKSDEINEKHKRRNEIEKMKENEINTLQP

SEQ ID NO: 2872202 - protein, 16 aa, Entamoeba invadens
KKEKEIEQKRKEVERI

SEQ ID NO: 2872203 - protein, 10 aa, Entamoeba invadens
KKEKEKNSPN

SEQ ID NO: 2872204 - protein, 9 aa, Entamoeba invadens
KKEKEMNER

SEQ ID NO: 2872205 - protein, 13 aa, Entamoeba invadens
KKEKENNKRLCLV

SEQ ID NO: 2872206 - protein, 6 aa, Entamoeba invadens
KKEKEQ

SEQ ID NO: 2872207 - protein, 13 aa, Entamoeba invadens
KKEKESVKDSSCL

SEQ ID NO: 2872208 - protein, 21 aa, Entamoeba invadens
KKEKETRSDEMKERKQRRQTS

SEQ ID NO: 2872209 - protein, 24 aa, Entamoeba invadens
KKEKFAKEKEAKKLKAENDEIKEK

SEQ ID NO: 2872210 - protein, 7 aa, Entamoeba invadens
KKEKGAY

SEQ ID NO: 2872211 - protein, 46 aa, Entamoeba invadens
KKEKKDKTESRKSLGNKKEKPVEKLGQKPLEKQLETKTEKDTEIEE

SEQ ID NO: 2872212 - protein, 61 aa, Entamoeba invadens
KKEKKEMKEKLKQEKKARLEAKKTYKRPEKKKENKKTETQVPSTEDLQNTPANQPKEEQKV

SEQ ID NO: 2872213 - protein, 20 aa, Entamoeba invadens
KKEKKKQMELTKKKNLQKRL

SEQ ID NO: 2872214 - protein, 10 aa, Entamoeba invadens
KKEKKQKEKV

SEQ ID NO: 2872215 - protein, 20 aa, Entamoeba invadens
KKEKMETSQSAQKEKKMDEI

SEQ ID NO: 2872216 - protein, 6 aa, Entamoeba invadens
KKEKNM

SEQ ID NO: 2872217 - protein, 8 aa, Entamoeba invadens
KKEKPKGH

SEQ ID NO: 2872218 - protein, 11 aa, Entamoeba invadens
KKEKQMIESKQ

SEQ ID NO: 2872219 - protein, 9 aa, Entamoeba invadens
KKEKQQEAI

SEQ ID NO: 2872220 - protein, 5 aa, Entamoeba invadens
KKEKR

SEQ ID NO: 2872221 - protein, 24 aa, Entamoeba invadens
KKEKRQHDLADRKKNPKKLEGEVE

SEQ ID NO: 2872222 - protein, 9 aa, Entamoeba invadens
KKEKSEIEQ

SEQ ID NO: 2872223 - protein, 8 aa, Entamoeba invadens
KKEKSKDK

SEQ ID NO: 2872224 - protein, 7 aa, Entamoeba invadens
KKEKVCS

SEQ ID NO: 2872225 - protein, 7 aa, Entamoeba invadens
KKEKVDI

SEQ ID NO: 2872226 - protein, 5 aa, Entamoeba invadens
KKEKY

SEQ ID NO: 2872227 - protein, 6 aa, Entamoeba invadens
KKELCE

SEQ ID NO: 2872228 - protein, 8 aa, Entamoeba invadens
KKELDNVK

SEQ ID NO: 2872229 - protein, 6 aa, Entamoeba invadens
KKELKD

SEQ ID NO: 2872230 - protein, 7 aa, Entamoeba invadens
KKELKDL

SEQ ID NO: 2872231 - protein, 5 aa, Entamoeba invadens
KKELR

SEQ ID NO: 2872232 - protein, 5 aa, Entamoeba invadens
KKELY

SEQ ID NO: 2872233 - protein, 6 aa, Entamoeba invadens
KKELYG

SEQ ID NO: 2872234 - protein, 8 aa, Entamoeba invadens
KKEMEQTL

SEQ ID NO: 2872235 - protein, 7 aa, Entamoeba invadens
KKEMETN

SEQ ID NO: 2872236 - protein, 4 aa, Entamoeba invadens
KKEN

SEQ ID NO: 2872237 - protein, 7 aa, Entamoeba invadens
KKENELN

SEQ ID NO: 2872238 - protein, 7 aa, Entamoeba invadens
KKENGTE

SEQ ID NO: 2872239 - protein, 8 aa, Entamoeba invadens
KKENKGDQ

SEQ ID NO: 2872240 - protein, 9 aa, Entamoeba invadens
KKENKNYKV

SEQ ID NO: 2872241 - protein, 18 aa, Entamoeba invadens
KKENPIGLRRANSKEWDR

SEQ ID NO: 2872242 - protein, 10 aa, Entamoeba invadens
KKENQLKTNL

SEQ ID NO: 2872243 - protein, 18 aa, Entamoeba invadens
KKENREKIAKGEVGDKDV

SEQ ID NO: 2872244 - protein, 9 aa, Entamoeba invadens
KKENTEDNF

SEQ ID NO: 2872245 - protein, 8 aa, Entamoeba invadens
KKENTPLS

SEQ ID NO: 2872246 - protein, 8 aa, Entamoeba invadens
KKENVGMS

SEQ ID NO: 2872247 - protein, 8 aa, Entamoeba invadens
KKENYAMP

SEQ ID NO: 2872248 - protein, 5 aa, Entamoeba invadens
KKEPF

SEQ ID NO: 2872249 - protein, 9 aa, Entamoeba invadens
KKEPFDGYS

SEQ ID NO: 2872250 - protein, 6 aa, Entamoeba invadens
KKEPKV

SEQ ID NO: 2872251 - protein, 20 aa, Entamoeba invadens
KKEPTPQKAVENTKMTGQNK

SEQ ID NO: 2872252 - protein, 8 aa, Entamoeba invadens
KKEQENQQ

SEQ ID NO: 2872253 - protein, 7 aa, Entamoeba invadens
KKEQLGD

SEQ ID NO: 2872254 - protein, 19 aa, Entamoeba invadens
KKEQNKNKKGIKREKQNTK

SEQ ID NO: 2872255 - protein, 49 aa, Entamoeba invadens
KKEQPKGQGYFNKGGTEFYSNDGDEAYKAAESTASRDNGNKYHDAGKGD

SEQ ID NO: 2872256 - protein, 9 aa, Entamoeba invadens
KKEQQNTLE

SEQ ID NO: 2872257 - protein, 8 aa, Entamoeba invadens
KKEQRTTE

SEQ ID NO: 2872258 - protein, 12 aa, Entamoeba invadens
KKEQTEPKLQRS

SEQ ID NO: 2872259 - protein, 4 aa, Entamoeba invadens
KKER

SEQ ID NO: 2872260 - protein, 25 aa, Entamoeba invadens
KKERARRENEVDSKKVAKKRKEAHL

SEQ ID NO: 2872261 - protein, 9 aa, Entamoeba invadens
KKERESPWD

SEQ ID NO: 2872262 - protein, 9 aa, Entamoeba invadens
KKERKETVD

SEQ ID NO: 2872263 - protein, 8 aa, Entamoeba invadens
KKERKRDA

SEQ ID NO: 2872264 - protein, 16 aa, Entamoeba invadens
KKERLSSQLSAPPKVD

SEQ ID NO: 2872265 - protein, 16 aa, Entamoeba invadens
KKERNEVDGCEKEKKR

SEQ ID NO: 2872266 - protein, 21 aa, Entamoeba invadens
KKERNPQSVNQDDTKKQRLSH

SEQ ID NO: 2872267 - protein, 14 aa, Entamoeba invadens
KKERQKAKTRRRMD

SEQ ID NO: 2872268 - protein, 6 aa, Entamoeba invadens
KKERVC

SEQ ID NO: 2872269 - protein, 7 aa, Entamoeba invadens
KKERVTR

SEQ ID NO: 2872270 - protein, 6 aa, Entamoeba invadens
KKESAI

SEQ ID NO: 2872271 - protein, 14 aa, Entamoeba invadens
KKESDFVKENTEIE

SEQ ID NO: 2872272 - protein, 14 aa, Entamoeba invadens
KKESDFVKENTELE

SEQ ID NO: 2872273 - protein, 9 aa, Entamoeba invadens
KKESETIQD

SEQ ID NO: 2872274 - protein, 7 aa, Entamoeba invadens
KKESGHL

SEQ ID NO: 2872275 - protein, 7 aa, Entamoeba invadens
KKESIPD

SEQ ID NO: 2872276 - protein, 5 aa, Entamoeba invadens
KKESP

SEQ ID NO: 2872277 - protein, 8 aa, Entamoeba invadens
KKESQPSM

SEQ ID NO: 2872278 - protein, 9 aa, Entamoeba invadens
KKESQTIED

SEQ ID NO: 2872279 - protein, 8 aa, Entamoeba invadens
KKESTPLG

SEQ ID NO: 2872280 - protein, 7 aa, Entamoeba invadens
KKESVGV

SEQ ID NO: 2872281 - protein, 10 aa, Entamoeba invadens
KKESVRENNE

SEQ ID NO: 2872282 - protein, 5 aa, Entamoeba invadens
KKETA

SEQ ID NO: 2872283 - protein, 5 aa, Entamoeba invadens
KKETC

SEQ ID NO: 2872284 - protein, 7 aa, Entamoeba invadens
KKETCQV

SEQ ID NO: 2872285 - protein, 7 aa, Entamoeba invadens
KKETENM

SEQ ID NO: 2872286 - protein, 9 aa, Entamoeba invadens
KKETIEEMQ

SEQ ID NO: 2872287 - protein, 27 aa, Entamoeba invadens
KKETKYEQQNEREIPQKVKIQYELFIY

SEQ ID NO: 2872288 - protein, 6 aa, Entamoeba invadens
KKETLD

SEQ ID NO: 2872289 - protein, 10 aa, Entamoeba invadens
KKETPKLTED

SEQ ID NO: 2872290 - protein, 11 aa, Entamoeba invadens
KKETQQQDERI

SEQ ID NO: 2872291 - protein, 8 aa, Entamoeba invadens
KKETTADT

SEQ ID NO: 2872292 - protein, 9 aa, Entamoeba invadens
KKETTEELI

SEQ ID NO: 2872293 - protein, 12 aa, Entamoeba invadens
KKETTVYGDASS

SEQ ID NO: 2872294 - protein, 7 aa, Entamoeba invadens
KKETTWG

SEQ ID NO: 2872295 - protein, 8 aa, Entamoeba invadens
KKETYEGV

SEQ ID NO: 2872296 - protein, 4 aa, Entamoeba invadens
KKEV

SEQ ID NO: 2872297 - protein, 18 aa, Entamoeba invadens
KKEVDDLGGEDSFEEVED

SEQ ID NO: 2872298 - protein, 8 aa, Entamoeba invadens
KKEVEEKM

SEQ ID NO: 2872299 - protein, 6 aa, Entamoeba invadens
KKEVGE

SEQ ID NO: 2872300 - protein, 5 aa, Entamoeba invadens
KKEVH

SEQ ID NO: 2872301 - protein, 6 aa, Entamoeba invadens
KKEVKI

SEQ ID NO: 2872302 - protein, 6 aa, Entamoeba invadens
KKEVNG

SEQ ID NO: 2872303 - protein, 12 aa, Entamoeba invadens
KKEVQEDHVGSN

SEQ ID NO: 2872304 - protein, 7 aa, Entamoeba invadens
KKEVSLD

SEQ ID NO: 2872305 - protein, 6 aa, Entamoeba invadens
KKEVYN

SEQ ID NO: 2872306 - protein, 4 aa, Entamoeba invadens
KKEY

SEQ ID NO: 2872307 - protein, 8 aa, Entamoeba invadens
KKEYDEER

SEQ ID NO: 2872308 - protein, 8 aa, Entamoeba invadens
KKEYKKVE

SEQ ID NO: 2872309 - protein, 5 aa, Entamoeba invadens
KKEYN

SEQ ID NO: 2872310 - protein, 17 aa, Entamoeba invadens
KKEYPDIDVTTDNKRAI

SEQ ID NO: 2872311 - protein, 7 aa, Entamoeba invadens
KKEYQKA

SEQ ID NO: 2872312 - protein, 6 aa, Entamoeba invadens
KKFAAS

SEQ ID NO: 2872313 - protein, 7 aa, Entamoeba invadens
KKFAEEN

SEQ ID NO: 2872314 - protein, 5 aa, Entamoeba invadens
KKFDR

SEQ ID NO: 2872315 - protein, 4 aa, Entamoeba invadens
KKFE

SEQ ID NO: 2872316 - protein, 8 aa, Entamoeba invadens
KKFEIPKN

SEQ ID NO: 2872317 - protein, 7 aa, Entamoeba invadens
KKFEKDN

SEQ ID NO: 2872318 - protein, 11 aa, Entamoeba invadens
KKFEPTNEYNT

SEQ ID NO: 2872319 - protein, 5 aa, Entamoeba invadens
KKFER

SEQ ID NO: 2872320 - protein, 6 aa, Entamoeba invadens
KKFESK

SEQ ID NO: 2872321 - protein, 9 aa, Entamoeba invadens
KKFESTPQR

SEQ ID NO: 2872322 - protein, 9 aa, Entamoeba invadens
KKFETETDD

SEQ ID NO: 2872323 - protein, 5 aa, Entamoeba invadens
KKFGE

SEQ ID NO: 2872324 - protein, 7 aa, Entamoeba invadens
KKFGGKK

SEQ ID NO: 2872325 - protein, 17 aa, Entamoeba invadens
KKFGGSKKALKKLTIKE

SEQ ID NO: 2872326 - protein, 6 aa, Entamoeba invadens
KKFGNH

SEQ ID NO: 2872327 - protein, 18 aa, Entamoeba invadens
KKFKAEDGKMITIEAKNR

SEQ ID NO: 2872328 - protein, 13 aa, Entamoeba invadens
KKFNKKTDSKVVE

SEQ ID NO: 2872329 - protein, 14 aa, Entamoeba invadens
KKFNSKKETVEGED

SEQ ID NO: 2872330 - protein, 14 aa, Entamoeba invadens
KKFPVTNSDDDEGV

SEQ ID NO: 2872331 - protein, 14 aa, Entamoeba invadens
KKFPVTNSDDNEGV

SEQ ID NO: 2872332 - protein, 4 aa, Entamoeba invadens
KKFQ

SEQ ID NO: 2872333 - protein, 6 aa, Entamoeba invadens
KKFQIG

SEQ ID NO: 2872334 - protein, 14 aa, Entamoeba invadens
KKFQSSAEKLGDQF

SEQ ID NO: 2872335 - protein, 7 aa, Entamoeba invadens
KKFSEKS

SEQ ID NO: 2872336 - protein, 10 aa, Entamoeba invadens
KKFSNTGSGC

SEQ ID NO: 2872337 - protein, 8 aa, Entamoeba invadens
KKFSSSNY

SEQ ID NO: 2872338 - protein, 6 aa, Entamoeba invadens
KKFTEK

SEQ ID NO: 2872339 - protein, 12 aa, Entamoeba invadens
KKGAAQSYCKTS

SEQ ID NO: 2872340 - protein, 10 aa, Entamoeba invadens
KKGAASNRAN

SEQ ID NO: 2872341 - protein, 19 aa, Entamoeba invadens
KKGADITNKKKRGPPPKHS

SEQ ID NO: 2872342 - protein, 16 aa, Entamoeba invadens
KKGANEVTKALNRGRA

SEQ ID NO: 2872343 - protein, 6 aa, Entamoeba invadens
KKGANM

SEQ ID NO: 2872344 - protein, 8 aa, Entamoeba invadens
KKGATAAV

SEQ ID NO: 2872345 - protein, 11 aa, Entamoeba invadens
KKGDGNKLPST

SEQ ID NO: 2872346 - protein, 7 aa, Entamoeba invadens
KKGDIER

SEQ ID NO: 2872347 - protein, 8 aa, Entamoeba invadens
KKGDKNAR

SEQ ID NO: 2872348 - protein, 11 aa, Entamoeba invadens
KKGDKTGASQH

SEQ ID NO: 2872349 - protein, 7 aa, Entamoeba invadens
KKGDPFW

SEQ ID NO: 2872350 - protein, 6 aa, Entamoeba invadens
KKGDSL

SEQ ID NO: 2872351 - protein, 8 aa, Entamoeba invadens
KKGEDDET

SEQ ID NO: 2872352 - protein, 7 aa, Entamoeba invadens
KKGEEMN

SEQ ID NO: 2872353 - protein, 9 aa, Entamoeba invadens
KKGEETELN

SEQ ID NO: 2872354 - protein, 7 aa, Entamoeba invadens
KKGEITS

SEQ ID NO: 2872355 - protein, 5 aa, Entamoeba invadens
KKGEL

SEQ ID NO: 2872356 - protein, 8 aa, Entamoeba invadens
KKGELKGD

SEQ ID NO: 2872357 - protein, 8 aa, Entamoeba invadens
KKGELNSS

SEQ ID NO: 2872358 - protein, 7 aa, Entamoeba invadens
KKGEMKS

SEQ ID NO: 2872359 - protein, 8 aa, Entamoeba invadens
KKGESLNE

SEQ ID NO: 2872360 - protein, 5 aa, Entamoeba invadens
KKGET

SEQ ID NO: 2872361 - protein, 9 aa, Entamoeba invadens
KKGEVPEKD

SEQ ID NO: 2872362 - protein, 6 aa, Entamoeba invadens
KKGEYP

SEQ ID NO: 2872363 - protein, 9 aa, Entamoeba invadens
KKGGIERSI

SEQ ID NO: 2872364 - protein, 7 aa, Entamoeba invadens
KKGGITS

SEQ ID NO: 2872365 - protein, 7 aa, Entamoeba invadens
KKGGKNM

SEQ ID NO: 2872366 - protein, 16 aa, Entamoeba invadens
KKGGKTDIVSEECTSV

SEQ ID NO: 2872367 - protein, 11 aa, Entamoeba invadens
KKGGKVSSDDV

SEQ ID NO: 2872368 - protein, 13 aa, Entamoeba invadens
KKGGVSDKDIAEH

SEQ ID NO: 2872369 - protein, 8 aa, Entamoeba invadens
KKGHNAGY

SEQ ID NO: 2872370 - protein, 4 aa, Entamoeba invadens
KKGI

SEQ ID NO: 2872371 - protein, 11 aa, Entamoeba invadens
KKGIEGSYCSP

SEQ ID NO: 2872372 - protein, 15 aa, Entamoeba invadens
KKGIQQTNEGVTPLE

SEQ ID NO: 2872373 - protein, 5 aa, Entamoeba invadens
KKGIT

SEQ ID NO: 2872374 - protein, 10 aa, Entamoeba invadens
KKGKDGSRCF

SEQ ID NO: 2872375 - protein, 10 aa, Entamoeba invadens
KKGKEEGKQY

SEQ ID NO: 2872376 - protein, 7 aa, Entamoeba invadens
KKGKEEI

SEQ ID NO: 2872377 - protein, 8 aa, Entamoeba invadens
KKGKEVKE

SEQ ID NO: 2872378 - protein, 14 aa, Entamoeba invadens
KKGKFEDLTKTTPV

SEQ ID NO: 2872379 - protein, 6 aa, Entamoeba invadens
KKGKIN

SEQ ID NO: 2872380 - protein, 11 aa, Entamoeba invadens
KKGKIVDTTKL

SEQ ID NO: 2872381 - protein, 13 aa, Entamoeba invadens
KKGKKLNKNSQKK

SEQ ID NO: 2872382 - protein, 9 aa, Entamoeba invadens
KKGKLKGHA

SEQ ID NO: 2872383 - protein, 9 aa, Entamoeba invadens
KKGKPENRS

SEQ ID NO: 2872384 - protein, 9 aa, Entamoeba invadens
KKGKQSAKI

SEQ ID NO: 2872385 - protein, 6 aa, Entamoeba invadens
KKGKRV

SEQ ID NO: 2872386 - protein, 11 aa, Entamoeba invadens
KKGKSEELRKR

SEQ ID NO: 2872387 - protein, 7 aa, Entamoeba invadens
KKGKTTH

SEQ ID NO: 2872388 - protein, 6 aa, Entamoeba invadens
KKGKWI

SEQ ID NO: 2872389 - protein, 7 aa, Entamoeba invadens
KKGKWSE

SEQ ID NO: 2872390 - protein, 5 aa, Entamoeba invadens
KKGKY

SEQ ID NO: 2872391 - protein, 8 aa, Entamoeba invadens
KKGLGQAT

SEQ ID NO: 2872392 - protein, 160 aa, Entamoeba invadens
KKGLKLDSDTEAQKKAADSLNRYTRTRDTDTSKTESTSSRRTIDPSKAAEDERKRREEEREKERARRKAEREEEARRDEERRKQREEERQKERLARQQQRAQEKLEEERLQREREERRAKLKAEREAQQAADAEKEIERQKKYDLEREQRRKQREAERNK

SEQ ID NO: 2872393 - protein, 19 aa, Entamoeba invadens
KKGMAKYKNEMEEKNESLE

SEQ ID NO: 2872394 - protein, 32 aa, Entamoeba invadens
KKGMNAEKRQYKAMKEEAEKYQTLEDEMAEKK

SEQ ID NO: 2872395 - protein, 12 aa, Entamoeba invadens
KKGMTTRQKEEY

SEQ ID NO: 2872396 - protein, 5 aa, Entamoeba invadens
KKGMV

SEQ ID NO: 2872397 - protein, 6 aa, Entamoeba invadens
KKGNDM

SEQ ID NO: 2872398 - protein, 9 aa, Entamoeba invadens
KKGNDPMKR

SEQ ID NO: 2872399 - protein, 9 aa, Entamoeba invadens
KKGNEIGET

SEQ ID NO: 2872400 - protein, 12 aa, Entamoeba invadens
KKGPTDERQMST

SEQ ID NO: 2872401 - protein, 7 aa, Entamoeba invadens
KKGRISV

SEQ ID NO: 2872402 - protein, 11 aa, Entamoeba invadens
KKGSGCQGSIE

SEQ ID NO: 2872403 - protein, 5 aa, Entamoeba invadens
KKGSI

SEQ ID NO: 2872404 - protein, 9 aa, Entamoeba invadens
KKGTEKGKK

SEQ ID NO: 2872405 - protein, 25 aa, Entamoeba invadens
KKGTKDHDQTNQKPKKVSLFKQRQN

SEQ ID NO: 2872406 - protein, 10 aa, Entamoeba invadens
KKGTKKMSRC

SEQ ID NO: 2872407 - protein, 10 aa, Entamoeba invadens
KKGTPSGKAK

SEQ ID NO: 2872408 - protein, 9 aa, Entamoeba invadens
KKGTSGKTV

SEQ ID NO: 2872409 - protein, 9 aa, Entamoeba invadens
KKGTTEMLT

SEQ ID NO: 2872410 - protein, 4 aa, Entamoeba invadens
KKGV

SEQ ID NO: 2872411 - protein, 34 aa, Entamoeba invadens
KKGVDKKNRSASVVSKETQTQAKNTKNAAQVNVN

SEQ ID NO: 2872412 - protein, 10 aa, Entamoeba invadens
KKGVDKSKCK

SEQ ID NO: 2872413 - protein, 18 aa, Entamoeba invadens
KKGVEENASEEDEEVEME

SEQ ID NO: 2872414 - protein, 7 aa, Entamoeba invadens
KKGVNAA

SEQ ID NO: 2872415 - protein, 13 aa, Entamoeba invadens
KKGVSRTTAQRRM

SEQ ID NO: 2872416 - protein, 16 aa, Entamoeba invadens
KKGWGNRSVTSSQSDV

SEQ ID NO: 2872417 - protein, 15 aa, Entamoeba invadens
KKGYKVDDKGTYTAD

SEQ ID NO: 2872418 - protein, 4 aa, Entamoeba invadens
KKHE

SEQ ID NO: 2872419 - protein, 14 aa, Entamoeba invadens
KKHEAKDPITKKPY

SEQ ID NO: 2872420 - protein, 8 aa, Entamoeba invadens
KKHEGDKR

SEQ ID NO: 2872421 - protein, 10 aa, Entamoeba invadens
KKHEIAKNKY

SEQ ID NO: 2872422 - protein, 11 aa, Entamoeba invadens
KKHEKKAEKCS

SEQ ID NO: 2872423 - protein, 8 aa, Entamoeba invadens
KKHETTKS

SEQ ID NO: 2872424 - protein, 11 aa, Entamoeba invadens
KKHGRGGQSSV

SEQ ID NO: 2872425 - protein, 8 aa, Entamoeba invadens
KKHKITTE

SEQ ID NO: 2872426 - protein, 12 aa, Entamoeba invadens
KKHKRGRKAKFP

SEQ ID NO: 2872427 - protein, 6 aa, Entamoeba invadens
KKHQDS

SEQ ID NO: 2872428 - protein, 8 aa, Entamoeba invadens
KKHSAHAI

SEQ ID NO: 2872429 - protein, 7 aa, Entamoeba invadens
KKHSKRD

SEQ ID NO: 2872430 - protein, 9 aa, Entamoeba invadens
KKHSPDNYF

SEQ ID NO: 2872431 - protein, 5 aa, Entamoeba invadens
KKHTN

SEQ ID NO: 2872432 - protein, 24 aa, Entamoeba invadens
KKIAQQQKSRKQREKAMNERTAKL

SEQ ID NO: 2872433 - protein, 9 aa, Entamoeba invadens
KKIDEKKFD

SEQ ID NO: 2872434 - protein, 7 aa, Entamoeba invadens
KKIDGQL

SEQ ID NO: 2872435 - protein, 13 aa, Entamoeba invadens
KKIDNNNNEYEGI

SEQ ID NO: 2872436 - protein, 7 aa, Entamoeba invadens
KKIDSNE

SEQ ID NO: 2872437 - protein, 6 aa, Entamoeba invadens
KKIDTP

SEQ ID NO: 2872438 - protein, 10 aa, Entamoeba invadens
KKIEEDNGRM

SEQ ID NO: 2872439 - protein, 9 aa, Entamoeba invadens
KKIEEENKA

SEQ ID NO: 2872440 - protein, 9 aa, Entamoeba invadens
KKIEEVTKA

SEQ ID NO: 2872441 - protein, 17 aa, Entamoeba invadens
KKIEKEDMTKKQKRLSA

SEQ ID NO: 2872442 - protein, 13 aa, Entamoeba invadens
KKIEKIEKVESQV

SEQ ID NO: 2872443 - protein, 6 aa, Entamoeba invadens
KKIENH

SEQ ID NO: 2872444 - protein, 8 aa, Entamoeba invadens
KKIEQNKI

SEQ ID NO: 2872445 - protein, 10 aa, Entamoeba invadens
KKIEQNKVVN

SEQ ID NO: 2872446 - protein, 13 aa, Entamoeba invadens
KKIEQNKVVNEKS

SEQ ID NO: 2872447 - protein, 15 aa, Entamoeba invadens
KKIEQNSISPISPEE

SEQ ID NO: 2872448 - protein, 10 aa, Entamoeba invadens
KKIERAKTEE

SEQ ID NO: 2872449 - protein, 6 aa, Entamoeba invadens
KKIESY

SEQ ID NO: 2872450 - protein, 7 aa, Entamoeba invadens
KKIETAG

SEQ ID NO: 2872451 - protein, 56 aa, Entamoeba invadens
KKIETTQTPPLEKKEEPKKEATSSGRLDDKPEVLNTPRNFESPTKKTRMSKSEVHN

SEQ ID NO: 2872452 - protein, 5 aa, Entamoeba invadens
KKIEY

SEQ ID NO: 2872453 - protein, 9 aa, Entamoeba invadens
KKIGDDNTP

SEQ ID NO: 2872454 - protein, 7 aa, Entamoeba invadens
KKIGEGG

SEQ ID NO: 2872455 - protein, 8 aa, Entamoeba invadens
KKIGEGSF

SEQ ID NO: 2872456 - protein, 5 aa, Entamoeba invadens
KKIGG

SEQ ID NO: 2872457 - protein, 7 aa, Entamoeba invadens
KKIGNPI

SEQ ID NO: 2872458 - protein, 14 aa, Entamoeba invadens
KKIGTRKTQIPESQ

SEQ ID NO: 2872459 - protein, 6 aa, Entamoeba invadens
KKIHGK

SEQ ID NO: 2872460 - protein, 4 aa, Entamoeba invadens
KKIK

SEQ ID NO: 2872461 - protein, 8 aa, Entamoeba invadens
KKIKEESL

SEQ ID NO: 2872462 - protein, 5 aa, Entamoeba invadens
KKIKP

SEQ ID NO: 2872463 - protein, 17 aa, Entamoeba invadens
KKIKPTTDEIKKAPVTV

SEQ ID NO: 2872464 - protein, 12 aa, Entamoeba invadens
KKIKTNAENMEE

SEQ ID NO: 2872465 - protein, 17 aa, Entamoeba invadens
KKINESVAGASSECEKN

SEQ ID NO: 2872466 - protein, 20 aa, Entamoeba invadens
KKINTEKKPKKEEKKKKSTF

SEQ ID NO: 2872467 - protein, 4 aa, Entamoeba invadens
KKIP

SEQ ID NO: 2872468 - protein, 10 aa, Entamoeba invadens
KKIPKEKKEG

SEQ ID NO: 2872469 - protein, 32 aa, Entamoeba invadens
KKIPKLRTSQKDKEREEKKPRPIEKEKPKSAL

SEQ ID NO: 2872470 - protein, 6 aa, Entamoeba invadens
KKIPNH

SEQ ID NO: 2872471 - protein, 6 aa, Entamoeba invadens
KKIPPE

SEQ ID NO: 2872472 - protein, 6 aa, Entamoeba invadens
KKIPTR

SEQ ID NO: 2872473 - protein, 4 aa, Entamoeba invadens
KKIQ

SEQ ID NO: 2872474 - protein, 7 aa, Entamoeba invadens
KKIQDRP

SEQ ID NO: 2872475 - protein, 10 aa, Entamoeba invadens
KKIQSGDIGQ

SEQ ID NO: 2872476 - protein, 7 aa, Entamoeba invadens
KKIRELA

SEQ ID NO: 2872477 - protein, 4 aa, Entamoeba invadens
KKIS

SEQ ID NO: 2872478 - protein, 14 aa, Entamoeba invadens
KKISEKYREVGKLE

SEQ ID NO: 2872479 - protein, 9 aa, Entamoeba invadens
KKISKSACT

SEQ ID NO: 2872480 - protein, 8 aa, Entamoeba invadens
KKISQADE

SEQ ID NO: 2872481 - protein, 11 aa, Entamoeba invadens
KKITENSSKEM

SEQ ID NO: 2872482 - protein, 11 aa, Entamoeba invadens
KKITESDAENY

SEQ ID NO: 2872483 - protein, 6 aa, Entamoeba invadens
KKITGK

SEQ ID NO: 2872484 - protein, 11 aa, Entamoeba invadens
KKITKNSFCTD

SEQ ID NO: 2872485 - protein, 6 aa, Entamoeba invadens
KKITKQ

SEQ ID NO: 2872486 - protein, 6 aa, Entamoeba invadens
KKITST

SEQ ID NO: 2872487 - protein, 31 aa, Entamoeba invadens
KKITTDKTPKRNTHSNIKPDNLLPNTETTLQ

SEQ ID NO: 2872488 - protein, 31 aa, Entamoeba invadens
KKITTDKTPKRNTHSNTKPDNLLPNTETTLQ

SEQ ID NO: 2872489 - protein, 17 aa, Entamoeba invadens
KKITTTSTSIKIDRTDP

SEQ ID NO: 2872490 - protein, 6 aa, Entamoeba invadens
KKITVN

SEQ ID NO: 2872491 - protein, 27 aa, Entamoeba invadens
KKIVNNKKKRSIKDVNDLKKSSKVNQQ

SEQ ID NO: 2872492 - protein, 5 aa, Entamoeba invadens
KKIVT

SEQ ID NO: 2872493 - protein, 9 aa, Entamoeba invadens
KKKADKKPM

SEQ ID NO: 2872494 - protein, 16 aa, Entamoeba invadens
KKKADYVTDDVDHGGV

SEQ ID NO: 2872495 - protein, 10 aa, Entamoeba invadens
KKKAEDYKSW

SEQ ID NO: 2872496 - protein, 7 aa, Entamoeba invadens
KKKAERL

SEQ ID NO: 2872497 - protein, 9 aa, Entamoeba invadens
KKKAETKEI

SEQ ID NO: 2872498 - protein, 27 aa, Entamoeba invadens
KKKAQNAAAKAKKQAKQYTRKVEEAER

SEQ ID NO: 2872499 - protein, 5 aa, Entamoeba invadens
KKKAR

SEQ ID NO: 2872500 - protein, 21 aa, Entamoeba invadens
KKKASTSLETSPRNSAQIPPL

SEQ ID NO: 2872501 - protein, 18 aa, Entamoeba invadens
KKKATANASGDDQTAQSV

SEQ ID NO: 2872502 - protein, 7 aa, Entamoeba invadens
KKKCPQC

SEQ ID NO: 2872503 - protein, 9 aa, Entamoeba invadens
KKKDAKNAL

SEQ ID NO: 2872504 - protein, 9 aa, Entamoeba invadens
KKKDDEIKQ

SEQ ID NO: 2872505 - protein, 13 aa, Entamoeba invadens
KKKDDKTPRGDKP

SEQ ID NO: 2872506 - protein, 18 aa, Entamoeba invadens
KKKDDNTVSITKNGEEID

SEQ ID NO: 2872507 - protein, 8 aa, Entamoeba invadens
KKKDEAFA

SEQ ID NO: 2872508 - protein, 7 aa, Entamoeba invadens
KKKDEEI

SEQ ID NO: 2872509 - protein, 9 aa, Entamoeba invadens
KKKDGERRE

SEQ ID NO: 2872510 - protein, 8 aa, Entamoeba invadens
KKKDGNSL

SEQ ID NO: 2872511 - protein, 13 aa, Entamoeba invadens
KKKDGSFYVVKTE

SEQ ID NO: 2872512 - protein, 9 aa, Entamoeba invadens
KKKDHAKTQ

SEQ ID NO: 2872513 - protein, 32 aa, Entamoeba invadens
KKKDKADQPSSAKTSKISTEDLSFSSSQISAC

SEQ ID NO: 2872514 - protein, 54 aa, Entamoeba invadens
KKKDPAVIQAEKQQKEAEEKKRRQIEEKKREEERRFKKEQQDKKTKELMTSGPE

SEQ ID NO: 2872515 - protein, 6 aa, Entamoeba invadens
KKKDPT

SEQ ID NO: 2872516 - protein, 4 aa, Entamoeba invadens
KKKE

SEQ ID NO: 2872517 - protein, 21 aa, Entamoeba invadens
KKKEAQEKKAAEQPKEEEKNK

SEQ ID NO: 2872518 - protein, 19 aa, Entamoeba invadens
KKKEEDDGKIKAPLSRKLE

SEQ ID NO: 2872519 - protein, 7 aa, Entamoeba invadens
KKKEEEE

SEQ ID NO: 2872520 - protein, 9 aa, Entamoeba invadens
KKKEEEEEM

SEQ ID NO: 2872521 - protein, 10 aa, Entamoeba invadens
KKKEEEQNRI

SEQ ID NO: 2872522 - protein, 11 aa, Entamoeba invadens
KKKEEKEKQKD

SEQ ID NO: 2872523 - protein, 14 aa, Entamoeba invadens
KKKEEKSEGFPQIT

SEQ ID NO: 2872524 - protein, 57 aa, Entamoeba invadens
KKKEESQSAYVPPSLRGAKKDCDEYDPMPAPGQKSTRKKHTKKVNKKAKKADDDLYD

SEQ ID NO: 2872525 - protein, 13 aa, Entamoeba invadens
KKKEIEKIKQSTV

SEQ ID NO: 2872526 - protein, 7 aa, Entamoeba invadens
KKKEIKR

SEQ ID NO: 2872527 - protein, 9 aa, Entamoeba invadens
KKKEKEEKE

SEQ ID NO: 2872528 - protein, 12 aa, Entamoeba invadens
KKKEKKNGRVRI

SEQ ID NO: 2872529 - protein, 12 aa, Entamoeba invadens
KKKEKREYQKTR

SEQ ID NO: 2872530 - protein, 16 aa, Entamoeba invadens
KKKEKRRKSSSRESVS

SEQ ID NO: 2872531 - protein, 20 aa, Entamoeba invadens
KKKEKSDSSHSSSENTRPEV

SEQ ID NO: 2872532 - protein, 9 aa, Entamoeba invadens
KKKENEKKV

SEQ ID NO: 2872533 - protein, 31 aa, Entamoeba invadens
KKKENKTKDKKSDEEMSPSSQSPKSINMSNS

SEQ ID NO: 2872534 - protein, 11 aa, Entamoeba invadens
KKKENRFSGQK

SEQ ID NO: 2872535 - protein, 7 aa, Entamoeba invadens
KKKENYK

SEQ ID NO: 2872536 - protein, 7 aa, Entamoeba invadens
KKKERKE

SEQ ID NO: 2872537 - protein, 27 aa, Entamoeba invadens
KKKERNAKNDKDKKDLAAADDAKAKAF

SEQ ID NO: 2872538 - protein, 9 aa, Entamoeba invadens
KKKESGDFS

SEQ ID NO: 2872539 - protein, 13 aa, Entamoeba invadens
KKKETTFKTKGEI

SEQ ID NO: 2872540 - protein, 6 aa, Entamoeba invadens
KKKEVC

SEQ ID NO: 2872541 - protein, 6 aa, Entamoeba invadens
KKKEVD

SEQ ID NO: 2872542 - protein, 4 aa, Entamoeba invadens
KKKF

SEQ ID NO: 2872543 - protein, 18 aa, Entamoeba invadens
KKKFKNETKPRKIKTKSR

SEQ ID NO: 2872544 - protein, 34 aa, Entamoeba invadens
KKKGADGGITHPTTTPKKTTGYKKGSSSDFSMEE

SEQ ID NO: 2872545 - protein, 20 aa, Entamoeba invadens
KKKGFELDQTRKELGKEQKE

SEQ ID NO: 2872546 - protein, 11 aa, Entamoeba invadens
KKKGKNEGKNE

SEQ ID NO: 2872547 - protein, 13 aa, Entamoeba invadens
KKKGLKTQKQMDT

SEQ ID NO: 2872548 - protein, 20 aa, Entamoeba invadens
KKKGNKSKKEKKEKEEEEST

SEQ ID NO: 2872549 - protein, 9 aa, Entamoeba invadens
KKKGSSFSP

SEQ ID NO: 2872550 - protein, 5 aa, Entamoeba invadens
KKKGT

SEQ ID NO: 2872551 - protein, 14 aa, Entamoeba invadens
KKKGTFKIAPSTPL

SEQ ID NO: 2872552 - protein, 5 aa, Entamoeba invadens
KKKGV

SEQ ID NO: 2872553 - protein, 13 aa, Entamoeba invadens
KKKHAKPQNLYGA

SEQ ID NO: 2872554 - protein, 7 aa, Entamoeba invadens
KKKHISN

SEQ ID NO: 2872555 - protein, 6 aa, Entamoeba invadens
KKKIET

SEQ ID NO: 2872556 - protein, 9 aa, Entamoeba invadens
KKKIGESEI

SEQ ID NO: 2872557 - protein, 12 aa, Entamoeba invadens
KKKIKDKQYTYA

SEQ ID NO: 2872558 - protein, 11 aa, Entamoeba invadens
KKKKADEEKYL

SEQ ID NO: 2872559 - protein, 8 aa, Entamoeba invadens
KKKKAEQI

SEQ ID NO: 2872560 - protein, 7 aa, Entamoeba invadens
KKKKAEV

SEQ ID NO: 2872561 - protein, 70 aa, Entamoeba invadens
KKKKARDTVDDENKETKKTEPVKMEEETTSQSSEEERKDEGEEDNQKEKKAEVQSEEDEIQVPENENWEE

SEQ ID NO: 2872562 - protein, 12 aa, Entamoeba invadens
KKKKDQVKSEWK

SEQ ID NO: 2872563 - protein, 10 aa, Entamoeba invadens
KKKKEEESQT

SEQ ID NO: 2872564 - protein, 10 aa, Entamoeba invadens
KKKKEEYEEE

SEQ ID NO: 2872565 - protein, 6 aa, Entamoeba invadens
KKKKEI

SEQ ID NO: 2872566 - protein, 32 aa, Entamoeba invadens
KKKKERVGTPSTEKKPRGSSLSEEVKLEKGNT

SEQ ID NO: 2872567 - protein, 8 aa, Entamoeba invadens
KKKKETKL

SEQ ID NO: 2872568 - protein, 9 aa, Entamoeba invadens
KKKKKDQEK

SEQ ID NO: 2872569 - protein, 44 aa, Entamoeba invadens
KKKKLEIQNEDAGLKEKVENITQENEKLKKRVEENEKEKERITQ

SEQ ID NO: 2872570 - protein, 15 aa, Entamoeba invadens
KKKKQDDDNKKVRED

SEQ ID NO: 2872571 - protein, 14 aa, Entamoeba invadens
KKKKQGKKYTISYS

SEQ ID NO: 2872572 - protein, 6 aa, Entamoeba invadens
KKKKQI

SEQ ID NO: 2872573 - protein, 63 aa, Entamoeba invadens
KKKKSNLKKTDNENTTESTESKEMSEESNQEIAEEKGTKGEEAKQLKRSTLEPKKFKKPAKLS

SEQ ID NO: 2872574 - protein, 7 aa, Entamoeba invadens
KKKKSQI

SEQ ID NO: 2872575 - protein, 7 aa, Entamoeba invadens
KKKKTET

SEQ ID NO: 2872576 - protein, 19 aa, Entamoeba invadens
KKKKTKKVADKEWSKEEDR

SEQ ID NO: 2872577 - protein, 12 aa, Entamoeba invadens
KKKKTVSDQTIQ

SEQ ID NO: 2872578 - protein, 7 aa, Entamoeba invadens
KKKKVDI

SEQ ID NO: 2872579 - protein, 16 aa, Entamoeba invadens
KKKKVIEKKEKELEQR

SEQ ID NO: 2872580 - protein, 9 aa, Entamoeba invadens
KKKKVTDAM

SEQ ID NO: 2872581 - protein, 14 aa, Entamoeba invadens
KKKKYKEDKDNVAC

SEQ ID NO: 2872582 - protein, 9 aa, Entamoeba invadens
KKKMKEHKK

SEQ ID NO: 2872583 - protein, 9 aa, Entamoeba invadens
KKKMRVDKR

SEQ ID NO: 2872584 - protein, 10 aa, Entamoeba invadens
KKKMSGDEAL

SEQ ID NO: 2872585 - protein, 4 aa, Entamoeba invadens
KKKN

SEQ ID NO: 2872586 - protein, 8 aa, Entamoeba invadens
KKKNDQTI

SEQ ID NO: 2872587 - protein, 8 aa, Entamoeba invadens
KKKNEDRL

SEQ ID NO: 2872588 - protein, 10 aa, Entamoeba invadens
KKKNEKDLEE

SEQ ID NO: 2872589 - protein, 13 aa, Entamoeba invadens
KKKNKKGKTFDEE

SEQ ID NO: 2872590 - protein, 9 aa, Entamoeba invadens
KKKNLPSDV

SEQ ID NO: 2872591 - protein, 9 aa, Entamoeba invadens
KKKNPKGLE

SEQ ID NO: 2872592 - protein, 4 aa, Entamoeba invadens
KKKP

SEQ ID NO: 2872593 - protein, 6 aa, Entamoeba invadens
KKKPDV

SEQ ID NO: 2872594 - protein, 8 aa, Entamoeba invadens
KKKPENAW

SEQ ID NO: 2872595 - protein, 6 aa, Entamoeba invadens
KKKPFA

SEQ ID NO: 2872596 - protein, 16 aa, Entamoeba invadens
KKKPKELEEHVSAEDA

SEQ ID NO: 2872597 - protein, 21 aa, Entamoeba invadens
KKKPKTPREPNNTKVDAAKAN

SEQ ID NO: 2872598 - protein, 11 aa, Entamoeba invadens
KKKPMRKVRGN

SEQ ID NO: 2872599 - protein, 10 aa, Entamoeba invadens
KKKPSKSITL

SEQ ID NO: 2872600 - protein, 8 aa, Entamoeba invadens
KKKPSPNC

SEQ ID NO: 2872601 - protein, 17 aa, Entamoeba invadens
KKKPVTNAVVKTFFEQM

SEQ ID NO: 2872602 - protein, 8 aa, Entamoeba invadens
KKKQASYV

SEQ ID NO: 2872603 - protein, 14 aa, Entamoeba invadens
KKKQEELENERQAE

SEQ ID NO: 2872604 - protein, 13 aa, Entamoeba invadens
KKKQEGLESQAEE

SEQ ID NO: 2872605 - protein, 48 aa, Entamoeba invadens
KKKQIKPQISMENNSKKDINTSQVSDTKKVDGEQQEEQLNQNKEIPKN

SEQ ID NO: 2872606 - protein, 9 aa, Entamoeba invadens
KKKQKQFPQ

SEQ ID NO: 2872607 - protein, 6 aa, Entamoeba invadens
KKKQKV

SEQ ID NO: 2872608 - protein, 22 aa, Entamoeba invadens
KKKRESGPKKNTTPTKKNMKTT

SEQ ID NO: 2872609 - protein, 17 aa, Entamoeba invadens
KKKRKKEVKEEMSEENK

SEQ ID NO: 2872610 - protein, 7 aa, Entamoeba invadens
KKKRPGM

SEQ ID NO: 2872611 - protein, 5 aa, Entamoeba invadens
KKKRS

SEQ ID NO: 2872612 - protein, 7 aa, Entamoeba invadens
KKKRTFE

SEQ ID NO: 2872613 - protein, 7 aa, Entamoeba invadens
KKKRVDA

SEQ ID NO: 2872614 - protein, 8 aa, Entamoeba invadens
KKKRYNPE

SEQ ID NO: 2872615 - protein, 41 aa, Entamoeba invadens
KKKRYQPPLVGTQRKHPQFARKRNAKEKPANENTENEDKIK

SEQ ID NO: 2872616 - protein, 13 aa, Entamoeba invadens
KKKSCGIKRNMKF

SEQ ID NO: 2872617 - protein, 15 aa, Entamoeba invadens
KKKSEEDKMLEDERA

SEQ ID NO: 2872618 - protein, 14 aa, Entamoeba invadens
KKKSELKPKKITKN

SEQ ID NO: 2872619 - protein, 15 aa, Entamoeba invadens
KKKSEMKEKEKPIRV

SEQ ID NO: 2872620 - protein, 20 aa, Entamoeba invadens
KKKSEVNTSTISAASPQQNE

SEQ ID NO: 2872621 - protein, 17 aa, Entamoeba invadens
KKKSLDRQLEKNPELNK

SEQ ID NO: 2872622 - protein, 7 aa, Entamoeba invadens
KKKSNNI

SEQ ID NO: 2872623 - protein, 9 aa, Entamoeba invadens
KKKSPNSTF

SEQ ID NO: 2872624 - protein, 13 aa, Entamoeba invadens
KKKSSGEQNGRIG

SEQ ID NO: 2872625 - protein, 8 aa, Entamoeba invadens
KKKSTGEY

SEQ ID NO: 2872626 - protein, 23 aa, Entamoeba invadens
KKKSTKKSKKTNNTKSLNYETER

SEQ ID NO: 2872627 - protein, 8 aa, Entamoeba invadens
KKKSTQAL

SEQ ID NO: 2872628 - protein, 9 aa, Entamoeba invadens
KKKSYEERA

SEQ ID NO: 2872629 - protein, 8 aa, Entamoeba invadens
KKKTDKSW

SEQ ID NO: 2872630 - protein, 10 aa, Entamoeba invadens
KKKTEERKVR

SEQ ID NO: 2872631 - protein, 9 aa, Entamoeba invadens
KKKTENDAK

SEQ ID NO: 2872632 - protein, 9 aa, Entamoeba invadens
KKKTGSTLD

SEQ ID NO: 2872633 - protein, 10 aa, Entamoeba invadens
KKKTKNEPVS

SEQ ID NO: 2872634 - protein, 7 aa, Entamoeba invadens
KKKTLNP

SEQ ID NO: 2872635 - protein, 15 aa, Entamoeba invadens
KKKTLQRDIKEKEVQ

SEQ ID NO: 2872636 - protein, 8 aa, Entamoeba invadens
KKKTPKTL

SEQ ID NO: 2872637 - protein, 19 aa, Entamoeba invadens
KKKTSKQESNPVRIAECCR

SEQ ID NO: 2872638 - protein, 10 aa, Entamoeba invadens
KKKTTSARGG

SEQ ID NO: 2872639 - protein, 5 aa, Entamoeba invadens
KKKTY

SEQ ID NO: 2872640 - protein, 6 aa, Entamoeba invadens
KKKTYV

SEQ ID NO: 2872641 - protein, 9 aa, Entamoeba invadens
KKKVAKGTL

SEQ ID NO: 2872642 - protein, 7 aa, Entamoeba invadens
KKKVKTE

SEQ ID NO: 2872643 - protein, 4 aa, Entamoeba invadens
KKKY

SEQ ID NO: 2872644 - protein, 5 aa, Entamoeba invadens
KKKYD

SEQ ID NO: 2872645 - protein, 8 aa, Entamoeba invadens
KKKYEESY

SEQ ID NO: 2872646 - protein, 6 aa, Entamoeba invadens
KKKYEN

SEQ ID NO: 2872647 - protein, 12 aa, Entamoeba invadens
KKKYGVSVKLPW

SEQ ID NO: 2872648 - protein, 10 aa, Entamoeba invadens
KKKYKKPADV

SEQ ID NO: 2872649 - protein, 9 aa, Entamoeba invadens
KKKYKKSAD

SEQ ID NO: 2872650 - protein, 6 aa, Entamoeba invadens
KKKYNP

SEQ ID NO: 2872651 - protein, 9 aa, Entamoeba invadens
KKKYTKSAD

SEQ ID NO: 2872652 - protein, 6 aa, Entamoeba invadens
KKLAED

SEQ ID NO: 2872653 - protein, 7 aa, Entamoeba invadens
KKLARKY

SEQ ID NO: 2872654 - protein, 44 aa, Entamoeba invadens
KKLDDERKVKEAIEQERLAKEKAMKEEEARKMEEEKSEDERNQE

SEQ ID NO: 2872655 - protein, 6 aa, Entamoeba invadens
KKLDKT

SEQ ID NO: 2872656 - protein, 7 aa, Entamoeba invadens
KKLDNEE

SEQ ID NO: 2872657 - protein, 6 aa, Entamoeba invadens
KKLDTN

SEQ ID NO: 2872658 - protein, 13 aa, Entamoeba invadens
KKLEAEEDNLKDL

SEQ ID NO: 2872659 - protein, 28 aa, Entamoeba invadens
KKLEAEEDNPKDLETQLHEKEDDIADLE

SEQ ID NO: 2872660 - protein, 18 aa, Entamoeba invadens
KKLEAEKDNSKDLETQLH

SEQ ID NO: 2872661 - protein, 14 aa, Entamoeba invadens
KKLEAELKKKDQLI

SEQ ID NO: 2872662 - protein, 13 aa, Entamoeba invadens
KKLEDDALYGTTK

SEQ ID NO: 2872663 - protein, 6 aa, Entamoeba invadens
KKLEED

SEQ ID NO: 2872664 - protein, 7 aa, Entamoeba invadens
KKLEEER

SEQ ID NO: 2872665 - protein, 7 aa, Entamoeba invadens
KKLEENP

SEQ ID NO: 2872666 - protein, 10 aa, Entamoeba invadens
KKLEESQANI

SEQ ID NO: 2872667 - protein, 21 aa, Entamoeba invadens
KKLEGEAAKGGVKGMTAQNEL

SEQ ID NO: 2872668 - protein, 6 aa, Entamoeba invadens
KKLEGV

SEQ ID NO: 2872669 - protein, 7 aa, Entamoeba invadens
KKLENHP

SEQ ID NO: 2872670 - protein, 9 aa, Entamoeba invadens
KKLENTSIQ

SEQ ID NO: 2872671 - protein, 9 aa, Entamoeba invadens
KKLETEGVG

SEQ ID NO: 2872672 - protein, 7 aa, Entamoeba invadens
KKLETPN

SEQ ID NO: 2872673 - protein, 8 aa, Entamoeba invadens
KKLGDGGF

SEQ ID NO: 2872674 - protein, 7 aa, Entamoeba invadens
KKLGDSA

SEQ ID NO: 2872675 - protein, 13 aa, Entamoeba invadens
KKLGEETKLYSGS

SEQ ID NO: 2872676 - protein, 27 aa, Entamoeba invadens
KKLGEGKQNAFKSKLTRSCSGLNAQQN

SEQ ID NO: 2872677 - protein, 8 aa, Entamoeba invadens
KKLGEGSF

SEQ ID NO: 2872678 - protein, 6 aa, Entamoeba invadens
KKLGES

SEQ ID NO: 2872679 - protein, 8 aa, Entamoeba invadens
KKLGGGSF

SEQ ID NO: 2872680 - protein, 10 aa, Entamoeba invadens
KKLGKSQAKK

SEQ ID NO: 2872681 - protein, 12 aa, Entamoeba invadens
KKLGKTKGGKEV

SEQ ID NO: 2872682 - protein, 5 aa, Entamoeba invadens
KKLGL

SEQ ID NO: 2872683 - protein, 8 aa, Entamoeba invadens
KKLGPKKV

SEQ ID NO: 2872684 - protein, 7 aa, Entamoeba invadens
KKLGTIG

SEQ ID NO: 2872685 - protein, 14 aa, Entamoeba invadens
KKLKAENDEIKEEV

SEQ ID NO: 2872686 - protein, 13 aa, Entamoeba invadens
KKLKAENDEIKEK

SEQ ID NO: 2872687 - protein, 13 aa, Entamoeba invadens
KKLKDKKKEYNNQ

SEQ ID NO: 2872688 - protein, 5 aa, Entamoeba invadens
KKLKE

SEQ ID NO: 2872689 - protein, 9 aa, Entamoeba invadens
KKLKEYDKE

SEQ ID NO: 2872690 - protein, 9 aa, Entamoeba invadens
KKLKPSQIA

SEQ ID NO: 2872691 - protein, 8 aa, Entamoeba invadens
KKLKQTYN

SEQ ID NO: 2872692 - protein, 13 aa, Entamoeba invadens
KKLKTENDEIKEN

SEQ ID NO: 2872693 - protein, 13 aa, Entamoeba invadens
KKLKTENEEIKEN

SEQ ID NO: 2872694 - protein, 39 aa, Entamoeba invadens
KKLMKSTKSLKKSGTGSTSSSEVKALRTSRRGKVAKKMT

SEQ ID NO: 2872695 - protein, 8 aa, Entamoeba invadens
KKLNDQVK

SEQ ID NO: 2872696 - protein, 22 aa, Entamoeba invadens
KKLNEESKPFKSDSNSEKRYPK

SEQ ID NO: 2872697 - protein, 9 aa, Entamoeba invadens
KKLNESGEK

SEQ ID NO: 2872698 - protein, 10 aa, Entamoeba invadens
KKLNKSANVK

SEQ ID NO: 2872699 - protein, 10 aa, Entamoeba invadens
KKLPDEFKNS

SEQ ID NO: 2872700 - protein, 6 aa, Entamoeba invadens
KKLPFG

SEQ ID NO: 2872701 - protein, 7 aa, Entamoeba invadens
KKLPKEN

SEQ ID NO: 2872702 - protein, 9 aa, Entamoeba invadens
KKLPPKPNK

SEQ ID NO: 2872703 - protein, 9 aa, Entamoeba invadens
KKLPPPDGN

SEQ ID NO: 2872704 - protein, 13 aa, Entamoeba invadens
KKLPPSDQKGISP

SEQ ID NO: 2872705 - protein, 6 aa, Entamoeba invadens
KKLPQD

SEQ ID NO: 2872706 - protein, 6 aa, Entamoeba invadens
KKLPRN

SEQ ID NO: 2872707 - protein, 10 aa, Entamoeba invadens
KKLPSDAKKR

SEQ ID NO: 2872708 - protein, 37 aa, Entamoeba invadens
KKLPSRPQSVSPTPQNYSVPKKNPPLCPSKKPTKLPL

SEQ ID NO: 2872709 - protein, 43 aa, Entamoeba invadens
KKLQERNSQQETKGEPPLEQPVTKTQDQPVKEESSKQQEQPIE

SEQ ID NO: 2872710 - protein, 16 aa, Entamoeba invadens
KKLQKDRDADRKNKPK

SEQ ID NO: 2872711 - protein, 15 aa, Entamoeba invadens
KKLQKLEKNEEEDEK

SEQ ID NO: 2872712 - protein, 53 aa, Entamoeba invadens
KKLQNTISGVNAQNEDTGTKDKLEADAENTNGKKYVQEKQLSQLKADNDNLTK

SEQ ID NO: 2872713 - protein, 6 aa, Entamoeba invadens
KKLQQY

SEQ ID NO: 2872714 - protein, 6 aa, Entamoeba invadens
KKLSAG

SEQ ID NO: 2872715 - protein, 29 aa, Entamoeba invadens
KKLSDEINEKIARKKELKDDVENKRMELE

SEQ ID NO: 2872716 - protein, 6 aa, Entamoeba invadens
KKLSDG

SEQ ID NO: 2872717 - protein, 13 aa, Entamoeba invadens
KKLSEAKKEADHL

SEQ ID NO: 2872718 - protein, 8 aa, Entamoeba invadens
KKLSEESV

SEQ ID NO: 2872719 - protein, 5 aa, Entamoeba invadens
KKLSG

SEQ ID NO: 2872720 - protein, 9 aa, Entamoeba invadens
KKLSPPVDV

SEQ ID NO: 2872721 - protein, 12 aa, Entamoeba invadens
KKLSSEKKVQIQ

SEQ ID NO: 2872722 - protein, 8 aa, Entamoeba invadens
KKLSSNDI

SEQ ID NO: 2872723 - protein, 20 aa, Entamoeba invadens
KKLSTSTSTDEQKVINTSNE

SEQ ID NO: 2872724 - protein, 8 aa, Entamoeba invadens
KKLTEEIE

SEQ ID NO: 2872725 - protein, 7 aa, Entamoeba invadens
KKLTGDG

SEQ ID NO: 2872726 - protein, 12 aa, Entamoeba invadens
KKLTKEEQQIQN

SEQ ID NO: 2872727 - protein, 13 aa, Entamoeba invadens
KKLTPEDARASEI

SEQ ID NO: 2872728 - protein, 8 aa, Entamoeba invadens
KKLTQEEI

SEQ ID NO: 2872729 - protein, 18 aa, Entamoeba invadens
KKLVRNDKTSKIVTEKET

SEQ ID NO: 2872730 - protein, 13 aa, Entamoeba invadens
KKLVSQDEHKNTY

SEQ ID NO: 2872731 - protein, 25 aa, Entamoeba invadens
KKLYDSDEDGLTARSFNTKTCGKER

SEQ ID NO: 2872732 - protein, 12 aa, Entamoeba invadens
KKLYGENDTSEI

SEQ ID NO: 2872733 - protein, 53 aa, Entamoeba invadens
KKMDTSKTVQQKTQITTQQPQQIPTQTIPEPPKTTSRKGKEPLSKSRPHPLKR

SEQ ID NO: 2872734 - protein, 46 aa, Entamoeba invadens
KKMEEEKKRKQEELEKKKQEEIERKAAEEQKRKEEEELKKKEQEEL

SEQ ID NO: 2872735 - protein, 10 aa, Entamoeba invadens
KKMEEEPQKV

SEQ ID NO: 2872736 - protein, 7 aa, Entamoeba invadens
KKMEMNS

SEQ ID NO: 2872737 - protein, 7 aa, Entamoeba invadens
KKMERGT

SEQ ID NO: 2872738 - protein, 16 aa, Entamoeba invadens
KKMETEPSHEDHEHTC

SEQ ID NO: 2872739 - protein, 14 aa, Entamoeba invadens
KKMGQQEKRENLKI

SEQ ID NO: 2872740 - protein, 5 aa, Entamoeba invadens
KKMKD

SEQ ID NO: 2872741 - protein, 5 aa, Entamoeba invadens
KKMKV

SEQ ID NO: 2872742 - protein, 5 aa, Entamoeba invadens
KKMMS

SEQ ID NO: 2872743 - protein, 6 aa, Entamoeba invadens
KKMNTL

SEQ ID NO: 2872744 - protein, 7 aa, Entamoeba invadens
KKMQTRK

SEQ ID NO: 2872745 - protein, 17 aa, Entamoeba invadens
KKMSASTEQFNTRNREV

SEQ ID NO: 2872746 - protein, 11 aa, Entamoeba invadens
KKMSRNTAHKR

SEQ ID NO: 2872747 - protein, 8 aa, Entamoeba invadens
KKMSTYSK

SEQ ID NO: 2872748 - protein, 6 aa, Entamoeba invadens
KKMTEP

SEQ ID NO: 2872749 - protein, 7 aa, Entamoeba invadens
KKMTKAE

SEQ ID NO: 2872750 - protein, 8 aa, Entamoeba invadens
KKMTQEES

SEQ ID NO: 2872751 - protein, 5 aa, Entamoeba invadens
KKMTV

SEQ ID NO: 2872752 - protein, 13 aa, Entamoeba invadens
KKMYSRKEEKEKL

SEQ ID NO: 2872753 - protein, 9 aa, Entamoeba invadens
KKNAEDVSE

SEQ ID NO: 2872754 - protein, 6 aa, Entamoeba invadens
KKNAEL

SEQ ID NO: 2872755 - protein, 19 aa, Entamoeba invadens
KKNAETKTKSNENSTEEES

SEQ ID NO: 2872756 - protein, 6 aa, Entamoeba invadens
KKNAGV

SEQ ID NO: 2872757 - protein, 7 aa, Entamoeba invadens
KKNAIEN

SEQ ID NO: 2872758 - protein, 8 aa, Entamoeba invadens
KKNAIGES

SEQ ID NO: 2872759 - protein, 8 aa, Entamoeba invadens
KKNAIRGI

SEQ ID NO: 2872760 - protein, 10 aa, Entamoeba invadens
KKNAKKVNTL

SEQ ID NO: 2872761 - protein, 8 aa, Entamoeba invadens
KKNARQKL

SEQ ID NO: 2872762 - protein, 32 aa, Entamoeba invadens
KKNAVAAAPVATDDKADAGKKKKDKKKTNCTM

SEQ ID NO: 2872763 - protein, 4 aa, Entamoeba invadens
KKNC

SEQ ID NO: 2872764 - protein, 7 aa, Entamoeba invadens
KKNCEDG

SEQ ID NO: 2872765 - protein, 6 aa, Entamoeba invadens
KKNDAD

SEQ ID NO: 2872766 - protein, 8 aa, Entamoeba invadens
KKNDDETL

SEQ ID NO: 2872767 - protein, 11 aa, Entamoeba invadens
KKNDGMKRKEE

SEQ ID NO: 2872768 - protein, 8 aa, Entamoeba invadens
KKNDGSEY

SEQ ID NO: 2872769 - protein, 6 aa, Entamoeba invadens
KKNDKG

SEQ ID NO: 2872770 - protein, 7 aa, Entamoeba invadens
KKNDKTL

SEQ ID NO: 2872771 - protein, 6 aa, Entamoeba invadens
KKNDPM

SEQ ID NO: 2872772 - protein, 6 aa, Entamoeba invadens
KKNDWD

SEQ ID NO: 2872773 - protein, 4 aa, Entamoeba invadens
KKNE

SEQ ID NO: 2872774 - protein, 5 aa, Entamoeba invadens
KKNEC

SEQ ID NO: 2872775 - protein, 19 aa, Entamoeba invadens
KKNEEEKEKAPGYISTGPV

SEQ ID NO: 2872776 - protein, 20 aa, Entamoeba invadens
KKNEEGQEQKAKEQTSPATI

SEQ ID NO: 2872777 - protein, 21 aa, Entamoeba invadens
KKNEEIDDGSTFCDEDEMGSF

SEQ ID NO: 2872778 - protein, 6 aa, Entamoeba invadens
KKNEIE

SEQ ID NO: 2872779 - protein, 9 aa, Entamoeba invadens
KKNEKEKEC

SEQ ID NO: 2872780 - protein, 13 aa, Entamoeba invadens
KKNEKIDAPKPIK

SEQ ID NO: 2872781 - protein, 20 aa, Entamoeba invadens
KKNELGRVSDQQKQNETSLT

SEQ ID NO: 2872782 - protein, 27 aa, Entamoeba invadens
KKNENTPKEEKGDEKKKIGKTYGSDDV

SEQ ID NO: 2872783 - protein, 6 aa, Entamoeba invadens
KKNEPT

SEQ ID NO: 2872784 - protein, 10 aa, Entamoeba invadens
KKNESLGTKK

SEQ ID NO: 2872785 - protein, 7 aa, Entamoeba invadens
KKNESVH

SEQ ID NO: 2872786 - protein, 5 aa, Entamoeba invadens
KKNEV

SEQ ID NO: 2872787 - protein, 4 aa, Entamoeba invadens
KKNF

SEQ ID NO: 2872788 - protein, 5 aa, Entamoeba invadens
KKNFE

SEQ ID NO: 2872789 - protein, 10 aa, Entamoeba invadens
KKNGAEKDVK

SEQ ID NO: 2872790 - protein, 6 aa, Entamoeba invadens
KKNGDL

SEQ ID NO: 2872791 - protein, 10 aa, Entamoeba invadens
KKNGKDGYKE

SEQ ID NO: 2872792 - protein, 5 aa, Entamoeba invadens
KKNGN

SEQ ID NO: 2872793 - protein, 6 aa, Entamoeba invadens
KKNGNG

SEQ ID NO: 2872794 - protein, 8 aa, Entamoeba invadens
KKNGNGES

SEQ ID NO: 2872795 - protein, 7 aa, Entamoeba invadens
KKNGTKR

SEQ ID NO: 2872796 - protein, 6 aa, Entamoeba invadens
KKNGVE

SEQ ID NO: 2872797 - protein, 9 aa, Entamoeba invadens
KKNIKGGTI

SEQ ID NO: 2872798 - protein, 7 aa, Entamoeba invadens
KKNIKTT

SEQ ID NO: 2872799 - protein, 9 aa, Entamoeba invadens
KKNISNPKD

SEQ ID NO: 2872800 - protein, 14 aa, Entamoeba invadens
KKNITTLPDKTTLD

SEQ ID NO: 2872801 - protein, 6 aa, Entamoeba invadens
KKNIYE

SEQ ID NO: 2872802 - protein, 10 aa, Entamoeba invadens
KKNKASKNLH

SEQ ID NO: 2872803 - protein, 8 aa, Entamoeba invadens
KKNKDNVI

SEQ ID NO: 2872804 - protein, 8 aa, Entamoeba invadens
KKNKDVSD

SEQ ID NO: 2872805 - protein, 10 aa, Entamoeba invadens
KKNKEDIPVN

SEQ ID NO: 2872806 - protein, 8 aa, Entamoeba invadens
KKNKEPNC

SEQ ID NO: 2872807 - protein, 6 aa, Entamoeba invadens
KKNKHK

SEQ ID NO: 2872808 - protein, 5 aa, Entamoeba invadens
KKNKI

SEQ ID NO: 2872809 - protein, 22 aa, Entamoeba invadens
KKNKKAAKNKKGQYDSSSPSEF

SEQ ID NO: 2872810 - protein, 9 aa, Entamoeba invadens
KKNKKAKCE

SEQ ID NO: 2872811 - protein, 43 aa, Entamoeba invadens
KKNKKTKIEENENQEEINSHNLEDEKIENPQNEKTEKEEENLA

SEQ ID NO: 2872812 - protein, 10 aa, Entamoeba invadens
KKNKLKSQEE

SEQ ID NO: 2872813 - protein, 33 aa, Entamoeba invadens
KKNKNQGEKDGKSTPYPSSGYGEIDEGLSPLGN

SEQ ID NO: 2872814 - protein, 9 aa, Entamoeba invadens
KKNKSEWNG

SEQ ID NO: 2872815 - protein, 29 aa, Entamoeba invadens
KKNKTQSGTRTGFTRKKEVVKDQELSTLG

SEQ ID NO: 2872816 - protein, 9 aa, Entamoeba invadens
KKNLGSEKR

SEQ ID NO: 2872817 - protein, 10 aa, Entamoeba invadens
KKNMDAETKR

SEQ ID NO: 2872818 - protein, 11 aa, Entamoeba invadens
KKNNDEQRSKR

SEQ ID NO: 2872819 - protein, 9 aa, Entamoeba invadens
KKNNDQRAV

SEQ ID NO: 2872820 - protein, 8 aa, Entamoeba invadens
KKNNEKIN

SEQ ID NO: 2872821 - protein, 7 aa, Entamoeba invadens
KKNNQHD

SEQ ID NO: 2872822 - protein, 8 aa, Entamoeba invadens
KKNPKEIK

SEQ ID NO: 2872823 - protein, 9 aa, Entamoeba invadens
KKNPQSPLY

SEQ ID NO: 2872824 - protein, 7 aa, Entamoeba invadens
KKNPVAS

SEQ ID NO: 2872825 - protein, 10 aa, Entamoeba invadens
KKNPVEPDLP

SEQ ID NO: 2872826 - protein, 16 aa, Entamoeba invadens
KKNQKLKDSIEKDEVT

SEQ ID NO: 2872827 - protein, 6 aa, Entamoeba invadens
KKNQKQ

SEQ ID NO: 2872828 - protein, 7 aa, Entamoeba invadens
KKNQRLR

SEQ ID NO: 2872829 - protein, 9 aa, Entamoeba invadens
KKNRENRKA

SEQ ID NO: 2872830 - protein, 17 aa, Entamoeba invadens
KKNRMSMGTQRKSEAQQ

SEQ ID NO: 2872831 - protein, 6 aa, Entamoeba invadens
KKNRRC

SEQ ID NO: 2872832 - protein, 15 aa, Entamoeba invadens
KKNRSASVSAKAVEP

SEQ ID NO: 2872833 - protein, 6 aa, Entamoeba invadens
KKNRSL

SEQ ID NO: 2872834 - protein, 6 aa, Entamoeba invadens
KKNRVT

SEQ ID NO: 2872835 - protein, 6 aa, Entamoeba invadens
KKNSFR

SEQ ID NO: 2872836 - protein, 10 aa, Entamoeba invadens
KKNSFSDGTL

SEQ ID NO: 2872837 - protein, 8 aa, Entamoeba invadens
KKNSKKAM

SEQ ID NO: 2872838 - protein, 13 aa, Entamoeba invadens
KKNSKRKKQTKKK

SEQ ID NO: 2872839 - protein, 5 aa, Entamoeba invadens
KKNSN

SEQ ID NO: 2872840 - protein, 18 aa, Entamoeba invadens
KKNSQDNITAIVVKLSKD

SEQ ID NO: 2872841 - protein, 9 aa, Entamoeba invadens
KKNSQSGAD

SEQ ID NO: 2872842 - protein, 8 aa, Entamoeba invadens
KKNSSGSH

SEQ ID NO: 2872843 - protein, 32 aa, Entamoeba invadens
KKNSTKSTIPQTHSAPIKSAPMISTKASDEVL

SEQ ID NO: 2872844 - protein, 11 aa, Entamoeba invadens
KKNSYGYSRDD

SEQ ID NO: 2872845 - protein, 6 aa, Entamoeba invadens
KKNTHA

SEQ ID NO: 2872846 - protein, 19 aa, Entamoeba invadens
KKNTKEKKEVTKPKPAGAN

SEQ ID NO: 2872847 - protein, 6 aa, Entamoeba invadens
KKNTLQ

SEQ ID NO: 2872848 - protein, 14 aa, Entamoeba invadens
KKNTNENSKAIPNE

SEQ ID NO: 2872849 - protein, 7 aa, Entamoeba invadens
KKNTNTL

SEQ ID NO: 2872850 - protein, 6 aa, Entamoeba invadens
KKNTQI

SEQ ID NO: 2872851 - protein, 6 aa, Entamoeba invadens
KKNTTI

SEQ ID NO: 2872852 - protein, 10 aa, Entamoeba invadens
KKNTTQEHPD

SEQ ID NO: 2872853 - protein, 9 aa, Entamoeba invadens
KKNVDRNRS

SEQ ID NO: 2872854 - protein, 11 aa, Entamoeba invadens
KKNVKNALEKN

SEQ ID NO: 2872855 - protein, 8 aa, Entamoeba invadens
KKNVSPNS

SEQ ID NO: 2872856 - protein, 5 aa, Entamoeba invadens
KKNVT

SEQ ID NO: 2872857 - protein, 6 aa, Entamoeba invadens
KKNVTS

SEQ ID NO: 2872858 - protein, 6 aa, Entamoeba invadens
KKNWPK

SEQ ID NO: 2872859 - protein, 18 aa, Entamoeba invadens
KKNYKRTSQISPINMKDI

SEQ ID NO: 2872860 - protein, 7 aa, Entamoeba invadens
KKNYVES

SEQ ID NO: 2872861 - protein, 7 aa, Entamoeba invadens
KKPAEEL

SEQ ID NO: 2872862 - protein, 8 aa, Entamoeba invadens
KKPANLSD

SEQ ID NO: 2872863 - protein, 10 aa, Entamoeba invadens
KKPAQTDGEP

SEQ ID NO: 2872864 - protein, 7 aa, Entamoeba invadens
KKPATGS

SEQ ID NO: 2872865 - protein, 7 aa, Entamoeba invadens
KKPDDFR

SEQ ID NO: 2872866 - protein, 7 aa, Entamoeba invadens
KKPDDYD

SEQ ID NO: 2872867 - protein, 7 aa, Entamoeba invadens
KKPDFSP

SEQ ID NO: 2872868 - protein, 6 aa, Entamoeba invadens
KKPDSF

SEQ ID NO: 2872869 - protein, 7 aa, Entamoeba invadens
KKPDYDT

SEQ ID NO: 2872870 - protein, 10 aa, Entamoeba invadens
KKPEDVTKDF

SEQ ID NO: 2872871 - protein, 6 aa, Entamoeba invadens
KKPEEL

SEQ ID NO: 2872872 - protein, 17 aa, Entamoeba invadens
KKPEKNAYLVSKMKDSL

SEQ ID NO: 2872873 - protein, 6 aa, Entamoeba invadens
KKPELM

SEQ ID NO: 2872874 - protein, 6 aa, Entamoeba invadens
KKPENF

SEQ ID NO: 2872875 - protein, 10 aa, Entamoeba invadens
KKPENVDETK

SEQ ID NO: 2872876 - protein, 9 aa, Entamoeba invadens
KKPESKPSV

SEQ ID NO: 2872877 - protein, 10 aa, Entamoeba invadens
KKPESKQLGL

SEQ ID NO: 2872878 - protein, 15 aa, Entamoeba invadens
KKPETVTDEERRRAK

SEQ ID NO: 2872879 - protein, 7 aa, Entamoeba invadens
KKPFGGM

SEQ ID NO: 2872880 - protein, 8 aa, Entamoeba invadens
KKPFSSLP

SEQ ID NO: 2872881 - protein, 4 aa, Entamoeba invadens
KKPG

SEQ ID NO: 2872882 - protein, 8 aa, Entamoeba invadens
KKPGCSGR

SEQ ID NO: 2872883 - protein, 6 aa, Entamoeba invadens
KKPGEI

SEQ ID NO: 2872884 - protein, 8 aa, Entamoeba invadens
KKPIEGRS

SEQ ID NO: 2872885 - protein, 8 aa, Entamoeba invadens
KKPIEKMN

SEQ ID NO: 2872886 - protein, 7 aa, Entamoeba invadens
KKPIEKT

SEQ ID NO: 2872887 - protein, 6 aa, Entamoeba invadens
KKPIGG

SEQ ID NO: 2872888 - protein, 6 aa, Entamoeba invadens
KKPISK

SEQ ID NO: 2872889 - protein, 40 aa, Entamoeba invadens
KKPISNGKPFYSKKQETKPKTMVRTQNTDLKKKENSTFDD

SEQ ID NO: 2872890 - protein, 8 aa, Entamoeba invadens
KKPKDEAY

SEQ ID NO: 2872891 - protein, 8 aa, Entamoeba invadens
KKPKEEEF

SEQ ID NO: 2872892 - protein, 57 aa, Entamoeba invadens
KKPKESKEEKEAKEKEKKEKKEKEKEKKRRSKRVSTSFDAKQNGTPVITTNPPQALL

SEQ ID NO: 2872893 - protein, 25 aa, Entamoeba invadens
KKPKITQRGRCQQYGHNKQTCPTIK

SEQ ID NO: 2872894 - protein, 8 aa, Entamoeba invadens
KKPKKEEI

SEQ ID NO: 2872895 - protein, 19 aa, Entamoeba invadens
KKPKPIKARSKQTKRKYTR

SEQ ID NO: 2872896 - protein, 22 aa, Entamoeba invadens
KKPKQQKKNEESVKKKKSKKDI

SEQ ID NO: 2872897 - protein, 9 aa, Entamoeba invadens
KKPKVAPNN

SEQ ID NO: 2872898 - protein, 14 aa, Entamoeba invadens
KKPLSQVAEEKGHM

SEQ ID NO: 2872899 - protein, 7 aa, Entamoeba invadens
KKPLSRA

SEQ ID NO: 2872900 - protein, 8 aa, Entamoeba invadens
KKPNCKGK

SEQ ID NO: 2872901 - protein, 13 aa, Entamoeba invadens
KKPNNRIQRVANG

SEQ ID NO: 2872902 - protein, 20 aa, Entamoeba invadens
KKPNPFGEDSDEEDNKQLTT

SEQ ID NO: 2872903 - protein, 5 aa, Entamoeba invadens
KKPNY

SEQ ID NO: 2872904 - protein, 7 aa, Entamoeba invadens
KKPPHPP

SEQ ID NO: 2872905 - protein, 8 aa, Entamoeba invadens
KKPPQTYK

SEQ ID NO: 2872906 - protein, 8 aa, Entamoeba invadens
KKPPTFET

SEQ ID NO: 2872907 - protein, 4 aa, Entamoeba invadens
KKPQ

SEQ ID NO: 2872908 - protein, 15 aa, Entamoeba invadens
KKPQINGENSLTDPF

SEQ ID NO: 2872909 - protein, 12 aa, Entamoeba invadens
KKPQKPLPPLPT

SEQ ID NO: 2872910 - protein, 8 aa, Entamoeba invadens
KKPQTDKQ

SEQ ID NO: 2872911 - protein, 25 aa, Entamoeba invadens
KKPRIEGDNDYDGHRSPKPFSERPI

SEQ ID NO: 2872912 - protein, 10 aa, Entamoeba invadens
KKPRKATKVT

SEQ ID NO: 2872913 - protein, 15 aa, Entamoeba invadens
KKPRMTDEKKKVRDK

SEQ ID NO: 2872914 - protein, 6 aa, Entamoeba invadens
KKPSFP

SEQ ID NO: 2872915 - protein, 7 aa, Entamoeba invadens
KKPSKTN

SEQ ID NO: 2872916 - protein, 10 aa, Entamoeba invadens
KKPSRRSSVT

SEQ ID NO: 2872917 - protein, 12 aa, Entamoeba invadens
KKPSTKRKSLST

SEQ ID NO: 2872918 - protein, 7 aa, Entamoeba invadens
KKPTEEE

SEQ ID NO: 2872919 - protein, 6 aa, Entamoeba invadens
KKPTGD

SEQ ID NO: 2872920 - protein, 6 aa, Entamoeba invadens
KKPTGE

SEQ ID NO: 2872921 - protein, 5 aa, Entamoeba invadens
KKPTI

SEQ ID NO: 2872922 - protein, 6 aa, Entamoeba invadens
KKPTKV

SEQ ID NO: 2872923 - protein, 7 aa, Entamoeba invadens
KKPTNNE

SEQ ID NO: 2872924 - protein, 17 aa, Entamoeba invadens
KKPTTEAEKDRMKELQE

SEQ ID NO: 2872925 - protein, 9 aa, Entamoeba invadens
KKPTTTELK

SEQ ID NO: 2872926 - protein, 6 aa, Entamoeba invadens
KKPVDA

SEQ ID NO: 2872927 - protein, 12 aa, Entamoeba invadens
KKPVKYTSSSLD

SEQ ID NO: 2872928 - protein, 5 aa, Entamoeba invadens
KKPVV

SEQ ID NO: 2872929 - protein, 5 aa, Entamoeba invadens
KKQAV

SEQ ID NO: 2872930 - protein, 8 aa, Entamoeba invadens
KKQCDSEF

SEQ ID NO: 2872931 - protein, 23 aa, Entamoeba invadens
KKQDKKDIVASKSMDPDFFIKYK

SEQ ID NO: 2872932 - protein, 11 aa, Entamoeba invadens
KKQDTDEKAEM

SEQ ID NO: 2872933 - protein, 12 aa, Entamoeba invadens
KKQEASLKQKSI

SEQ ID NO: 2872934 - protein, 8 aa, Entamoeba invadens
KKQEDEKE

SEQ ID NO: 2872935 - protein, 15 aa, Entamoeba invadens
KKQEETGNYPTTSEH

SEQ ID NO: 2872936 - protein, 9 aa, Entamoeba invadens
KKQEGTPVV

SEQ ID NO: 2872937 - protein, 25 aa, Entamoeba invadens
KKQENLKENIEAKKDSKDVQSSPRV

SEQ ID NO: 2872938 - protein, 8 aa, Entamoeba invadens
KKQERHDR

SEQ ID NO: 2872939 - protein, 9 aa, Entamoeba invadens
KKQGGAVKT

SEQ ID NO: 2872940 - protein, 9 aa, Entamoeba invadens
KKQGGSVKS

SEQ ID NO: 2872941 - protein, 9 aa, Entamoeba invadens
KKQGMKEED

SEQ ID NO: 2872942 - protein, 17 aa, Entamoeba invadens
KKQGQQPPKVRTRVDKD

SEQ ID NO: 2872943 - protein, 4 aa, Entamoeba invadens
KKQI

SEQ ID NO: 2872944 - protein, 7 aa, Entamoeba invadens
KKQIEEK

SEQ ID NO: 2872945 - protein, 24 aa, Entamoeba invadens
KKQITSQLNQPQPQAMELEDDPIE

SEQ ID NO: 2872946 - protein, 59 aa, Entamoeba invadens
KKQKAQKEKKSETKIKTSTKPIKKNKSETTINQKKKMTKKDLSDDGTLSTDKGGEKMKN

SEQ ID NO: 2872947 - protein, 7 aa, Entamoeba invadens
KKQKDVL

SEQ ID NO: 2872948 - protein, 9 aa, Entamoeba invadens
KKQKGDKIK

SEQ ID NO: 2872949 - protein, 8 aa, Entamoeba invadens
KKQKGPDL

SEQ ID NO: 2872950 - protein, 13 aa, Entamoeba invadens
KKQKKENQSDDGM

SEQ ID NO: 2872951 - protein, 21 aa, Entamoeba invadens
KKQKKSVSSKPKMGQPQPQVP

SEQ ID NO: 2872952 - protein, 10 aa, Entamoeba invadens
KKQKSLPEQF

SEQ ID NO: 2872953 - protein, 8 aa, Entamoeba invadens
KKQKSQTR

SEQ ID NO: 2872954 - protein, 6 aa, Entamoeba invadens
KKQKVE

SEQ ID NO: 2872955 - protein, 7 aa, Entamoeba invadens
KKQLGRK

SEQ ID NO: 2872956 - protein, 28 aa, Entamoeba invadens
KKQLSKSGSVPAKKNEEKKDDKKKDKKK

SEQ ID NO: 2872957 - protein, 21 aa, Entamoeba invadens
KKQMENDVANGISSKTALRRY

SEQ ID NO: 2872958 - protein, 4 aa, Entamoeba invadens
KKQN

SEQ ID NO: 2872959 - protein, 10 aa, Entamoeba invadens
KKQNDQEVSQ

SEQ ID NO: 2872960 - protein, 35 aa, Entamoeba invadens
KKQNEKGKVKKERTKTEKEGQMEQKGSTEIGANDN

SEQ ID NO: 2872961 - protein, 7 aa, Entamoeba invadens
KKQNHVT

SEQ ID NO: 2872962 - protein, 10 aa, Entamoeba invadens
KKQNQEKCEK

SEQ ID NO: 2872963 - protein, 11 aa, Entamoeba invadens
KKQNRVDSERE

SEQ ID NO: 2872964 - protein, 17 aa, Entamoeba invadens
KKQNTDLTAKNQELTNT

SEQ ID NO: 2872965 - protein, 9 aa, Entamoeba invadens
KKQNVQKAT

SEQ ID NO: 2872966 - protein, 7 aa, Entamoeba invadens
KKQPSVE

SEQ ID NO: 2872967 - protein, 11 aa, Entamoeba invadens
KKQQEARNLQS

SEQ ID NO: 2872968 - protein, 45 aa, Entamoeba invadens
KKQQEIAQKALDEKKRLEDLNKTQQEKYTALEKTTQELLSPRQQN

SEQ ID NO: 2872969 - protein, 5 aa, Entamoeba invadens
KKQQI

SEQ ID NO: 2872970 - protein, 6 aa, Entamoeba invadens
KKQQKM

SEQ ID NO: 2872971 - protein, 13 aa, Entamoeba invadens
KKQQKWENNINPY

SEQ ID NO: 2872972 - protein, 6 aa, Entamoeba invadens
KKQQSI

SEQ ID NO: 2872973 - protein, 21 aa, Entamoeba invadens
KKQQTRATGFRKEGFKRPNVI

SEQ ID NO: 2872974 - protein, 11 aa, Entamoeba invadens
KKQRESEFKKE

SEQ ID NO: 2872975 - protein, 16 aa, Entamoeba invadens
KKQRKHTPIRPLSASQ

SEQ ID NO: 2872976 - protein, 19 aa, Entamoeba invadens
KKQRKYSEYEQSLSTKGRL

SEQ ID NO: 2872977 - protein, 7 aa, Entamoeba invadens
KKQRTIT

SEQ ID NO: 2872978 - protein, 16 aa, Entamoeba invadens
KKQSAESSVYSKEVSD

SEQ ID NO: 2872979 - protein, 10 aa, Entamoeba invadens
KKQSFQRAKN

SEQ ID NO: 2872980 - protein, 7 aa, Entamoeba invadens
KKQSTGP

SEQ ID NO: 2872981 - protein, 6 aa, Entamoeba invadens
KKQSVN

SEQ ID NO: 2872982 - protein, 9 aa, Entamoeba invadens
KKQTEETKD

SEQ ID NO: 2872983 - protein, 10 aa, Entamoeba invadens
KKQTERPRAL

SEQ ID NO: 2872984 - protein, 10 aa, Entamoeba invadens
KKQTETPENC

SEQ ID NO: 2872985 - protein, 14 aa, Entamoeba invadens
KKQTKTIFDFFEIQ

SEQ ID NO: 2872986 - protein, 14 aa, Entamoeba invadens
KKQTLRPQQISKGK

SEQ ID NO: 2872987 - protein, 8 aa, Entamoeba invadens
KKQTNDTL

SEQ ID NO: 2872988 - protein, 9 aa, Entamoeba invadens
KKQTRFGYE

SEQ ID NO: 2872989 - protein, 33 aa, Entamoeba invadens
KKQTRKARMSIGGQPQLNEKPKLSSHSKSDLKS

SEQ ID NO: 2872990 - protein, 7 aa, Entamoeba invadens
KKQTRLD

SEQ ID NO: 2872991 - protein, 7 aa, Entamoeba invadens
KKQTSEA

SEQ ID NO: 2872992 - protein, 7 aa, Entamoeba invadens
KKQTSTV

SEQ ID NO: 2872993 - protein, 6 aa, Entamoeba invadens
KKQTTQ

SEQ ID NO: 2872994 - protein, 16 aa, Entamoeba invadens
KKQTTTQERNKSQISD

SEQ ID NO: 2872995 - protein, 14 aa, Entamoeba invadens
KKQVEADKKDKQRY

SEQ ID NO: 2872996 - protein, 8 aa, Entamoeba invadens
KKQVEDQD

SEQ ID NO: 2872997 - protein, 8 aa, Entamoeba invadens
KKQVTPME

SEQ ID NO: 2872998 - protein, 19 aa, Entamoeba invadens
KKQYNAEKHDAEENAEEAM

SEQ ID NO: 2872999 - protein, 7 aa, Entamoeba invadens
KKRADDF

SEQ ID NO: 2873000 - protein, 9 aa, Entamoeba invadens
KKRADDRKE

SEQ ID NO: 2873001 - protein, 5 aa, Entamoeba invadens
KKRAL

SEQ ID NO: 2873002 - protein, 17 aa, Entamoeba invadens
KKRANKVEKIVPRKFVC

SEQ ID NO: 2873003 - protein, 7 aa, Entamoeba invadens
KKRASTV

SEQ ID NO: 2873004 - protein, 32 aa, Entamoeba invadens
KKRATKPTRRDDGTIKKVRRGTRGNTKQRKIR

SEQ ID NO: 2873005 - protein, 7 aa, Entamoeba invadens
KKRDDTF

SEQ ID NO: 2873006 - protein, 7 aa, Entamoeba invadens
KKRDGTL

SEQ ID NO: 2873007 - protein, 12 aa, Entamoeba invadens
KKREDELTRENI

SEQ ID NO: 2873008 - protein, 21 aa, Entamoeba invadens
KKREERKDREDNNNDRTRRRK

SEQ ID NO: 2873009 - protein, 20 aa, Entamoeba invadens
KKREERRQAEREKRRRDNEL

SEQ ID NO: 2873010 - protein, 8 aa, Entamoeba invadens
KKREINKG

SEQ ID NO: 2873011 - protein, 21 aa, Entamoeba invadens
KKREIQKAEKLQKKKERDQIT

SEQ ID NO: 2873012 - protein, 10 aa, Entamoeba invadens
KKRENEEKFR

SEQ ID NO: 2873013 - protein, 18 aa, Entamoeba invadens
KKRERGDFYQPSPKRYYT

SEQ ID NO: 2873014 - protein, 14 aa, Entamoeba invadens
KKRERSRSRERSDN

SEQ ID NO: 2873015 - protein, 6 aa, Entamoeba invadens
KKRESV

SEQ ID NO: 2873016 - protein, 7 aa, Entamoeba invadens
KKRETED

SEQ ID NO: 2873017 - protein, 8 aa, Entamoeba invadens
KKRETINQ

SEQ ID NO: 2873018 - protein, 6 aa, Entamoeba invadens
KKREVS

SEQ ID NO: 2873019 - protein, 4 aa, Entamoeba invadens
KKRG

SEQ ID NO: 2873020 - protein, 5 aa, Entamoeba invadens
KKRGH

SEQ ID NO: 2873021 - protein, 13 aa, Entamoeba invadens
KKRGRKDTLKTEH

SEQ ID NO: 2873022 - protein, 15 aa, Entamoeba invadens
KKRGTFGKKVTPHVD

SEQ ID NO: 2873023 - protein, 9 aa, Entamoeba invadens
KKRGTRGSK

SEQ ID NO: 2873024 - protein, 8 aa, Entamoeba invadens
KKRGYMDG

SEQ ID NO: 2873025 - protein, 6 aa, Entamoeba invadens
KKRHIG

SEQ ID NO: 2873026 - protein, 6 aa, Entamoeba invadens
KKRHQL

SEQ ID NO: 2873027 - protein, 13 aa, Entamoeba invadens
KKRHQTKSTKTSH

SEQ ID NO: 2873028 - protein, 13 aa, Entamoeba invadens
KKRKADTSRRKEE

SEQ ID NO: 2873029 - protein, 9 aa, Entamoeba invadens
KKRKARPLD

SEQ ID NO: 2873030 - protein, 11 aa, Entamoeba invadens
KKRKDSFDPLR

SEQ ID NO: 2873031 - protein, 7 aa, Entamoeba invadens
KKRKEIE

SEQ ID NO: 2873032 - protein, 44 aa, Entamoeba invadens
KKRKESEDLSEMSDSSSTAAASEVQERGNSHNSTEEKRVYRPRA

SEQ ID NO: 2873033 - protein, 19 aa, Entamoeba invadens
KKRKESKNDADKVEWTPEE

SEQ ID NO: 2873034 - protein, 10 aa, Entamoeba invadens
KKRKGLESGS

SEQ ID NO: 2873035 - protein, 27 aa, Entamoeba invadens
KKRKHQMSKASRSHSKKSTSKTQEVEA

SEQ ID NO: 2873036 - protein, 15 aa, Entamoeba invadens
KKRKHVSRKLSKNNP

SEQ ID NO: 2873037 - protein, 10 aa, Entamoeba invadens
KKRKKGGFGL

SEQ ID NO: 2873038 - protein, 9 aa, Entamoeba invadens
KKRKTNRKK

SEQ ID NO: 2873039 - protein, 5 aa, Entamoeba invadens
KKRLP

SEQ ID NO: 2873040 - protein, 15 aa, Entamoeba invadens
KKRLTDEELSRLVGH

SEQ ID NO: 2873041 - protein, 14 aa, Entamoeba invadens
KKRMDEEQKRKDIA

SEQ ID NO: 2873042 - protein, 22 aa, Entamoeba invadens
KKRMDGKKLEKGYDSHFSPKGN

SEQ ID NO: 2873043 - protein, 8 aa, Entamoeba invadens
KKRMETTI

SEQ ID NO: 2873044 - protein, 8 aa, Entamoeba invadens
KKRMQQQQ

SEQ ID NO: 2873045 - protein, 9 aa, Entamoeba invadens
KKRNDGTLQ

SEQ ID NO: 2873046 - protein, 8 aa, Entamoeba invadens
KKRNEDLE

SEQ ID NO: 2873047 - protein, 15 aa, Entamoeba invadens
KKRNESLEKEGKNQK

SEQ ID NO: 2873048 - protein, 10 aa, Entamoeba invadens
KKRNNEECKK

SEQ ID NO: 2873049 - protein, 10 aa, Entamoeba invadens
KKRNNKETIP

SEQ ID NO: 2873050 - protein, 15 aa, Entamoeba invadens
KKRNQVDHTKSEKEV

SEQ ID NO: 2873051 - protein, 15 aa, Entamoeba invadens
KKRNSKVVSRREPQT

SEQ ID NO: 2873052 - protein, 10 aa, Entamoeba invadens
KKRPAHNTRL

SEQ ID NO: 2873053 - protein, 31 aa, Entamoeba invadens
KKRPERRESKDKKEKPEKFEKKRSGTWDDSS

SEQ ID NO: 2873054 - protein, 7 aa, Entamoeba invadens
KKRPLND

SEQ ID NO: 2873055 - protein, 6 aa, Entamoeba invadens
KKRPNF

SEQ ID NO: 2873056 - protein, 7 aa, Entamoeba invadens
KKRPPAL

SEQ ID NO: 2873057 - protein, 6 aa, Entamoeba invadens
KKRQEM

SEQ ID NO: 2873058 - protein, 8 aa, Entamoeba invadens
KKRQERTE

SEQ ID NO: 2873059 - protein, 10 aa, Entamoeba invadens
KKRQIDETSP

SEQ ID NO: 2873060 - protein, 7 aa, Entamoeba invadens
KKRQIGS

SEQ ID NO: 2873061 - protein, 9 aa, Entamoeba invadens
KKRQNTDGR

SEQ ID NO: 2873062 - protein, 58 aa, Entamoeba invadens
KKRRDTKTKEEKLESGTDKSQKQRSEIDSWRNDTTLERRKKEGECKKSEKIQSENSPF

SEQ ID NO: 2873063 - protein, 49 aa, Entamoeba invadens
KKRRGRKRKADTKTDVEKIKEGESSPSYENSTETKSEKSRKSKIDKVEN

SEQ ID NO: 2873064 - protein, 21 aa, Entamoeba invadens
KKRRGSVGAEENAEESSPDTS

SEQ ID NO: 2873065 - protein, 16 aa, Entamoeba invadens
KKRRKEGGSLELQSEV

SEQ ID NO: 2873066 - protein, 6 aa, Entamoeba invadens
KKRRLR

SEQ ID NO: 2873067 - protein, 4 aa, Entamoeba invadens
KKRS

SEQ ID NO: 2873068 - protein, 8 aa, Entamoeba invadens
KKRSGGKY

SEQ ID NO: 2873069 - protein, 17 aa, Entamoeba invadens
KKRSKKVLRPLSEKSVY

SEQ ID NO: 2873070 - protein, 28 aa, Entamoeba invadens
KKRSSISTISTKQETPTEEKRPRLTSDQ

SEQ ID NO: 2873071 - protein, 13 aa, Entamoeba invadens
KKRSSVGNISPLA

SEQ ID NO: 2873072 - protein, 13 aa, Entamoeba invadens
KKRSTKPAKYTKK

SEQ ID NO: 2873073 - protein, 8 aa, Entamoeba invadens
KKRTARLS

SEQ ID NO: 2873074 - protein, 20 aa, Entamoeba invadens
KKRTARMSDMTDKQRRRNYK

SEQ ID NO: 2873075 - protein, 9 aa, Entamoeba invadens
KKRTEIENR

SEQ ID NO: 2873076 - protein, 7 aa, Entamoeba invadens
KKRTEKL

SEQ ID NO: 2873077 - protein, 12 aa, Entamoeba invadens
KKRTSDNPKATT

SEQ ID NO: 2873078 - protein, 9 aa, Entamoeba invadens
KKRTSNSNF

SEQ ID NO: 2873079 - protein, 9 aa, Entamoeba invadens
KKRTSNSTF

SEQ ID NO: 2873080 - protein, 16 aa, Entamoeba invadens
KKRTTKEPESNEERQK

SEQ ID NO: 2873081 - protein, 10 aa, Entamoeba invadens
KKRTTKKGTE

SEQ ID NO: 2873082 - protein, 19 aa, Entamoeba invadens
KKRVAHEQAKKKKENKKAD

SEQ ID NO: 2873083 - protein, 6 aa, Entamoeba invadens
KKRVKS

SEQ ID NO: 2873084 - protein, 22 aa, Entamoeba invadens
KKRYKESDEYKKKRKTERQEYT

SEQ ID NO: 2873085 - protein, 5 aa, Entamoeba invadens
KKSAF

SEQ ID NO: 2873086 - protein, 7 aa, Entamoeba invadens
KKSAGSV

SEQ ID NO: 2873087 - protein, 9 aa, Entamoeba invadens
KKSAYSAQL

SEQ ID NO: 2873088 - protein, 7 aa, Entamoeba invadens
KKSDEID

SEQ ID NO: 2873089 - protein, 7 aa, Entamoeba invadens
KKSDEIG

SEQ ID NO: 2873090 - protein, 9 aa, Entamoeba invadens
KKSDEISSK

SEQ ID NO: 2873091 - protein, 8 aa, Entamoeba invadens
KKSDGSLD

SEQ ID NO: 2873092 - protein, 9 aa, Entamoeba invadens
KKSDKSDDL

SEQ ID NO: 2873093 - protein, 11 aa, Entamoeba invadens
KKSDNSNWDNL

SEQ ID NO: 2873094 - protein, 7 aa, Entamoeba invadens
KKSDQIG

SEQ ID NO: 2873095 - protein, 154 aa, Entamoeba invadens
KKSDSKKPKPKEDLNEPEEKRAKPKLKDKTQLTKEKKLTKSEKSETSKKDEKTKEKPKKTEKKKEEKEKVDDKKPKTKTEKIKTKEKKQSKKETKEKTSDSEKSEQDEEQPLKGKKSKQKEKKKNKTQEAEKSKKRVKKEDDKKQEKSKEEAIT

SEQ ID NO: 2873096 - protein, 7 aa, Entamoeba invadens
KKSEDVD

SEQ ID NO: 2873097 - protein, 9 aa, Entamoeba invadens
KKSEDVQNG

SEQ ID NO: 2873098 - protein, 9 aa, Entamoeba invadens
KKSEEGETV

SEQ ID NO: 2873099 - protein, 7 aa, Entamoeba invadens
KKSEEID

SEQ ID NO: 2873100 - protein, 8 aa, Entamoeba invadens
KKSEEKWG

SEQ ID NO: 2873101 - protein, 7 aa, Entamoeba invadens
KKSEEMF

SEQ ID NO: 2873102 - protein, 9 aa, Entamoeba invadens
KKSEERKEN

SEQ ID NO: 2873103 - protein, 10 aa, Entamoeba invadens
KKSEETPLQN

SEQ ID NO: 2873104 - protein, 7 aa, Entamoeba invadens
KKSEEVD

SEQ ID NO: 2873105 - protein, 8 aa, Entamoeba invadens
KKSEEVET

SEQ ID NO: 2873106 - protein, 7 aa, Entamoeba invadens
KKSEGDT

SEQ ID NO: 2873107 - protein, 6 aa, Entamoeba invadens
KKSEGF

SEQ ID NO: 2873108 - protein, 7 aa, Entamoeba invadens
KKSEIEG

SEQ ID NO: 2873109 - protein, 14 aa, Entamoeba invadens
KKSEIKTDSRKDSF

SEQ ID NO: 2873110 - protein, 7 aa, Entamoeba invadens
KKSEMSE

SEQ ID NO: 2873111 - protein, 11 aa, Entamoeba invadens
KKSESDKSFES

SEQ ID NO: 2873112 - protein, 8 aa, Entamoeba invadens
KKSESETA

SEQ ID NO: 2873113 - protein, 9 aa, Entamoeba invadens
KKSETMTEE

SEQ ID NO: 2873114 - protein, 6 aa, Entamoeba invadens
KKSFAQ

SEQ ID NO: 2873115 - protein, 23 aa, Entamoeba invadens
KKSFDQKFGQNEELTKTQTDASF

SEQ ID NO: 2873116 - protein, 17 aa, Entamoeba invadens
KKSFQQDNLSKIKFDFI

SEQ ID NO: 2873117 - protein, 5 aa, Entamoeba invadens
KKSGA

SEQ ID NO: 2873118 - protein, 5 aa, Entamoeba invadens
KKSGE

SEQ ID NO: 2873119 - protein, 7 aa, Entamoeba invadens
KKSGEMM

SEQ ID NO: 2873120 - protein, 7 aa, Entamoeba invadens
KKSGGDN

SEQ ID NO: 2873121 - protein, 15 aa, Entamoeba invadens
KKSGIDIQNDLGDSP

SEQ ID NO: 2873122 - protein, 14 aa, Entamoeba invadens
KKSGIDLKNTRGDS

SEQ ID NO: 2873123 - protein, 7 aa, Entamoeba invadens
KKSGKGL

SEQ ID NO: 2873124 - protein, 7 aa, Entamoeba invadens
KKSGKIK

SEQ ID NO: 2873125 - protein, 11 aa, Entamoeba invadens
KKSGQQQKTVQ

SEQ ID NO: 2873126 - protein, 5 aa, Entamoeba invadens
KKSGS

SEQ ID NO: 2873127 - protein, 8 aa, Entamoeba invadens
KKSGSEDI

SEQ ID NO: 2873128 - protein, 12 aa, Entamoeba invadens
KKSGTLSSKLGE

SEQ ID NO: 2873129 - protein, 18 aa, Entamoeba invadens
KKSHAELSEQKKKLNMAK

SEQ ID NO: 2873130 - protein, 6 aa, Entamoeba invadens
KKSHDH

SEQ ID NO: 2873131 - protein, 10 aa, Entamoeba invadens
KKSHGSDTFE

SEQ ID NO: 2873132 - protein, 5 aa, Entamoeba invadens
KKSIA

SEQ ID NO: 2873133 - protein, 11 aa, Entamoeba invadens
KKSIEAIGEDT

SEQ ID NO: 2873134 - protein, 14 aa, Entamoeba invadens
KKSIKKVHRTKTPE

SEQ ID NO: 2873135 - protein, 11 aa, Entamoeba invadens
KKSISDVAKPV

SEQ ID NO: 2873136 - protein, 47 aa, Entamoeba invadens
KKSISSEFDKRKSISNSPSPSPSPRTPQIEKTVTSPELNHRPQTDRL

SEQ ID NO: 2873137 - protein, 4 aa, Entamoeba invadens
KKSK

SEQ ID NO: 2873138 - protein, 35 aa, Entamoeba invadens
KKSKDAEKSKDHRNTENNNSKHQKLNGLSKEEVTQ

SEQ ID NO: 2873139 - protein, 10 aa, Entamoeba invadens
KKSKDDPMGN

SEQ ID NO: 2873140 - protein, 23 aa, Entamoeba invadens
KKSKDSVSVKPQKDHKNKTIQIT

SEQ ID NO: 2873141 - protein, 7 aa, Entamoeba invadens
KKSKEGV

SEQ ID NO: 2873142 - protein, 10 aa, Entamoeba invadens
KKSKEIQQTV

SEQ ID NO: 2873143 - protein, 5 aa, Entamoeba invadens
KKSKF

SEQ ID NO: 2873144 - protein, 65 aa, Entamoeba invadens
KKSKGAVVKSGDGKKKMDEKTEDEESGEEKAQQNTQMEIEEPKEEKAEEQVLPPPMEEEPPHNVV

SEQ ID NO: 2873145 - protein, 16 aa, Entamoeba invadens
KKSKGSPHTSNSHEEI

SEQ ID NO: 2873146 - protein, 14 aa, Entamoeba invadens
KKSKIVKGIPKGEI

SEQ ID NO: 2873147 - protein, 17 aa, Entamoeba invadens
KKSKKIPPECFEQEPIM

SEQ ID NO: 2873148 - protein, 7 aa, Entamoeba invadens
KKSKKTI

SEQ ID NO: 2873149 - protein, 9 aa, Entamoeba invadens
KKSKKTNFY

SEQ ID NO: 2873150 - protein, 6 aa, Entamoeba invadens
KKSKKV

SEQ ID NO: 2873151 - protein, 9 aa, Entamoeba invadens
KKSKQEGTL

SEQ ID NO: 2873152 - protein, 10 aa, Entamoeba invadens
KKSKQSPTQH

SEQ ID NO: 2873153 - protein, 8 aa, Entamoeba invadens
KKSKQSTY

SEQ ID NO: 2873154 - protein, 8 aa, Entamoeba invadens
KKSKSKRY

SEQ ID NO: 2873155 - protein, 8 aa, Entamoeba invadens
KKSKSMKS

SEQ ID NO: 2873156 - protein, 11 aa, Entamoeba invadens
KKSKTPQYTKD

SEQ ID NO: 2873157 - protein, 37 aa, Entamoeba invadens
KKSKTQPPDPQAQKNNDKVNVEKEPPKEPSRRRFCSL

SEQ ID NO: 2873158 - protein, 14 aa, Entamoeba invadens
KKSKTTLAGHTQKK

SEQ ID NO: 2873159 - protein, 13 aa, Entamoeba invadens
KKSKWKNIKLIQE

SEQ ID NO: 2873160 - protein, 7 aa, Entamoeba invadens
KKSLEEV

SEQ ID NO: 2873161 - protein, 17 aa, Entamoeba invadens
KKSLKKNKKTENYTQSL

SEQ ID NO: 2873162 - protein, 5 aa, Entamoeba invadens
KKSLT

SEQ ID NO: 2873163 - protein, 6 aa, Entamoeba invadens
KKSLTD

SEQ ID NO: 2873164 - protein, 8 aa, Entamoeba invadens
KKSMEEKE

SEQ ID NO: 2873165 - protein, 27 aa, Entamoeba invadens
KKSMQIKKKKTLKTNSVKMSSHAKSVQ

SEQ ID NO: 2873166 - protein, 5 aa, Entamoeba invadens
KKSNA

SEQ ID NO: 2873167 - protein, 9 aa, Entamoeba invadens
KKSNDAENI

SEQ ID NO: 2873168 - protein, 9 aa, Entamoeba invadens
KKSNEEKAK

SEQ ID NO: 2873169 - protein, 8 aa, Entamoeba invadens
KKSNSGRT

SEQ ID NO: 2873170 - protein, 10 aa, Entamoeba invadens
KKSNSSEESL

SEQ ID NO: 2873171 - protein, 9 aa, Entamoeba invadens
KKSNWKQYE

SEQ ID NO: 2873172 - protein, 8 aa, Entamoeba invadens
KKSPELQE

SEQ ID NO: 2873173 - protein, 9 aa, Entamoeba invadens
KKSPITNKM

SEQ ID NO: 2873174 - protein, 9 aa, Entamoeba invadens
KKSPKCSEC

SEQ ID NO: 2873175 - protein, 8 aa, Entamoeba invadens
KKSPLDPP

SEQ ID NO: 2873176 - protein, 30 aa, Entamoeba invadens
KKSPQTTEKDSQKKSGSQKKLTQPTSSDEV

SEQ ID NO: 2873177 - protein, 6 aa, Entamoeba invadens
KKSPYQ

SEQ ID NO: 2873178 - protein, 13 aa, Entamoeba invadens
KKSQDKNSQSITT

SEQ ID NO: 2873179 - protein, 7 aa, Entamoeba invadens
KKSQSTF

SEQ ID NO: 2873180 - protein, 12 aa, Entamoeba invadens
KKSQTKQTKLGD

SEQ ID NO: 2873181 - protein, 4 aa, Entamoeba invadens
KKSS

SEQ ID NO: 2873182 - protein, 10 aa, Entamoeba invadens
KKSSENPAEV

SEQ ID NO: 2873183 - protein, 51 aa, Entamoeba invadens
KKSSERDDRRGRSRSRSRSRSDSRDRYRKRSDSRHHSRRRSRSRSEHRHYR

SEQ ID NO: 2873184 - protein, 7 aa, Entamoeba invadens
KKSSEVV

SEQ ID NO: 2873185 - protein, 7 aa, Entamoeba invadens
KKSSFEA

SEQ ID NO: 2873186 - protein, 7 aa, Entamoeba invadens
KKSSFES

SEQ ID NO: 2873187 - protein, 7 aa, Entamoeba invadens
KKSSFGT

SEQ ID NO: 2873188 - protein, 6 aa, Entamoeba invadens
KKSSIK

SEQ ID NO: 2873189 - protein, 23 aa, Entamoeba invadens
KKSSKTQTNNKPTDAPAAATTAP

SEQ ID NO: 2873190 - protein, 6 aa, Entamoeba invadens
KKSSLE

SEQ ID NO: 2873191 - protein, 7 aa, Entamoeba invadens
KKSSLQD

SEQ ID NO: 2873192 - protein, 10 aa, Entamoeba invadens
KKSSNGSIKE

SEQ ID NO: 2873193 - protein, 195 aa, Entamoeba invadens
KKSSPTSTTTTTTQQKTIKSPPPPSSTTITTTGEDQKQQKSLSKSTSVAQKSTSDSIGTLNTTQHKSPPPSVLSQSAKTTTSSQTYHQKAHSTQSPSSPNTFKTSGSVKAWEEKQKTQQAAPQLTRTSQSKSYEKPKFQKQNTTPLYTQKTQTTQVSKSEVKSPSPKVEEKKVDEVKETPFEPKKSPEPQKCEES

SEQ ID NO: 2873194 - protein, 11 aa, Entamoeba invadens
KKSSQSNTPEV

SEQ ID NO: 2873195 - protein, 8 aa, Entamoeba invadens
KKSSSDLA

SEQ ID NO: 2873196 - protein, 7 aa, Entamoeba invadens
KKSSSFS

SEQ ID NO: 2873197 - protein, 21 aa, Entamoeba invadens
KKSSSKARQPKTPTDGNRYDE

SEQ ID NO: 2873198 - protein, 9 aa, Entamoeba invadens
KKSSTVQHQ

SEQ ID NO: 2873199 - protein, 8 aa, Entamoeba invadens
KKSTERME

SEQ ID NO: 2873200 - protein, 24 aa, Entamoeba invadens
KKSTKQQNPLKEKDLDNLPTECDE

SEQ ID NO: 2873201 - protein, 25 aa, Entamoeba invadens
KKSTKQQNSFNEKDLNNLPTECNGR

SEQ ID NO: 2873202 - protein, 25 aa, Entamoeba invadens
KKSTKRYTPFNSKDLENLPTECNGK

SEQ ID NO: 2873203 - protein, 9 aa, Entamoeba invadens
KKSTKTSPL

SEQ ID NO: 2873204 - protein, 8 aa, Entamoeba invadens
KKSTNEME

SEQ ID NO: 2873205 - protein, 10 aa, Entamoeba invadens
KKSTNKEQSK

SEQ ID NO: 2873206 - protein, 8 aa, Entamoeba invadens
KKSTPVNI

SEQ ID NO: 2873207 - protein, 16 aa, Entamoeba invadens
KKSTQPDPQIELIVPV

SEQ ID NO: 2873208 - protein, 8 aa, Entamoeba invadens
KKSTRDRE

SEQ ID NO: 2873209 - protein, 9 aa, Entamoeba invadens
KKSTSEQLS

SEQ ID NO: 2873210 - protein, 13 aa, Entamoeba invadens
KKSTTTLNKDRSN

SEQ ID NO: 2873211 - protein, 13 aa, Entamoeba invadens
KKSTYEIVTGGNV

SEQ ID NO: 2873212 - protein, 7 aa, Entamoeba invadens
KKSVEDA

SEQ ID NO: 2873213 - protein, 10 aa, Entamoeba invadens
KKSVEPSADY

SEQ ID NO: 2873214 - protein, 21 aa, Entamoeba invadens
KKSVGDVNRELRAAKKRPGYD

SEQ ID NO: 2873215 - protein, 7 aa, Entamoeba invadens
KKSVMPN

SEQ ID NO: 2873216 - protein, 7 aa, Entamoeba invadens
KKSVTKF

SEQ ID NO: 2873217 - protein, 17 aa, Entamoeba invadens
KKSVYDVKKDKEEEDVE

SEQ ID NO: 2873218 - protein, 9 aa, Entamoeba invadens
KKSWNGPSV

SEQ ID NO: 2873219 - protein, 6 aa, Entamoeba invadens
KKSYGY

SEQ ID NO: 2873220 - protein, 6 aa, Entamoeba invadens
KKSYLQ

SEQ ID NO: 2873221 - protein, 6 aa, Entamoeba invadens
KKSYPL

SEQ ID NO: 2873222 - protein, 7 aa, Entamoeba invadens
KKSYSKN

SEQ ID NO: 2873223 - protein, 9 aa, Entamoeba invadens
KKTAKNNRA

SEQ ID NO: 2873224 - protein, 7 aa, Entamoeba invadens
KKTASDI

SEQ ID NO: 2873225 - protein, 14 aa, Entamoeba invadens
KKTATEEQKAIVFV

SEQ ID NO: 2873226 - protein, 6 aa, Entamoeba invadens
KKTDDH

SEQ ID NO: 2873227 - protein, 7 aa, Entamoeba invadens
KKTDTMN

SEQ ID NO: 2873228 - protein, 12 aa, Entamoeba invadens
KKTEASRDLQDD

SEQ ID NO: 2873229 - protein, 16 aa, Entamoeba invadens
KKTEEDQKTVTSVTDE

SEQ ID NO: 2873230 - protein, 6 aa, Entamoeba invadens
KKTEEI

SEQ ID NO: 2873231 - protein, 7 aa, Entamoeba invadens
KKTEEKL

SEQ ID NO: 2873232 - protein, 11 aa, Entamoeba invadens
KKTEEKPKNTV

SEQ ID NO: 2873233 - protein, 7 aa, Entamoeba invadens
KKTEHNE

SEQ ID NO: 2873234 - protein, 9 aa, Entamoeba invadens
KKTEHSEFK

SEQ ID NO: 2873235 - protein, 6 aa, Entamoeba invadens
KKTEKL

SEQ ID NO: 2873236 - protein, 12 aa, Entamoeba invadens
KKTEKPSEQIGG

SEQ ID NO: 2873237 - protein, 5 aa, Entamoeba invadens
KKTEL

SEQ ID NO: 2873238 - protein, 24 aa, Entamoeba invadens
KKTELTETDDAEAKDEKKTPRKSA

SEQ ID NO: 2873239 - protein, 6 aa, Entamoeba invadens
KKTERR

SEQ ID NO: 2873240 - protein, 7 aa, Entamoeba invadens
KKTESSP

SEQ ID NO: 2873241 - protein, 4 aa, Entamoeba invadens
KKTF

SEQ ID NO: 2873242 - protein, 17 aa, Entamoeba invadens
KKTFDSPQTSTGYQNPL

SEQ ID NO: 2873243 - protein, 7 aa, Entamoeba invadens
KKTFDTV

SEQ ID NO: 2873244 - protein, 4 aa, Entamoeba invadens
KKTG

SEQ ID NO: 2873245 - protein, 6 aa, Entamoeba invadens
KKTGDS

SEQ ID NO: 2873246 - protein, 22 aa, Entamoeba invadens
KKTGEKHPQKIDKEKKKKTCEI

SEQ ID NO: 2873247 - protein, 16 aa, Entamoeba invadens
KKTGKIEPQKVEEMKE

SEQ ID NO: 2873248 - protein, 7 aa, Entamoeba invadens
KKTGNSL

SEQ ID NO: 2873249 - protein, 10 aa, Entamoeba invadens
KKTGNTEKFS

SEQ ID NO: 2873250 - protein, 8 aa, Entamoeba invadens
KKTHASSF

SEQ ID NO: 2873251 - protein, 14 aa, Entamoeba invadens
KKTHKAKEQKTRAR

SEQ ID NO: 2873252 - protein, 7 aa, Entamoeba invadens
KKTHKNF

SEQ ID NO: 2873253 - protein, 21 aa, Entamoeba invadens
KKTHNPESKPWNTLKDKIKLS

SEQ ID NO: 2873254 - protein, 6 aa, Entamoeba invadens
KKTIDE

SEQ ID NO: 2873255 - protein, 6 aa, Entamoeba invadens
KKTIEE

SEQ ID NO: 2873256 - protein, 8 aa, Entamoeba invadens
KKTIGKEA

SEQ ID NO: 2873257 - protein, 16 aa, Entamoeba invadens
KKTISIKGESNEDISM

SEQ ID NO: 2873258 - protein, 4 aa, Entamoeba invadens
KKTK

SEQ ID NO: 2873259 - protein, 34 aa, Entamoeba invadens
KKTKAVSQSEKSVPEDKEQKKNKKGVKREKQNTK

SEQ ID NO: 2873260 - protein, 8 aa, Entamoeba invadens
KKTKDNII

SEQ ID NO: 2873261 - protein, 28 aa, Entamoeba invadens
KKTKEKMLNAEKKARAATSCEGKNLNKL

SEQ ID NO: 2873262 - protein, 10 aa, Entamoeba invadens
KKTKESSQIT

SEQ ID NO: 2873263 - protein, 9 aa, Entamoeba invadens
KKTKKAKMK

SEQ ID NO: 2873264 - protein, 15 aa, Entamoeba invadens
KKTKKESDPTHCDTK

SEQ ID NO: 2873265 - protein, 8 aa, Entamoeba invadens
KKTKKTVH

SEQ ID NO: 2873266 - protein, 51 aa, Entamoeba invadens
KKTKLMKEDDEDDDEEDEIKIEDEDGDGEDEIVSKKPRKARKDGKSPKEIK

SEQ ID NO: 2873267 - protein, 7 aa, Entamoeba invadens
KKTKNEL

SEQ ID NO: 2873268 - protein, 8 aa, Entamoeba invadens
KKTKNSYL

SEQ ID NO: 2873269 - protein, 9 aa, Entamoeba invadens
KKTKPKNLS

SEQ ID NO: 2873270 - protein, 7 aa, Entamoeba invadens
KKTKRAV

SEQ ID NO: 2873271 - protein, 6 aa, Entamoeba invadens
KKTKSF

SEQ ID NO: 2873272 - protein, 9 aa, Entamoeba invadens
KKTKSSSDL

SEQ ID NO: 2873273 - protein, 70 aa, Entamoeba invadens
KKTKTGKDTVKESPREKDKEKKEGTTSTETSEVNNSEQKSTLTDENETDESEEKTKKEGKETPRDPSQEV

SEQ ID NO: 2873274 - protein, 26 aa, Entamoeba invadens
KKTKTKHEDIIPDKPESKRPKEDANE

SEQ ID NO: 2873275 - protein, 7 aa, Entamoeba invadens
KKTKVND

SEQ ID NO: 2873276 - protein, 6 aa, Entamoeba invadens
KKTLDK

SEQ ID NO: 2873277 - protein, 7 aa, Entamoeba invadens
KKTLEKK

SEQ ID NO: 2873278 - protein, 24 aa, Entamoeba invadens
KKTLENLSTRKKHSTTVSTVTPTI

SEQ ID NO: 2873279 - protein, 7 aa, Entamoeba invadens
KKTLKRA

SEQ ID NO: 2873280 - protein, 11 aa, Entamoeba invadens
KKTLPNQQPNV

SEQ ID NO: 2873281 - protein, 5 aa, Entamoeba invadens
KKTLQ

SEQ ID NO: 2873282 - protein, 12 aa, Entamoeba invadens
KKTLSEKENAEA

SEQ ID NO: 2873283 - protein, 9 aa, Entamoeba invadens
KKTMDEYKS

SEQ ID NO: 2873284 - protein, 12 aa, Entamoeba invadens
KKTMERNGDTEE

SEQ ID NO: 2873285 - protein, 7 aa, Entamoeba invadens
KKTMETK

SEQ ID NO: 2873286 - protein, 7 aa, Entamoeba invadens
KKTMNEM

SEQ ID NO: 2873287 - protein, 14 aa, Entamoeba invadens
KKTMRDYKTASEEL

SEQ ID NO: 2873288 - protein, 7 aa, Entamoeba invadens
KKTMSKK

SEQ ID NO: 2873289 - protein, 9 aa, Entamoeba invadens
KKTNDMVNT

SEQ ID NO: 2873290 - protein, 6 aa, Entamoeba invadens
KKTNDY

SEQ ID NO: 2873291 - protein, 8 aa, Entamoeba invadens
KKTNELSD

SEQ ID NO: 2873292 - protein, 7 aa, Entamoeba invadens
KKTNGMK

SEQ ID NO: 2873293 - protein, 7 aa, Entamoeba invadens
KKTNGRI

SEQ ID NO: 2873294 - protein, 7 aa, Entamoeba invadens
KKTNKSR

SEQ ID NO: 2873295 - protein, 15 aa, Entamoeba invadens
KKTNPATFKTKEGET

SEQ ID NO: 2873296 - protein, 17 aa, Entamoeba invadens
KKTNPKRKSAYKTLNDL

SEQ ID NO: 2873297 - protein, 16 aa, Entamoeba invadens
KKTNSISRSAKHVEKV

SEQ ID NO: 2873298 - protein, 6 aa, Entamoeba invadens
KKTNSS

SEQ ID NO: 2873299 - protein, 5 aa, Entamoeba invadens
KKTNT

SEQ ID NO: 2873300 - protein, 6 aa, Entamoeba invadens
KKTNVN

SEQ ID NO: 2873301 - protein, 8 aa, Entamoeba invadens
KKTPAQKQ

SEQ ID NO: 2873302 - protein, 19 aa, Entamoeba invadens
KKTPENTKESDDFKRSESF

SEQ ID NO: 2873303 - protein, 6 aa, Entamoeba invadens
KKTPPC

SEQ ID NO: 2873304 - protein, 7 aa, Entamoeba invadens
KKTPPES

SEQ ID NO: 2873305 - protein, 11 aa, Entamoeba invadens
KKTPPKTIPNI

SEQ ID NO: 2873306 - protein, 6 aa, Entamoeba invadens
KKTPRR

SEQ ID NO: 2873307 - protein, 6 aa, Entamoeba invadens
KKTPVK

SEQ ID NO: 2873308 - protein, 7 aa, Entamoeba invadens
KKTQEEL

SEQ ID NO: 2873309 - protein, 20 aa, Entamoeba invadens
KKTQEEQKSEPRSKDISNSL

SEQ ID NO: 2873310 - protein, 11 aa, Entamoeba invadens
KKTQQSVRDGE

SEQ ID NO: 2873311 - protein, 5 aa, Entamoeba invadens
KKTQV

SEQ ID NO: 2873312 - protein, 15 aa, Entamoeba invadens
KKTRAFEKTTDTMET

SEQ ID NO: 2873313 - protein, 6 aa, Entamoeba invadens
KKTRAV

SEQ ID NO: 2873314 - protein, 7 aa, Entamoeba invadens
KKTRDLQ

SEQ ID NO: 2873315 - protein, 8 aa, Entamoeba invadens
KKTRKAVS

SEQ ID NO: 2873316 - protein, 16 aa, Entamoeba invadens
KKTSAKIENEIDRNED

SEQ ID NO: 2873317 - protein, 7 aa, Entamoeba invadens
KKTSDTV

SEQ ID NO: 2873318 - protein, 9 aa, Entamoeba invadens
KKTSDVPQN

SEQ ID NO: 2873319 - protein, 8 aa, Entamoeba invadens
KKTSEIDE

SEQ ID NO: 2873320 - protein, 7 aa, Entamoeba invadens
KKTSKMN

SEQ ID NO: 2873321 - protein, 14 aa, Entamoeba invadens
KKTSNESQTMPQPL

SEQ ID NO: 2873322 - protein, 7 aa, Entamoeba invadens
KKTSPRR

SEQ ID NO: 2873323 - protein, 30 aa, Entamoeba invadens
KKTSSAHKRSASSYTNKDIKSFENDTKPIP

SEQ ID NO: 2873324 - protein, 9 aa, Entamoeba invadens
KKTSTPRMA

SEQ ID NO: 2873325 - protein, 6 aa, Entamoeba invadens
KKTSVD

SEQ ID NO: 2873326 - protein, 5 aa, Entamoeba invadens
KKTTA

SEQ ID NO: 2873327 - protein, 10 aa, Entamoeba invadens
KKTTEKVGAN

SEQ ID NO: 2873328 - protein, 16 aa, Entamoeba invadens
KKTTELKKTLKAKDEM

SEQ ID NO: 2873329 - protein, 10 aa, Entamoeba invadens
KKTTGTATAP

SEQ ID NO: 2873330 - protein, 8 aa, Entamoeba invadens
KKTTKEKI

SEQ ID NO: 2873331 - protein, 9 aa, Entamoeba invadens
KKTTNKSYY

SEQ ID NO: 2873332 - protein, 6 aa, Entamoeba invadens
KKTTPF

SEQ ID NO: 2873333 - protein, 9 aa, Entamoeba invadens
KKTTPPKHP

SEQ ID NO: 2873334 - protein, 6 aa, Entamoeba invadens
KKTTSL

SEQ ID NO: 2873335 - protein, 10 aa, Entamoeba invadens
KKTTTEEQTK

SEQ ID NO: 2873336 - protein, 15 aa, Entamoeba invadens
KKTVDGKSTASPDLE

SEQ ID NO: 2873337 - protein, 5 aa, Entamoeba invadens
KKTVE

SEQ ID NO: 2873338 - protein, 14 aa, Entamoeba invadens
KKTVENNKKESEAS

SEQ ID NO: 2873339 - protein, 5 aa, Entamoeba invadens
KKTVK

SEQ ID NO: 2873340 - protein, 17 aa, Entamoeba invadens
KKTVQQAKAQKKKYADK

SEQ ID NO: 2873341 - protein, 13 aa, Entamoeba invadens
KKTVSEKTIRKSE

SEQ ID NO: 2873342 - protein, 6 aa, Entamoeba invadens
KKTYPD

SEQ ID NO: 2873343 - protein, 18 aa, Entamoeba invadens
KKVASPPTKVQKATEGKV

SEQ ID NO: 2873344 - protein, 9 aa, Entamoeba invadens
KKVATTKNT

SEQ ID NO: 2873345 - protein, 16 aa, Entamoeba invadens
KKVDDEAKAKEAVAGE

SEQ ID NO: 2873346 - protein, 5 aa, Entamoeba invadens
KKVDE

SEQ ID NO: 2873347 - protein, 12 aa, Entamoeba invadens
KKVDEQEKKAAQ

SEQ ID NO: 2873348 - protein, 13 aa, Entamoeba invadens
KKVDEQNKTIKQL

SEQ ID NO: 2873349 - protein, 6 aa, Entamoeba invadens
KKVDNS

SEQ ID NO: 2873350 - protein, 6 aa, Entamoeba invadens
KKVDSK

SEQ ID NO: 2873351 - protein, 9 aa, Entamoeba invadens
KKVEAPKPL

SEQ ID NO: 2873352 - protein, 21 aa, Entamoeba invadens
KKVEEEKIKMREDKANCNEGM

SEQ ID NO: 2873353 - protein, 8 aa, Entamoeba invadens
KKVEEEKV

SEQ ID NO: 2873354 - protein, 12 aa, Entamoeba invadens
KKVEEGGNENYQ

SEQ ID NO: 2873355 - protein, 6 aa, Entamoeba invadens
KKVEGI

SEQ ID NO: 2873356 - protein, 10 aa, Entamoeba invadens
KKVEHGDTPF

SEQ ID NO: 2873357 - protein, 8 aa, Entamoeba invadens
KKVEHKKN

SEQ ID NO: 2873358 - protein, 14 aa, Entamoeba invadens
KKVEKKDEKKKETK

SEQ ID NO: 2873359 - protein, 16 aa, Entamoeba invadens
KKVEPTEKHIKTKQTS

SEQ ID NO: 2873360 - protein, 14 aa, Entamoeba invadens
KKVEPTKEHAPQRH

SEQ ID NO: 2873361 - protein, 18 aa, Entamoeba invadens
KKVESTKKNKKLMKNNPD

SEQ ID NO: 2873362 - protein, 6 aa, Entamoeba invadens
KKVGDA

SEQ ID NO: 2873363 - protein, 14 aa, Entamoeba invadens
KKVGGADYSTNSGS

SEQ ID NO: 2873364 - protein, 17 aa, Entamoeba invadens
KKVGGAEAQALIDEWMN

SEQ ID NO: 2873365 - protein, 8 aa, Entamoeba invadens
KKVGKSSI

SEQ ID NO: 2873366 - protein, 5 aa, Entamoeba invadens
KKVIQ

SEQ ID NO: 2873367 - protein, 4 aa, Entamoeba invadens
KKVK

SEQ ID NO: 2873368 - protein, 12 aa, Entamoeba invadens
KKVKASAENVKK

SEQ ID NO: 2873369 - protein, 30 aa, Entamoeba invadens
KKVKDDLKKALEEEGLQENDAEKKKMAQEC

SEQ ID NO: 2873370 - protein, 12 aa, Entamoeba invadens
KKVKEKTSKVGC

SEQ ID NO: 2873371 - protein, 20 aa, Entamoeba invadens
KKVKETVTQRQAEVPVPLAL

SEQ ID NO: 2873372 - protein, 8 aa, Entamoeba invadens
KKVKGKDA

SEQ ID NO: 2873373 - protein, 10 aa, Entamoeba invadens
KKVKKGPVSI

SEQ ID NO: 2873374 - protein, 15 aa, Entamoeba invadens
KKVKKTTKKAGLPDF

SEQ ID NO: 2873375 - protein, 6 aa, Entamoeba invadens
KKVKNI

SEQ ID NO: 2873376 - protein, 8 aa, Entamoeba invadens
KKVKTSQR

SEQ ID NO: 2873377 - protein, 7 aa, Entamoeba invadens
KKVLESG

SEQ ID NO: 2873378 - protein, 6 aa, Entamoeba invadens
KKVNAK

SEQ ID NO: 2873379 - protein, 11 aa, Entamoeba invadens
KKVNKDDSLNC

SEQ ID NO: 2873380 - protein, 16 aa, Entamoeba invadens
KKVNPSVSKDSSSLTE

SEQ ID NO: 2873381 - protein, 6 aa, Entamoeba invadens
KKVPAQ

SEQ ID NO: 2873382 - protein, 8 aa, Entamoeba invadens
KKVPESGF

SEQ ID NO: 2873383 - protein, 7 aa, Entamoeba invadens
KKVPVSG

SEQ ID NO: 2873384 - protein, 45 aa, Entamoeba invadens
KKVQESQEKEKRSKTKSPKTQNPTKKGKKLKKEKKDKKKTGSCVI

SEQ ID NO: 2873385 - protein, 5 aa, Entamoeba invadens
KKVQT

SEQ ID NO: 2873386 - protein, 8 aa, Entamoeba invadens
KKVRDPYG

SEQ ID NO: 2873387 - protein, 7 aa, Entamoeba invadens
KKVRSLR

SEQ ID NO: 2873388 - protein, 11 aa, Entamoeba invadens
KKVSAKEINDI

SEQ ID NO: 2873389 - protein, 8 aa, Entamoeba invadens
KKVSDAEI

SEQ ID NO: 2873390 - protein, 34 aa, Entamoeba invadens
KKVSDERDGYNQQLQAGKTKTAALTSAKNASDKK

SEQ ID NO: 2873391 - protein, 7 aa, Entamoeba invadens
KKVSEIE

SEQ ID NO: 2873392 - protein, 15 aa, Entamoeba invadens
KKVSEIEKEISSTFE

SEQ ID NO: 2873393 - protein, 10 aa, Entamoeba invadens
KKVSGSSDLA

SEQ ID NO: 2873394 - protein, 15 aa, Entamoeba invadens
KKVSKNKRGAKTPTV

SEQ ID NO: 2873395 - protein, 8 aa, Entamoeba invadens
KKVSKNQF

SEQ ID NO: 2873396 - protein, 17 aa, Entamoeba invadens
KKVSKRTIAKQFEKGVF

SEQ ID NO: 2873397 - protein, 11 aa, Entamoeba invadens
KKVSKRTIANS

SEQ ID NO: 2873398 - protein, 22 aa, Entamoeba invadens
KKVTDEEKLAEQREIKKSDSAF

SEQ ID NO: 2873399 - protein, 7 aa, Entamoeba invadens
KKVTISE

SEQ ID NO: 2873400 - protein, 12 aa, Entamoeba invadens
KKVTKKDNNALK

SEQ ID NO: 2873401 - protein, 8 aa, Entamoeba invadens
KKVTKKNA

SEQ ID NO: 2873402 - protein, 7 aa, Entamoeba invadens
KKVTLGN

SEQ ID NO: 2873403 - protein, 9 aa, Entamoeba invadens
KKVTTPGIQ

SEQ ID NO: 2873404 - protein, 29 aa, Entamoeba invadens
KKVVEEKREEIDEENEQEKPKIGKVGKVA

SEQ ID NO: 2873405 - protein, 14 aa, Entamoeba invadens
KKVVKKEEGKPEEV

SEQ ID NO: 2873406 - protein, 17 aa, Entamoeba invadens
KKVVREQPKPKPKNTEM

SEQ ID NO: 2873407 - protein, 17 aa, Entamoeba invadens
KKVYEEQVKADEGKAKE

SEQ ID NO: 2873408 - protein, 5 aa, Entamoeba invadens
KKWDG

SEQ ID NO: 2873409 - protein, 19 aa, Entamoeba invadens
KKWDSDLSNAEKRTASATD

SEQ ID NO: 2873410 - protein, 10 aa, Entamoeba invadens
KKWEEEQQAR

SEQ ID NO: 2873411 - protein, 7 aa, Entamoeba invadens
KKWNDEE

SEQ ID NO: 2873412 - protein, 7 aa, Entamoeba invadens
KKWPESG

SEQ ID NO: 2873413 - protein, 10 aa, Entamoeba invadens
KKWRDSVSQV

SEQ ID NO: 2873414 - protein, 7 aa, Entamoeba invadens
KKWTASE

SEQ ID NO: 2873415 - protein, 7 aa, Entamoeba invadens
KKWTDSL

SEQ ID NO: 2873416 - protein, 5 aa, Entamoeba invadens
KKWTE

SEQ ID NO: 2873417 - protein, 9 aa, Entamoeba invadens
KKWTEEEKI

SEQ ID NO: 2873418 - protein, 12 aa, Entamoeba invadens
KKYAADTSHLNA

SEQ ID NO: 2873419 - protein, 6 aa, Entamoeba invadens
KKYAPE

SEQ ID NO: 2873420 - protein, 9 aa, Entamoeba invadens
KKYARSNGV

SEQ ID NO: 2873421 - protein, 9 aa, Entamoeba invadens
KKYATRQQK

SEQ ID NO: 2873422 - protein, 5 aa, Entamoeba invadens
KKYDR

SEQ ID NO: 2873423 - protein, 10 aa, Entamoeba invadens
KKYDSYAGKN

SEQ ID NO: 2873424 - protein, 8 aa, Entamoeba invadens
KKYEDQEK

SEQ ID NO: 2873425 - protein, 20 aa, Entamoeba invadens
KKYEEKKDGSAEEEEGEEDD

SEQ ID NO: 2873426 - protein, 13 aa, Entamoeba invadens
KKYEEKTEKNIPS

SEQ ID NO: 2873427 - protein, 13 aa, Entamoeba invadens
KKYEGKLERKPSE

SEQ ID NO: 2873428 - protein, 8 aa, Entamoeba invadens
KKYEKDQD

SEQ ID NO: 2873429 - protein, 10 aa, Entamoeba invadens
KKYEKYGDLT

SEQ ID NO: 2873430 - protein, 7 aa, Entamoeba invadens
KKYEQSC

SEQ ID NO: 2873431 - protein, 7 aa, Entamoeba invadens
KKYEQSI

SEQ ID NO: 2873432 - protein, 19 aa, Entamoeba invadens
KKYFTGKAGRPDSHKAARE

SEQ ID NO: 2873433 - protein, 5 aa, Entamoeba invadens
KKYGE

SEQ ID NO: 2873434 - protein, 8 aa, Entamoeba invadens
KKYGECNA

SEQ ID NO: 2873435 - protein, 7 aa, Entamoeba invadens
KKYGEVG

SEQ ID NO: 2873436 - protein, 8 aa, Entamoeba invadens
KKYGGGMS

SEQ ID NO: 2873437 - protein, 7 aa, Entamoeba invadens
KKYGGTL

SEQ ID NO: 2873438 - protein, 16 aa, Entamoeba invadens
KKYGGVSKNGDSIPDP

SEQ ID NO: 2873439 - protein, 13 aa, Entamoeba invadens
KKYGKGCDATFKE

SEQ ID NO: 2873440 - protein, 8 aa, Entamoeba invadens
KKYGSSDA

SEQ ID NO: 2873441 - protein, 4 aa, Entamoeba invadens
KKYI

SEQ ID NO: 2873442 - protein, 8 aa, Entamoeba invadens
KKYKTPAD

SEQ ID NO: 2873443 - protein, 6 aa, Entamoeba invadens
KKYNED

SEQ ID NO: 2873444 - protein, 7 aa, Entamoeba invadens
KKYNGNL

SEQ ID NO: 2873445 - protein, 6 aa, Entamoeba invadens
KKYNNG

SEQ ID NO: 2873446 - protein, 7 aa, Entamoeba invadens
KKYNRNK

SEQ ID NO: 2873447 - protein, 7 aa, Entamoeba invadens
KKYPGQR

SEQ ID NO: 2873448 - protein, 5 aa, Entamoeba invadens
KKYPN

SEQ ID NO: 2873449 - protein, 11 aa, Entamoeba invadens
KKYPQGTERRY

SEQ ID NO: 2873450 - protein, 8 aa, Entamoeba invadens
KKYPSQGV

SEQ ID NO: 2873451 - protein, 8 aa, Entamoeba invadens
KKYPSYKQ

SEQ ID NO: 2873452 - protein, 14 aa, Entamoeba invadens
KKYPSYPKERDDEI

SEQ ID NO: 2873453 - protein, 5 aa, Entamoeba invadens
KKYQE

SEQ ID NO: 2873454 - protein, 5 aa, Entamoeba invadens
KKYQK

SEQ ID NO: 2873455 - protein, 5 aa, Entamoeba invadens
KKYQT

SEQ ID NO: 2873456 - protein, 8 aa, Entamoeba invadens
KKYRDNKT

SEQ ID NO: 2873457 - protein, 9 aa, Entamoeba invadens
KKYRDNKTM

SEQ ID NO: 2873458 - protein, 21 aa, Entamoeba invadens
KKYRRQERSPFGNYNMGYNPF

SEQ ID NO: 2873459 - protein, 4 aa, Entamoeba invadens
KKYS

SEQ ID NO: 2873460 - protein, 6 aa, Entamoeba invadens
KKYSEA

SEQ ID NO: 2873461 - protein, 19 aa, Entamoeba invadens
KKYSEKRVSSLGLKTSNSF

SEQ ID NO: 2873462 - protein, 7 aa, Entamoeba invadens
KKYSGND

SEQ ID NO: 2873463 - protein, 9 aa, Entamoeba invadens
KKYSKDNKV

SEQ ID NO: 2873464 - protein, 9 aa, Entamoeba invadens
KKYSPPSQR

SEQ ID NO: 2873465 - protein, 10 aa, Entamoeba invadens
KKYSQADEAG

SEQ ID NO: 2873466 - protein, 9 aa, Entamoeba invadens
KKYSSGMNK

SEQ ID NO: 2873467 - protein, 9 aa, Entamoeba invadens
KKYSTPSQR

SEQ ID NO: 2873468 - protein, 7 aa, Entamoeba invadens
KKYTALE

SEQ ID NO: 2873469 - protein, 6 aa, Entamoeba invadens
KKYTDL

SEQ ID NO: 2873470 - protein, 6 aa, Entamoeba invadens
KKYTDV

SEQ ID NO: 2873471 - protein, 5 aa, Entamoeba invadens
KKYTE

SEQ ID NO: 2873472 - protein, 8 aa, Entamoeba invadens
KKYTESSE

SEQ ID NO: 2873473 - protein, 16 aa, Entamoeba invadens
KKYTGDDNVWVEEVER

SEQ ID NO: 2873474 - protein, 4 aa, Entamoeba invadens
KKYY

SEQ ID NO: 2873475 - protein, 12 aa, Entamoeba invadens
KKYYKKGDYRTE

SEQ ID NO: 2873476 - protein, 13 aa, Entamoeba invadens
KLAAEECDEAYKD

SEQ ID NO: 2873477 - protein, 4 aa, Entamoeba invadens
KLAD

SEQ ID NO: 2873478 - protein, 4 aa, Entamoeba invadens
KLAE

SEQ ID NO: 2873479 - protein, 8 aa, Entamoeba invadens
KLAEEKEH

SEQ ID NO: 2873480 - protein, 12 aa, Entamoeba invadens
KLAEEKEHHTKD

SEQ ID NO: 2873481 - protein, 8 aa, Entamoeba invadens
KLAEEKEY

SEQ ID NO: 2873482 - protein, 5 aa, Entamoeba invadens
KLAEN

SEQ ID NO: 2873483 - protein, 5 aa, Entamoeba invadens
KLAIE

SEQ ID NO: 2873484 - protein, 12 aa, Entamoeba invadens
KLAKDTETYEES

SEQ ID NO: 2873485 - protein, 41 aa, Entamoeba invadens
KLAKEKAEKEAAAKRAEEERLAKEKVEKEKQLKEKQEAERI

SEQ ID NO: 2873486 - protein, 10 aa, Entamoeba invadens
KLAKKKKNNI

SEQ ID NO: 2873487 - protein, 25 aa, Entamoeba invadens
KLAKNKDDKKAKDDVEKASKDLDKA

SEQ ID NO: 2873488 - protein, 13 aa, Entamoeba invadens
KLAKSNNNTHKNN

SEQ ID NO: 2873489 - protein, 7 aa, Entamoeba invadens
KLAKTGI

SEQ ID NO: 2873490 - protein, 22 aa, Entamoeba invadens
KLANDKDQLSSEKKKLQDEYDQ

SEQ ID NO: 2873491 - protein, 18 aa, Entamoeba invadens
KLANDKDQLSSEKKKLQY

SEQ ID NO: 2873492 - protein, 6 aa, Entamoeba invadens
KLAPPK

SEQ ID NO: 2873493 - protein, 5 aa, Entamoeba invadens
KLAPR

SEQ ID NO: 2873494 - protein, 9 aa, Entamoeba invadens
KLAQTGTTP

SEQ ID NO: 2873495 - protein, 75 aa, Entamoeba invadens
KLAREEAERLEKERLAKEKAEQERIAQEKAEAERLEKERLEAEKTAKEKAEQEEKERLERERIAKEKAEAERLEA

SEQ ID NO: 2873496 - protein, 8 aa, Entamoeba invadens
KLASEKGS

SEQ ID NO: 2873497 - protein, 5 aa, Entamoeba invadens
KLAST

SEQ ID NO: 2873498 - protein, 6 aa, Entamoeba invadens
KLATSK

SEQ ID NO: 2873499 - protein, 14 aa, Entamoeba invadens
KLCGEGKKMEEVQQ

SEQ ID NO: 2873500 - protein, 13 aa, Entamoeba invadens
KLDDDDDEEDDAI

SEQ ID NO: 2873501 - protein, 12 aa, Entamoeba invadens
KLDDKDRVASSK

SEQ ID NO: 2873502 - protein, 7 aa, Entamoeba invadens
KLDDKKK

SEQ ID NO: 2873503 - protein, 5 aa, Entamoeba invadens
KLDDN

SEQ ID NO: 2873504 - protein, 12 aa, Entamoeba invadens
KLDDNESSFPLD

SEQ ID NO: 2873505 - protein, 33 aa, Entamoeba invadens
KLDEERQKADSADAARKAADIKLQEKKNKDLEE

SEQ ID NO: 2873506 - protein, 8 aa, Entamoeba invadens
KLDEITNN

SEQ ID NO: 2873507 - protein, 6 aa, Entamoeba invadens
KLDENI

SEQ ID NO: 2873508 - protein, 15 aa, Entamoeba invadens
KLDEQQEGSEHEDME

SEQ ID NO: 2873509 - protein, 8 aa, Entamoeba invadens
KLDEQTKI

SEQ ID NO: 2873510 - protein, 19 aa, Entamoeba invadens
KLDETPAGHQKEKVEAELK

SEQ ID NO: 2873511 - protein, 19 aa, Entamoeba invadens
KLDGKDKDDIKNESGSPKI

SEQ ID NO: 2873512 - protein, 5 aa, Entamoeba invadens
KLDGS

SEQ ID NO: 2873513 - protein, 15 aa, Entamoeba invadens
KLDKDSADKAKQQAA

SEQ ID NO: 2873514 - protein, 16 aa, Entamoeba invadens
KLDKDSADKAKQQAAL

SEQ ID NO: 2873515 - protein, 9 aa, Entamoeba invadens
KLDKTQHVN

SEQ ID NO: 2873516 - protein, 9 aa, Entamoeba invadens
KLDPHKKEM

SEQ ID NO: 2873517 - protein, 6 aa, Entamoeba invadens
KLDPST

SEQ ID NO: 2873518 - protein, 11 aa, Entamoeba invadens
KLDRDERTCDG

SEQ ID NO: 2873519 - protein, 15 aa, Entamoeba invadens
KLDSEEKKRQSAESA

SEQ ID NO: 2873520 - protein, 19 aa, Entamoeba invadens
KLDSGIKNSFDKKTVPVDN

SEQ ID NO: 2873521 - protein, 9 aa, Entamoeba invadens
KLDSRNEEG

SEQ ID NO: 2873522 - protein, 6 aa, Entamoeba invadens
KLDSSN

SEQ ID NO: 2873523 - protein, 9 aa, Entamoeba invadens
KLDTNGDGV

SEQ ID NO: 2873524 - protein, 12 aa, Entamoeba invadens
KLDTQHQSSQSF

SEQ ID NO: 2873525 - protein, 12 aa, Entamoeba invadens
KLDVPQNTETVS

SEQ ID NO: 2873526 - protein, 13 aa, Entamoeba invadens
KLEAEEDNQRISR

SEQ ID NO: 2873527 - protein, 14 aa, Entamoeba invadens
KLEAEEDNSKDFET

SEQ ID NO: 2873528 - protein, 26 aa, Entamoeba invadens
KLEAEEDNSKDIETQSHEKEDDIADL

SEQ ID NO: 2873529 - protein, 17 aa, Entamoeba invadens
KLEAEEDNSKDLETQLH

SEQ ID NO: 2873530 - protein, 41 aa, Entamoeba invadens
KLEAEQQRIAEEKRKMEVEKQRQEELQRKQQEEAERKAELE

SEQ ID NO: 2873531 - protein, 6 aa, Entamoeba invadens
KLEAGN

SEQ ID NO: 2873532 - protein, 5 aa, Entamoeba invadens
KLEDD

SEQ ID NO: 2873533 - protein, 11 aa, Entamoeba invadens
KLEDDDDDAID

SEQ ID NO: 2873534 - protein, 10 aa, Entamoeba invadens
KLEDEGGKRV

SEQ ID NO: 2873535 - protein, 8 aa, Entamoeba invadens
KLEDEKYN

SEQ ID NO: 2873536 - protein, 7 aa, Entamoeba invadens
KLEDLSN

SEQ ID NO: 2873537 - protein, 7 aa, Entamoeba invadens
KLEDQTV

SEQ ID NO: 2873538 - protein, 5 aa, Entamoeba invadens
KLEDT

SEQ ID NO: 2873539 - protein, 4 aa, Entamoeba invadens
KLEE

SEQ ID NO: 2873540 - protein, 7 aa, Entamoeba invadens
KLEEAIS

SEQ ID NO: 2873541 - protein, 6 aa, Entamoeba invadens
KLEEAS

SEQ ID NO: 2873542 - protein, 49 aa, Entamoeba invadens
KLEECTKQADLSKKAAEAAKQKNESAKASAEKALAKQKEAQAAEDEVTK

SEQ ID NO: 2873543 - protein, 23 aa, Entamoeba invadens
KLEEENKNLRDEVESATTQTVES

SEQ ID NO: 2873544 - protein, 44 aa, Entamoeba invadens
KLEEENRPVEEEYAKVKGKIDSEEKKTLDSNRSYDSNEKEYGRV

SEQ ID NO: 2873545 - protein, 28 aa, Entamoeba invadens
KLEEERKAEEKRLAKERKQKKEADDKQK

SEQ ID NO: 2873546 - protein, 6 aa, Entamoeba invadens
KLEEGA

SEQ ID NO: 2873547 - protein, 37 aa, Entamoeba invadens
KLEEGSSPTTPIDSSTPVNVGSDVQRSGSIKKGLKTT

SEQ ID NO: 2873548 - protein, 13 aa, Entamoeba invadens
KLEEKRGEMTPEL

SEQ ID NO: 2873549 - protein, 10 aa, Entamoeba invadens
KLEENDKKEF

SEQ ID NO: 2873550 - protein, 14 aa, Entamoeba invadens
KLEENGLGKYREQF

SEQ ID NO: 2873551 - protein, 5 aa, Entamoeba invadens
KLEEQ

SEQ ID NO: 2873552 - protein, 12 aa, Entamoeba invadens
KLEESSQIGEGS

SEQ ID NO: 2873553 - protein, 9 aa, Entamoeba invadens
KLEETNKFK

SEQ ID NO: 2873554 - protein, 5 aa, Entamoeba invadens
KLEGR

SEQ ID NO: 2873555 - protein, 14 aa, Entamoeba invadens
KLEKATDDASERVQ

SEQ ID NO: 2873556 - protein, 10 aa, Entamoeba invadens
KLEKDNHTQF

SEQ ID NO: 2873557 - protein, 5 aa, Entamoeba invadens
KLEKI

SEQ ID NO: 2873558 - protein, 35 aa, Entamoeba invadens
KLEKQNAKLTSDLAESKKLNDIRKDQALKSAESVK

SEQ ID NO: 2873559 - protein, 15 aa, Entamoeba invadens
KLEKRKERISSENID

SEQ ID NO: 2873560 - protein, 13 aa, Entamoeba invadens
KLEKSKDFKDTSV

SEQ ID NO: 2873561 - protein, 21 aa, Entamoeba invadens
KLENEGKAKWETKPKKEVEKL

SEQ ID NO: 2873562 - protein, 9 aa, Entamoeba invadens
KLENGGCEV

SEQ ID NO: 2873563 - protein, 9 aa, Entamoeba invadens
KLENSNTNL

SEQ ID NO: 2873564 - protein, 4 aa, Entamoeba invadens
KLEP

SEQ ID NO: 2873565 - protein, 6 aa, Entamoeba invadens
KLEPAE

SEQ ID NO: 2873566 - protein, 6 aa, Entamoeba invadens
KLEPEN

SEQ ID NO: 2873567 - protein, 41 aa, Entamoeba invadens
KLEPQMPTEVQSERPVERPRSSIGDCSRQNTARVSLDSTPM

SEQ ID NO: 2873568 - protein, 28 aa, Entamoeba invadens
KLEQAEEEKQEEQKQLYKKQTSISRNTF

SEQ ID NO: 2873569 - protein, 16 aa, Entamoeba invadens
KLEQERVAKEKAEAER

SEQ ID NO: 2873570 - protein, 15 aa, Entamoeba invadens
KLEQQVTRAEEEAQK

SEQ ID NO: 2873571 - protein, 19 aa, Entamoeba invadens
KLEQSNQKLSQAEEETQKV

SEQ ID NO: 2873572 - protein, 6 aa, Entamoeba invadens
KLERTQ

SEQ ID NO: 2873573 - protein, 11 aa, Entamoeba invadens
KLESADVSFSP

SEQ ID NO: 2873574 - protein, 19 aa, Entamoeba invadens
KLESDKPGSVFKKEANSTT

SEQ ID NO: 2873575 - protein, 18 aa, Entamoeba invadens
KLESELTSIRTQQKEVRA

SEQ ID NO: 2873576 - protein, 8 aa, Entamoeba invadens
KLESGRTH

SEQ ID NO: 2873577 - protein, 10 aa, Entamoeba invadens
KLESKNKKFK

SEQ ID NO: 2873578 - protein, 11 aa, Entamoeba invadens
KLESKNKKFKQ

SEQ ID NO: 2873579 - protein, 9 aa, Entamoeba invadens
KLESQTREL

SEQ ID NO: 2873580 - protein, 7 aa, Entamoeba invadens
KLESSGR

SEQ ID NO: 2873581 - protein, 4 aa, Entamoeba invadens
KLET

SEQ ID NO: 2873582 - protein, 5 aa, Entamoeba invadens
KLETH

SEQ ID NO: 2873583 - protein, 9 aa, Entamoeba invadens
KLETNPSPL

SEQ ID NO: 2873584 - protein, 14 aa, Entamoeba invadens
KLETPKESKGEKTP

SEQ ID NO: 2873585 - protein, 7 aa, Entamoeba invadens
KLETTTK

SEQ ID NO: 2873586 - protein, 8 aa, Entamoeba invadens
KLETTTQT

SEQ ID NO: 2873587 - protein, 5 aa, Entamoeba invadens
KLETV

SEQ ID NO: 2873588 - protein, 10 aa, Entamoeba invadens
KLEVKGNATV

SEQ ID NO: 2873589 - protein, 11 aa, Entamoeba invadens
KLGDEEDDQIH

SEQ ID NO: 2873590 - protein, 8 aa, Entamoeba invadens
KLGDTPDQ

SEQ ID NO: 2873591 - protein, 12 aa, Entamoeba invadens
KLGEALQKNEDC

SEQ ID NO: 2873592 - protein, 17 aa, Entamoeba invadens
KLGEEIEKREAAEKALS

SEQ ID NO: 2873593 - protein, 8 aa, Entamoeba invadens
KLGEGSEG

SEQ ID NO: 2873594 - protein, 10 aa, Entamoeba invadens
KLGEKERKPE

SEQ ID NO: 2873595 - protein, 8 aa, Entamoeba invadens
KLGENAIG

SEQ ID NO: 2873596 - protein, 8 aa, Entamoeba invadens
KLGESEKY

SEQ ID NO: 2873597 - protein, 6 aa, Entamoeba invadens
KLGESS

SEQ ID NO: 2873598 - protein, 5 aa, Entamoeba invadens
KLGET

SEQ ID NO: 2873599 - protein, 9 aa, Entamoeba invadens
KLGGENGAI

SEQ ID NO: 2873600 - protein, 14 aa, Entamoeba invadens
KLGGIGVTTQDEED

SEQ ID NO: 2873601 - protein, 7 aa, Entamoeba invadens
KLGGNTV

SEQ ID NO: 2873602 - protein, 7 aa, Entamoeba invadens
KLGKTFE

SEQ ID NO: 2873603 - protein, 8 aa, Entamoeba invadens
KLGNERTA

SEQ ID NO: 2873604 - protein, 22 aa, Entamoeba invadens
KLGNLENERTQNSHNAHPQANR

SEQ ID NO: 2873605 - protein, 11 aa, Entamoeba invadens
KLGPNCKTCNT

SEQ ID NO: 2873606 - protein, 7 aa, Entamoeba invadens
KLGPNGA

SEQ ID NO: 2873607 - protein, 6 aa, Entamoeba invadens
KLGQFS

SEQ ID NO: 2873608 - protein, 11 aa, Entamoeba invadens
KLGQSQGAAVT

SEQ ID NO: 2873609 - protein, 16 aa, Entamoeba invadens
KLGQTVDAKSQERKEF

SEQ ID NO: 2873610 - protein, 17 aa, Entamoeba invadens
KLGSNEENKKAQMNTEQ

SEQ ID NO: 2873611 - protein, 7 aa, Entamoeba invadens
KLGTESF

SEQ ID NO: 2873612 - protein, 8 aa, Entamoeba invadens
KLGTPRHP

SEQ ID NO: 2873613 - protein, 8 aa, Entamoeba invadens
KLHRESNR

SEQ ID NO: 2873614 - protein, 7 aa, Entamoeba invadens
KLIPPQT

SEQ ID NO: 2873615 - protein, 8 aa, Entamoeba invadens
KLISKNKD

SEQ ID NO: 2873616 - protein, 9 aa, Entamoeba invadens
KLKAQEDFN

SEQ ID NO: 2873617 - protein, 8 aa, Entamoeba invadens
KLKDDDIK

SEQ ID NO: 2873618 - protein, 6 aa, Entamoeba invadens
KLKDEN

SEQ ID NO: 2873619 - protein, 20 aa, Entamoeba invadens
KLKDPESVNAEFSQNQETQE

SEQ ID NO: 2873620 - protein, 11 aa, Entamoeba invadens
KLKDPESVNAT

SEQ ID NO: 2873621 - protein, 5 aa, Entamoeba invadens
KLKDQ

SEQ ID NO: 2873622 - protein, 5 aa, Entamoeba invadens
KLKDS

SEQ ID NO: 2873623 - protein, 24 aa, Entamoeba invadens
KLKDTEKEKVSLNEEVEAANEKLR

SEQ ID NO: 2873624 - protein, 4 aa, Entamoeba invadens
KLKE

SEQ ID NO: 2873625 - protein, 21 aa, Entamoeba invadens
KLKEDKKPQIKEEDSSSEEVI

SEQ ID NO: 2873626 - protein, 32 aa, Entamoeba invadens
KLKEENERKEREENERKMREAEEEKIRKQQEE

SEQ ID NO: 2873627 - protein, 10 aa, Entamoeba invadens
KLKEENERLK

SEQ ID NO: 2873628 - protein, 10 aa, Entamoeba invadens
KLKEGDNAYG

SEQ ID NO: 2873629 - protein, 24 aa, Entamoeba invadens
KLKEKIPKKKKQQMIKHSKRNQTK

SEQ ID NO: 2873630 - protein, 8 aa, Entamoeba invadens
KLKEKTQD

SEQ ID NO: 2873631 - protein, 7 aa, Entamoeba invadens
KLKERVS

SEQ ID NO: 2873632 - protein, 22 aa, Entamoeba invadens
KLKESDNNKQISGPIPSIDLGS

SEQ ID NO: 2873633 - protein, 12 aa, Entamoeba invadens
KLKESQDEASKW

SEQ ID NO: 2873634 - protein, 8 aa, Entamoeba invadens
KLKETQRS

SEQ ID NO: 2873635 - protein, 41 aa, Entamoeba invadens
KLKETTDVGNKEQKEEQINQQQRNKEDKTSPEFNDDISHYL

SEQ ID NO: 2873636 - protein, 7 aa, Entamoeba invadens
KLKKAEL

SEQ ID NO: 2873637 - protein, 16 aa, Entamoeba invadens
KLKKAGGADYSTNTSS

SEQ ID NO: 2873638 - protein, 15 aa, Entamoeba invadens
KLKKKTQSKASELAK

SEQ ID NO: 2873639 - protein, 19 aa, Entamoeba invadens
KLKKNSEQIDTKKEERAYL

SEQ ID NO: 2873640 - protein, 19 aa, Entamoeba invadens
KLKKQEHKVKTLKDTVKSL

SEQ ID NO: 2873641 - protein, 9 aa, Entamoeba invadens
KLKKQKSAI

SEQ ID NO: 2873642 - protein, 9 aa, Entamoeba invadens
KLKLQRKPP

SEQ ID NO: 2873643 - protein, 4 aa, Entamoeba invadens
KLKN

SEQ ID NO: 2873644 - protein, 8 aa, Entamoeba invadens
KLKNEIEK

SEQ ID NO: 2873645 - protein, 19 aa, Entamoeba invadens
KLKNEKNEVVENTNKQIKT

SEQ ID NO: 2873646 - protein, 8 aa, Entamoeba invadens
KLKNETSQ

SEQ ID NO: 2873647 - protein, 7 aa, Entamoeba invadens
KLKNNFP

SEQ ID NO: 2873648 - protein, 17 aa, Entamoeba invadens
KLKNPEKIQKNSAQSEL

SEQ ID NO: 2873649 - protein, 6 aa, Entamoeba invadens
KLKPLE

SEQ ID NO: 2873650 - protein, 7 aa, Entamoeba invadens
KLKPTKG

SEQ ID NO: 2873651 - protein, 6 aa, Entamoeba invadens
KLKPVS

SEQ ID NO: 2873652 - protein, 23 aa, Entamoeba invadens
KLKQDAAKEKETAIAAKETEVAA

SEQ ID NO: 2873653 - protein, 6 aa, Entamoeba invadens
KLKQDD

SEQ ID NO: 2873654 - protein, 15 aa, Entamoeba invadens
KLKQVTKPRKGQKLS

SEQ ID NO: 2873655 - protein, 12 aa, Entamoeba invadens
KLKSDNSSLNLS

SEQ ID NO: 2873656 - protein, 8 aa, Entamoeba invadens
KLKSEKEQ

SEQ ID NO: 2873657 - protein, 9 aa, Entamoeba invadens
KLKSENAAL

SEQ ID NO: 2873658 - protein, 5 aa, Entamoeba invadens
KLKSY

SEQ ID NO: 2873659 - protein, 4 aa, Entamoeba invadens
KLKT

SEQ ID NO: 2873660 - protein, 7 aa, Entamoeba invadens
KLKTKQL

SEQ ID NO: 2873661 - protein, 8 aa, Entamoeba invadens
KLKTPKKG

SEQ ID NO: 2873662 - protein, 18 aa, Entamoeba invadens
KLKTPNSIRDNDFDVEND

SEQ ID NO: 2873663 - protein, 10 aa, Entamoeba invadens
KLKTSHSANF

SEQ ID NO: 2873664 - protein, 8 aa, Entamoeba invadens
KLKTSPDL

SEQ ID NO: 2873665 - protein, 9 aa, Entamoeba invadens
KLKTTHEGD

SEQ ID NO: 2873666 - protein, 4 aa, Entamoeba invadens
KLKV

SEQ ID NO: 2873667 - protein, 5 aa, Entamoeba invadens
KLKVE

SEQ ID NO: 2873668 - protein, 9 aa, Entamoeba invadens
KLLEESPRR

SEQ ID NO: 2873669 - protein, 9 aa, Entamoeba invadens
KLLEQRANS

SEQ ID NO: 2873670 - protein, 13 aa, Entamoeba invadens
KLLQQENERVTMT

SEQ ID NO: 2873671 - protein, 7 aa, Entamoeba invadens
KLMGEKG

SEQ ID NO: 2873672 - protein, 10 aa, Entamoeba invadens
KLMPQNDTLQ

SEQ ID NO: 2873673 - protein, 29 aa, Entamoeba invadens
KLMSSSSLSTNSPEQSPRREKQHDHTPSF

SEQ ID NO: 2873674 - protein, 8 aa, Entamoeba invadens
KLNDENVQ

SEQ ID NO: 2873675 - protein, 8 aa, Entamoeba invadens
KLNDKSES

SEQ ID NO: 2873676 - protein, 10 aa, Entamoeba invadens
KLNEAKEAID

SEQ ID NO: 2873677 - protein, 17 aa, Entamoeba invadens
KLNEERAVENFLVKSVR

SEQ ID NO: 2873678 - protein, 6 aa, Entamoeba invadens
KLNEET

SEQ ID NO: 2873679 - protein, 12 aa, Entamoeba invadens
KLNEHDEASEYE

SEQ ID NO: 2873680 - protein, 30 aa, Entamoeba invadens
KLNEKYTKIPRGGSTKSHVKGQDYIKPDFG

SEQ ID NO: 2873681 - protein, 10 aa, Entamoeba invadens
KLNEQQRTAY

SEQ ID NO: 2873682 - protein, 5 aa, Entamoeba invadens
KLNGD

SEQ ID NO: 2873683 - protein, 10 aa, Entamoeba invadens
KLNGKELGSQ

SEQ ID NO: 2873684 - protein, 40 aa, Entamoeba invadens
KLNGNNFDNNNPANTPCQAVDENEENEEQNDEGRTRTNRL

SEQ ID NO: 2873685 - protein, 16 aa, Entamoeba invadens
KLNGRGGAIKRQKASE

SEQ ID NO: 2873686 - protein, 7 aa, Entamoeba invadens
KLNKDGD

SEQ ID NO: 2873687 - protein, 14 aa, Entamoeba invadens
KLNNDKYTISETEN

SEQ ID NO: 2873688 - protein, 5 aa, Entamoeba invadens
KLNNE

SEQ ID NO: 2873689 - protein, 7 aa, Entamoeba invadens
KLNNEYN

SEQ ID NO: 2873690 - protein, 16 aa, Entamoeba invadens
KLNPLGQDEDAKGTDA

SEQ ID NO: 2873691 - protein, 18 aa, Entamoeba invadens
KLNRNMEETSLDTFGASE

SEQ ID NO: 2873692 - protein, 6 aa, Entamoeba invadens
KLNRPN

SEQ ID NO: 2873693 - protein, 6 aa, Entamoeba invadens
KLNRSE

SEQ ID NO: 2873694 - protein, 7 aa, Entamoeba invadens
KLNSEFG

SEQ ID NO: 2873695 - protein, 9 aa, Entamoeba invadens
KLNSKGNGM

SEQ ID NO: 2873696 - protein, 6 aa, Entamoeba invadens
KLNSKL

SEQ ID NO: 2873697 - protein, 15 aa, Entamoeba invadens
KLNSKPERLKRLRES

SEQ ID NO: 2873698 - protein, 12 aa, Entamoeba invadens
KLNSKRADFNDD

SEQ ID NO: 2873699 - protein, 9 aa, Entamoeba invadens
KLNVDKDDN

SEQ ID NO: 2873700 - protein, 9 aa, Entamoeba invadens
KLPDEKEIK

SEQ ID NO: 2873701 - protein, 10 aa, Entamoeba invadens
KLPDGKEIKL

SEQ ID NO: 2873702 - protein, 9 aa, Entamoeba invadens
KLPDSTLNG

SEQ ID NO: 2873703 - protein, 11 aa, Entamoeba invadens
KLPEGKKEDRW

SEQ ID NO: 2873704 - protein, 7 aa, Entamoeba invadens
KLPEGTQ

SEQ ID NO: 2873705 - protein, 9 aa, Entamoeba invadens
KLPENQALP

SEQ ID NO: 2873706 - protein, 21 aa, Entamoeba invadens
KLPESPRGDIKTKSVLSSNSD

SEQ ID NO: 2873707 - protein, 8 aa, Entamoeba invadens
KLPESTQK

SEQ ID NO: 2873708 - protein, 15 aa, Entamoeba invadens
KLPEYSKENEPLQKC

SEQ ID NO: 2873709 - protein, 8 aa, Entamoeba invadens
KLPGGADL

SEQ ID NO: 2873710 - protein, 7 aa, Entamoeba invadens
KLPGGPF

SEQ ID NO: 2873711 - protein, 7 aa, Entamoeba invadens
KLPGNAI

SEQ ID NO: 2873712 - protein, 12 aa, Entamoeba invadens
KLPGRTANQVKN

SEQ ID NO: 2873713 - protein, 4 aa, Entamoeba invadens
KLPH

SEQ ID NO: 2873714 - protein, 24 aa, Entamoeba invadens
KLPKAEKTTKKDAHPQPKKKKKKR

SEQ ID NO: 2873715 - protein, 6 aa, Entamoeba invadens
KLPKDL

SEQ ID NO: 2873716 - protein, 6 aa, Entamoeba invadens
KLPKDV

SEQ ID NO: 2873717 - protein, 26 aa, Entamoeba invadens
KLPKEKKRNATFRKSSVQKEKKELKS

SEQ ID NO: 2873718 - protein, 10 aa, Entamoeba invadens
KLPKENQPAL

SEQ ID NO: 2873719 - protein, 8 aa, Entamoeba invadens
KLPKETNS

SEQ ID NO: 2873720 - protein, 6 aa, Entamoeba invadens
KLPKEV

SEQ ID NO: 2873721 - protein, 24 aa, Entamoeba invadens
KLPKHDKPHSQTDKKESEPPKKFD

SEQ ID NO: 2873722 - protein, 11 aa, Entamoeba invadens
KLPKNDIGKAL

SEQ ID NO: 2873723 - protein, 19 aa, Entamoeba invadens
KLPKPTTSSEQQTCSSQQP

SEQ ID NO: 2873724 - protein, 11 aa, Entamoeba invadens
KLPKTEKGLID

SEQ ID NO: 2873725 - protein, 10 aa, Entamoeba invadens
KLPKVKGKKM

SEQ ID NO: 2873726 - protein, 7 aa, Entamoeba invadens
KLPNGYS

SEQ ID NO: 2873727 - protein, 6 aa, Entamoeba invadens
KLPNPN

SEQ ID NO: 2873728 - protein, 9 aa, Entamoeba invadens
KLPNPTKQN

SEQ ID NO: 2873729 - protein, 6 aa, Entamoeba invadens
KLPNTK

SEQ ID NO: 2873730 - protein, 4 aa, Entamoeba invadens
KLPP

SEQ ID NO: 2873731 - protein, 8 aa, Entamoeba invadens
KLPPDQKH

SEQ ID NO: 2873732 - protein, 5 aa, Entamoeba invadens
KLPPH

SEQ ID NO: 2873733 - protein, 50 aa, Entamoeba invadens
KLPPHLSPYGNGDGDYISERRKELDNIKKGHEYNYDEDAEKKEKASKEII

SEQ ID NO: 2873734 - protein, 7 aa, Entamoeba invadens
KLPPIEK

SEQ ID NO: 2873735 - protein, 7 aa, Entamoeba invadens
KLPPNIT

SEQ ID NO: 2873736 - protein, 14 aa, Entamoeba invadens
KLPPPTPPKPRATL

SEQ ID NO: 2873737 - protein, 6 aa, Entamoeba invadens
KLPPSH

SEQ ID NO: 2873738 - protein, 5 aa, Entamoeba invadens
KLPPT

SEQ ID NO: 2873739 - protein, 8 aa, Entamoeba invadens
KLPQAPGI

SEQ ID NO: 2873740 - protein, 11 aa, Entamoeba invadens
KLPQDLRSKPI

SEQ ID NO: 2873741 - protein, 4 aa, Entamoeba invadens
KLPR

SEQ ID NO: 2873742 - protein, 6 aa, Entamoeba invadens
KLPRKS

SEQ ID NO: 2873743 - protein, 41 aa, Entamoeba invadens
KLPSEIEKVENQVQQSAPTQYTKSPSPKLQQQPKQPHPYQQ

SEQ ID NO: 2873744 - protein, 7 aa, Entamoeba invadens
KLPSKGI

SEQ ID NO: 2873745 - protein, 7 aa, Entamoeba invadens
KLPSKIK

SEQ ID NO: 2873746 - protein, 9 aa, Entamoeba invadens
KLPSKKSIN

SEQ ID NO: 2873747 - protein, 7 aa, Entamoeba invadens
KLPSKSI

SEQ ID NO: 2873748 - protein, 9 aa, Entamoeba invadens
KLPSNAKVT

SEQ ID NO: 2873749 - protein, 8 aa, Entamoeba invadens
KLPSNLKE

SEQ ID NO: 2873750 - protein, 12 aa, Entamoeba invadens
KLPSNTTSLPPN

SEQ ID NO: 2873751 - protein, 12 aa, Entamoeba invadens
KLPSSVTKTQEI

SEQ ID NO: 2873752 - protein, 5 aa, Entamoeba invadens
KLPST

SEQ ID NO: 2873753 - protein, 8 aa, Entamoeba invadens
KLPTEKVS

SEQ ID NO: 2873754 - protein, 5 aa, Entamoeba invadens
KLPTF

SEQ ID NO: 2873755 - protein, 9 aa, Entamoeba invadens
KLPTKTELQ

SEQ ID NO: 2873756 - protein, 6 aa, Entamoeba invadens
KLPTNN

SEQ ID NO: 2873757 - protein, 7 aa, Entamoeba invadens
KLPTQLA

SEQ ID NO: 2873758 - protein, 5 aa, Entamoeba invadens
KLPTT

SEQ ID NO: 2873759 - protein, 13 aa, Entamoeba invadens
KLPTTAAALADGN

SEQ ID NO: 2873760 - protein, 17 aa, Entamoeba invadens
KLPTTANGKKLATRLLT

SEQ ID NO: 2873761 - protein, 30 aa, Entamoeba invadens
KLQDEKEQIENNKKTLSDELEKTKEENKKI

SEQ ID NO: 2873762 - protein, 7 aa, Entamoeba invadens
KLQDESY

SEQ ID NO: 2873763 - protein, 11 aa, Entamoeba invadens
KLQDPDTEAEI

SEQ ID NO: 2873764 - protein, 4 aa, Entamoeba invadens
KLQE

SEQ ID NO: 2873765 - protein, 7 aa, Entamoeba invadens
KLQEANN

SEQ ID NO: 2873766 - protein, 12 aa, Entamoeba invadens
KLQEEMKEVRRE

SEQ ID NO: 2873767 - protein, 52 aa, Entamoeba invadens
KLQEKTDTKVRCEKEEKKEKKLKTPQPSSKGEDDENKQKKKKRRFSEEETQN

SEQ ID NO: 2873768 - protein, 17 aa, Entamoeba invadens
KLQEQRKRGRQDQTDPS

SEQ ID NO: 2873769 - protein, 5 aa, Entamoeba invadens
KLQIS

SEQ ID NO: 2873770 - protein, 24 aa, Entamoeba invadens
KLQKMKRTKKTKQVEEPENTEIDT

SEQ ID NO: 2873771 - protein, 9 aa, Entamoeba invadens
KLQKPSEKF

SEQ ID NO: 2873772 - protein, 9 aa, Entamoeba invadens
KLQKQNDEF

SEQ ID NO: 2873773 - protein, 6 aa, Entamoeba invadens
KLQNET

SEQ ID NO: 2873774 - protein, 52 aa, Entamoeba invadens
KLQNTISDVNAQNEDIDSKVSDERDGYNQQLQAEKTKTAALTSAKNASDKKI

SEQ ID NO: 2873775 - protein, 38 aa, Entamoeba invadens
KLQNTISDVNAQNEDTGAVLNDTKDDIANTKNDLKKTQ

SEQ ID NO: 2873776 - protein, 37 aa, Entamoeba invadens
KLQNTISDVNAQNEDTGAVLNDTKDDLANTKNDLKKT

SEQ ID NO: 2873777 - protein, 37 aa, Entamoeba invadens
KLQNTISDVNAQNEDTGAVLNDTKDDLSNTKNELKKT

SEQ ID NO: 2873778 - protein, 32 aa, Entamoeba invadens
KLQNTISDVNAQNEDTGAVLNDTKDDTEKKLD

SEQ ID NO: 2873779 - protein, 22 aa, Entamoeba invadens
KLQNTISDVNAQNENTGSTKTA

SEQ ID NO: 2873780 - protein, 8 aa, Entamoeba invadens
KLQNTNDA

SEQ ID NO: 2873781 - protein, 7 aa, Entamoeba invadens
KLQPDPK

SEQ ID NO: 2873782 - protein, 48 aa, Entamoeba invadens
KLQPQTEQKKVQPKAGKKHDSDSESENELSSSDSIDSEEANLIRMSKT

SEQ ID NO: 2873783 - protein, 6 aa, Entamoeba invadens
KLQPTE

SEQ ID NO: 2873784 - protein, 5 aa, Entamoeba invadens
KLQQP

SEQ ID NO: 2873785 - protein, 13 aa, Entamoeba invadens
KLQRKDSKRRERI

SEQ ID NO: 2873786 - protein, 9 aa, Entamoeba invadens
KLQSTKARE

SEQ ID NO: 2873787 - protein, 4 aa, Entamoeba invadens
KLQT

SEQ ID NO: 2873788 - protein, 27 aa, Entamoeba invadens
KLQTKDDTVLESNENLTSGSSSLLESP

SEQ ID NO: 2873789 - protein, 12 aa, Entamoeba invadens
KLQTKNEEYPPI

SEQ ID NO: 2873790 - protein, 6 aa, Entamoeba invadens
KLQTNR

SEQ ID NO: 2873791 - protein, 10 aa, Entamoeba invadens
KLQTSSKDQQ

SEQ ID NO: 2873792 - protein, 8 aa, Entamoeba invadens
KLREAEGD

SEQ ID NO: 2873793 - protein, 13 aa, Entamoeba invadens
KLREAKVERKKEL

SEQ ID NO: 2873794 - protein, 7 aa, Entamoeba invadens
KLREESP

SEQ ID NO: 2873795 - protein, 7 aa, Entamoeba invadens
KLRGQRA

SEQ ID NO: 2873796 - protein, 6 aa, Entamoeba invadens
KLRKIG

SEQ ID NO: 2873797 - protein, 16 aa, Entamoeba invadens
KLRKSDSFRELPLATR

SEQ ID NO: 2873798 - protein, 6 aa, Entamoeba invadens
KLRKYK

SEQ ID NO: 2873799 - protein, 6 aa, Entamoeba invadens
KLRNEI

SEQ ID NO: 2873800 - protein, 7 aa, Entamoeba invadens
KLRNSTF

SEQ ID NO: 2873801 - protein, 18 aa, Entamoeba invadens
KLRNYREQARGTDSDGMK

SEQ ID NO: 2873802 - protein, 12 aa, Entamoeba invadens
KLRQTSQNRPKF

SEQ ID NO: 2873803 - protein, 5 aa, Entamoeba invadens
KLRRE

SEQ ID NO: 2873804 - protein, 6 aa, Entamoeba invadens
KLRSEV

SEQ ID NO: 2873805 - protein, 20 aa, Entamoeba invadens
KLRTRKGPKQTPLDKPAANL

SEQ ID NO: 2873806 - protein, 15 aa, Entamoeba invadens
KLSAEGIVPQKSKGV

SEQ ID NO: 2873807 - protein, 7 aa, Entamoeba invadens
KLSASSI

SEQ ID NO: 2873808 - protein, 6 aa, Entamoeba invadens
KLSDAQ

SEQ ID NO: 2873809 - protein, 10 aa, Entamoeba invadens
KLSDKKETRR

SEQ ID NO: 2873810 - protein, 20 aa, Entamoeba invadens
KLSDKMEEAVEEVNEDELKN

SEQ ID NO: 2873811 - protein, 7 aa, Entamoeba invadens
KLSDPKD

SEQ ID NO: 2873812 - protein, 5 aa, Entamoeba invadens
KLSDY

SEQ ID NO: 2873813 - protein, 8 aa, Entamoeba invadens
KLSEEAQK

SEQ ID NO: 2873814 - protein, 7 aa, Entamoeba invadens
KLSEEDF

SEQ ID NO: 2873815 - protein, 9 aa, Entamoeba invadens
KLSEENTTV

SEQ ID NO: 2873816 - protein, 15 aa, Entamoeba invadens
KLSEISKKGKQSKML

SEQ ID NO: 2873817 - protein, 19 aa, Entamoeba invadens
KLSEKHSEKHFETPKPIQP

SEQ ID NO: 2873818 - protein, 6 aa, Entamoeba invadens
KLSEPM

SEQ ID NO: 2873819 - protein, 12 aa, Entamoeba invadens
KLSETKTSDNKR

SEQ ID NO: 2873820 - protein, 4 aa, Entamoeba invadens
KLSF

SEQ ID NO: 2873821 - protein, 10 aa, Entamoeba invadens
KLSGGKNECS

SEQ ID NO: 2873822 - protein, 7 aa, Entamoeba invadens
KLSGKQQ

SEQ ID NO: 2873823 - protein, 6 aa, Entamoeba invadens
KLSGMP

SEQ ID NO: 2873824 - protein, 7 aa, Entamoeba invadens
KLSGVTP

SEQ ID NO: 2873825 - protein, 18 aa, Entamoeba invadens
KLSKKHSIEKKIGQHNQK

SEQ ID NO: 2873826 - protein, 8 aa, Entamoeba invadens
KLSKKSAT

SEQ ID NO: 2873827 - protein, 12 aa, Entamoeba invadens
KLSKNGGNNDLT

SEQ ID NO: 2873828 - protein, 16 aa, Entamoeba invadens
KLSKQKVEKHEGSIRV

SEQ ID NO: 2873829 - protein, 12 aa, Entamoeba invadens
KLSKSKSNIPRE

SEQ ID NO: 2873830 - protein, 5 aa, Entamoeba invadens
KLSLK

SEQ ID NO: 2873831 - protein, 7 aa, Entamoeba invadens
KLSNPAS

SEQ ID NO: 2873832 - protein, 11 aa, Entamoeba invadens
KLSNPPKTKFT

SEQ ID NO: 2873833 - protein, 4 aa, Entamoeba invadens
KLSP

SEQ ID NO: 2873834 - protein, 13 aa, Entamoeba invadens
KLSPDDKAAIEAT

SEQ ID NO: 2873835 - protein, 18 aa, Entamoeba invadens
KLSPDEKSQKAFFLGKSI

SEQ ID NO: 2873836 - protein, 8 aa, Entamoeba invadens
KLSPEERE

SEQ ID NO: 2873837 - protein, 16 aa, Entamoeba invadens
KLSPKQKEYYKTLAKK

SEQ ID NO: 2873838 - protein, 10 aa, Entamoeba invadens
KLSPNNDSIH

SEQ ID NO: 2873839 - protein, 7 aa, Entamoeba invadens
KLSPQSV

SEQ ID NO: 2873840 - protein, 5 aa, Entamoeba invadens
KLSQE

SEQ ID NO: 2873841 - protein, 9 aa, Entamoeba invadens
KLSQGYPNP

SEQ ID NO: 2873842 - protein, 7 aa, Entamoeba invadens
KLSQQGQ

SEQ ID NO: 2873843 - protein, 7 aa, Entamoeba invadens
KLSRDQA

SEQ ID NO: 2873844 - protein, 6 aa, Entamoeba invadens
KLSRES

SEQ ID NO: 2873845 - protein, 11 aa, Entamoeba invadens
KLSRKSEKTFS

SEQ ID NO: 2873846 - protein, 5 aa, Entamoeba invadens
KLSRQ

SEQ ID NO: 2873847 - protein, 10 aa, Entamoeba invadens
KLSRSEIEEE

SEQ ID NO: 2873848 - protein, 11 aa, Entamoeba invadens
KLSRTPKIKSA

SEQ ID NO: 2873849 - protein, 14 aa, Entamoeba invadens
KLSSKDTLENEKQP

SEQ ID NO: 2873850 - protein, 41 aa, Entamoeba invadens
KLSSKEKKEQKKQKKDEEKQRKEEEKARKEKEKDEKRQQKL

SEQ ID NO: 2873851 - protein, 16 aa, Entamoeba invadens
KLSSKENTCDGTPLQN

SEQ ID NO: 2873852 - protein, 10 aa, Entamoeba invadens
KLSSQPTQTI

SEQ ID NO: 2873853 - protein, 10 aa, Entamoeba invadens
KLSSSADDVV

SEQ ID NO: 2873854 - protein, 15 aa, Entamoeba invadens
KLSSSEAKRQSQSFK

SEQ ID NO: 2873855 - protein, 12 aa, Entamoeba invadens
KLSSTTGTIQIQ

SEQ ID NO: 2873856 - protein, 6 aa, Entamoeba invadens
KLSSTY

SEQ ID NO: 2873857 - protein, 8 aa, Entamoeba invadens
KLSTADKP

SEQ ID NO: 2873858 - protein, 6 aa, Entamoeba invadens
KLSTEN

SEQ ID NO: 2873859 - protein, 5 aa, Entamoeba invadens
KLSTK

SEQ ID NO: 2873860 - protein, 19 aa, Entamoeba invadens
KLSTNKSEWEERQKSMQEE

SEQ ID NO: 2873861 - protein, 5 aa, Entamoeba invadens
KLSVE

SEQ ID NO: 2873862 - protein, 7 aa, Entamoeba invadens
KLSVNGK

SEQ ID NO: 2873863 - protein, 11 aa, Entamoeba invadens
KLSYSSQNSQI

SEQ ID NO: 2873864 - protein, 5 aa, Entamoeba invadens
KLTAD

SEQ ID NO: 2873865 - protein, 10 aa, Entamoeba invadens
KLTASKEHGI

SEQ ID NO: 2873866 - protein, 6 aa, Entamoeba invadens
KLTATR

SEQ ID NO: 2873867 - protein, 18 aa, Entamoeba invadens
KLTDEQWDQIRPEVEEIF

SEQ ID NO: 2873868 - protein, 9 aa, Entamoeba invadens
KLTDEREEV

SEQ ID NO: 2873869 - protein, 8 aa, Entamoeba invadens
KLTDFGAS

SEQ ID NO: 2873870 - protein, 8 aa, Entamoeba invadens
KLTDFGSA

SEQ ID NO: 2873871 - protein, 10 aa, Entamoeba invadens
KLTDFGSSRN

SEQ ID NO: 2873872 - protein, 15 aa, Entamoeba invadens
KLTDSANKAITAAER

SEQ ID NO: 2873873 - protein, 5 aa, Entamoeba invadens
KLTED

SEQ ID NO: 2873874 - protein, 30 aa, Entamoeba invadens
KLTEDEKKAVQEGEEALRRKEREKNKEELG

SEQ ID NO: 2873875 - protein, 8 aa, Entamoeba invadens
KLTEEKEH

SEQ ID NO: 2873876 - protein, 10 aa, Entamoeba invadens
KLTEEKEHYE

SEQ ID NO: 2873877 - protein, 5 aa, Entamoeba invadens
KLTEL

SEQ ID NO: 2873878 - protein, 7 aa, Entamoeba invadens
KLTELPD

SEQ ID NO: 2873879 - protein, 8 aa, Entamoeba invadens
KLTENSKR

SEQ ID NO: 2873880 - protein, 8 aa, Entamoeba invadens
KLTEQEVE

SEQ ID NO: 2873881 - protein, 13 aa, Entamoeba invadens
KLTGQVAGTVGSL

SEQ ID NO: 2873882 - protein, 34 aa, Entamoeba invadens
KLTGTQSIGKPQKAMDSESESELSSSCSADSPKS

SEQ ID NO: 2873883 - protein, 10 aa, Entamoeba invadens
KLTKKANDLT

SEQ ID NO: 2873884 - protein, 9 aa, Entamoeba invadens
KLTKQNGRM

SEQ ID NO: 2873885 - protein, 25 aa, Entamoeba invadens
KLTLSNSPSPRLEDDGINRNRTESF

SEQ ID NO: 2873886 - protein, 15 aa, Entamoeba invadens
KLTNAQRSGLNQIPN

SEQ ID NO: 2873887 - protein, 7 aa, Entamoeba invadens
KLTNESV

SEQ ID NO: 2873888 - protein, 29 aa, Entamoeba invadens
KLTNEYKKLEADNQRLQDEITEHKATIAK

SEQ ID NO: 2873889 - protein, 5 aa, Entamoeba invadens
KLTNQ

SEQ ID NO: 2873890 - protein, 22 aa, Entamoeba invadens
KLTNTEQQKEEIDKQKTEIEEK

SEQ ID NO: 2873891 - protein, 5 aa, Entamoeba invadens
KLTPI

SEQ ID NO: 2873892 - protein, 10 aa, Entamoeba invadens
KLTPNPPADY

SEQ ID NO: 2873893 - protein, 5 aa, Entamoeba invadens
KLTPT

SEQ ID NO: 2873894 - protein, 9 aa, Entamoeba invadens
KLTPTEQGT

SEQ ID NO: 2873895 - protein, 6 aa, Entamoeba invadens
KLTQDA

SEQ ID NO: 2873896 - protein, 17 aa, Entamoeba invadens
KLTQDPPTGITAGPISE

SEQ ID NO: 2873897 - protein, 6 aa, Entamoeba invadens
KLTQES

SEQ ID NO: 2873898 - protein, 8 aa, Entamoeba invadens
KLTQPTRA

SEQ ID NO: 2873899 - protein, 9 aa, Entamoeba invadens
KLTRNETKE

SEQ ID NO: 2873900 - protein, 5 aa, Entamoeba invadens
KLTSE

SEQ ID NO: 2873901 - protein, 6 aa, Entamoeba invadens
KLTSKT

SEQ ID NO: 2873902 - protein, 7 aa, Entamoeba invadens
KLTSQKQ

SEQ ID NO: 2873903 - protein, 8 aa, Entamoeba invadens
KLTSQNQR

SEQ ID NO: 2873904 - protein, 12 aa, Entamoeba invadens
KLTSSSDEVVSP

SEQ ID NO: 2873905 - protein, 7 aa, Entamoeba invadens
KLTSVAS

SEQ ID NO: 2873906 - protein, 9 aa, Entamoeba invadens
KLTTDEQDN

SEQ ID NO: 2873907 - protein, 5 aa, Entamoeba invadens
KLTTE

SEQ ID NO: 2873908 - protein, 8 aa, Entamoeba invadens
KLTTEEKI

SEQ ID NO: 2873909 - protein, 26 aa, Entamoeba invadens
KLTTESDQSLNREAPETTSKVPRGGM

SEQ ID NO: 2873910 - protein, 6 aa, Entamoeba invadens
KLTTGT

SEQ ID NO: 2873911 - protein, 5 aa, Entamoeba invadens
KLTTK

SEQ ID NO: 2873912 - protein, 10 aa, Entamoeba invadens
KLTTSRREKS

SEQ ID NO: 2873913 - protein, 31 aa, Entamoeba invadens
KLTTSTFEQDKSNETTTYSEERKIQTNKSTI

SEQ ID NO: 2873914 - protein, 7 aa, Entamoeba invadens
KLTTVGD

SEQ ID NO: 2873915 - protein, 27 aa, Entamoeba invadens
KLTVSGGAKRKNTNGNKSSEGNLKAEY

SEQ ID NO: 2873916 - protein, 31 aa, Entamoeba invadens
KLTVSGGAKRKNTNGNKSSEGNLKAEYTGKK

SEQ ID NO: 2873917 - protein, 25 aa, Entamoeba invadens
KLVAEGKLEKYGKPTDKTPAEYTKS

SEQ ID NO: 2873918 - protein, 13 aa, Entamoeba invadens
KLVEEKEAKEADL

SEQ ID NO: 2873919 - protein, 19 aa, Entamoeba invadens
KLVESEEKYINEQQTLQQE

SEQ ID NO: 2873920 - protein, 10 aa, Entamoeba invadens
KLVPGGGASE

SEQ ID NO: 2873921 - protein, 17 aa, Entamoeba invadens
KLVTTSPKSAGSCEMSQ

SEQ ID NO: 2873922 - protein, 5 aa, Entamoeba invadens
KLYEG

SEQ ID NO: 2873923 - protein, 7 aa, Entamoeba invadens
KLYSNSN

SEQ ID NO: 2873924 - protein, 8 aa, Entamoeba invadens
KMAEPTRE

SEQ ID NO: 2873925 - protein, 14 aa, Entamoeba invadens
KMAKSKKTLDTEQS

SEQ ID NO: 2873926 - protein, 8 aa, Entamoeba invadens
KMAKSTGN

SEQ ID NO: 2873927 - protein, 8 aa, Entamoeba invadens
KMANANTD

SEQ ID NO: 2873928 - protein, 10 aa, Entamoeba invadens
KMAREESCSP

SEQ ID NO: 2873929 - protein, 7 aa, Entamoeba invadens
KMDDMTK

SEQ ID NO: 2873930 - protein, 8 aa, Entamoeba invadens
KMDENNWP

SEQ ID NO: 2873931 - protein, 7 aa, Entamoeba invadens
KMDESDK

SEQ ID NO: 2873932 - protein, 12 aa, Entamoeba invadens
KMDETPNETPKE

SEQ ID NO: 2873933 - protein, 5 aa, Entamoeba invadens
KMDPS

SEQ ID NO: 2873934 - protein, 7 aa, Entamoeba invadens
KMDSATK

SEQ ID NO: 2873935 - protein, 23 aa, Entamoeba invadens
KMDSRKKKNNNNFPETKFSSGSA

SEQ ID NO: 2873936 - protein, 5 aa, Entamoeba invadens
KMDYE

SEQ ID NO: 2873937 - protein, 7 aa, Entamoeba invadens
KMEDGFG

SEQ ID NO: 2873938 - protein, 11 aa, Entamoeba invadens
KMEDSAEETSM

SEQ ID NO: 2873939 - protein, 9 aa, Entamoeba invadens
KMEDSNIEE

SEQ ID NO: 2873940 - protein, 11 aa, Entamoeba invadens
KMEECGEKRDE

SEQ ID NO: 2873941 - protein, 13 aa, Entamoeba invadens
KMEEDSDDDDDLM

SEQ ID NO: 2873942 - protein, 16 aa, Entamoeba invadens
KMEEDSQKPPTPLNSR

SEQ ID NO: 2873943 - protein, 83 aa, Entamoeba invadens
KMEEEKPKEEKKAEKKVEKKEEKKAEKKEEKKEEKKPVPKEEKKVEKKEEKKPVKKEEKKEDKKVEKKEDKKQNKKQNKKHNK

SEQ ID NO: 2873944 - protein, 121 aa, Entamoeba invadens
KMEEENDENNENNTDNENEEKDEKDNSDKSEEKEKEKESKELKTPKKTQKVTKEKKEKKTRTKKSRTKKAKTEKVDKQDKFEKAENSEISEKSEVSEKVDDHEPSKLSKGATTPKKVDDKH

SEQ ID NO: 2873945 - protein, 8 aa, Entamoeba invadens
KMEEGDRT

SEQ ID NO: 2873946 - protein, 37 aa, Entamoeba invadens
KMEINDKEKTEQVEVAEKKEEPSAPPETTEKEEKVEK

SEQ ID NO: 2873947 - protein, 13 aa, Entamoeba invadens
KMEINEKPTKINN

SEQ ID NO: 2873948 - protein, 23 aa, Entamoeba invadens
KMEKEYEKKKVDSLDEQKSLQTS

SEQ ID NO: 2873949 - protein, 6 aa, Entamoeba invadens
KMEKRK

SEQ ID NO: 2873950 - protein, 20 aa, Entamoeba invadens
KMENGDEDEYMATRKSDGLE

SEQ ID NO: 2873951 - protein, 26 aa, Entamoeba invadens
KMEPREPKRKVSESPTKMLQSPSQRI

SEQ ID NO: 2873952 - protein, 5 aa, Entamoeba invadens
KMEQA

SEQ ID NO: 2873953 - protein, 8 aa, Entamoeba invadens
KMEQNGKK

SEQ ID NO: 2873954 - protein, 6 aa, Entamoeba invadens
KMERPK

SEQ ID NO: 2873955 - protein, 19 aa, Entamoeba invadens
KMESKSKDLATGEDTPTST

SEQ ID NO: 2873956 - protein, 8 aa, Entamoeba invadens
KMESSGYK

SEQ ID NO: 2873957 - protein, 17 aa, Entamoeba invadens
KMGDERNRLLKHMIQGQ

SEQ ID NO: 2873958 - protein, 31 aa, Entamoeba invadens
KMGEDEMEKLKEENEELKKSREEKRKELKNV

SEQ ID NO: 2873959 - protein, 5 aa, Entamoeba invadens
KMGEE

SEQ ID NO: 2873960 - protein, 7 aa, Entamoeba invadens
KMGEGKV

SEQ ID NO: 2873961 - protein, 4 aa, Entamoeba invadens
KMGK

SEQ ID NO: 2873962 - protein, 31 aa, Entamoeba invadens
KMGKKKLKEGMNNDEKTKDQLKKEARDNIDA

SEQ ID NO: 2873963 - protein, 5 aa, Entamoeba invadens
KMGNK

SEQ ID NO: 2873964 - protein, 21 aa, Entamoeba invadens
KMGRNTKGSQQAAHKEVKKRF

SEQ ID NO: 2873965 - protein, 6 aa, Entamoeba invadens
KMGTFS

SEQ ID NO: 2873966 - protein, 8 aa, Entamoeba invadens
KMGTGIKE

SEQ ID NO: 2873967 - protein, 15 aa, Entamoeba invadens
KMHKNTNKSPLDSYK

SEQ ID NO: 2873968 - protein, 12 aa, Entamoeba invadens
KMHSKEEQKEEV

SEQ ID NO: 2873969 - protein, 12 aa, Entamoeba invadens
KMKEEKERIENE

SEQ ID NO: 2873970 - protein, 23 aa, Entamoeba invadens
KMKEEKKSYRKSLKSGQFSKSPA

SEQ ID NO: 2873971 - protein, 9 aa, Entamoeba invadens
KMKEETECL

SEQ ID NO: 2873972 - protein, 19 aa, Entamoeba invadens
KMKEKAVKCENEKDSNQVK

SEQ ID NO: 2873973 - protein, 8 aa, Entamoeba invadens
KMKENQEL

SEQ ID NO: 2873974 - protein, 5 aa, Entamoeba invadens
KMKGE

SEQ ID NO: 2873975 - protein, 17 aa, Entamoeba invadens
KMKGQKVKKSKLNKTYA

SEQ ID NO: 2873976 - protein, 17 aa, Entamoeba invadens
KMKKNGTFEETKRRDDL

SEQ ID NO: 2873977 - protein, 6 aa, Entamoeba invadens
KMKNKG

SEQ ID NO: 2873978 - protein, 11 aa, Entamoeba invadens
KMKNNNEESKL

SEQ ID NO: 2873979 - protein, 9 aa, Entamoeba invadens
KMKNTTETP

SEQ ID NO: 2873980 - protein, 19 aa, Entamoeba invadens
KMKPPRNGKATDKSHPPIH

SEQ ID NO: 2873981 - protein, 7 aa, Entamoeba invadens
KMKRQRK

SEQ ID NO: 2873982 - protein, 7 aa, Entamoeba invadens
KMKSAGE

SEQ ID NO: 2873983 - protein, 9 aa, Entamoeba invadens
KMKTKGFDL

SEQ ID NO: 2873984 - protein, 9 aa, Entamoeba invadens
KMKTTNVEL

SEQ ID NO: 2873985 - protein, 4 aa, Entamoeba invadens
KMMP

SEQ ID NO: 2873986 - protein, 6 aa, Entamoeba invadens
KMNADV

SEQ ID NO: 2873987 - protein, 34 aa, Entamoeba invadens
KMNASTNYPTQQKQCQDVTNNVTNTTSDIHPNPH

SEQ ID NO: 2873988 - protein, 6 aa, Entamoeba invadens
KMNATA

SEQ ID NO: 2873989 - protein, 17 aa, Entamoeba invadens
KMNDAEKDRYRKEEVKG

SEQ ID NO: 2873990 - protein, 9 aa, Entamoeba invadens
KMNDTSTVK

SEQ ID NO: 2873991 - protein, 9 aa, Entamoeba invadens
KMNEREEKS

SEQ ID NO: 2873992 - protein, 7 aa, Entamoeba invadens
KMNNPDD

SEQ ID NO: 2873993 - protein, 7 aa, Entamoeba invadens
KMNNSDD

SEQ ID NO: 2873994 - protein, 10 aa, Entamoeba invadens
KMNPEEQKST

SEQ ID NO: 2873995 - protein, 11 aa, Entamoeba invadens
KMNPGDKGSFD

SEQ ID NO: 2873996 - protein, 7 aa, Entamoeba invadens
KMNQEGV

SEQ ID NO: 2873997 - protein, 7 aa, Entamoeba invadens
KMNRGSL

SEQ ID NO: 2873998 - protein, 5 aa, Entamoeba invadens
KMNTR

SEQ ID NO: 2873999 - protein, 9 aa, Entamoeba invadens
KMNTSNPLD

SEQ ID NO: 2874000 - protein, 20 aa, Entamoeba invadens
KMPERPKDDDDEDSSDDIET

SEQ ID NO: 2874001 - protein, 7 aa, Entamoeba invadens
KMPESPI

SEQ ID NO: 2874002 - protein, 22 aa, Entamoeba invadens
KMPGDDESEEKEEEKAEQMSED

SEQ ID NO: 2874003 - protein, 11 aa, Entamoeba invadens
KMPKEKSTTQL

SEQ ID NO: 2874004 - protein, 5 aa, Entamoeba invadens
KMPKN

SEQ ID NO: 2874005 - protein, 6 aa, Entamoeba invadens
KMPKTN

SEQ ID NO: 2874006 - protein, 12 aa, Entamoeba invadens
KMPKTQKEKREL

SEQ ID NO: 2874007 - protein, 4 aa, Entamoeba invadens
KMPN

SEQ ID NO: 2874008 - protein, 5 aa, Entamoeba invadens
KMPNG

SEQ ID NO: 2874009 - protein, 5 aa, Entamoeba invadens
KMPNI

SEQ ID NO: 2874010 - protein, 5 aa, Entamoeba invadens
KMPNN

SEQ ID NO: 2874011 - protein, 6 aa, Entamoeba invadens
KMPNRF

SEQ ID NO: 2874012 - protein, 24 aa, Entamoeba invadens
KMPPPPPTSAPGIAAAPAKSQPSL

SEQ ID NO: 2874013 - protein, 4 aa, Entamoeba invadens
KMPW

SEQ ID NO: 2874014 - protein, 19 aa, Entamoeba invadens
KMQKSASSSELEKSYELPD

SEQ ID NO: 2874015 - protein, 23 aa, Entamoeba invadens
KMQPTSTIKSSNTSKPQIGSFEP

SEQ ID NO: 2874016 - protein, 8 aa, Entamoeba invadens
KMQQSQNL

SEQ ID NO: 2874017 - protein, 5 aa, Entamoeba invadens
KMQQT

SEQ ID NO: 2874018 - protein, 5 aa, Entamoeba invadens
KMQQV

SEQ ID NO: 2874019 - protein, 6 aa, Entamoeba invadens
KMQRDF

SEQ ID NO: 2874020 - protein, 25 aa, Entamoeba invadens
KMQRTESTQTKNKINNEKKPRKNFT

SEQ ID NO: 2874021 - protein, 7 aa, Entamoeba invadens
KMRDNKM

SEQ ID NO: 2874022 - protein, 7 aa, Entamoeba invadens
KMREEDT

SEQ ID NO: 2874023 - protein, 13 aa, Entamoeba invadens
KMREEEKKEMEEI

SEQ ID NO: 2874024 - protein, 10 aa, Entamoeba invadens
KMRGGQLRKG

SEQ ID NO: 2874025 - protein, 18 aa, Entamoeba invadens
KMRKEEKRVQRDQQETRL

SEQ ID NO: 2874026 - protein, 7 aa, Entamoeba invadens
KMRKMKT

SEQ ID NO: 2874027 - protein, 17 aa, Entamoeba invadens
KMRNENNKTQYGGMGNG

SEQ ID NO: 2874028 - protein, 6 aa, Entamoeba invadens
KMRRSV

SEQ ID NO: 2874029 - protein, 19 aa, Entamoeba invadens
KMSDDPAKIAELEKEASVT

SEQ ID NO: 2874030 - protein, 5 aa, Entamoeba invadens
KMSDE

SEQ ID NO: 2874031 - protein, 10 aa, Entamoeba invadens
KMSDEDRTSI

SEQ ID NO: 2874032 - protein, 12 aa, Entamoeba invadens
KMSDEKSTRLYE

SEQ ID NO: 2874033 - protein, 5 aa, Entamoeba invadens
KMSED

SEQ ID NO: 2874034 - protein, 6 aa, Entamoeba invadens
KMSEPE

SEQ ID NO: 2874035 - protein, 7 aa, Entamoeba invadens
KMSESGA

SEQ ID NO: 2874036 - protein, 60 aa, Entamoeba invadens
KMSKDSVNNESGSDVQKEEKEVNPRKGAVAAKTDKKCQPKKVATTSCPPTPGRKGDKNDI

SEQ ID NO: 2874037 - protein, 6 aa, Entamoeba invadens
KMSKEK

SEQ ID NO: 2874038 - protein, 10 aa, Entamoeba invadens
KMSKKQSALT

SEQ ID NO: 2874039 - protein, 12 aa, Entamoeba invadens
KMSNSDFAGAKN

SEQ ID NO: 2874040 - protein, 7 aa, Entamoeba invadens
KMSNTSD

SEQ ID NO: 2874041 - protein, 5 aa, Entamoeba invadens
KMSPN

SEQ ID NO: 2874042 - protein, 8 aa, Entamoeba invadens
KMSQNEME

SEQ ID NO: 2874043 - protein, 7 aa, Entamoeba invadens
KMSSDGV

SEQ ID NO: 2874044 - protein, 9 aa, Entamoeba invadens
KMSSRSEAL

SEQ ID NO: 2874045 - protein, 13 aa, Entamoeba invadens
KMSVSDALDKTKS

SEQ ID NO: 2874046 - protein, 5 aa, Entamoeba invadens
KMTAI

SEQ ID NO: 2874047 - protein, 5 aa, Entamoeba invadens
KMTDA

SEQ ID NO: 2874048 - protein, 13 aa, Entamoeba invadens
KMTEIPDKLRESS

SEQ ID NO: 2874049 - protein, 6 aa, Entamoeba invadens
KMTHPV

SEQ ID NO: 2874050 - protein, 14 aa, Entamoeba invadens
KMTKDEKEKLTRKE

SEQ ID NO: 2874051 - protein, 7 aa, Entamoeba invadens
KMTKEEV

SEQ ID NO: 2874052 - protein, 7 aa, Entamoeba invadens
KMTLTQN

SEQ ID NO: 2874053 - protein, 5 aa, Entamoeba invadens
KMTNQ

SEQ ID NO: 2874054 - protein, 7 aa, Entamoeba invadens
KMTNSHE

SEQ ID NO: 2874055 - protein, 25 aa, Entamoeba invadens
KMTPIPPVEPEKRVPQMDPSIAPQQ

SEQ ID NO: 2874056 - protein, 22 aa, Entamoeba invadens
KMTRGDEKQTQKMSIENGTKGL

SEQ ID NO: 2874057 - protein, 7 aa, Entamoeba invadens
KMTSTEE

SEQ ID NO: 2874058 - protein, 4 aa, Entamoeba invadens
KMTT

SEQ ID NO: 2874059 - protein, 4 aa, Entamoeba invadens
KMTV

SEQ ID NO: 2874060 - protein, 5 aa, Entamoeba invadens
KMTYK

SEQ ID NO: 2874061 - protein, 11 aa, Entamoeba invadens
KMYEKAVSETQ

SEQ ID NO: 2874062 - protein, 21 aa, Entamoeba invadens
KMYESQRESFKKKRDYQSQQE

SEQ ID NO: 2874063 - protein, 6 aa, Entamoeba invadens
KNAAEA

SEQ ID NO: 2874064 - protein, 10 aa, Entamoeba invadens
KNAANANKEG

SEQ ID NO: 2874065 - protein, 6 aa, Entamoeba invadens
KNAAQT

SEQ ID NO: 2874066 - protein, 8 aa, Entamoeba invadens
KNAASLRE

SEQ ID NO: 2874067 - protein, 36 aa, Entamoeba invadens
KNAATDAADKKKLNGTVNESNKKIEELSAKADKLSG

SEQ ID NO: 2874068 - protein, 6 aa, Entamoeba invadens
KNADLD

SEQ ID NO: 2874069 - protein, 8 aa, Entamoeba invadens
KNADPKSV

SEQ ID NO: 2874070 - protein, 6 aa, Entamoeba invadens
KNADQL

SEQ ID NO: 2874071 - protein, 28 aa, Entamoeba invadens
KNADTDAADKEKLNGTVNESNKKIEELS

SEQ ID NO: 2874072 - protein, 14 aa, Entamoeba invadens
KNADTDAADKKKIN

SEQ ID NO: 2874073 - protein, 24 aa, Entamoeba invadens
KNADTDAADKKKLNETVNENNKKL

SEQ ID NO: 2874074 - protein, 38 aa, Entamoeba invadens
KNADTDAADKKKLNGTDKFAKEKEAKKLKAENDEIKEK

SEQ ID NO: 2874075 - protein, 28 aa, Entamoeba invadens
KNADTDAADKKKLNGTVNKSNKKIEELS

SEQ ID NO: 2874076 - protein, 28 aa, Entamoeba invadens
KNADTDAADKKKLNGTVNKSNNKIEELS

SEQ ID NO: 2874077 - protein, 24 aa, Entamoeba invadens
KNADTDAADKKKLNKTVNESNKKI

SEQ ID NO: 2874078 - protein, 28 aa, Entamoeba invadens
KNADTDAADKKKLNKTVNESNKKIEELS

SEQ ID NO: 2874079 - protein, 27 aa, Entamoeba invadens
KNADTDTVDKKKLNGTVNKSNKKIEEL

SEQ ID NO: 2874080 - protein, 26 aa, Entamoeba invadens
KNADTDVADKKKLNGTVNESNKKIEE

SEQ ID NO: 2874081 - protein, 28 aa, Entamoeba invadens
KNADTDVADKKKLNGTVNNSNNKIEELS

SEQ ID NO: 2874082 - protein, 4 aa, Entamoeba invadens
KNAE

SEQ ID NO: 2874083 - protein, 8 aa, Entamoeba invadens
KNAEETSI

SEQ ID NO: 2874084 - protein, 8 aa, Entamoeba invadens
KNAEKERA

SEQ ID NO: 2874085 - protein, 9 aa, Entamoeba invadens
KNAESFTEE

SEQ ID NO: 2874086 - protein, 8 aa, Entamoeba invadens
KNAFPSSL

SEQ ID NO: 2874087 - protein, 7 aa, Entamoeba invadens
KNAGRRC

SEQ ID NO: 2874088 - protein, 16 aa, Entamoeba invadens
KNAGSSEAKSVATSIE

SEQ ID NO: 2874089 - protein, 7 aa, Entamoeba invadens
KNAGVEN

SEQ ID NO: 2874090 - protein, 7 aa, Entamoeba invadens
KNAHPQS

SEQ ID NO: 2874091 - protein, 43 aa, Entamoeba invadens
KNAHQKEKKIETKNNSKSDLKQDQNSSSQEIQIQDNAESQIQT

SEQ ID NO: 2874092 - protein, 6 aa, Entamoeba invadens
KNAIEK

SEQ ID NO: 2874093 - protein, 31 aa, Entamoeba invadens
KNAKADTADKKVKRDDPPPTPRNYYRGSHSQ

SEQ ID NO: 2874094 - protein, 6 aa, Entamoeba invadens
KNAKCA

SEQ ID NO: 2874095 - protein, 7 aa, Entamoeba invadens
KNAKHLT

SEQ ID NO: 2874096 - protein, 16 aa, Entamoeba invadens
KNAKIKRGFSNKDNCP

SEQ ID NO: 2874097 - protein, 5 aa, Entamoeba invadens
KNAKK

SEQ ID NO: 2874098 - protein, 5 aa, Entamoeba invadens
KNAKN

SEQ ID NO: 2874099 - protein, 8 aa, Entamoeba invadens
KNAKPDKT

SEQ ID NO: 2874100 - protein, 20 aa, Entamoeba invadens
KNAKPEDDKKGGTSSSCCAI

SEQ ID NO: 2874101 - protein, 11 aa, Entamoeba invadens
KNAKSISSDQL

SEQ ID NO: 2874102 - protein, 18 aa, Entamoeba invadens
KNALATNAKINKDKLKSG

SEQ ID NO: 2874103 - protein, 7 aa, Entamoeba invadens
KNANDPL

SEQ ID NO: 2874104 - protein, 9 aa, Entamoeba invadens
KNANGNKFD

SEQ ID NO: 2874105 - protein, 7 aa, Entamoeba invadens
KNANGQY

SEQ ID NO: 2874106 - protein, 15 aa, Entamoeba invadens
KNANPDLYFDIITVY

SEQ ID NO: 2874107 - protein, 6 aa, Entamoeba invadens
KNAPEG

SEQ ID NO: 2874108 - protein, 6 aa, Entamoeba invadens
KNAPSV

SEQ ID NO: 2874109 - protein, 7 aa, Entamoeba invadens
KNARQAL

SEQ ID NO: 2874110 - protein, 21 aa, Entamoeba invadens
KNARQIKATSMTRNSNKLKKE

SEQ ID NO: 2874111 - protein, 7 aa, Entamoeba invadens
KNARRQR

SEQ ID NO: 2874112 - protein, 4 aa, Entamoeba invadens
KNAS

SEQ ID NO: 2874113 - protein, 8 aa, Entamoeba invadens
KNASDKKI

SEQ ID NO: 2874114 - protein, 7 aa, Entamoeba invadens
KNASEIK

SEQ ID NO: 2874115 - protein, 6 aa, Entamoeba invadens
KNASKV

SEQ ID NO: 2874116 - protein, 12 aa, Entamoeba invadens
KNATDSNDQMAE

SEQ ID NO: 2874117 - protein, 14 aa, Entamoeba invadens
KNATEMDTDSTSQL

SEQ ID NO: 2874118 - protein, 5 aa, Entamoeba invadens
KNATK

SEQ ID NO: 2874119 - protein, 12 aa, Entamoeba invadens
KNATNSKDQMAE

SEQ ID NO: 2874120 - protein, 6 aa, Entamoeba invadens
KNATSV

SEQ ID NO: 2874121 - protein, 5 aa, Entamoeba invadens
KNATY

SEQ ID NO: 2874122 - protein, 8 aa, Entamoeba invadens
KNAYYGAQ

SEQ ID NO: 2874123 - protein, 4 aa, Entamoeba invadens
KNCE

SEQ ID NO: 2874124 - protein, 13 aa, Entamoeba invadens
KNCEGGKCKKCQE

SEQ ID NO: 2874125 - protein, 6 aa, Entamoeba invadens
KNCGIQ

SEQ ID NO: 2874126 - protein, 8 aa, Entamoeba invadens
KNCGSNDH

SEQ ID NO: 2874127 - protein, 5 aa, Entamoeba invadens
KNCKP

SEQ ID NO: 2874128 - protein, 10 aa, Entamoeba invadens
KNCKSSKDSF

SEQ ID NO: 2874129 - protein, 8 aa, Entamoeba invadens
KNCNSTDF

SEQ ID NO: 2874130 - protein, 5 aa, Entamoeba invadens
KNCPQ

SEQ ID NO: 2874131 - protein, 6 aa, Entamoeba invadens
KNCPSD

SEQ ID NO: 2874132 - protein, 7 aa, Entamoeba invadens
KNCPSSV

SEQ ID NO: 2874133 - protein, 4 aa, Entamoeba invadens
KNCQ

SEQ ID NO: 2874134 - protein, 6 aa, Entamoeba invadens
KNCSQD

SEQ ID NO: 2874135 - protein, 9 aa, Entamoeba invadens
KNCSTTSKV

SEQ ID NO: 2874136 - protein, 6 aa, Entamoeba invadens
KNCTGT

SEQ ID NO: 2874137 - protein, 21 aa, Entamoeba invadens
KNDCRKDKGADTITTAQGEEL

SEQ ID NO: 2874138 - protein, 10 aa, Entamoeba invadens
KNDDDDEFEK

SEQ ID NO: 2874139 - protein, 17 aa, Entamoeba invadens
KNDDDSEFSTRNETPTI

SEQ ID NO: 2874140 - protein, 6 aa, Entamoeba invadens
KNDDFS

SEQ ID NO: 2874141 - protein, 8 aa, Entamoeba invadens
KNDDKKEM

SEQ ID NO: 2874142 - protein, 21 aa, Entamoeba invadens
KNDDKTEEKTPKDEKDQKEKF

SEQ ID NO: 2874143 - protein, 5 aa, Entamoeba invadens
KNDDL

SEQ ID NO: 2874144 - protein, 13 aa, Entamoeba invadens
KNDDMKPKKMSKS

SEQ ID NO: 2874145 - protein, 7 aa, Entamoeba invadens
KNDEATV

SEQ ID NO: 2874146 - protein, 5 aa, Entamoeba invadens
KNDED

SEQ ID NO: 2874147 - protein, 8 aa, Entamoeba invadens
KNDEDNEV

SEQ ID NO: 2874148 - protein, 6 aa, Entamoeba invadens
KNDEIE

SEQ ID NO: 2874149 - protein, 16 aa, Entamoeba invadens
KNDEKSKEWEKNALET

SEQ ID NO: 2874150 - protein, 7 aa, Entamoeba invadens
KNDELYT

SEQ ID NO: 2874151 - protein, 11 aa, Entamoeba invadens
KNDENDEVKNR

SEQ ID NO: 2874152 - protein, 7 aa, Entamoeba invadens
KNDENFG

SEQ ID NO: 2874153 - protein, 11 aa, Entamoeba invadens
KNDENNKEMKS

SEQ ID NO: 2874154 - protein, 6 aa, Entamoeba invadens
KNDESG

SEQ ID NO: 2874155 - protein, 23 aa, Entamoeba invadens
KNDETFGSTFDSNNTKENSFNKK

SEQ ID NO: 2874156 - protein, 4 aa, Entamoeba invadens
KNDF

SEQ ID NO: 2874157 - protein, 5 aa, Entamoeba invadens
KNDGA

SEQ ID NO: 2874158 - protein, 6 aa, Entamoeba invadens
KNDGDN

SEQ ID NO: 2874159 - protein, 10 aa, Entamoeba invadens
KNDGKAKSTV

SEQ ID NO: 2874160 - protein, 10 aa, Entamoeba invadens
KNDGKGDKEI

SEQ ID NO: 2874161 - protein, 10 aa, Entamoeba invadens
KNDGKLKNTY

SEQ ID NO: 2874162 - protein, 8 aa, Entamoeba invadens
KNDGKSVV

SEQ ID NO: 2874163 - protein, 10 aa, Entamoeba invadens
KNDGLKSCSN

SEQ ID NO: 2874164 - protein, 9 aa, Entamoeba invadens
KNDGVENGW

SEQ ID NO: 2874165 - protein, 8 aa, Entamoeba invadens
KNDGVNTQ

SEQ ID NO: 2874166 - protein, 4 aa, Entamoeba invadens
KNDI

SEQ ID NO: 2874167 - protein, 6 aa, Entamoeba invadens
KNDIGG

SEQ ID NO: 2874168 - protein, 19 aa, Entamoeba invadens
KNDIGKREVTQKEALDKAD

SEQ ID NO: 2874169 - protein, 10 aa, Entamoeba invadens
KNDIQKTKAA

SEQ ID NO: 2874170 - protein, 10 aa, Entamoeba invadens
KNDISEDQKS

SEQ ID NO: 2874171 - protein, 18 aa, Entamoeba invadens
KNDKDAYEEAKKDALEEE

SEQ ID NO: 2874172 - protein, 11 aa, Entamoeba invadens
KNDKDGTPEID

SEQ ID NO: 2874173 - protein, 7 aa, Entamoeba invadens
KNDKGEG

SEQ ID NO: 2874174 - protein, 10 aa, Entamoeba invadens
KNDKSENFEE

SEQ ID NO: 2874175 - protein, 26 aa, Entamoeba invadens
KNDKSPKGIAGIEESKKALKSAGSSV

SEQ ID NO: 2874176 - protein, 11 aa, Entamoeba invadens
KNDKTAPNFTQ

SEQ ID NO: 2874177 - protein, 12 aa, Entamoeba invadens
KNDKVKSNPKYV

SEQ ID NO: 2874178 - protein, 15 aa, Entamoeba invadens
KNDLESKVEDDQITK

SEQ ID NO: 2874179 - protein, 16 aa, Entamoeba invadens
KNDLETERAVNKESVT

SEQ ID NO: 2874180 - protein, 7 aa, Entamoeba invadens
KNDLGEF

SEQ ID NO: 2874181 - protein, 19 aa, Entamoeba invadens
KNDLGRTKPNLTNSNRTYL

SEQ ID NO: 2874182 - protein, 7 aa, Entamoeba invadens
KNDLKKT

SEQ ID NO: 2874183 - protein, 11 aa, Entamoeba invadens
KNDLKQYQSKV

SEQ ID NO: 2874184 - protein, 9 aa, Entamoeba invadens
KNDLKTQQN

SEQ ID NO: 2874185 - protein, 6 aa, Entamoeba invadens
KNDLTN

SEQ ID NO: 2874186 - protein, 4 aa, Entamoeba invadens
KNDM

SEQ ID NO: 2874187 - protein, 7 aa, Entamoeba invadens
KNDMNTT

SEQ ID NO: 2874188 - protein, 15 aa, Entamoeba invadens
KNDNDIQSVLEQFEL

SEQ ID NO: 2874189 - protein, 8 aa, Entamoeba invadens
KNDNHDYY

SEQ ID NO: 2874190 - protein, 7 aa, Entamoeba invadens
KNDNSTQ

SEQ ID NO: 2874191 - protein, 6 aa, Entamoeba invadens
KNDNTW

SEQ ID NO: 2874192 - protein, 7 aa, Entamoeba invadens
KNDPADR

SEQ ID NO: 2874193 - protein, 8 aa, Entamoeba invadens
KNDPFEKA

SEQ ID NO: 2874194 - protein, 8 aa, Entamoeba invadens
KNDPHNAI

SEQ ID NO: 2874195 - protein, 7 aa, Entamoeba invadens
KNDPKQI

SEQ ID NO: 2874196 - protein, 8 aa, Entamoeba invadens
KNDPYAKA

SEQ ID NO: 2874197 - protein, 5 aa, Entamoeba invadens
KNDQA

SEQ ID NO: 2874198 - protein, 7 aa, Entamoeba invadens
KNDQCAK

SEQ ID NO: 2874199 - protein, 13 aa, Entamoeba invadens
KNDQDKQHMSGEN

SEQ ID NO: 2874200 - protein, 7 aa, Entamoeba invadens
KNDQKTT

SEQ ID NO: 2874201 - protein, 7 aa, Entamoeba invadens
KNDQNKK

SEQ ID NO: 2874202 - protein, 5 aa, Entamoeba invadens
KNDRE

SEQ ID NO: 2874203 - protein, 7 aa, Entamoeba invadens
KNDRERF

SEQ ID NO: 2874204 - protein, 7 aa, Entamoeba invadens
KNDRLAE

SEQ ID NO: 2874205 - protein, 10 aa, Entamoeba invadens
KNDSDDTSRF

SEQ ID NO: 2874206 - protein, 9 aa, Entamoeba invadens
KNDSEERDK

SEQ ID NO: 2874207 - protein, 6 aa, Entamoeba invadens
KNDSEM

SEQ ID NO: 2874208 - protein, 9 aa, Entamoeba invadens
KNDSFNTPS

SEQ ID NO: 2874209 - protein, 12 aa, Entamoeba invadens
KNDSFSDITGTL

SEQ ID NO: 2874210 - protein, 7 aa, Entamoeba invadens
KNDSHTE

SEQ ID NO: 2874211 - protein, 9 aa, Entamoeba invadens
KNDSMGSAQ

SEQ ID NO: 2874212 - protein, 9 aa, Entamoeba invadens
KNDSSKEGM

SEQ ID NO: 2874213 - protein, 13 aa, Entamoeba invadens
KNDSVTNNSWDFS

SEQ ID NO: 2874214 - protein, 4 aa, Entamoeba invadens
KNDT

SEQ ID NO: 2874215 - protein, 8 aa, Entamoeba invadens
KNDTCPPK

SEQ ID NO: 2874216 - protein, 8 aa, Entamoeba invadens
KNDTEAKG

SEQ ID NO: 2874217 - protein, 16 aa, Entamoeba invadens
KNDTHDKVGKAPYEVS

SEQ ID NO: 2874218 - protein, 13 aa, Entamoeba invadens
KNDTLDEKTRRHA

SEQ ID NO: 2874219 - protein, 8 aa, Entamoeba invadens
KNDTNEAL

SEQ ID NO: 2874220 - protein, 12 aa, Entamoeba invadens
KNDTTIRNLLMK

SEQ ID NO: 2874221 - protein, 9 aa, Entamoeba invadens
KNDTTQKKV

SEQ ID NO: 2874222 - protein, 4 aa, Entamoeba invadens
KNDV

SEQ ID NO: 2874223 - protein, 7 aa, Entamoeba invadens
KNDVAIK

SEQ ID NO: 2874224 - protein, 8 aa, Entamoeba invadens
KNDVDSKK

SEQ ID NO: 2874225 - protein, 10 aa, Entamoeba invadens
KNDVKTAMTN

SEQ ID NO: 2874226 - protein, 6 aa, Entamoeba invadens
KNDWDV

SEQ ID NO: 2874227 - protein, 11 aa, Entamoeba invadens
KNDWNEAPSGL

SEQ ID NO: 2874228 - protein, 11 aa, Entamoeba invadens
KNDWNEAPSGM

SEQ ID NO: 2874229 - protein, 9 aa, Entamoeba invadens
KNDYRPNKE

SEQ ID NO: 2874230 - protein, 7 aa, Entamoeba invadens
KNECEEL

SEQ ID NO: 2874231 - protein, 7 aa, Entamoeba invadens
KNECTSC

SEQ ID NO: 2874232 - protein, 4 aa, Entamoeba invadens
KNED

SEQ ID NO: 2874233 - protein, 9 aa, Entamoeba invadens
KNEDENKER

SEQ ID NO: 2874234 - protein, 6 aa, Entamoeba invadens
KNEDIK

SEQ ID NO: 2874235 - protein, 6 aa, Entamoeba invadens
KNEDLS

SEQ ID NO: 2874236 - protein, 9 aa, Entamoeba invadens
KNEDRDGIH

SEQ ID NO: 2874237 - protein, 12 aa, Entamoeba invadens
KNEDTKKVYSNE

SEQ ID NO: 2874238 - protein, 12 aa, Entamoeba invadens
KNEDVDGFEVIN

SEQ ID NO: 2874239 - protein, 5 aa, Entamoeba invadens
KNEED

SEQ ID NO: 2874240 - protein, 8 aa, Entamoeba invadens
KNEEDAKK

SEQ ID NO: 2874241 - protein, 17 aa, Entamoeba invadens
KNEEDSDEDTTESSSKE

SEQ ID NO: 2874242 - protein, 8 aa, Entamoeba invadens
KNEEEAKI

SEQ ID NO: 2874243 - protein, 11 aa, Entamoeba invadens
KNEEEKTPNTK

SEQ ID NO: 2874244 - protein, 7 aa, Entamoeba invadens
KNEEESS

SEQ ID NO: 2874245 - protein, 13 aa, Entamoeba invadens
KNEEKMGAKMRKG

SEQ ID NO: 2874246 - protein, 7 aa, Entamoeba invadens
KNEEKRV

SEQ ID NO: 2874247 - protein, 21 aa, Entamoeba invadens
KNEEKTGEKMPRQPVKYEKGI

SEQ ID NO: 2874248 - protein, 39 aa, Entamoeba invadens
KNEENDEKPKVGKVGKKVTKKTEEGEEITKPKIGKIGKV

SEQ ID NO: 2874249 - protein, 50 aa, Entamoeba invadens
KNEENENDENDENDENDENDENDENDENDENDENDENDENKEDKEDDKAV

SEQ ID NO: 2874250 - protein, 47 aa, Entamoeba invadens
KNEENENDENDENDENDENDENDENDENDENDENDENKEDKEDDKAV

SEQ ID NO: 2874251 - protein, 8 aa, Entamoeba invadens
KNEENSKE

SEQ ID NO: 2874252 - protein, 6 aa, Entamoeba invadens
KNEERY

SEQ ID NO: 2874253 - protein, 22 aa, Entamoeba invadens
KNEETKTKEKQIESPPPKEHPW

SEQ ID NO: 2874254 - protein, 9 aa, Entamoeba invadens
KNEETLDDI

SEQ ID NO: 2874255 - protein, 42 aa, Entamoeba invadens
KNEETNYTKECQSKRANCVSGGQGLQNKENKEVNVSPKHSKS

SEQ ID NO: 2874256 - protein, 19 aa, Entamoeba invadens
KNEETQRQREREEQEAEYQ

SEQ ID NO: 2874257 - protein, 22 aa, Entamoeba invadens
KNEEVKQENVSMEQHNGNEPHV

SEQ ID NO: 2874258 - protein, 15 aa, Entamoeba invadens
KNEEVTFSKTPQLNI

SEQ ID NO: 2874259 - protein, 5 aa, Entamoeba invadens
KNEFT

SEQ ID NO: 2874260 - protein, 5 aa, Entamoeba invadens
KNEFV

SEQ ID NO: 2874261 - protein, 4 aa, Entamoeba invadens
KNEG

SEQ ID NO: 2874262 - protein, 5 aa, Entamoeba invadens
KNEGC

SEQ ID NO: 2874263 - protein, 36 aa, Entamoeba invadens
KNEGEEPAEGSTTPELEEKTSSQEQSHHQRSNSKTA

SEQ ID NO: 2874264 - protein, 5 aa, Entamoeba invadens
KNEGV

SEQ ID NO: 2874265 - protein, 11 aa, Entamoeba invadens
KNEGVSKDDIG

SEQ ID NO: 2874266 - protein, 9 aa, Entamoeba invadens
KNEGVTKDV

SEQ ID NO: 2874267 - protein, 8 aa, Entamoeba invadens
KNEHEYRG

SEQ ID NO: 2874268 - protein, 4 aa, Entamoeba invadens
KNEI

SEQ ID NO: 2874269 - protein, 9 aa, Entamoeba invadens
KNEIEKTKQ

SEQ ID NO: 2874270 - protein, 8 aa, Entamoeba invadens
KNEINPMD

SEQ ID NO: 2874271 - protein, 6 aa, Entamoeba invadens
KNEIQK

SEQ ID NO: 2874272 - protein, 7 aa, Entamoeba invadens
KNEISGV

SEQ ID NO: 2874273 - protein, 11 aa, Entamoeba invadens
KNEITDIESDS

SEQ ID NO: 2874274 - protein, 6 aa, Entamoeba invadens
KNEKDE

SEQ ID NO: 2874275 - protein, 9 aa, Entamoeba invadens
KNEKEIKTR

SEQ ID NO: 2874276 - protein, 15 aa, Entamoeba invadens
KNEKEKNSKHKTERL

SEQ ID NO: 2874277 - protein, 8 aa, Entamoeba invadens
KNEKERQD

SEQ ID NO: 2874278 - protein, 9 aa, Entamoeba invadens
KNEKESRSF

SEQ ID NO: 2874279 - protein, 7 aa, Entamoeba invadens
KNEKETM

SEQ ID NO: 2874280 - protein, 11 aa, Entamoeba invadens
KNEKKKAEDVL

SEQ ID NO: 2874281 - protein, 6 aa, Entamoeba invadens
KNEKND

SEQ ID NO: 2874282 - protein, 8 aa, Entamoeba invadens
KNEKNTKI

SEQ ID NO: 2874283 - protein, 24 aa, Entamoeba invadens
KNEKQKKKEEKQKRKDKRAEEAGV

SEQ ID NO: 2874284 - protein, 16 aa, Entamoeba invadens
KNEKSPRREKRDTPEV

SEQ ID NO: 2874285 - protein, 8 aa, Entamoeba invadens
KNEKSQTV

SEQ ID NO: 2874286 - protein, 9 aa, Entamoeba invadens
KNEKVKENK

SEQ ID NO: 2874287 - protein, 12 aa, Entamoeba invadens
KNELDQTTQTRS

SEQ ID NO: 2874288 - protein, 25 aa, Entamoeba invadens
KNELENKNSKLALENGNLRRDFNDS

SEQ ID NO: 2874289 - protein, 7 aa, Entamoeba invadens
KNELQDG

SEQ ID NO: 2874290 - protein, 6 aa, Entamoeba invadens
KNELSD

SEQ ID NO: 2874291 - protein, 5 aa, Entamoeba invadens
KNEND

SEQ ID NO: 2874292 - protein, 16 aa, Entamoeba invadens
KNENDPGHFPTVTSQG

SEQ ID NO: 2874293 - protein, 5 aa, Entamoeba invadens
KNENF

SEQ ID NO: 2874294 - protein, 7 aa, Entamoeba invadens
KNENGAV

SEQ ID NO: 2874295 - protein, 7 aa, Entamoeba invadens
KNENKKL

SEQ ID NO: 2874296 - protein, 10 aa, Entamoeba invadens
KNENMKPFSG

SEQ ID NO: 2874297 - protein, 12 aa, Entamoeba invadens
KNENPSNRNGVS

SEQ ID NO: 2874298 - protein, 6 aa, Entamoeba invadens
KNENQK

SEQ ID NO: 2874299 - protein, 6 aa, Entamoeba invadens
KNENSW

SEQ ID NO: 2874300 - protein, 8 aa, Entamoeba invadens
KNENTGES

SEQ ID NO: 2874301 - protein, 5 aa, Entamoeba invadens
KNENV

SEQ ID NO: 2874302 - protein, 7 aa, Entamoeba invadens
KNENYKK

SEQ ID NO: 2874303 - protein, 9 aa, Entamoeba invadens
KNEPATSDV

SEQ ID NO: 2874304 - protein, 8 aa, Entamoeba invadens
KNEQGELT

SEQ ID NO: 2874305 - protein, 5 aa, Entamoeba invadens
KNEQI

SEQ ID NO: 2874306 - protein, 8 aa, Entamoeba invadens
KNEQKTTM

SEQ ID NO: 2874307 - protein, 10 aa, Entamoeba invadens
KNEQQQKQFE

SEQ ID NO: 2874308 - protein, 7 aa, Entamoeba invadens
KNEQQRT

SEQ ID NO: 2874309 - protein, 8 aa, Entamoeba invadens
KNEQQTLD

SEQ ID NO: 2874310 - protein, 4 aa, Entamoeba invadens
KNER

SEQ ID NO: 2874311 - protein, 8 aa, Entamoeba invadens
KNERAKME

SEQ ID NO: 2874312 - protein, 10 aa, Entamoeba invadens
KNEREPTEED

SEQ ID NO: 2874313 - protein, 9 aa, Entamoeba invadens
KNERKMSIE

SEQ ID NO: 2874314 - protein, 8 aa, Entamoeba invadens
KNERSKEI

SEQ ID NO: 2874315 - protein, 9 aa, Entamoeba invadens
KNERYKNGK

SEQ ID NO: 2874316 - protein, 8 aa, Entamoeba invadens
KNESEGKG

SEQ ID NO: 2874317 - protein, 9 aa, Entamoeba invadens
KNESEVKSI

SEQ ID NO: 2874318 - protein, 10 aa, Entamoeba invadens
KNESGKTNTI

SEQ ID NO: 2874319 - protein, 13 aa, Entamoeba invadens
KNESKSSQLRRQT

SEQ ID NO: 2874320 - protein, 14 aa, Entamoeba invadens
KNESTKKGEGNQVD

SEQ ID NO: 2874321 - protein, 6 aa, Entamoeba invadens
KNESVD

SEQ ID NO: 2874322 - protein, 7 aa, Entamoeba invadens
KNESYEI

SEQ ID NO: 2874323 - protein, 6 aa, Entamoeba invadens
KNETDM

SEQ ID NO: 2874324 - protein, 9 aa, Entamoeba invadens
KNETEASQE

SEQ ID NO: 2874325 - protein, 7 aa, Entamoeba invadens
KNETHSY

SEQ ID NO: 2874326 - protein, 15 aa, Entamoeba invadens
KNETISRKNMKRRRR

SEQ ID NO: 2874327 - protein, 41 aa, Entamoeba invadens
KNETKGGTLDGGQHTKTFETKENATKETDDKEKTNKEEQNI

SEQ ID NO: 2874328 - protein, 11 aa, Entamoeba invadens
KNETKIKDFPK

SEQ ID NO: 2874329 - protein, 9 aa, Entamoeba invadens
KNETMKNAE

SEQ ID NO: 2874330 - protein, 7 aa, Entamoeba invadens
KNETNAK

SEQ ID NO: 2874331 - protein, 11 aa, Entamoeba invadens
KNETNTTTVPP

SEQ ID NO: 2874332 - protein, 7 aa, Entamoeba invadens
KNETRID

SEQ ID NO: 2874333 - protein, 9 aa, Entamoeba invadens
KNETTNEQQ

SEQ ID NO: 2874334 - protein, 7 aa, Entamoeba invadens
KNETTVF

SEQ ID NO: 2874335 - protein, 12 aa, Entamoeba invadens
KNEVELKETKRA

SEQ ID NO: 2874336 - protein, 7 aa, Entamoeba invadens
KNEVTDD

SEQ ID NO: 2874337 - protein, 14 aa, Entamoeba invadens
KNEYEGEDIVDDED

SEQ ID NO: 2874338 - protein, 5 aa, Entamoeba invadens
KNEYQ

SEQ ID NO: 2874339 - protein, 27 aa, Entamoeba invadens
KNEYQDLQKRNEELESGKKLAQNIENE

SEQ ID NO: 2874340 - protein, 5 aa, Entamoeba invadens
KNFEG

SEQ ID NO: 2874341 - protein, 13 aa, Entamoeba invadens
KNFENKKITEENE

SEQ ID NO: 2874342 - protein, 8 aa, Entamoeba invadens
KNFGNALS

SEQ ID NO: 2874343 - protein, 5 aa, Entamoeba invadens
KNFHS

SEQ ID NO: 2874344 - protein, 8 aa, Entamoeba invadens
KNFKEDPN

SEQ ID NO: 2874345 - protein, 5 aa, Entamoeba invadens
KNFKN

SEQ ID NO: 2874346 - protein, 9 aa, Entamoeba invadens
KNFNRTPLK

SEQ ID NO: 2874347 - protein, 11 aa, Entamoeba invadens
KNFSDNPSDVG

SEQ ID NO: 2874348 - protein, 5 aa, Entamoeba invadens
KNFSG

SEQ ID NO: 2874349 - protein, 24 aa, Entamoeba invadens
KNFSGSKGTKKKGDTSDASELETI

SEQ ID NO: 2874350 - protein, 4 aa, Entamoeba invadens
KNGC

SEQ ID NO: 2874351 - protein, 17 aa, Entamoeba invadens
KNGDATKPMRRPSNVAN

SEQ ID NO: 2874352 - protein, 13 aa, Entamoeba invadens
KNGDFKKKCGAVR

SEQ ID NO: 2874353 - protein, 10 aa, Entamoeba invadens
KNGDGTISEQ

SEQ ID NO: 2874354 - protein, 6 aa, Entamoeba invadens
KNGDIE

SEQ ID NO: 2874355 - protein, 7 aa, Entamoeba invadens
KNGDPDL

SEQ ID NO: 2874356 - protein, 11 aa, Entamoeba invadens
KNGDQSSMDKD

SEQ ID NO: 2874357 - protein, 6 aa, Entamoeba invadens
KNGDVK

SEQ ID NO: 2874358 - protein, 9 aa, Entamoeba invadens
KNGEDRLSS

SEQ ID NO: 2874359 - protein, 7 aa, Entamoeba invadens
KNGEGVQ

SEQ ID NO: 2874360 - protein, 5 aa, Entamoeba invadens
KNGEI

SEQ ID NO: 2874361 - protein, 6 aa, Entamoeba invadens
KNGEIV

SEQ ID NO: 2874362 - protein, 21 aa, Entamoeba invadens
KNGEKAGSALKSFQSQNGLRV

SEQ ID NO: 2874363 - protein, 7 aa, Entamoeba invadens
KNGEKSL

SEQ ID NO: 2874364 - protein, 6 aa, Entamoeba invadens
KNGELV

SEQ ID NO: 2874365 - protein, 7 aa, Entamoeba invadens
KNGENTP

SEQ ID NO: 2874366 - protein, 17 aa, Entamoeba invadens
KNGERNCKKYTPNNGFE

SEQ ID NO: 2874367 - protein, 9 aa, Entamoeba invadens
KNGETFRLN

SEQ ID NO: 2874368 - protein, 11 aa, Entamoeba invadens
KNGETKMKGSE

SEQ ID NO: 2874369 - protein, 7 aa, Entamoeba invadens
KNGEVPI

SEQ ID NO: 2874370 - protein, 6 aa, Entamoeba invadens
KNGEVS

SEQ ID NO: 2874371 - protein, 4 aa, Entamoeba invadens
KNGF

SEQ ID NO: 2874372 - protein, 6 aa, Entamoeba invadens
KNGGDY

SEQ ID NO: 2874373 - protein, 6 aa, Entamoeba invadens
KNGGEI

SEQ ID NO: 2874374 - protein, 6 aa, Entamoeba invadens
KNGGGH

SEQ ID NO: 2874375 - protein, 9 aa, Entamoeba invadens
KNGGKNEGM

SEQ ID NO: 2874376 - protein, 7 aa, Entamoeba invadens
KNGGNDY

SEQ ID NO: 2874377 - protein, 8 aa, Entamoeba invadens
KNGGQEQA

SEQ ID NO: 2874378 - protein, 6 aa, Entamoeba invadens
KNGHPV

SEQ ID NO: 2874379 - protein, 4 aa, Entamoeba invadens
KNGI

SEQ ID NO: 2874380 - protein, 36 aa, Entamoeba invadens
KNGIGTTTDNEEEEVGNNIEDTNNNGDDGDEQPNEM

SEQ ID NO: 2874381 - protein, 5 aa, Entamoeba invadens
KNGIS

SEQ ID NO: 2874382 - protein, 7 aa, Entamoeba invadens
KNGKEEL

SEQ ID NO: 2874383 - protein, 98 aa, Entamoeba invadens
KNGKEKDKKDLKGSKDQKNKSNAVQPKQQKQTKPNNQRKKDDKKNNNKKQLISKNRKLTNRKNRTPRNTKKMTNRNNNLMGKRGKQLQNRKQHRKEIT

SEQ ID NO: 2874384 - protein, 5 aa, Entamoeba invadens
KNGKH

SEQ ID NO: 2874385 - protein, 8 aa, Entamoeba invadens
KNGKKSNV

SEQ ID NO: 2874386 - protein, 15 aa, Entamoeba invadens
KNGKKTKTAEFNEQS

SEQ ID NO: 2874387 - protein, 8 aa, Entamoeba invadens
KNGKTPLG

SEQ ID NO: 2874388 - protein, 14 aa, Entamoeba invadens
KNGLDKEVASINDQ

SEQ ID NO: 2874389 - protein, 30 aa, Entamoeba invadens
KNGMRGIEDKQNAVTDENEHAELIASDLFN

SEQ ID NO: 2874390 - protein, 12 aa, Entamoeba invadens
KNGNASGEEYNR

SEQ ID NO: 2874391 - protein, 20 aa, Entamoeba invadens
KNGNCSEKIDDNENNTCDPQ

SEQ ID NO: 2874392 - protein, 6 aa, Entamoeba invadens
KNGNDV

SEQ ID NO: 2874393 - protein, 8 aa, Entamoeba invadens
KNGNEVGN

SEQ ID NO: 2874394 - protein, 5 aa, Entamoeba invadens
KNGNF

SEQ ID NO: 2874395 - protein, 6 aa, Entamoeba invadens
KNGNIA

SEQ ID NO: 2874396 - protein, 5 aa, Entamoeba invadens
KNGNL

SEQ ID NO: 2874397 - protein, 11 aa, Entamoeba invadens
KNGNNGNVDYP

SEQ ID NO: 2874398 - protein, 13 aa, Entamoeba invadens
KNGNQGSACQSCH

SEQ ID NO: 2874399 - protein, 6 aa, Entamoeba invadens
KNGPIS

SEQ ID NO: 2874400 - protein, 5 aa, Entamoeba invadens
KNGQR

SEQ ID NO: 2874401 - protein, 4 aa, Entamoeba invadens
KNGR

SEQ ID NO: 2874402 - protein, 6 aa, Entamoeba invadens
KNGREN

SEQ ID NO: 2874403 - protein, 7 aa, Entamoeba invadens
KNGRISK

SEQ ID NO: 2874404 - protein, 16 aa, Entamoeba invadens
KNGRKEEFDDESETTY

SEQ ID NO: 2874405 - protein, 8 aa, Entamoeba invadens
KNGSEEAV

SEQ ID NO: 2874406 - protein, 7 aa, Entamoeba invadens
KNGSEEI

SEQ ID NO: 2874407 - protein, 9 aa, Entamoeba invadens
KNGSGKSNF

SEQ ID NO: 2874408 - protein, 16 aa, Entamoeba invadens
KNGSKSVFLNNSVFVL

SEQ ID NO: 2874409 - protein, 9 aa, Entamoeba invadens
KNGSQLVST

SEQ ID NO: 2874410 - protein, 9 aa, Entamoeba invadens
KNGTATTTE

SEQ ID NO: 2874411 - protein, 6 aa, Entamoeba invadens
KNGTDL

SEQ ID NO: 2874412 - protein, 15 aa, Entamoeba invadens
KNGTEITIDKNDTTI

SEQ ID NO: 2874413 - protein, 8 aa, Entamoeba invadens
KNGTEVKP

SEQ ID NO: 2874414 - protein, 5 aa, Entamoeba invadens
KNGTL

SEQ ID NO: 2874415 - protein, 7 aa, Entamoeba invadens
KNGTQIN

SEQ ID NO: 2874416 - protein, 4 aa, Entamoeba invadens
KNGV

SEQ ID NO: 2874417 - protein, 6 aa, Entamoeba invadens
KNGVEE

SEQ ID NO: 2874418 - protein, 7 aa, Entamoeba invadens
KNGVKED

SEQ ID NO: 2874419 - protein, 5 aa, Entamoeba invadens
KNGVS

SEQ ID NO: 2874420 - protein, 24 aa, Entamoeba invadens
KNGVSRLKAEQGGLQDRSRQASNQ

SEQ ID NO: 2874421 - protein, 8 aa, Entamoeba invadens
KNHDGLKK

SEQ ID NO: 2874422 - protein, 17 aa, Entamoeba invadens
KNHEKTTTSDVDAKIEE

SEQ ID NO: 2874423 - protein, 9 aa, Entamoeba invadens
KNHGPKTGG

SEQ ID NO: 2874424 - protein, 19 aa, Entamoeba invadens
KNHHPDLKEERERVEKDGG

SEQ ID NO: 2874425 - protein, 6 aa, Entamoeba invadens
KNHLKE

SEQ ID NO: 2874426 - protein, 9 aa, Entamoeba invadens
KNHNEEKRD

SEQ ID NO: 2874427 - protein, 5 aa, Entamoeba invadens
KNHNN

SEQ ID NO: 2874428 - protein, 9 aa, Entamoeba invadens
KNHNQNTEF

SEQ ID NO: 2874429 - protein, 7 aa, Entamoeba invadens
KNHTQKV

SEQ ID NO: 2874430 - protein, 7 aa, Entamoeba invadens
KNHVDAQ

SEQ ID NO: 2874431 - protein, 12 aa, Entamoeba invadens
KNIAETKPTYSQ

SEQ ID NO: 2874432 - protein, 22 aa, Entamoeba invadens
KNIAKAVSGIAKGAKKATATKK

SEQ ID NO: 2874433 - protein, 6 aa, Entamoeba invadens
KNIAPT

SEQ ID NO: 2874434 - protein, 15 aa, Entamoeba invadens
KNIDEKLARLTAASK

SEQ ID NO: 2874435 - protein, 6 aa, Entamoeba invadens
KNIEAP

SEQ ID NO: 2874436 - protein, 41 aa, Entamoeba invadens
KNIEDKEGKISDLKKKHEAKEDNSKDLETQLHEKEDNIADL

SEQ ID NO: 2874437 - protein, 6 aa, Entamoeba invadens
KNIEER

SEQ ID NO: 2874438 - protein, 13 aa, Entamoeba invadens
KNIENKEGEISDL

SEQ ID NO: 2874439 - protein, 6 aa, Entamoeba invadens
KNIENS

SEQ ID NO: 2874440 - protein, 5 aa, Entamoeba invadens
KNIEQ

SEQ ID NO: 2874441 - protein, 17 aa, Entamoeba invadens
KNIESGMNYDPNSVKTM

SEQ ID NO: 2874442 - protein, 10 aa, Entamoeba invadens
KNIGDKKTFE

SEQ ID NO: 2874443 - protein, 10 aa, Entamoeba invadens
KNIGSETFRG

SEQ ID NO: 2874444 - protein, 10 aa, Entamoeba invadens
KNIKATKETM

SEQ ID NO: 2874445 - protein, 12 aa, Entamoeba invadens
KNIKDKEGEISD

SEQ ID NO: 2874446 - protein, 7 aa, Entamoeba invadens
KNIKKRQ

SEQ ID NO: 2874447 - protein, 23 aa, Entamoeba invadens
KNIKSGDDFKIENDGTKVIEEDG

SEQ ID NO: 2874448 - protein, 9 aa, Entamoeba invadens
KNIKTEISK

SEQ ID NO: 2874449 - protein, 7 aa, Entamoeba invadens
KNILPDN

SEQ ID NO: 2874450 - protein, 15 aa, Entamoeba invadens
KNINDKLARLTRESK

SEQ ID NO: 2874451 - protein, 23 aa, Entamoeba invadens
KNINEKKDELISKSNEINTPTQQ

SEQ ID NO: 2874452 - protein, 17 aa, Entamoeba invadens
KNINELKNTDFKNIGGN

SEQ ID NO: 2874453 - protein, 7 aa, Entamoeba invadens
KNINKKS

SEQ ID NO: 2874454 - protein, 6 aa, Entamoeba invadens
KNINPV

SEQ ID NO: 2874455 - protein, 7 aa, Entamoeba invadens
KNIPSLN

SEQ ID NO: 2874456 - protein, 4 aa, Entamoeba invadens
KNIQ

SEQ ID NO: 2874457 - protein, 15 aa, Entamoeba invadens
KNIQEDDLREQNHCG

SEQ ID NO: 2874458 - protein, 14 aa, Entamoeba invadens
KNIRDSSTEVSNYK

SEQ ID NO: 2874459 - protein, 7 aa, Entamoeba invadens
KNIRSAK

SEQ ID NO: 2874460 - protein, 6 aa, Entamoeba invadens
KNISAE

SEQ ID NO: 2874461 - protein, 7 aa, Entamoeba invadens
KNISETV

SEQ ID NO: 2874462 - protein, 11 aa, Entamoeba invadens
KNISNDSGEQM

SEQ ID NO: 2874463 - protein, 9 aa, Entamoeba invadens
KNISPNNVK

SEQ ID NO: 2874464 - protein, 5 aa, Entamoeba invadens
KNITI

SEQ ID NO: 2874465 - protein, 11 aa, Entamoeba invadens
KNITRTKDEAM

SEQ ID NO: 2874466 - protein, 6 aa, Entamoeba invadens
KNKAAL

SEQ ID NO: 2874467 - protein, 16 aa, Entamoeba invadens
KNKAFTEDDYKKGDSR

SEQ ID NO: 2874468 - protein, 8 aa, Entamoeba invadens
KNKAFTNN

SEQ ID NO: 2874469 - protein, 8 aa, Entamoeba invadens
KNKAGFET

SEQ ID NO: 2874470 - protein, 32 aa, Entamoeba invadens
KNKALEEEKKDLRNKYNSRAPMQYSPDDNVQI

SEQ ID NO: 2874471 - protein, 8 aa, Entamoeba invadens
KNKALRDP

SEQ ID NO: 2874472 - protein, 12 aa, Entamoeba invadens
KNKAPSSGNGHI

SEQ ID NO: 2874473 - protein, 8 aa, Entamoeba invadens
KNKATHLR

SEQ ID NO: 2874474 - protein, 7 aa, Entamoeba invadens
KNKCEEY

SEQ ID NO: 2874475 - protein, 5 aa, Entamoeba invadens
KNKDI

SEQ ID NO: 2874476 - protein, 6 aa, Entamoeba invadens
KNKEAK

SEQ ID NO: 2874477 - protein, 8 aa, Entamoeba invadens
KNKEAKEM

SEQ ID NO: 2874478 - protein, 11 aa, Entamoeba invadens
KNKECERTASD

SEQ ID NO: 2874479 - protein, 7 aa, Entamoeba invadens
KNKEDDV

SEQ ID NO: 2874480 - protein, 12 aa, Entamoeba invadens
KNKEDEKTRPFE

SEQ ID NO: 2874481 - protein, 6 aa, Entamoeba invadens
KNKEDV

SEQ ID NO: 2874482 - protein, 9 aa, Entamoeba invadens
KNKEEEEQV

SEQ ID NO: 2874483 - protein, 9 aa, Entamoeba invadens
KNKEEEQEV

SEQ ID NO: 2874484 - protein, 14 aa, Entamoeba invadens
KNKELEKRQKSIKT

SEQ ID NO: 2874485 - protein, 8 aa, Entamoeba invadens
KNKELQSE

SEQ ID NO: 2874486 - protein, 8 aa, Entamoeba invadens
KNKEMYGE

SEQ ID NO: 2874487 - protein, 10 aa, Entamoeba invadens
KNKEPQNEVQ

SEQ ID NO: 2874488 - protein, 14 aa, Entamoeba invadens
KNKEVYQEIQGSEL

SEQ ID NO: 2874489 - protein, 10 aa, Entamoeba invadens
KNKEYSPKSF

SEQ ID NO: 2874490 - protein, 10 aa, Entamoeba invadens
KNKFKRSSVQ

SEQ ID NO: 2874491 - protein, 14 aa, Entamoeba invadens
KNKFTPEKAEQITQ

SEQ ID NO: 2874492 - protein, 6 aa, Entamoeba invadens
KNKGEV

SEQ ID NO: 2874493 - protein, 29 aa, Entamoeba invadens
KNKGKDLTKRPLKDEYAKLTKEKASAQRY

SEQ ID NO: 2874494 - protein, 16 aa, Entamoeba invadens
KNKGKIKTKYKVEGSV

SEQ ID NO: 2874495 - protein, 22 aa, Entamoeba invadens
KNKGKTNGDCRGPTKPPKTTLM

SEQ ID NO: 2874496 - protein, 7 aa, Entamoeba invadens
KNKGMGY

SEQ ID NO: 2874497 - protein, 8 aa, Entamoeba invadens
KNKGNEFY

SEQ ID NO: 2874498 - protein, 6 aa, Entamoeba invadens
KNKHDM

SEQ ID NO: 2874499 - protein, 8 aa, Entamoeba invadens
KNKHKTVT

SEQ ID NO: 2874500 - protein, 8 aa, Entamoeba invadens
KNKHNDDE

SEQ ID NO: 2874501 - protein, 4 aa, Entamoeba invadens
KNKI

SEQ ID NO: 2874502 - protein, 8 aa, Entamoeba invadens
KNKIEEAT

SEQ ID NO: 2874503 - protein, 8 aa, Entamoeba invadens
KNKIGGDG

SEQ ID NO: 2874504 - protein, 16 aa, Entamoeba invadens
KNKINKSNTQTQSNAI

SEQ ID NO: 2874505 - protein, 7 aa, Entamoeba invadens
KNKITTI

SEQ ID NO: 2874506 - protein, 10 aa, Entamoeba invadens
KNKKAKYSQD

SEQ ID NO: 2874507 - protein, 8 aa, Entamoeba invadens
KNKKDNDL

SEQ ID NO: 2874508 - protein, 26 aa, Entamoeba invadens
KNKKFNEAASKAFDKYTEDIRDALEH

SEQ ID NO: 2874509 - protein, 11 aa, Entamoeba invadens
KNKKGQDNQFP

SEQ ID NO: 2874510 - protein, 5 aa, Entamoeba invadens
KNKKI

SEQ ID NO: 2874511 - protein, 15 aa, Entamoeba invadens
KNKKKFNEATKASNP

SEQ ID NO: 2874512 - protein, 8 aa, Entamoeba invadens
KNKKKKRT

SEQ ID NO: 2874513 - protein, 17 aa, Entamoeba invadens
KNKKNSKGEKVQVREKG

SEQ ID NO: 2874514 - protein, 11 aa, Entamoeba invadens
KNKKPKNKTQH

SEQ ID NO: 2874515 - protein, 15 aa, Entamoeba invadens
KNKKPQKEKSGCCLL

SEQ ID NO: 2874516 - protein, 28 aa, Entamoeba invadens
KNKKRPTSTVEPSALEQTKKRESPTTSI

SEQ ID NO: 2874517 - protein, 10 aa, Entamoeba invadens
KNKKSPSQKV

SEQ ID NO: 2874518 - protein, 6 aa, Entamoeba invadens
KNKKSY

SEQ ID NO: 2874519 - protein, 13 aa, Entamoeba invadens
KNKKTEYEKSQTN

SEQ ID NO: 2874520 - protein, 6 aa, Entamoeba invadens
KNKKYK

SEQ ID NO: 2874521 - protein, 17 aa, Entamoeba invadens
KNKLNKTKQQEQQQQQG

SEQ ID NO: 2874522 - protein, 8 aa, Entamoeba invadens
KNKMDASR

SEQ ID NO: 2874523 - protein, 4 aa, Entamoeba invadens
KNKN

SEQ ID NO: 2874524 - protein, 73 aa, Entamoeba invadens
KNKNEELEKLKKENEEYNNKLETEKESLKNKVNEIEKSYNIEKEEHKKSREELEKEKTEKRKIEEEKKTVEEV

SEQ ID NO: 2874525 - protein, 19 aa, Entamoeba invadens
KNKNEIFNQNNENNKTLQN

SEQ ID NO: 2874526 - protein, 16 aa, Entamoeba invadens
KNKNESVTQQINTTRS

SEQ ID NO: 2874527 - protein, 9 aa, Entamoeba invadens
KNKNGSAIK

SEQ ID NO: 2874528 - protein, 11 aa, Entamoeba invadens
KNKNGSIDSTE

SEQ ID NO: 2874529 - protein, 7 aa, Entamoeba invadens
KNKNGYT

SEQ ID NO: 2874530 - protein, 15 aa, Entamoeba invadens
KNKNLPEGIKSGTFS

SEQ ID NO: 2874531 - protein, 9 aa, Entamoeba invadens
KNKNNSSIK

SEQ ID NO: 2874532 - protein, 19 aa, Entamoeba invadens
KNKNQELENCKTENSQNKQ

SEQ ID NO: 2874533 - protein, 9 aa, Entamoeba invadens
KNKNSITLK

SEQ ID NO: 2874534 - protein, 9 aa, Entamoeba invadens
KNKNSNAVK

SEQ ID NO: 2874535 - protein, 8 aa, Entamoeba invadens
KNKNSNIT

SEQ ID NO: 2874536 - protein, 4 aa, Entamoeba invadens
KNKP

SEQ ID NO: 2874537 - protein, 5 aa, Entamoeba invadens
KNKPL

SEQ ID NO: 2874538 - protein, 10 aa, Entamoeba invadens
KNKPPPPEEF

SEQ ID NO: 2874539 - protein, 9 aa, Entamoeba invadens
KNKPTFNKT

SEQ ID NO: 2874540 - protein, 7 aa, Entamoeba invadens
KNKPYEM

SEQ ID NO: 2874541 - protein, 10 aa, Entamoeba invadens
KNKQEESLET

SEQ ID NO: 2874542 - protein, 7 aa, Entamoeba invadens
KNKQIKK

SEQ ID NO: 2874543 - protein, 8 aa, Entamoeba invadens
KNKQLTQH

SEQ ID NO: 2874544 - protein, 10 aa, Entamoeba invadens
KNKQRTFSEQ

SEQ ID NO: 2874545 - protein, 8 aa, Entamoeba invadens
KNKQSEDV

SEQ ID NO: 2874546 - protein, 12 aa, Entamoeba invadens
KNKREEGRSRQE

SEQ ID NO: 2874547 - protein, 5 aa, Entamoeba invadens
KNKRN

SEQ ID NO: 2874548 - protein, 8 aa, Entamoeba invadens
KNKRSGFD

SEQ ID NO: 2874549 - protein, 5 aa, Entamoeba invadens
KNKRT

SEQ ID NO: 2874550 - protein, 12 aa, Entamoeba invadens
KNKRTLEEAKRD

SEQ ID NO: 2874551 - protein, 6 aa, Entamoeba invadens
KNKSLK

SEQ ID NO: 2874552 - protein, 8 aa, Entamoeba invadens
KNKSNAVS

SEQ ID NO: 2874553 - protein, 13 aa, Entamoeba invadens
KNKSNSPVAPSSF

SEQ ID NO: 2874554 - protein, 8 aa, Entamoeba invadens
KNKSTLVG

SEQ ID NO: 2874555 - protein, 4 aa, Entamoeba invadens
KNKT

SEQ ID NO: 2874556 - protein, 10 aa, Entamoeba invadens
KNKTEKINGK

SEQ ID NO: 2874557 - protein, 6 aa, Entamoeba invadens
KNKTFQ

SEQ ID NO: 2874558 - protein, 18 aa, Entamoeba invadens
KNKTNLQVNNEPNTKGMG

SEQ ID NO: 2874559 - protein, 26 aa, Entamoeba invadens
KNKTQLTDPETLRNRKRMSRNGESVV

SEQ ID NO: 2874560 - protein, 11 aa, Entamoeba invadens
KNKTTEGTAPS

SEQ ID NO: 2874561 - protein, 8 aa, Entamoeba invadens
KNKTTTET

SEQ ID NO: 2874562 - protein, 7 aa, Entamoeba invadens
KNKTVKP

SEQ ID NO: 2874563 - protein, 5 aa, Entamoeba invadens
KNKVD

SEQ ID NO: 2874564 - protein, 7 aa, Entamoeba invadens
KNKVDKK

SEQ ID NO: 2874565 - protein, 9 aa, Entamoeba invadens
KNKYKKSAD

SEQ ID NO: 2874566 - protein, 7 aa, Entamoeba invadens
KNKYQAY

SEQ ID NO: 2874567 - protein, 10 aa, Entamoeba invadens
KNLAKPTAKT

SEQ ID NO: 2874568 - protein, 23 aa, Entamoeba invadens
KNLANDKDQLSSEKKKLQDKYDQ

SEQ ID NO: 2874569 - protein, 22 aa, Entamoeba invadens
KNLANDKDQLSSEKKKLQDQYD

SEQ ID NO: 2874570 - protein, 20 aa, Entamoeba invadens
KNLANDKDQLSSEKKKLQYE

SEQ ID NO: 2874571 - protein, 23 aa, Entamoeba invadens
KNLANDRDQLSSEKKKLQDKYDQ

SEQ ID NO: 2874572 - protein, 6 aa, Entamoeba invadens
KNLAQS

SEQ ID NO: 2874573 - protein, 6 aa, Entamoeba invadens
KNLDDE

SEQ ID NO: 2874574 - protein, 9 aa, Entamoeba invadens
KNLDEQKRD

SEQ ID NO: 2874575 - protein, 13 aa, Entamoeba invadens
KNLDEQSETGPKF

SEQ ID NO: 2874576 - protein, 5 aa, Entamoeba invadens
KNLEE

SEQ ID NO: 2874577 - protein, 13 aa, Entamoeba invadens
KNLEGRTARSIRN

SEQ ID NO: 2874578 - protein, 12 aa, Entamoeba invadens
KNLENPKSAEQL

SEQ ID NO: 2874579 - protein, 5 aa, Entamoeba invadens
KNLIG

SEQ ID NO: 2874580 - protein, 5 aa, Entamoeba invadens
KNLKE

SEQ ID NO: 2874581 - protein, 6 aa, Entamoeba invadens
KNLKEE

SEQ ID NO: 2874582 - protein, 15 aa, Entamoeba invadens
KNLKGADFGGLSSDP

SEQ ID NO: 2874583 - protein, 5 aa, Entamoeba invadens
KNLNK

SEQ ID NO: 2874584 - protein, 6 aa, Entamoeba invadens
KNLNSA

SEQ ID NO: 2874585 - protein, 4 aa, Entamoeba invadens
KNLP

SEQ ID NO: 2874586 - protein, 12 aa, Entamoeba invadens
KNLPKNQRMEAQ

SEQ ID NO: 2874587 - protein, 7 aa, Entamoeba invadens
KNLPTKR

SEQ ID NO: 2874588 - protein, 9 aa, Entamoeba invadens
KNLQEEKSN

SEQ ID NO: 2874589 - protein, 6 aa, Entamoeba invadens
KNLQGD

SEQ ID NO: 2874590 - protein, 7 aa, Entamoeba invadens
KNLQNTI

SEQ ID NO: 2874591 - protein, 11 aa, Entamoeba invadens
KNLRKENGSTI

SEQ ID NO: 2874592 - protein, 4 aa, Entamoeba invadens
KNLS

SEQ ID NO: 2874593 - protein, 12 aa, Entamoeba invadens
KNLSDKKYLTKE

SEQ ID NO: 2874594 - protein, 21 aa, Entamoeba invadens
KNLSKGSYKENSTSDNEKQSS

SEQ ID NO: 2874595 - protein, 8 aa, Entamoeba invadens
KNLSKTEI

SEQ ID NO: 2874596 - protein, 9 aa, Entamoeba invadens
KNLSPEGCT

SEQ ID NO: 2874597 - protein, 8 aa, Entamoeba invadens
KNLSPTLD

SEQ ID NO: 2874598 - protein, 7 aa, Entamoeba invadens
KNLSQNN

SEQ ID NO: 2874599 - protein, 5 aa, Entamoeba invadens
KNLTE

SEQ ID NO: 2874600 - protein, 6 aa, Entamoeba invadens
KNLTEK

SEQ ID NO: 2874601 - protein, 5 aa, Entamoeba invadens
KNLTN

SEQ ID NO: 2874602 - protein, 23 aa, Entamoeba invadens
KNLTNDKNQLSSEKKKLQDKYDQ

SEQ ID NO: 2874603 - protein, 12 aa, Entamoeba invadens
KNLYTERSTFPP

SEQ ID NO: 2874604 - protein, 10 aa, Entamoeba invadens
KNMDNKEEAI

SEQ ID NO: 2874605 - protein, 95 aa, Entamoeba invadens
KNMDTSKTVQQKTQITTQQPQQIPTQTIPEPPKTTSRKGKEPLSKSRPHPLKRRREESGESSGTTDTSKSRKIEKEHPTTSPKREDKEDDESKKM

SEQ ID NO: 2874606 - protein, 5 aa, Entamoeba invadens
KNMEE

SEQ ID NO: 2874607 - protein, 8 aa, Entamoeba invadens
KNMEEGDV

SEQ ID NO: 2874608 - protein, 5 aa, Entamoeba invadens
KNMEI

SEQ ID NO: 2874609 - protein, 11 aa, Entamoeba invadens
KNMENDTATDE

SEQ ID NO: 2874610 - protein, 6 aa, Entamoeba invadens
KNMGKE

SEQ ID NO: 2874611 - protein, 12 aa, Entamoeba invadens
KNMNKKKIGNDS

SEQ ID NO: 2874612 - protein, 19 aa, Entamoeba invadens
KNMNKPKMLPPRPEYTKGK

SEQ ID NO: 2874613 - protein, 8 aa, Entamoeba invadens
KNMNRSTV

SEQ ID NO: 2874614 - protein, 9 aa, Entamoeba invadens
KNMNSQRPY

SEQ ID NO: 2874615 - protein, 5 aa, Entamoeba invadens
KNMPN

SEQ ID NO: 2874616 - protein, 9 aa, Entamoeba invadens
KNMSTFPKG

SEQ ID NO: 2874617 - protein, 5 aa, Entamoeba invadens
KNMTD

SEQ ID NO: 2874618 - protein, 7 aa, Entamoeba invadens
KNMTTPT

SEQ ID NO: 2874619 - protein, 5 aa, Entamoeba invadens
KNNAD

SEQ ID NO: 2874620 - protein, 6 aa, Entamoeba invadens
KNNAIT

SEQ ID NO: 2874621 - protein, 7 aa, Entamoeba invadens
KNNAQEM

SEQ ID NO: 2874622 - protein, 4 aa, Entamoeba invadens
KNND

SEQ ID NO: 2874623 - protein, 6 aa, Entamoeba invadens
KNNDGH

SEQ ID NO: 2874624 - protein, 18 aa, Entamoeba invadens
KNNDKKTPNSLNATDEQT

SEQ ID NO: 2874625 - protein, 12 aa, Entamoeba invadens
KNNDVDGDNVDT

SEQ ID NO: 2874626 - protein, 17 aa, Entamoeba invadens
KNNEDGTYTGSYTPVPG

SEQ ID NO: 2874627 - protein, 8 aa, Entamoeba invadens
KNNEEEIN

SEQ ID NO: 2874628 - protein, 8 aa, Entamoeba invadens
KNNEEENT

SEQ ID NO: 2874629 - protein, 10 aa, Entamoeba invadens
KNNEFKGKAS

SEQ ID NO: 2874630 - protein, 6 aa, Entamoeba invadens
KNNEGL

SEQ ID NO: 2874631 - protein, 9 aa, Entamoeba invadens
KNNEIEKYS

SEQ ID NO: 2874632 - protein, 7 aa, Entamoeba invadens
KNNEIEQ

SEQ ID NO: 2874633 - protein, 5 aa, Entamoeba invadens
KNNEK

SEQ ID NO: 2874634 - protein, 24 aa, Entamoeba invadens
KNNEKDLKKPVRQDQQQQKDDGTY

SEQ ID NO: 2874635 - protein, 6 aa, Entamoeba invadens
KNNELT

SEQ ID NO: 2874636 - protein, 16 aa, Entamoeba invadens
KNNELYPTVEDNTPKD

SEQ ID NO: 2874637 - protein, 10 aa, Entamoeba invadens
KNNENAKKRA

SEQ ID NO: 2874638 - protein, 12 aa, Entamoeba invadens
KNNEVIQTQSGV

SEQ ID NO: 2874639 - protein, 7 aa, Entamoeba invadens
KNNFKTA

SEQ ID NO: 2874640 - protein, 6 aa, Entamoeba invadens
KNNFLS

SEQ ID NO: 2874641 - protein, 4 aa, Entamoeba invadens
KNNG

SEQ ID NO: 2874642 - protein, 14 aa, Entamoeba invadens
KNNGACKKADGTAF

SEQ ID NO: 2874643 - protein, 9 aa, Entamoeba invadens
KNNGKCNGK

SEQ ID NO: 2874644 - protein, 9 aa, Entamoeba invadens
KNNGKTTKI

SEQ ID NO: 2874645 - protein, 6 aa, Entamoeba invadens
KNNGSI

SEQ ID NO: 2874646 - protein, 7 aa, Entamoeba invadens
KNNGYEP

SEQ ID NO: 2874647 - protein, 15 aa, Entamoeba invadens
KNNGYVDKSGRLNGE

SEQ ID NO: 2874648 - protein, 7 aa, Entamoeba invadens
KNNHKDD

SEQ ID NO: 2874649 - protein, 6 aa, Entamoeba invadens
KNNIGV

SEQ ID NO: 2874650 - protein, 9 aa, Entamoeba invadens
KNNKDETKI

SEQ ID NO: 2874651 - protein, 6 aa, Entamoeba invadens
KNNKDQ

SEQ ID NO: 2874652 - protein, 13 aa, Entamoeba invadens
KNNKESIDNSQAE

SEQ ID NO: 2874653 - protein, 16 aa, Entamoeba invadens
KNNKETGIPKPVTYTD

SEQ ID NO: 2874654 - protein, 8 aa, Entamoeba invadens
KNNKGKVE

SEQ ID NO: 2874655 - protein, 6 aa, Entamoeba invadens
KNNKKS

SEQ ID NO: 2874656 - protein, 22 aa, Entamoeba invadens
KNNKLSAKFANSSYSKISSETD

SEQ ID NO: 2874657 - protein, 15 aa, Entamoeba invadens
KNNKNNKRKNFIEST

SEQ ID NO: 2874658 - protein, 6 aa, Entamoeba invadens
KNNKPF

SEQ ID NO: 2874659 - protein, 6 aa, Entamoeba invadens
KNNKRL

SEQ ID NO: 2874660 - protein, 18 aa, Entamoeba invadens
KNNKTISDYRDEKNLYEQ

SEQ ID NO: 2874661 - protein, 16 aa, Entamoeba invadens
KNNKTISDYRNENNMY

SEQ ID NO: 2874662 - protein, 15 aa, Entamoeba invadens
KNNLEKNEKISEEEK

SEQ ID NO: 2874663 - protein, 13 aa, Entamoeba invadens
KNNLKQSEQTTEK

SEQ ID NO: 2874664 - protein, 32 aa, Entamoeba invadens
KNNLNEEQTNTKEESDKAKEQLKQSQSENEKL

SEQ ID NO: 2874665 - protein, 7 aa, Entamoeba invadens
KNNLPGI

SEQ ID NO: 2874666 - protein, 7 aa, Entamoeba invadens
KNNLRSP

SEQ ID NO: 2874667 - protein, 14 aa, Entamoeba invadens
KNNLTKTEEYTKSA

SEQ ID NO: 2874668 - protein, 4 aa, Entamoeba invadens
KNNM

SEQ ID NO: 2874669 - protein, 8 aa, Entamoeba invadens
KNNMTDEE

SEQ ID NO: 2874670 - protein, 4 aa, Entamoeba invadens
KNNN

SEQ ID NO: 2874671 - protein, 7 aa, Entamoeba invadens
KNNNDTT

SEQ ID NO: 2874672 - protein, 10 aa, Entamoeba invadens
KNNNKTAQLD

SEQ ID NO: 2874673 - protein, 5 aa, Entamoeba invadens
KNNNN

SEQ ID NO: 2874674 - protein, 9 aa, Entamoeba invadens
KNNNSPNYK

SEQ ID NO: 2874675 - protein, 5 aa, Entamoeba invadens
KNNNV

SEQ ID NO: 2874676 - protein, 40 aa, Entamoeba invadens
KNNPLNKNTKKIKSQKRKSSKTPQSSHEVNNHNDKKCCTI

SEQ ID NO: 2874677 - protein, 6 aa, Entamoeba invadens
KNNPLQ

SEQ ID NO: 2874678 - protein, 23 aa, Entamoeba invadens
KNNPPKIDENGRLKSGLTPPTNR

SEQ ID NO: 2874679 - protein, 5 aa, Entamoeba invadens
KNNQF

SEQ ID NO: 2874680 - protein, 7 aa, Entamoeba invadens
KNNQITL

SEQ ID NO: 2874681 - protein, 5 aa, Entamoeba invadens
KNNQK

SEQ ID NO: 2874682 - protein, 16 aa, Entamoeba invadens
KNNQKGTNYLSPSTCA

SEQ ID NO: 2874683 - protein, 5 aa, Entamoeba invadens
KNNQT

SEQ ID NO: 2874684 - protein, 7 aa, Entamoeba invadens
KNNQTQN

SEQ ID NO: 2874685 - protein, 7 aa, Entamoeba invadens
KNNQTTP

SEQ ID NO: 2874686 - protein, 4 aa, Entamoeba invadens
KNNR

SEQ ID NO: 2874687 - protein, 10 aa, Entamoeba invadens
KNNRKQFGNN

SEQ ID NO: 2874688 - protein, 8 aa, Entamoeba invadens
KNNRKVPG

SEQ ID NO: 2874689 - protein, 6 aa, Entamoeba invadens
KNNRNL

SEQ ID NO: 2874690 - protein, 4 aa, Entamoeba invadens
KNNS

SEQ ID NO: 2874691 - protein, 5 aa, Entamoeba invadens
KNNSE

SEQ ID NO: 2874692 - protein, 6 aa, Entamoeba invadens
KNNSKN

SEQ ID NO: 2874693 - protein, 11 aa, Entamoeba invadens
KNNSNSQRNIT

SEQ ID NO: 2874694 - protein, 10 aa, Entamoeba invadens
KNNSPSSVLE

SEQ ID NO: 2874695 - protein, 6 aa, Entamoeba invadens
KNNSVS

SEQ ID NO: 2874696 - protein, 18 aa, Entamoeba invadens
KNNSYSQRNIISCVDGYF

SEQ ID NO: 2874697 - protein, 9 aa, Entamoeba invadens
KNNTETQKS

SEQ ID NO: 2874698 - protein, 16 aa, Entamoeba invadens
KNNTGITEAFTWLGQN

SEQ ID NO: 2874699 - protein, 9 aa, Entamoeba invadens
KNNTHENEK

SEQ ID NO: 2874700 - protein, 7 aa, Entamoeba invadens
KNNTKDA

SEQ ID NO: 2874701 - protein, 7 aa, Entamoeba invadens
KNNTNIR

SEQ ID NO: 2874702 - protein, 8 aa, Entamoeba invadens
KNNTNMER

SEQ ID NO: 2874703 - protein, 9 aa, Entamoeba invadens
KNNTPSHSI

SEQ ID NO: 2874704 - protein, 19 aa, Entamoeba invadens
KNNTPVKTGISSKGADPIW

SEQ ID NO: 2874705 - protein, 7 aa, Entamoeba invadens
KNNTTTE

SEQ ID NO: 2874706 - protein, 6 aa, Entamoeba invadens
KNNTTY

SEQ ID NO: 2874707 - protein, 5 aa, Entamoeba invadens
KNNVF

SEQ ID NO: 2874708 - protein, 8 aa, Entamoeba invadens
KNNVGETP

SEQ ID NO: 2874709 - protein, 7 aa, Entamoeba invadens
KNNVGID

SEQ ID NO: 2874710 - protein, 10 aa, Entamoeba invadens
KNNVKEQIAG

SEQ ID NO: 2874711 - protein, 5 aa, Entamoeba invadens
KNNVN

SEQ ID NO: 2874712 - protein, 10 aa, Entamoeba invadens
KNNVTTEEEV

SEQ ID NO: 2874713 - protein, 4 aa, Entamoeba invadens
KNNY

SEQ ID NO: 2874714 - protein, 6 aa, Entamoeba invadens
KNNYEV

SEQ ID NO: 2874715 - protein, 7 aa, Entamoeba invadens
KNNYTKR

SEQ ID NO: 2874716 - protein, 8 aa, Entamoeba invadens
KNPAPQGF

SEQ ID NO: 2874717 - protein, 9 aa, Entamoeba invadens
KNPAPTSRQ

SEQ ID NO: 2874718 - protein, 11 aa, Entamoeba invadens
KNPDERIKDAD

SEQ ID NO: 2874719 - protein, 5 aa, Entamoeba invadens
KNPDL

SEQ ID NO: 2874720 - protein, 7 aa, Entamoeba invadens
KNPEDVS

SEQ ID NO: 2874721 - protein, 6 aa, Entamoeba invadens
KNPEIG

SEQ ID NO: 2874722 - protein, 11 aa, Entamoeba invadens
KNPENAEEFKD

SEQ ID NO: 2874723 - protein, 9 aa, Entamoeba invadens
KNPEPQQIP

SEQ ID NO: 2874724 - protein, 7 aa, Entamoeba invadens
KNPEVKG

SEQ ID NO: 2874725 - protein, 8 aa, Entamoeba invadens
KNPHELTA

SEQ ID NO: 2874726 - protein, 5 aa, Entamoeba invadens
KNPIV

SEQ ID NO: 2874727 - protein, 4 aa, Entamoeba invadens
KNPK

SEQ ID NO: 2874728 - protein, 13 aa, Entamoeba invadens
KNPKDEPDTNSTV

SEQ ID NO: 2874729 - protein, 6 aa, Entamoeba invadens
KNPKEE

SEQ ID NO: 2874730 - protein, 9 aa, Entamoeba invadens
KNPKKTPIQ

SEQ ID NO: 2874731 - protein, 8 aa, Entamoeba invadens
KNPKNYHT

SEQ ID NO: 2874732 - protein, 10 aa, Entamoeba invadens
KNPKTGKKSR

SEQ ID NO: 2874733 - protein, 38 aa, Entamoeba invadens
KNPKYITKNKENDNQQEENSKQKKRVGSLSKPPSELDK

SEQ ID NO: 2874734 - protein, 9 aa, Entamoeba invadens
KNPLEDMNE

SEQ ID NO: 2874735 - protein, 9 aa, Entamoeba invadens
KNPLTNRQT

SEQ ID NO: 2874736 - protein, 5 aa, Entamoeba invadens
KNPML

SEQ ID NO: 2874737 - protein, 9 aa, Entamoeba invadens
KNPNDKVNA

SEQ ID NO: 2874738 - protein, 5 aa, Entamoeba invadens
KNPNE

SEQ ID NO: 2874739 - protein, 12 aa, Entamoeba invadens
KNPNEKNPEEME

SEQ ID NO: 2874740 - protein, 9 aa, Entamoeba invadens
KNPNESELK

SEQ ID NO: 2874741 - protein, 8 aa, Entamoeba invadens
KNPNITTT

SEQ ID NO: 2874742 - protein, 6 aa, Entamoeba invadens
KNPNLF

SEQ ID NO: 2874743 - protein, 8 aa, Entamoeba invadens
KNPNLTPT

SEQ ID NO: 2874744 - protein, 8 aa, Entamoeba invadens
KNPNNEGE

SEQ ID NO: 2874745 - protein, 8 aa, Entamoeba invadens
KNPNNNYN

SEQ ID NO: 2874746 - protein, 12 aa, Entamoeba invadens
KNPNSPRYSPGL

SEQ ID NO: 2874747 - protein, 6 aa, Entamoeba invadens
KNPNYF

SEQ ID NO: 2874748 - protein, 12 aa, Entamoeba invadens
KNPPINPIGQNP

SEQ ID NO: 2874749 - protein, 7 aa, Entamoeba invadens
KNPPLSQ

SEQ ID NO: 2874750 - protein, 6 aa, Entamoeba invadens
KNPQTQ

SEQ ID NO: 2874751 - protein, 6 aa, Entamoeba invadens
KNPRNV

SEQ ID NO: 2874752 - protein, 8 aa, Entamoeba invadens
KNPRTAAY

SEQ ID NO: 2874753 - protein, 7 aa, Entamoeba invadens
KNPRYLQ

SEQ ID NO: 2874754 - protein, 9 aa, Entamoeba invadens
KNPRYPPAR

SEQ ID NO: 2874755 - protein, 6 aa, Entamoeba invadens
KNPSEG

SEQ ID NO: 2874756 - protein, 10 aa, Entamoeba invadens
KNPSILRSSS

SEQ ID NO: 2874757 - protein, 8 aa, Entamoeba invadens
KNPSNTAE

SEQ ID NO: 2874758 - protein, 10 aa, Entamoeba invadens
KNPSSPLNNP

SEQ ID NO: 2874759 - protein, 10 aa, Entamoeba invadens
KNPSTSQLPT

SEQ ID NO: 2874760 - protein, 4 aa, Entamoeba invadens
KNPT

SEQ ID NO: 2874761 - protein, 9 aa, Entamoeba invadens
KNPTFSQKG

SEQ ID NO: 2874762 - protein, 6 aa, Entamoeba invadens
KNPTIS

SEQ ID NO: 2874763 - protein, 5 aa, Entamoeba invadens
KNPTK

SEQ ID NO: 2874764 - protein, 10 aa, Entamoeba invadens
KNPTKSSEKL

SEQ ID NO: 2874765 - protein, 5 aa, Entamoeba invadens
KNPTL

SEQ ID NO: 2874766 - protein, 8 aa, Entamoeba invadens
KNPTPQIP

SEQ ID NO: 2874767 - protein, 7 aa, Entamoeba invadens
KNPVDDY

SEQ ID NO: 2874768 - protein, 27 aa, Entamoeba invadens
KNPVDTQRNHSGAQKTDFGVPGTRDKW

SEQ ID NO: 2874769 - protein, 9 aa, Entamoeba invadens
KNPVSQSDI

SEQ ID NO: 2874770 - protein, 5 aa, Entamoeba invadens
KNPYW

SEQ ID NO: 2874771 - protein, 11 aa, Entamoeba invadens
KNQANRNARNL

SEQ ID NO: 2874772 - protein, 8 aa, Entamoeba invadens
KNQDKDFN

SEQ ID NO: 2874773 - protein, 24 aa, Entamoeba invadens
KNQDKKIDKEKGVKQLSTKTKDEV

SEQ ID NO: 2874774 - protein, 8 aa, Entamoeba invadens
KNQEMNKD

SEQ ID NO: 2874775 - protein, 21 aa, Entamoeba invadens
KNQERLQEKAALDKQGIYQPS

SEQ ID NO: 2874776 - protein, 5 aa, Entamoeba invadens
KNQES

SEQ ID NO: 2874777 - protein, 7 aa, Entamoeba invadens
KNQEYKD

SEQ ID NO: 2874778 - protein, 9 aa, Entamoeba invadens
KNQFRSQDQ

SEQ ID NO: 2874779 - protein, 8 aa, Entamoeba invadens
KNQGKQEW

SEQ ID NO: 2874780 - protein, 8 aa, Entamoeba invadens
KNQHEATL

SEQ ID NO: 2874781 - protein, 9 aa, Entamoeba invadens
KNQIGASNG

SEQ ID NO: 2874782 - protein, 5 aa, Entamoeba invadens
KNQKM

SEQ ID NO: 2874783 - protein, 6 aa, Entamoeba invadens
KNQKMK

SEQ ID NO: 2874784 - protein, 11 aa, Entamoeba invadens
KNQKQQVSQHQ

SEQ ID NO: 2874785 - protein, 9 aa, Entamoeba invadens
KNQLEDKDI

SEQ ID NO: 2874786 - protein, 17 aa, Entamoeba invadens
KNQLTNTVAKNSKENTL

SEQ ID NO: 2874787 - protein, 7 aa, Entamoeba invadens
KNQNAVA

SEQ ID NO: 2874788 - protein, 5 aa, Entamoeba invadens
KNQNE

SEQ ID NO: 2874789 - protein, 5 aa, Entamoeba invadens
KNQPF

SEQ ID NO: 2874790 - protein, 9 aa, Entamoeba invadens
KNQPTKSTL

SEQ ID NO: 2874791 - protein, 6 aa, Entamoeba invadens
KNQQEA

SEQ ID NO: 2874792 - protein, 5 aa, Entamoeba invadens
KNQRE

SEQ ID NO: 2874793 - protein, 21 aa, Entamoeba invadens
KNQSASKDEYTQKQKEAEAKI

SEQ ID NO: 2874794 - protein, 10 aa, Entamoeba invadens
KNQSEEDDED

SEQ ID NO: 2874795 - protein, 8 aa, Entamoeba invadens
KNQSEIYE

SEQ ID NO: 2874796 - protein, 8 aa, Entamoeba invadens
KNQSIKSL

SEQ ID NO: 2874797 - protein, 10 aa, Entamoeba invadens
KNQTENEVRE

SEQ ID NO: 2874798 - protein, 6 aa, Entamoeba invadens
KNQTTI

SEQ ID NO: 2874799 - protein, 12 aa, Entamoeba invadens
KNQYNKIQNSMR

SEQ ID NO: 2874800 - protein, 5 aa, Entamoeba invadens
KNRDE

SEQ ID NO: 2874801 - protein, 9 aa, Entamoeba invadens
KNRDTNKMT

SEQ ID NO: 2874802 - protein, 15 aa, Entamoeba invadens
KNREKSSLSKNRTQS

SEQ ID NO: 2874803 - protein, 8 aa, Entamoeba invadens
KNRESGEV

SEQ ID NO: 2874804 - protein, 11 aa, Entamoeba invadens
KNRESNKNVEP

SEQ ID NO: 2874805 - protein, 5 aa, Entamoeba invadens
KNRET

SEQ ID NO: 2874806 - protein, 10 aa, Entamoeba invadens
KNRETSEAQQ

SEQ ID NO: 2874807 - protein, 6 aa, Entamoeba invadens
KNRGNG

SEQ ID NO: 2874808 - protein, 13 aa, Entamoeba invadens
KNRGTPLGHGSAV

SEQ ID NO: 2874809 - protein, 4 aa, Entamoeba invadens
KNRI

SEQ ID NO: 2874810 - protein, 5 aa, Entamoeba invadens
KNRKE

SEQ ID NO: 2874811 - protein, 8 aa, Entamoeba invadens
KNRKGGSL

SEQ ID NO: 2874812 - protein, 9 aa, Entamoeba invadens
KNRKNPGLA

SEQ ID NO: 2874813 - protein, 13 aa, Entamoeba invadens
KNRKTAKRQVAPL

SEQ ID NO: 2874814 - protein, 5 aa, Entamoeba invadens
KNRLT

SEQ ID NO: 2874815 - protein, 5 aa, Entamoeba invadens
KNRNI

SEQ ID NO: 2874816 - protein, 9 aa, Entamoeba invadens
KNRNNNVKN

SEQ ID NO: 2874817 - protein, 5 aa, Entamoeba invadens
KNRPL

SEQ ID NO: 2874818 - protein, 6 aa, Entamoeba invadens
KNRPNT

SEQ ID NO: 2874819 - protein, 15 aa, Entamoeba invadens
KNRRGQIQKDGKAKF

SEQ ID NO: 2874820 - protein, 14 aa, Entamoeba invadens
KNRRGQVQADGKAK

SEQ ID NO: 2874821 - protein, 15 aa, Entamoeba invadens
KNRRGQVQTDGKAKF

SEQ ID NO: 2874822 - protein, 5 aa, Entamoeba invadens
KNRRT

SEQ ID NO: 2874823 - protein, 7 aa, Entamoeba invadens
KNRSDGI

SEQ ID NO: 2874824 - protein, 6 aa, Entamoeba invadens
KNRSPQ

SEQ ID NO: 2874825 - protein, 14 aa, Entamoeba invadens
KNRTATDKDSDIED

SEQ ID NO: 2874826 - protein, 5 aa, Entamoeba invadens
KNRTK

SEQ ID NO: 2874827 - protein, 7 aa, Entamoeba invadens
KNRVAAQ

SEQ ID NO: 2874828 - protein, 10 aa, Entamoeba invadens
KNRVPENQRG

SEQ ID NO: 2874829 - protein, 7 aa, Entamoeba invadens
KNRVQNT

SEQ ID NO: 2874830 - protein, 11 aa, Entamoeba invadens
KNRVQTRKEKY

SEQ ID NO: 2874831 - protein, 4 aa, Entamoeba invadens
KNRY

SEQ ID NO: 2874832 - protein, 6 aa, Entamoeba invadens
KNRYGK

SEQ ID NO: 2874833 - protein, 4 aa, Entamoeba invadens
KNSA

SEQ ID NO: 2874834 - protein, 20 aa, Entamoeba invadens
KNSDDNSEESDMDEDAKEEL

SEQ ID NO: 2874835 - protein, 6 aa, Entamoeba invadens
KNSDGV

SEQ ID NO: 2874836 - protein, 5 aa, Entamoeba invadens
KNSDI

SEQ ID NO: 2874837 - protein, 6 aa, Entamoeba invadens
KNSDID

SEQ ID NO: 2874838 - protein, 13 aa, Entamoeba invadens
KNSDTTNQTQNPL

SEQ ID NO: 2874839 - protein, 6 aa, Entamoeba invadens
KNSDVK

SEQ ID NO: 2874840 - protein, 4 aa, Entamoeba invadens
KNSE

SEQ ID NO: 2874841 - protein, 8 aa, Entamoeba invadens
KNSEDAQF

SEQ ID NO: 2874842 - protein, 7 aa, Entamoeba invadens
KNSEEIR

SEQ ID NO: 2874843 - protein, 6 aa, Entamoeba invadens
KNSEHN

SEQ ID NO: 2874844 - protein, 18 aa, Entamoeba invadens
KNSEINTSQETNDEKIEK

SEQ ID NO: 2874845 - protein, 7 aa, Entamoeba invadens
KNSEKEI

SEQ ID NO: 2874846 - protein, 28 aa, Entamoeba invadens
KNSELEDEKAKLKRDNETLKKKGSNMPT

SEQ ID NO: 2874847 - protein, 6 aa, Entamoeba invadens
KNSELP

SEQ ID NO: 2874848 - protein, 20 aa, Entamoeba invadens
KNSELQVDAKTQTEERELSE

SEQ ID NO: 2874849 - protein, 6 aa, Entamoeba invadens
KNSEQK

SEQ ID NO: 2874850 - protein, 9 aa, Entamoeba invadens
KNSERSKST

SEQ ID NO: 2874851 - protein, 10 aa, Entamoeba invadens
KNSETDPNTI

SEQ ID NO: 2874852 - protein, 6 aa, Entamoeba invadens
KNSETN

SEQ ID NO: 2874853 - protein, 14 aa, Entamoeba invadens
KNSETSPTSISERK

SEQ ID NO: 2874854 - protein, 9 aa, Entamoeba invadens
KNSETYPQR

SEQ ID NO: 2874855 - protein, 10 aa, Entamoeba invadens
KNSFATGSND

SEQ ID NO: 2874856 - protein, 6 aa, Entamoeba invadens
KNSFPA

SEQ ID NO: 2874857 - protein, 8 aa, Entamoeba invadens
KNSFSECE

SEQ ID NO: 2874858 - protein, 6 aa, Entamoeba invadens
KNSGET

SEQ ID NO: 2874859 - protein, 7 aa, Entamoeba invadens
KNSGGAF

SEQ ID NO: 2874860 - protein, 6 aa, Entamoeba invadens
KNSGKA

SEQ ID NO: 2874861 - protein, 20 aa, Entamoeba invadens
KNSHSENNLLSPRENGKVTG

SEQ ID NO: 2874862 - protein, 18 aa, Entamoeba invadens
KNSIKSVGKDLNRTEMEE

SEQ ID NO: 2874863 - protein, 10 aa, Entamoeba invadens
KNSKDLATKY

SEQ ID NO: 2874864 - protein, 16 aa, Entamoeba invadens
KNSKEGIEETDEIDDG

SEQ ID NO: 2874865 - protein, 6 aa, Entamoeba invadens
KNSKLG

SEQ ID NO: 2874866 - protein, 6 aa, Entamoeba invadens
KNSKNL

SEQ ID NO: 2874867 - protein, 9 aa, Entamoeba invadens
KNSKRKRPK

SEQ ID NO: 2874868 - protein, 14 aa, Entamoeba invadens
KNSKTKEIVEQPEQ

SEQ ID NO: 2874869 - protein, 11 aa, Entamoeba invadens
KNSKTLPDNTE

SEQ ID NO: 2874870 - protein, 5 aa, Entamoeba invadens
KNSKV

SEQ ID NO: 2874871 - protein, 6 aa, Entamoeba invadens
KNSLTE

SEQ ID NO: 2874872 - protein, 6 aa, Entamoeba invadens
KNSMPK

SEQ ID NO: 2874873 - protein, 7 aa, Entamoeba invadens
KNSMQSQ

SEQ ID NO: 2874874 - protein, 7 aa, Entamoeba invadens
KNSNEID

SEQ ID NO: 2874875 - protein, 10 aa, Entamoeba invadens
KNSNGSVSEM

SEQ ID NO: 2874876 - protein, 7 aa, Entamoeba invadens
KNSNHLD

SEQ ID NO: 2874877 - protein, 9 aa, Entamoeba invadens
KNSPQTQSC

SEQ ID NO: 2874878 - protein, 19 aa, Entamoeba invadens
KNSQPEEIDNLEKKDTQLT

SEQ ID NO: 2874879 - protein, 8 aa, Entamoeba invadens
KNSRLADT

SEQ ID NO: 2874880 - protein, 7 aa, Entamoeba invadens
KNSRSSI

SEQ ID NO: 2874881 - protein, 9 aa, Entamoeba invadens
KNSRYNARD

SEQ ID NO: 2874882 - protein, 8 aa, Entamoeba invadens
KNSSENTE

SEQ ID NO: 2874883 - protein, 7 aa, Entamoeba invadens
KNSSGEV

SEQ ID NO: 2874884 - protein, 8 aa, Entamoeba invadens
KNSSGKVS

SEQ ID NO: 2874885 - protein, 9 aa, Entamoeba invadens
KNSSRKQVI

SEQ ID NO: 2874886 - protein, 20 aa, Entamoeba invadens
KNSSSEEEFTEGDEKPKRVL

SEQ ID NO: 2874887 - protein, 10 aa, Entamoeba invadens
KNSSSGSSNT

SEQ ID NO: 2874888 - protein, 9 aa, Entamoeba invadens
KNSSVSSPY

SEQ ID NO: 2874889 - protein, 8 aa, Entamoeba invadens
KNSTDTIK

SEQ ID NO: 2874890 - protein, 5 aa, Entamoeba invadens
KNSTF

SEQ ID NO: 2874891 - protein, 8 aa, Entamoeba invadens
KNSTFDEK

SEQ ID NO: 2874892 - protein, 6 aa, Entamoeba invadens
KNSTGI

SEQ ID NO: 2874893 - protein, 7 aa, Entamoeba invadens
KNSTGYT

SEQ ID NO: 2874894 - protein, 5 aa, Entamoeba invadens
KNSTI

SEQ ID NO: 2874895 - protein, 9 aa, Entamoeba invadens
KNSTKQIND

SEQ ID NO: 2874896 - protein, 5 aa, Entamoeba invadens
KNSTN

SEQ ID NO: 2874897 - protein, 16 aa, Entamoeba invadens
KNSTNKKGGAKSKAET

SEQ ID NO: 2874898 - protein, 8 aa, Entamoeba invadens
KNSTNLTS

SEQ ID NO: 2874899 - protein, 9 aa, Entamoeba invadens
KNSTQLKNM

SEQ ID NO: 2874900 - protein, 13 aa, Entamoeba invadens
KNSVEGASVENES

SEQ ID NO: 2874901 - protein, 4 aa, Entamoeba invadens
KNTA

SEQ ID NO: 2874902 - protein, 8 aa, Entamoeba invadens
KNTAIAEY

SEQ ID NO: 2874903 - protein, 10 aa, Entamoeba invadens
KNTANPVDKQ

SEQ ID NO: 2874904 - protein, 4 aa, Entamoeba invadens
KNTD

SEQ ID NO: 2874905 - protein, 11 aa, Entamoeba invadens
KNTDESHKDHK

SEQ ID NO: 2874906 - protein, 9 aa, Entamoeba invadens
KNTDHPKRD

SEQ ID NO: 2874907 - protein, 12 aa, Entamoeba invadens
KNTDKEHPDAAI

SEQ ID NO: 2874908 - protein, 15 aa, Entamoeba invadens
KNTDLNGLNSPNSTF

SEQ ID NO: 2874909 - protein, 7 aa, Entamoeba invadens
KNTDMSI

SEQ ID NO: 2874910 - protein, 6 aa, Entamoeba invadens
KNTEAE

SEQ ID NO: 2874911 - protein, 9 aa, Entamoeba invadens
KNTEDDKEM

SEQ ID NO: 2874912 - protein, 7 aa, Entamoeba invadens
KNTEDRL

SEQ ID NO: 2874913 - protein, 8 aa, Entamoeba invadens
KNTEEFPK

SEQ ID NO: 2874914 - protein, 12 aa, Entamoeba invadens
KNTEETHQDYKE

SEQ ID NO: 2874915 - protein, 19 aa, Entamoeba invadens
KNTEETKNKTDEKNPLETS

SEQ ID NO: 2874916 - protein, 14 aa, Entamoeba invadens
KNTEKFHSNPISLT

SEQ ID NO: 2874917 - protein, 8 aa, Entamoeba invadens
KNTEKGTN

SEQ ID NO: 2874918 - protein, 8 aa, Entamoeba invadens
KNTENITS

SEQ ID NO: 2874919 - protein, 7 aa, Entamoeba invadens
KNTENVQ

SEQ ID NO: 2874920 - protein, 6 aa, Entamoeba invadens
KNTETL

SEQ ID NO: 2874921 - protein, 13 aa, Entamoeba invadens
KNTFNQAEKATIG

SEQ ID NO: 2874922 - protein, 15 aa, Entamoeba invadens
KNTGGLRRKSFSQQF

SEQ ID NO: 2874923 - protein, 5 aa, Entamoeba invadens
KNTGL

SEQ ID NO: 2874924 - protein, 5 aa, Entamoeba invadens
KNTGR

SEQ ID NO: 2874925 - protein, 17 aa, Entamoeba invadens
KNTHENNITSTTYNGPF

SEQ ID NO: 2874926 - protein, 7 aa, Entamoeba invadens
KNTHFDE

SEQ ID NO: 2874927 - protein, 19 aa, Entamoeba invadens
KNTHIKKSQEKHVPKGNQP

SEQ ID NO: 2874928 - protein, 5 aa, Entamoeba invadens
KNTIE

SEQ ID NO: 2874929 - protein, 6 aa, Entamoeba invadens
KNTIEK

SEQ ID NO: 2874930 - protein, 7 aa, Entamoeba invadens
KNTIGQK

SEQ ID NO: 2874931 - protein, 17 aa, Entamoeba invadens
KNTINSPNEVTSEGPKV

SEQ ID NO: 2874932 - protein, 6 aa, Entamoeba invadens
KNTISP

SEQ ID NO: 2874933 - protein, 6 aa, Entamoeba invadens
KNTISQ

SEQ ID NO: 2874934 - protein, 7 aa, Entamoeba invadens
KNTIYDG

SEQ ID NO: 2874935 - protein, 4 aa, Entamoeba invadens
KNTK

SEQ ID NO: 2874936 - protein, 19 aa, Entamoeba invadens
KNTKALSKKSTKSVDEKSL

SEQ ID NO: 2874937 - protein, 8 aa, Entamoeba invadens
KNTKDEQQ

SEQ ID NO: 2874938 - protein, 6 aa, Entamoeba invadens
KNTKDV

SEQ ID NO: 2874939 - protein, 9 aa, Entamoeba invadens
KNTKEEENF

SEQ ID NO: 2874940 - protein, 8 aa, Entamoeba invadens
KNTKENGL

SEQ ID NO: 2874941 - protein, 7 aa, Entamoeba invadens
KNTKEYY

SEQ ID NO: 2874942 - protein, 24 aa, Entamoeba invadens
KNTKFDGTETKKTIQRSSNKNALY

SEQ ID NO: 2874943 - protein, 6 aa, Entamoeba invadens
KNTKNY

SEQ ID NO: 2874944 - protein, 8 aa, Entamoeba invadens
KNTKPSEF

SEQ ID NO: 2874945 - protein, 5 aa, Entamoeba invadens
KNTKQ

SEQ ID NO: 2874946 - protein, 9 aa, Entamoeba invadens
KNTKRRDGV

SEQ ID NO: 2874947 - protein, 14 aa, Entamoeba invadens
KNTKSSMVKQEEDM

SEQ ID NO: 2874948 - protein, 6 aa, Entamoeba invadens
KNTLEN

SEQ ID NO: 2874949 - protein, 17 aa, Entamoeba invadens
KNTLQYGDSIATEAPCN

SEQ ID NO: 2874950 - protein, 55 aa, Entamoeba invadens
KNTLSQSHNNIDNKSRQKSRSRSRSRSRSRQLSQHNSSHYSHNRRNSSCSKESSL

SEQ ID NO: 2874951 - protein, 4 aa, Entamoeba invadens
KNTM

SEQ ID NO: 2874952 - protein, 6 aa, Entamoeba invadens
KNTMNN

SEQ ID NO: 2874953 - protein, 7 aa, Entamoeba invadens
KNTMNSL

SEQ ID NO: 2874954 - protein, 7 aa, Entamoeba invadens
KNTNETV

SEQ ID NO: 2874955 - protein, 6 aa, Entamoeba invadens
KNTNFK

SEQ ID NO: 2874956 - protein, 8 aa, Entamoeba invadens
KNTNHITE

SEQ ID NO: 2874957 - protein, 14 aa, Entamoeba invadens
KNTNKPKTEAGKEI

SEQ ID NO: 2874958 - protein, 7 aa, Entamoeba invadens
KNTNNYV

SEQ ID NO: 2874959 - protein, 6 aa, Entamoeba invadens
KNTNRI

SEQ ID NO: 2874960 - protein, 20 aa, Entamoeba invadens
KNTNSVVNEQQKYVLHKCCL

SEQ ID NO: 2874961 - protein, 12 aa, Entamoeba invadens
KNTNTKDKQHFD

SEQ ID NO: 2874962 - protein, 4 aa, Entamoeba invadens
KNTP

SEQ ID NO: 2874963 - protein, 12 aa, Entamoeba invadens
KNTPATKPKKIR

SEQ ID NO: 2874964 - protein, 13 aa, Entamoeba invadens
KNTPDGTEGKNEI

SEQ ID NO: 2874965 - protein, 16 aa, Entamoeba invadens
KNTPKIKKLSKTQNVW

SEQ ID NO: 2874966 - protein, 12 aa, Entamoeba invadens
KNTPKKQKTYND

SEQ ID NO: 2874967 - protein, 6 aa, Entamoeba invadens
KNTPLK

SEQ ID NO: 2874968 - protein, 8 aa, Entamoeba invadens
KNTPPAVL

SEQ ID NO: 2874969 - protein, 7 aa, Entamoeba invadens
KNTPQDH

SEQ ID NO: 2874970 - protein, 8 aa, Entamoeba invadens
KNTPSQRL

SEQ ID NO: 2874971 - protein, 6 aa, Entamoeba invadens
KNTQFG

SEQ ID NO: 2874972 - protein, 9 aa, Entamoeba invadens
KNTQKPVTT

SEQ ID NO: 2874973 - protein, 8 aa, Entamoeba invadens
KNTQLEER

SEQ ID NO: 2874974 - protein, 11 aa, Entamoeba invadens
KNTQTSIEDGL

SEQ ID NO: 2874975 - protein, 15 aa, Entamoeba invadens
KNTRENTSTCSTYNG

SEQ ID NO: 2874976 - protein, 8 aa, Entamoeba invadens
KNTRGDLN

SEQ ID NO: 2874977 - protein, 9 aa, Entamoeba invadens
KNTRKCPKC

SEQ ID NO: 2874978 - protein, 5 aa, Entamoeba invadens
KNTSG

SEQ ID NO: 2874979 - protein, 8 aa, Entamoeba invadens
KNTSGRTD

SEQ ID NO: 2874980 - protein, 10 aa, Entamoeba invadens
KNTSGSAAYN

SEQ ID NO: 2874981 - protein, 14 aa, Entamoeba invadens
KNTSQRKSIELNDR

SEQ ID NO: 2874982 - protein, 12 aa, Entamoeba invadens
KNTSRNHAEKRT

SEQ ID NO: 2874983 - protein, 5 aa, Entamoeba invadens
KNTSV

SEQ ID NO: 2874984 - protein, 26 aa, Entamoeba invadens
KNTTDKMSEDSDDDNDVEDKELNVPT

SEQ ID NO: 2874985 - protein, 8 aa, Entamoeba invadens
KNTTGTDE

SEQ ID NO: 2874986 - protein, 21 aa, Entamoeba invadens
KNTTITPEKTAETQKPSVEDR

SEQ ID NO: 2874987 - protein, 7 aa, Entamoeba invadens
KNTTNNI

SEQ ID NO: 2874988 - protein, 10 aa, Entamoeba invadens
KNTTQETSLH

SEQ ID NO: 2874989 - protein, 8 aa, Entamoeba invadens
KNTTSDGV

SEQ ID NO: 2874990 - protein, 9 aa, Entamoeba invadens
KNTTSKDEV

SEQ ID NO: 2874991 - protein, 9 aa, Entamoeba invadens
KNTTSPCGP

SEQ ID NO: 2874992 - protein, 6 aa, Entamoeba invadens
KNTTST

SEQ ID NO: 2874993 - protein, 6 aa, Entamoeba invadens
KNTTYS

SEQ ID NO: 2874994 - protein, 9 aa, Entamoeba invadens
KNTVGKQSF

SEQ ID NO: 2874995 - protein, 13 aa, Entamoeba invadens
KNTVKPRLFPFLL

SEQ ID NO: 2874996 - protein, 6 aa, Entamoeba invadens
KNTVKV

SEQ ID NO: 2874997 - protein, 5 aa, Entamoeba invadens
KNTVP

SEQ ID NO: 2874998 - protein, 6 aa, Entamoeba invadens
KNTVSG

SEQ ID NO: 2874999 - protein, 5 aa, Entamoeba invadens
KNVDD

SEQ ID NO: 2875000 - protein, 11 aa, Entamoeba invadens
KNVDDPNPNIE

SEQ ID NO: 2875001 - protein, 18 aa, Entamoeba invadens
KNVDNYSTTNDAGNERGS

SEQ ID NO: 2875002 - protein, 17 aa, Entamoeba invadens
KNVDSYSTTNDAGDERG

SEQ ID NO: 2875003 - protein, 18 aa, Entamoeba invadens
KNVDSYSTTNDAGNKRGS

SEQ ID NO: 2875004 - protein, 19 aa, Entamoeba invadens
KNVDSYSTTSDAKNKKGSF

SEQ ID NO: 2875005 - protein, 7 aa, Entamoeba invadens
KNVDTPT

SEQ ID NO: 2875006 - protein, 5 aa, Entamoeba invadens
KNVED

SEQ ID NO: 2875007 - protein, 5 aa, Entamoeba invadens
KNVEE

SEQ ID NO: 2875008 - protein, 8 aa, Entamoeba invadens
KNVEETKE

SEQ ID NO: 2875009 - protein, 5 aa, Entamoeba invadens
KNVEK

SEQ ID NO: 2875010 - protein, 10 aa, Entamoeba invadens
KNVENKEKLL

SEQ ID NO: 2875011 - protein, 20 aa, Entamoeba invadens
KNVESIAKNQKTDPNPESLA

SEQ ID NO: 2875012 - protein, 7 aa, Entamoeba invadens
KNVETTL

SEQ ID NO: 2875013 - protein, 5 aa, Entamoeba invadens
KNVGE

SEQ ID NO: 2875014 - protein, 6 aa, Entamoeba invadens
KNVGKT

SEQ ID NO: 2875015 - protein, 8 aa, Entamoeba invadens
KNVGPASI

SEQ ID NO: 2875016 - protein, 5 aa, Entamoeba invadens
KNVHL

SEQ ID NO: 2875017 - protein, 46 aa, Entamoeba invadens
KNVHTTTNTPRDVPQSVSSAHVSTDSTSQSTCSTSTLGTKSENDKK

SEQ ID NO: 2875018 - protein, 4 aa, Entamoeba invadens
KNVK

SEQ ID NO: 2875019 - protein, 7 aa, Entamoeba invadens
KNVKKTI

SEQ ID NO: 2875020 - protein, 13 aa, Entamoeba invadens
KNVKNDTSLQNEE

SEQ ID NO: 2875021 - protein, 7 aa, Entamoeba invadens
KNVKQSV

SEQ ID NO: 2875022 - protein, 9 aa, Entamoeba invadens
KNVKTKKIG

SEQ ID NO: 2875023 - protein, 25 aa, Entamoeba invadens
KNVNEKQKEELEKMRKEKETTSNQH

SEQ ID NO: 2875024 - protein, 7 aa, Entamoeba invadens
KNVPETD

SEQ ID NO: 2875025 - protein, 36 aa, Entamoeba invadens
KNVPKWKNERNPIRKRRNATKPRKDDRRGVIAKLTG

SEQ ID NO: 2875026 - protein, 10 aa, Entamoeba invadens
KNVPTEPESR

SEQ ID NO: 2875027 - protein, 5 aa, Entamoeba invadens
KNVQS

SEQ ID NO: 2875028 - protein, 4 aa, Entamoeba invadens
KNVR

SEQ ID NO: 2875029 - protein, 4 aa, Entamoeba invadens
KNVS

SEQ ID NO: 2875030 - protein, 6 aa, Entamoeba invadens
KNVSSM

SEQ ID NO: 2875031 - protein, 6 aa, Entamoeba invadens
KNVSSV

SEQ ID NO: 2875032 - protein, 6 aa, Entamoeba invadens
KNVSTI

SEQ ID NO: 2875033 - protein, 5 aa, Entamoeba invadens
KNVTA

SEQ ID NO: 2875034 - protein, 14 aa, Entamoeba invadens
KNVTDNDPEVRTSA

SEQ ID NO: 2875035 - protein, 5 aa, Entamoeba invadens
KNVTE

SEQ ID NO: 2875036 - protein, 14 aa, Entamoeba invadens
KNVTEHGERVKDPN

SEQ ID NO: 2875037 - protein, 7 aa, Entamoeba invadens
KNVTGKE

SEQ ID NO: 2875038 - protein, 10 aa, Entamoeba invadens
KNVTKNNKKH

SEQ ID NO: 2875039 - protein, 7 aa, Entamoeba invadens
KNVTNQK

SEQ ID NO: 2875040 - protein, 5 aa, Entamoeba invadens
KNVTS

SEQ ID NO: 2875041 - protein, 17 aa, Entamoeba invadens
KNVTTTVRGRNLNTTQP

SEQ ID NO: 2875042 - protein, 4 aa, Entamoeba invadens
KNVV

SEQ ID NO: 2875043 - protein, 8 aa, Entamoeba invadens
KNWERTDE

SEQ ID NO: 2875044 - protein, 4 aa, Entamoeba invadens
KNWR

SEQ ID NO: 2875045 - protein, 9 aa, Entamoeba invadens
KNYATPPMT

SEQ ID NO: 2875046 - protein, 11 aa, Entamoeba invadens
KNYDGKTDAAG

SEQ ID NO: 2875047 - protein, 7 aa, Entamoeba invadens
KNYDRRG

SEQ ID NO: 2875048 - protein, 7 aa, Entamoeba invadens
KNYEESC

SEQ ID NO: 2875049 - protein, 6 aa, Entamoeba invadens
KNYGQS

SEQ ID NO: 2875050 - protein, 4 aa, Entamoeba invadens
KNYH

SEQ ID NO: 2875051 - protein, 27 aa, Entamoeba invadens
KNYKVPKKKKVTTPTKAYSPVPVAPNT

SEQ ID NO: 2875052 - protein, 11 aa, Entamoeba invadens
KNYNEEKRRCN

SEQ ID NO: 2875053 - protein, 4 aa, Entamoeba invadens
KNYP

SEQ ID NO: 2875054 - protein, 27 aa, Entamoeba invadens
KNYQSNFQKTESQDDMNSSRTWTEKTT

SEQ ID NO: 2875055 - protein, 5 aa, Entamoeba invadens
KNYSD

SEQ ID NO: 2875056 - protein, 6 aa, Entamoeba invadens
KNYSEP

SEQ ID NO: 2875057 - protein, 33 aa, Entamoeba invadens
KNYSKERKHEEKREGQNYGSGRKMRGRARLNLG

SEQ ID NO: 2875058 - protein, 5 aa, Entamoeba invadens
KNYTT

SEQ ID NO: 2875059 - protein, 10 aa, Entamoeba invadens
KNYTTPRGEF

SEQ ID NO: 2875060 - protein, 6 aa, Entamoeba invadens
KNYTVK

SEQ ID NO: 2875061 - protein, 4 aa, Entamoeba invadens
KNYY

SEQ ID NO: 2875062 - protein, 5 aa, Entamoeba invadens
KPADL

SEQ ID NO: 2875063 - protein, 5 aa, Entamoeba invadens
KPADT

SEQ ID NO: 2875064 - protein, 5 aa, Entamoeba invadens
KPADV

SEQ ID NO: 2875065 - protein, 7 aa, Entamoeba invadens
KPAEKPG

SEQ ID NO: 2875066 - protein, 9 aa, Entamoeba invadens
KPAFSRYGS

SEQ ID NO: 2875067 - protein, 14 aa, Entamoeba invadens
KPAGAAENKPTEAV

SEQ ID NO: 2875068 - protein, 8 aa, Entamoeba invadens
KPAHVKKD

SEQ ID NO: 2875069 - protein, 8 aa, Entamoeba invadens
KPAKKSKV

SEQ ID NO: 2875070 - protein, 4 aa, Entamoeba invadens
KPAL

SEQ ID NO: 2875071 - protein, 8 aa, Entamoeba invadens
KPANPSSH

SEQ ID NO: 2875072 - protein, 7 aa, Entamoeba invadens
KPAPSQV

SEQ ID NO: 2875073 - protein, 7 aa, Entamoeba invadens
KPAQNQI

SEQ ID NO: 2875074 - protein, 35 aa, Entamoeba invadens
KPASTTAPTTTTGNDATTTTPQTPATTTSTTTAAI

SEQ ID NO: 2875075 - protein, 5 aa, Entamoeba invadens
KPATR

SEQ ID NO: 2875076 - protein, 6 aa, Entamoeba invadens
KPAVAK

SEQ ID NO: 2875077 - protein, 5 aa, Entamoeba invadens
KPAVP

SEQ ID NO: 2875078 - protein, 6 aa, Entamoeba invadens
KPAVPY

SEQ ID NO: 2875079 - protein, 4 aa, Entamoeba invadens
KPCK

SEQ ID NO: 2875080 - protein, 6 aa, Entamoeba invadens
KPCRKE

SEQ ID NO: 2875081 - protein, 12 aa, Entamoeba invadens
KPCTPKPQYTGD

SEQ ID NO: 2875082 - protein, 4 aa, Entamoeba invadens
KPCV

SEQ ID NO: 2875083 - protein, 7 aa, Entamoeba invadens
KPDASSL

SEQ ID NO: 2875084 - protein, 4 aa, Entamoeba invadens
KPDD

SEQ ID NO: 2875085 - protein, 28 aa, Entamoeba invadens
KPDDDRRPKRNRSNTPTPAQYPITITHN

SEQ ID NO: 2875086 - protein, 6 aa, Entamoeba invadens
KPDELP

SEQ ID NO: 2875087 - protein, 13 aa, Entamoeba invadens
KPDEVKQTQRSTV

SEQ ID NO: 2875088 - protein, 4 aa, Entamoeba invadens
KPDG

SEQ ID NO: 2875089 - protein, 6 aa, Entamoeba invadens
KPDGVG

SEQ ID NO: 2875090 - protein, 5 aa, Entamoeba invadens
KPDGY

SEQ ID NO: 2875091 - protein, 6 aa, Entamoeba invadens
KPDLQT

SEQ ID NO: 2875092 - protein, 13 aa, Entamoeba invadens
KPDNSDGISSTSI

SEQ ID NO: 2875093 - protein, 6 aa, Entamoeba invadens
KPDNVK

SEQ ID NO: 2875094 - protein, 5 aa, Entamoeba invadens
KPDQF

SEQ ID NO: 2875095 - protein, 11 aa, Entamoeba invadens
KPDSKSENPLV

SEQ ID NO: 2875096 - protein, 9 aa, Entamoeba invadens
KPDSQRQKY

SEQ ID NO: 2875097 - protein, 11 aa, Entamoeba invadens
KPDSRIKRDEF

SEQ ID NO: 2875098 - protein, 9 aa, Entamoeba invadens
KPDSSRSAS

SEQ ID NO: 2875099 - protein, 13 aa, Entamoeba invadens
KPDTKLKDNNGRN

SEQ ID NO: 2875100 - protein, 7 aa, Entamoeba invadens
KPDTQKL

SEQ ID NO: 2875101 - protein, 9 aa, Entamoeba invadens
KPDYSNYDM

SEQ ID NO: 2875102 - protein, 52 aa, Entamoeba invadens
KPEAKKESGGKVRATTKKEEKVVKRKRSKTAVKKRKTGKGSLEGDGSAVVDE

SEQ ID NO: 2875103 - protein, 9 aa, Entamoeba invadens
KPEARPSIE

SEQ ID NO: 2875104 - protein, 20 aa, Entamoeba invadens
KPEASQETIQQPSEQQKDEM

SEQ ID NO: 2875105 - protein, 5 aa, Entamoeba invadens
KPECS

SEQ ID NO: 2875106 - protein, 9 aa, Entamoeba invadens
KPEDAATDC

SEQ ID NO: 2875107 - protein, 20 aa, Entamoeba invadens
KPEDAESPEKSITSPETQEK

SEQ ID NO: 2875108 - protein, 9 aa, Entamoeba invadens
KPEDDAHEL

SEQ ID NO: 2875109 - protein, 14 aa, Entamoeba invadens
KPEDDTTNDPNEMY

SEQ ID NO: 2875110 - protein, 9 aa, Entamoeba invadens
KPEDLSKDD

SEQ ID NO: 2875111 - protein, 6 aa, Entamoeba invadens
KPEDSC

SEQ ID NO: 2875112 - protein, 13 aa, Entamoeba invadens
KPEEDKNVKERVE

SEQ ID NO: 2875113 - protein, 7 aa, Entamoeba invadens
KPEEHDT

SEQ ID NO: 2875114 - protein, 7 aa, Entamoeba invadens
KPEEKYE

SEQ ID NO: 2875115 - protein, 20 aa, Entamoeba invadens
KPEESSGQTKQLPDQSKLST

SEQ ID NO: 2875116 - protein, 11 aa, Entamoeba invadens
KPEGYDEAQEK

SEQ ID NO: 2875117 - protein, 7 aa, Entamoeba invadens
KPEIGVP

SEQ ID NO: 2875118 - protein, 6 aa, Entamoeba invadens
KPEITK

SEQ ID NO: 2875119 - protein, 22 aa, Entamoeba invadens
KPEKAEKAVPEKKVVDNSKDSF

SEQ ID NO: 2875120 - protein, 8 aa, Entamoeba invadens
KPEKARQV

SEQ ID NO: 2875121 - protein, 21 aa, Entamoeba invadens
KPEKEKNASVDEKPKVGNKGR

SEQ ID NO: 2875122 - protein, 16 aa, Entamoeba invadens
KPEKGTIGPKGKKKIK

SEQ ID NO: 2875123 - protein, 5 aa, Entamoeba invadens
KPELA

SEQ ID NO: 2875124 - protein, 5 aa, Entamoeba invadens
KPELI

SEQ ID NO: 2875125 - protein, 5 aa, Entamoeba invadens
KPELK

SEQ ID NO: 2875126 - protein, 5 aa, Entamoeba invadens
KPELQ

SEQ ID NO: 2875127 - protein, 4 aa, Entamoeba invadens
KPEN

SEQ ID NO: 2875128 - protein, 9 aa, Entamoeba invadens
KPENDSETL

SEQ ID NO: 2875129 - protein, 7 aa, Entamoeba invadens
KPENEFR

SEQ ID NO: 2875130 - protein, 6 aa, Entamoeba invadens
KPENFE

SEQ ID NO: 2875131 - protein, 7 aa, Entamoeba invadens
KPENGKS

SEQ ID NO: 2875132 - protein, 6 aa, Entamoeba invadens
KPENHD

SEQ ID NO: 2875133 - protein, 5 aa, Entamoeba invadens
KPENI

SEQ ID NO: 2875134 - protein, 11 aa, Entamoeba invadens
KPENITQIESS

SEQ ID NO: 2875135 - protein, 17 aa, Entamoeba invadens
KPENKKQDQIVINNIIN

SEQ ID NO: 2875136 - protein, 8 aa, Entamoeba invadens
KPENRPTA

SEQ ID NO: 2875137 - protein, 5 aa, Entamoeba invadens
KPENS

SEQ ID NO: 2875138 - protein, 7 aa, Entamoeba invadens
KPENTRH

SEQ ID NO: 2875139 - protein, 6 aa, Entamoeba invadens
KPENYC

SEQ ID NO: 2875140 - protein, 9 aa, Entamoeba invadens
KPEPSLGAQ

SEQ ID NO: 2875141 - protein, 5 aa, Entamoeba invadens
KPEQM

SEQ ID NO: 2875142 - protein, 6 aa, Entamoeba invadens
KPERRF

SEQ ID NO: 2875143 - protein, 4 aa, Entamoeba invadens
KPES

SEQ ID NO: 2875144 - protein, 10 aa, Entamoeba invadens
KPESDYSNPF

SEQ ID NO: 2875145 - protein, 9 aa, Entamoeba invadens
KPESEGESV

SEQ ID NO: 2875146 - protein, 7 aa, Entamoeba invadens
KPESTDM

SEQ ID NO: 2875147 - protein, 4 aa, Entamoeba invadens
KPET

SEQ ID NO: 2875148 - protein, 6 aa, Entamoeba invadens
KPETGK

SEQ ID NO: 2875149 - protein, 8 aa, Entamoeba invadens
KPETNEET

SEQ ID NO: 2875150 - protein, 5 aa, Entamoeba invadens
KPETQ

SEQ ID NO: 2875151 - protein, 4 aa, Entamoeba invadens
KPEV

SEQ ID NO: 2875152 - protein, 12 aa, Entamoeba invadens
KPEVDTQDEPKL

SEQ ID NO: 2875153 - protein, 17 aa, Entamoeba invadens
KPEVTPTVTPRPNRQEM

SEQ ID NO: 2875154 - protein, 6 aa, Entamoeba invadens
KPEYQT

SEQ ID NO: 2875155 - protein, 8 aa, Entamoeba invadens
KPEYQTEG

SEQ ID NO: 2875156 - protein, 7 aa, Entamoeba invadens
KPEYRKK

SEQ ID NO: 2875157 - protein, 6 aa, Entamoeba invadens
KPFANG

SEQ ID NO: 2875158 - protein, 6 aa, Entamoeba invadens
KPFAPS

SEQ ID NO: 2875159 - protein, 4 aa, Entamoeba invadens
KPFD

SEQ ID NO: 2875160 - protein, 6 aa, Entamoeba invadens
KPFDEF

SEQ ID NO: 2875161 - protein, 6 aa, Entamoeba invadens
KPFEPM

SEQ ID NO: 2875162 - protein, 25 aa, Entamoeba invadens
KPFETSKPLPATPNVNQNEEKDSFV

SEQ ID NO: 2875163 - protein, 6 aa, Entamoeba invadens
KPFFKG

SEQ ID NO: 2875164 - protein, 4 aa, Entamoeba invadens
KPFG

SEQ ID NO: 2875165 - protein, 6 aa, Entamoeba invadens
KPFKST

SEQ ID NO: 2875166 - protein, 22 aa, Entamoeba invadens
KPFNKKKGGFQYKTADNSMTVS

SEQ ID NO: 2875167 - protein, 5 aa, Entamoeba invadens
KPFNV

SEQ ID NO: 2875168 - protein, 6 aa, Entamoeba invadens
KPFPPP

SEQ ID NO: 2875169 - protein, 4 aa, Entamoeba invadens
KPFQ

SEQ ID NO: 2875170 - protein, 4 aa, Entamoeba invadens
KPFS

SEQ ID NO: 2875171 - protein, 15 aa, Entamoeba invadens
KPFTHKRRSKDETPR

SEQ ID NO: 2875172 - protein, 8 aa, Entamoeba invadens
KPFTPKSY

SEQ ID NO: 2875173 - protein, 5 aa, Entamoeba invadens
KPFTT

SEQ ID NO: 2875174 - protein, 6 aa, Entamoeba invadens
KPFVES

SEQ ID NO: 2875175 - protein, 4 aa, Entamoeba invadens
KPGA

SEQ ID NO: 2875176 - protein, 9 aa, Entamoeba invadens
KPGDLSDTV

SEQ ID NO: 2875177 - protein, 8 aa, Entamoeba invadens
KPGENLPP

SEQ ID NO: 2875178 - protein, 7 aa, Entamoeba invadens
KPGEVGA

SEQ ID NO: 2875179 - protein, 4 aa, Entamoeba invadens
KPGF

SEQ ID NO: 2875180 - protein, 8 aa, Entamoeba invadens
KPGIQAET

SEQ ID NO: 2875181 - protein, 19 aa, Entamoeba invadens
KPGKNWGPGCKKKKTLTNK

SEQ ID NO: 2875182 - protein, 8 aa, Entamoeba invadens
KPGKPGFS

SEQ ID NO: 2875183 - protein, 6 aa, Entamoeba invadens
KPGMEP

SEQ ID NO: 2875184 - protein, 7 aa, Entamoeba invadens
KPGNKGV

SEQ ID NO: 2875185 - protein, 13 aa, Entamoeba invadens
KPGNTKPVVTATE

SEQ ID NO: 2875186 - protein, 9 aa, Entamoeba invadens
KPGQHDENS

SEQ ID NO: 2875187 - protein, 15 aa, Entamoeba invadens
KPGRFSSGASQTVGK

SEQ ID NO: 2875188 - protein, 5 aa, Entamoeba invadens
KPGSE

SEQ ID NO: 2875189 - protein, 7 aa, Entamoeba invadens
KPGTQYN

SEQ ID NO: 2875190 - protein, 9 aa, Entamoeba invadens
KPHDMKPPE

SEQ ID NO: 2875191 - protein, 6 aa, Entamoeba invadens
KPHGGK

SEQ ID NO: 2875192 - protein, 20 aa, Entamoeba invadens
KPHHPEPHTRQKPPAQQQNA

SEQ ID NO: 2875193 - protein, 8 aa, Entamoeba invadens
KPHISSQT

SEQ ID NO: 2875194 - protein, 9 aa, Entamoeba invadens
KPHKKSTVS

SEQ ID NO: 2875195 - protein, 6 aa, Entamoeba invadens
KPHKSG

SEQ ID NO: 2875196 - protein, 7 aa, Entamoeba invadens
KPHLDES

SEQ ID NO: 2875197 - protein, 12 aa, Entamoeba invadens
KPHLSNETIDDA

SEQ ID NO: 2875198 - protein, 4 aa, Entamoeba invadens
KPHQ

SEQ ID NO: 2875199 - protein, 6 aa, Entamoeba invadens
KPHTKE

SEQ ID NO: 2875200 - protein, 22 aa, Entamoeba invadens
KPHTTKPVTKVEPSLEETKLEE

SEQ ID NO: 2875201 - protein, 6 aa, Entamoeba invadens
KPHVTQ

SEQ ID NO: 2875202 - protein, 7 aa, Entamoeba invadens
KPIDEKD

SEQ ID NO: 2875203 - protein, 8 aa, Entamoeba invadens
KPIDGANN

SEQ ID NO: 2875204 - protein, 5 aa, Entamoeba invadens
KPIDV

SEQ ID NO: 2875205 - protein, 8 aa, Entamoeba invadens
KPIEETDV

SEQ ID NO: 2875206 - protein, 12 aa, Entamoeba invadens
KPIEKEKDGTYD

SEQ ID NO: 2875207 - protein, 16 aa, Entamoeba invadens
KPIEKKKEEKTPEDLS

SEQ ID NO: 2875208 - protein, 14 aa, Entamoeba invadens
KPIEQKKKEEKPLK

SEQ ID NO: 2875209 - protein, 23 aa, Entamoeba invadens
KPIEQNKTSVTSKPQTDSISASV

SEQ ID NO: 2875210 - protein, 21 aa, Entamoeba invadens
KPIERSEETKDSSEDDEKYKG

SEQ ID NO: 2875211 - protein, 9 aa, Entamoeba invadens
KPIFSHNNG

SEQ ID NO: 2875212 - protein, 4 aa, Entamoeba invadens
KPIG

SEQ ID NO: 2875213 - protein, 89 aa, Entamoeba invadens
KPIGAREEKEKSEKVEEKNERKENKERSKQVSFKAKKGKTEESEKENQKDMTNQMSEEKMHRKEEEDTRLSKKNEIKENEISPKQVSEV

SEQ ID NO: 2875214 - protein, 12 aa, Entamoeba invadens
KPIGKEKDGNYD

SEQ ID NO: 2875215 - protein, 12 aa, Entamoeba invadens
KPIGKEKEGTYD

SEQ ID NO: 2875216 - protein, 12 aa, Entamoeba invadens
KPIGNSAEGITD

SEQ ID NO: 2875217 - protein, 10 aa, Entamoeba invadens
KPIKAATLQN

SEQ ID NO: 2875218 - protein, 13 aa, Entamoeba invadens
KPIKDAKKNEVNE

SEQ ID NO: 2875219 - protein, 9 aa, Entamoeba invadens
KPIKDVEVK

SEQ ID NO: 2875220 - protein, 6 aa, Entamoeba invadens
KPIKRS

SEQ ID NO: 2875221 - protein, 48 aa, Entamoeba invadens
KPIKSTSKADSHRKPKTLREKNPTKEQKIKKASKPKKEDDTQTTVSKR

SEQ ID NO: 2875222 - protein, 15 aa, Entamoeba invadens
KPIPKSNKEVENEDN

SEQ ID NO: 2875223 - protein, 15 aa, Entamoeba invadens
KPIPSDRGMQSVSPH

SEQ ID NO: 2875224 - protein, 5 aa, Entamoeba invadens
KPIQL

SEQ ID NO: 2875225 - protein, 4 aa, Entamoeba invadens
KPIS

SEQ ID NO: 2875226 - protein, 5 aa, Entamoeba invadens
KPISE

SEQ ID NO: 2875227 - protein, 9 aa, Entamoeba invadens
KPISPNVKT

SEQ ID NO: 2875228 - protein, 4 aa, Entamoeba invadens
KPIY

SEQ ID NO: 2875229 - protein, 6 aa, Entamoeba invadens
KPIYKT

SEQ ID NO: 2875230 - protein, 8 aa, Entamoeba invadens
KPKASRRR

SEQ ID NO: 2875231 - protein, 10 aa, Entamoeba invadens
KPKDDAEEVK

SEQ ID NO: 2875232 - protein, 15 aa, Entamoeba invadens
KPKDENKNTQKKSLS

SEQ ID NO: 2875233 - protein, 5 aa, Entamoeba invadens
KPKEA

SEQ ID NO: 2875234 - protein, 5 aa, Entamoeba invadens
KPKEH

SEQ ID NO: 2875235 - protein, 11 aa, Entamoeba invadens
KPKEKSRDGLK

SEQ ID NO: 2875236 - protein, 20 aa, Entamoeba invadens
KPKEQDSRDKIDTTSQNGNC

SEQ ID NO: 2875237 - protein, 16 aa, Entamoeba invadens
KPKESQRKSNSSKAPV

SEQ ID NO: 2875238 - protein, 63 aa, Entamoeba invadens
KPKGATKRGPKRKGSVTYENEEEGKNTIQTEEHKMEEKDSDIEHSENEKDNKLDVEQSVGQAT

SEQ ID NO: 2875239 - protein, 10 aa, Entamoeba invadens
KPKGSESFSI

SEQ ID NO: 2875240 - protein, 5 aa, Entamoeba invadens
KPKGV

SEQ ID NO: 2875241 - protein, 8 aa, Entamoeba invadens
KPKIAKKS

SEQ ID NO: 2875242 - protein, 19 aa, Entamoeba invadens
KPKIDGNEQQKENKNDNSI

SEQ ID NO: 2875243 - protein, 8 aa, Entamoeba invadens
KPKIEPSG

SEQ ID NO: 2875244 - protein, 7 aa, Entamoeba invadens
KPKISTE

SEQ ID NO: 2875245 - protein, 17 aa, Entamoeba invadens
KPKKFHGESVKKQDGDM

SEQ ID NO: 2875246 - protein, 18 aa, Entamoeba invadens
KPKKLKRLSEVKRKTEIK

SEQ ID NO: 2875247 - protein, 11 aa, Entamoeba invadens
KPKKLSGKVEA

SEQ ID NO: 2875248 - protein, 12 aa, Entamoeba invadens
KPKKSFKSDEKI

SEQ ID NO: 2875249 - protein, 11 aa, Entamoeba invadens
KPKKSRDDGVE

SEQ ID NO: 2875250 - protein, 16 aa, Entamoeba invadens
KPKKTEKRKRASEDAF

SEQ ID NO: 2875251 - protein, 7 aa, Entamoeba invadens
KPKLDAQ

SEQ ID NO: 2875252 - protein, 6 aa, Entamoeba invadens
KPKNII

SEQ ID NO: 2875253 - protein, 5 aa, Entamoeba invadens
KPKNK

SEQ ID NO: 2875254 - protein, 8 aa, Entamoeba invadens
KPKNLTSQ

SEQ ID NO: 2875255 - protein, 53 aa, Entamoeba invadens
KPKNNLKLSSSQTSEEELYSENDSKKSTESSSSPPEDKNDKKEKKKSEKLSTH

SEQ ID NO: 2875256 - protein, 8 aa, Entamoeba invadens
KPKNRNKT

SEQ ID NO: 2875257 - protein, 9 aa, Entamoeba invadens
KPKNSDGFE

SEQ ID NO: 2875258 - protein, 6 aa, Entamoeba invadens
KPKPKY

SEQ ID NO: 2875259 - protein, 14 aa, Entamoeba invadens
KPKPSILQSPAVNR

SEQ ID NO: 2875260 - protein, 8 aa, Entamoeba invadens
KPKPSLKD

SEQ ID NO: 2875261 - protein, 10 aa, Entamoeba invadens
KPKQQPPQLG

SEQ ID NO: 2875262 - protein, 12 aa, Entamoeba invadens
KPKQQPPQPGQI

SEQ ID NO: 2875263 - protein, 7 aa, Entamoeba invadens
KPKQTDI

SEQ ID NO: 2875264 - protein, 8 aa, Entamoeba invadens
KPKRDDVK

SEQ ID NO: 2875265 - protein, 10 aa, Entamoeba invadens
KPKRRIPPEE

SEQ ID NO: 2875266 - protein, 7 aa, Entamoeba invadens
KPKRTSK

SEQ ID NO: 2875267 - protein, 11 aa, Entamoeba invadens
KPKSDDDDTAE

SEQ ID NO: 2875268 - protein, 8 aa, Entamoeba invadens
KPKSEKMG

SEQ ID NO: 2875269 - protein, 16 aa, Entamoeba invadens
KPKSFQKSTQKQKQLA

SEQ ID NO: 2875270 - protein, 5 aa, Entamoeba invadens
KPKSL

SEQ ID NO: 2875271 - protein, 19 aa, Entamoeba invadens
KPKSLAEMTENQPKSEPLR

SEQ ID NO: 2875272 - protein, 10 aa, Entamoeba invadens
KPKSNSFSKM

SEQ ID NO: 2875273 - protein, 6 aa, Entamoeba invadens
KPKSVS

SEQ ID NO: 2875274 - protein, 4 aa, Entamoeba invadens
KPKT

SEQ ID NO: 2875275 - protein, 8 aa, Entamoeba invadens
KPKTAEQV

SEQ ID NO: 2875276 - protein, 11 aa, Entamoeba invadens
KPKTIEPEEEE

SEQ ID NO: 2875277 - protein, 12 aa, Entamoeba invadens
KPKTIGIPGENL

SEQ ID NO: 2875278 - protein, 29 aa, Entamoeba invadens
KPKTLPQKYSYTSDEVTISSPYKLSTPKI

SEQ ID NO: 2875279 - protein, 15 aa, Entamoeba invadens
KPKVKKNAKQALSNV

SEQ ID NO: 2875280 - protein, 16 aa, Entamoeba invadens
KPKVTSKSQILNTPPS

SEQ ID NO: 2875281 - protein, 7 aa, Entamoeba invadens
KPKYSKY

SEQ ID NO: 2875282 - protein, 5 aa, Entamoeba invadens
KPLAE

SEQ ID NO: 2875283 - protein, 7 aa, Entamoeba invadens
KPLAPSY

SEQ ID NO: 2875284 - protein, 14 aa, Entamoeba invadens
KPLFSSKDKFDSGC

SEQ ID NO: 2875285 - protein, 4 aa, Entamoeba invadens
KPLG

SEQ ID NO: 2875286 - protein, 8 aa, Entamoeba invadens
KPLGNGKF

SEQ ID NO: 2875287 - protein, 4 aa, Entamoeba invadens
KPLH

SEQ ID NO: 2875288 - protein, 118 aa, Entamoeba invadens
KPLHDEEKETVKDSTPVGQDETLKEPIEQDKVPTKTESSESTPKATNKSIETNKMEEDEENSAEEVEKETTQKDDQEEQYTSEEYDSPKPKKSTKKSKKAVKRKAHKKDDEDEYDDEG

SEQ ID NO: 2875289 - protein, 15 aa, Entamoeba invadens
KPLKDNKVKMKEDEA

SEQ ID NO: 2875290 - protein, 14 aa, Entamoeba invadens
KPLNRSGMDSNPSV

SEQ ID NO: 2875291 - protein, 5 aa, Entamoeba invadens
KPLPG

SEQ ID NO: 2875292 - protein, 16 aa, Entamoeba invadens
KPLPKAPKKGYKYVKD

SEQ ID NO: 2875293 - protein, 32 aa, Entamoeba invadens
KPLPKPKPIEDAPEGGVKRKKPISKKDHAQHV

SEQ ID NO: 2875294 - protein, 18 aa, Entamoeba invadens
KPLPPLPNKQKTSDTLQP

SEQ ID NO: 2875295 - protein, 31 aa, Entamoeba invadens
KPLPQPEEEEAEVEEQKVAPAEIKPQPIELE

SEQ ID NO: 2875296 - protein, 8 aa, Entamoeba invadens
KPLPSGQG

SEQ ID NO: 2875297 - protein, 40 aa, Entamoeba invadens
KPLPTPPKGKDPRKKPLPPSPVVKKGKELGKITDVSEKLN

SEQ ID NO: 2875298 - protein, 6 aa, Entamoeba invadens
KPLPTS

SEQ ID NO: 2875299 - protein, 14 aa, Entamoeba invadens
KPLQTTNQPTPKKI

SEQ ID NO: 2875300 - protein, 6 aa, Entamoeba invadens
KPLSDK

SEQ ID NO: 2875301 - protein, 8 aa, Entamoeba invadens
KPLSEQQA

SEQ ID NO: 2875302 - protein, 5 aa, Entamoeba invadens
KPLSK

SEQ ID NO: 2875303 - protein, 5 aa, Entamoeba invadens
KPLSQ

SEQ ID NO: 2875304 - protein, 9 aa, Entamoeba invadens
KPLSRDFDE

SEQ ID NO: 2875305 - protein, 5 aa, Entamoeba invadens
KPLTT

SEQ ID NO: 2875306 - protein, 5 aa, Entamoeba invadens
KPLVK

SEQ ID NO: 2875307 - protein, 5 aa, Entamoeba invadens
KPLWT

SEQ ID NO: 2875308 - protein, 5 aa, Entamoeba invadens
KPMAP

SEQ ID NO: 2875309 - protein, 15 aa, Entamoeba invadens
KPMGALTPERAENTI

SEQ ID NO: 2875310 - protein, 9 aa, Entamoeba invadens
KPMGRGRAE

SEQ ID NO: 2875311 - protein, 30 aa, Entamoeba invadens
  misc_feature (16)..(17): Xaa can be any naturally occurring amino acid
KPMGRGRAETCLRWGXXSTTDYEQKVEETL

SEQ ID NO: 2875312 - protein, 35 aa, Entamoeba invadens
KPMKTENDEIKENKKNLANDKDQLSSEKKKLQDEY

SEQ ID NO: 2875313 - protein, 5 aa, Entamoeba invadens
KPMKV

SEQ ID NO: 2875314 - protein, 10 aa, Entamoeba invadens
KPMNEETYQE

SEQ ID NO: 2875315 - protein, 6 aa, Entamoeba invadens
KPMNEK

SEQ ID NO: 2875316 - protein, 23 aa, Entamoeba invadens
KPMNPEYEKGRKRLEDKEREFEE

SEQ ID NO: 2875317 - protein, 12 aa, Entamoeba invadens
KPMPKPKESNYR

SEQ ID NO: 2875318 - protein, 16 aa, Entamoeba invadens
KPMQRDLSLDGRRSDL

SEQ ID NO: 2875319 - protein, 11 aa, Entamoeba invadens
KPMSNENEKSS

SEQ ID NO: 2875320 - protein, 4 aa, Entamoeba invadens
KPMT

SEQ ID NO: 2875321 - protein, 31 aa, Entamoeba invadens
KPMTQSTPINQTQNTPQKASITPQPKSASKY

SEQ ID NO: 2875322 - protein, 5 aa, Entamoeba invadens
KPNAN

SEQ ID NO: 2875323 - protein, 8 aa, Entamoeba invadens
KPNAQNKL

SEQ ID NO: 2875324 - protein, 6 aa, Entamoeba invadens
KPNARE

SEQ ID NO: 2875325 - protein, 7 aa, Entamoeba invadens
KPNDAKL

SEQ ID NO: 2875326 - protein, 6 aa, Entamoeba invadens
KPNDKE

SEQ ID NO: 2875327 - protein, 6 aa, Entamoeba invadens
KPNDKI

SEQ ID NO: 2875328 - protein, 4 aa, Entamoeba invadens
KPNE

SEQ ID NO: 2875329 - protein, 6 aa, Entamoeba invadens
KPNEEE

SEQ ID NO: 2875330 - protein, 5 aa, Entamoeba invadens
KPNEF

SEQ ID NO: 2875331 - protein, 8 aa, Entamoeba invadens
KPNEKTWE

SEQ ID NO: 2875332 - protein, 5 aa, Entamoeba invadens
KPNEQ

SEQ ID NO: 2875333 - protein, 5 aa, Entamoeba invadens
KPNEV

SEQ ID NO: 2875334 - protein, 5 aa, Entamoeba invadens
KPNFT

SEQ ID NO: 2875335 - protein, 7 aa, Entamoeba invadens
KPNGEPC

SEQ ID NO: 2875336 - protein, 9 aa, Entamoeba invadens
KPNGNRKRI

SEQ ID NO: 2875337 - protein, 7 aa, Entamoeba invadens
KPNIEGD

SEQ ID NO: 2875338 - protein, 21 aa, Entamoeba invadens
KPNKDELPPITSLSTKPTAHR

SEQ ID NO: 2875339 - protein, 6 aa, Entamoeba invadens
KPNKEE

SEQ ID NO: 2875340 - protein, 11 aa, Entamoeba invadens
KPNKNKDYGNK

SEQ ID NO: 2875341 - protein, 13 aa, Entamoeba invadens
KPNLGDFKNPPDW

SEQ ID NO: 2875342 - protein, 4 aa, Entamoeba invadens
KPNN

SEQ ID NO: 2875343 - protein, 6 aa, Entamoeba invadens
KPNNDV

SEQ ID NO: 2875344 - protein, 25 aa, Entamoeba invadens
KPNNGKSSCVETENCEEYDGSGNCE

SEQ ID NO: 2875345 - protein, 6 aa, Entamoeba invadens
KPNNIA

SEQ ID NO: 2875346 - protein, 9 aa, Entamoeba invadens
KPNNKPFPP

SEQ ID NO: 2875347 - protein, 7 aa, Entamoeba invadens
KPNNPEA

SEQ ID NO: 2875348 - protein, 7 aa, Entamoeba invadens
KPNNVPL

SEQ ID NO: 2875349 - protein, 17 aa, Entamoeba invadens
KPNPPEEKKKEERKKTN

SEQ ID NO: 2875350 - protein, 15 aa, Entamoeba invadens
KPNQDESQIFSNDKD

SEQ ID NO: 2875351 - protein, 15 aa, Entamoeba invadens
KPNRNSPVKTSSAIS

SEQ ID NO: 2875352 - protein, 8 aa, Entamoeba invadens
KPNSEIQE

SEQ ID NO: 2875353 - protein, 5 aa, Entamoeba invadens
KPNSL

SEQ ID NO: 2875354 - protein, 6 aa, Entamoeba invadens
KPNSQI

SEQ ID NO: 2875355 - protein, 12 aa, Entamoeba invadens
KPNSRNSEIQGI

SEQ ID NO: 2875356 - protein, 30 aa, Entamoeba invadens
KPNSSKRKRDEKSEKDENFNKEKQNEQEDL

SEQ ID NO: 2875357 - protein, 4 aa, Entamoeba invadens
KPNT

SEQ ID NO: 2875358 - protein, 5 aa, Entamoeba invadens
KPNTM

SEQ ID NO: 2875359 - protein, 9 aa, Entamoeba invadens
KPNVSKDKE

SEQ ID NO: 2875360 - protein, 4 aa, Entamoeba invadens
KPPA

SEQ ID NO: 2875361 - protein, 8 aa, Entamoeba invadens
KPPDPRLP

SEQ ID NO: 2875362 - protein, 6 aa, Entamoeba invadens
KPPELI

SEQ ID NO: 2875363 - protein, 4 aa, Entamoeba invadens
KPPF

SEQ ID NO: 2875364 - protein, 7 aa, Entamoeba invadens
KPPILDD

SEQ ID NO: 2875365 - protein, 7 aa, Entamoeba invadens
KPPKPVT

SEQ ID NO: 2875366 - protein, 20 aa, Entamoeba invadens
KPPLSPRPSTLGSPRPTTRP

SEQ ID NO: 2875367 - protein, 6 aa, Entamoeba invadens
KPPLSS

SEQ ID NO: 2875368 - protein, 6 aa, Entamoeba invadens
KPPMPS

SEQ ID NO: 2875369 - protein, 4 aa, Entamoeba invadens
KPPN

SEQ ID NO: 2875370 - protein, 19 aa, Entamoeba invadens
KPPPGTSDEVFEAARINTS

SEQ ID NO: 2875371 - protein, 7 aa, Entamoeba invadens
KPPPLKG

SEQ ID NO: 2875372 - protein, 7 aa, Entamoeba invadens
KPPPSLS

SEQ ID NO: 2875373 - protein, 8 aa, Entamoeba invadens
KPPPSNGI

SEQ ID NO: 2875374 - protein, 19 aa, Entamoeba invadens
KPPQCTSPRRNKRTPTPHK

SEQ ID NO: 2875375 - protein, 7 aa, Entamoeba invadens
KPPQRGM

SEQ ID NO: 2875376 - protein, 21 aa, Entamoeba invadens
KPPQSPLPQKLTTSKSIATTR

SEQ ID NO: 2875377 - protein, 17 aa, Entamoeba invadens
KPPQTSQTTTQTTPNTL

SEQ ID NO: 2875378 - protein, 9 aa, Entamoeba invadens
KPPTEEECE

SEQ ID NO: 2875379 - protein, 17 aa, Entamoeba invadens
KPPTPKTPLLRAELLQN

SEQ ID NO: 2875380 - protein, 19 aa, Entamoeba invadens
KPPTQETSDANKATTQTET

SEQ ID NO: 2875381 - protein, 19 aa, Entamoeba invadens
KPPTQETSDANRATTQTET

SEQ ID NO: 2875382 - protein, 22 aa, Entamoeba invadens
KPPTTCPQQVTQPQSTPQQQVE

SEQ ID NO: 2875383 - protein, 5 aa, Entamoeba invadens
KPPTV

SEQ ID NO: 2875384 - protein, 16 aa, Entamoeba invadens
KPQDDLAENNNLDNNN

SEQ ID NO: 2875385 - protein, 5 aa, Entamoeba invadens
KPQEA

SEQ ID NO: 2875386 - protein, 15 aa, Entamoeba invadens
KPQEKYDKSGNNEFD

SEQ ID NO: 2875387 - protein, 37 aa, Entamoeba invadens
KPQEPPQQQSQQAQPDKSPTLSLQTSSLNEQNELSAY

SEQ ID NO: 2875388 - protein, 5 aa, Entamoeba invadens
KPQGI

SEQ ID NO: 2875389 - protein, 11 aa, Entamoeba invadens
KPQHKKSRVPG

SEQ ID NO: 2875390 - protein, 11 aa, Entamoeba invadens
KPQIISQKQTE

SEQ ID NO: 2875391 - protein, 11 aa, Entamoeba invadens
KPQKKSTTAKQ

SEQ ID NO: 2875392 - protein, 9 aa, Entamoeba invadens
KPQKKTSIT

SEQ ID NO: 2875393 - protein, 6 aa, Entamoeba invadens
KPQLPP

SEQ ID NO: 2875394 - protein, 6 aa, Entamoeba invadens
KPQLRP

SEQ ID NO: 2875395 - protein, 9 aa, Entamoeba invadens
KPQNATSGC

SEQ ID NO: 2875396 - protein, 5 aa, Entamoeba invadens
KPQNI

SEQ ID NO: 2875397 - protein, 11 aa, Entamoeba invadens
KPQNPKVTELE

SEQ ID NO: 2875398 - protein, 9 aa, Entamoeba invadens
KPQPSKQEI

SEQ ID NO: 2875399 - protein, 6 aa, Entamoeba invadens
KPQPSV

SEQ ID NO: 2875400 - protein, 6 aa, Entamoeba invadens
KPQRDN

SEQ ID NO: 2875401 - protein, 5 aa, Entamoeba invadens
KPQRP

SEQ ID NO: 2875402 - protein, 12 aa, Entamoeba invadens
KPQSENKETIKV

SEQ ID NO: 2875403 - protein, 5 aa, Entamoeba invadens
KPQSL

SEQ ID NO: 2875404 - protein, 8 aa, Entamoeba invadens
KPQSREVV

SEQ ID NO: 2875405 - protein, 8 aa, Entamoeba invadens
KPQTNMQT

SEQ ID NO: 2875406 - protein, 29 aa, Entamoeba invadens
KPQTRITTSPSLWDNNSPNSGNLSPSIQK

SEQ ID NO: 2875407 - protein, 4 aa, Entamoeba invadens
KPQV

SEQ ID NO: 2875408 - protein, 20 aa, Entamoeba invadens
KPQVDQTRQRTNITQNTVTK

SEQ ID NO: 2875409 - protein, 5 aa, Entamoeba invadens
KPQVT

SEQ ID NO: 2875410 - protein, 7 aa, Entamoeba invadens
KPQYHKG

SEQ ID NO: 2875411 - protein, 5 aa, Entamoeba invadens
KPQYN

SEQ ID NO: 2875412 - protein, 5 aa, Entamoeba invadens
KPRAL

SEQ ID NO: 2875413 - protein, 11 aa, Entamoeba invadens
KPREISRPISK

SEQ ID NO: 2875414 - protein, 15 aa, Entamoeba invadens
KPRENTPNQMQSPRS

SEQ ID NO: 2875415 - protein, 5 aa, Entamoeba invadens
KPRER

SEQ ID NO: 2875416 - protein, 5 aa, Entamoeba invadens
KPREV

SEQ ID NO: 2875417 - protein, 12 aa, Entamoeba invadens
KPRGIRVGRTGK

SEQ ID NO: 2875418 - protein, 8 aa, Entamoeba invadens
KPRGNKPL

SEQ ID NO: 2875419 - protein, 7 aa, Entamoeba invadens
KPRGYER

SEQ ID NO: 2875420 - protein, 4 aa, Entamoeba invadens
KPRI

SEQ ID NO: 2875421 - protein, 14 aa, Entamoeba invadens
KPRISATQSSFTQS

SEQ ID NO: 2875422 - protein, 5 aa, Entamoeba invadens
KPRNM

SEQ ID NO: 2875423 - protein, 25 aa, Entamoeba invadens
KPRPATHGEGGLGFSGKSSSTATQN

SEQ ID NO: 2875424 - protein, 17 aa, Entamoeba invadens
KPRPTADKITSTTPLVT

SEQ ID NO: 2875425 - protein, 11 aa, Entamoeba invadens
KPRQISRPISK

SEQ ID NO: 2875426 - protein, 4 aa, Entamoeba invadens
KPRR

SEQ ID NO: 2875427 - protein, 8 aa, Entamoeba invadens
KPRRKIEG

SEQ ID NO: 2875428 - protein, 6 aa, Entamoeba invadens
KPRRVE

SEQ ID NO: 2875429 - protein, 9 aa, Entamoeba invadens
KPRTPSPRK

SEQ ID NO: 2875430 - protein, 9 aa, Entamoeba invadens
KPRVTTKTQ

SEQ ID NO: 2875431 - protein, 7 aa, Entamoeba invadens
KPSAIQQ

SEQ ID NO: 2875432 - protein, 7 aa, Entamoeba invadens
KPSATTL

SEQ ID NO: 2875433 - protein, 6 aa, Entamoeba invadens
KPSDCE

SEQ ID NO: 2875434 - protein, 8 aa, Entamoeba invadens
KPSDEDLE

SEQ ID NO: 2875435 - protein, 6 aa, Entamoeba invadens
KPSDEV

SEQ ID NO: 2875436 - protein, 7 aa, Entamoeba invadens
KPSDITT

SEQ ID NO: 2875437 - protein, 8 aa, Entamoeba invadens
KPSDLAPF

SEQ ID NO: 2875438 - protein, 8 aa, Entamoeba invadens
KPSDVTRT

SEQ ID NO: 2875439 - protein, 4 aa, Entamoeba invadens
KPSE

SEQ ID NO: 2875440 - protein, 32 aa, Entamoeba invadens
KPSECKSKKVEQHMGNTKDNAVEISSTESSDE

SEQ ID NO: 2875441 - protein, 6 aa, Entamoeba invadens
KPSEEE

SEQ ID NO: 2875442 - protein, 5 aa, Entamoeba invadens
KPSEK

SEQ ID NO: 2875443 - protein, 11 aa, Entamoeba invadens
KPSEKTTTATV

SEQ ID NO: 2875444 - protein, 18 aa, Entamoeba invadens
KPSEPLYTKTDKKRKRSL

SEQ ID NO: 2875445 - protein, 22 aa, Entamoeba invadens
KPSEQPSKLPKPPSEGHEKTKR

SEQ ID NO: 2875446 - protein, 5 aa, Entamoeba invadens
KPSEV

SEQ ID NO: 2875447 - protein, 4 aa, Entamoeba invadens
KPSF

SEQ ID NO: 2875448 - protein, 13 aa, Entamoeba invadens
KPSFKKINKGADL

SEQ ID NO: 2875449 - protein, 6 aa, Entamoeba invadens
KPSHFD

SEQ ID NO: 2875450 - protein, 30 aa, Entamoeba invadens
KPSHGDNNNTFSQQNSYSQTFQPQANTYQI

SEQ ID NO: 2875451 - protein, 8 aa, Entamoeba invadens
KPSHKESL

SEQ ID NO: 2875452 - protein, 4 aa, Entamoeba invadens
KPSI

SEQ ID NO: 2875453 - protein, 8 aa, Entamoeba invadens
KPSIGFSE

SEQ ID NO: 2875454 - protein, 10 aa, Entamoeba invadens
KPSIQSTQTG

SEQ ID NO: 2875455 - protein, 12 aa, Entamoeba invadens
KPSKGYKKIQPE

SEQ ID NO: 2875456 - protein, 6 aa, Entamoeba invadens
KPSKVS

SEQ ID NO: 2875457 - protein, 8 aa, Entamoeba invadens
KPSLKNYE

SEQ ID NO: 2875458 - protein, 12 aa, Entamoeba invadens
KPSLLEQKTTVP

SEQ ID NO: 2875459 - protein, 11 aa, Entamoeba invadens
KPSNEDRLDPG

SEQ ID NO: 2875460 - protein, 16 aa, Entamoeba invadens
KPSNFSLPKAGDQTGI

SEQ ID NO: 2875461 - protein, 6 aa, Entamoeba invadens
KPSNPA

SEQ ID NO: 2875462 - protein, 9 aa, Entamoeba invadens
KPSNTMKKK

SEQ ID NO: 2875463 - protein, 7 aa, Entamoeba invadens
KPSPPCD

SEQ ID NO: 2875464 - protein, 5 aa, Entamoeba invadens
KPSPT

SEQ ID NO: 2875465 - protein, 4 aa, Entamoeba invadens
KPSQ

SEQ ID NO: 2875466 - protein, 12 aa, Entamoeba invadens
KPSQKTDLIPSG

SEQ ID NO: 2875467 - protein, 6 aa, Entamoeba invadens
KPSQPV

SEQ ID NO: 2875468 - protein, 23 aa, Entamoeba invadens
KPSQSQLSQTTQSSQPKRTASGK

SEQ ID NO: 2875469 - protein, 14 aa, Entamoeba invadens
KPSRRAYNDPKYLT

SEQ ID NO: 2875470 - protein, 7 aa, Entamoeba invadens
KPSRRER

SEQ ID NO: 2875471 - protein, 6 aa, Entamoeba invadens
KPSRRN

SEQ ID NO: 2875472 - protein, 6 aa, Entamoeba invadens
KPSSIL

SEQ ID NO: 2875473 - protein, 7 aa, Entamoeba invadens
KPSSQLP

SEQ ID NO: 2875474 - protein, 7 aa, Entamoeba invadens
KPSSQRV

SEQ ID NO: 2875475 - protein, 9 aa, Entamoeba invadens
KPSSTMKKK

SEQ ID NO: 2875476 - protein, 4 aa, Entamoeba invadens
KPSV

SEQ ID NO: 2875477 - protein, 5 aa, Entamoeba invadens
KPSYA

SEQ ID NO: 2875478 - protein, 8 aa, Entamoeba invadens
KPTAGPRY

SEQ ID NO: 2875479 - protein, 9 aa, Entamoeba invadens
KPTDPINPD

SEQ ID NO: 2875480 - protein, 8 aa, Entamoeba invadens
KPTDSGVT

SEQ ID NO: 2875481 - protein, 19 aa, Entamoeba invadens
KPTEEEKKAFDTDDTRPKN

SEQ ID NO: 2875482 - protein, 5 aa, Entamoeba invadens
KPTEH

SEQ ID NO: 2875483 - protein, 9 aa, Entamoeba invadens
KPTEKPIRD

SEQ ID NO: 2875484 - protein, 15 aa, Entamoeba invadens
KPTFEEKKKTLPDVS

SEQ ID NO: 2875485 - protein, 7 aa, Entamoeba invadens
KPTFPNN

SEQ ID NO: 2875486 - protein, 7 aa, Entamoeba invadens
KPTGGTL

SEQ ID NO: 2875487 - protein, 15 aa, Entamoeba invadens
KPTGNIRSSEEGGDD

SEQ ID NO: 2875488 - protein, 18 aa, Entamoeba invadens
KPTHIEKESTIDKTTPRL

SEQ ID NO: 2875489 - protein, 6 aa, Entamoeba invadens
KPTIGE

SEQ ID NO: 2875490 - protein, 6 aa, Entamoeba invadens
KPTIVG

SEQ ID NO: 2875491 - protein, 8 aa, Entamoeba invadens
KPTKDIEK

SEQ ID NO: 2875492 - protein, 46 aa, Entamoeba invadens
KPTKQIKDDKKPQISPQNNLKRNKTHTKRSNFSEQEDIQTPNSKPL

SEQ ID NO: 2875493 - protein, 16 aa, Entamoeba invadens
KPTKTKTPNMEKDEGI

SEQ ID NO: 2875494 - protein, 6 aa, Entamoeba invadens
KPTKVF

SEQ ID NO: 2875495 - protein, 5 aa, Entamoeba invadens
KPTKY

SEQ ID NO: 2875496 - protein, 4 aa, Entamoeba invadens
KPTM

SEQ ID NO: 2875497 - protein, 6 aa, Entamoeba invadens
KPTNLI

SEQ ID NO: 2875498 - protein, 4 aa, Entamoeba invadens
KPTP

SEQ ID NO: 2875499 - protein, 11 aa, Entamoeba invadens
KPTPINVPGYS

SEQ ID NO: 2875500 - protein, 12 aa, Entamoeba invadens
KPTPKDKKREEI

SEQ ID NO: 2875501 - protein, 7 aa, Entamoeba invadens
KPTPPDY

SEQ ID NO: 2875502 - protein, 11 aa, Entamoeba invadens
KPTQQPANTMP

SEQ ID NO: 2875503 - protein, 6 aa, Entamoeba invadens
KPTQSG

SEQ ID NO: 2875504 - protein, 6 aa, Entamoeba invadens
KPTQSL

SEQ ID NO: 2875505 - protein, 6 aa, Entamoeba invadens
KPTQVF

SEQ ID NO: 2875506 - protein, 4 aa, Entamoeba invadens
KPTR

SEQ ID NO: 2875507 - protein, 7 aa, Entamoeba invadens
KPTSKSF

SEQ ID NO: 2875508 - protein, 8 aa, Entamoeba invadens
KPTSMPAQ

SEQ ID NO: 2875509 - protein, 11 aa, Entamoeba invadens
KPTTAKSVTEK

SEQ ID NO: 2875510 - protein, 18 aa, Entamoeba invadens
KPTTFTKTGLPSCPEDDD

SEQ ID NO: 2875511 - protein, 7 aa, Entamoeba invadens
KPTTTFS

SEQ ID NO: 2875512 - protein, 6 aa, Entamoeba invadens
KPTVSS

SEQ ID NO: 2875513 - protein, 24 aa, Entamoeba invadens
KPVADKLKKDKKKTTKKEHKEKKV

SEQ ID NO: 2875514 - protein, 33 aa, Entamoeba invadens
KPVDEKHDDDGKLEKGEKPKKKKKTKKTKKQVK

SEQ ID NO: 2875515 - protein, 5 aa, Entamoeba invadens
KPVDT

SEQ ID NO: 2875516 - protein, 9 aa, Entamoeba invadens
KPVDTFQQN

SEQ ID NO: 2875517 - protein, 8 aa, Entamoeba invadens
KPVEEKRY

SEQ ID NO: 2875518 - protein, 14 aa, Entamoeba invadens
KPVEITSKSKNRNK

SEQ ID NO: 2875519 - protein, 5 aa, Entamoeba invadens
KPVEK

SEQ ID NO: 2875520 - protein, 12 aa, Entamoeba invadens
KPVEKKTDEIPW

SEQ ID NO: 2875521 - protein, 37 aa, Entamoeba invadens
KPVENKYTPTPNIPNSVSQSVERTTEAQTKCSHQRSF

SEQ ID NO: 2875522 - protein, 7 aa, Entamoeba invadens
KPVETSF

SEQ ID NO: 2875523 - protein, 9 aa, Entamoeba invadens
KPVGDDRVK

SEQ ID NO: 2875524 - protein, 13 aa, Entamoeba invadens
KPVISDVQSTAQL

SEQ ID NO: 2875525 - protein, 6 aa, Entamoeba invadens
KPVKNC

SEQ ID NO: 2875526 - protein, 17 aa, Entamoeba invadens
KPVKTNLANTTSKEVPD

SEQ ID NO: 2875527 - protein, 5 aa, Entamoeba invadens
KPVPG

SEQ ID NO: 2875528 - protein, 15 aa, Entamoeba invadens
KPVPNSGNVFSSKKK

SEQ ID NO: 2875529 - protein, 7 aa, Entamoeba invadens
KPVPPNK

SEQ ID NO: 2875530 - protein, 17 aa, Entamoeba invadens
KPVPQSVSAGVPTNQND

SEQ ID NO: 2875531 - protein, 6 aa, Entamoeba invadens
KPVPRS

SEQ ID NO: 2875532 - protein, 10 aa, Entamoeba invadens
KPVRKGHNRE

SEQ ID NO: 2875533 - protein, 7 aa, Entamoeba invadens
KPVRTAS

SEQ ID NO: 2875534 - protein, 11 aa, Entamoeba invadens
KPVSQIKQEDV

SEQ ID NO: 2875535 - protein, 5 aa, Entamoeba invadens
KPVTI

SEQ ID NO: 2875536 - protein, 14 aa, Entamoeba invadens
KPVTPKYKNPAEDV

SEQ ID NO: 2875537 - protein, 12 aa, Entamoeba invadens
KPVVEEDDDFES

SEQ ID NO: 2875538 - protein, 6 aa, Entamoeba invadens
KPVVNK

SEQ ID NO: 2875539 - protein, 4 aa, Entamoeba invadens
KPVY

SEQ ID NO: 2875540 - protein, 73 aa, Entamoeba invadens
KPWNPAKVSGSTSPNVSNQQSPERLSNGTPVPQHKPPPPPKPIHKEQNLTNPPIQRTNPPSVTSQPVTQPQTS

SEQ ID NO: 2875541 - protein, 9 aa, Entamoeba invadens
KPYDFGEGS

SEQ ID NO: 2875542 - protein, 7 aa, Entamoeba invadens
KPYDSTQ

SEQ ID NO: 2875543 - protein, 6 aa, Entamoeba invadens
KPYEEM

SEQ ID NO: 2875544 - protein, 17 aa, Entamoeba invadens
KPYEQNESELEEVDKED

SEQ ID NO: 2875545 - protein, 5 aa, Entamoeba invadens
KPYFP

SEQ ID NO: 2875546 - protein, 5 aa, Entamoeba invadens
KPYGN

SEQ ID NO: 2875547 - protein, 5 aa, Entamoeba invadens
KPYHP

SEQ ID NO: 2875548 - protein, 5 aa, Entamoeba invadens
KPYLS

SEQ ID NO: 2875549 - protein, 12 aa, Entamoeba invadens
KPYMTEEELSTP

SEQ ID NO: 2875550 - protein, 4 aa, Entamoeba invadens
KPYN

SEQ ID NO: 2875551 - protein, 6 aa, Entamoeba invadens
KPYNGI

SEQ ID NO: 2875552 - protein, 7 aa, Entamoeba invadens
KPYQTTY

SEQ ID NO: 2875553 - protein, 5 aa, Entamoeba invadens
KPYRD

SEQ ID NO: 2875554 - protein, 12 aa, Entamoeba invadens
KPYSDKIKADEK

SEQ ID NO: 2875555 - protein, 4 aa, Entamoeba invadens
KPYT

SEQ ID NO: 2875556 - protein, 32 aa, Entamoeba invadens
KQADKGNTLDDRYDEEEEKDSKAIRKSSKKRK

SEQ ID NO: 2875557 - protein, 7 aa, Entamoeba invadens
KQAEDKY

SEQ ID NO: 2875558 - protein, 9 aa, Entamoeba invadens
KQAEDPSEL

SEQ ID NO: 2875559 - protein, 8 aa, Entamoeba invadens
KQAEDTVD

SEQ ID NO: 2875560 - protein, 8 aa, Entamoeba invadens
KQAEERAS

SEQ ID NO: 2875561 - protein, 8 aa, Entamoeba invadens
KQAEIEEK

SEQ ID NO: 2875562 - protein, 28 aa, Entamoeba invadens
KQAEIEEKVNKHSNAKNTPALSSKELTQ

SEQ ID NO: 2875563 - protein, 17 aa, Entamoeba invadens
KQAETSDIKDDGGITNG

SEQ ID NO: 2875564 - protein, 12 aa, Entamoeba invadens
KQAGNGGTDGSK

SEQ ID NO: 2875565 - protein, 9 aa, Entamoeba invadens
KQAKTAKTL

SEQ ID NO: 2875566 - protein, 7 aa, Entamoeba invadens
KQANHTG

SEQ ID NO: 2875567 - protein, 11 aa, Entamoeba invadens
KQANTTPEALN

SEQ ID NO: 2875568 - protein, 18 aa, Entamoeba invadens
KQAPAAAGLSGQMGGTLG

SEQ ID NO: 2875569 - protein, 7 aa, Entamoeba invadens
KQAPKDL

SEQ ID NO: 2875570 - protein, 15 aa, Entamoeba invadens
KQAPPREKKDTIKGQ

SEQ ID NO: 2875571 - protein, 21 aa, Entamoeba invadens
KQAQKKPQNVTEANNHGNTKS

SEQ ID NO: 2875572 - protein, 7 aa, Entamoeba invadens
KQAQTQM

SEQ ID NO: 2875573 - protein, 7 aa, Entamoeba invadens
KQASDRL

SEQ ID NO: 2875574 - protein, 7 aa, Entamoeba invadens
KQATKDF

SEQ ID NO: 2875575 - protein, 18 aa, Entamoeba invadens
KQATNEANSSPKAVPKSL

SEQ ID NO: 2875576 - protein, 7 aa, Entamoeba invadens
KQATPLH

SEQ ID NO: 2875577 - protein, 10 aa, Entamoeba invadens
KQAVENVKNE

SEQ ID NO: 2875578 - protein, 28 aa, Entamoeba invadens
KQAVSEDSSSESMSGSESQSSSKSSSES

SEQ ID NO: 2875579 - protein, 7 aa, Entamoeba invadens
KQAYRAH

SEQ ID NO: 2875580 - protein, 5 aa, Entamoeba invadens
KQCAP

SEQ ID NO: 2875581 - protein, 4 aa, Entamoeba invadens
KQCD

SEQ ID NO: 2875582 - protein, 6 aa, Entamoeba invadens
KQCGPA

SEQ ID NO: 2875583 - protein, 12 aa, Entamoeba invadens
KQCPPPFPLPTD

SEQ ID NO: 2875584 - protein, 5 aa, Entamoeba invadens
KQCSK

SEQ ID NO: 2875585 - protein, 8 aa, Entamoeba invadens
KQCTKDTA

SEQ ID NO: 2875586 - protein, 6 aa, Entamoeba invadens
KQDAEF

SEQ ID NO: 2875587 - protein, 7 aa, Entamoeba invadens
KQDAEGD

SEQ ID NO: 2875588 - protein, 7 aa, Entamoeba invadens
KQDCDGS

SEQ ID NO: 2875589 - protein, 5 aa, Entamoeba invadens
KQDDI

SEQ ID NO: 2875590 - protein, 10 aa, Entamoeba invadens
KQDDKKQKRW

SEQ ID NO: 2875591 - protein, 15 aa, Entamoeba invadens
KQDDKSLQKLKSEVD

SEQ ID NO: 2875592 - protein, 7 aa, Entamoeba invadens
KQDDSRH

SEQ ID NO: 2875593 - protein, 6 aa, Entamoeba invadens
KQDDVA

SEQ ID NO: 2875594 - protein, 19 aa, Entamoeba invadens
KQDEISEATDYRITQTQNS

SEQ ID NO: 2875595 - protein, 6 aa, Entamoeba invadens
KQDHEE

SEQ ID NO: 2875596 - protein, 37 aa, Entamoeba invadens
KQDHPTGKKEGENVTENRQQGVEEESTPIDKKEQPIH

SEQ ID NO: 2875597 - protein, 5 aa, Entamoeba invadens
KQDKC

SEQ ID NO: 2875598 - protein, 13 aa, Entamoeba invadens
KQDKEEKKDPEQS

SEQ ID NO: 2875599 - protein, 20 aa, Entamoeba invadens
KQDKFSPIGRSNSCPSSPRA

SEQ ID NO: 2875600 - protein, 10 aa, Entamoeba invadens
KQDKLTKNEI

SEQ ID NO: 2875601 - protein, 9 aa, Entamoeba invadens
KQDKPPLTE

SEQ ID NO: 2875602 - protein, 17 aa, Entamoeba invadens
KQDKQFEKDKENIKKYA

SEQ ID NO: 2875603 - protein, 40 aa, Entamoeba invadens
KQDKYIKKDNDQNYYGKRYERDSRDYRSGYDHNRSWRKDE

SEQ ID NO: 2875604 - protein, 7 aa, Entamoeba invadens
KQDLRAK

SEQ ID NO: 2875605 - protein, 5 aa, Entamoeba invadens
KQDPK

SEQ ID NO: 2875606 - protein, 12 aa, Entamoeba invadens
KQDPNLPKKPMT

SEQ ID NO: 2875607 - protein, 7 aa, Entamoeba invadens
KQDPNSY

SEQ ID NO: 2875608 - protein, 12 aa, Entamoeba invadens
KQDPQRFEGGSI

SEQ ID NO: 2875609 - protein, 6 aa, Entamoeba invadens
KQDPTF

SEQ ID NO: 2875610 - protein, 5 aa, Entamoeba invadens
KQDQN

SEQ ID NO: 2875611 - protein, 7 aa, Entamoeba invadens
KQDRERW

SEQ ID NO: 2875612 - protein, 9 aa, Entamoeba invadens
KQDRKVPTV

SEQ ID NO: 2875613 - protein, 7 aa, Entamoeba invadens
KQDSSYI

SEQ ID NO: 2875614 - protein, 8 aa, Entamoeba invadens
KQDTKQSI

SEQ ID NO: 2875615 - protein, 6 aa, Entamoeba invadens
KQDVAS

SEQ ID NO: 2875616 - protein, 10 aa, Entamoeba invadens
KQDVKNEEET

SEQ ID NO: 2875617 - protein, 8 aa, Entamoeba invadens
KQEAPIEE

SEQ ID NO: 2875618 - protein, 6 aa, Entamoeba invadens
KQEAVE

SEQ ID NO: 2875619 - protein, 8 aa, Entamoeba invadens
KQEAYEQL

SEQ ID NO: 2875620 - protein, 14 aa, Entamoeba invadens
KQEDPSKKAKAGIN

SEQ ID NO: 2875621 - protein, 6 aa, Entamoeba invadens
KQEEFT

SEQ ID NO: 2875622 - protein, 15 aa, Entamoeba invadens
KQEEGKSKPVGYGTS

SEQ ID NO: 2875623 - protein, 27 aa, Entamoeba invadens
KQEEKNSTQNVNVNSENYDNKNEKKIQ

SEQ ID NO: 2875624 - protein, 6 aa, Entamoeba invadens
KQEETF

SEQ ID NO: 2875625 - protein, 5 aa, Entamoeba invadens
KQEEV

SEQ ID NO: 2875626 - protein, 5 aa, Entamoeba invadens
KQEFP

SEQ ID NO: 2875627 - protein, 10 aa, Entamoeba invadens
KQEGEAPKSI

SEQ ID NO: 2875628 - protein, 12 aa, Entamoeba invadens
KQEGKDVKDNKE

SEQ ID NO: 2875629 - protein, 9 aa, Entamoeba invadens
KQEGSDEIK

SEQ ID NO: 2875630 - protein, 11 aa, Entamoeba invadens
KQEGSERPTFD

SEQ ID NO: 2875631 - protein, 6 aa, Entamoeba invadens
KQEGVD

SEQ ID NO: 2875632 - protein, 4 aa, Entamoeba invadens
KQEI

SEQ ID NO: 2875633 - protein, 19 aa, Entamoeba invadens
KQEIEKVEEEASEGPIKES

SEQ ID NO: 2875634 - protein, 5 aa, Entamoeba invadens
KQEIR

SEQ ID NO: 2875635 - protein, 14 aa, Entamoeba invadens
KQEISFGDQNDEID

SEQ ID NO: 2875636 - protein, 4 aa, Entamoeba invadens
KQEK

SEQ ID NO: 2875637 - protein, 5 aa, Entamoeba invadens
KQEKE

SEQ ID NO: 2875638 - protein, 14 aa, Entamoeba invadens
KQEKEENKKSMATL

SEQ ID NO: 2875639 - protein, 19 aa, Entamoeba invadens
KQEKKKEDKKAKQNFENQQ

SEQ ID NO: 2875640 - protein, 5 aa, Entamoeba invadens
KQEKP

SEQ ID NO: 2875641 - protein, 16 aa, Entamoeba invadens
KQEKQLSRLQQFLRTW

SEQ ID NO: 2875642 - protein, 28 aa, Entamoeba invadens
KQEKREHEEEDRKMEKVKKTDKHERKYY

SEQ ID NO: 2875643 - protein, 8 aa, Entamoeba invadens
KQELAKDD

SEQ ID NO: 2875644 - protein, 7 aa, Entamoeba invadens
KQELEKK

SEQ ID NO: 2875645 - protein, 6 aa, Entamoeba invadens
KQENIT

SEQ ID NO: 2875646 - protein, 7 aa, Entamoeba invadens
KQENPQM

SEQ ID NO: 2875647 - protein, 10 aa, Entamoeba invadens
KQENQSLRTQ

SEQ ID NO: 2875648 - protein, 19 aa, Entamoeba invadens
KQEPKERSDINTIIACLEH

SEQ ID NO: 2875649 - protein, 6 aa, Entamoeba invadens
KQEPQE

SEQ ID NO: 2875650 - protein, 6 aa, Entamoeba invadens
KQEPQK

SEQ ID NO: 2875651 - protein, 7 aa, Entamoeba invadens
KQEPYQN

SEQ ID NO: 2875652 - protein, 5 aa, Entamoeba invadens
KQEQR

SEQ ID NO: 2875653 - protein, 19 aa, Entamoeba invadens
KQEQTNAKASAETVVFTKQ

SEQ ID NO: 2875654 - protein, 39 aa, Entamoeba invadens
KQERATAKTQKRDYSGVGNCGGFGNTSSYSDNSYGNSNT

SEQ ID NO: 2875655 - protein, 8 aa, Entamoeba invadens
KQERKKRQ

SEQ ID NO: 2875656 - protein, 12 aa, Entamoeba invadens
KQESDEAAREYT

SEQ ID NO: 2875657 - protein, 26 aa, Entamoeba invadens
KQESSSDKGEADGKKVKEKKKKGCYL

SEQ ID NO: 2875658 - protein, 11 aa, Entamoeba invadens
KQESTSKKEDE

SEQ ID NO: 2875659 - protein, 7 aa, Entamoeba invadens
KQETAAR

SEQ ID NO: 2875660 - protein, 8 aa, Entamoeba invadens
KQETEKRC

SEQ ID NO: 2875661 - protein, 9 aa, Entamoeba invadens
KQETSSEEV

SEQ ID NO: 2875662 - protein, 6 aa, Entamoeba invadens
KQETVT

SEQ ID NO: 2875663 - protein, 4 aa, Entamoeba invadens
KQEV

SEQ ID NO: 2875664 - protein, 24 aa, Entamoeba invadens
KQEVAEADEELETVKKDKFAKEIE

SEQ ID NO: 2875665 - protein, 36 aa, Entamoeba invadens
KQEVPEETKQVENTEVKKEEKKEESKSDKKENKPID

SEQ ID NO: 2875666 - protein, 7 aa, Entamoeba invadens
KQEWSGC

SEQ ID NO: 2875667 - protein, 17 aa, Entamoeba invadens
KQEYEEELEKKDATMKK

SEQ ID NO: 2875668 - protein, 13 aa, Entamoeba invadens
KQEYEEKGILVFN

SEQ ID NO: 2875669 - protein, 40 aa, Entamoeba invadens
KQEYVENKEKRKEKEKKKRMDMEKDKQRMEEDSENDEDDV

SEQ ID NO: 2875670 - protein, 11 aa, Entamoeba invadens
KQFDEQEKSLP

SEQ ID NO: 2875671 - protein, 6 aa, Entamoeba invadens
KQFDEY

SEQ ID NO: 2875672 - protein, 27 aa, Entamoeba invadens
KQFEKEDDKLRMNTTEVRNVKTRRKQL

SEQ ID NO: 2875673 - protein, 7 aa, Entamoeba invadens
KQFEKRG

SEQ ID NO: 2875674 - protein, 8 aa, Entamoeba invadens
KQFETKSG

SEQ ID NO: 2875675 - protein, 6 aa, Entamoeba invadens
KQFETQ

SEQ ID NO: 2875676 - protein, 6 aa, Entamoeba invadens
KQFGPK

SEQ ID NO: 2875677 - protein, 9 aa, Entamoeba invadens
KQFGSVNTV

SEQ ID NO: 2875678 - protein, 5 aa, Entamoeba invadens
KQFQY

SEQ ID NO: 2875679 - protein, 7 aa, Entamoeba invadens
KQFSDQV

SEQ ID NO: 2875680 - protein, 19 aa, Entamoeba invadens
KQFSEANGKESPLSQARER

SEQ ID NO: 2875681 - protein, 11 aa, Entamoeba invadens
KQGAKQRRSLF

SEQ ID NO: 2875682 - protein, 21 aa, Entamoeba invadens
KQGCSEKTANRRFQTNKKTEA

SEQ ID NO: 2875683 - protein, 9 aa, Entamoeba invadens
KQGDADILE

SEQ ID NO: 2875684 - protein, 6 aa, Entamoeba invadens
KQGDDL

SEQ ID NO: 2875685 - protein, 8 aa, Entamoeba invadens
KQGDPNCD

SEQ ID NO: 2875686 - protein, 13 aa, Entamoeba invadens
KQGDVDKIPRHAM

SEQ ID NO: 2875687 - protein, 14 aa, Entamoeba invadens
KQGENHNDKPTNLK

SEQ ID NO: 2875688 - protein, 6 aa, Entamoeba invadens
KQGEPL

SEQ ID NO: 2875689 - protein, 4 aa, Entamoeba invadens
KQGG

SEQ ID NO: 2875690 - protein, 7 aa, Entamoeba invadens
KQGGKDF

SEQ ID NO: 2875691 - protein, 6 aa, Entamoeba invadens
KQGGLS

SEQ ID NO: 2875692 - protein, 13 aa, Entamoeba invadens
KQGKAPSQPTRRK

SEQ ID NO: 2875693 - protein, 37 aa, Entamoeba invadens
KQGKAPSVAKPGESFDPSLQTIDEDEMSPEKESSALN

SEQ ID NO: 2875694 - protein, 9 aa, Entamoeba invadens
KQGKESVKI

SEQ ID NO: 2875695 - protein, 11 aa, Entamoeba invadens
KQGLRRQATND

SEQ ID NO: 2875696 - protein, 6 aa, Entamoeba invadens
KQGNLK

SEQ ID NO: 2875697 - protein, 8 aa, Entamoeba invadens
KQGPKIPP

SEQ ID NO: 2875698 - protein, 7 aa, Entamoeba invadens
KQGQRTE

SEQ ID NO: 2875699 - protein, 22 aa, Entamoeba invadens
KQGSSIDVKRKEEDLTNSNQNI

SEQ ID NO: 2875700 - protein, 6 aa, Entamoeba invadens
KQGTTM

SEQ ID NO: 2875701 - protein, 6 aa, Entamoeba invadens
KQGVRR

SEQ ID NO: 2875702 - protein, 16 aa, Entamoeba invadens
KQGYREISGDEQKEKE

SEQ ID NO: 2875703 - protein, 12 aa, Entamoeba invadens
KQGYSKPSPIQQ

SEQ ID NO: 2875704 - protein, 15 aa, Entamoeba invadens
KQGYTEGFKWISQYL

SEQ ID NO: 2875705 - protein, 26 aa, Entamoeba invadens
KQHNMSDQQEHSETVEGSSDTPVKFD

SEQ ID NO: 2875706 - protein, 5 aa, Entamoeba invadens
KQHPT

SEQ ID NO: 2875707 - protein, 8 aa, Entamoeba invadens
KQHPTGAK

SEQ ID NO: 2875708 - protein, 8 aa, Entamoeba invadens
KQHQKEKK

SEQ ID NO: 2875709 - protein, 7 aa, Entamoeba invadens
KQHQNAK

SEQ ID NO: 2875710 - protein, 7 aa, Entamoeba invadens
KQHQPAH

SEQ ID NO: 2875711 - protein, 4 aa, Entamoeba invadens
KQHR

SEQ ID NO: 2875712 - protein, 7 aa, Entamoeba invadens
KQHSPPF

SEQ ID NO: 2875713 - protein, 16 aa, Entamoeba invadens
KQHTDTAKTRKEVAKE

SEQ ID NO: 2875714 - protein, 26 aa, Entamoeba invadens
KQHTTTDSGESEDKKPKKKKKGGCFL

SEQ ID NO: 2875715 - protein, 6 aa, Entamoeba invadens
KQIAGG

SEQ ID NO: 2875716 - protein, 10 aa, Entamoeba invadens
KQIAPKGMTD

SEQ ID NO: 2875717 - protein, 4 aa, Entamoeba invadens
KQID

SEQ ID NO: 2875718 - protein, 24 aa, Entamoeba invadens
KQIDAKDKNDSKKKKSAVTVKTGK

SEQ ID NO: 2875719 - protein, 6 aa, Entamoeba invadens
KQIDDE

SEQ ID NO: 2875720 - protein, 9 aa, Entamoeba invadens
KQIDGAKRL

SEQ ID NO: 2875721 - protein, 7 aa, Entamoeba invadens
KQIDGQK

SEQ ID NO: 2875722 - protein, 8 aa, Entamoeba invadens
KQIDYTQS

SEQ ID NO: 2875723 - protein, 4 aa, Entamoeba invadens
KQIE

SEQ ID NO: 2875724 - protein, 8 aa, Entamoeba invadens
KQIEEAGG

SEQ ID NO: 2875725 - protein, 6 aa, Entamoeba invadens
KQIEED

SEQ ID NO: 2875726 - protein, 7 aa, Entamoeba invadens
KQIEELE

SEQ ID NO: 2875727 - protein, 7 aa, Entamoeba invadens
KQIEELK

SEQ ID NO: 2875728 - protein, 11 aa, Entamoeba invadens
KQIEETKKRIE

SEQ ID NO: 2875729 - protein, 11 aa, Entamoeba invadens
KQIENKNTTSF

SEQ ID NO: 2875730 - protein, 17 aa, Entamoeba invadens
KQIENKTIPEVILVERI

SEQ ID NO: 2875731 - protein, 7 aa, Entamoeba invadens
KQIENLE

SEQ ID NO: 2875732 - protein, 19 aa, Entamoeba invadens
KQIESRNNSLNPTRSTVSA

SEQ ID NO: 2875733 - protein, 12 aa, Entamoeba invadens
KQIESSDTIGKI

SEQ ID NO: 2875734 - protein, 13 aa, Entamoeba invadens
KQIESSDTTEKIK

SEQ ID NO: 2875735 - protein, 20 aa, Entamoeba invadens
KQIETEKAKGKRESKKSCAV

SEQ ID NO: 2875736 - protein, 7 aa, Entamoeba invadens
KQIETTR

SEQ ID NO: 2875737 - protein, 6 aa, Entamoeba invadens
KQIGAD

SEQ ID NO: 2875738 - protein, 13 aa, Entamoeba invadens
KQIGEEKEEEKTI

SEQ ID NO: 2875739 - protein, 72 aa, Entamoeba invadens
KQIGGTSKEEPPPSTDTNKTPRELAKEKKEKLKKEKEEKANQKKEEKAKKISDAKEKRQNKEKKDRPKSDVL

SEQ ID NO: 2875740 - protein, 7 aa, Entamoeba invadens
KQIGKKA

SEQ ID NO: 2875741 - protein, 5 aa, Entamoeba invadens
KQIGL

SEQ ID NO: 2875742 - protein, 14 aa, Entamoeba invadens
KQIKEEKDTIQKEL

SEQ ID NO: 2875743 - protein, 11 aa, Entamoeba invadens
KQIKGSSGESA

SEQ ID NO: 2875744 - protein, 13 aa, Entamoeba invadens
KQIPQDDDFGISE

SEQ ID NO: 2875745 - protein, 9 aa, Entamoeba invadens
KQIQQGGLN

SEQ ID NO: 2875746 - protein, 7 aa, Entamoeba invadens
KQIQYKD

SEQ ID NO: 2875747 - protein, 11 aa, Entamoeba invadens
KQIRESGNAIN

SEQ ID NO: 2875748 - protein, 4 aa, Entamoeba invadens
KQIS

SEQ ID NO: 2875749 - protein, 6 aa, Entamoeba invadens
KQISSI

SEQ ID NO: 2875750 - protein, 10 aa, Entamoeba invadens
KQISSKFSQT

SEQ ID NO: 2875751 - protein, 6 aa, Entamoeba invadens
KQITPE

SEQ ID NO: 2875752 - protein, 18 aa, Entamoeba invadens
KQIVTKNAEDVLSNGSEE

SEQ ID NO: 2875753 - protein, 5 aa, Entamoeba invadens
KQIYR

SEQ ID NO: 2875754 - protein, 9 aa, Entamoeba invadens
KQKAENNKI

SEQ ID NO: 2875755 - protein, 10 aa, Entamoeba invadens
KQKAQIKAND

SEQ ID NO: 2875756 - protein, 8 aa, Entamoeba invadens
KQKAQVDA

SEQ ID NO: 2875757 - protein, 19 aa, Entamoeba invadens
KQKASTAKTNEERRKYAEE

SEQ ID NO: 2875758 - protein, 24 aa, Entamoeba invadens
KQKASVQFSPSRSQLPNKTQMGYQ

SEQ ID NO: 2875759 - protein, 13 aa, Entamoeba invadens
KQKDEFEKNNEEV

SEQ ID NO: 2875760 - protein, 14 aa, Entamoeba invadens
KQKDESSLSTTTIA

SEQ ID NO: 2875761 - protein, 8 aa, Entamoeba invadens
KQKDKIKE

SEQ ID NO: 2875762 - protein, 7 aa, Entamoeba invadens
KQKDRNL

SEQ ID NO: 2875763 - protein, 7 aa, Entamoeba invadens
KQKDSLR

SEQ ID NO: 2875764 - protein, 4 aa, Entamoeba invadens
KQKE

SEQ ID NO: 2875765 - protein, 28 aa, Entamoeba invadens
KQKEAKEKKQKKTTKRQNKRKEDQENVT

SEQ ID NO: 2875766 - protein, 8 aa, Entamoeba invadens
KQKEDITE

SEQ ID NO: 2875767 - protein, 27 aa, Entamoeba invadens
KQKEEAEKKVETIEATQQGNEKQINEK

SEQ ID NO: 2875768 - protein, 58 aa, Entamoeba invadens
KQKEEAERRKREEESHKRELERQRREAERKKREEEFNRQEEIRKQNEALEKKRQEDLR

SEQ ID NO: 2875769 - protein, 22 aa, Entamoeba invadens
KQKEEERIENENKEKLRKENER

SEQ ID NO: 2875770 - protein, 15 aa, Entamoeba invadens
KQKEEEVSKVEEVKK

SEQ ID NO: 2875771 - protein, 8 aa, Entamoeba invadens
KQKEENAK

SEQ ID NO: 2875772 - protein, 7 aa, Entamoeba invadens
KQKEESV

SEQ ID NO: 2875773 - protein, 41 aa, Entamoeba invadens
KQKEISKKEKEKINNEKKPKKKRVSDYEKAEKLKRAMKKYK

SEQ ID NO: 2875774 - protein, 33 aa, Entamoeba invadens
KQKEKTEKLAKEKERVENIKKNPPTKTIPRVSS

SEQ ID NO: 2875775 - protein, 13 aa, Entamoeba invadens
KQKENSNEKQMDM

SEQ ID NO: 2875776 - protein, 16 aa, Entamoeba invadens
KQKEQKDRKEDKEKDK

SEQ ID NO: 2875777 - protein, 10 aa, Entamoeba invadens
KQKERKKYME

SEQ ID NO: 2875778 - protein, 12 aa, Entamoeba invadens
KQKESNKDKQVD

SEQ ID NO: 2875779 - protein, 48 aa, Entamoeba invadens
KQKESQQMANQMPGQSKQPLSLKKEEEKIRQDENDQYFGEQQQDPQSR

SEQ ID NO: 2875780 - protein, 6 aa, Entamoeba invadens
KQKEVR

SEQ ID NO: 2875781 - protein, 4 aa, Entamoeba invadens
KQKF

SEQ ID NO: 2875782 - protein, 9 aa, Entamoeba invadens
KQKGAKNYT

SEQ ID NO: 2875783 - protein, 8 aa, Entamoeba invadens
KQKGDATT

SEQ ID NO: 2875784 - protein, 15 aa, Entamoeba invadens
KQKGEGASSGNSSTI

SEQ ID NO: 2875785 - protein, 16 aa, Entamoeba invadens
KQKGNKEDKKEKSDDE

SEQ ID NO: 2875786 - protein, 46 aa, Entamoeba invadens
KQKHAKRENRSIEKKECESKPRKCKGDEGLKSNATKITDFFGQKKK

SEQ ID NO: 2875787 - protein, 31 aa, Entamoeba invadens
KQKKAEKGCSDKQKKGKKGENTSKKENKKHK

SEQ ID NO: 2875788 - protein, 41 aa, Entamoeba invadens
KQKKEEAKKLADQRAAELQAEKKLKEKMEKEKEKEQKVAEE

SEQ ID NO: 2875789 - protein, 6 aa, Entamoeba invadens
KQKKEN

SEQ ID NO: 2875790 - protein, 8 aa, Entamoeba invadens
KQKKGVFD

SEQ ID NO: 2875791 - protein, 6 aa, Entamoeba invadens
KQKKHK

SEQ ID NO: 2875792 - protein, 9 aa, Entamoeba invadens
KQKKNTTIK

SEQ ID NO: 2875793 - protein, 26 aa, Entamoeba invadens
KQKKPTVTEEDESSDGYENSEGEYVE

SEQ ID NO: 2875794 - protein, 10 aa, Entamoeba invadens
KQKKSTEVET

SEQ ID NO: 2875795 - protein, 8 aa, Entamoeba invadens
KQKKTFEK

SEQ ID NO: 2875796 - protein, 6 aa, Entamoeba invadens
KQKKVD

SEQ ID NO: 2875797 - protein, 9 aa, Entamoeba invadens
KQKLGTSDI

SEQ ID NO: 2875798 - protein, 16 aa, Entamoeba invadens
KQKLSSRNYRSEKTKY

SEQ ID NO: 2875799 - protein, 7 aa, Entamoeba invadens
KQKLTDG

SEQ ID NO: 2875800 - protein, 11 aa, Entamoeba invadens
KQKMNEKNEEI

SEQ ID NO: 2875801 - protein, 9 aa, Entamoeba invadens
KQKNEEIAK

SEQ ID NO: 2875802 - protein, 8 aa, Entamoeba invadens
KQKNSTKL

SEQ ID NO: 2875803 - protein, 7 aa, Entamoeba invadens
KQKPGYA

SEQ ID NO: 2875804 - protein, 7 aa, Entamoeba invadens
KQKPIWT

SEQ ID NO: 2875805 - protein, 10 aa, Entamoeba invadens
KQKPKMDYSG

SEQ ID NO: 2875806 - protein, 17 aa, Entamoeba invadens
KQKPSEKKSSKTESESL

SEQ ID NO: 2875807 - protein, 11 aa, Entamoeba invadens
KQKQAVDITNT

SEQ ID NO: 2875808 - protein, 10 aa, Entamoeba invadens
KQKQGQIQSE

SEQ ID NO: 2875809 - protein, 42 aa, Entamoeba invadens
KQKQKEQKDVKDLKENKEVKETKEAKEKMRPQTALPKTPVVK

SEQ ID NO: 2875810 - protein, 8 aa, Entamoeba invadens
KQKQQTEL

SEQ ID NO: 2875811 - protein, 25 aa, Entamoeba invadens
KQKQREKGLDVRPDTKYTGRKRSRG

SEQ ID NO: 2875812 - protein, 7 aa, Entamoeba invadens
KQKQSLS

SEQ ID NO: 2875813 - protein, 6 aa, Entamoeba invadens
KQKRLE

SEQ ID NO: 2875814 - protein, 5 aa, Entamoeba invadens
KQKRM

SEQ ID NO: 2875815 - protein, 5 aa, Entamoeba invadens
KQKRQ

SEQ ID NO: 2875816 - protein, 28 aa, Entamoeba invadens
KQKRREARGLTHAGKVSRGLSGKGRRYN

SEQ ID NO: 2875817 - protein, 47 aa, Entamoeba invadens
KQKRRELEKERQMKKEEDQKRREENAKRREEKLAKKKEFHKHTKKGQ

SEQ ID NO: 2875818 - protein, 5 aa, Entamoeba invadens
KQKRV

SEQ ID NO: 2875819 - protein, 21 aa, Entamoeba invadens
KQKSEKEKETTEDKEGPTDEV

SEQ ID NO: 2875820 - protein, 6 aa, Entamoeba invadens
KQKSFD

SEQ ID NO: 2875821 - protein, 14 aa, Entamoeba invadens
KQKSLSATSGKGFT

SEQ ID NO: 2875822 - protein, 14 aa, Entamoeba invadens
KQKSPKKYTPKKRT

SEQ ID NO: 2875823 - protein, 8 aa, Entamoeba invadens
KQKSQPKK

SEQ ID NO: 2875824 - protein, 10 aa, Entamoeba invadens
KQKSSESQAL

SEQ ID NO: 2875825 - protein, 4 aa, Entamoeba invadens
KQKT

SEQ ID NO: 2875826 - protein, 12 aa, Entamoeba invadens
KQKTASRRKNSN

SEQ ID NO: 2875827 - protein, 6 aa, Entamoeba invadens
KQKTGE

SEQ ID NO: 2875828 - protein, 6 aa, Entamoeba invadens
KQKTIE

SEQ ID NO: 2875829 - protein, 16 aa, Entamoeba invadens
KQKTISSDSKAKTDDF

SEQ ID NO: 2875830 - protein, 10 aa, Entamoeba invadens
KQKTVQPQSM

SEQ ID NO: 2875831 - protein, 7 aa, Entamoeba invadens
KQKVSEM

SEQ ID NO: 2875832 - protein, 13 aa, Entamoeba invadens
KQKVTSSEAKRIS

SEQ ID NO: 2875833 - protein, 18 aa, Entamoeba invadens
KQLDEELKTDPKNESPED

SEQ ID NO: 2875834 - protein, 10 aa, Entamoeba invadens
KQLDSNDYKQ

SEQ ID NO: 2875835 - protein, 22 aa, Entamoeba invadens
KQLDTANDDKDCNEAMKQKYQD

SEQ ID NO: 2875836 - protein, 41 aa, Entamoeba invadens
KQLDTANDEKDGNEAMKQKYQDELKSVRTELDQENKDHTKT

SEQ ID NO: 2875837 - protein, 24 aa, Entamoeba invadens
KQLDTSNDDKDGNEAMKQKYQDKL

SEQ ID NO: 2875838 - protein, 28 aa, Entamoeba invadens
KQLEAENEKKEKERVERSGNPSEKDENV

SEQ ID NO: 2875839 - protein, 13 aa, Entamoeba invadens
KQLEEQDGECKTL

SEQ ID NO: 2875840 - protein, 18 aa, Entamoeba invadens
KQLEETNTLNKEANKQIE

SEQ ID NO: 2875841 - protein, 8 aa, Entamoeba invadens
KQLEHEGQ

SEQ ID NO: 2875842 - protein, 5 aa, Entamoeba invadens
KQLEK

SEQ ID NO: 2875843 - protein, 63 aa, Entamoeba invadens
KQLEKERKKEEKEREKERKKEEKKSRSTSRPGSKGNSRSNSKARSKASSREPSQEREEKIEKA

SEQ ID NO: 2875844 - protein, 17 aa, Entamoeba invadens
KQLENANTDKSNLNEKK

SEQ ID NO: 2875845 - protein, 15 aa, Entamoeba invadens
KQLGGNGTLNQQSTL

SEQ ID NO: 2875846 - protein, 4 aa, Entamoeba invadens
KQLK

SEQ ID NO: 2875847 - protein, 25 aa, Entamoeba invadens
KQLKDDDLSVKKKDHEETKNVQTKL

SEQ ID NO: 2875848 - protein, 6 aa, Entamoeba invadens
KQLKEQ

SEQ ID NO: 2875849 - protein, 10 aa, Entamoeba invadens
KQLKTGSDIV

SEQ ID NO: 2875850 - protein, 6 aa, Entamoeba invadens
KQLNEQ

SEQ ID NO: 2875851 - protein, 15 aa, Entamoeba invadens
KQLPPCPLQPPPDLK

SEQ ID NO: 2875852 - protein, 10 aa, Entamoeba invadens
KQLPPNLSVQ

SEQ ID NO: 2875853 - protein, 7 aa, Entamoeba invadens
KQLPSTV

SEQ ID NO: 2875854 - protein, 13 aa, Entamoeba invadens
KQLQEPKVPKEPI

SEQ ID NO: 2875855 - protein, 32 aa, Entamoeba invadens
KQLQPNNTNTLQQQTQQMQQHQQSTPPRPIQD

SEQ ID NO: 2875856 - protein, 11 aa, Entamoeba invadens
KQLQRKENIQE

SEQ ID NO: 2875857 - protein, 5 aa, Entamoeba invadens
KQLRD

SEQ ID NO: 2875858 - protein, 7 aa, Entamoeba invadens
KQLREDT

SEQ ID NO: 2875859 - protein, 13 aa, Entamoeba invadens
KQLRYPKNTTTNF

SEQ ID NO: 2875860 - protein, 8 aa, Entamoeba invadens
KQLSDEEK

SEQ ID NO: 2875861 - protein, 12 aa, Entamoeba invadens
KQLSKSNDRTLE

SEQ ID NO: 2875862 - protein, 15 aa, Entamoeba invadens
KQLSSEYSDVTKSTK

SEQ ID NO: 2875863 - protein, 10 aa, Entamoeba invadens
KQLSSKFSQT

SEQ ID NO: 2875864 - protein, 11 aa, Entamoeba invadens
KQLSSNNEKFE

SEQ ID NO: 2875865 - protein, 4 aa, Entamoeba invadens
KQLT

SEQ ID NO: 2875866 - protein, 8 aa, Entamoeba invadens
KQLTDSAI

SEQ ID NO: 2875867 - protein, 5 aa, Entamoeba invadens
KQLTF

SEQ ID NO: 2875868 - protein, 8 aa, Entamoeba invadens
KQLTGYGS

SEQ ID NO: 2875869 - protein, 6 aa, Entamoeba invadens
KQLTSA

SEQ ID NO: 2875870 - protein, 21 aa, Entamoeba invadens
KQMEETKAQADGVETKKKDIR

SEQ ID NO: 2875871 - protein, 7 aa, Entamoeba invadens
KQMERQE

SEQ ID NO: 2875872 - protein, 6 aa, Entamoeba invadens
KQMGQD

SEQ ID NO: 2875873 - protein, 14 aa, Entamoeba invadens
KQMKETEEDARISS

SEQ ID NO: 2875874 - protein, 10 aa, Entamoeba invadens
KQMKKTQSLV

SEQ ID NO: 2875875 - protein, 8 aa, Entamoeba invadens
KQMPGPTK

SEQ ID NO: 2875876 - protein, 13 aa, Entamoeba invadens
KQMQSQNVSEAIT

SEQ ID NO: 2875877 - protein, 6 aa, Entamoeba invadens
KQMRKD

SEQ ID NO: 2875878 - protein, 5 aa, Entamoeba invadens
KQMTD

SEQ ID NO: 2875879 - protein, 7 aa, Entamoeba invadens
KQNATKE

SEQ ID NO: 2875880 - protein, 29 aa, Entamoeba invadens
KQNCTYKEKNKQLEEEIQTEIEKNKTIND

SEQ ID NO: 2875881 - protein, 7 aa, Entamoeba invadens
KQNDDFG

SEQ ID NO: 2875882 - protein, 8 aa, Entamoeba invadens
KQNDNKRR

SEQ ID NO: 2875883 - protein, 6 aa, Entamoeba invadens
KQNDYD

SEQ ID NO: 2875884 - protein, 7 aa, Entamoeba invadens
KQNDYET

SEQ ID NO: 2875885 - protein, 9 aa, Entamoeba invadens
KQNEENKTI

SEQ ID NO: 2875886 - protein, 8 aa, Entamoeba invadens
KQNESKHL

SEQ ID NO: 2875887 - protein, 7 aa, Entamoeba invadens
KQNETAF

SEQ ID NO: 2875888 - protein, 4 aa, Entamoeba invadens
KQNF

SEQ ID NO: 2875889 - protein, 23 aa, Entamoeba invadens
KQNFPPPTLESAEEKKKLSTTVT

SEQ ID NO: 2875890 - protein, 7 aa, Entamoeba invadens
KQNFTKN

SEQ ID NO: 2875891 - protein, 6 aa, Entamoeba invadens
KQNGDL

SEQ ID NO: 2875892 - protein, 9 aa, Entamoeba invadens
KQNGSTLDE

SEQ ID NO: 2875893 - protein, 4 aa, Entamoeba invadens
KQNI

SEQ ID NO: 2875894 - protein, 7 aa, Entamoeba invadens
KQNISSE

SEQ ID NO: 2875895 - protein, 4 aa, Entamoeba invadens
KQNK

SEQ ID NO: 2875896 - protein, 12 aa, Entamoeba invadens
KQNKARKDKKLC

SEQ ID NO: 2875897 - protein, 14 aa, Entamoeba invadens
KQNKARTEKKLPEN

SEQ ID NO: 2875898 - protein, 12 aa, Entamoeba invadens
KQNKDDTPQIPK

SEQ ID NO: 2875899 - protein, 8 aa, Entamoeba invadens
KQNKEDTI

SEQ ID NO: 2875900 - protein, 9 aa, Entamoeba invadens
KQNKESREK

SEQ ID NO: 2875901 - protein, 15 aa, Entamoeba invadens
KQNKETENSTPVESI

SEQ ID NO: 2875902 - protein, 5 aa, Entamoeba invadens
KQNKG

SEQ ID NO: 2875903 - protein, 5 aa, Entamoeba invadens
KQNLD

SEQ ID NO: 2875904 - protein, 5 aa, Entamoeba invadens
KQNLP

SEQ ID NO: 2875905 - protein, 7 aa, Entamoeba invadens
KQNNKES

SEQ ID NO: 2875906 - protein, 34 aa, Entamoeba invadens
KQNNLKKNTAKSKREKLSQLKKKETPSKVSKSVQ

SEQ ID NO: 2875907 - protein, 5 aa, Entamoeba invadens
KQNNN

SEQ ID NO: 2875908 - protein, 6 aa, Entamoeba invadens
KQNNND

SEQ ID NO: 2875909 - protein, 10 aa, Entamoeba invadens
KQNPKERETI

SEQ ID NO: 2875910 - protein, 8 aa, Entamoeba invadens
KQNPKERI

SEQ ID NO: 2875911 - protein, 9 aa, Entamoeba invadens
KQNPKERTT

SEQ ID NO: 2875912 - protein, 8 aa, Entamoeba invadens
KQNPKKEL

SEQ ID NO: 2875913 - protein, 14 aa, Entamoeba invadens
KQNPKVVPTISGTV

SEQ ID NO: 2875914 - protein, 7 aa, Entamoeba invadens
KQNPQEI

SEQ ID NO: 2875915 - protein, 5 aa, Entamoeba invadens
KQNPS

SEQ ID NO: 2875916 - protein, 8 aa, Entamoeba invadens
KQNPSFGT

SEQ ID NO: 2875917 - protein, 7 aa, Entamoeba invadens
KQNQAKY

SEQ ID NO: 2875918 - protein, 47 aa, Entamoeba invadens
KQNQEEKKKRIEKAENQKAKKKGEEKKKEKTQLTKQEKAVKELEGKA

SEQ ID NO: 2875919 - protein, 16 aa, Entamoeba invadens
KQNQENVNKAKSLESD

SEQ ID NO: 2875920 - protein, 6 aa, Entamoeba invadens
KQNQTL

SEQ ID NO: 2875921 - protein, 27 aa, Entamoeba invadens
KQNQVHQSDKTGSVENGDKKQKCCCVL

SEQ ID NO: 2875922 - protein, 4 aa, Entamoeba invadens
KQNR

SEQ ID NO: 2875923 - protein, 34 aa, Entamoeba invadens
KQNRASSQAAAPSAGEEAGKKDKKKDKKDKKCTL

SEQ ID NO: 2875924 - protein, 15 aa, Entamoeba invadens
KQNSEIVKEPHKTLP

SEQ ID NO: 2875925 - protein, 11 aa, Entamoeba invadens
KQNSFDSGDNL

SEQ ID NO: 2875926 - protein, 6 aa, Entamoeba invadens
KQNSHD

SEQ ID NO: 2875927 - protein, 7 aa, Entamoeba invadens
KQNSQTL

SEQ ID NO: 2875928 - protein, 4 aa, Entamoeba invadens
KQNT

SEQ ID NO: 2875929 - protein, 26 aa, Entamoeba invadens
KQNTAHEDSEQSDDSQNFDDDGFDNI

SEQ ID NO: 2875930 - protein, 7 aa, Entamoeba invadens
KQNTNHD

SEQ ID NO: 2875931 - protein, 7 aa, Entamoeba invadens
KQNTPNK

SEQ ID NO: 2875932 - protein, 8 aa, Entamoeba invadens
KQNTPTTL

SEQ ID NO: 2875933 - protein, 7 aa, Entamoeba invadens
KQNTSNS

SEQ ID NO: 2875934 - protein, 4 aa, Entamoeba invadens
KQNY

SEQ ID NO: 2875935 - protein, 6 aa, Entamoeba invadens
KQNYTQ

SEQ ID NO: 2875936 - protein, 5 aa, Entamoeba invadens
KQPAK

SEQ ID NO: 2875937 - protein, 11 aa, Entamoeba invadens
KQPAKKSTVAP

SEQ ID NO: 2875938 - protein, 12 aa, Entamoeba invadens
KQPAKKSTVTQQ

SEQ ID NO: 2875939 - protein, 10 aa, Entamoeba invadens
KQPAKKSVVT

SEQ ID NO: 2875940 - protein, 9 aa, Entamoeba invadens
KQPANNAEM

SEQ ID NO: 2875941 - protein, 15 aa, Entamoeba invadens
KQPAPNAQPVQQPQP

SEQ ID NO: 2875942 - protein, 21 aa, Entamoeba invadens
KQPAQTPTGAGQAQNAAESQC

SEQ ID NO: 2875943 - protein, 6 aa, Entamoeba invadens
KQPDEK

SEQ ID NO: 2875944 - protein, 6 aa, Entamoeba invadens
KQPDNK

SEQ ID NO: 2875945 - protein, 15 aa, Entamoeba invadens
KQPDPESFKQSRESF

SEQ ID NO: 2875946 - protein, 7 aa, Entamoeba invadens
KQPDYKD

SEQ ID NO: 2875947 - protein, 54 aa, Entamoeba invadens
KQPENEDKKDEKEVQETKESEDLENSTNSKEDSELTDSEISDSEESESEKKSGL

SEQ ID NO: 2875948 - protein, 23 aa, Entamoeba invadens
KQPERGSDKGSETLQEKEKDVNI

SEQ ID NO: 2875949 - protein, 4 aa, Entamoeba invadens
KQPF

SEQ ID NO: 2875950 - protein, 7 aa, Entamoeba invadens
KQPHRKT

SEQ ID NO: 2875951 - protein, 6 aa, Entamoeba invadens
KQPISF

SEQ ID NO: 2875952 - protein, 9 aa, Entamoeba invadens
KQPKTTTET

SEQ ID NO: 2875953 - protein, 21 aa, Entamoeba invadens
KQPNDTKSSTENVTGKDEPWN

SEQ ID NO: 2875954 - protein, 8 aa, Entamoeba invadens
KQPNYNLP

SEQ ID NO: 2875955 - protein, 13 aa, Entamoeba invadens
KQPPQPPENSTYY

SEQ ID NO: 2875956 - protein, 13 aa, Entamoeba invadens
KQPPTLSHRSSDA

SEQ ID NO: 2875957 - protein, 10 aa, Entamoeba invadens
KQPRPKGVPF

SEQ ID NO: 2875958 - protein, 7 aa, Entamoeba invadens
KQPSGAF

SEQ ID NO: 2875959 - protein, 7 aa, Entamoeba invadens
KQPSLEK

SEQ ID NO: 2875960 - protein, 29 aa, Entamoeba invadens
KQPTDQIKPEPKQEKVDRRERPVQPPAAL

SEQ ID NO: 2875961 - protein, 11 aa, Entamoeba invadens
KQPTESKDKHF

SEQ ID NO: 2875962 - protein, 5 aa, Entamoeba invadens
KQPTF

SEQ ID NO: 2875963 - protein, 5 aa, Entamoeba invadens
KQPTI

SEQ ID NO: 2875964 - protein, 8 aa, Entamoeba invadens
KQPTIQDE

SEQ ID NO: 2875965 - protein, 4 aa, Entamoeba invadens
KQPV

SEQ ID NO: 2875966 - protein, 9 aa, Entamoeba invadens
KQPVPATNG

SEQ ID NO: 2875967 - protein, 12 aa, Entamoeba invadens
KQQAEKVEAGKK

SEQ ID NO: 2875968 - protein, 19 aa, Entamoeba invadens
KQQAGGAPKKRRGGVPSVD

SEQ ID NO: 2875969 - protein, 5 aa, Entamoeba invadens
KQQDE

SEQ ID NO: 2875970 - protein, 7 aa, Entamoeba invadens
KQQDEVK

SEQ ID NO: 2875971 - protein, 15 aa, Entamoeba invadens
KQQDKIDEEIDKQKC

SEQ ID NO: 2875972 - protein, 4 aa, Entamoeba invadens
KQQE

SEQ ID NO: 2875973 - protein, 35 aa, Entamoeba invadens
KQQEALNDQTATRNRQIDDTIKNAKPLVPKEEQIQ

SEQ ID NO: 2875974 - protein, 8 aa, Entamoeba invadens
KQQEEIKQ

SEQ ID NO: 2875975 - protein, 9 aa, Entamoeba invadens
KQQEPTTID

SEQ ID NO: 2875976 - protein, 20 aa, Entamoeba invadens
KQQFEDGFGSNTTLKTAQTR

SEQ ID NO: 2875977 - protein, 8 aa, Entamoeba invadens
KQQIKNDE

SEQ ID NO: 2875978 - protein, 18 aa, Entamoeba invadens
KQQKDEPKEPEIIEPENE

SEQ ID NO: 2875979 - protein, 7 aa, Entamoeba invadens
KQQKENV

SEQ ID NO: 2875980 - protein, 14 aa, Entamoeba invadens
KQQKKEKEEQQEIE

SEQ ID NO: 2875981 - protein, 6 aa, Entamoeba invadens
KQQKMN

SEQ ID NO: 2875982 - protein, 5 aa, Entamoeba invadens
KQQKY

SEQ ID NO: 2875983 - protein, 12 aa, Entamoeba invadens
KQQLTTETGKKF

SEQ ID NO: 2875984 - protein, 6 aa, Entamoeba invadens
KQQMTS

SEQ ID NO: 2875985 - protein, 6 aa, Entamoeba invadens
KQQNAS

SEQ ID NO: 2875986 - protein, 6 aa, Entamoeba invadens
KQQNDM

SEQ ID NO: 2875987 - protein, 7 aa, Entamoeba invadens
KQQNPGY

SEQ ID NO: 2875988 - protein, 7 aa, Entamoeba invadens
KQQPLAK

SEQ ID NO: 2875989 - protein, 18 aa, Entamoeba invadens
KQQPNVGTPQVNYSQPQK

SEQ ID NO: 2875990 - protein, 13 aa, Entamoeba invadens
KQQQQPPQQQQIP

SEQ ID NO: 2875991 - protein, 21 aa, Entamoeba invadens
KQQQRESITEAAKKKETQRLT

SEQ ID NO: 2875992 - protein, 5 aa, Entamoeba invadens
KQQQT

SEQ ID NO: 2875993 - protein, 10 aa, Entamoeba invadens
KQQREEEDLT

SEQ ID NO: 2875994 - protein, 10 aa, Entamoeba invadens
KQQRERGRYV

SEQ ID NO: 2875995 - protein, 6 aa, Entamoeba invadens
KQQRGV

SEQ ID NO: 2875996 - protein, 16 aa, Entamoeba invadens
KQQRTITNLKKKLNKV

SEQ ID NO: 2875997 - protein, 10 aa, Entamoeba invadens
KQQSEDKLPK

SEQ ID NO: 2875998 - protein, 31 aa, Entamoeba invadens
KQQSFTTKEDDDKTQNCDADTNDQTKRFPNA

SEQ ID NO: 2875999 - protein, 11 aa, Entamoeba invadens
KQQTKDAEENP

SEQ ID NO: 2876000 - protein, 9 aa, Entamoeba invadens
KQRAPKPEQ

SEQ ID NO: 2876001 - protein, 6 aa, Entamoeba invadens
KQRDLH

SEQ ID NO: 2876002 - protein, 4 aa, Entamoeba invadens
KQRE

SEQ ID NO: 2876003 - protein, 6 aa, Entamoeba invadens
KQREKY

SEQ ID NO: 2876004 - protein, 7 aa, Entamoeba invadens
KQREQSY

SEQ ID NO: 2876005 - protein, 17 aa, Entamoeba invadens
KQRERTQKKYVPQRTTT

SEQ ID NO: 2876006 - protein, 12 aa, Entamoeba invadens
KQREYSNTGRLR

SEQ ID NO: 2876007 - protein, 13 aa, Entamoeba invadens
KQRGEEKVQKSIE

SEQ ID NO: 2876008 - protein, 6 aa, Entamoeba invadens
KQRGKD

SEQ ID NO: 2876009 - protein, 12 aa, Entamoeba invadens
KQRGSRGDSTGI

SEQ ID NO: 2876010 - protein, 12 aa, Entamoeba invadens
KQRHKQQNTKIR

SEQ ID NO: 2876011 - protein, 14 aa, Entamoeba invadens
KQRHSQKNSGSRSY

SEQ ID NO: 2876012 - protein, 19 aa, Entamoeba invadens
KQRKKGNNCYTKPGAKDTI

SEQ ID NO: 2876013 - protein, 20 aa, Entamoeba invadens
KQRKKGNSYLTNPGAKSNIK

SEQ ID NO: 2876014 - protein, 16 aa, Entamoeba invadens
KQRKKRKTITQPLTET

SEQ ID NO: 2876015 - protein, 6 aa, Entamoeba invadens
KQRKNI

SEQ ID NO: 2876016 - protein, 9 aa, Entamoeba invadens
KQRKQTTIA

SEQ ID NO: 2876017 - protein, 13 aa, Entamoeba invadens
KQRKQTTISETTP

SEQ ID NO: 2876018 - protein, 13 aa, Entamoeba invadens
KQRKQTTVTSTTP

SEQ ID NO: 2876019 - protein, 8 aa, Entamoeba invadens
KQRKTKED

SEQ ID NO: 2876020 - protein, 12 aa, Entamoeba invadens
KQRKTSKKTNTL

SEQ ID NO: 2876021 - protein, 17 aa, Entamoeba invadens
KQRMKAKEEAEKKEKYG

SEQ ID NO: 2876022 - protein, 6 aa, Entamoeba invadens
KQRNEL

SEQ ID NO: 2876023 - protein, 10 aa, Entamoeba invadens
KQRNENSNFD

SEQ ID NO: 2876024 - protein, 8 aa, Entamoeba invadens
KQRNMSKA

SEQ ID NO: 2876025 - protein, 5 aa, Entamoeba invadens
KQRNT

SEQ ID NO: 2876026 - protein, 9 aa, Entamoeba invadens
KQRPDEKLA

SEQ ID NO: 2876027 - protein, 8 aa, Entamoeba invadens
KQRPNTPI

SEQ ID NO: 2876028 - protein, 6 aa, Entamoeba invadens
KQRQKY

SEQ ID NO: 2876029 - protein, 4 aa, Entamoeba invadens
KQRR

SEQ ID NO: 2876030 - protein, 9 aa, Entamoeba invadens
KQRRPTQEN

SEQ ID NO: 2876031 - protein, 13 aa, Entamoeba invadens
KQRRQLRKDEDFK

SEQ ID NO: 2876032 - protein, 6 aa, Entamoeba invadens
KQRRTG

SEQ ID NO: 2876033 - protein, 8 aa, Entamoeba invadens
KQRTDTQT

SEQ ID NO: 2876034 - protein, 5 aa, Entamoeba invadens
KQRTL

SEQ ID NO: 2876035 - protein, 49 aa, Entamoeba invadens
KQRVEEEAKRLQEEKAAQEEEERVEKERREEERLHREEENPKRKKPKEK

SEQ ID NO: 2876036 - protein, 6 aa, Entamoeba invadens
KQRYDD

SEQ ID NO: 2876037 - protein, 65 aa, Entamoeba invadens
KQRYEKSKKVREQVKEDKIQKEEERKKAKYSRRAERKRDELKQESDSLKNPTKKIKFQKKPKKAT

SEQ ID NO: 2876038 - protein, 22 aa, Entamoeba invadens
KQRYNKNKQCYEVKDKNSNTIK

SEQ ID NO: 2876039 - protein, 6 aa, Entamoeba invadens
KQRYPN

SEQ ID NO: 2876040 - protein, 11 aa, Entamoeba invadens
KQSANSRYSRY

SEQ ID NO: 2876041 - protein, 7 aa, Entamoeba invadens
KQSATNR

SEQ ID NO: 2876042 - protein, 4 aa, Entamoeba invadens
KQSD

SEQ ID NO: 2876043 - protein, 8 aa, Entamoeba invadens
KQSDSELT

SEQ ID NO: 2876044 - protein, 25 aa, Entamoeba invadens
KQSDSTDSVSVEQNLQESPKSDKIS

SEQ ID NO: 2876045 - protein, 6 aa, Entamoeba invadens
KQSECE

SEQ ID NO: 2876046 - protein, 7 aa, Entamoeba invadens
KQSEEKI

SEQ ID NO: 2876047 - protein, 9 aa, Entamoeba invadens
KQSELSPDA

SEQ ID NO: 2876048 - protein, 9 aa, Entamoeba invadens
KQSENNGAT

SEQ ID NO: 2876049 - protein, 12 aa, Entamoeba invadens
KQSEQKYSTVDT

SEQ ID NO: 2876050 - protein, 6 aa, Entamoeba invadens
KQSFAN

SEQ ID NO: 2876051 - protein, 6 aa, Entamoeba invadens
KQSFET

SEQ ID NO: 2876052 - protein, 5 aa, Entamoeba invadens
KQSFG

SEQ ID NO: 2876053 - protein, 9 aa, Entamoeba invadens
KQSGATLSG

SEQ ID NO: 2876054 - protein, 15 aa, Entamoeba invadens
KQSGEQVKKDSENLS

SEQ ID NO: 2876055 - protein, 5 aa, Entamoeba invadens
KQSGI

SEQ ID NO: 2876056 - protein, 7 aa, Entamoeba invadens
KQSGIDV

SEQ ID NO: 2876057 - protein, 13 aa, Entamoeba invadens
KQSHRVEKSGCKT

SEQ ID NO: 2876058 - protein, 8 aa, Entamoeba invadens
KQSIENNK

SEQ ID NO: 2876059 - protein, 7 aa, Entamoeba invadens
KQSIERN

SEQ ID NO: 2876060 - protein, 14 aa, Entamoeba invadens
KQSIKGTLNPSEMV

SEQ ID NO: 2876061 - protein, 10 aa, Entamoeba invadens
KQSKAVNKEM

SEQ ID NO: 2876062 - protein, 7 aa, Entamoeba invadens
KQSKEEN

SEQ ID NO: 2876063 - protein, 10 aa, Entamoeba invadens
KQSKEHPEDN

SEQ ID NO: 2876064 - protein, 6 aa, Entamoeba invadens
KQSKEI

SEQ ID NO: 2876065 - protein, 9 aa, Entamoeba invadens
KQSKEKDEK

SEQ ID NO: 2876066 - protein, 5 aa, Entamoeba invadens
KQSKI

SEQ ID NO: 2876067 - protein, 5 aa, Entamoeba invadens
KQSKK

SEQ ID NO: 2876068 - protein, 19 aa, Entamoeba invadens
KQSKKGNNYYTKPGAKDTI

SEQ ID NO: 2876069 - protein, 7 aa, Entamoeba invadens
KQSKNET

SEQ ID NO: 2876070 - protein, 10 aa, Entamoeba invadens
KQSKNLKNEV

SEQ ID NO: 2876071 - protein, 7 aa, Entamoeba invadens
KQSKPIT

SEQ ID NO: 2876072 - protein, 11 aa, Entamoeba invadens
KQSKSVQSSSR

SEQ ID NO: 2876073 - protein, 26 aa, Entamoeba invadens
KQSLHPSKAEFKPSPTLQKSAQSEYI

SEQ ID NO: 2876074 - protein, 10 aa, Entamoeba invadens
KQSLNAAPAL

SEQ ID NO: 2876075 - protein, 24 aa, Entamoeba invadens
KQSNDDGDDESLENEKQSDIQQTE

SEQ ID NO: 2876076 - protein, 6 aa, Entamoeba invadens
KQSNET

SEQ ID NO: 2876077 - protein, 8 aa, Entamoeba invadens
KQSNGGIQ

SEQ ID NO: 2876078 - protein, 7 aa, Entamoeba invadens
KQSNLPQ

SEQ ID NO: 2876079 - protein, 5 aa, Entamoeba invadens
KQSPM

SEQ ID NO: 2876080 - protein, 10 aa, Entamoeba invadens
KQSPQNGIEQ

SEQ ID NO: 2876081 - protein, 10 aa, Entamoeba invadens
KQSQGNAEQF

SEQ ID NO: 2876082 - protein, 10 aa, Entamoeba invadens
KQSQHEKTTI

SEQ ID NO: 2876083 - protein, 9 aa, Entamoeba invadens
KQSQLPSTC

SEQ ID NO: 2876084 - protein, 10 aa, Entamoeba invadens
KQSQNYTPSS

SEQ ID NO: 2876085 - protein, 10 aa, Entamoeba invadens
KQSRGDTTAL

SEQ ID NO: 2876086 - protein, 8 aa, Entamoeba invadens
KQSRKVRA

SEQ ID NO: 2876087 - protein, 14 aa, Entamoeba invadens
KQSRNEKNAKYSDQ

SEQ ID NO: 2876088 - protein, 8 aa, Entamoeba invadens
KQSRRVEA

SEQ ID NO: 2876089 - protein, 4 aa, Entamoeba invadens
KQSS

SEQ ID NO: 2876090 - protein, 5 aa, Entamoeba invadens
KQSSV

SEQ ID NO: 2876091 - protein, 7 aa, Entamoeba invadens
KQSSVPI

SEQ ID NO: 2876092 - protein, 6 aa, Entamoeba invadens
KQSTPF

SEQ ID NO: 2876093 - protein, 6 aa, Entamoeba invadens
KQSVDS

SEQ ID NO: 2876094 - protein, 4 aa, Entamoeba invadens
KQTC

SEQ ID NO: 2876095 - protein, 8 aa, Entamoeba invadens
KQTEEALK

SEQ ID NO: 2876096 - protein, 10 aa, Entamoeba invadens
KQTEKNPNEF

SEQ ID NO: 2876097 - protein, 13 aa, Entamoeba invadens
KQTELQKSLDESK

SEQ ID NO: 2876098 - protein, 9 aa, Entamoeba invadens
KQTETLKKE

SEQ ID NO: 2876099 - protein, 6 aa, Entamoeba invadens
KQTEYE

SEQ ID NO: 2876100 - protein, 9 aa, Entamoeba invadens
KQTFGNNHG

SEQ ID NO: 2876101 - protein, 6 aa, Entamoeba invadens
KQTGKD

SEQ ID NO: 2876102 - protein, 8 aa, Entamoeba invadens
KQTGRKET

SEQ ID NO: 2876103 - protein, 7 aa, Entamoeba invadens
KQTGSSL

SEQ ID NO: 2876104 - protein, 15 aa, Entamoeba invadens
KQTGSTCQSLTVLHW

SEQ ID NO: 2876105 - protein, 4 aa, Entamoeba invadens
KQTH

SEQ ID NO: 2876106 - protein, 6 aa, Entamoeba invadens
KQTIES

SEQ ID NO: 2876107 - protein, 12 aa, Entamoeba invadens
KQTIGMDAPKSG

SEQ ID NO: 2876108 - protein, 7 aa, Entamoeba invadens
KQTKEAM

SEQ ID NO: 2876109 - protein, 9 aa, Entamoeba invadens
KQTKHAEKT

SEQ ID NO: 2876110 - protein, 5 aa, Entamoeba invadens
KQTKK

SEQ ID NO: 2876111 - protein, 10 aa, Entamoeba invadens
KQTKSSKKTI

SEQ ID NO: 2876112 - protein, 4 aa, Entamoeba invadens
KQTL

SEQ ID NO: 2876113 - protein, 49 aa, Entamoeba invadens
KQTLAKPKLPSLGGKRPRDTNSPKSEQEDKIDHSESERSEKRDDDKKEA

SEQ ID NO: 2876114 - protein, 13 aa, Entamoeba invadens
KQTLGELKASEET

SEQ ID NO: 2876115 - protein, 8 aa, Entamoeba invadens
KQTLKEKK

SEQ ID NO: 2876116 - protein, 6 aa, Entamoeba invadens
KQTMQY

SEQ ID NO: 2876117 - protein, 15 aa, Entamoeba invadens
KQTNDKSKSQPMTGT

SEQ ID NO: 2876118 - protein, 7 aa, Entamoeba invadens
KQTNNKI

SEQ ID NO: 2876119 - protein, 7 aa, Entamoeba invadens
KQTNPSD

SEQ ID NO: 2876120 - protein, 5 aa, Entamoeba invadens
KQTNY

SEQ ID NO: 2876121 - protein, 14 aa, Entamoeba invadens
KQTPDENENEEQRK

SEQ ID NO: 2876122 - protein, 8 aa, Entamoeba invadens
KQTPEDHV

SEQ ID NO: 2876123 - protein, 10 aa, Entamoeba invadens
KQTPKVQSNQ

SEQ ID NO: 2876124 - protein, 8 aa, Entamoeba invadens
KQTPLEKS

SEQ ID NO: 2876125 - protein, 14 aa, Entamoeba invadens
KQTPQSTTQKLTTS

SEQ ID NO: 2876126 - protein, 7 aa, Entamoeba invadens
KQTPSSY

SEQ ID NO: 2876127 - protein, 8 aa, Entamoeba invadens
KQTQANEE

SEQ ID NO: 2876128 - protein, 5 aa, Entamoeba invadens
KQTQE

SEQ ID NO: 2876129 - protein, 9 aa, Entamoeba invadens
KQTQPNSSA

SEQ ID NO: 2876130 - protein, 7 aa, Entamoeba invadens
KQTRQWT

SEQ ID NO: 2876131 - protein, 16 aa, Entamoeba invadens
KQTSLFDPKESAPNKL

SEQ ID NO: 2876132 - protein, 10 aa, Entamoeba invadens
KQTSLPAPDL

SEQ ID NO: 2876133 - protein, 7 aa, Entamoeba invadens
KQTTEMK

SEQ ID NO: 2876134 - protein, 6 aa, Entamoeba invadens
KQTTHQ

SEQ ID NO: 2876135 - protein, 12 aa, Entamoeba invadens
KQTTKNQREHLI

SEQ ID NO: 2876136 - protein, 9 aa, Entamoeba invadens
KQTTLPKIG

SEQ ID NO: 2876137 - protein, 14 aa, Entamoeba invadens
KQTTQPIKSSPVVN

SEQ ID NO: 2876138 - protein, 5 aa, Entamoeba invadens
KQTTT

SEQ ID NO: 2876139 - protein, 27 aa, Entamoeba invadens
KQTTTPKTTPKPRPKLPKRAQPPIPPL

SEQ ID NO: 2876140 - protein, 8 aa, Entamoeba invadens
KQTTVEAG

SEQ ID NO: 2876141 - protein, 6 aa, Entamoeba invadens
KQTTYN

SEQ ID NO: 2876142 - protein, 12 aa, Entamoeba invadens
KQTYCTEVDIIS

SEQ ID NO: 2876143 - protein, 14 aa, Entamoeba invadens
KQTYKTNTIKSTLD

SEQ ID NO: 2876144 - protein, 6 aa, Entamoeba invadens
KQVADA

SEQ ID NO: 2876145 - protein, 10 aa, Entamoeba invadens
KQVDKEDVYV

SEQ ID NO: 2876146 - protein, 12 aa, Entamoeba invadens
KQVDQHRDMSDK

SEQ ID NO: 2876147 - protein, 4 aa, Entamoeba invadens
KQVE

SEQ ID NO: 2876148 - protein, 12 aa, Entamoeba invadens
KQVENKKRELST

SEQ ID NO: 2876149 - protein, 6 aa, Entamoeba invadens
KQVEPV

SEQ ID NO: 2876150 - protein, 18 aa, Entamoeba invadens
KQVERKDEKIEEKAQDEK

SEQ ID NO: 2876151 - protein, 8 aa, Entamoeba invadens
KQVNETSP

SEQ ID NO: 2876152 - protein, 9 aa, Entamoeba invadens
KQVNSAPWP

SEQ ID NO: 2876153 - protein, 10 aa, Entamoeba invadens
KQVPKEKKDS

SEQ ID NO: 2876154 - protein, 23 aa, Entamoeba invadens
KQVPSLKTPKRRAAPLAKSPRTQ

SEQ ID NO: 2876155 - protein, 5 aa, Entamoeba invadens
KQVPT

SEQ ID NO: 2876156 - protein, 6 aa, Entamoeba invadens
KQVTYN

SEQ ID NO: 2876157 - protein, 4 aa, Entamoeba invadens
KQYD

SEQ ID NO: 2876158 - protein, 4 aa, Entamoeba invadens
KQYE

SEQ ID NO: 2876159 - protein, 9 aa, Entamoeba invadens
KQYEEEGYG

SEQ ID NO: 2876160 - protein, 8 aa, Entamoeba invadens
KQYEKAAD

SEQ ID NO: 2876161 - protein, 42 aa, Entamoeba invadens
KQYENDSPEINDTTNIENTKEEVSSDKITNQTIGEKKVEEEI

SEQ ID NO: 2876162 - protein, 7 aa, Entamoeba invadens
KQYESTC

SEQ ID NO: 2876163 - protein, 6 aa, Entamoeba invadens
KQYETF

SEQ ID NO: 2876164 - protein, 4 aa, Entamoeba invadens
KQYF

SEQ ID NO: 2876165 - protein, 7 aa, Entamoeba invadens
KQYGEQT

SEQ ID NO: 2876166 - protein, 5 aa, Entamoeba invadens
KQYGK

SEQ ID NO: 2876167 - protein, 6 aa, Entamoeba invadens
KQYGKM

SEQ ID NO: 2876168 - protein, 11 aa, Entamoeba invadens
KQYKKEIEEEE

SEQ ID NO: 2876169 - protein, 6 aa, Entamoeba invadens
KQYNNA

SEQ ID NO: 2876170 - protein, 5 aa, Entamoeba invadens
KQYNT

SEQ ID NO: 2876171 - protein, 6 aa, Entamoeba invadens
KQYTIG

SEQ ID NO: 2876172 - protein, 5 aa, Entamoeba invadens
KQYTL

SEQ ID NO: 2876173 - protein, 5 aa, Entamoeba invadens
KRAAA

SEQ ID NO: 2876174 - protein, 9 aa, Entamoeba invadens
KRACGESTP

SEQ ID NO: 2876175 - protein, 12 aa, Entamoeba invadens
KRADAAAALATT

SEQ ID NO: 2876176 - protein, 5 aa, Entamoeba invadens
KRADG

SEQ ID NO: 2876177 - protein, 7 aa, Entamoeba invadens
KRAEGML

SEQ ID NO: 2876178 - protein, 19 aa, Entamoeba invadens
KRAEKETSVQTKKKTEVKL

SEQ ID NO: 2876179 - protein, 9 aa, Entamoeba invadens
KRAEKSPVV

SEQ ID NO: 2876180 - protein, 6 aa, Entamoeba invadens
KRAELE

SEQ ID NO: 2876181 - protein, 10 aa, Entamoeba invadens
KRAENDDSPF

SEQ ID NO: 2876182 - protein, 9 aa, Entamoeba invadens
KRAGAPPYI

SEQ ID NO: 2876183 - protein, 8 aa, Entamoeba invadens
KRAGESGV

SEQ ID NO: 2876184 - protein, 10 aa, Entamoeba invadens
KRAKERQNVD

SEQ ID NO: 2876185 - protein, 10 aa, Entamoeba invadens
KRAKGERTVD

SEQ ID NO: 2876186 - protein, 7 aa, Entamoeba invadens
KRAKGKN

SEQ ID NO: 2876187 - protein, 27 aa, Entamoeba invadens
KRAKKKEESLKKAEKLKANELEYRRTP

SEQ ID NO: 2876188 - protein, 15 aa, Entamoeba invadens
KRANEEIKKAKESLT

SEQ ID NO: 2876189 - protein, 19 aa, Entamoeba invadens
KRANKKNTPQVPLQKQTTK

SEQ ID NO: 2876190 - protein, 8 aa, Entamoeba invadens
KRAREALT

SEQ ID NO: 2876191 - protein, 15 aa, Entamoeba invadens
KRARSIENRKNSFYA

SEQ ID NO: 2876192 - protein, 12 aa, Entamoeba invadens
KRASADRDAAQQ

SEQ ID NO: 2876193 - protein, 8 aa, Entamoeba invadens
KRASAQTA

SEQ ID NO: 2876194 - protein, 12 aa, Entamoeba invadens
KRASVERDAAQQ

SEQ ID NO: 2876195 - protein, 4 aa, Entamoeba invadens
KRAT

SEQ ID NO: 2876196 - protein, 9 aa, Entamoeba invadens
KRAYDKGEY

SEQ ID NO: 2876197 - protein, 9 aa, Entamoeba invadens
KRCETAENK

SEQ ID NO: 2876198 - protein, 7 aa, Entamoeba invadens
KRCGDKK

SEQ ID NO: 2876199 - protein, 7 aa, Entamoeba invadens
KRCSEME

SEQ ID NO: 2876200 - protein, 6 aa, Entamoeba invadens
KRCSPC

SEQ ID NO: 2876201 - protein, 7 aa, Entamoeba invadens
KRCSPCS

SEQ ID NO: 2876202 - protein, 7 aa, Entamoeba invadens
KRCSVKE

SEQ ID NO: 2876203 - protein, 7 aa, Entamoeba invadens
KRCTGRL

SEQ ID NO: 2876204 - protein, 7 aa, Entamoeba invadens
KRCTHQR

SEQ ID NO: 2876205 - protein, 10 aa, Entamoeba invadens
KRDAQEGYRT

SEQ ID NO: 2876206 - protein, 15 aa, Entamoeba invadens
KRDDKKCSDGTTNTQ

SEQ ID NO: 2876207 - protein, 7 aa, Entamoeba invadens
KRDDQSQ

SEQ ID NO: 2876208 - protein, 7 aa, Entamoeba invadens
KRDEADV

SEQ ID NO: 2876209 - protein, 18 aa, Entamoeba invadens
KRDEEIRKAKGKKYYEAK

SEQ ID NO: 2876210 - protein, 17 aa, Entamoeba invadens
KRDEEIRKARGKKYYEA

SEQ ID NO: 2876211 - protein, 12 aa, Entamoeba invadens
KRDEEPLSPEEL

SEQ ID NO: 2876212 - protein, 19 aa, Entamoeba invadens
KRDEEWEDAPITKKKAGKV

SEQ ID NO: 2876213 - protein, 17 aa, Entamoeba invadens
KRDFKNDRNKGKGQRRG

SEQ ID NO: 2876214 - protein, 10 aa, Entamoeba invadens
KRDGKDTFTC

SEQ ID NO: 2876215 - protein, 5 aa, Entamoeba invadens
KRDGL

SEQ ID NO: 2876216 - protein, 9 aa, Entamoeba invadens
KRDGRLEKF

SEQ ID NO: 2876217 - protein, 5 aa, Entamoeba invadens
KRDGW

SEQ ID NO: 2876218 - protein, 7 aa, Entamoeba invadens
KRDIEPH

SEQ ID NO: 2876219 - protein, 8 aa, Entamoeba invadens
KRDITSKA

SEQ ID NO: 2876220 - protein, 5 aa, Entamoeba invadens
KRDKY

SEQ ID NO: 2876221 - protein, 7 aa, Entamoeba invadens
KRDLNTQ

SEQ ID NO: 2876222 - protein, 6 aa, Entamoeba invadens
KRDLRR

SEQ ID NO: 2876223 - protein, 14 aa, Entamoeba invadens
KRDLSGNSITPDRI

SEQ ID NO: 2876224 - protein, 6 aa, Entamoeba invadens
KRDPEN

SEQ ID NO: 2876225 - protein, 6 aa, Entamoeba invadens
KRDPHR

SEQ ID NO: 2876226 - protein, 9 aa, Entamoeba invadens
KRDPKRADK

SEQ ID NO: 2876227 - protein, 6 aa, Entamoeba invadens
KRDPNR

SEQ ID NO: 2876228 - protein, 11 aa, Entamoeba invadens
KRDRGSKKEVN

SEQ ID NO: 2876229 - protein, 9 aa, Entamoeba invadens
KRDRVPSRV

SEQ ID NO: 2876230 - protein, 10 aa, Entamoeba invadens
KRDSSDDDDF

SEQ ID NO: 2876231 - protein, 10 aa, Entamoeba invadens
KRDSSDDNDF

SEQ ID NO: 2876232 - protein, 7 aa, Entamoeba invadens
KRDTNVS

SEQ ID NO: 2876233 - protein, 29 aa, Entamoeba invadens
KRDTSQRSRSRSRERNESRRWGEDERNSF

SEQ ID NO: 2876234 - protein, 8 aa, Entamoeba invadens
KREAAEKA

SEQ ID NO: 2876235 - protein, 11 aa, Entamoeba invadens
KREAEVAQKEK

SEQ ID NO: 2876236 - protein, 12 aa, Entamoeba invadens
KREANPKEFESQ

SEQ ID NO: 2876237 - protein, 28 aa, Entamoeba invadens
KREARKKKRALKGVDKESDLENSEEENM

SEQ ID NO: 2876238 - protein, 14 aa, Entamoeba invadens
KRECDGVKDEIKDD

SEQ ID NO: 2876239 - protein, 15 aa, Entamoeba invadens
KRECERNEKSPLKKC

SEQ ID NO: 2876240 - protein, 14 aa, Entamoeba invadens
KREDDNSGRAHSTR

SEQ ID NO: 2876241 - protein, 8 aa, Entamoeba invadens
KREDGLNP

SEQ ID NO: 2876242 - protein, 8 aa, Entamoeba invadens
KREDPPEL

SEQ ID NO: 2876243 - protein, 6 aa, Entamoeba invadens
KREDSF

SEQ ID NO: 2876244 - protein, 11 aa, Entamoeba invadens
KREEEEKDEEE

SEQ ID NO: 2876245 - protein, 7 aa, Entamoeba invadens
KREEERC

SEQ ID NO: 2876246 - protein, 8 aa, Entamoeba invadens
KREEGKKT

SEQ ID NO: 2876247 - protein, 6 aa, Entamoeba invadens
KREEIS

SEQ ID NO: 2876248 - protein, 14 aa, Entamoeba invadens
KREEKKQEEQSEST

SEQ ID NO: 2876249 - protein, 9 aa, Entamoeba invadens
KREENMKKE

SEQ ID NO: 2876250 - protein, 5 aa, Entamoeba invadens
KREEQ

SEQ ID NO: 2876251 - protein, 18 aa, Entamoeba invadens
KREESKPRSPSVNTPTHS

SEQ ID NO: 2876252 - protein, 7 aa, Entamoeba invadens
KREGDDL

SEQ ID NO: 2876253 - protein, 15 aa, Entamoeba invadens
KREGEKDEKDEKEDQ

SEQ ID NO: 2876254 - protein, 6 aa, Entamoeba invadens
KREGKK

SEQ ID NO: 2876255 - protein, 25 aa, Entamoeba invadens
KREHAEEVERVEEEKRNAEERGEAY

SEQ ID NO: 2876256 - protein, 6 aa, Entamoeba invadens
KREHPS

SEQ ID NO: 2876257 - protein, 4 aa, Entamoeba invadens
KREI

SEQ ID NO: 2876258 - protein, 35 aa, Entamoeba invadens
KREIEEAKAKAELEKQKAEAERVRLENEKKRIEAE

SEQ ID NO: 2876259 - protein, 13 aa, Entamoeba invadens
KREIETTNTETQI

SEQ ID NO: 2876260 - protein, 9 aa, Entamoeba invadens
KREIETTNV

SEQ ID NO: 2876261 - protein, 6 aa, Entamoeba invadens
KREIKH

SEQ ID NO: 2876262 - protein, 8 aa, Entamoeba invadens
KREKGVRS

SEQ ID NO: 2876263 - protein, 58 aa, Entamoeba invadens
KRELEKEKHKTRRPHTRTSTKDKTEEKNAMKPVPSNTSPKARKRRTRKTTQKSKLDDV

SEQ ID NO: 2876264 - protein, 4 aa, Entamoeba invadens
KREM

SEQ ID NO: 2876265 - protein, 5 aa, Entamoeba invadens
KREMK

SEQ ID NO: 2876266 - protein, 5 aa, Entamoeba invadens
KRENE

SEQ ID NO: 2876267 - protein, 5 aa, Entamoeba invadens
KRENN

SEQ ID NO: 2876268 - protein, 8 aa, Entamoeba invadens
KRENPKKY

SEQ ID NO: 2876269 - protein, 10 aa, Entamoeba invadens
KRENSINEKL

SEQ ID NO: 2876270 - protein, 5 aa, Entamoeba invadens
KRENT

SEQ ID NO: 2876271 - protein, 6 aa, Entamoeba invadens
KREPNI

SEQ ID NO: 2876272 - protein, 19 aa, Entamoeba invadens
KREPTDTSVPITKQQADFK

SEQ ID NO: 2876273 - protein, 12 aa, Entamoeba invadens
KREPVSVNPPVS

SEQ ID NO: 2876274 - protein, 7 aa, Entamoeba invadens
KREQPES

SEQ ID NO: 2876275 - protein, 13 aa, Entamoeba invadens
KREQSGADTMKGI

SEQ ID NO: 2876276 - protein, 5 aa, Entamoeba invadens
KREQV

SEQ ID NO: 2876277 - protein, 6 aa, Entamoeba invadens
KREQYR

SEQ ID NO: 2876278 - protein, 10 aa, Entamoeba invadens
KREREEKQRK

SEQ ID NO: 2876279 - protein, 11 aa, Entamoeba invadens
KRERGAKKEMN

SEQ ID NO: 2876280 - protein, 18 aa, Entamoeba invadens
KRESEGPTEKEIQDFNDV

SEQ ID NO: 2876281 - protein, 9 aa, Entamoeba invadens
KRESETNNR

SEQ ID NO: 2876282 - protein, 8 aa, Entamoeba invadens
KRESGAFR

SEQ ID NO: 2876283 - protein, 12 aa, Entamoeba invadens
KRESRDEEATLA

SEQ ID NO: 2876284 - protein, 6 aa, Entamoeba invadens
KRESRE

SEQ ID NO: 2876285 - protein, 10 aa, Entamoeba invadens
KRESTNREHL

SEQ ID NO: 2876286 - protein, 7 aa, Entamoeba invadens
KRETDDL

SEQ ID NO: 2876287 - protein, 6 aa, Entamoeba invadens
KRETGT

SEQ ID NO: 2876288 - protein, 5 aa, Entamoeba invadens
KRETL

SEQ ID NO: 2876289 - protein, 7 aa, Entamoeba invadens
KRETPSV

SEQ ID NO: 2876290 - protein, 6 aa, Entamoeba invadens
KRETPV

SEQ ID NO: 2876291 - protein, 8 aa, Entamoeba invadens
KRETTEWS

SEQ ID NO: 2876292 - protein, 23 aa, Entamoeba invadens
KRETTSEADSKASLEESINNQKS

SEQ ID NO: 2876293 - protein, 21 aa, Entamoeba invadens
KREVHEKTEQPEINDTKQIYE

SEQ ID NO: 2876294 - protein, 5 aa, Entamoeba invadens
KREVK

SEQ ID NO: 2876295 - protein, 13 aa, Entamoeba invadens
KREYDNSACYGKS

SEQ ID NO: 2876296 - protein, 15 aa, Entamoeba invadens
KREYEEKGSAIYESK

SEQ ID NO: 2876297 - protein, 18 aa, Entamoeba invadens
KREYYAKQKSDTKNYESI

SEQ ID NO: 2876298 - protein, 13 aa, Entamoeba invadens
KRFDNPKKETIQE

SEQ ID NO: 2876299 - protein, 5 aa, Entamoeba invadens
KRFEK

SEQ ID NO: 2876300 - protein, 24 aa, Entamoeba invadens
KRFETAKKEIAKKNPVLEKDEKIQ

SEQ ID NO: 2876301 - protein, 5 aa, Entamoeba invadens
KRFNE

SEQ ID NO: 2876302 - protein, 4 aa, Entamoeba invadens
KRFP

SEQ ID NO: 2876303 - protein, 36 aa, Entamoeba invadens
KRFPRRKPTQNNDEKKTEESKPRPPEKDEKEQTKVR

SEQ ID NO: 2876304 - protein, 14 aa, Entamoeba invadens
KRFSNAPKNGDAAE

SEQ ID NO: 2876305 - protein, 6 aa, Entamoeba invadens
KRGCDR

SEQ ID NO: 2876306 - protein, 8 aa, Entamoeba invadens
KRGDISES

SEQ ID NO: 2876307 - protein, 12 aa, Entamoeba invadens
KRGDKNIIIEYV

SEQ ID NO: 2876308 - protein, 7 aa, Entamoeba invadens
KRGDNAE

SEQ ID NO: 2876309 - protein, 4 aa, Entamoeba invadens
KRGE

SEQ ID NO: 2876310 - protein, 15 aa, Entamoeba invadens
KRGEANEASNTGDLE

SEQ ID NO: 2876311 - protein, 6 aa, Entamoeba invadens
KRGEGD

SEQ ID NO: 2876312 - protein, 16 aa, Entamoeba invadens
KRGEGGKGRYRLYIQN

SEQ ID NO: 2876313 - protein, 61 aa, Entamoeba invadens
KRGEISTGTPAYQSLQQSDGIEKQNDSKPIHRETKPEKKTKTKKKTIKETVSGSEDSDSEI

SEQ ID NO: 2876314 - protein, 12 aa, Entamoeba invadens
KRGESVSGDIPM

SEQ ID NO: 2876315 - protein, 24 aa, Entamoeba invadens
KRGETPKPHNSKETNEVEPTKCTL

SEQ ID NO: 2876316 - protein, 13 aa, Entamoeba invadens
KRGFTTKVGASEA

SEQ ID NO: 2876317 - protein, 7 aa, Entamoeba invadens
KRGGEKD

SEQ ID NO: 2876318 - protein, 18 aa, Entamoeba invadens
KRGGKRGGRGRPAAPVRQ

SEQ ID NO: 2876319 - protein, 6 aa, Entamoeba invadens
KRGGMD

SEQ ID NO: 2876320 - protein, 7 aa, Entamoeba invadens
KRGGQPM

SEQ ID NO: 2876321 - protein, 60 aa, Entamoeba invadens
KRGHSSRHCPDHGRDSRSHSRSRSRSRSSRRSHRDRRSRSRSPRNHSRSYRKRSHSRDSR

SEQ ID NO: 2876322 - protein, 4 aa, Entamoeba invadens
KRGK

SEQ ID NO: 2876323 - protein, 5 aa, Entamoeba invadens
KRGKA

SEQ ID NO: 2876324 - protein, 20 aa, Entamoeba invadens
KRGKEDLSKRSLKPKKTIQR

SEQ ID NO: 2876325 - protein, 9 aa, Entamoeba invadens
KRGKESNQS

SEQ ID NO: 2876326 - protein, 11 aa, Entamoeba invadens
KRGKTDPDEEI

SEQ ID NO: 2876327 - protein, 7 aa, Entamoeba invadens
KRGKTTA

SEQ ID NO: 2876328 - protein, 37 aa, Entamoeba invadens
KRGLGKDVNKTSNESKKETKLEEIDDGEELATIAEKD

SEQ ID NO: 2876329 - protein, 10 aa, Entamoeba invadens
KRGNLSAKEI

SEQ ID NO: 2876330 - protein, 9 aa, Entamoeba invadens
KRGNLTARE

SEQ ID NO: 2876331 - protein, 6 aa, Entamoeba invadens
KRGPTD

SEQ ID NO: 2876332 - protein, 8 aa, Entamoeba invadens
KRGPTRRQ

SEQ ID NO: 2876333 - protein, 7 aa, Entamoeba invadens
KRGPVER

SEQ ID NO: 2876334 - protein, 8 aa, Entamoeba invadens
KRGRESVM

SEQ ID NO: 2876335 - protein, 13 aa, Entamoeba invadens
KRGRKRTENRSMQ

SEQ ID NO: 2876336 - protein, 12 aa, Entamoeba invadens
KRGRKSFFNNPN

SEQ ID NO: 2876337 - protein, 14 aa, Entamoeba invadens
KRGRSGSNGPNQRI

SEQ ID NO: 2876338 - protein, 32 aa, Entamoeba invadens
KRGRSKKTEKSDVDRSRSMSGSGGAHPNKPIN

SEQ ID NO: 2876339 - protein, 6 aa, Entamoeba invadens
KRGSAF

SEQ ID NO: 2876340 - protein, 5 aa, Entamoeba invadens
KRGSE

SEQ ID NO: 2876341 - protein, 7 aa, Entamoeba invadens
KRGSEMN

SEQ ID NO: 2876342 - protein, 11 aa, Entamoeba invadens
KRGSKTHLPSK

SEQ ID NO: 2876343 - protein, 18 aa, Entamoeba invadens
KRGTKRTISRSISALPQQ

SEQ ID NO: 2876344 - protein, 4 aa, Entamoeba invadens
KRGV

SEQ ID NO: 2876345 - protein, 5 aa, Entamoeba invadens
KRGYE

SEQ ID NO: 2876346 - protein, 5 aa, Entamoeba invadens
KRHIG

SEQ ID NO: 2876347 - protein, 12 aa, Entamoeba invadens
KRHNSGSTTRRL

SEQ ID NO: 2876348 - protein, 12 aa, Entamoeba invadens
KRHRDANKTATS

SEQ ID NO: 2876349 - protein, 12 aa, Entamoeba invadens
KRHRDANKTSTS

SEQ ID NO: 2876350 - protein, 6 aa, Entamoeba invadens
KRHSSG

SEQ ID NO: 2876351 - protein, 39 aa, Entamoeba invadens
KRHSTNSTSNDTQEDGTSSSSDSPREGKRSVSETRKGMS

SEQ ID NO: 2876352 - protein, 39 aa, Entamoeba invadens
KRHSVPNQTETQTLSEETKGLYTPQLGGDSMSTDSDTHI

SEQ ID NO: 2876353 - protein, 21 aa, Entamoeba invadens
KRHTPKGVEQVKNFRQKKDIL

SEQ ID NO: 2876354 - protein, 13 aa, Entamoeba invadens
KRIAELKPHKSGV

SEQ ID NO: 2876355 - protein, 5 aa, Entamoeba invadens
KRIAQ

SEQ ID NO: 2876356 - protein, 5 aa, Entamoeba invadens
KRIDG

SEQ ID NO: 2876357 - protein, 12 aa, Entamoeba invadens
KRIDSTTIVNFF

SEQ ID NO: 2876358 - protein, 6 aa, Entamoeba invadens
KRIEDV

SEQ ID NO: 2876359 - protein, 5 aa, Entamoeba invadens
KRIES

SEQ ID NO: 2876360 - protein, 40 aa, Entamoeba invadens
KRIETQQPTQQKDKDLHEDKEPLDDKEDDDEKEEKDEKEQ

SEQ ID NO: 2876361 - protein, 6 aa, Entamoeba invadens
KRIKDI

SEQ ID NO: 2876362 - protein, 9 aa, Entamoeba invadens
KRIKKAGGF

SEQ ID NO: 2876363 - protein, 8 aa, Entamoeba invadens
KRINESKF

SEQ ID NO: 2876364 - protein, 4 aa, Entamoeba invadens
KRIP

SEQ ID NO: 2876365 - protein, 6 aa, Entamoeba invadens
KRIPES

SEQ ID NO: 2876366 - protein, 25 aa, Entamoeba invadens
KRIRDESTVDFKEDKEAVDDINEDE

SEQ ID NO: 2876367 - protein, 21 aa, Entamoeba invadens
KRISEDVSEDLGLNADDELPP

SEQ ID NO: 2876368 - protein, 6 aa, Entamoeba invadens
KRITAA

SEQ ID NO: 2876369 - protein, 7 aa, Entamoeba invadens
KRITPQQ

SEQ ID NO: 2876370 - protein, 7 aa, Entamoeba invadens
KRITRDP

SEQ ID NO: 2876371 - protein, 7 aa, Entamoeba invadens
KRITRDS

SEQ ID NO: 2876372 - protein, 5 aa, Entamoeba invadens
KRKAE

SEQ ID NO: 2876373 - protein, 8 aa, Entamoeba invadens
KRKAEKMY

SEQ ID NO: 2876374 - protein, 6 aa, Entamoeba invadens
KRKAGA

SEQ ID NO: 2876375 - protein, 13 aa, Entamoeba invadens
KRKAGFADEEEER

SEQ ID NO: 2876376 - protein, 7 aa, Entamoeba invadens
KRKAKPI

SEQ ID NO: 2876377 - protein, 61 aa, Entamoeba invadens
KRKALNPPKKKKVVEKVGKDEKKSSVIPTDFTKTEKNVVNSTIKEPIDKCSEEHKTTRKPL

SEQ ID NO: 2876378 - protein, 13 aa, Entamoeba invadens
KRKDDINRGGYNL

SEQ ID NO: 2876379 - protein, 4 aa, Entamoeba invadens
KRKE

SEQ ID NO: 2876380 - protein, 10 aa, Entamoeba invadens
KRKEEDMEKL

SEQ ID NO: 2876381 - protein, 12 aa, Entamoeba invadens
KRKEELDKREHE

SEQ ID NO: 2876382 - protein, 19 aa, Entamoeba invadens
KRKEEMQQKDVKAENNTQS

SEQ ID NO: 2876383 - protein, 59 aa, Entamoeba invadens
KRKEENPKKRKKTAKKTKKTKKAVMGGDVESEEEVDDNDEEEEVKTVKKKKTKKKVNKK

SEQ ID NO: 2876384 - protein, 13 aa, Entamoeba invadens
KRKEEVTAGDEPF

SEQ ID NO: 2876385 - protein, 6 aa, Entamoeba invadens
KRKELN

SEQ ID NO: 2876386 - protein, 6 aa, Entamoeba invadens
KRKENI

SEQ ID NO: 2876387 - protein, 7 aa, Entamoeba invadens
KRKEQVI

SEQ ID NO: 2876388 - protein, 12 aa, Entamoeba invadens
KRKERADANEAI

SEQ ID NO: 2876389 - protein, 10 aa, Entamoeba invadens
KRKERADATE

SEQ ID NO: 2876390 - protein, 13 aa, Entamoeba invadens
KRKERERSNSRNR

SEQ ID NO: 2876391 - protein, 12 aa, Entamoeba invadens
KRKESIRPIPQR

SEQ ID NO: 2876392 - protein, 5 aa, Entamoeba invadens
KRKEV

SEQ ID NO: 2876393 - protein, 6 aa, Entamoeba invadens
KRKEYE

SEQ ID NO: 2876394 - protein, 6 aa, Entamoeba invadens
KRKEYR

SEQ ID NO: 2876395 - protein, 16 aa, Entamoeba invadens
KRKGPKASPPFPPTSY

SEQ ID NO: 2876396 - protein, 17 aa, Entamoeba invadens
KRKGQKVQKYVGSSAQD

SEQ ID NO: 2876397 - protein, 6 aa, Entamoeba invadens
KRKGTI

SEQ ID NO: 2876398 - protein, 6 aa, Entamoeba invadens
KRKITQ

SEQ ID NO: 2876399 - protein, 10 aa, Entamoeba invadens
KRKKEEEIAR

SEQ ID NO: 2876400 - protein, 8 aa, Entamoeba invadens
KRKKKGKS

SEQ ID NO: 2876401 - protein, 10 aa, Entamoeba invadens
KRKKKGKSVS

SEQ ID NO: 2876402 - protein, 20 aa, Entamoeba invadens
KRKKLEDKRGEVTKSINYQN

SEQ ID NO: 2876403 - protein, 22 aa, Entamoeba invadens
KRKKLVKKGAKDESEAQKDKKV

SEQ ID NO: 2876404 - protein, 17 aa, Entamoeba invadens
KRKKNKKDILSPQQQAK

SEQ ID NO: 2876405 - protein, 21 aa, Entamoeba invadens
KRKKRFEEQTLETSKQKVEVA

SEQ ID NO: 2876406 - protein, 18 aa, Entamoeba invadens
KRKKTKKNKSLSPHCQQE

SEQ ID NO: 2876407 - protein, 6 aa, Entamoeba invadens
KRKKVI

SEQ ID NO: 2876408 - protein, 9 aa, Entamoeba invadens
KRKKYDPKR

SEQ ID NO: 2876409 - protein, 18 aa, Entamoeba invadens
KRKLDHKNRITNSTKVPH

SEQ ID NO: 2876410 - protein, 9 aa, Entamoeba invadens
KRKLQSAGT

SEQ ID NO: 2876411 - protein, 14 aa, Entamoeba invadens
KRKMTENVVKGGST

SEQ ID NO: 2876412 - protein, 9 aa, Entamoeba invadens
KRKNENSPV

SEQ ID NO: 2876413 - protein, 5 aa, Entamoeba invadens
KRKNF

SEQ ID NO: 2876414 - protein, 10 aa, Entamoeba invadens
KRKNKNREAA

SEQ ID NO: 2876415 - protein, 5 aa, Entamoeba invadens
KRKNS

SEQ ID NO: 2876416 - protein, 7 aa, Entamoeba invadens
KRKNSNV

SEQ ID NO: 2876417 - protein, 14 aa, Entamoeba invadens
KRKPDDTPSTTTLP

SEQ ID NO: 2876418 - protein, 18 aa, Entamoeba invadens
KRKPHRRTSSVEVSRDYE

SEQ ID NO: 2876419 - protein, 5 aa, Entamoeba invadens
KRKPW

SEQ ID NO: 2876420 - protein, 4 aa, Entamoeba invadens
KRKQ

SEQ ID NO: 2876421 - protein, 4 aa, Entamoeba invadens
KRKR

SEQ ID NO: 2876422 - protein, 9 aa, Entamoeba invadens
KRKREEYDQ

SEQ ID NO: 2876423 - protein, 7 aa, Entamoeba invadens
KRKRGSY

SEQ ID NO: 2876424 - protein, 10 aa, Entamoeba invadens
KRKRKELKLK

SEQ ID NO: 2876425 - protein, 7 aa, Entamoeba invadens
KRKRPIR

SEQ ID NO: 2876426 - protein, 9 aa, Entamoeba invadens
KRKSDAKKH

SEQ ID NO: 2876427 - protein, 8 aa, Entamoeba invadens
KRKSGEIK

SEQ ID NO: 2876428 - protein, 20 aa, Entamoeba invadens
KRKSGTSYSLPRKSPTSNFV

SEQ ID NO: 2876429 - protein, 7 aa, Entamoeba invadens
KRKSKVT

SEQ ID NO: 2876430 - protein, 16 aa, Entamoeba invadens
KRKSPKLSQSTSDVAE

SEQ ID NO: 2876431 - protein, 9 aa, Entamoeba invadens
KRKSSSPDF

SEQ ID NO: 2876432 - protein, 12 aa, Entamoeba invadens
KRKSVQKTKTWR

SEQ ID NO: 2876433 - protein, 8 aa, Entamoeba invadens
KRKSVTEK

SEQ ID NO: 2876434 - protein, 11 aa, Entamoeba invadens
KRKTKSEEFTN

SEQ ID NO: 2876435 - protein, 8 aa, Entamoeba invadens
KRKTLAPA

SEQ ID NO: 2876436 - protein, 10 aa, Entamoeba invadens
KRKTRASDTA

SEQ ID NO: 2876437 - protein, 11 aa, Entamoeba invadens
KRKVAKDMKTD

SEQ ID NO: 2876438 - protein, 33 aa, Entamoeba invadens
KRKVEAKEQAREAAKAKKLAAKGVTPATNNTEK

SEQ ID NO: 2876439 - protein, 6 aa, Entamoeba invadens
KRKVGT

SEQ ID NO: 2876440 - protein, 15 aa, Entamoeba invadens
KRKVKTDGDVTNDRS

SEQ ID NO: 2876441 - protein, 5 aa, Entamoeba invadens
KRKYD

SEQ ID NO: 2876442 - protein, 16 aa, Entamoeba invadens
KRLAEREPKVKENPKT

SEQ ID NO: 2876443 - protein, 12 aa, Entamoeba invadens
KRLDKKENMSDK

SEQ ID NO: 2876444 - protein, 4 aa, Entamoeba invadens
KRLE

SEQ ID NO: 2876445 - protein, 13 aa, Entamoeba invadens
KRLEEEEKKIEAE

SEQ ID NO: 2876446 - protein, 6 aa, Entamoeba invadens
KRLEKR

SEQ ID NO: 2876447 - protein, 13 aa, Entamoeba invadens
KRLENGEKETVKK

SEQ ID NO: 2876448 - protein, 11 aa, Entamoeba invadens
KRLERRENIPK

SEQ ID NO: 2876449 - protein, 5 aa, Entamoeba invadens
KRLGL

SEQ ID NO: 2876450 - protein, 9 aa, Entamoeba invadens
KRLKDEEFK

SEQ ID NO: 2876451 - protein, 11 aa, Entamoeba invadens
KRLKSKPLKQL

SEQ ID NO: 2876452 - protein, 7 aa, Entamoeba invadens
KRLKTSH

SEQ ID NO: 2876453 - protein, 8 aa, Entamoeba invadens
KRLPETLT

SEQ ID NO: 2876454 - protein, 12 aa, Entamoeba invadens
KRLPKEESITQD

SEQ ID NO: 2876455 - protein, 12 aa, Entamoeba invadens
KRLPKKESITQD

SEQ ID NO: 2876456 - protein, 7 aa, Entamoeba invadens
KRLPKNE

SEQ ID NO: 2876457 - protein, 6 aa, Entamoeba invadens
KRLPTT

SEQ ID NO: 2876458 - protein, 28 aa, Entamoeba invadens
KRLQETKRGVKKTSGWTEDGFSASVTAE

SEQ ID NO: 2876459 - protein, 4 aa, Entamoeba invadens
KRLR

SEQ ID NO: 2876460 - protein, 5 aa, Entamoeba invadens
KRLRP

SEQ ID NO: 2876461 - protein, 6 aa, Entamoeba invadens
KRLSGS

SEQ ID NO: 2876462 - protein, 6 aa, Entamoeba invadens
KRLSIS

SEQ ID NO: 2876463 - protein, 7 aa, Entamoeba invadens
KRLSSGN

SEQ ID NO: 2876464 - protein, 14 aa, Entamoeba invadens
KRLSSVSDPSGNPI

SEQ ID NO: 2876465 - protein, 5 aa, Entamoeba invadens
KRLTD

SEQ ID NO: 2876466 - protein, 10 aa, Entamoeba invadens
KRLTKETNKF

SEQ ID NO: 2876467 - protein, 6 aa, Entamoeba invadens
KRLTNG

SEQ ID NO: 2876468 - protein, 26 aa, Entamoeba invadens
KRLTSKEEEDNVEPQNERIENTEDIK

SEQ ID NO: 2876469 - protein, 13 aa, Entamoeba invadens
KRMKSQNVKTTSI

SEQ ID NO: 2876470 - protein, 8 aa, Entamoeba invadens
KRMPPHVP

SEQ ID NO: 2876471 - protein, 18 aa, Entamoeba invadens
KRNAHRRVKTTGEGMRKG

SEQ ID NO: 2876472 - protein, 15 aa, Entamoeba invadens
KRNANPEKFKSPLAN

SEQ ID NO: 2876473 - protein, 17 aa, Entamoeba invadens
KRNANRCGKTTGEGMKR

SEQ ID NO: 2876474 - protein, 8 aa, Entamoeba invadens
KRNDAELV

SEQ ID NO: 2876475 - protein, 15 aa, Entamoeba invadens
KRNDINSNEKHKEMP

SEQ ID NO: 2876476 - protein, 7 aa, Entamoeba invadens
KRNEASG

SEQ ID NO: 2876477 - protein, 16 aa, Entamoeba invadens
KRNEELGVQPPSYPAF

SEQ ID NO: 2876478 - protein, 7 aa, Entamoeba invadens
KRNEMQG

SEQ ID NO: 2876479 - protein, 5 aa, Entamoeba invadens
KRNES

SEQ ID NO: 2876480 - protein, 8 aa, Entamoeba invadens
KRNETKEL

SEQ ID NO: 2876481 - protein, 9 aa, Entamoeba invadens
KRNETLEES

SEQ ID NO: 2876482 - protein, 6 aa, Entamoeba invadens
KRNFTK

SEQ ID NO: 2876483 - protein, 7 aa, Entamoeba invadens
KRNIEGG

SEQ ID NO: 2876484 - protein, 7 aa, Entamoeba invadens
KRNIPPF

SEQ ID NO: 2876485 - protein, 13 aa, Entamoeba invadens
KRNIPSLKPSHAK

SEQ ID NO: 2876486 - protein, 5 aa, Entamoeba invadens
KRNKT

SEQ ID NO: 2876487 - protein, 4 aa, Entamoeba invadens
KRNL

SEQ ID NO: 2876488 - protein, 10 aa, Entamoeba invadens
KRNNELQNEG

SEQ ID NO: 2876489 - protein, 4 aa, Entamoeba invadens
KRNP

SEQ ID NO: 2876490 - protein, 6 aa, Entamoeba invadens
KRNPRK

SEQ ID NO: 2876491 - protein, 10 aa, Entamoeba invadens
KRNQKNENPI

SEQ ID NO: 2876492 - protein, 9 aa, Entamoeba invadens
KRNQLNEQV

SEQ ID NO: 2876493 - protein, 5 aa, Entamoeba invadens
KRNSE

SEQ ID NO: 2876494 - protein, 5 aa, Entamoeba invadens
KRNSF

SEQ ID NO: 2876495 - protein, 17 aa, Entamoeba invadens
KRNSLQRNTTKKEEEIK

SEQ ID NO: 2876496 - protein, 8 aa, Entamoeba invadens
KRNSPSDS

SEQ ID NO: 2876497 - protein, 7 aa, Entamoeba invadens
KRNSRAS

SEQ ID NO: 2876498 - protein, 6 aa, Entamoeba invadens
KRNSVE

SEQ ID NO: 2876499 - protein, 6 aa, Entamoeba invadens
KRNTFG

SEQ ID NO: 2876500 - protein, 8 aa, Entamoeba invadens
KRNTISTS

SEQ ID NO: 2876501 - protein, 5 aa, Entamoeba invadens
KRNTT

SEQ ID NO: 2876502 - protein, 5 aa, Entamoeba invadens
KRNTV

SEQ ID NO: 2876503 - protein, 7 aa, Entamoeba invadens
KRNVGGK

SEQ ID NO: 2876504 - protein, 8 aa, Entamoeba invadens
KRNVPEDL

SEQ ID NO: 2876505 - protein, 11 aa, Entamoeba invadens
KRNWDITSSER

SEQ ID NO: 2876506 - protein, 7 aa, Entamoeba invadens
KRNYDEF

SEQ ID NO: 2876507 - protein, 10 aa, Entamoeba invadens
KRNYEAQQTS

SEQ ID NO: 2876508 - protein, 10 aa, Entamoeba invadens
KRPAYSTLGS

SEQ ID NO: 2876509 - protein, 7 aa, Entamoeba invadens
KRPDTTL

SEQ ID NO: 2876510 - protein, 16 aa, Entamoeba invadens
KRPEDKSVLDETGETR

SEQ ID NO: 2876511 - protein, 7 aa, Entamoeba invadens
KRPEEIA

SEQ ID NO: 2876512 - protein, 7 aa, Entamoeba invadens
KRPEGDC

SEQ ID NO: 2876513 - protein, 8 aa, Entamoeba invadens
KRPEGSEV

SEQ ID NO: 2876514 - protein, 6 aa, Entamoeba invadens
KRPEGY

SEQ ID NO: 2876515 - protein, 5 aa, Entamoeba invadens
KRPEI

SEQ ID NO: 2876516 - protein, 7 aa, Entamoeba invadens
KRPEIPN

SEQ ID NO: 2876517 - protein, 6 aa, Entamoeba invadens
KRPENP

SEQ ID NO: 2876518 - protein, 13 aa, Entamoeba invadens
KRPEPRKQPLKPQ

SEQ ID NO: 2876519 - protein, 12 aa, Entamoeba invadens
KRPEPSDTNLSS

SEQ ID NO: 2876520 - protein, 7 aa, Entamoeba invadens
KRPERLT

SEQ ID NO: 2876521 - protein, 9 aa, Entamoeba invadens
KRPERRSQK

SEQ ID NO: 2876522 - protein, 10 aa, Entamoeba invadens
KRPERRSQKT

SEQ ID NO: 2876523 - protein, 5 aa, Entamoeba invadens
KRPFG

SEQ ID NO: 2876524 - protein, 7 aa, Entamoeba invadens
KRPGDVP

SEQ ID NO: 2876525 - protein, 9 aa, Entamoeba invadens
KRPGGHEAK

SEQ ID NO: 2876526 - protein, 6 aa, Entamoeba invadens
KRPGNE

SEQ ID NO: 2876527 - protein, 5 aa, Entamoeba invadens
KRPGV

SEQ ID NO: 2876528 - protein, 24 aa, Entamoeba invadens
KRPINKQKGLADAQTLYTTAKENY

SEQ ID NO: 2876529 - protein, 8 aa, Entamoeba invadens
KRPKPNKL

SEQ ID NO: 2876530 - protein, 7 aa, Entamoeba invadens
KRPKSSV

SEQ ID NO: 2876531 - protein, 6 aa, Entamoeba invadens
KRPKTY

SEQ ID NO: 2876532 - protein, 6 aa, Entamoeba invadens
KRPNQQ

SEQ ID NO: 2876533 - protein, 8 aa, Entamoeba invadens
KRPQKEVP

SEQ ID NO: 2876534 - protein, 6 aa, Entamoeba invadens
KRPRVS

SEQ ID NO: 2876535 - protein, 7 aa, Entamoeba invadens
KRPSKSL

SEQ ID NO: 2876536 - protein, 5 aa, Entamoeba invadens
KRPSL

SEQ ID NO: 2876537 - protein, 6 aa, Entamoeba invadens
KRPSLR

SEQ ID NO: 2876538 - protein, 8 aa, Entamoeba invadens
KRPTLQKY

SEQ ID NO: 2876539 - protein, 44 aa, Entamoeba invadens
KRPTQNTTNISVQTQRRENLKDAQYENSKKGDSSNGSTDSKKQK

SEQ ID NO: 2876540 - protein, 4 aa, Entamoeba invadens
KRPW

SEQ ID NO: 2876541 - protein, 7 aa, Entamoeba invadens
KRQAAEY

SEQ ID NO: 2876542 - protein, 11 aa, Entamoeba invadens
KRQAHQGEEKM

SEQ ID NO: 2876543 - protein, 6 aa, Entamoeba invadens
KRQDKK

SEQ ID NO: 2876544 - protein, 6 aa, Entamoeba invadens
KRQDTM

SEQ ID NO: 2876545 - protein, 8 aa, Entamoeba invadens
KRQETSRC

SEQ ID NO: 2876546 - protein, 13 aa, Entamoeba invadens
KRQFELTKGRGDI

SEQ ID NO: 2876547 - protein, 8 aa, Entamoeba invadens
KRQGKLEK

SEQ ID NO: 2876548 - protein, 6 aa, Entamoeba invadens
KRQKDR

SEQ ID NO: 2876549 - protein, 12 aa, Entamoeba invadens
KRQKGKDSTDVF

SEQ ID NO: 2876550 - protein, 10 aa, Entamoeba invadens
KRQKPVQNRP

SEQ ID NO: 2876551 - protein, 8 aa, Entamoeba invadens
KRQKQADF

SEQ ID NO: 2876552 - protein, 8 aa, Entamoeba invadens
KRQLKDTD

SEQ ID NO: 2876553 - protein, 22 aa, Entamoeba invadens
KRQLPDDTFKPKRRPDDEQKKW

SEQ ID NO: 2876554 - protein, 6 aa, Entamoeba invadens
KRQPIP

SEQ ID NO: 2876555 - protein, 6 aa, Entamoeba invadens
KRQREK

SEQ ID NO: 2876556 - protein, 20 aa, Entamoeba invadens
KRQRTISQSKGSPDKIKNSP

SEQ ID NO: 2876557 - protein, 7 aa, Entamoeba invadens
KRQSEAI

SEQ ID NO: 2876558 - protein, 10 aa, Entamoeba invadens
KRQSEDIRTR

SEQ ID NO: 2876559 - protein, 13 aa, Entamoeba invadens
KRQSQNGQGPQQV

SEQ ID NO: 2876560 - protein, 8 aa, Entamoeba invadens
KRQSRDDL

SEQ ID NO: 2876561 - protein, 10 aa, Entamoeba invadens
KRQSRPIDAG

SEQ ID NO: 2876562 - protein, 7 aa, Entamoeba invadens
KRQSSEV

SEQ ID NO: 2876563 - protein, 11 aa, Entamoeba invadens
KRQTAGVNNHA

SEQ ID NO: 2876564 - protein, 11 aa, Entamoeba invadens
KRQTSPSPYTI

SEQ ID NO: 2876565 - protein, 12 aa, Entamoeba invadens
KRRAVNKALRDN

SEQ ID NO: 2876566 - protein, 18 aa, Entamoeba invadens
KRRCSTQSFTRESFSCDV

SEQ ID NO: 2876567 - protein, 7 aa, Entamoeba invadens
KRRDPRL

SEQ ID NO: 2876568 - protein, 8 aa, Entamoeba invadens
KRRDSGEK

SEQ ID NO: 2876569 - protein, 4 aa, Entamoeba invadens
KRRE

SEQ ID NO: 2876570 - protein, 7 aa, Entamoeba invadens
KRREGEW

SEQ ID NO: 2876571 - protein, 15 aa, Entamoeba invadens
KRREKISRMLHLTRT

SEQ ID NO: 2876572 - protein, 14 aa, Entamoeba invadens
KRRESVEKRKKYVE

SEQ ID NO: 2876573 - protein, 19 aa, Entamoeba invadens
KRRFTPDNEDGNKITPGTD

SEQ ID NO: 2876574 - protein, 4 aa, Entamoeba invadens
KRRG

SEQ ID NO: 2876575 - protein, 5 aa, Entamoeba invadens
KRRGS

SEQ ID NO: 2876576 - protein, 11 aa, Entamoeba invadens
KRRGTFSGEDD

SEQ ID NO: 2876577 - protein, 9 aa, Entamoeba invadens
KRRKDLNRS

SEQ ID NO: 2876578 - protein, 9 aa, Entamoeba invadens
KRRKREDGK

SEQ ID NO: 2876579 - protein, 8 aa, Entamoeba invadens
KRRNAQHR

SEQ ID NO: 2876580 - protein, 7 aa, Entamoeba invadens
KRRNQKM

SEQ ID NO: 2876581 - protein, 11 aa, Entamoeba invadens
KRRNSIENARQ

SEQ ID NO: 2876582 - protein, 9 aa, Entamoeba invadens
KRRNTKKKA

SEQ ID NO: 2876583 - protein, 6 aa, Entamoeba invadens
KRRPEE

SEQ ID NO: 2876584 - protein, 8 aa, Entamoeba invadens
KRRPKTEL

SEQ ID NO: 2876585 - protein, 7 aa, Entamoeba invadens
KRRPNYN

SEQ ID NO: 2876586 - protein, 7 aa, Entamoeba invadens
KRRRDLN

SEQ ID NO: 2876587 - protein, 9 aa, Entamoeba invadens
KRRRELSRA

SEQ ID NO: 2876588 - protein, 14 aa, Entamoeba invadens
KRRRQPTVTTSIPN

SEQ ID NO: 2876589 - protein, 7 aa, Entamoeba invadens
KRRRTTI

SEQ ID NO: 2876590 - protein, 15 aa, Entamoeba invadens
KRRSANDIVAIYVKM

SEQ ID NO: 2876591 - protein, 8 aa, Entamoeba invadens
KRRSQGTV

SEQ ID NO: 2876592 - protein, 26 aa, Entamoeba invadens
KRRTKEKNDREELEEKLEKKSEIVRR

SEQ ID NO: 2876593 - protein, 12 aa, Entamoeba invadens
KRRTKPKQVSES

SEQ ID NO: 2876594 - protein, 13 aa, Entamoeba invadens
KRRTSANEESPCD

SEQ ID NO: 2876595 - protein, 9 aa, Entamoeba invadens
KRRTSISSS

SEQ ID NO: 2876596 - protein, 8 aa, Entamoeba invadens
KRRVSGKE

SEQ ID NO: 2876597 - protein, 32 aa, Entamoeba invadens
KRRYDEQLSQNTGQHQKTQHQPQTQNQPPMQS

SEQ ID NO: 2876598 - protein, 15 aa, Entamoeba invadens
KRRYSKNWKKSNRRQ

SEQ ID NO: 2876599 - protein, 6 aa, Entamoeba invadens
KRSADA

SEQ ID NO: 2876600 - protein, 10 aa, Entamoeba invadens
KRSAISKEAF

SEQ ID NO: 2876601 - protein, 11 aa, Entamoeba invadens
KRSANKEDENV

SEQ ID NO: 2876602 - protein, 8 aa, Entamoeba invadens
KRSATASV

SEQ ID NO: 2876603 - protein, 5 aa, Entamoeba invadens
KRSCP

SEQ ID NO: 2876604 - protein, 5 aa, Entamoeba invadens
KRSCS

SEQ ID NO: 2876605 - protein, 7 aa, Entamoeba invadens
KRSDNSQ

SEQ ID NO: 2876606 - protein, 8 aa, Entamoeba invadens
KRSDRPLN

SEQ ID NO: 2876607 - protein, 13 aa, Entamoeba invadens
KRSDTAIDTLEYL

SEQ ID NO: 2876608 - protein, 4 aa, Entamoeba invadens
KRSE

SEQ ID NO: 2876609 - protein, 13 aa, Entamoeba invadens
KRSEDDPSTLEYV

SEQ ID NO: 2876610 - protein, 6 aa, Entamoeba invadens
KRSEIS

SEQ ID NO: 2876611 - protein, 10 aa, Entamoeba invadens
KRSEKSEVAT

SEQ ID NO: 2876612 - protein, 5 aa, Entamoeba invadens
KRSEP

SEQ ID NO: 2876613 - protein, 16 aa, Entamoeba invadens
KRSEPKKTEVSKQTTF

SEQ ID NO: 2876614 - protein, 9 aa, Entamoeba invadens
KRSFSGEVT

SEQ ID NO: 2876615 - protein, 4 aa, Entamoeba invadens
KRSG

SEQ ID NO: 2876616 - protein, 6 aa, Entamoeba invadens
KRSGAI

SEQ ID NO: 2876617 - protein, 8 aa, Entamoeba invadens
KRSGEIAG

SEQ ID NO: 2876618 - protein, 8 aa, Entamoeba invadens
KRSGHTKR

SEQ ID NO: 2876619 - protein, 26 aa, Entamoeba invadens
KRSGKPRLSRSIKASDEKKEIEKMEK

SEQ ID NO: 2876620 - protein, 7 aa, Entamoeba invadens
KRSGTDC

SEQ ID NO: 2876621 - protein, 7 aa, Entamoeba invadens
KRSGTQA

SEQ ID NO: 2876622 - protein, 8 aa, Entamoeba invadens
KRSGYSVE

SEQ ID NO: 2876623 - protein, 6 aa, Entamoeba invadens
KRSHPD

SEQ ID NO: 2876624 - protein, 6 aa, Entamoeba invadens
KRSHTD

SEQ ID NO: 2876625 - protein, 4 aa, Entamoeba invadens
KRSI

SEQ ID NO: 2876626 - protein, 5 aa, Entamoeba invadens
KRSID

SEQ ID NO: 2876627 - protein, 12 aa, Entamoeba invadens
KRSITSGGLDLD

SEQ ID NO: 2876628 - protein, 9 aa, Entamoeba invadens
KRSKEAELN

SEQ ID NO: 2876629 - protein, 7 aa, Entamoeba invadens
KRSKKTI

SEQ ID NO: 2876630 - protein, 9 aa, Entamoeba invadens
KRSKPVTNL

SEQ ID NO: 2876631 - protein, 11 aa, Entamoeba invadens
KRSKQSNKTLQ

SEQ ID NO: 2876632 - protein, 4 aa, Entamoeba invadens
KRSL

SEQ ID NO: 2876633 - protein, 5 aa, Entamoeba invadens
KRSNF

SEQ ID NO: 2876634 - protein, 8 aa, Entamoeba invadens
KRSNSTTL

SEQ ID NO: 2876635 - protein, 6 aa, Entamoeba invadens
KRSNVA

SEQ ID NO: 2876636 - protein, 8 aa, Entamoeba invadens
KRSNYANC

SEQ ID NO: 2876637 - protein, 7 aa, Entamoeba invadens
KRSPGEK

SEQ ID NO: 2876638 - protein, 6 aa, Entamoeba invadens
KRSPKI

SEQ ID NO: 2876639 - protein, 7 aa, Entamoeba invadens
KRSPQMK

SEQ ID NO: 2876640 - protein, 9 aa, Entamoeba invadens
KRSPSPYRD

SEQ ID NO: 2876641 - protein, 59 aa, Entamoeba invadens
KRSPSRSPRRSPPRNASPRGRSPLRSPSRGRSPPRNSLPRERSPIRSPSRGRSPPRGRF

SEQ ID NO: 2876642 - protein, 11 aa, Entamoeba invadens
KRSQNNKENAL

SEQ ID NO: 2876643 - protein, 12 aa, Entamoeba invadens
KRSQRTNIPPYG

SEQ ID NO: 2876644 - protein, 12 aa, Entamoeba invadens
KRSRDQMTRRDG

SEQ ID NO: 2876645 - protein, 8 aa, Entamoeba invadens
KRSREAEL

SEQ ID NO: 2876646 - protein, 9 aa, Entamoeba invadens
KRSREAQIS

SEQ ID NO: 2876647 - protein, 9 aa, Entamoeba invadens
KRSRQPSAL

SEQ ID NO: 2876648 - protein, 4 aa, Entamoeba invadens
KRSS

SEQ ID NO: 2876649 - protein, 5 aa, Entamoeba invadens
KRSSK

SEQ ID NO: 2876650 - protein, 8 aa, Entamoeba invadens
KRSSNEFD

SEQ ID NO: 2876651 - protein, 25 aa, Entamoeba invadens
KRSSQMAVSPDSSSTSTPSTPSVRS

SEQ ID NO: 2876652 - protein, 6 aa, Entamoeba invadens
KRSSRK

SEQ ID NO: 2876653 - protein, 27 aa, Entamoeba invadens
KRSSSSTQVIDQDDSVDSSPRKNTRSS

SEQ ID NO: 2876654 - protein, 6 aa, Entamoeba invadens
KRSTAF

SEQ ID NO: 2876655 - protein, 19 aa, Entamoeba invadens
KRSTDREHGWDDSPLLPHK

SEQ ID NO: 2876656 - protein, 8 aa, Entamoeba invadens
KRSTDRVE

SEQ ID NO: 2876657 - protein, 5 aa, Entamoeba invadens
KRSTI

SEQ ID NO: 2876658 - protein, 12 aa, Entamoeba invadens
KRSTKPTKYTQK

SEQ ID NO: 2876659 - protein, 29 aa, Entamoeba invadens
KRSTPRSRTPRHSNSLERQDDSIKKQESV

SEQ ID NO: 2876660 - protein, 16 aa, Entamoeba invadens
KRSTSTMITPTSSSQK

SEQ ID NO: 2876661 - protein, 8 aa, Entamoeba invadens
KRSTTSSK

SEQ ID NO: 2876662 - protein, 7 aa, Entamoeba invadens
KRSTVTN

SEQ ID NO: 2876663 - protein, 9 aa, Entamoeba invadens
KRSVIEPQK

SEQ ID NO: 2876664 - protein, 7 aa, Entamoeba invadens
KRSWDGQ

SEQ ID NO: 2876665 - protein, 6 aa, Entamoeba invadens
KRSYRE

SEQ ID NO: 2876666 - protein, 5 aa, Entamoeba invadens
KRTAG

SEQ ID NO: 2876667 - protein, 6 aa, Entamoeba invadens
KRTAYD

SEQ ID NO: 2876668 - protein, 10 aa, Entamoeba invadens
KRTEDNTQYR

SEQ ID NO: 2876669 - protein, 5 aa, Entamoeba invadens
KRTEG

SEQ ID NO: 2876670 - protein, 7 aa, Entamoeba invadens
KRTEKKS

SEQ ID NO: 2876671 - protein, 9 aa, Entamoeba invadens
KRTENSIKT

SEQ ID NO: 2876672 - protein, 4 aa, Entamoeba invadens
KRTG

SEQ ID NO: 2876673 - protein, 6 aa, Entamoeba invadens
KRTGYA

SEQ ID NO: 2876674 - protein, 16 aa, Entamoeba invadens
KRTHEISEHNGRTQST

SEQ ID NO: 2876675 - protein, 8 aa, Entamoeba invadens
KRTIDGSN

SEQ ID NO: 2876676 - protein, 16 aa, Entamoeba invadens
KRTKFDVDTTPTYTPL

SEQ ID NO: 2876677 - protein, 10 aa, Entamoeba invadens
KRTKNFSGAE

SEQ ID NO: 2876678 - protein, 23 aa, Entamoeba invadens
KRTKTGVNFSKKDLKEKNFSGRN

SEQ ID NO: 2876679 - protein, 7 aa, Entamoeba invadens
KRTLSKT

SEQ ID NO: 2876680 - protein, 7 aa, Entamoeba invadens
KRTLTQW

SEQ ID NO: 2876681 - protein, 4 aa, Entamoeba invadens
KRTN

SEQ ID NO: 2876682 - protein, 88 aa, Entamoeba invadens
KRTNAKQTKTKKEIRRSSKKREKKAEKAEKAEKAEKAEKAEKAEKAEKAEKAEKAEKAEKAEKAEKAEKAEKAEKAEKAEKAEKAEKR

SEQ ID NO: 2876683 - protein, 5 aa, Entamoeba invadens
KRTNF

SEQ ID NO: 2876684 - protein, 7 aa, Entamoeba invadens
KRTNQKI

SEQ ID NO: 2876685 - protein, 9 aa, Entamoeba invadens
KRTNTEKHD

SEQ ID NO: 2876686 - protein, 12 aa, Entamoeba invadens
KRTNTKLPKDGI

SEQ ID NO: 2876687 - protein, 6 aa, Entamoeba invadens
KRTPKA

SEQ ID NO: 2876688 - protein, 6 aa, Entamoeba invadens
KRTPRI

SEQ ID NO: 2876689 - protein, 8 aa, Entamoeba invadens
KRTQAKKK

SEQ ID NO: 2876690 - protein, 10 aa, Entamoeba invadens
KRTQTMDDND

SEQ ID NO: 2876691 - protein, 5 aa, Entamoeba invadens
KRTRG

SEQ ID NO: 2876692 - protein, 13 aa, Entamoeba invadens
KRTRISNKQYNEL

SEQ ID NO: 2876693 - protein, 6 aa, Entamoeba invadens
KRTRNW

SEQ ID NO: 2876694 - protein, 8 aa, Entamoeba invadens
KRTRSLNY

SEQ ID NO: 2876695 - protein, 10 aa, Entamoeba invadens
KRTSEAEENS

SEQ ID NO: 2876696 - protein, 18 aa, Entamoeba invadens
KRTSLQNKERRKKSDTLT

SEQ ID NO: 2876697 - protein, 14 aa, Entamoeba invadens
KRTSNGEEPETKRV

SEQ ID NO: 2876698 - protein, 7 aa, Entamoeba invadens
KRTSQKM

SEQ ID NO: 2876699 - protein, 52 aa, Entamoeba invadens
KRTSTEPSKPTALQSDETKNTKSKKIVKKRRTSNGQLPATSATEEAARRLAE

SEQ ID NO: 2876700 - protein, 8 aa, Entamoeba invadens
KRTSTNHL

SEQ ID NO: 2876701 - protein, 10 aa, Entamoeba invadens
KRTTPEAKSA

SEQ ID NO: 2876702 - protein, 4 aa, Entamoeba invadens
KRTV

SEQ ID NO: 2876703 - protein, 10 aa, Entamoeba invadens
KRTVPGMGSE

SEQ ID NO: 2876704 - protein, 6 aa, Entamoeba invadens
KRTYYS

SEQ ID NO: 2876705 - protein, 14 aa, Entamoeba invadens
KRVAEEKKARIEGA

SEQ ID NO: 2876706 - protein, 13 aa, Entamoeba invadens
KRVDNSKLTPYEK

SEQ ID NO: 2876707 - protein, 5 aa, Entamoeba invadens
KRVEE

SEQ ID NO: 2876708 - protein, 26 aa, Entamoeba invadens
KRVEEEEKARKELEAKKKKAEEERKK

SEQ ID NO: 2876709 - protein, 7 aa, Entamoeba invadens
KRVEGRK

SEQ ID NO: 2876710 - protein, 5 aa, Entamoeba invadens
KRVEK

SEQ ID NO: 2876711 - protein, 11 aa, Entamoeba invadens
KRVEKKDNMPQ

SEQ ID NO: 2876712 - protein, 15 aa, Entamoeba invadens
KRVETAEERQERRRR

SEQ ID NO: 2876713 - protein, 4 aa, Entamoeba invadens
KRVG

SEQ ID NO: 2876714 - protein, 5 aa, Entamoeba invadens
KRVGE

SEQ ID NO: 2876715 - protein, 7 aa, Entamoeba invadens
KRVGETI

SEQ ID NO: 2876716 - protein, 7 aa, Entamoeba invadens
KRVGKGE

SEQ ID NO: 2876717 - protein, 6 aa, Entamoeba invadens
KRVKED

SEQ ID NO: 2876718 - protein, 11 aa, Entamoeba invadens
KRVKKKENIPQ

SEQ ID NO: 2876719 - protein, 12 aa, Entamoeba invadens
KRVLNGENQYED

SEQ ID NO: 2876720 - protein, 4 aa, Entamoeba invadens
KRVN

SEQ ID NO: 2876721 - protein, 6 aa, Entamoeba invadens
KRVNDE

SEQ ID NO: 2876722 - protein, 25 aa, Entamoeba invadens
KRVPESDNSEQSESQEKVKDNEDLG

SEQ ID NO: 2876723 - protein, 10 aa, Entamoeba invadens
KRVQEKNEEP

SEQ ID NO: 2876724 - protein, 8 aa, Entamoeba invadens
KRVQNDKS

SEQ ID NO: 2876725 - protein, 8 aa, Entamoeba invadens
KRVQTDDL

SEQ ID NO: 2876726 - protein, 67 aa, Entamoeba invadens
KRVREEERKRLEEQLQETKKAEEEKERARLEQEKKEAEIKAQQEKEAQKLEQSSEQQKSNADEVRKN

SEQ ID NO: 2876727 - protein, 11 aa, Entamoeba invadens
KRVRGKTSKVL

SEQ ID NO: 2876728 - protein, 9 aa, Entamoeba invadens
KRVRGTHLT

SEQ ID NO: 2876729 - protein, 17 aa, Entamoeba invadens
KRVRNKETVRKSKKRLR

SEQ ID NO: 2876730 - protein, 11 aa, Entamoeba invadens
KRVSRNEETTL

SEQ ID NO: 2876731 - protein, 24 aa, Entamoeba invadens
KRVSRQESSIDEPHFSESKSPAIA

SEQ ID NO: 2876732 - protein, 9 aa, Entamoeba invadens
KRVSSSGVI

SEQ ID NO: 2876733 - protein, 5 aa, Entamoeba invadens
KRVTE

SEQ ID NO: 2876734 - protein, 16 aa, Entamoeba invadens
KRVTGALEKKTDEEID

SEQ ID NO: 2876735 - protein, 7 aa, Entamoeba invadens
KRVTNNS

SEQ ID NO: 2876736 - protein, 21 aa, Entamoeba invadens
KRVTREKRSSSRVTSVMEELI

SEQ ID NO: 2876737 - protein, 20 aa, Entamoeba invadens
KRVTSGEFKTQSARNSTSVS

SEQ ID NO: 2876738 - protein, 12 aa, Entamoeba invadens
KRWQGGSGEYNS

SEQ ID NO: 2876739 - protein, 29 aa, Entamoeba invadens
KRWTTPDDAPALSRKAKLTKRELTKKRPD

SEQ ID NO: 2876740 - protein, 20 aa, Entamoeba invadens
KRYDNDIKRANGAVSNAEKK

SEQ ID NO: 2876741 - protein, 8 aa, Entamoeba invadens
KRYDQAEE

SEQ ID NO: 2876742 - protein, 6 aa, Entamoeba invadens
KRYEDI

SEQ ID NO: 2876743 - protein, 6 aa, Entamoeba invadens
KRYEED

SEQ ID NO: 2876744 - protein, 10 aa, Entamoeba invadens
KRYEKAETQY

SEQ ID NO: 2876745 - protein, 6 aa, Entamoeba invadens
KRYELD

SEQ ID NO: 2876746 - protein, 7 aa, Entamoeba invadens
KRYESAI

SEQ ID NO: 2876747 - protein, 6 aa, Entamoeba invadens
KRYGET

SEQ ID NO: 2876748 - protein, 12 aa, Entamoeba invadens
KRYGPDKGNIPK

SEQ ID NO: 2876749 - protein, 9 aa, Entamoeba invadens
KRYKKTGKN

SEQ ID NO: 2876750 - protein, 12 aa, Entamoeba invadens
KRYKSERAAESL

SEQ ID NO: 2876751 - protein, 7 aa, Entamoeba invadens
KRYKSIE

SEQ ID NO: 2876752 - protein, 4 aa, Entamoeba invadens
KRYN

SEQ ID NO: 2876753 - protein, 7 aa, Entamoeba invadens
KRYNHYN

SEQ ID NO: 2876754 - protein, 5 aa, Entamoeba invadens
KRYNQ

SEQ ID NO: 2876755 - protein, 4 aa, Entamoeba invadens
KRYP

SEQ ID NO: 2876756 - protein, 32 aa, Entamoeba invadens
KRYQTENQMKEHENSKKHKANLKKKENPTTVI

SEQ ID NO: 2876757 - protein, 4 aa, Entamoeba invadens
KRYS

SEQ ID NO: 2876758 - protein, 17 aa, Entamoeba invadens
KRYSELTKDGFEESNSV

SEQ ID NO: 2876759 - protein, 8 aa, Entamoeba invadens
KRYSGGDV

SEQ ID NO: 2876760 - protein, 7 aa, Entamoeba invadens
KRYSKSN

SEQ ID NO: 2876761 - protein, 8 aa, Entamoeba invadens
KRYTETRN

SEQ ID NO: 2876762 - protein, 23 aa, Entamoeba invadens
KRYTGTNAMKTDYTRSGKRGIKG

SEQ ID NO: 2876763 - protein, 8 aa, Entamoeba invadens
KRYTKDDQ

SEQ ID NO: 2876764 - protein, 30 aa, Entamoeba invadens
KRYYQGEPPEDDIYRSESVGETQHEEGQYN

SEQ ID NO: 2876765 - protein, 9 aa, Entamoeba invadens
KSAAEELDK

SEQ ID NO: 2876766 - protein, 12 aa, Entamoeba invadens
KSAAKVEAPVTE

SEQ ID NO: 2876767 - protein, 11 aa, Entamoeba invadens
KSAASVSMSKD

SEQ ID NO: 2876768 - protein, 9 aa, Entamoeba invadens
KSADGSARV

SEQ ID NO: 2876769 - protein, 10 aa, Entamoeba invadens
KSADSKKENL

SEQ ID NO: 2876770 - protein, 13 aa, Entamoeba invadens
KSAEDLAEARRKA

SEQ ID NO: 2876771 - protein, 22 aa, Entamoeba invadens
KSAEEIMKQPNDSDKSKQEEKL

SEQ ID NO: 2876772 - protein, 12 aa, Entamoeba invadens
KSAEERELFEML

SEQ ID NO: 2876773 - protein, 5 aa, Entamoeba invadens
KSAEF

SEQ ID NO: 2876774 - protein, 8 aa, Entamoeba invadens
KSAEKDLL

SEQ ID NO: 2876775 - protein, 8 aa, Entamoeba invadens
KSAEKHVE

SEQ ID NO: 2876776 - protein, 7 aa, Entamoeba invadens
KSAENSK

SEQ ID NO: 2876777 - protein, 20 aa, Entamoeba invadens
KSAEQANEYANRTNEIKTDT

SEQ ID NO: 2876778 - protein, 8 aa, Entamoeba invadens
KSAERVRC

SEQ ID NO: 2876779 - protein, 9 aa, Entamoeba invadens
KSAETDQQL

SEQ ID NO: 2876780 - protein, 7 aa, Entamoeba invadens
KSAFGTK

SEQ ID NO: 2876781 - protein, 8 aa, Entamoeba invadens
KSAGVTDG

SEQ ID NO: 2876782 - protein, 4 aa, Entamoeba invadens
KSAI

SEQ ID NO: 2876783 - protein, 38 aa, Entamoeba invadens
KSAIKTPKSQTLSPRSPRVAPNPPKKEPPKVPQKSEKD

SEQ ID NO: 2876784 - protein, 7 aa, Entamoeba invadens
KSAINPD

SEQ ID NO: 2876785 - protein, 11 aa, Entamoeba invadens
KSAISGIESDK

SEQ ID NO: 2876786 - protein, 4 aa, Entamoeba invadens
KSAK

SEQ ID NO: 2876787 - protein, 22 aa, Entamoeba invadens
KSAKEQINETNTRQREQIKRES

SEQ ID NO: 2876788 - protein, 9 aa, Entamoeba invadens
KSAKKSQEI

SEQ ID NO: 2876789 - protein, 6 aa, Entamoeba invadens
KSAKQG

SEQ ID NO: 2876790 - protein, 22 aa, Entamoeba invadens
KSAKVDKDSIQDGTRIGVDRGR

SEQ ID NO: 2876791 - protein, 8 aa, Entamoeba invadens
KSALEAVK

SEQ ID NO: 2876792 - protein, 8 aa, Entamoeba invadens
KSAMTEEA

SEQ ID NO: 2876793 - protein, 8 aa, Entamoeba invadens
KSANEKDF

SEQ ID NO: 2876794 - protein, 7 aa, Entamoeba invadens
KSANNQN

SEQ ID NO: 2876795 - protein, 8 aa, Entamoeba invadens
KSANSVSN

SEQ ID NO: 2876796 - protein, 11 aa, Entamoeba invadens
KSAPERFQETK

SEQ ID NO: 2876797 - protein, 17 aa, Entamoeba invadens
KSAPHLKNVTSKSALTA

SEQ ID NO: 2876798 - protein, 7 aa, Entamoeba invadens
KSAPKKR

SEQ ID NO: 2876799 - protein, 8 aa, Entamoeba invadens
KSAPPKMS

SEQ ID NO: 2876800 - protein, 6 aa, Entamoeba invadens
KSAPQH

SEQ ID NO: 2876801 - protein, 13 aa, Entamoeba invadens
KSAPTKKPSAPLI

SEQ ID NO: 2876802 - protein, 5 aa, Entamoeba invadens
KSAQE

SEQ ID NO: 2876803 - protein, 8 aa, Entamoeba invadens
KSAQEGKY

SEQ ID NO: 2876804 - protein, 6 aa, Entamoeba invadens
KSAQEN

SEQ ID NO: 2876805 - protein, 9 aa, Entamoeba invadens
KSAQGNGKL

SEQ ID NO: 2876806 - protein, 7 aa, Entamoeba invadens
KSAQPTC

SEQ ID NO: 2876807 - protein, 8 aa, Entamoeba invadens
KSARGKIE

SEQ ID NO: 2876808 - protein, 7 aa, Entamoeba invadens
KSARNSY

SEQ ID NO: 2876809 - protein, 13 aa, Entamoeba invadens
KSARPKKHAAPRV

SEQ ID NO: 2876810 - protein, 9 aa, Entamoeba invadens
KSARSSMEQ

SEQ ID NO: 2876811 - protein, 6 aa, Entamoeba invadens
KSASEL

SEQ ID NO: 2876812 - protein, 15 aa, Entamoeba invadens
KSASFGNGGERTAFS

SEQ ID NO: 2876813 - protein, 10 aa, Entamoeba invadens
KSASFTQDPK

SEQ ID NO: 2876814 - protein, 7 aa, Entamoeba invadens
KSASLAD

SEQ ID NO: 2876815 - protein, 17 aa, Entamoeba invadens
KSASQIKDKINNTKTGY

SEQ ID NO: 2876816 - protein, 6 aa, Entamoeba invadens
KSASTT

SEQ ID NO: 2876817 - protein, 4 aa, Entamoeba invadens
KSAT

SEQ ID NO: 2876818 - protein, 26 aa, Entamoeba invadens
KSATEIPFESSSDVSSKSSHEMSSEG

SEQ ID NO: 2876819 - protein, 12 aa, Entamoeba invadens
KSATENDLKKAY

SEQ ID NO: 2876820 - protein, 8 aa, Entamoeba invadens
KSATENRL

SEQ ID NO: 2876821 - protein, 16 aa, Entamoeba invadens
KSATEQPKRSKKKDQD

SEQ ID NO: 2876822 - protein, 6 aa, Entamoeba invadens
KSATKM

SEQ ID NO: 2876823 - protein, 8 aa, Entamoeba invadens
KSATPQVP

SEQ ID NO: 2876824 - protein, 8 aa, Entamoeba invadens
KSATTATG

SEQ ID NO: 2876825 - protein, 4 aa, Entamoeba invadens
KSAV

SEQ ID NO: 2876826 - protein, 14 aa, Entamoeba invadens
KSAYQGIEETDVNG

SEQ ID NO: 2876827 - protein, 10 aa, Entamoeba invadens
KSCDSTSSEI

SEQ ID NO: 2876828 - protein, 7 aa, Entamoeba invadens
KSCESKH

SEQ ID NO: 2876829 - protein, 19 aa, Entamoeba invadens
KSCESTKKSLVNDDQSQTL

SEQ ID NO: 2876830 - protein, 14 aa, Entamoeba invadens
KSCGTADAEKESYF

SEQ ID NO: 2876831 - protein, 8 aa, Entamoeba invadens
KSCKENGK

SEQ ID NO: 2876832 - protein, 4 aa, Entamoeba invadens
KSCL

SEQ ID NO: 2876833 - protein, 9 aa, Entamoeba invadens
KSCNSRENK

SEQ ID NO: 2876834 - protein, 4 aa, Entamoeba invadens
KSCS

SEQ ID NO: 2876835 - protein, 11 aa, Entamoeba invadens
KSCSDDPLSDN

SEQ ID NO: 2876836 - protein, 5 aa, Entamoeba invadens
KSCSQ

SEQ ID NO: 2876837 - protein, 9 aa, Entamoeba invadens
KSCSSSIQN

SEQ ID NO: 2876838 - protein, 9 aa, Entamoeba invadens
KSCSSVRCG

SEQ ID NO: 2876839 - protein, 11 aa, Entamoeba invadens
KSCTEKRTEEI

SEQ ID NO: 2876840 - protein, 7 aa, Entamoeba invadens
KSCTNEG

SEQ ID NO: 2876841 - protein, 4 aa, Entamoeba invadens
KSCV

SEQ ID NO: 2876842 - protein, 19 aa, Entamoeba invadens
KSDAGADRVVKTEDAQRLA

SEQ ID NO: 2876843 - protein, 4 aa, Entamoeba invadens
KSDC

SEQ ID NO: 2876844 - protein, 10 aa, Entamoeba invadens
KSDCTDEERQ

SEQ ID NO: 2876845 - protein, 10 aa, Entamoeba invadens
KSDDEENAFP

SEQ ID NO: 2876846 - protein, 7 aa, Entamoeba invadens
KSDDEWK

SEQ ID NO: 2876847 - protein, 8 aa, Entamoeba invadens
KSDDGEMK

SEQ ID NO: 2876848 - protein, 6 aa, Entamoeba invadens
KSDDKT

SEQ ID NO: 2876849 - protein, 8 aa, Entamoeba invadens
KSDDTISL

SEQ ID NO: 2876850 - protein, 9 aa, Entamoeba invadens
KSDEDVMSS

SEQ ID NO: 2876851 - protein, 8 aa, Entamoeba invadens
KSDEEAEV

SEQ ID NO: 2876852 - protein, 16 aa, Entamoeba invadens
KSDEETADKSSYQIEE

SEQ ID NO: 2876853 - protein, 7 aa, Entamoeba invadens
KSDEGNY

SEQ ID NO: 2876854 - protein, 8 aa, Entamoeba invadens
KSDEIEDL

SEQ ID NO: 2876855 - protein, 27 aa, Entamoeba invadens
KSDEKKQSLSEQKKSEKEAPSVSESCG

SEQ ID NO: 2876856 - protein, 16 aa, Entamoeba invadens
KSDENIEKESTIEVPR

SEQ ID NO: 2876857 - protein, 10 aa, Entamoeba invadens
KSDENKQNKT

SEQ ID NO: 2876858 - protein, 8 aa, Entamoeba invadens
KSDEYCKT

SEQ ID NO: 2876859 - protein, 4 aa, Entamoeba invadens
KSDF

SEQ ID NO: 2876860 - protein, 7 aa, Entamoeba invadens
KSDFGNE

SEQ ID NO: 2876861 - protein, 6 aa, Entamoeba invadens
KSDFPQ

SEQ ID NO: 2876862 - protein, 5 aa, Entamoeba invadens
KSDGK

SEQ ID NO: 2876863 - protein, 9 aa, Entamoeba invadens
KSDGNSEYN

SEQ ID NO: 2876864 - protein, 6 aa, Entamoeba invadens
KSDIAK

SEQ ID NO: 2876865 - protein, 8 aa, Entamoeba invadens
KSDIASDL

SEQ ID NO: 2876866 - protein, 9 aa, Entamoeba invadens
KSDIEQQRD

SEQ ID NO: 2876867 - protein, 19 aa, Entamoeba invadens
KSDIKNRAVKQDDAKDVAA

SEQ ID NO: 2876868 - protein, 7 aa, Entamoeba invadens
KSDINRE

SEQ ID NO: 2876869 - protein, 7 aa, Entamoeba invadens
KSDISEI

SEQ ID NO: 2876870 - protein, 4 aa, Entamoeba invadens
KSDK

SEQ ID NO: 2876871 - protein, 7 aa, Entamoeba invadens
KSDKFDR

SEQ ID NO: 2876872 - protein, 9 aa, Entamoeba invadens
KSDKTAFED

SEQ ID NO: 2876873 - protein, 7 aa, Entamoeba invadens
KSDKVDF

SEQ ID NO: 2876874 - protein, 13 aa, Entamoeba invadens
KSDKVKQMSGERP

SEQ ID NO: 2876875 - protein, 5 aa, Entamoeba invadens
KSDKY

SEQ ID NO: 2876876 - protein, 6 aa, Entamoeba invadens
KSDKYT

SEQ ID NO: 2876877 - protein, 5 aa, Entamoeba invadens
KSDLE

SEQ ID NO: 2876878 - protein, 7 aa, Entamoeba invadens
KSDLEDV

SEQ ID NO: 2876879 - protein, 8 aa, Entamoeba invadens
KSDLEETV

SEQ ID NO: 2876880 - protein, 6 aa, Entamoeba invadens
KSDLEM

SEQ ID NO: 2876881 - protein, 20 aa, Entamoeba invadens
KSDLEQERDVKPSEGEEFAQ

SEQ ID NO: 2876882 - protein, 21 aa, Entamoeba invadens
KSDLEQERQVSTQEGQDLADE

SEQ ID NO: 2876883 - protein, 7 aa, Entamoeba invadens
KSDLEQQ

SEQ ID NO: 2876884 - protein, 17 aa, Entamoeba invadens
KSDLESDREVPTDEANR

SEQ ID NO: 2876885 - protein, 18 aa, Entamoeba invadens
KSDLESDRQVPKECGEDL

SEQ ID NO: 2876886 - protein, 6 aa, Entamoeba invadens
KSDLLS

SEQ ID NO: 2876887 - protein, 22 aa, Entamoeba invadens
KSDLNQTREVTTEEGKKLAEDN

SEQ ID NO: 2876888 - protein, 16 aa, Entamoeba invadens
KSDLPKIDDTIQPTEM

SEQ ID NO: 2876889 - protein, 7 aa, Entamoeba invadens
KSDLQER

SEQ ID NO: 2876890 - protein, 8 aa, Entamoeba invadens
KSDLRDTK

SEQ ID NO: 2876891 - protein, 32 aa, Entamoeba invadens
KSDLREDQKTLAELESAGEKPYTYEEGEDLAK

SEQ ID NO: 2876892 - protein, 13 aa, Entamoeba invadens
KSDLRKEDPPTQQ

SEQ ID NO: 2876893 - protein, 7 aa, Entamoeba invadens
KSDLSDK

SEQ ID NO: 2876894 - protein, 6 aa, Entamoeba invadens
KSDLSM

SEQ ID NO: 2876895 - protein, 18 aa, Entamoeba invadens
KSDLSTQRNVSKEEGVTY

SEQ ID NO: 2876896 - protein, 7 aa, Entamoeba invadens
KSDLTSD

SEQ ID NO: 2876897 - protein, 21 aa, Entamoeba invadens
KSDMESARQVSAAEGKEFADK

SEQ ID NO: 2876898 - protein, 7 aa, Entamoeba invadens
KSDMREY

SEQ ID NO: 2876899 - protein, 7 aa, Entamoeba invadens
KSDMRNE

SEQ ID NO: 2876900 - protein, 7 aa, Entamoeba invadens
KSDNDNF

SEQ ID NO: 2876901 - protein, 8 aa, Entamoeba invadens
KSDNTNVH

SEQ ID NO: 2876902 - protein, 6 aa, Entamoeba invadens
KSDPHT

SEQ ID NO: 2876903 - protein, 7 aa, Entamoeba invadens
KSDPSRL

SEQ ID NO: 2876904 - protein, 7 aa, Entamoeba invadens
KSDPVYP

SEQ ID NO: 2876905 - protein, 6 aa, Entamoeba invadens
KSDQRY

SEQ ID NO: 2876906 - protein, 35 aa, Entamoeba invadens
KSDRKPAKKRERKGNSKNFDKPDTLKKKRPLTPVR

SEQ ID NO: 2876907 - protein, 9 aa, Entamoeba invadens
KSDRNGALS

SEQ ID NO: 2876908 - protein, 7 aa, Entamoeba invadens
KSDRSKF

SEQ ID NO: 2876909 - protein, 14 aa, Entamoeba invadens
KSDSEELMEENERN

SEQ ID NO: 2876910 - protein, 7 aa, Entamoeba invadens
KSDSEQS

SEQ ID NO: 2876911 - protein, 8 aa, Entamoeba invadens
KSDSQKTI

SEQ ID NO: 2876912 - protein, 10 aa, Entamoeba invadens
KSDSQNRVIT

SEQ ID NO: 2876913 - protein, 8 aa, Entamoeba invadens
KSDSSEFF

SEQ ID NO: 2876914 - protein, 16 aa, Entamoeba invadens
KSDTFEGKTGYSQTKY

SEQ ID NO: 2876915 - protein, 10 aa, Entamoeba invadens
KSDTISSQKY

SEQ ID NO: 2876916 - protein, 6 aa, Entamoeba invadens
KSDTTI

SEQ ID NO: 2876917 - protein, 9 aa, Entamoeba invadens
KSDVNEQEK

SEQ ID NO: 2876918 - protein, 10 aa, Entamoeba invadens
KSDVSKGETD

SEQ ID NO: 2876919 - protein, 8 aa, Entamoeba invadens
KSDVSTEI

SEQ ID NO: 2876920 - protein, 5 aa, Entamoeba invadens
KSDYS

SEQ ID NO: 2876921 - protein, 11 aa, Entamoeba invadens
KSDYSPSKTDQ

SEQ ID NO: 2876922 - protein, 20 aa, Entamoeba invadens
KSDYYQPKHPTDSKTPPPKQ

SEQ ID NO: 2876923 - protein, 7 aa, Entamoeba invadens
KSEAEKM

SEQ ID NO: 2876924 - protein, 14 aa, Entamoeba invadens
KSEAGKKAKYDKSA

SEQ ID NO: 2876925 - protein, 5 aa, Entamoeba invadens
KSECK

SEQ ID NO: 2876926 - protein, 4 aa, Entamoeba invadens
KSED

SEQ ID NO: 2876927 - protein, 15 aa, Entamoeba invadens
KSEDEESDHYEENKM

SEQ ID NO: 2876928 - protein, 5 aa, Entamoeba invadens
KSEDQ

SEQ ID NO: 2876929 - protein, 14 aa, Entamoeba invadens
KSEDQSETEDELDA

SEQ ID NO: 2876930 - protein, 8 aa, Entamoeba invadens
KSEDSDYI

SEQ ID NO: 2876931 - protein, 8 aa, Entamoeba invadens
KSEDSKLD

SEQ ID NO: 2876932 - protein, 6 aa, Entamoeba invadens
KSEEDI

SEQ ID NO: 2876933 - protein, 51 aa, Entamoeba invadens
KSEEDMKEEENVEEQEEEHEVVKEEKEEAPPEPPKIRDIDDAKQAFSEGSV

SEQ ID NO: 2876934 - protein, 7 aa, Entamoeba invadens
KSEEEEI

SEQ ID NO: 2876935 - protein, 9 aa, Entamoeba invadens
KSEEEFDNE

SEQ ID NO: 2876936 - protein, 18 aa, Entamoeba invadens
KSEEEKKAEVERKKDEMI

SEQ ID NO: 2876937 - protein, 16 aa, Entamoeba invadens
KSEEIKAKEGSTFDKG

SEQ ID NO: 2876938 - protein, 31 aa, Entamoeba invadens
KSEEITFQNDGNDKEETEKEEVSDTGLNEKI

SEQ ID NO: 2876939 - protein, 5 aa, Entamoeba invadens
KSEEK

SEQ ID NO: 2876940 - protein, 6 aa, Entamoeba invadens
KSEEKK

SEQ ID NO: 2876941 - protein, 25 aa, Entamoeba invadens
KSEEKKGEKEVMKKEESKKIDIRPI

SEQ ID NO: 2876942 - protein, 43 aa, Entamoeba invadens
KSEEMKIEKKEQKKVVEQKPFEREKKQPKKKREGKSQKKTGMD

SEQ ID NO: 2876943 - protein, 8 aa, Entamoeba invadens
KSEENTRE

SEQ ID NO: 2876944 - protein, 8 aa, Entamoeba invadens
KSEEQFAP

SEQ ID NO: 2876945 - protein, 6 aa, Entamoeba invadens
KSEEQL

SEQ ID NO: 2876946 - protein, 17 aa, Entamoeba invadens
KSEESMDSEENKEYTDH

SEQ ID NO: 2876947 - protein, 7 aa, Entamoeba invadens
KSEESNV

SEQ ID NO: 2876948 - protein, 9 aa, Entamoeba invadens
KSEETAANS

SEQ ID NO: 2876949 - protein, 6 aa, Entamoeba invadens
KSEETK

SEQ ID NO: 2876950 - protein, 10 aa, Entamoeba invadens
KSEETVTLPS

SEQ ID NO: 2876951 - protein, 6 aa, Entamoeba invadens
KSEETW

SEQ ID NO: 2876952 - protein, 15 aa, Entamoeba invadens
KSEEVCEPKPSPRRL

SEQ ID NO: 2876953 - protein, 15 aa, Entamoeba invadens
KSEEVPAKTHSPVQA

SEQ ID NO: 2876954 - protein, 7 aa, Entamoeba invadens
KSEEYKA

SEQ ID NO: 2876955 - protein, 13 aa, Entamoeba invadens
KSEEYRKRIAERS

SEQ ID NO: 2876956 - protein, 6 aa, Entamoeba invadens
KSEFEK

SEQ ID NO: 2876957 - protein, 6 aa, Entamoeba invadens
KSEFQE

SEQ ID NO: 2876958 - protein, 6 aa, Entamoeba invadens
KSEFVD

SEQ ID NO: 2876959 - protein, 4 aa, Entamoeba invadens
KSEG

SEQ ID NO: 2876960 - protein, 28 aa, Entamoeba invadens
KSEGEKMPSRNRRSLKQQIDPADIQKQE

SEQ ID NO: 2876961 - protein, 16 aa, Entamoeba invadens
KSEGGETCETQQPPAL

SEQ ID NO: 2876962 - protein, 7 aa, Entamoeba invadens
KSEGGGL

SEQ ID NO: 2876963 - protein, 6 aa, Entamoeba invadens
KSEGKM

SEQ ID NO: 2876964 - protein, 17 aa, Entamoeba invadens
KSEGKYYEVSSSVNSTL

SEQ ID NO: 2876965 - protein, 6 aa, Entamoeba invadens
KSEGSF

SEQ ID NO: 2876966 - protein, 22 aa, Entamoeba invadens
KSEGTGTQFSESNSSEKRPDTF

SEQ ID NO: 2876967 - protein, 18 aa, Entamoeba invadens
KSEGVRESLEASHSSGHF

SEQ ID NO: 2876968 - protein, 9 aa, Entamoeba invadens
KSEHDSTSL

SEQ ID NO: 2876969 - protein, 18 aa, Entamoeba invadens
KSEHKSVKAGGEVSKEAT

SEQ ID NO: 2876970 - protein, 10 aa, Entamoeba invadens
KSEHTPKSLE

SEQ ID NO: 2876971 - protein, 7 aa, Entamoeba invadens
KSEIKEP

SEQ ID NO: 2876972 - protein, 5 aa, Entamoeba invadens
KSEIQ

SEQ ID NO: 2876973 - protein, 6 aa, Entamoeba invadens
KSEITK

SEQ ID NO: 2876974 - protein, 5 aa, Entamoeba invadens
KSEIY

SEQ ID NO: 2876975 - protein, 22 aa, Entamoeba invadens
KSEKDLKRTTKNKENKKKNEDI

SEQ ID NO: 2876976 - protein, 9 aa, Entamoeba invadens
KSEKDSVSQ

SEQ ID NO: 2876977 - protein, 18 aa, Entamoeba invadens
KSEKEKIKGEMDEKETKE

SEQ ID NO: 2876978 - protein, 7 aa, Entamoeba invadens
KSEKEKQ

SEQ ID NO: 2876979 - protein, 19 aa, Entamoeba invadens
KSEKIKKTVDSKKRTDNIE

SEQ ID NO: 2876980 - protein, 69 aa, Entamoeba invadens
KSEKKPEKDEKDVLSRGRDRDRKKDRDPHKRSLSRSDDRTRRRSSQRSDDRWKSEKTERFEKEKDVHRS

SEQ ID NO: 2876981 - protein, 7 aa, Entamoeba invadens
KSEKMNT

SEQ ID NO: 2876982 - protein, 11 aa, Entamoeba invadens
KSEKPKEPMPN

SEQ ID NO: 2876983 - protein, 9 aa, Entamoeba invadens
KSEKSGSDI

SEQ ID NO: 2876984 - protein, 7 aa, Entamoeba invadens
KSEKVED

SEQ ID NO: 2876985 - protein, 9 aa, Entamoeba invadens
KSEKVQEDD

SEQ ID NO: 2876986 - protein, 7 aa, Entamoeba invadens
KSELTSS

SEQ ID NO: 2876987 - protein, 13 aa, Entamoeba invadens
KSEMGKRVRAEDT

SEQ ID NO: 2876988 - protein, 8 aa, Entamoeba invadens
KSEMNGEG

SEQ ID NO: 2876989 - protein, 8 aa, Entamoeba invadens
KSEMSPSL

SEQ ID NO: 2876990 - protein, 6 aa, Entamoeba invadens
KSENDF

SEQ ID NO: 2876991 - protein, 16 aa, Entamoeba invadens
KSENEKIENDVTSGKE

SEQ ID NO: 2876992 - protein, 10 aa, Entamoeba invadens
KSENENNEIV

SEQ ID NO: 2876993 - protein, 6 aa, Entamoeba invadens
KSENGF

SEQ ID NO: 2876994 - protein, 6 aa, Entamoeba invadens
KSENKG

SEQ ID NO: 2876995 - protein, 7 aa, Entamoeba invadens
KSENPPY

SEQ ID NO: 2876996 - protein, 7 aa, Entamoeba invadens
KSENSDL

SEQ ID NO: 2876997 - protein, 16 aa, Entamoeba invadens
KSENVVQRKENTEQQE

SEQ ID NO: 2876998 - protein, 5 aa, Entamoeba invadens
KSENY

SEQ ID NO: 2876999 - protein, 6 aa, Entamoeba invadens
KSEPDR

SEQ ID NO: 2877000 - protein, 6 aa, Entamoeba invadens
KSEPEK

SEQ ID NO: 2877001 - protein, 9 aa, Entamoeba invadens
KSEPEKNID

SEQ ID NO: 2877002 - protein, 7 aa, Entamoeba invadens
KSEPFRT

SEQ ID NO: 2877003 - protein, 7 aa, Entamoeba invadens
KSEPGNR

SEQ ID NO: 2877004 - protein, 7 aa, Entamoeba invadens
KSEPKSK

SEQ ID NO: 2877005 - protein, 5 aa, Entamoeba invadens
KSEPN

SEQ ID NO: 2877006 - protein, 7 aa, Entamoeba invadens
KSEPNMI

SEQ ID NO: 2877007 - protein, 19 aa, Entamoeba invadens
KSEQHKNDQNDKLESKIEQ

SEQ ID NO: 2877008 - protein, 6 aa, Entamoeba invadens
KSEQMT

SEQ ID NO: 2877009 - protein, 6 aa, Entamoeba invadens
KSEQRI

SEQ ID NO: 2877010 - protein, 10 aa, Entamoeba invadens
KSEQTDLTQT

SEQ ID NO: 2877011 - protein, 25 aa, Entamoeba invadens
KSERENLEKQNNELTTNKQQLDEKV

SEQ ID NO: 2877012 - protein, 8 aa, Entamoeba invadens
KSEREVDE

SEQ ID NO: 2877013 - protein, 6 aa, Entamoeba invadens
KSERNF

SEQ ID NO: 2877014 - protein, 7 aa, Entamoeba invadens
KSERPYN

SEQ ID NO: 2877015 - protein, 6 aa, Entamoeba invadens
KSERVK

SEQ ID NO: 2877016 - protein, 15 aa, Entamoeba invadens
KSERVRPDPQSDGFE

SEQ ID NO: 2877017 - protein, 8 aa, Entamoeba invadens
KSERVSVE

SEQ ID NO: 2877018 - protein, 8 aa, Entamoeba invadens
KSERYAQT

SEQ ID NO: 2877019 - protein, 6 aa, Entamoeba invadens
KSESGA

SEQ ID NO: 2877020 - protein, 9 aa, Entamoeba invadens
KSESKGNYL

SEQ ID NO: 2877021 - protein, 20 aa, Entamoeba invadens
KSESQTPSRTTSRSSSQSKQ

SEQ ID NO: 2877022 - protein, 8 aa, Entamoeba invadens
KSESTASM

SEQ ID NO: 2877023 - protein, 8 aa, Entamoeba invadens
KSESTTVL

SEQ ID NO: 2877024 - protein, 8 aa, Entamoeba invadens
KSESVKKK

SEQ ID NO: 2877025 - protein, 6 aa, Entamoeba invadens
KSESYY

SEQ ID NO: 2877026 - protein, 4 aa, Entamoeba invadens
KSET

SEQ ID NO: 2877027 - protein, 14 aa, Entamoeba invadens
KSETAGRYVTYRAV

SEQ ID NO: 2877028 - protein, 10 aa, Entamoeba invadens
KSETESTKGD

SEQ ID NO: 2877029 - protein, 5 aa, Entamoeba invadens
KSETF

SEQ ID NO: 2877030 - protein, 5 aa, Entamoeba invadens
KSETK

SEQ ID NO: 2877031 - protein, 7 aa, Entamoeba invadens
KSETKAK

SEQ ID NO: 2877032 - protein, 6 aa, Entamoeba invadens
KSETKC

SEQ ID NO: 2877033 - protein, 9 aa, Entamoeba invadens
KSETKGSSV

SEQ ID NO: 2877034 - protein, 8 aa, Entamoeba invadens
KSETLATD

SEQ ID NO: 2877035 - protein, 7 aa, Entamoeba invadens
KSETSEK

SEQ ID NO: 2877036 - protein, 10 aa, Entamoeba invadens
KSETSTKEEE

SEQ ID NO: 2877037 - protein, 9 aa, Entamoeba invadens
KSEVGPNIE

SEQ ID NO: 2877038 - protein, 5 aa, Entamoeba invadens
KSEVK

SEQ ID NO: 2877039 - protein, 13 aa, Entamoeba invadens
KSEVVQKSEFPSY

SEQ ID NO: 2877040 - protein, 6 aa, Entamoeba invadens
KSEYLA

SEQ ID NO: 2877041 - protein, 6 aa, Entamoeba invadens
KSEYLG

SEQ ID NO: 2877042 - protein, 5 aa, Entamoeba invadens
KSFAD

SEQ ID NO: 2877043 - protein, 7 aa, Entamoeba invadens
KSFAEQL

SEQ ID NO: 2877044 - protein, 5 aa, Entamoeba invadens
KSFAS

SEQ ID NO: 2877045 - protein, 13 aa, Entamoeba invadens
KSFDESDDQELKA

SEQ ID NO: 2877046 - protein, 9 aa, Entamoeba invadens
KSFEEFDPS

SEQ ID NO: 2877047 - protein, 6 aa, Entamoeba invadens
KSFEGC

SEQ ID NO: 2877048 - protein, 27 aa, Entamoeba invadens
KSFEKKVENDQSNTEKCEKTEASFRSV

SEQ ID NO: 2877049 - protein, 7 aa, Entamoeba invadens
KSFENTV

SEQ ID NO: 2877050 - protein, 7 aa, Entamoeba invadens
KSFEYGE

SEQ ID NO: 2877051 - protein, 5 aa, Entamoeba invadens
KSFGD

SEQ ID NO: 2877052 - protein, 15 aa, Entamoeba invadens
KSFGEKCFPQHLIIN

SEQ ID NO: 2877053 - protein, 8 aa, Entamoeba invadens
KSFGEKDR

SEQ ID NO: 2877054 - protein, 5 aa, Entamoeba invadens
KSFGN

SEQ ID NO: 2877055 - protein, 13 aa, Entamoeba invadens
KSFGNEEITVGES

SEQ ID NO: 2877056 - protein, 8 aa, Entamoeba invadens
KSFHKKKG

SEQ ID NO: 2877057 - protein, 6 aa, Entamoeba invadens
KSFKEE

SEQ ID NO: 2877058 - protein, 6 aa, Entamoeba invadens
KSFKTS

SEQ ID NO: 2877059 - protein, 4 aa, Entamoeba invadens
KSFL

SEQ ID NO: 2877060 - protein, 6 aa, Entamoeba invadens
KSFNEN

SEQ ID NO: 2877061 - protein, 16 aa, Entamoeba invadens
KSFPECANPGNSSNYE

SEQ ID NO: 2877062 - protein, 24 aa, Entamoeba invadens
KSFPESSYRRMKKDDDDLLTQNTS

SEQ ID NO: 2877063 - protein, 13 aa, Entamoeba invadens
KSFQRKALGDTLE

SEQ ID NO: 2877064 - protein, 6 aa, Entamoeba invadens
KSFSGC

SEQ ID NO: 2877065 - protein, 5 aa, Entamoeba invadens
KSFSQ

SEQ ID NO: 2877066 - protein, 4 aa, Entamoeba invadens
KSFT

SEQ ID NO: 2877067 - protein, 5 aa, Entamoeba invadens
KSFTS

SEQ ID NO: 2877068 - protein, 5 aa, Entamoeba invadens
KSFTT

SEQ ID NO: 2877069 - protein, 6 aa, Entamoeba invadens
KSFVTN

SEQ ID NO: 2877070 - protein, 6 aa, Entamoeba invadens
KSFYDD

SEQ ID NO: 2877071 - protein, 9 aa, Entamoeba invadens
KSGAAPFSC

SEQ ID NO: 2877072 - protein, 6 aa, Entamoeba invadens
KSGADL

SEQ ID NO: 2877073 - protein, 9 aa, Entamoeba invadens
KSGADNVRD

SEQ ID NO: 2877074 - protein, 9 aa, Entamoeba invadens
KSGAENSYL

SEQ ID NO: 2877075 - protein, 18 aa, Entamoeba invadens
KSGAKTMKKRRRPSTCQS

SEQ ID NO: 2877076 - protein, 7 aa, Entamoeba invadens
KSGCTEK

SEQ ID NO: 2877077 - protein, 7 aa, Entamoeba invadens
KSGDKIE

SEQ ID NO: 2877078 - protein, 5 aa, Entamoeba invadens
KSGEA

SEQ ID NO: 2877079 - protein, 5 aa, Entamoeba invadens
KSGEE

SEQ ID NO: 2877080 - protein, 14 aa, Entamoeba invadens
KSGEEERKKRAKFE

SEQ ID NO: 2877081 - protein, 5 aa, Entamoeba invadens
KSGEF

SEQ ID NO: 2877082 - protein, 25 aa, Entamoeba invadens
KSGEGFGTEDEKLKDLNKQKEGTYK

SEQ ID NO: 2877083 - protein, 5 aa, Entamoeba invadens
KSGEH

SEQ ID NO: 2877084 - protein, 5 aa, Entamoeba invadens
KSGEL

SEQ ID NO: 2877085 - protein, 6 aa, Entamoeba invadens
KSGELE

SEQ ID NO: 2877086 - protein, 9 aa, Entamoeba invadens
KSGENEVDE

SEQ ID NO: 2877087 - protein, 6 aa, Entamoeba invadens
KSGEQS

SEQ ID NO: 2877088 - protein, 15 aa, Entamoeba invadens
KSGEQYTTHTDNSTL

SEQ ID NO: 2877089 - protein, 8 aa, Entamoeba invadens
KSGERPEW

SEQ ID NO: 2877090 - protein, 11 aa, Entamoeba invadens
KSGETKLSGSQ

SEQ ID NO: 2877091 - protein, 8 aa, Entamoeba invadens
KSGGDNKS

SEQ ID NO: 2877092 - protein, 7 aa, Entamoeba invadens
KSGGHFG

SEQ ID NO: 2877093 - protein, 12 aa, Entamoeba invadens
KSGGKTSKDEKV

SEQ ID NO: 2877094 - protein, 7 aa, Entamoeba invadens
KSGGLHN

SEQ ID NO: 2877095 - protein, 9 aa, Entamoeba invadens
KSGGNAMQQ

SEQ ID NO: 2877096 - protein, 4 aa, Entamoeba invadens
KSGI

SEQ ID NO: 2877097 - protein, 5 aa, Entamoeba invadens
KSGIN

SEQ ID NO: 2877098 - protein, 14 aa, Entamoeba invadens
KSGINENITKGGNY

SEQ ID NO: 2877099 - protein, 4 aa, Entamoeba invadens
KSGK

SEQ ID NO: 2877100 - protein, 10 aa, Entamoeba invadens
KSGKDCPNDK

SEQ ID NO: 2877101 - protein, 6 aa, Entamoeba invadens
KSGKKC

SEQ ID NO: 2877102 - protein, 5 aa, Entamoeba invadens
KSGKN

SEQ ID NO: 2877103 - protein, 16 aa, Entamoeba invadens
KSGKNDEKCMFQVTTS

SEQ ID NO: 2877104 - protein, 23 aa, Entamoeba invadens
KSGKPVQSIDNKMTKTPIHESKV

SEQ ID NO: 2877105 - protein, 10 aa, Entamoeba invadens
KSGKRQNKSW

SEQ ID NO: 2877106 - protein, 7 aa, Entamoeba invadens
KSGKTEL

SEQ ID NO: 2877107 - protein, 9 aa, Entamoeba invadens
KSGKTSGEC

SEQ ID NO: 2877108 - protein, 12 aa, Entamoeba invadens
KSGKVIEKPEPN

SEQ ID NO: 2877109 - protein, 4 aa, Entamoeba invadens
KSGL

SEQ ID NO: 2877110 - protein, 7 aa, Entamoeba invadens
KSGLKSL

SEQ ID NO: 2877111 - protein, 6 aa, Entamoeba invadens
KSGLQA

SEQ ID NO: 2877112 - protein, 7 aa, Entamoeba invadens
KSGLRGR

SEQ ID NO: 2877113 - protein, 14 aa, Entamoeba invadens
KSGLSPKTALRRRH

SEQ ID NO: 2877114 - protein, 7 aa, Entamoeba invadens
KSGMGKT

SEQ ID NO: 2877115 - protein, 7 aa, Entamoeba invadens
KSGMSDH

SEQ ID NO: 2877116 - protein, 12 aa, Entamoeba invadens
KSGMYPDTTTGK

SEQ ID NO: 2877117 - protein, 34 aa, Entamoeba invadens; identical to SEQ ID NO: 2763239

SEQ ID NO: 2877118 - protein, 9 aa, Entamoeba invadens
KSGNATRQF

SEQ ID NO: 2877119 - protein, 8 aa, Entamoeba invadens
KSGNEDYI

SEQ ID NO: 2877120 - protein, 15 aa, Entamoeba invadens
KSGNEEQFNGESNVN

SEQ ID NO: 2877121 - protein, 10 aa, Entamoeba invadens
KSGNEGSSRR

SEQ ID NO: 2877122 - protein, 6 aa, Entamoeba invadens
KSGNHL

SEQ ID NO: 2877123 - protein, 11 aa, Entamoeba invadens
KSGNKELKPPV

SEQ ID NO: 2877124 - protein, 5 aa, Entamoeba invadens
KSGNL

SEQ ID NO: 2877125 - protein, 7 aa, Entamoeba invadens
KSGPLDK

SEQ ID NO: 2877126 - protein, 6 aa, Entamoeba invadens
KSGPNV

SEQ ID NO: 2877127 - protein, 21 aa, Entamoeba invadens
KSGQCEHNNCSEPNDENGRCS

SEQ ID NO: 2877128 - protein, 7 aa, Entamoeba invadens
KSGQTSE

SEQ ID NO: 2877129 - protein, 11 aa, Entamoeba invadens
KSGRGRVSSGR

SEQ ID NO: 2877130 - protein, 9 aa, Entamoeba invadens
KSGRRSAKQ

SEQ ID NO: 2877131 - protein, 8 aa, Entamoeba invadens
KSGRTFND

SEQ ID NO: 2877132 - protein, 7 aa, Entamoeba invadens
KSGRTKY

SEQ ID NO: 2877133 - protein, 14 aa, Entamoeba invadens
KSGRVSQNTSTPVK

SEQ ID NO: 2877134 - protein, 5 aa, Entamoeba invadens
KSGSI

SEQ ID NO: 2877135 - protein, 10 aa, Entamoeba invadens
KSGSISPSFT

SEQ ID NO: 2877136 - protein, 11 aa, Entamoeba invadens
KSGSTAQYRWG

SEQ ID NO: 2877137 - protein, 14 aa, Entamoeba invadens
KSGSVTGAILVKTK

SEQ ID NO: 2877138 - protein, 17 aa, Entamoeba invadens
KSGTASCDIKTNNKSTI

SEQ ID NO: 2877139 - protein, 6 aa, Entamoeba invadens
KSGTIE

SEQ ID NO: 2877140 - protein, 17 aa, Entamoeba invadens
KSGTNNSPTTNSPRQNM

SEQ ID NO: 2877141 - protein, 11 aa, Entamoeba invadens
KSGTRIHSSTR

SEQ ID NO: 2877142 - protein, 5 aa, Entamoeba invadens
KSGTT

SEQ ID NO: 2877143 - protein, 4 aa, Entamoeba invadens
KSGV

SEQ ID NO: 2877144 - protein, 6 aa, Entamoeba invadens
KSGVDA

SEQ ID NO: 2877145 - protein, 7 aa, Entamoeba invadens
KSGVGNE

SEQ ID NO: 2877146 - protein, 6 aa, Entamoeba invadens
KSGVGV

SEQ ID NO: 2877147 - protein, 17 aa, Entamoeba invadens
KSGVSDKTATRRYQNNK

SEQ ID NO: 2877148 - protein, 14 aa, Entamoeba invadens
KSGVTNLKEKNYSN

SEQ ID NO: 2877149 - protein, 7 aa, Entamoeba invadens
KSGVVEE

SEQ ID NO: 2877150 - protein, 8 aa, Entamoeba invadens
KSGVVKTS

SEQ ID NO: 2877151 - protein, 6 aa, Entamoeba invadens
KSGWVG

SEQ ID NO: 2877152 - protein, 14 aa, Entamoeba invadens
KSGYKYSEKSPEME

SEQ ID NO: 2877153 - protein, 20 aa, Entamoeba invadens
KSGYNLESNSASIKRKSNFE

SEQ ID NO: 2877154 - protein, 6 aa, Entamoeba invadens
KSGYQS

SEQ ID NO: 2877155 - protein, 4 aa, Entamoeba invadens
KSHD

SEQ ID NO: 2877156 - protein, 7 aa, Entamoeba invadens
KSHEKGV

SEQ ID NO: 2877157 - protein, 7 aa, Entamoeba invadens
KSHETVE

SEQ ID NO: 2877158 - protein, 13 aa, Entamoeba invadens
KSHGKKETVKRET

SEQ ID NO: 2877159 - protein, 7 aa, Entamoeba invadens
KSHGRVG

SEQ ID NO: 2877160 - protein, 11 aa, Entamoeba invadens
KSHKGTTKCTC

SEQ ID NO: 2877161 - protein, 5 aa, Entamoeba invadens
KSHNE

SEQ ID NO: 2877162 - protein, 6 aa, Entamoeba invadens
KSHQLE

SEQ ID NO: 2877163 - protein, 9 aa, Entamoeba invadens
KSHRDEKNI

SEQ ID NO: 2877164 - protein, 12 aa, Entamoeba invadens
KSHSLGKQDEER

SEQ ID NO: 2877165 - protein, 15 aa, Entamoeba invadens
KSHSLSQRLTDAEGF

SEQ ID NO: 2877166 - protein, 13 aa, Entamoeba invadens
KSHTEKTESNYPT

SEQ ID NO: 2877167 - protein, 6 aa, Entamoeba invadens
KSHTNE

SEQ ID NO: 2877168 - protein, 6 aa, Entamoeba invadens
KSHVPG

SEQ ID NO: 2877169 - protein, 13 aa, Entamoeba invadens
KSHVPNQSDEPYN

SEQ ID NO: 2877170 - protein, 4 aa, Entamoeba invadens
KSIA

SEQ ID NO: 2877171 - protein, 4 aa, Entamoeba invadens
KSID

SEQ ID NO: 2877172 - protein, 6 aa, Entamoeba invadens
KSIDGL

SEQ ID NO: 2877173 - protein, 20 aa, Entamoeba invadens
KSIDGLQSRFPTKTEKIDEV

SEQ ID NO: 2877174 - protein, 90 aa, Entamoeba invadens
KSIDGLQSRFPTKTEKIDEVENLPSKIEKVENQIQQSAPTQYTKSPSPKLQQQQPKQQTHSYQQEIQRPNYPAKSPSPNTPKEQKKPSIP

SEQ ID NO: 2877175 - protein, 5 aa, Entamoeba invadens
KSIDN

SEQ ID NO: 2877176 - protein, 13 aa, Entamoeba invadens
KSIDNKEDKAGAV

SEQ ID NO: 2877177 - protein, 7 aa, Entamoeba invadens
KSIDNLG

SEQ ID NO: 2877178 - protein, 7 aa, Entamoeba invadens
KSIEEQK

SEQ ID NO: 2877179 - protein, 11 aa, Entamoeba invadens
KSIEKSQLNEE

SEQ ID NO: 2877180 - protein, 10 aa, Entamoeba invadens
KSIENGENET

SEQ ID NO: 2877181 - protein, 4 aa, Entamoeba invadens
KSIG

SEQ ID NO: 2877182 - protein, 5 aa, Entamoeba invadens
KSIGD

SEQ ID NO: 2877183 - protein, 6 aa, Entamoeba invadens
KSIGDG

SEQ ID NO: 2877184 - protein, 7 aa, Entamoeba invadens
KSIGGLQ

SEQ ID NO: 2877185 - protein, 4 aa, Entamoeba invadens
KSIK

SEQ ID NO: 2877186 - protein, 15 aa, Entamoeba invadens
KSIKDYTKQDSTMSM

SEQ ID NO: 2877187 - protein, 6 aa, Entamoeba invadens
KSIKEI

SEQ ID NO: 2877188 - protein, 10 aa, Entamoeba invadens
KSIKQSHENA

SEQ ID NO: 2877189 - protein, 7 aa, Entamoeba invadens
KSIKSEG

SEQ ID NO: 2877190 - protein, 6 aa, Entamoeba invadens
KSIKSI

SEQ ID NO: 2877191 - protein, 7 aa, Entamoeba invadens
KSIKSIQ

SEQ ID NO: 2877192 - protein, 4 aa, Entamoeba invadens
KSIN

SEQ ID NO: 2877193 - protein, 7 aa, Entamoeba invadens
KSINEGV

SEQ ID NO: 2877194 - protein, 9 aa, Entamoeba invadens
KSINKPKNV

SEQ ID NO: 2877195 - protein, 9 aa, Entamoeba invadens
KSINTDQNT

SEQ ID NO: 2877196 - protein, 4 aa, Entamoeba invadens
KSIP

SEQ ID NO: 2877197 - protein, 23 aa, Entamoeba invadens
KSIPISGEGSSAELKNDGVNFKE

SEQ ID NO: 2877198 - protein, 8 aa, Entamoeba invadens
KSIPQKEV

SEQ ID NO: 2877199 - protein, 6 aa, Entamoeba invadens
KSIPSS

SEQ ID NO: 2877200 - protein, 6 aa, Entamoeba invadens
KSIPTQ

SEQ ID NO: 2877201 - protein, 5 aa, Entamoeba invadens
KSIQE

SEQ ID NO: 2877202 - protein, 25 aa, Entamoeba invadens
KSIQETPKERQQSVEQNKESTGDEP

SEQ ID NO: 2877203 - protein, 7 aa, Entamoeba invadens
KSIQGAR

SEQ ID NO: 2877204 - protein, 9 aa, Entamoeba invadens
KSIQNSEKY

SEQ ID NO: 2877205 - protein, 9 aa, Entamoeba invadens
KSIQSPRRN

SEQ ID NO: 2877206 - protein, 19 aa, Entamoeba invadens
KSIRKRGRECFPSGITVRN

SEQ ID NO: 2877207 - protein, 18 aa, Entamoeba invadens
KSIRTERDQENKDHAKTQ

SEQ ID NO: 2877208 - protein, 8 aa, Entamoeba invadens
KSISDNVG

SEQ ID NO: 2877209 - protein, 8 aa, Entamoeba invadens
KSISEGDK

SEQ ID NO: 2877210 - protein, 7 aa, Entamoeba invadens
KSISFGE

SEQ ID NO: 2877211 - protein, 28 aa, Entamoeba invadens
KSISKEDLKKTTKEDVEKATKHQKVKKT

SEQ ID NO: 2877212 - protein, 6 aa, Entamoeba invadens
KSISKS

SEQ ID NO: 2877213 - protein, 6 aa, Entamoeba invadens
KSISNG

SEQ ID NO: 2877214 - protein, 4 aa, Entamoeba invadens
KSIT

SEQ ID NO: 2877215 - protein, 17 aa, Entamoeba invadens
KSITEYSKHPRMSGEFT

SEQ ID NO: 2877216 - protein, 5 aa, Entamoeba invadens
KSITR

SEQ ID NO: 2877217 - protein, 8 aa, Entamoeba invadens
KSKAADSL

SEQ ID NO: 2877218 - protein, 7 aa, Entamoeba invadens
KSKAITG

SEQ ID NO: 2877219 - protein, 6 aa, Entamoeba invadens
KSKAPA

SEQ ID NO: 2877220 - protein, 22 aa, Entamoeba invadens
KSKASQNEKAKISENDIQRETA

SEQ ID NO: 2877221 - protein, 5 aa, Entamoeba invadens
KSKDM

SEQ ID NO: 2877222 - protein, 5 aa, Entamoeba invadens
KSKDT

SEQ ID NO: 2877223 - protein, 5 aa, Entamoeba invadens
KSKED

SEQ ID NO: 2877224 - protein, 6 aa, Entamoeba invadens
KSKEDQ

SEQ ID NO: 2877225 - protein, 23 aa, Entamoeba invadens
KSKEDQKAAIEKLNNTKQGEKEI

SEQ ID NO: 2877226 - protein, 9 aa, Entamoeba invadens
KSKEEDFKK

SEQ ID NO: 2877227 - protein, 7 aa, Entamoeba invadens
KSKEEKL

SEQ ID NO: 2877228 - protein, 10 aa, Entamoeba invadens
KSKEETPERR

SEQ ID NO: 2877229 - protein, 6 aa, Entamoeba invadens
KSKEGF

SEQ ID NO: 2877230 - protein, 9 aa, Entamoeba invadens
KSKENKEDA

SEQ ID NO: 2877231 - protein, 9 aa, Entamoeba invadens
KSKEPDEYE

SEQ ID NO: 2877232 - protein, 7 aa, Entamoeba invadens
KSKERTL

SEQ ID NO: 2877233 - protein, 6 aa, Entamoeba invadens
KSKESN

SEQ ID NO: 2877234 - protein, 13 aa, Entamoeba invadens
KSKESSKKQKKRL

SEQ ID NO: 2877235 - protein, 10 aa, Entamoeba invadens
KSKEVERAKV

SEQ ID NO: 2877236 - protein, 8 aa, Entamoeba invadens
KSKEYEDA

SEQ ID NO: 2877237 - protein, 4 aa, Entamoeba invadens
KSKF

SEQ ID NO: 2877238 - protein, 21 aa, Entamoeba invadens
KSKFNERKEKQHVNTTPHNQS

SEQ ID NO: 2877239 - protein, 15 aa, Entamoeba invadens
KSKFTKDFQKSPPSA

SEQ ID NO: 2877240 - protein, 13 aa, Entamoeba invadens
KSKGLLKKKKQLK

SEQ ID NO: 2877241 - protein, 8 aa, Entamoeba invadens
KSKGSEFN

SEQ ID NO: 2877242 - protein, 7 aa, Entamoeba invadens
KSKHGEA

SEQ ID NO: 2877243 - protein, 19 aa, Entamoeba invadens
KSKIEGVTSELDTTKEEKM

SEQ ID NO: 2877244 - protein, 12 aa, Entamoeba invadens
KSKIEKKLMKYL

SEQ ID NO: 2877245 - protein, 42 aa, Entamoeba invadens
KSKIETNTNSNKNSKSCDDEKDENKKQQEKIEKVEDDNGEIN

SEQ ID NO: 2877246 - protein, 21 aa, Entamoeba invadens
KSKIGNDPGGRIGKTKEELTK

SEQ ID NO: 2877247 - protein, 6 aa, Entamoeba invadens
KSKKAI

SEQ ID NO: 2877248 - protein, 11 aa, Entamoeba invadens
KSKKASAENLD

SEQ ID NO: 2877249 - protein, 5 aa, Entamoeba invadens
KSKKC

SEQ ID NO: 2877250 - protein, 9 aa, Entamoeba invadens
KSKKEGSIN

SEQ ID NO: 2877251 - protein, 8 aa, Entamoeba invadens
KSKKKEAA

SEQ ID NO: 2877252 - protein, 8 aa, Entamoeba invadens
KSKKKTAF

SEQ ID NO: 2877253 - protein, 20 aa, Entamoeba invadens
KSKKQQQKFEAPVAQDAEMA

SEQ ID NO: 2877254 - protein, 18 aa, Entamoeba invadens
KSKKSKKKVQQDNSSPAE

SEQ ID NO: 2877255 - protein, 24 aa, Entamoeba invadens
KSKKSKTPPPADPPAMTPPEPEIK

SEQ ID NO: 2877256 - protein, 20 aa, Entamoeba invadens
KSKKSNKKRLSLRSDPGDVA

SEQ ID NO: 2877257 - protein, 6 aa, Entamoeba invadens
KSKKTL

SEQ ID NO: 2877258 - protein, 9 aa, Entamoeba invadens
KSKLKQTSM

SEQ ID NO: 2877259 - protein, 6 aa, Entamoeba invadens
KSKLQK

SEQ ID NO: 2877260 - protein, 7 aa, Entamoeba invadens
KSKMSQL

SEQ ID NO: 2877261 - protein, 6 aa, Entamoeba invadens
KSKMTK

SEQ ID NO: 2877262 - protein, 4 aa, Entamoeba invadens
KSKN

SEQ ID NO: 2877263 - protein, 5 aa, Entamoeba invadens
KSKNM

SEQ ID NO: 2877264 - protein, 15 aa, Entamoeba invadens
KSKNTDQKAIEEKEN

SEQ ID NO: 2877265 - protein, 10 aa, Entamoeba invadens
KSKNTKETVL

SEQ ID NO: 2877266 - protein, 8 aa, Entamoeba invadens
KSKNVNLD

SEQ ID NO: 2877267 - protein, 11 aa, Entamoeba invadens
KSKNVTPVKVG

SEQ ID NO: 2877268 - protein, 7 aa, Entamoeba invadens
KSKPNYS

SEQ ID NO: 2877269 - protein, 12 aa, Entamoeba invadens
KSKPSESLDKRS

SEQ ID NO: 2877270 - protein, 9 aa, Entamoeba invadens
KSKPSRYSS

SEQ ID NO: 2877271 - protein, 10 aa, Entamoeba invadens
KSKPTSKGFK

SEQ ID NO: 2877272 - protein, 5 aa, Entamoeba invadens
KSKPV

SEQ ID NO: 2877273 - protein, 8 aa, Entamoeba invadens
KSKQEEQF

SEQ ID NO: 2877274 - protein, 12 aa, Entamoeba invadens
KSKQLDKETTSE

SEQ ID NO: 2877275 - protein, 5 aa, Entamoeba invadens
KSKQQ

SEQ ID NO: 2877276 - protein, 6 aa, Entamoeba invadens
KSKQTF

SEQ ID NO: 2877277 - protein, 10 aa, Entamoeba invadens
KSKRDYTDKM

SEQ ID NO: 2877278 - protein, 10 aa, Entamoeba invadens
KSKREDSTNI

SEQ ID NO: 2877279 - protein, 13 aa, Entamoeba invadens
KSKRGGPVKPGHA

SEQ ID NO: 2877280 - protein, 8 aa, Entamoeba invadens
KSKRKKRD

SEQ ID NO: 2877281 - protein, 34 aa, Entamoeba invadens
KSKRNANKYEKDRIEQTIKNTGITLTNKAEKIQQ

SEQ ID NO: 2877282 - protein, 9 aa, Entamoeba invadens
KSKRPTYSL

SEQ ID NO: 2877283 - protein, 29 aa, Entamoeba invadens
KSKRSTSARDSLRNSLRNSPKSTPSPQIP

SEQ ID NO: 2877284 - protein, 26 aa, Entamoeba invadens
KSKRTEETDLKQNDMKNAEVKTQSGE

SEQ ID NO: 2877285 - protein, 6 aa, Entamoeba invadens
KSKRTL

SEQ ID NO: 2877286 - protein, 12 aa, Entamoeba invadens
KSKRVNKQIQNM

SEQ ID NO: 2877287 - protein, 7 aa, Entamoeba invadens
KSKRVRP

SEQ ID NO: 2877288 - protein, 13 aa, Entamoeba invadens
KSKSEGSLSSTSF

SEQ ID NO: 2877289 - protein, 9 aa, Entamoeba invadens
KSKSEYSVN

SEQ ID NO: 2877290 - protein, 9 aa, Entamoeba invadens
KSKSGDVDL

SEQ ID NO: 2877291 - protein, 8 aa, Entamoeba invadens
KSKSGEPW

SEQ ID NO: 2877292 - protein, 8 aa, Entamoeba invadens
KSKSNTIP

SEQ ID NO: 2877293 - protein, 11 aa, Entamoeba invadens
KSKSTSQNAVT

SEQ ID NO: 2877294 - protein, 14 aa, Entamoeba invadens
KSKSYSLSNARTIT

SEQ ID NO: 2877295 - protein, 11 aa, Entamoeba invadens
KSKTAKVTQTL

SEQ ID NO: 2877296 - protein, 8 aa, Entamoeba invadens
KSKTCSSQ

SEQ ID NO: 2877297 - protein, 9 aa, Entamoeba invadens
KSKTDEEVK

SEQ ID NO: 2877298 - protein, 12 aa, Entamoeba invadens
KSKTDMSPLQYT

SEQ ID NO: 2877299 - protein, 8 aa, Entamoeba invadens
KSKTEHPN

SEQ ID NO: 2877300 - protein, 8 aa, Entamoeba invadens
KSKTFDDE

SEQ ID NO: 2877301 - protein, 7 aa, Entamoeba invadens
KSKTMTS

SEQ ID NO: 2877302 - protein, 8 aa, Entamoeba invadens
KSKTNALG

SEQ ID NO: 2877303 - protein, 8 aa, Entamoeba invadens
KSKTNFKP

SEQ ID NO: 2877304 - protein, 12 aa, Entamoeba invadens
KSKTNGLSPKIK

SEQ ID NO: 2877305 - protein, 19 aa, Entamoeba invadens
KSKTQTSPIPTSGSFSRRS

SEQ ID NO: 2877306 - protein, 4 aa, Entamoeba invadens
KSKV

SEQ ID NO: 2877307 - protein, 42 aa, Entamoeba invadens
KSKVANEDLKNKNKALEEELAATKAALEASQMRKRGFSFGRK

SEQ ID NO: 2877308 - protein, 11 aa, Entamoeba invadens
KSKVQEPPKIK

SEQ ID NO: 2877309 - protein, 15 aa, Entamoeba invadens
KSKVVAAKPTPTVQQ

SEQ ID NO: 2877310 - protein, 6 aa, Entamoeba invadens
KSKYCS

SEQ ID NO: 2877311 - protein, 9 aa, Entamoeba invadens
KSLAPKMTS

SEQ ID NO: 2877312 - protein, 6 aa, Entamoeba invadens
KSLAVT

SEQ ID NO: 2877313 - protein, 6 aa, Entamoeba invadens
KSLDAV

SEQ ID NO: 2877314 - protein, 6 aa, Entamoeba invadens
KSLDGE

SEQ ID NO: 2877315 - protein, 5 aa, Entamoeba invadens
KSLDV

SEQ ID NO: 2877316 - protein, 4 aa, Entamoeba invadens
KSLE

SEQ ID NO: 2877317 - protein, 23 aa, Entamoeba invadens
KSLEDDMKQKDDELASEKRKLDS

SEQ ID NO: 2877318 - protein, 7 aa, Entamoeba invadens
KSLEDGK

SEQ ID NO: 2877319 - protein, 11 aa, Entamoeba invadens
KSLEDSKPATR

SEQ ID NO: 2877320 - protein, 5 aa, Entamoeba invadens
KSLEE

SEQ ID NO: 2877321 - protein, 6 aa, Entamoeba invadens
KSLEEI

SEQ ID NO: 2877322 - protein, 13 aa, Entamoeba invadens
KSLEESDDQELKA

SEQ ID NO: 2877323 - protein, 9 aa, Entamoeba invadens
KSLEISDEK

SEQ ID NO: 2877324 - protein, 25 aa, Entamoeba invadens
KSLEKKVGPVHEKSAQKIKETKEDK

SEQ ID NO: 2877325 - protein, 6 aa, Entamoeba invadens
KSLENF

SEQ ID NO: 2877326 - protein, 6 aa, Entamoeba invadens
KSLEPF

SEQ ID NO: 2877327 - protein, 5 aa, Entamoeba invadens
KSLET

SEQ ID NO: 2877328 - protein, 4 aa, Entamoeba invadens
KSLG

SEQ ID NO: 2877329 - protein, 8 aa, Entamoeba invadens
KSLGAEKS

SEQ ID NO: 2877330 - protein, 16 aa, Entamoeba invadens
KSLGASTTRVPQGEEP

SEQ ID NO: 2877331 - protein, 15 aa, Entamoeba invadens
KSLGDKTAESFIKAC

SEQ ID NO: 2877332 - protein, 25 aa, Entamoeba invadens
KSLGEKTAAVSELTNEKTRIEEEKI

SEQ ID NO: 2877333 - protein, 10 aa, Entamoeba invadens
KSLINTSKES

SEQ ID NO: 2877334 - protein, 4 aa, Entamoeba invadens
KSLK

SEQ ID NO: 2877335 - protein, 16 aa, Entamoeba invadens
KSLKEGKENKELTQLP

SEQ ID NO: 2877336 - protein, 8 aa, Entamoeba invadens
KSLKQPSF

SEQ ID NO: 2877337 - protein, 4 aa, Entamoeba invadens
KSLN

SEQ ID NO: 2877338 - protein, 6 aa, Entamoeba invadens
KSLNEK

SEQ ID NO: 2877339 - protein, 4 aa, Entamoeba invadens
KSLP

SEQ ID NO: 2877340 - protein, 6 aa, Entamoeba invadens
KSLPAD

SEQ ID NO: 2877341 - protein, 5 aa, Entamoeba invadens
KSLPD

SEQ ID NO: 2877342 - protein, 14 aa, Entamoeba invadens
KSLPEDQQDPTSYT

SEQ ID NO: 2877343 - protein, 23 aa, Entamoeba invadens
KSLPKEEKQEKSEKNTKKVVKRK

SEQ ID NO: 2877344 - protein, 7 aa, Entamoeba invadens
KSLPNNV

SEQ ID NO: 2877345 - protein, 12 aa, Entamoeba invadens
KSLPVNQSNDLA

SEQ ID NO: 2877346 - protein, 5 aa, Entamoeba invadens
KSLQR

SEQ ID NO: 2877347 - protein, 8 aa, Entamoeba invadens
KSLQRSSQ

SEQ ID NO: 2877348 - protein, 9 aa, Entamoeba invadens
KSLQSTELK

SEQ ID NO: 2877349 - protein, 5 aa, Entamoeba invadens
KSLRD

SEQ ID NO: 2877350 - protein, 12 aa, Entamoeba invadens
KSLSDDESTPAL

SEQ ID NO: 2877351 - protein, 10 aa, Entamoeba invadens
KSLSETKSSI

SEQ ID NO: 2877352 - protein, 17 aa, Entamoeba invadens
KSLSKELKSPESVLGRK

SEQ ID NO: 2877353 - protein, 7 aa, Entamoeba invadens
KSLSNQI

SEQ ID NO: 2877354 - protein, 8 aa, Entamoeba invadens
KSLSPNTM

SEQ ID NO: 2877355 - protein, 10 aa, Entamoeba invadens
KSLSQTQTLE

SEQ ID NO: 2877356 - protein, 7 aa, Entamoeba invadens
KSLSSAS

SEQ ID NO: 2877357 - protein, 29 aa, Entamoeba invadens
KSLSTREVPSAVQRATKSEEERVEKKTGL

SEQ ID NO: 2877358 - protein, 6 aa, Entamoeba invadens
KSLSVT

SEQ ID NO: 2877359 - protein, 7 aa, Entamoeba invadens
KSLTDPD

SEQ ID NO: 2877360 - protein, 33 aa, Entamoeba invadens
KSLTEEERGNYAEQARINKQRDLKIDDKKQVQL

SEQ ID NO: 2877361 - protein, 8 aa, Entamoeba invadens
KSLTEITK

SEQ ID NO: 2877362 - protein, 6 aa, Entamoeba invadens
KSLTFD

SEQ ID NO: 2877363 - protein, 6 aa, Entamoeba invadens
KSLTQT

SEQ ID NO: 2877364 - protein, 6 aa, Entamoeba invadens
KSLTTP

SEQ ID NO: 2877365 - protein, 8 aa, Entamoeba invadens
KSLTTTPL

SEQ ID NO: 2877366 - protein, 8 aa, Entamoeba invadens
KSLVGKQD

SEQ ID NO: 2877367 - protein, 27 aa, Entamoeba invadens
KSLYQKRDFSKPTQPTHNKHNTQKSKV

SEQ ID NO: 2877368 - protein, 67 aa, Entamoeba invadens
KSMDKKVQQSMKNTEKKSGGNIRNKDTKEIKKNSKNTKNVKKQSKEKSGNTSSDDSSSNSNESSSDT

SEQ ID NO: 2877369 - protein, 9 aa, Entamoeba invadens
KSMDQVGKD

SEQ ID NO: 2877370 - protein, 6 aa, Entamoeba invadens
KSMDVD

SEQ ID NO: 2877371 - protein, 5 aa, Entamoeba invadens
KSMEA

SEQ ID NO: 2877372 - protein, 43 aa, Entamoeba invadens
KSMEEDVAQKREGKTQKLKAPQPIDKQGKEELNKKRATDGWGE

SEQ ID NO: 2877373 - protein, 7 aa, Entamoeba invadens
KSMGYNA

SEQ ID NO: 2877374 - protein, 9 aa, Entamoeba invadens
KSMKEDSED

SEQ ID NO: 2877375 - protein, 24 aa, Entamoeba invadens
KSMKYKEKEKAKKEEKKEEKKFSG

SEQ ID NO: 2877376 - protein, 7 aa, Entamoeba invadens
KSMNRTT

SEQ ID NO: 2877377 - protein, 6 aa, Entamoeba invadens
KSMQQK

SEQ ID NO: 2877378 - protein, 12 aa, Entamoeba invadens
KSMSPENVLLWA

SEQ ID NO: 2877379 - protein, 6 aa, Entamoeba invadens
KSMTEK

SEQ ID NO: 2877380 - protein, 6 aa, Entamoeba invadens
KSMTNV

SEQ ID NO: 2877381 - protein, 9 aa, Entamoeba invadens
KSNADYDKI

SEQ ID NO: 2877382 - protein, 6 aa, Entamoeba invadens
KSNAFG

SEQ ID NO: 2877383 - protein, 18 aa, Entamoeba invadens
KSNAKEQAIEDSKLARQA

SEQ ID NO: 2877384 - protein, 8 aa, Entamoeba invadens
KSNDAATR

SEQ ID NO: 2877385 - protein, 10 aa, Entamoeba invadens
KSNDELKDSC

SEQ ID NO: 2877386 - protein, 20 aa, Entamoeba invadens
KSNDELKESYKKFSNTGSGC

SEQ ID NO: 2877387 - protein, 9 aa, Entamoeba invadens
KSNDISERM

SEQ ID NO: 2877388 - protein, 8 aa, Entamoeba invadens
KSNDPSVF

SEQ ID NO: 2877389 - protein, 6 aa, Entamoeba invadens
KSNDST

SEQ ID NO: 2877390 - protein, 18 aa, Entamoeba invadens
KSNEENTFQSPPHSALPP

SEQ ID NO: 2877391 - protein, 6 aa, Entamoeba invadens
KSNEFQ

SEQ ID NO: 2877392 - protein, 8 aa, Entamoeba invadens
KSNENFEE

SEQ ID NO: 2877393 - protein, 10 aa, Entamoeba invadens
KSNENSSKIP

SEQ ID NO: 2877394 - protein, 5 aa, Entamoeba invadens
KSNES

SEQ ID NO: 2877395 - protein, 9 aa, Entamoeba invadens
KSNESETCE

SEQ ID NO: 2877396 - protein, 5 aa, Entamoeba invadens
KSNET

SEQ ID NO: 2877397 - protein, 14 aa, Entamoeba invadens
KSNGEPCDPAENTN

SEQ ID NO: 2877398 - protein, 8 aa, Entamoeba invadens
KSNGMPVS

SEQ ID NO: 2877399 - protein, 9 aa, Entamoeba invadens
KSNGRGDVK

SEQ ID NO: 2877400 - protein, 4 aa, Entamoeba invadens
KSNI

SEQ ID NO: 2877401 - protein, 10 aa, Entamoeba invadens
KSNIDTSSDL

SEQ ID NO: 2877402 - protein, 6 aa, Entamoeba invadens
KSNIDY

SEQ ID NO: 2877403 - protein, 8 aa, Entamoeba invadens
KSNIQGKY

SEQ ID NO: 2877404 - protein, 11 aa, Entamoeba invadens
KSNISNTQNTF

SEQ ID NO: 2877405 - protein, 10 aa, Entamoeba invadens
KSNITRTVTG

SEQ ID NO: 2877406 - protein, 7 aa, Entamoeba invadens
KSNKEDN

SEQ ID NO: 2877407 - protein, 9 aa, Entamoeba invadens
KSNKEKMDE

SEQ ID NO: 2877408 - protein, 8 aa, Entamoeba invadens
KSNKLGKQ

SEQ ID NO: 2877409 - protein, 8 aa, Entamoeba invadens
KSNKNDDL

SEQ ID NO: 2877410 - protein, 9 aa, Entamoeba invadens
KSNKNLTDF

SEQ ID NO: 2877411 - protein, 10 aa, Entamoeba invadens
KSNKNQKPKN

SEQ ID NO: 2877412 - protein, 35 aa, Entamoeba invadens
KSNKRKTKYEESDESPLEISSKKKIESDESSSSEI

SEQ ID NO: 2877413 - protein, 21 aa, Entamoeba invadens
KSNKRRASSPQKDETKEIKDE

SEQ ID NO: 2877414 - protein, 12 aa, Entamoeba invadens
KSNKSTERNAKE

SEQ ID NO: 2877415 - protein, 6 aa, Entamoeba invadens
KSNLNS

SEQ ID NO: 2877416 - protein, 10 aa, Entamoeba invadens
KSNMKGHTLP

SEQ ID NO: 2877417 - protein, 15 aa, Entamoeba invadens
KSNMNQNDVEINNLN

SEQ ID NO: 2877418 - protein, 25 aa, Entamoeba invadens
KSNNKKHQSAAKKACEKSTTPIKGE

SEQ ID NO: 2877419 - protein, 8 aa, Entamoeba invadens
KSNNQERY

SEQ ID NO: 2877420 - protein, 15 aa, Entamoeba invadens
KSNNSGSIPKNKSYV

SEQ ID NO: 2877421 - protein, 7 aa, Entamoeba invadens
KSNNTAY

SEQ ID NO: 2877422 - protein, 7 aa, Entamoeba invadens
KSNPEPH

SEQ ID NO: 2877423 - protein, 9 aa, Entamoeba invadens
KSNPHNAET

SEQ ID NO: 2877424 - protein, 5 aa, Entamoeba invadens
KSNPI

SEQ ID NO: 2877425 - protein, 10 aa, Entamoeba invadens
KSNPIGNCSQ

SEQ ID NO: 2877426 - protein, 6 aa, Entamoeba invadens
KSNPKV

SEQ ID NO: 2877427 - protein, 16 aa, Entamoeba invadens
KSNPSHEPFSSDDNTG

SEQ ID NO: 2877428 - protein, 12 aa, Entamoeba invadens
KSNQENKEVQPH

SEQ ID NO: 2877429 - protein, 12 aa, Entamoeba invadens
KSNQLVPKDDEM

SEQ ID NO: 2877430 - protein, 5 aa, Entamoeba invadens
KSNSI

SEQ ID NO: 2877431 - protein, 9 aa, Entamoeba invadens
KSNSKDGCK

SEQ ID NO: 2877432 - protein, 11 aa, Entamoeba invadens
KSNSKIDEKDI

SEQ ID NO: 2877433 - protein, 31 aa, Entamoeba invadens
KSNSRSESLSSESESPVLSPSKLDNEPIKRR

SEQ ID NO: 2877434 - protein, 5 aa, Entamoeba invadens
KSNSY

SEQ ID NO: 2877435 - protein, 10 aa, Entamoeba invadens
KSNTAEESGF

SEQ ID NO: 2877436 - protein, 12 aa, Entamoeba invadens
KSNTDTKMKEVK

SEQ ID NO: 2877437 - protein, 6 aa, Entamoeba invadens
KSNTEP

SEQ ID NO: 2877438 - protein, 7 aa, Entamoeba invadens
KSNTERV

SEQ ID NO: 2877439 - protein, 14 aa, Entamoeba invadens
KSNTLGANNLLIDF

SEQ ID NO: 2877440 - protein, 8 aa, Entamoeba invadens
KSNTTAVA

SEQ ID NO: 2877441 - protein, 10 aa, Entamoeba invadens
KSNTTERGIT

SEQ ID NO: 2877442 - protein, 11 aa, Entamoeba invadens
KSNTWTGKNSF

SEQ ID NO: 2877443 - protein, 11 aa, Entamoeba invadens
KSNTWTGTHSF

SEQ ID NO: 2877444 - protein, 4 aa, Entamoeba invadens
KSNV

SEQ ID NO: 2877445 - protein, 5 aa, Entamoeba invadens
KSNVD

SEQ ID NO: 2877446 - protein, 37 aa, Entamoeba invadens
KSNVKKPEPKNESLKQEPRKDEPKKEEPKKVEPPQLI

SEQ ID NO: 2877447 - protein, 7 aa, Entamoeba invadens
KSNVNPR

SEQ ID NO: 2877448 - protein, 9 aa, Entamoeba invadens
KSNVPNSIS

SEQ ID NO: 2877449 - protein, 7 aa, Entamoeba invadens
KSNVTIS

SEQ ID NO: 2877450 - protein, 12 aa, Entamoeba invadens
KSPAVSAEGTPA

SEQ ID NO: 2877451 - protein, 9 aa, Entamoeba invadens
KSPDALNSG

SEQ ID NO: 2877452 - protein, 7 aa, Entamoeba invadens
KSPDNTS

SEQ ID NO: 2877453 - protein, 5 aa, Entamoeba invadens
KSPDV

SEQ ID NO: 2877454 - protein, 6 aa, Entamoeba invadens
KSPDYD

SEQ ID NO: 2877455 - protein, 4 aa, Entamoeba invadens
KSPE

SEQ ID NO: 2877456 - protein, 8 aa, Entamoeba invadens
KSPEEETR

SEQ ID NO: 2877457 - protein, 6 aa, Entamoeba invadens
KSPEEL

SEQ ID NO: 2877458 - protein, 6 aa, Entamoeba invadens
KSPEFI

SEQ ID NO: 2877459 - protein, 9 aa, Entamoeba invadens
KSPEGALKN

SEQ ID NO: 2877460 - protein, 7 aa, Entamoeba invadens
KSPEHGV

SEQ ID NO: 2877461 - protein, 8 aa, Entamoeba invadens
KSPELTEP

SEQ ID NO: 2877462 - protein, 8 aa, Entamoeba invadens
KSPERVAE

SEQ ID NO: 2877463 - protein, 19 aa, Entamoeba invadens
KSPETKTSKVFSGPNSSVV

SEQ ID NO: 2877464 - protein, 4 aa, Entamoeba invadens
KSPF

SEQ ID NO: 2877465 - protein, 7 aa, Entamoeba invadens
KSPFEPI

SEQ ID NO: 2877466 - protein, 6 aa, Entamoeba invadens
KSPFPQ

SEQ ID NO: 2877467 - protein, 7 aa, Entamoeba invadens
KSPGAVK

SEQ ID NO: 2877468 - protein, 8 aa, Entamoeba invadens
KSPGFAEQ

SEQ ID NO: 2877469 - protein, 6 aa, Entamoeba invadens
KSPGGG

SEQ ID NO: 2877470 - protein, 31 aa, Entamoeba invadens
KSPHPAPSKSKVKDDNSKQPVAKQEVNEDQV

SEQ ID NO: 2877471 - protein, 23 aa, Entamoeba invadens
KSPIEYKEENYGVDRPLLLANLF

SEQ ID NO: 2877472 - protein, 13 aa, Entamoeba invadens
KSPIGANHQPLSL

SEQ ID NO: 2877473 - protein, 11 aa, Entamoeba invadens
KSPIPKQSYQP

SEQ ID NO: 2877474 - protein, 10 aa, Entamoeba invadens
KSPIPSAHKK

SEQ ID NO: 2877475 - protein, 9 aa, Entamoeba invadens
KSPIQPSDN

SEQ ID NO: 2877476 - protein, 7 aa, Entamoeba invadens
KSPKATY

SEQ ID NO: 2877477 - protein, 5 aa, Entamoeba invadens
KSPKI

SEQ ID NO: 2877478 - protein, 9 aa, Entamoeba invadens
KSPKISTIA

SEQ ID NO: 2877479 - protein, 8 aa, Entamoeba invadens
KSPKITNK

SEQ ID NO: 2877480 - protein, 11 aa, Entamoeba invadens
KSPKKKTKNLD

SEQ ID NO: 2877481 - protein, 7 aa, Entamoeba invadens
KSPKNRI

SEQ ID NO: 2877482 - protein, 6 aa, Entamoeba invadens
KSPKPV

SEQ ID NO: 2877483 - protein, 14 aa, Entamoeba invadens
KSPKSKDRFEPRRK

SEQ ID NO: 2877484 - protein, 12 aa, Entamoeba invadens
KSPKSKQFKDNT

SEQ ID NO: 2877485 - protein, 4 aa, Entamoeba invadens
KSPN

SEQ ID NO: 2877486 - protein, 5 aa, Entamoeba invadens
KSPNA

SEQ ID NO: 2877487 - protein, 9 aa, Entamoeba invadens
KSPNDRTLL

SEQ ID NO: 2877488 - protein, 7 aa, Entamoeba invadens
KSPNDYV

SEQ ID NO: 2877489 - protein, 17 aa, Entamoeba invadens
KSPNEMKREKKKKEIPL

SEQ ID NO: 2877490 - protein, 5 aa, Entamoeba invadens
KSPNK

SEQ ID NO: 2877491 - protein, 7 aa, Entamoeba invadens
KSPNNQV

SEQ ID NO: 2877492 - protein, 9 aa, Entamoeba invadens
KSPNSFNEA

SEQ ID NO: 2877493 - protein, 9 aa, Entamoeba invadens
KSPNTSVNS

SEQ ID NO: 2877494 - protein, 6 aa, Entamoeba invadens
KSPNYR

SEQ ID NO: 2877495 - protein, 11 aa, Entamoeba invadens
KSPPSPRQTNN

SEQ ID NO: 2877496 - protein, 23 aa, Entamoeba invadens
KSPPVNTPSSREEQSESPFNEES

SEQ ID NO: 2877497 - protein, 6 aa, Entamoeba invadens
KSPQFE

SEQ ID NO: 2877498 - protein, 7 aa, Entamoeba invadens
KSPQHIS

SEQ ID NO: 2877499 - protein, 11 aa, Entamoeba invadens
KSPQMTKNEAK

SEQ ID NO: 2877500 - protein, 11 aa, Entamoeba invadens
KSPQQNSKKAM

SEQ ID NO: 2877501 - protein, 5 aa, Entamoeba invadens
KSPRK

SEQ ID NO: 2877502 - protein, 7 aa, Entamoeba invadens
KSPRNKA

SEQ ID NO: 2877503 - protein, 7 aa, Entamoeba invadens
KSPRTIS

SEQ ID NO: 2877504 - protein, 6 aa, Entamoeba invadens
KSPSGS

SEQ ID NO: 2877505 - protein, 10 aa, Entamoeba invadens
KSPSGSEATM

SEQ ID NO: 2877506 - protein, 8 aa, Entamoeba invadens
KSPSKEVE

SEQ ID NO: 2877507 - protein, 5 aa, Entamoeba invadens
KSPSL

SEQ ID NO: 2877508 - protein, 19 aa, Entamoeba invadens
KSPSLSIQKRGPQNSFTSS

SEQ ID NO: 2877509 - protein, 7 aa, Entamoeba invadens
KSPSPER

SEQ ID NO: 2877510 - protein, 9 aa, Entamoeba invadens
KSPSQDKVS

SEQ ID NO: 2877511 - protein, 16 aa, Entamoeba invadens
KSPSQIKDKINNTKAG

SEQ ID NO: 2877512 - protein, 9 aa, Entamoeba invadens
KSPSRADDI

SEQ ID NO: 2877513 - protein, 9 aa, Entamoeba invadens
KSPSSFGQQ

SEQ ID NO: 2877514 - protein, 8 aa, Entamoeba invadens
KSPSTINP

SEQ ID NO: 2877515 - protein, 7 aa, Entamoeba invadens
KSPSTVS

SEQ ID NO: 2877516 - protein, 10 aa, Entamoeba invadens
KSPTDKHADS

SEQ ID NO: 2877517 - protein, 6 aa, Entamoeba invadens
KSPTGD

SEQ ID NO: 2877518 - protein, 18 aa, Entamoeba invadens
KSPTLDPQTITTKENARE

SEQ ID NO: 2877519 - protein, 6 aa, Entamoeba invadens
KSPTLE

SEQ ID NO: 2877520 - protein, 4 aa, Entamoeba invadens
KSPV

SEQ ID NO: 2877521 - protein, 12 aa, Entamoeba invadens
KSPVSDKIPPLG

SEQ ID NO: 2877522 - protein, 7 aa, Entamoeba invadens
KSPVSSE

SEQ ID NO: 2877523 - protein, 5 aa, Entamoeba invadens
KSPYI

SEQ ID NO: 2877524 - protein, 9 aa, Entamoeba invadens
KSQARETRS

SEQ ID NO: 2877525 - protein, 14 aa, Entamoeba invadens
KSQDESNGSSVTRQ

SEQ ID NO: 2877526 - protein, 10 aa, Entamoeba invadens
KSQDKPLPEK

SEQ ID NO: 2877527 - protein, 18 aa, Entamoeba invadens
KSQDSENLTVEREETTQH

SEQ ID NO: 2877528 - protein, 63 aa, Entamoeba invadens
KSQDTKPIQKTPSIPSTPQRPEPQPIPTKKTPLQKSEPIKNSLHSSQSLKPQQSQKDQPIAPL

SEQ ID NO: 2877529 - protein, 22 aa, Entamoeba invadens
KSQEDAKNKKRAELQKKIETAG

SEQ ID NO: 2877530 - protein, 6 aa, Entamoeba invadens
KSQEFE

SEQ ID NO: 2877531 - protein, 6 aa, Entamoeba invadens
KSQEGC

SEQ ID NO: 2877532 - protein, 10 aa, Entamoeba invadens
KSQENSTEID

SEQ ID NO: 2877533 - protein, 8 aa, Entamoeba invadens
KSQENTDI

SEQ ID NO: 2877534 - protein, 7 aa, Entamoeba invadens
KSQEPIG

SEQ ID NO: 2877535 - protein, 9 aa, Entamoeba invadens
KSQETNREY

SEQ ID NO: 2877536 - protein, 11 aa, Entamoeba invadens
KSQGNNGLTEE

SEQ ID NO: 2877537 - protein, 8 aa, Entamoeba invadens
KSQGVNGV

SEQ ID NO: 2877538 - protein, 4 aa, Entamoeba invadens
KSQI

SEQ ID NO: 2877539 - protein, 7 aa, Entamoeba invadens
KSQIDGK

SEQ ID NO: 2877540 - protein, 5 aa, Entamoeba invadens
KSQIK

SEQ ID NO: 2877541 - protein, 12 aa, Entamoeba invadens
KSQIKTTNPHLK

SEQ ID NO: 2877542 - protein, 5 aa, Entamoeba invadens
KSQIN

SEQ ID NO: 2877543 - protein, 6 aa, Entamoeba invadens
KSQKEL

SEQ ID NO: 2877544 - protein, 13 aa, Entamoeba invadens
KSQKEPNAQYSKL

SEQ ID NO: 2877545 - protein, 5 aa, Entamoeba invadens
KSQKI

SEQ ID NO: 2877546 - protein, 7 aa, Entamoeba invadens
KSQKLKE

SEQ ID NO: 2877547 - protein, 9 aa, Entamoeba invadens
KSQKPNEYF

SEQ ID NO: 2877548 - protein, 24 aa, Entamoeba invadens
KSQKSTPRTPTNSTLKDSDIAKRR

SEQ ID NO: 2877549 - protein, 5 aa, Entamoeba invadens
KSQKV

SEQ ID NO: 2877550 - protein, 18 aa, Entamoeba invadens
KSQLKNKDTTSSIKDCVI

SEQ ID NO: 2877551 - protein, 5 aa, Entamoeba invadens
KSQLS

SEQ ID NO: 2877552 - protein, 6 aa, Entamoeba invadens
KSQMKE

SEQ ID NO: 2877553 - protein, 8 aa, Entamoeba invadens
KSQNDLDK

SEQ ID NO: 2877554 - protein, 38 aa, Entamoeba invadens
KSQNEENEEDKTNTWGKGHTLKSEKGEVEDKPDEIEPK

SEQ ID NO: 2877555 - protein, 7 aa, Entamoeba invadens
KSQNEKS

SEQ ID NO: 2877556 - protein, 25 aa, Entamoeba invadens
KSQNGSKSTSKRELNTDINNTKPDI

SEQ ID NO: 2877557 - protein, 7 aa, Entamoeba invadens
KSQNGTW

SEQ ID NO: 2877558 - protein, 13 aa, Entamoeba invadens
KSQNNKKNNNDNI

SEQ ID NO: 2877559 - protein, 14 aa, Entamoeba invadens
KSQPGKSGRYNTST

SEQ ID NO: 2877560 - protein, 14 aa, Entamoeba invadens
KSQPKKGSSGKCSL

SEQ ID NO: 2877561 - protein, 6 aa, Entamoeba invadens
KSQPNA

SEQ ID NO: 2877562 - protein, 7 aa, Entamoeba invadens
KSQPNST

SEQ ID NO: 2877563 - protein, 8 aa, Entamoeba invadens
KSQPVSFT

SEQ ID NO: 2877564 - protein, 4 aa, Entamoeba invadens
KSQQ

SEQ ID NO: 2877565 - protein, 9 aa, Entamoeba invadens
KSQQDAGKE

SEQ ID NO: 2877566 - protein, 16 aa, Entamoeba invadens
KSQQIEKVEKSGNEKL

SEQ ID NO: 2877567 - protein, 7 aa, Entamoeba invadens
KSQQLPN

SEQ ID NO: 2877568 - protein, 16 aa, Entamoeba invadens
KSQQQTTLEEYQKTET

SEQ ID NO: 2877569 - protein, 7 aa, Entamoeba invadens
KSQQRSY

SEQ ID NO: 2877570 - protein, 36 aa, Entamoeba invadens
KSQQSSLNTTNLTQPVNGGVKQNRQASPPTLPHRAP

SEQ ID NO: 2877571 - protein, 6 aa, Entamoeba invadens
KSQRGY

SEQ ID NO: 2877572 - protein, 4 aa, Entamoeba invadens
KSQS

SEQ ID NO: 2877573 - protein, 8 aa, Entamoeba invadens
KSQSLTTV

SEQ ID NO: 2877574 - protein, 6 aa, Entamoeba invadens
KSQSNV

SEQ ID NO: 2877575 - protein, 7 aa, Entamoeba invadens
KSQSRAC

SEQ ID NO: 2877576 - protein, 8 aa, Entamoeba invadens
KSQSSLSE

SEQ ID NO: 2877577 - protein, 9 aa, Entamoeba invadens
KSQSTQEIQ

SEQ ID NO: 2877578 - protein, 4 aa, Entamoeba invadens
KSQT

SEQ ID NO: 2877579 - protein, 13 aa, Entamoeba invadens
KSQTAKHTSETIG

SEQ ID NO: 2877580 - protein, 10 aa, Entamoeba invadens
KSQTEKYEGK

SEQ ID NO: 2877581 - protein, 7 aa, Entamoeba invadens
KSQTELD

SEQ ID NO: 2877582 - protein, 29 aa, Entamoeba invadens
KSQTHDEIPEDTFKTPRERQKEDTGYSRE

SEQ ID NO: 2877583 - protein, 14 aa, Entamoeba invadens
KSQTQVESGGRQSL

SEQ ID NO: 2877584 - protein, 7 aa, Entamoeba invadens
KSQTRKI

SEQ ID NO: 2877585 - protein, 7 aa, Entamoeba invadens
KSQTTSL

SEQ ID NO: 2877586 - protein, 8 aa, Entamoeba invadens
KSQTVKPH

SEQ ID NO: 2877587 - protein, 7 aa, Entamoeba invadens
KSQYGGC

SEQ ID NO: 2877588 - protein, 18 aa, Entamoeba invadens
KSQYKSKNNRKRTTKSKQ

SEQ ID NO: 2877589 - protein, 7 aa, Entamoeba invadens
KSQYNGK

SEQ ID NO: 2877590 - protein, 8 aa, Entamoeba invadens
KSQYNYDD

SEQ ID NO: 2877591 - protein, 10 aa, Entamoeba invadens
KSQYTHNGEK

SEQ ID NO: 2877592 - protein, 7 aa, Entamoeba invadens
KSRAGEV

SEQ ID NO: 2877593 - protein, 11 aa, Entamoeba invadens
KSRANRSKNRV

SEQ ID NO: 2877594 - protein, 7 aa, Entamoeba invadens
KSRCDNE

SEQ ID NO: 2877595 - protein, 7 aa, Entamoeba invadens
KSRCTKT

SEQ ID NO: 2877596 - protein, 4 aa, Entamoeba invadens
KSRD

SEQ ID NO: 2877597 - protein, 6 aa, Entamoeba invadens
KSRDNK

SEQ ID NO: 2877598 - protein, 6 aa, Entamoeba invadens
KSRDYY

SEQ ID NO: 2877599 - protein, 5 aa, Entamoeba invadens
KSREF

SEQ ID NO: 2877600 - protein, 10 aa, Entamoeba invadens
KSREQEENIH

SEQ ID NO: 2877601 - protein, 7 aa, Entamoeba invadens
KSRFKKP

SEQ ID NO: 2877602 - protein, 7 aa, Entamoeba invadens
KSRFNEA

SEQ ID NO: 2877603 - protein, 4 aa, Entamoeba invadens
KSRG

SEQ ID NO: 2877604 - protein, 7 aa, Entamoeba invadens
KSRGDLD

SEQ ID NO: 2877605 - protein, 8 aa, Entamoeba invadens
KSRGKELI

SEQ ID NO: 2877606 - protein, 8 aa, Entamoeba invadens
KSRGQTNI

SEQ ID NO: 2877607 - protein, 8 aa, Entamoeba invadens
KSRGYTEA

SEQ ID NO: 2877608 - protein, 7 aa, Entamoeba invadens
KSRKELE

SEQ ID NO: 2877609 - protein, 6 aa, Entamoeba invadens
KSRKNN

SEQ ID NO: 2877610 - protein, 6 aa, Entamoeba invadens
KSRKTI

SEQ ID NO: 2877611 - protein, 11 aa, Entamoeba invadens
KSRLEKEYPPG

SEQ ID NO: 2877612 - protein, 13 aa, Entamoeba invadens
KSRLKPNTHNTTD

SEQ ID NO: 2877613 - protein, 18 aa, Entamoeba invadens
KSRLKTLKREKGENETAP

SEQ ID NO: 2877614 - protein, 9 aa, Entamoeba invadens
KSRLPPGTI

SEQ ID NO: 2877615 - protein, 6 aa, Entamoeba invadens
KSRLQT

SEQ ID NO: 2877616 - protein, 4 aa, Entamoeba invadens
KSRM

SEQ ID NO: 2877617 - protein, 5 aa, Entamoeba invadens
KSRMW

SEQ ID NO: 2877618 - protein, 13 aa, Entamoeba invadens
KSRNANRKSQYGM

SEQ ID NO: 2877619 - protein, 8 aa, Entamoeba invadens
KSRNCETR

SEQ ID NO: 2877620 - protein, 5 aa, Entamoeba invadens
KSRNI

SEQ ID NO: 2877621 - protein, 15 aa, Entamoeba invadens
KSRPNQKMDIEEDGV

SEQ ID NO: 2877622 - protein, 7 aa, Entamoeba invadens
KSRRDGW

SEQ ID NO: 2877623 - protein, 18 aa, Entamoeba invadens
KSRRDKEPSHAQKDVPTG

SEQ ID NO: 2877624 - protein, 48 aa, Entamoeba invadens
KSRRQSRSSKKSKEEKEKREEEKRLQEEKNKTTEELNDKKTLDQQKSY

SEQ ID NO: 2877625 - protein, 19 aa, Entamoeba invadens
KSRSESFGVSECKGNRERM

SEQ ID NO: 2877626 - protein, 9 aa, Entamoeba invadens
KSRSGPTTQ

SEQ ID NO: 2877627 - protein, 6 aa, Entamoeba invadens
KSRSSA

SEQ ID NO: 2877628 - protein, 13 aa, Entamoeba invadens
KSRTEYDKTYKDY

SEQ ID NO: 2877629 - protein, 5 aa, Entamoeba invadens
KSRTF

SEQ ID NO: 2877630 - protein, 14 aa, Entamoeba invadens
KSRTKKIQTQPKKS

SEQ ID NO: 2877631 - protein, 8 aa, Entamoeba invadens
KSRTVKDE

SEQ ID NO: 2877632 - protein, 4 aa, Entamoeba invadens
KSRV

SEQ ID NO: 2877633 - protein, 6 aa, Entamoeba invadens
KSRYGN

SEQ ID NO: 2877634 - protein, 7 aa, Entamoeba invadens
KSRYNRA

SEQ ID NO: 2877635 - protein, 13 aa, Entamoeba invadens
KSRYRTTETKPLE

SEQ ID NO: 2877636 - protein, 13 aa, Entamoeba invadens
KSRYTRNVKEAKR

SEQ ID NO: 2877637 - protein, 14 aa, Entamoeba invadens
KSSAHSTDIKAPRN

SEQ ID NO: 2877638 - protein, 6 aa, Entamoeba invadens
KSSANE

SEQ ID NO: 2877639 - protein, 8 aa, Entamoeba invadens
KSSATTTE

SEQ ID NO: 2877640 - protein, 4 aa, Entamoeba invadens
KSSD

SEQ ID NO: 2877641 - protein, 11 aa, Entamoeba invadens
KSSDKKESATK

SEQ ID NO: 2877642 - protein, 8 aa, Entamoeba invadens
KSSDTPMD

SEQ ID NO: 2877643 - protein, 7 aa, Entamoeba invadens
KSSDWKR

SEQ ID NO: 2877644 - protein, 7 aa, Entamoeba invadens
KSSEAER

SEQ ID NO: 2877645 - protein, 10 aa, Entamoeba invadens
KSSEEAQKMD

SEQ ID NO: 2877646 - protein, 18 aa, Entamoeba invadens
KSSENSKESSVEAPQYKN

SEQ ID NO: 2877647 - protein, 11 aa, Entamoeba invadens
KSSEPVKETGR

SEQ ID NO: 2877648 - protein, 6 aa, Entamoeba invadens
KSSESC

SEQ ID NO: 2877649 - protein, 6 aa, Entamoeba invadens
KSSESY

SEQ ID NO: 2877650 - protein, 8 aa, Entamoeba invadens
KSSETDPL

SEQ ID NO: 2877651 - protein, 6 aa, Entamoeba invadens
KSSEYE

SEQ ID NO: 2877652 - protein, 6 aa, Entamoeba invadens
KSSFND

SEQ ID NO: 2877653 - protein, 7 aa, Entamoeba invadens
KSSFSDG

SEQ ID NO: 2877654 - protein, 37 aa, Entamoeba invadens
KSSGFLEKSSDKNYEKKNDKVIEKKTETKVEKSSNSI

SEQ ID NO: 2877655 - protein, 11 aa, Entamoeba invadens
KSSGKKRSSGC

SEQ ID NO: 2877656 - protein, 11 aa, Entamoeba invadens
KSSGKTSPRHL

SEQ ID NO: 2877657 - protein, 10 aa, Entamoeba invadens
KSSGTKPNQI

SEQ ID NO: 2877658 - protein, 6 aa, Entamoeba invadens
KSSGVD

SEQ ID NO: 2877659 - protein, 7 aa, Entamoeba invadens
KSSIADS

SEQ ID NO: 2877660 - protein, 8 aa, Entamoeba invadens
KSSIQRTT

SEQ ID NO: 2877661 - protein, 13 aa, Entamoeba invadens
KSSKIDPDDSLTK

SEQ ID NO: 2877662 - protein, 10 aa, Entamoeba invadens
KSSKKLTKTL

SEQ ID NO: 2877663 - protein, 5 aa, Entamoeba invadens
KSSKL

SEQ ID NO: 2877664 - protein, 15 aa, Entamoeba invadens
KSSKPETLKATQPSL

SEQ ID NO: 2877665 - protein, 5 aa, Entamoeba invadens
KSSKQ

SEQ ID NO: 2877666 - protein, 28 aa, Entamoeba invadens
KSSKSLKKSLTPELSPTSPQQPQAPPLS

SEQ ID NO: 2877667 - protein, 12 aa, Entamoeba invadens
KSSLDGKSKHKQ

SEQ ID NO: 2877668 - protein, 7 aa, Entamoeba invadens
KSSLDID

SEQ ID NO: 2877669 - protein, 9 aa, Entamoeba invadens
KSSLEKAKQ

SEQ ID NO: 2877670 - protein, 6 aa, Entamoeba invadens
KSSLGM

SEQ ID NO: 2877671 - protein, 15 aa, Entamoeba invadens
KSSLNKSEDDKKEIG

SEQ ID NO: 2877672 - protein, 11 aa, Entamoeba invadens
KSSLQKSPTIE

SEQ ID NO: 2877673 - protein, 17 aa, Entamoeba invadens
KSSNENYQEKKKKKLIG

SEQ ID NO: 2877674 - protein, 35 aa, Entamoeba invadens
KSSNGDLTQELSKKNDENQNVKQKNEELSESNKTL

SEQ ID NO: 2877675 - protein, 12 aa, Entamoeba invadens
KSSNPQDKNKAI

SEQ ID NO: 2877676 - protein, 6 aa, Entamoeba invadens
KSSNQL

SEQ ID NO: 2877677 - protein, 8 aa, Entamoeba invadens
KSSNSDIT

SEQ ID NO: 2877678 - protein, 7 aa, Entamoeba invadens
KSSPERI

SEQ ID NO: 2877679 - protein, 26 aa, Entamoeba invadens
KSSPPKPVAAQSNTEISAPKPVQSST

SEQ ID NO: 2877680 - protein, 10 aa, Entamoeba invadens
KSSPPSPKKR

SEQ ID NO: 2877681 - protein, 30 aa, Entamoeba invadens
KSSPSPLCSSGSFSRRSGTIKTPKNSSPMT

SEQ ID NO: 2877682 - protein, 9 aa, Entamoeba invadens
KSSPSVKSD

SEQ ID NO: 2877683 - protein, 11 aa, Entamoeba invadens
KSSPTKDDPSF

SEQ ID NO: 2877684 - protein, 5 aa, Entamoeba invadens
KSSQC

SEQ ID NO: 2877685 - protein, 20 aa, Entamoeba invadens
KSSQIENSKSHKSHKNKCSL

SEQ ID NO: 2877686 - protein, 10 aa, Entamoeba invadens
KSSQKTADHL

SEQ ID NO: 2877687 - protein, 17 aa, Entamoeba invadens
KSSQKTKKSLEKKGDDC

SEQ ID NO: 2877688 - protein, 9 aa, Entamoeba invadens
KSSQNRVKT

SEQ ID NO: 2877689 - protein, 35 aa, Entamoeba invadens
KSSQSEKTKEIELENKNSELTTANETLKKQNKDFE

SEQ ID NO: 2877690 - protein, 10 aa, Entamoeba invadens
KSSQSEVKSA

SEQ ID NO: 2877691 - protein, 5 aa, Entamoeba invadens
KSSSF

SEQ ID NO: 2877692 - protein, 9 aa, Entamoeba invadens
KSSSGTRSI

SEQ ID NO: 2877693 - protein, 17 aa, Entamoeba invadens
KSSSKNMKREDATPSGI

SEQ ID NO: 2877694 - protein, 6 aa, Entamoeba invadens
KSSSRV

SEQ ID NO: 2877695 - protein, 7 aa, Entamoeba invadens
KSSTEDY

SEQ ID NO: 2877696 - protein, 8 aa, Entamoeba invadens
KSSTEEVE

SEQ ID NO: 2877697 - protein, 14 aa, Entamoeba invadens
KSSTGALPDTATGR

SEQ ID NO: 2877698 - protein, 8 aa, Entamoeba invadens
KSSTLQPY

SEQ ID NO: 2877699 - protein, 9 aa, Entamoeba invadens
KSSTNIPLP

SEQ ID NO: 2877700 - protein, 8 aa, Entamoeba invadens
KSSTRYDD

SEQ ID NO: 2877701 - protein, 7 aa, Entamoeba invadens
KSSTSAG

SEQ ID NO: 2877702 - protein, 8 aa, Entamoeba invadens
KSSTSDYK

SEQ ID NO: 2877703 - protein, 6 aa, Entamoeba invadens
KSSVDR

SEQ ID NO: 2877704 - protein, 5 aa, Entamoeba invadens
KSSVT

SEQ ID NO: 2877705 - protein, 8 aa, Entamoeba invadens
KSSVTEIK

SEQ ID NO: 2877706 - protein, 7 aa, Entamoeba invadens
KSSYNGK

SEQ ID NO: 2877707 - protein, 6 aa, Entamoeba invadens
KSSYRD

SEQ ID NO: 2877708 - protein, 6 aa, Entamoeba invadens
KSSYVN

SEQ ID NO: 2877709 - protein, 7 aa, Entamoeba invadens
KSSYVSV

SEQ ID NO: 2877710 - protein, 4 aa, Entamoeba invadens
KSTA

SEQ ID NO: 2877711 - protein, 7 aa, Entamoeba invadens
KSTAGYV

SEQ ID NO: 2877712 - protein, 4 aa, Entamoeba invadens
KSTC

SEQ ID NO: 2877713 - protein, 9 aa, Entamoeba invadens
KSTDIEANN

SEQ ID NO: 2877714 - protein, 7 aa, Entamoeba invadens
KSTDKNV

SEQ ID NO: 2877715 - protein, 12 aa, Entamoeba invadens
KSTDSKELIPKQ

SEQ ID NO: 2877716 - protein, 5 aa, Entamoeba invadens
KSTDV

SEQ ID NO: 2877717 - protein, 7 aa, Entamoeba invadens
KSTEIKY

SEQ ID NO: 2877718 - protein, 5 aa, Entamoeba invadens
KSTEP

SEQ ID NO: 2877719 - protein, 8 aa, Entamoeba invadens
KSTEPDLT

SEQ ID NO: 2877720 - protein, 8 aa, Entamoeba invadens
KSTEVTQQ

SEQ ID NO: 2877721 - protein, 7 aa, Entamoeba invadens
KSTFNTS

SEQ ID NO: 2877722 - protein, 13 aa, Entamoeba invadens
KSTFTKKTNGKEA

SEQ ID NO: 2877723 - protein, 14 aa, Entamoeba invadens
KSTFTKKTNGKEAI

SEQ ID NO: 2877724 - protein, 15 aa, Entamoeba invadens
KSTFTKKTNGKEAIH

SEQ ID NO: 2877725 - protein, 16 aa, Entamoeba invadens
KSTFTKKTNGKEAIHT

SEQ ID NO: 2877726 - protein, 15 aa, Entamoeba invadens
KSTFTKQTNGKEAIH

SEQ ID NO: 2877727 - protein, 6 aa, Entamoeba invadens
KSTFYS

SEQ ID NO: 2877728 - protein, 18 aa, Entamoeba invadens
KSTGAPPDYFSAGEGQNW

SEQ ID NO: 2877729 - protein, 19 aa, Entamoeba invadens
KSTGAPPDYFSAGEGQNWG

SEQ ID NO: 2877730 - protein, 12 aa, Entamoeba invadens
KSTGEKPQEDTK

SEQ ID NO: 2877731 - protein, 17 aa, Entamoeba invadens
KSTGNTPKKATVETQTR

SEQ ID NO: 2877732 - protein, 11 aa, Entamoeba invadens
KSTGNVDDQQV

SEQ ID NO: 2877733 - protein, 4 aa, Entamoeba invadens
KSTI

SEQ ID NO: 2877734 - protein, 7 aa, Entamoeba invadens
KSTIAHK

SEQ ID NO: 2877735 - protein, 12 aa, Entamoeba invadens
KSTIEKGKAVTN

SEQ ID NO: 2877736 - protein, 7 aa, Entamoeba invadens
KSTIHPE

SEQ ID NO: 2877737 - protein, 13 aa, Entamoeba invadens
KSTKGTPMPIKSS

SEQ ID NO: 2877738 - protein, 5 aa, Entamoeba invadens
KSTKI

SEQ ID NO: 2877739 - protein, 13 aa, Entamoeba invadens
KSTKITNLMAFEM

SEQ ID NO: 2877740 - protein, 8 aa, Entamoeba invadens
KSTKKSAL

SEQ ID NO: 2877741 - protein, 17 aa, Entamoeba invadens
KSTKKTIDKVKNPETTT

SEQ ID NO: 2877742 - protein, 6 aa, Entamoeba invadens
KSTKNT

SEQ ID NO: 2877743 - protein, 21 aa, Entamoeba invadens
KSTKQKEIKSLDADEDHEEKI

SEQ ID NO: 2877744 - protein, 9 aa, Entamoeba invadens
KSTKSEKEL

SEQ ID NO: 2877745 - protein, 10 aa, Entamoeba invadens
KSTKVETDAV

SEQ ID NO: 2877746 - protein, 9 aa, Entamoeba invadens
KSTKYQNRV

SEQ ID NO: 2877747 - protein, 6 aa, Entamoeba invadens
KSTLGA

SEQ ID NO: 2877748 - protein, 13 aa, Entamoeba invadens
KSTLKGTNAFITL

SEQ ID NO: 2877749 - protein, 13 aa, Entamoeba invadens
KSTLMGTNALITH

SEQ ID NO: 2877750 - protein, 8 aa, Entamoeba invadens
KSTLNSEE

SEQ ID NO: 2877751 - protein, 4 aa, Entamoeba invadens
KSTM

SEQ ID NO: 2877752 - protein, 15 aa, Entamoeba invadens
KSTNAHQKYDEVEEE

SEQ ID NO: 2877753 - protein, 6 aa, Entamoeba invadens
KSTNAQ

SEQ ID NO: 2877754 - protein, 13 aa, Entamoeba invadens
KSTNGDTALGGAD

SEQ ID NO: 2877755 - protein, 7 aa, Entamoeba invadens
KSTNGPI

SEQ ID NO: 2877756 - protein, 8 aa, Entamoeba invadens
KSTNNAWS

SEQ ID NO: 2877757 - protein, 6 aa, Entamoeba invadens
KSTNNF

SEQ ID NO: 2877758 - protein, 5 aa, Entamoeba invadens
KSTNT

SEQ ID NO: 2877759 - protein, 6 aa, Entamoeba invadens
KSTNVG

SEQ ID NO: 2877760 - protein, 4 aa, Entamoeba invadens
KSTP

SEQ ID NO: 2877761 - protein, 10 aa, Entamoeba invadens
KSTPAYKGKY

SEQ ID NO: 2877762 - protein, 6 aa, Entamoeba invadens
KSTPET

SEQ ID NO: 2877763 - protein, 7 aa, Entamoeba invadens
KSTPETE

SEQ ID NO: 2877764 - protein, 13 aa, Entamoeba invadens
KSTPISPPEHKYR

SEQ ID NO: 2877765 - protein, 11 aa, Entamoeba invadens
KSTPKTPIQQI

SEQ ID NO: 2877766 - protein, 8 aa, Entamoeba invadens
KSTPVGTI

SEQ ID NO: 2877767 - protein, 9 aa, Entamoeba invadens
KSTQDPSHI

SEQ ID NO: 2877768 - protein, 8 aa, Entamoeba invadens
KSTQEEKL

SEQ ID NO: 2877769 - protein, 19 aa, Entamoeba invadens
KSTQEEKSKYFDEKRNEVS

SEQ ID NO: 2877770 - protein, 5 aa, Entamoeba invadens
KSTQI

SEQ ID NO: 2877771 - protein, 9 aa, Entamoeba invadens
KSTQKNDDL

SEQ ID NO: 2877772 - protein, 6 aa, Entamoeba invadens
KSTQVE

SEQ ID NO: 2877773 - protein, 7 aa, Entamoeba invadens
KSTRATV

SEQ ID NO: 2877774 - protein, 27 aa, Entamoeba invadens
KSTRQKRAAKSVEYTKDLRRSTRKEKV

SEQ ID NO: 2877775 - protein, 7 aa, Entamoeba invadens
KSTRRIS

SEQ ID NO: 2877776 - protein, 24 aa, Entamoeba invadens
KSTRSQSTSRQQSQNSSRKQSLTP

SEQ ID NO: 2877777 - protein, 13 aa, Entamoeba invadens
KSTSDLLSSEKMP

SEQ ID NO: 2877778 - protein, 7 aa, Entamoeba invadens
KSTSDNF

SEQ ID NO: 2877779 - protein, 8 aa, Entamoeba invadens
KSTSDNKM

SEQ ID NO: 2877780 - protein, 7 aa, Entamoeba invadens
KSTSMRV

SEQ ID NO: 2877781 - protein, 10 aa, Entamoeba invadens
KSTSQGTYKP

SEQ ID NO: 2877782 - protein, 8 aa, Entamoeba invadens
KSTSYNQL

SEQ ID NO: 2877783 - protein, 4 aa, Entamoeba invadens
KSTT

SEQ ID NO: 2877784 - protein, 8 aa, Entamoeba invadens
KSTTDDLN

SEQ ID NO: 2877785 - protein, 8 aa, Entamoeba invadens
KSTTDNTR

SEQ ID NO: 2877786 - protein, 9 aa, Entamoeba invadens
KSTTKIGKK

SEQ ID NO: 2877787 - protein, 6 aa, Entamoeba invadens
KSTTKK

SEQ ID NO: 2877788 - protein, 7 aa, Entamoeba invadens
KSTTLDN

SEQ ID NO: 2877789 - protein, 7 aa, Entamoeba invadens
KSTTNNL

SEQ ID NO: 2877790 - protein, 6 aa, Entamoeba invadens
KSTTQC

SEQ ID NO: 2877791 - protein, 12 aa, Entamoeba invadens
KSTTRRVGKGSY

SEQ ID NO: 2877792 - protein, 6 aa, Entamoeba invadens
KSTTRY

SEQ ID NO: 2877793 - protein, 10 aa, Entamoeba invadens
KSTTSKGNSE

SEQ ID NO: 2877794 - protein, 7 aa, Entamoeba invadens
KSTVDNI

SEQ ID NO: 2877795 - protein, 11 aa, Entamoeba invadens
KSTVITTSKTS

SEQ ID NO: 2877796 - protein, 17 aa, Entamoeba invadens
KSTVKDLKKRQTFSPKG

SEQ ID NO: 2877797 - protein, 7 aa, Entamoeba invadens
KSTVTEP

SEQ ID NO: 2877798 - protein, 4 aa, Entamoeba invadens
KSTY

SEQ ID NO: 2877799 - protein, 7 aa, Entamoeba invadens
KSVDEDG

SEQ ID NO: 2877800 - protein, 6 aa, Entamoeba invadens
KSVDES

SEQ ID NO: 2877801 - protein, 6 aa, Entamoeba invadens
KSVDFG

SEQ ID NO: 2877802 - protein, 6 aa, Entamoeba invadens
KSVDQT

SEQ ID NO: 2877803 - protein, 5 aa, Entamoeba invadens
KSVED

SEQ ID NO: 2877804 - protein, 5 aa, Entamoeba invadens
KSVEE

SEQ ID NO: 2877805 - protein, 7 aa, Entamoeba invadens
KSVEEAA

SEQ ID NO: 2877806 - protein, 6 aa, Entamoeba invadens
KSVEEK

SEQ ID NO: 2877807 - protein, 8 aa, Entamoeba invadens
KSVEEKSV

SEQ ID NO: 2877808 - protein, 6 aa, Entamoeba invadens
KSVEEL

SEQ ID NO: 2877809 - protein, 10 aa, Entamoeba invadens
KSVEGDEGKL

SEQ ID NO: 2877810 - protein, 7 aa, Entamoeba invadens
KSVEKNG

SEQ ID NO: 2877811 - protein, 11 aa, Entamoeba invadens
KSVEKVPEEPD

SEQ ID NO: 2877812 - protein, 8 aa, Entamoeba invadens
KSVENGYR

SEQ ID NO: 2877813 - protein, 16 aa, Entamoeba invadens
KSVEPSQTLQSDSPVL

SEQ ID NO: 2877814 - protein, 5 aa, Entamoeba invadens
KSVER

SEQ ID NO: 2877815 - protein, 6 aa, Entamoeba invadens
KSVESL

SEQ ID NO: 2877816 - protein, 7 aa, Entamoeba invadens
KSVETNH

SEQ ID NO: 2877817 - protein, 14 aa, Entamoeba invadens
KSVETQEKERNKQR

SEQ ID NO: 2877818 - protein, 5 aa, Entamoeba invadens
KSVEV

SEQ ID NO: 2877819 - protein, 11 aa, Entamoeba invadens
KSVGAKRGRLT

SEQ ID NO: 2877820 - protein, 8 aa, Entamoeba invadens
KSVGMKGN

SEQ ID NO: 2877821 - protein, 5 aa, Entamoeba invadens
KSVGR

SEQ ID NO: 2877822 - protein, 9 aa, Entamoeba invadens
KSVGRTSAQ

SEQ ID NO: 2877823 - protein, 7 aa, Entamoeba invadens
KSVGTTK

SEQ ID NO: 2877824 - protein, 17 aa, Entamoeba invadens
KSVKATTPVTQGKPTVN

SEQ ID NO: 2877825 - protein, 11 aa, Entamoeba invadens
KSVKQGTGHDG

SEQ ID NO: 2877826 - protein, 9 aa, Entamoeba invadens
KSVKREGQN

SEQ ID NO: 2877827 - protein, 11 aa, Entamoeba invadens
KSVKSNEKQQG

SEQ ID NO: 2877828 - protein, 4 aa, Entamoeba invadens
KSVN

SEQ ID NO: 2877829 - protein, 12 aa, Entamoeba invadens
KSVNETQEVDEL

SEQ ID NO: 2877830 - protein, 12 aa, Entamoeba invadens
KSVNGASVTLTQ

SEQ ID NO: 2877831 - protein, 9 aa, Entamoeba invadens
KSVNKEQNV

SEQ ID NO: 2877832 - protein, 8 aa, Entamoeba invadens
KSVNNETM

SEQ ID NO: 2877833 - protein, 7 aa, Entamoeba invadens
KSVNNSI

SEQ ID NO: 2877834 - protein, 8 aa, Entamoeba invadens
KSVNQKEL

SEQ ID NO: 2877835 - protein, 12 aa, Entamoeba invadens
KSVNSKTEELSI

SEQ ID NO: 2877836 - protein, 6 aa, Entamoeba invadens
KSVNVD

SEQ ID NO: 2877837 - protein, 20 aa, Entamoeba invadens
KSVPIGSQITPTATNNIGES

SEQ ID NO: 2877838 - protein, 7 aa, Entamoeba invadens
KSVPKQT

SEQ ID NO: 2877839 - protein, 8 aa, Entamoeba invadens
KSVPPHVP

SEQ ID NO: 2877840 - protein, 6 aa, Entamoeba invadens
KSVQAA

SEQ ID NO: 2877841 - protein, 12 aa, Entamoeba invadens
KSVQEREKKRFT

SEQ ID NO: 2877842 - protein, 14 aa, Entamoeba invadens
KSVQINEESNVKTH

SEQ ID NO: 2877843 - protein, 5 aa, Entamoeba invadens
KSVRK

SEQ ID NO: 2877844 - protein, 12 aa, Entamoeba invadens
KSVRNDTNSRYY

SEQ ID NO: 2877845 - protein, 9 aa, Entamoeba invadens
KSVSDVGES

SEQ ID NO: 2877846 - protein, 8 aa, Entamoeba invadens
KSVSGIGQ

SEQ ID NO: 2877847 - protein, 7 aa, Entamoeba invadens
KSVSKIG

SEQ ID NO: 2877848 - protein, 17 aa, Entamoeba invadens
KSVSNGIKSVDTGIENG

SEQ ID NO: 2877849 - protein, 8 aa, Entamoeba invadens
KSVSPMTP

SEQ ID NO: 2877850 - protein, 13 aa, Entamoeba invadens
KSVSQRRLNGGEV

SEQ ID NO: 2877851 - protein, 12 aa, Entamoeba invadens
KSVSSDNVVQEM

SEQ ID NO: 2877852 - protein, 14 aa, Entamoeba invadens
KSVSSSDSNENLKP

SEQ ID NO: 2877853 - protein, 4 aa, Entamoeba invadens
KSVT

SEQ ID NO: 2877854 - protein, 11 aa, Entamoeba invadens
KSVTEELASNT

SEQ ID NO: 2877855 - protein, 6 aa, Entamoeba invadens
KSVTER

SEQ ID NO: 2877856 - protein, 5 aa, Entamoeba invadens
KSVTK

SEQ ID NO: 2877857 - protein, 19 aa, Entamoeba invadens
KSVTKIGSNGFESFTQVVY

SEQ ID NO: 2877858 - protein, 12 aa, Entamoeba invadens
KSVTLSKDKLHK

SEQ ID NO: 2877859 - protein, 6 aa, Entamoeba invadens
KSVTPH

SEQ ID NO: 2877860 - protein, 6 aa, Entamoeba invadens
KSVTSG

SEQ ID NO: 2877861 - protein, 6 aa, Entamoeba invadens
KSVTSI

SEQ ID NO: 2877862 - protein, 9 aa, Entamoeba invadens
KSVTSQMHS

SEQ ID NO: 2877863 - protein, 9 aa, Entamoeba invadens
KSWDTSITQ

SEQ ID NO: 2877864 - protein, 5 aa, Entamoeba invadens
KSWED

SEQ ID NO: 2877865 - protein, 4 aa, Entamoeba invadens
KSWG

SEQ ID NO: 2877866 - protein, 5 aa, Entamoeba invadens
KSWNK

SEQ ID NO: 2877867 - protein, 8 aa, Entamoeba invadens
KSWREKDK

SEQ ID NO: 2877868 - protein, 4 aa, Entamoeba invadens
KSYD

SEQ ID NO: 2877869 - protein, 6 aa, Entamoeba invadens
KSYDAQ

SEQ ID NO: 2877870 - protein, 13 aa, Entamoeba invadens
KSYDQLKKDNVNG

SEQ ID NO: 2877871 - protein, 11 aa, Entamoeba invadens
KSYDTSMGNST

SEQ ID NO: 2877872 - protein, 4 aa, Entamoeba invadens
KSYE

SEQ ID NO: 2877873 - protein, 6 aa, Entamoeba invadens
KSYEAI

SEQ ID NO: 2877874 - protein, 13 aa, Entamoeba invadens
KSYEGHKGNVTGI

SEQ ID NO: 2877875 - protein, 8 aa, Entamoeba invadens
KSYELPDG

SEQ ID NO: 2877876 - protein, 6 aa, Entamoeba invadens
KSYGSL

SEQ ID NO: 2877877 - protein, 6 aa, Entamoeba invadens
KSYGTD

SEQ ID NO: 2877878 - protein, 7 aa, Entamoeba invadens
KSYKDKE

SEQ ID NO: 2877879 - protein, 23 aa, Entamoeba invadens
KSYKEKKSEQQQEEKDQEKEKEM

SEQ ID NO: 2877880 - protein, 7 aa, Entamoeba invadens
KSYKERI

SEQ ID NO: 2877881 - protein, 8 aa, Entamoeba invadens
KSYKMSDE

SEQ ID NO: 2877882 - protein, 7 aa, Entamoeba invadens
KSYKSAD

SEQ ID NO: 2877883 - protein, 23 aa, Entamoeba invadens
KSYKSSKRSEEPKVTESNTKTAS

SEQ ID NO: 2877884 - protein, 13 aa, Entamoeba invadens
KSYKVDENKEETL

SEQ ID NO: 2877885 - protein, 7 aa, Entamoeba invadens
KSYNLQN

SEQ ID NO: 2877886 - protein, 15 aa, Entamoeba invadens
KSYNSTNKLSCFFSI

SEQ ID NO: 2877887 - protein, 13 aa, Entamoeba invadens
KSYNTYSDTENEL

SEQ ID NO: 2877888 - protein, 6 aa, Entamoeba invadens
KSYPDV

SEQ ID NO: 2877889 - protein, 7 aa, Entamoeba invadens
KSYPQKE

SEQ ID NO: 2877890 - protein, 14 aa, Entamoeba invadens
KSYQEVGKTWKQEV

SEQ ID NO: 2877891 - protein, 7 aa, Entamoeba invadens
KSYQNDL

SEQ ID NO: 2877892 - protein, 7 aa, Entamoeba invadens
KSYQTHQ

SEQ ID NO: 2877893 - protein, 6 aa, Entamoeba invadens
KSYQTL

SEQ ID NO: 2877894 - protein, 7 aa, Entamoeba invadens
KSYQVTS

SEQ ID NO: 2877895 - protein, 21 aa, Entamoeba invadens
KSYREPTLDKSMNKRRVNNEN

SEQ ID NO: 2877896 - protein, 6 aa, Entamoeba invadens
KSYSIG

SEQ ID NO: 2877897 - protein, 12 aa, Entamoeba invadens
KSYSPHHPIDPK

SEQ ID NO: 2877898 - protein, 6 aa, Entamoeba invadens
KSYSSF

SEQ ID NO: 2877899 - protein, 9 aa, Entamoeba invadens
KSYSTSGFG

SEQ ID NO: 2877900 - protein, 4 aa, Entamoeba invadens
KSYT

SEQ ID NO: 2877901 - protein, 6 aa, Entamoeba invadens
KSYTAP

SEQ ID NO: 2877902 - protein, 4 aa, Entamoeba invadens
KSYY

SEQ ID NO: 2877903 - protein, 9 aa, Entamoeba invadens
KSYYKGADG

SEQ ID NO: 2877904 - protein, 9 aa, Entamoeba invadens
KTAAEQSIK

SEQ ID NO: 2877905 - protein, 19 aa, Entamoeba invadens
KTAASAAKKQMEEEERKRE

SEQ ID NO: 2877906 - protein, 4 aa, Entamoeba invadens
KTAD

SEQ ID NO: 2877907 - protein, 7 aa, Entamoeba invadens
KTADDVE

SEQ ID NO: 2877908 - protein, 15 aa, Entamoeba invadens
KTADEMADLNDSNID

SEQ ID NO: 2877909 - protein, 10 aa, Entamoeba invadens
KTADETTIKN

SEQ ID NO: 2877910 - protein, 10 aa, Entamoeba invadens
KTADKAATYD

SEQ ID NO: 2877911 - protein, 10 aa, Entamoeba invadens
KTADKIGKKV

SEQ ID NO: 2877912 - protein, 9 aa, Entamoeba invadens
KTADSAQKA

SEQ ID NO: 2877913 - protein, 9 aa, Entamoeba invadens
KTAEEGYQD

SEQ ID NO: 2877914 - protein, 6 aa, Entamoeba invadens
KTAEER

SEQ ID NO: 2877915 - protein, 5 aa, Entamoeba invadens
KTAEF

SEQ ID NO: 2877916 - protein, 8 aa, Entamoeba invadens
KTAEGGEV

SEQ ID NO: 2877917 - protein, 7 aa, Entamoeba invadens
KTAEGKK

SEQ ID NO: 2877918 - protein, 8 aa, Entamoeba invadens
KTAEGMDH

SEQ ID NO: 2877919 - protein, 5 aa, Entamoeba invadens
KTAGD

SEQ ID NO: 2877920 - protein, 8 aa, Entamoeba invadens
KTAGDNKL

SEQ ID NO: 2877921 - protein, 7 aa, Entamoeba invadens
KTAGMNI

SEQ ID NO: 2877922 - protein, 12 aa, Entamoeba invadens
KTAGSVSFTPSI

SEQ ID NO: 2877923 - protein, 13 aa, Entamoeba invadens
KTAGSVSFTPSIP

SEQ ID NO: 2877924 - protein, 11 aa, Entamoeba invadens
KTAITKKTSDL

SEQ ID NO: 2877925 - protein, 4 aa, Entamoeba invadens
KTAK

SEQ ID NO: 2877926 - protein, 7 aa, Entamoeba invadens
KTAKEGL

SEQ ID NO: 2877927 - protein, 10 aa, Entamoeba invadens
KTAKENIEKY

SEQ ID NO: 2877928 - protein, 8 aa, Entamoeba invadens
KTAKGRNV

SEQ ID NO: 2877929 - protein, 5 aa, Entamoeba invadens
KTAKQ

SEQ ID NO: 2877930 - protein, 7 aa, Entamoeba invadens
KTAKRYG

SEQ ID NO: 2877931 - protein, 5 aa, Entamoeba invadens
KTAKS

SEQ ID NO: 2877932 - protein, 4 aa, Entamoeba invadens
KTAL

SEQ ID NO: 2877933 - protein, 7 aa, Entamoeba invadens
KTAPSTY

SEQ ID NO: 2877934 - protein, 9 aa, Entamoeba invadens
KTAQKESYD

SEQ ID NO: 2877935 - protein, 8 aa, Entamoeba invadens
KTAQTPRV

SEQ ID NO: 2877936 - protein, 10 aa, Entamoeba invadens
KTARRRRNTN

SEQ ID NO: 2877937 - protein, 12 aa, Entamoeba invadens
KTARTEQVSTHE

SEQ ID NO: 2877938 - protein, 9 aa, Entamoeba invadens
KTASGSTAS

SEQ ID NO: 2877939 - protein, 12 aa, Entamoeba invadens
KTASLNSPIKET

SEQ ID NO: 2877940 - protein, 25 aa, Entamoeba invadens
KTASPEKPLDIEKKPQVETQQSTGC

SEQ ID NO: 2877941 - protein, 23 aa, Entamoeba invadens
KTASSGPNSSPSPTGELQQGGIS

SEQ ID NO: 2877942 - protein, 4 aa, Entamoeba invadens
KTAT

SEQ ID NO: 2877943 - protein, 6 aa, Entamoeba invadens
KTATDA

SEQ ID NO: 2877944 - protein, 8 aa, Entamoeba invadens
KTATDTDI

SEQ ID NO: 2877945 - protein, 5 aa, Entamoeba invadens
KTATF

SEQ ID NO: 2877946 - protein, 7 aa, Entamoeba invadens
KTATGLS

SEQ ID NO: 2877947 - protein, 20 aa, Entamoeba invadens
KTATNTPRVVDETNGPRRLT

SEQ ID NO: 2877948 - protein, 16 aa, Entamoeba invadens
KTATQIRDKVNNTRSS

SEQ ID NO: 2877949 - protein, 12 aa, Entamoeba invadens
KTATQKKKMGTN

SEQ ID NO: 2877950 - protein, 11 aa, Entamoeba invadens
KTATRRLQNNK

SEQ ID NO: 2877951 - protein, 8 aa, Entamoeba invadens
KTATSAKG

SEQ ID NO: 2877952 - protein, 23 aa, Entamoeba invadens
KTAVKSPSKTPKTPKTPNTELKE

SEQ ID NO: 2877953 - protein, 6 aa, Entamoeba invadens
KTAYEK

SEQ ID NO: 2877954 - protein, 6 aa, Entamoeba invadens
KTCATD

SEQ ID NO: 2877955 - protein, 19 aa, Entamoeba invadens
KTCDETGETYYENPPWQPT

SEQ ID NO: 2877956 - protein, 6 aa, Entamoeba invadens
KTCDGE

SEQ ID NO: 2877957 - protein, 16 aa, Entamoeba invadens
KTCERGSDRNKQINTQ

SEQ ID NO: 2877958 - protein, 12 aa, Entamoeba invadens
KTCHSSDETQFE

SEQ ID NO: 2877959 - protein, 10 aa, Entamoeba invadens
KTCNGPSGDN

SEQ ID NO: 2877960 - protein, 5 aa, Entamoeba invadens
KTCNT

SEQ ID NO: 2877961 - protein, 10 aa, Entamoeba invadens
KTCNTDGTCN

SEQ ID NO: 2877962 - protein, 12 aa, Entamoeba invadens
KTCPSTVTPTNS

SEQ ID NO: 2877963 - protein, 6 aa, Entamoeba invadens
KTCQVS

SEQ ID NO: 2877964 - protein, 29 aa, Entamoeba invadens
KTCRPKRQNVSQQNQDNFINSDEEKQQNE

SEQ ID NO: 2877965 - protein, 4 aa, Entamoeba invadens
KTCS

SEQ ID NO: 2877966 - protein, 6 aa, Entamoeba invadens
KTCSLE

SEQ ID NO: 2877967 - protein, 10 aa, Entamoeba invadens
KTCSPDNNRK

SEQ ID NO: 2877968 - protein, 6 aa, Entamoeba invadens
KTCSRP

SEQ ID NO: 2877969 - protein, 11 aa, Entamoeba invadens
KTCSSDSTRKC

SEQ ID NO: 2877970 - protein, 11 aa, Entamoeba invadens
KTCSSTSKKCH

SEQ ID NO: 2877971 - protein, 22 aa, Entamoeba invadens
KTCSTANKCTNAQQHQVNVRNA

SEQ ID NO: 2877972 - protein, 5 aa, Entamoeba invadens
KTCTA

SEQ ID NO: 2877973 - protein, 7 aa, Entamoeba invadens
KTCTEET

SEQ ID NO: 2877974 - protein, 6 aa, Entamoeba invadens
KTDADC

SEQ ID NO: 2877975 - protein, 7 aa, Entamoeba invadens
KTDAKYV

SEQ ID NO: 2877976 - protein, 5 aa, Entamoeba invadens
KTDAL

SEQ ID NO: 2877977 - protein, 6 aa, Entamoeba invadens
KTDATY

SEQ ID NO: 2877978 - protein, 8 aa, Entamoeba invadens
KTDCRNDE

SEQ ID NO: 2877979 - protein, 9 aa, Entamoeba invadens
KTDCRTDEG

SEQ ID NO: 2877980 - protein, 16 aa, Entamoeba invadens
KTDDDIDTKVSDHQPR

SEQ ID NO: 2877981 - protein, 6 aa, Entamoeba invadens
KTDEEK

SEQ ID NO: 2877982 - protein, 7 aa, Entamoeba invadens
KTDEKQC

SEQ ID NO: 2877983 - protein, 6 aa, Entamoeba invadens
KTDEKR

SEQ ID NO: 2877984 - protein, 8 aa, Entamoeba invadens
KTDENFGN

SEQ ID NO: 2877985 - protein, 11 aa, Entamoeba invadens
KTDERSQTLTQ

SEQ ID NO: 2877986 - protein, 8 aa, Entamoeba invadens
KTDETFGN

SEQ ID NO: 2877987 - protein, 6 aa, Entamoeba invadens
KTDFTK

SEQ ID NO: 2877988 - protein, 4 aa, Entamoeba invadens
KTDG

SEQ ID NO: 2877989 - protein, 6 aa, Entamoeba invadens
KTDGFS

SEQ ID NO: 2877990 - protein, 5 aa, Entamoeba invadens
KTDGH

SEQ ID NO: 2877991 - protein, 7 aa, Entamoeba invadens
KTDGKKK

SEQ ID NO: 2877992 - protein, 10 aa, Entamoeba invadens
KTDGLKQSTL

SEQ ID NO: 2877993 - protein, 8 aa, Entamoeba invadens
KTDHTNDT

SEQ ID NO: 2877994 - protein, 4 aa, Entamoeba invadens
KTDK

SEQ ID NO: 2877995 - protein, 8 aa, Entamoeba invadens
KTDKDPDV

SEQ ID NO: 2877996 - protein, 14 aa, Entamoeba invadens
KTDKEEVSKPQHVE

SEQ ID NO: 2877997 - protein, 6 aa, Entamoeba invadens
KTDKKE

SEQ ID NO: 2877998 - protein, 10 aa, Entamoeba invadens
KTDKKERAVS

SEQ ID NO: 2877999 - protein, 5 aa, Entamoeba invadens
KTDKL

SEQ ID NO: 2878000 - protein, 8 aa, Entamoeba invadens
KTDKPAVI

SEQ ID NO: 2878001 - protein, 9 aa, Entamoeba invadens
KTDKQYADK

SEQ ID NO: 2878002 - protein, 14 aa, Entamoeba invadens
KTDKSSSDECEDGV

SEQ ID NO: 2878003 - protein, 10 aa, Entamoeba invadens
KTDKTISTQL

SEQ ID NO: 2878004 - protein, 5 aa, Entamoeba invadens
KTDKY

SEQ ID NO: 2878005 - protein, 22 aa, Entamoeba invadens
KTDLADARQVPTSDGQAFAKSK

SEQ ID NO: 2878006 - protein, 18 aa, Entamoeba invadens
KTDLEDKREVSVDEGVKL

SEQ ID NO: 2878007 - protein, 7 aa, Entamoeba invadens
KTDLEHK

SEQ ID NO: 2878008 - protein, 24 aa, Entamoeba invadens
KTDLEKDRAVSTDDGQNLAEKYNS

SEQ ID NO: 2878009 - protein, 6 aa, Entamoeba invadens
KTDLEN

SEQ ID NO: 2878010 - protein, 17 aa, Entamoeba invadens
KTDLEQNRVVSSEQGQM

SEQ ID NO: 2878011 - protein, 13 aa, Entamoeba invadens
KTDLKESKYPQKL

SEQ ID NO: 2878012 - protein, 20 aa, Entamoeba invadens
KTDLPPKVTVEQGEAMAREQ

SEQ ID NO: 2878013 - protein, 7 aa, Entamoeba invadens
KTDLRED

SEQ ID NO: 2878014 - protein, 15 aa, Entamoeba invadens
KTDLRESEDVKSRLQ

SEQ ID NO: 2878015 - protein, 10 aa, Entamoeba invadens
KTDLRSSAEH

SEQ ID NO: 2878016 - protein, 5 aa, Entamoeba invadens
KTDLT

SEQ ID NO: 2878017 - protein, 4 aa, Entamoeba invadens
KTDN

SEQ ID NO: 2878018 - protein, 5 aa, Entamoeba invadens
KTDNA

SEQ ID NO: 2878019 - protein, 5 aa, Entamoeba invadens
KTDNE

SEQ ID NO: 2878020 - protein, 27 aa, Entamoeba invadens
KTDNINERTVTDQQAEQFSKPKGYKSM

SEQ ID NO: 2878021 - protein, 7 aa, Entamoeba invadens
KTDNTTI

SEQ ID NO: 2878022 - protein, 18 aa, Entamoeba invadens
KTDPEKRLGTKKGAEEIK

SEQ ID NO: 2878023 - protein, 9 aa, Entamoeba invadens
KTDPKNADY

SEQ ID NO: 2878024 - protein, 4 aa, Entamoeba invadens
KTDQ

SEQ ID NO: 2878025 - protein, 13 aa, Entamoeba invadens
KTDQSKFKEDTDT

SEQ ID NO: 2878026 - protein, 7 aa, Entamoeba invadens
KTDRARN

SEQ ID NO: 2878027 - protein, 7 aa, Entamoeba invadens
KTDRSKF

SEQ ID NO: 2878028 - protein, 10 aa, Entamoeba invadens
KTDSPVPHKA

SEQ ID NO: 2878029 - protein, 10 aa, Entamoeba invadens
KTDSSNNYRG

SEQ ID NO: 2878030 - protein, 7 aa, Entamoeba invadens
KTDSTYK

SEQ ID NO: 2878031 - protein, 8 aa, Entamoeba invadens
KTDTAAAF

SEQ ID NO: 2878032 - protein, 6 aa, Entamoeba invadens
KTDTGC

SEQ ID NO: 2878033 - protein, 7 aa, Entamoeba invadens
KTDTSFE

SEQ ID NO: 2878034 - protein, 17 aa, Entamoeba invadens
KTDTSIAATRVDDGDAF

SEQ ID NO: 2878035 - protein, 21 aa, Entamoeba invadens
KTDTTKDITTGGTGMEPGDAY

SEQ ID NO: 2878036 - protein, 15 aa, Entamoeba invadens
KTDTVTGETKLSPSG

SEQ ID NO: 2878037 - protein, 11 aa, Entamoeba invadens
KTDTYQQTKAR

SEQ ID NO: 2878038 - protein, 4 aa, Entamoeba invadens
KTDV

SEQ ID NO: 2878039 - protein, 8 aa, Entamoeba invadens
KTDVPYSS

SEQ ID NO: 2878040 - protein, 5 aa, Entamoeba invadens
KTDVR

SEQ ID NO: 2878041 - protein, 18 aa, Entamoeba invadens
KTDYDDQEKIKEKIRKMD

SEQ ID NO: 2878042 - protein, 6 aa, Entamoeba invadens
KTDYEA

SEQ ID NO: 2878043 - protein, 4 aa, Entamoeba invadens
KTEA

SEQ ID NO: 2878044 - protein, 10 aa, Entamoeba invadens
KTEAEDLAKK

SEQ ID NO: 2878045 - protein, 5 aa, Entamoeba invadens
KTEAQ

SEQ ID NO: 2878046 - protein, 6 aa, Entamoeba invadens
KTECTK

SEQ ID NO: 2878047 - protein, 5 aa, Entamoeba invadens
KTEDA

SEQ ID NO: 2878048 - protein, 7 aa, Entamoeba invadens
KTEDAQK

SEQ ID NO: 2878049 - protein, 10 aa, Entamoeba invadens
KTEDETFSSI

SEQ ID NO: 2878050 - protein, 21 aa, Entamoeba invadens
KTEDLKSIQSDLDEVRSGKLN

SEQ ID NO: 2878051 - protein, 7 aa, Entamoeba invadens
KTEDTLN

SEQ ID NO: 2878052 - protein, 31 aa, Entamoeba invadens
KTEEANNQDNTDLKTQNEKLKKELETSKQSW

SEQ ID NO: 2878053 - protein, 9 aa, Entamoeba invadens
KTEEATKNA

SEQ ID NO: 2878054 - protein, 5 aa, Entamoeba invadens
KTEED

SEQ ID NO: 2878055 - protein, 21 aa, Entamoeba invadens
KTEEDAKKALEMDKKTIGKRS

SEQ ID NO: 2878056 - protein, 12 aa, Entamoeba invadens
KTEEDLSRAKRE

SEQ ID NO: 2878057 - protein, 14 aa, Entamoeba invadens
KTEEEKNNKLNEEL

SEQ ID NO: 2878058 - protein, 75 aa, Entamoeba invadens
KTEEEKNNKLNEELDNIKEEKDKITNEKKEIEEKFKRKTDDLEKQIKEKEDKLNATTEKIEEIEKEKKEKIEQLE

SEQ ID NO: 2878059 - protein, 24 aa, Entamoeba invadens
KTEEEKNNKLNEELDNIKEEKEKV

SEQ ID NO: 2878060 - protein, 6 aa, Entamoeba invadens
KTEEEW

SEQ ID NO: 2878061 - protein, 9 aa, Entamoeba invadens
KTEEGGRSY

SEQ ID NO: 2878062 - protein, 6 aa, Entamoeba invadens
KTEEHR

SEQ ID NO: 2878063 - protein, 5 aa, Entamoeba invadens
KTEEM

SEQ ID NO: 2878064 - protein, 15 aa, Entamoeba invadens
KTEEQNEKDKNEQKI

SEQ ID NO: 2878065 - protein, 6 aa, Entamoeba invadens
KTEESV

SEQ ID NO: 2878066 - protein, 10 aa, Entamoeba invadens
KTEEVERGTV

SEQ ID NO: 2878067 - protein, 5 aa, Entamoeba invadens
KTEFE

SEQ ID NO: 2878068 - protein, 6 aa, Entamoeba invadens
KTEFKT

SEQ ID NO: 2878069 - protein, 5 aa, Entamoeba invadens
KTEFT

SEQ ID NO: 2878070 - protein, 15 aa, Entamoeba invadens
KTEGGKSTISSYSPS

SEQ ID NO: 2878071 - protein, 8 aa, Entamoeba invadens
KTEGPLND

SEQ ID NO: 2878072 - protein, 6 aa, Entamoeba invadens
KTEGSI

SEQ ID NO: 2878073 - protein, 7 aa, Entamoeba invadens
KTEHPFP

SEQ ID NO: 2878074 - protein, 6 aa, Entamoeba invadens
KTEHSP

SEQ ID NO: 2878075 - protein, 6 aa, Entamoeba invadens
KTEHYN

SEQ ID NO: 2878076 - protein, 7 aa, Entamoeba invadens
KTEIERN

SEQ ID NO: 2878077 - protein, 8 aa, Entamoeba invadens
KTEIKRDT

SEQ ID NO: 2878078 - protein, 9 aa, Entamoeba invadens
KTEKARRPL

SEQ ID NO: 2878079 - protein, 5 aa, Entamoeba invadens
KTEKC

SEQ ID NO: 2878080 - protein, 11 aa, Entamoeba invadens
KTEKEETEFKE

SEQ ID NO: 2878081 - protein, 8 aa, Entamoeba invadens
KTEKESSE

SEQ ID NO: 2878082 - protein, 6 aa, Entamoeba invadens
KTEKGI

SEQ ID NO: 2878083 - protein, 25 aa, Entamoeba invadens
KTEKLQKAENMPKQIESKKKKEMPQ

SEQ ID NO: 2878084 - protein, 8 aa, Entamoeba invadens
KTEKNTIL

SEQ ID NO: 2878085 - protein, 6 aa, Entamoeba invadens
KTEKSE

SEQ ID NO: 2878086 - protein, 9 aa, Entamoeba invadens
KTEKSKLSK

SEQ ID NO: 2878087 - protein, 9 aa, Entamoeba invadens
KTEKTDQKF

SEQ ID NO: 2878088 - protein, 21 aa, Entamoeba invadens
KTEKTGEASVSSNTSSKKIPN

SEQ ID NO: 2878089 - protein, 4 aa, Entamoeba invadens
KTEL

SEQ ID NO: 2878090 - protein, 54 aa, Entamoeba invadens
KTELDDKQDKCDKLEDDLQTQRIGTEEKEAQNAAAKANKQAKQYDRKVEEAERK

SEQ ID NO: 2878091 - protein, 19 aa, Entamoeba invadens
KTELDEKQDECDKLEDDMS

SEQ ID NO: 2878092 - protein, 23 aa, Entamoeba invadens
KTELDEKQDKCDKLEDEVSEMKT

SEQ ID NO: 2878093 - protein, 22 aa, Entamoeba invadens
KTELDEKQNECDKLEDDMSEMK

SEQ ID NO: 2878094 - protein, 13 aa, Entamoeba invadens
KTELGRTKAELDQ

SEQ ID NO: 2878095 - protein, 5 aa, Entamoeba invadens
KTELK

SEQ ID NO: 2878096 - protein, 6 aa, Entamoeba invadens
KTELSK

SEQ ID NO: 2878097 - protein, 7 aa, Entamoeba invadens
KTELSKQ

SEQ ID NO: 2878098 - protein, 18 aa, Entamoeba invadens
KTELTELRDRTANDNEKI

SEQ ID NO: 2878099 - protein, 7 aa, Entamoeba invadens
KTELTNS

SEQ ID NO: 2878100 - protein, 11 aa, Entamoeba invadens
KTEMETKNAEI

SEQ ID NO: 2878101 - protein, 7 aa, Entamoeba invadens
KTENAEN

SEQ ID NO: 2878102 - protein, 5 aa, Entamoeba invadens
KTENF

SEQ ID NO: 2878103 - protein, 6 aa, Entamoeba invadens
KTENKQ

SEQ ID NO: 2878104 - protein, 5 aa, Entamoeba invadens
KTENL

SEQ ID NO: 2878105 - protein, 6 aa, Entamoeba invadens
KTENQV

SEQ ID NO: 2878106 - protein, 7 aa, Entamoeba invadens
KTENSTC

SEQ ID NO: 2878107 - protein, 8 aa, Entamoeba invadens
KTENVPKS

SEQ ID NO: 2878108 - protein, 4 aa, Entamoeba invadens
KTEQ

SEQ ID NO: 2878109 - protein, 19 aa, Entamoeba invadens
KTEQEEDEEKRTAIKNENE

SEQ ID NO: 2878110 - protein, 11 aa, Entamoeba invadens
KTEQEKPHDAK

SEQ ID NO: 2878111 - protein, 24 aa, Entamoeba invadens
KTEQEKTKKLNEELEKCQNEKDKV

SEQ ID NO: 2878112 - protein, 8 aa, Entamoeba invadens
KTEQTTDE

SEQ ID NO: 2878113 - protein, 7 aa, Entamoeba invadens
KTERAVN

SEQ ID NO: 2878114 - protein, 10 aa, Entamoeba invadens
KTERNNKNIE

SEQ ID NO: 2878115 - protein, 4 aa, Entamoeba invadens
KTES

SEQ ID NO: 2878116 - protein, 7 aa, Entamoeba invadens
KTESDAF

SEQ ID NO: 2878117 - protein, 8 aa, Entamoeba invadens
KTESFPQS

SEQ ID NO: 2878118 - protein, 8 aa, Entamoeba invadens
KTESPTTV

SEQ ID NO: 2878119 - protein, 10 aa, Entamoeba invadens
KTESSSSSIG

SEQ ID NO: 2878120 - protein, 15 aa, Entamoeba invadens
KTESTTPPPPTSPVS

SEQ ID NO: 2878121 - protein, 7 aa, Entamoeba invadens
KTESVSV

SEQ ID NO: 2878122 - protein, 6 aa, Entamoeba invadens
KTETAL

SEQ ID NO: 2878123 - protein, 7 aa, Entamoeba invadens
KTETDFA

SEQ ID NO: 2878124 - protein, 7 aa, Entamoeba invadens
KTETDKY

SEQ ID NO: 2878125 - protein, 27 aa, Entamoeba invadens
KTETKCFESSSRIQGEKQKFSSEGGAY

SEQ ID NO: 2878126 - protein, 8 aa, Entamoeba invadens
KTETKKSV

SEQ ID NO: 2878127 - protein, 9 aa, Entamoeba invadens
KTETPPDDA

SEQ ID NO: 2878128 - protein, 38 aa, Entamoeba invadens
KTETPPSKKSHCTPPNKPAMTPPLPFSSPENKPFGSKS

SEQ ID NO: 2878129 - protein, 8 aa, Entamoeba invadens
KTETQTKR

SEQ ID NO: 2878130 - protein, 6 aa, Entamoeba invadens
KTETSY

SEQ ID NO: 2878131 - protein, 12 aa, Entamoeba invadens
KTEVADRSNMKG

SEQ ID NO: 2878132 - protein, 8 aa, Entamoeba invadens
KTEVDGSK

SEQ ID NO: 2878133 - protein, 9 aa, Entamoeba invadens
KTEVEQQKP

SEQ ID NO: 2878134 - protein, 13 aa, Entamoeba invadens
KTEVKKREKKEKV

SEQ ID NO: 2878135 - protein, 7 aa, Entamoeba invadens
KTEVNQV

SEQ ID NO: 2878136 - protein, 4 aa, Entamoeba invadens
KTEY

SEQ ID NO: 2878137 - protein, 19 aa, Entamoeba invadens
KTFAKTSSLYYDDGDDVLA

SEQ ID NO: 2878138 - protein, 6 aa, Entamoeba invadens
KTFDTD

SEQ ID NO: 2878139 - protein, 10 aa, Entamoeba invadens
KTFDTKETTI

SEQ ID NO: 2878140 - protein, 5 aa, Entamoeba invadens
KTFEE

SEQ ID NO: 2878141 - protein, 6 aa, Entamoeba invadens
KTFESN

SEQ ID NO: 2878142 - protein, 13 aa, Entamoeba invadens
KTFGGKKGTLKEE

SEQ ID NO: 2878143 - protein, 5 aa, Entamoeba invadens
KTFGN

SEQ ID NO: 2878144 - protein, 16 aa, Entamoeba invadens
KTFKGSHQVPSHTTPN

SEQ ID NO: 2878145 - protein, 8 aa, Entamoeba invadens
KTFKTTNE

SEQ ID NO: 2878146 - protein, 32 aa, Entamoeba invadens
KTFNGVKSSVNKGMKSISTSMKKATKKVKGVM

SEQ ID NO: 2878147 - protein, 6 aa, Entamoeba invadens
KTFPAD

SEQ ID NO: 2878148 - protein, 6 aa, Entamoeba invadens
KTFPDD

SEQ ID NO: 2878149 - protein, 6 aa, Entamoeba invadens
KTFPED

SEQ ID NO: 2878150 - protein, 5 aa, Entamoeba invadens
KTFPS

SEQ ID NO: 2878151 - protein, 18 aa, Entamoeba invadens
KTFQANTKIKNSESVTSS

SEQ ID NO: 2878152 - protein, 10 aa, Entamoeba invadens
KTFQRRKNSE

SEQ ID NO: 2878153 - protein, 7 aa, Entamoeba invadens
KTFSKNG

SEQ ID NO: 2878154 - protein, 6 aa, Entamoeba invadens
KTFSNC

SEQ ID NO: 2878155 - protein, 6 aa, Entamoeba invadens
KTFSNP

SEQ ID NO: 2878156 - protein, 30 aa, Entamoeba invadens
KTFSSDTENMSLEQNSDEESDSEFEDTNND

SEQ ID NO: 2878157 - protein, 13 aa, Entamoeba invadens
KTFTEEEELSTNA

SEQ ID NO: 2878158 - protein, 8 aa, Entamoeba invadens
KTFTNSSS

SEQ ID NO: 2878159 - protein, 5 aa, Entamoeba invadens
KTFTR

SEQ ID NO: 2878160 - protein, 11 aa, Entamoeba invadens
KTFTSAKDQQT

SEQ ID NO: 2878161 - protein, 5 aa, Entamoeba invadens
KTFTY

SEQ ID NO: 2878162 - protein, 5 aa, Entamoeba invadens
KTFVP

SEQ ID NO: 2878163 - protein, 4 aa, Entamoeba invadens
KTGA

SEQ ID NO: 2878164 - protein, 5 aa, Entamoeba invadens
KTGAL

SEQ ID NO: 2878165 - protein, 7 aa, Entamoeba invadens
KTGAQEK

SEQ ID NO: 2878166 - protein, 4 aa, Entamoeba invadens
KTGD

SEQ ID NO: 2878167 - protein, 9 aa, Entamoeba invadens
KTGDEGCLD

SEQ ID NO: 2878168 - protein, 13 aa, Entamoeba invadens
KTGDIGSVAKDGA

SEQ ID NO: 2878169 - protein, 5 aa, Entamoeba invadens
KTGEE

SEQ ID NO: 2878170 - protein, 6 aa, Entamoeba invadens
KTGEGI

SEQ ID NO: 2878171 - protein, 5 aa, Entamoeba invadens
KTGEH

SEQ ID NO: 2878172 - protein, 6 aa, Entamoeba invadens
KTGEQH

SEQ ID NO: 2878173 - protein, 9 aa, Entamoeba invadens
KTGESKSQL

SEQ ID NO: 2878174 - protein, 6 aa, Entamoeba invadens
KTGESQ

SEQ ID NO: 2878175 - protein, 6 aa, Entamoeba invadens
KTGEYE

SEQ ID NO: 2878176 - protein, 6 aa, Entamoeba invadens
KTGEYS

SEQ ID NO: 2878177 - protein, 5 aa, Entamoeba invadens
KTGFD

SEQ ID NO: 2878178 - protein, 5 aa, Entamoeba invadens
KTGFE

SEQ ID NO: 2878179 - protein, 6 aa, Entamoeba invadens
KTGGLE

SEQ ID NO: 2878180 - protein, 5 aa, Entamoeba invadens
KTGHS

SEQ ID NO: 2878181 - protein, 7 aa, Entamoeba invadens
KTGHSAS

SEQ ID NO: 2878182 - protein, 19 aa, Entamoeba invadens
KTGHTSFKKNCRELQQFLL

SEQ ID NO: 2878183 - protein, 4 aa, Entamoeba invadens
KTGI

SEQ ID NO: 2878184 - protein, 6 aa, Entamoeba invadens
KTGICN

SEQ ID NO: 2878185 - protein, 7 aa, Entamoeba invadens
KTGIYSD

SEQ ID NO: 2878186 - protein, 7 aa, Entamoeba invadens
KTGKESV

SEQ ID NO: 2878187 - protein, 8 aa, Entamoeba invadens
KTGKTSVT

SEQ ID NO: 2878188 - protein, 4 aa, Entamoeba invadens
KTGL

SEQ ID NO: 2878189 - protein, 11 aa, Entamoeba invadens
KTGLATDDEDL

SEQ ID NO: 2878190 - protein, 12 aa, Entamoeba invadens
KTGLFPSNYVTL

SEQ ID NO: 2878191 - protein, 13 aa, Entamoeba invadens
KTGLNSKIESLGE

SEQ ID NO: 2878192 - protein, 8 aa, Entamoeba invadens
KTGLSSNT

SEQ ID NO: 2878193 - protein, 7 aa, Entamoeba invadens
KTGLVPT

SEQ ID NO: 2878194 - protein, 10 aa, Entamoeba invadens
KTGMSKTTAF

SEQ ID NO: 2878195 - protein, 7 aa, Entamoeba invadens
KTGNDGR

SEQ ID NO: 2878196 - protein, 7 aa, Entamoeba invadens
KTGNHDK

SEQ ID NO: 2878197 - protein, 8 aa, Entamoeba invadens
KTGNTQSN

SEQ ID NO: 2878198 - protein, 6 aa, Entamoeba invadens
KTGNYS

SEQ ID NO: 2878199 - protein, 8 aa, Entamoeba invadens
KTGQAPNM

SEQ ID NO: 2878200 - protein, 6 aa, Entamoeba invadens
KTGQYN

SEQ ID NO: 2878201 - protein, 29 aa, Entamoeba invadens
KTGRTKKTSDGDSPEPTTSRTPRKYSNPV

SEQ ID NO: 2878202 - protein, 7 aa, Entamoeba invadens
KTGSGKT

SEQ ID NO: 2878203 - protein, 8 aa, Entamoeba invadens
KTGSHTQY

SEQ ID NO: 2878204 - protein, 24 aa, Entamoeba invadens
KTGTFIGEGASRSFDTRKVIALHF

SEQ ID NO: 2878205 - protein, 8 aa, Entamoeba invadens
KTGTPEEF

SEQ ID NO: 2878206 - protein, 8 aa, Entamoeba invadens
KTGTQYNE

SEQ ID NO: 2878207 - protein, 8 aa, Entamoeba invadens
KTGTVTDQ

SEQ ID NO: 2878208 - protein, 10 aa, Entamoeba invadens
KTGVENGNFT

SEQ ID NO: 2878209 - protein, 6 aa, Entamoeba invadens
KTGVSY

SEQ ID NO: 2878210 - protein, 4 aa, Entamoeba invadens
KTGW

SEQ ID NO: 2878211 - protein, 5 aa, Entamoeba invadens
KTGWN

SEQ ID NO: 2878212 - protein, 5 aa, Entamoeba invadens
KTGYD

SEQ ID NO: 2878213 - protein, 5 aa, Entamoeba invadens
KTGYE

SEQ ID NO: 2878214 - protein, 6 aa, Entamoeba invadens
KTGYFD

SEQ ID NO: 2878215 - protein, 7 aa, Entamoeba invadens
KTGYNLD

SEQ ID NO: 2878216 - protein, 6 aa, Entamoeba invadens
KTHANW

SEQ ID NO: 2878217 - protein, 6 aa, Entamoeba invadens
KTHEDF

SEQ ID NO: 2878218 - protein, 10 aa, Entamoeba invadens
KTHELEKTLS

SEQ ID NO: 2878219 - protein, 13 aa, Entamoeba invadens
KTHEQPKKNEKGG

SEQ ID NO: 2878220 - protein, 5 aa, Entamoeba invadens
KTHFE

SEQ ID NO: 2878221 - protein, 7 aa, Entamoeba invadens
KTHGEGE

SEQ ID NO: 2878222 - protein, 10 aa, Entamoeba invadens
KTHGEKTGGF

SEQ ID NO: 2878223 - protein, 9 aa, Entamoeba invadens
KTHGTQTGG

SEQ ID NO: 2878224 - protein, 7 aa, Entamoeba invadens
KTHHPEE

SEQ ID NO: 2878225 - protein, 11 aa, Entamoeba invadens
KTHKGSDANKS

SEQ ID NO: 2878226 - protein, 8 aa, Entamoeba invadens
KTHKKNGK

SEQ ID NO: 2878227 - protein, 17 aa, Entamoeba invadens
KTHKKSRDYTKRDEFKE

SEQ ID NO: 2878228 - protein, 10 aa, Entamoeba invadens
KTHKVNAAEE

SEQ ID NO: 2878229 - protein, 7 aa, Entamoeba invadens
KTHPTSL

SEQ ID NO: 2878230 - protein, 6 aa, Entamoeba invadens
KTHQIT

SEQ ID NO: 2878231 - protein, 8 aa, Entamoeba invadens
KTHSKPKS

SEQ ID NO: 2878232 - protein, 83 aa, Entamoeba invadens
KTHSSQVVKENGKPGVSTEGQSSSISPDDKRSEGVRNRCTEKYERSLGEFTESDGCGNDENSIVRGQSEKKSDNSLSDPELST

SEQ ID NO: 2878233 - protein, 8 aa, Entamoeba invadens
KTHTKHST

SEQ ID NO: 2878234 - protein, 6 aa, Entamoeba invadens
KTHTPT

SEQ ID NO: 2878235 - protein, 5 aa, Entamoeba invadens
KTHVD

SEQ ID NO: 2878236 - protein, 7 aa, Entamoeba invadens
KTHYSLE

SEQ ID NO: 2878237 - protein, 4 aa, Entamoeba invadens
KTIA

SEQ ID NO: 2878238 - protein, 8 aa, Entamoeba invadens
KTIADNEA

SEQ ID NO: 2878239 - protein, 9 aa, Entamoeba invadens
KTIAKTEEI

SEQ ID NO: 2878240 - protein, 8 aa, Entamoeba invadens
KTIAPQNR

SEQ ID NO: 2878241 - protein, 13 aa, Entamoeba invadens
KTIASQKNEFDEK

SEQ ID NO: 2878242 - protein, 13 aa, Entamoeba invadens
KTIASREDEYHSR

SEQ ID NO: 2878243 - protein, 8 aa, Entamoeba invadens
KTIDDKTH

SEQ ID NO: 2878244 - protein, 7 aa, Entamoeba invadens
KTIDGDL

SEQ ID NO: 2878245 - protein, 12 aa, Entamoeba invadens
KTIDNDISYTDT

SEQ ID NO: 2878246 - protein, 7 aa, Entamoeba invadens
KTIEKNS

SEQ ID NO: 2878247 - protein, 59 aa, Entamoeba invadens
KTIENQKETTKQLQNELKDKNDIIETTKKQKEEAEQKEKTTSIQLSEEQSKAKELTEKL

SEQ ID NO: 2878248 - protein, 28 aa, Entamoeba invadens
KTIENQNKTTKQLQNELKDKNDNLEKVN

SEQ ID NO: 2878249 - protein, 12 aa, Entamoeba invadens
KTIENQNKTTLQ

SEQ ID NO: 2878250 - protein, 16 aa, Entamoeba invadens
KTIENQNKTTTQLQNN

SEQ ID NO: 2878251 - protein, 9 aa, Entamoeba invadens
KTIENTDAY

SEQ ID NO: 2878252 - protein, 8 aa, Entamoeba invadens
KTIETMKE

SEQ ID NO: 2878253 - protein, 7 aa, Entamoeba invadens
KTIETST

SEQ ID NO: 2878254 - protein, 5 aa, Entamoeba invadens
KTIEV

SEQ ID NO: 2878255 - protein, 5 aa, Entamoeba invadens
KTIGE

SEQ ID NO: 2878256 - protein, 17 aa, Entamoeba invadens
KTIGKSGHGSIKSEEQI

SEQ ID NO: 2878257 - protein, 11 aa, Entamoeba invadens
KTIGRKQFDEN

SEQ ID NO: 2878258 - protein, 5 aa, Entamoeba invadens
KTIGS

SEQ ID NO: 2878259 - protein, 4 aa, Entamoeba invadens
KTIK

SEQ ID NO: 2878260 - protein, 9 aa, Entamoeba invadens
KTIKEDERR

SEQ ID NO: 2878261 - protein, 14 aa, Entamoeba invadens
KTIKSTDVTTTQKD

SEQ ID NO: 2878262 - protein, 14 aa, Entamoeba invadens
KTIKTRSTNVGRTI

SEQ ID NO: 2878263 - protein, 12 aa, Entamoeba invadens
KTINDPTDYKTR

SEQ ID NO: 2878264 - protein, 16 aa, Entamoeba invadens
KTINKDFKNAVKNNQI

SEQ ID NO: 2878265 - protein, 6 aa, Entamoeba invadens
KTINYN

SEQ ID NO: 2878266 - protein, 4 aa, Entamoeba invadens
KTIP

SEQ ID NO: 2878267 - protein, 5 aa, Entamoeba invadens
KTIPP

SEQ ID NO: 2878268 - protein, 10 aa, Entamoeba invadens
KTIQDNKDLH

SEQ ID NO: 2878269 - protein, 5 aa, Entamoeba invadens
KTIQM

SEQ ID NO: 2878270 - protein, 15 aa, Entamoeba invadens
KTIQNEKNKNSTGIH

SEQ ID NO: 2878271 - protein, 13 aa, Entamoeba invadens
KTIQNEQIDTNTT

SEQ ID NO: 2878272 - protein, 9 aa, Entamoeba invadens
KTIQRGGDT

SEQ ID NO: 2878273 - protein, 4 aa, Entamoeba invadens
KTIR

SEQ ID NO: 2878274 - protein, 21 aa, Entamoeba invadens
KTISEDFRGNTKEEGDAGKQI

SEQ ID NO: 2878275 - protein, 8 aa, Entamoeba invadens
KTISGEKF

SEQ ID NO: 2878276 - protein, 14 aa, Entamoeba invadens
KTISGKVKPTDVSK

SEQ ID NO: 2878277 - protein, 7 aa, Entamoeba invadens
KTISKAQ

SEQ ID NO: 2878278 - protein, 5 aa, Entamoeba invadens
KTISR

SEQ ID NO: 2878279 - protein, 11 aa, Entamoeba invadens
KTISRHSTEFS

SEQ ID NO: 2878280 - protein, 10 aa, Entamoeba invadens
KTISRNAESA

SEQ ID NO: 2878281 - protein, 22 aa, Entamoeba invadens
KTISTPLDTKDIKERQNEEHPV

SEQ ID NO: 2878282 - protein, 4 aa, Entamoeba invadens
KTIT

SEQ ID NO: 2878283 - protein, 6 aa, Entamoeba invadens
KTITAT

SEQ ID NO: 2878284 - protein, 13 aa, Entamoeba invadens
KTITEKTQTLTEN

SEQ ID NO: 2878285 - protein, 9 aa, Entamoeba invadens
KTITSKPPL

SEQ ID NO: 2878286 - protein, 4 aa, Entamoeba invadens
KTKA

SEQ ID NO: 2878287 - protein, 6 aa, Entamoeba invadens
KTKAKD

SEQ ID NO: 2878288 - protein, 13 aa, Entamoeba invadens
KTKAKINDTLTRA

SEQ ID NO: 2878289 - protein, 7 aa, Entamoeba invadens
KTKAPDN

SEQ ID NO: 2878290 - protein, 7 aa, Entamoeba invadens
KTKAVPE

SEQ ID NO: 2878291 - protein, 8 aa, Entamoeba invadens
KTKCPKSL

SEQ ID NO: 2878292 - protein, 10 aa, Entamoeba invadens
KTKDEKKEIS

SEQ ID NO: 2878293 - protein, 6 aa, Entamoeba invadens
KTKDFQ

SEQ ID NO: 2878294 - protein, 8 aa, Entamoeba invadens
KTKDITEK

SEQ ID NO: 2878295 - protein, 6 aa, Entamoeba invadens
KTKDQL

SEQ ID NO: 2878296 - protein, 10 aa, Entamoeba invadens
KTKDYEGSYT

SEQ ID NO: 2878297 - protein, 9 aa, Entamoeba invadens
KTKEAFPGD

SEQ ID NO: 2878298 - protein, 12 aa, Entamoeba invadens
KTKEDAKTNYQQ

SEQ ID NO: 2878299 - protein, 8 aa, Entamoeba invadens
KTKEDEFK

SEQ ID NO: 2878300 - protein, 12 aa, Entamoeba invadens
KTKEDLKESNNL

SEQ ID NO: 2878301 - protein, 9 aa, Entamoeba invadens
KTKEEDKAF

SEQ ID NO: 2878302 - protein, 18 aa, Entamoeba invadens
KTKEEKDMKDKDEKVNME

SEQ ID NO: 2878303 - protein, 12 aa, Entamoeba invadens
KTKEENKGHEKQ

SEQ ID NO: 2878304 - protein, 6 aa, Entamoeba invadens
KTKEKT

SEQ ID NO: 2878305 - protein, 8 aa, Entamoeba invadens
KTKEMRRD

SEQ ID NO: 2878306 - protein, 5 aa, Entamoeba invadens
KTKEN

SEQ ID NO: 2878307 - protein, 6 aa, Entamoeba invadens
KTKEPF

SEQ ID NO: 2878308 - protein, 8 aa, Entamoeba invadens
KTKEQKDG

SEQ ID NO: 2878309 - protein, 13 aa, Entamoeba invadens
KTKETFESREGKN

SEQ ID NO: 2878310 - protein, 9 aa, Entamoeba invadens
KTKEVTTEL

SEQ ID NO: 2878311 - protein, 5 aa, Entamoeba invadens
KTKEY

SEQ ID NO: 2878312 - protein, 16 aa, Entamoeba invadens
KTKEYEVDEANEKAEQ

SEQ ID NO: 2878313 - protein, 7 aa, Entamoeba invadens
KTKFGNY

SEQ ID NO: 2878314 - protein, 5 aa, Entamoeba invadens
KTKGA

SEQ ID NO: 2878315 - protein, 7 aa, Entamoeba invadens
KTKGARY

SEQ ID NO: 2878316 - protein, 14 aa, Entamoeba invadens
KTKGDKNEKVEEKM

SEQ ID NO: 2878317 - protein, 13 aa, Entamoeba invadens
KTKGEEKVTKKKR

SEQ ID NO: 2878318 - protein, 8 aa, Entamoeba invadens
KTKGETKN

SEQ ID NO: 2878319 - protein, 12 aa, Entamoeba invadens
KTKGKEDPNYEE

SEQ ID NO: 2878320 - protein, 11 aa, Entamoeba invadens
KTKGQLHHEGN

SEQ ID NO: 2878321 - protein, 8 aa, Entamoeba invadens
KTKGSITN

SEQ ID NO: 2878322 - protein, 7 aa, Entamoeba invadens
KTKGSSE

SEQ ID NO: 2878323 - protein, 28 aa, Entamoeba invadens
KTKKAEKKSSEKSDGSNPLVKSKSEPQM

SEQ ID NO: 2878324 - protein, 18 aa, Entamoeba invadens
KTKKANVKAFDDNTPQEN

SEQ ID NO: 2878325 - protein, 9 aa, Entamoeba invadens
KTKKASVTE

SEQ ID NO: 2878326 - protein, 7 aa, Entamoeba invadens
KTKKDNE

SEQ ID NO: 2878327 - protein, 12 aa, Entamoeba invadens
KTKKEETKQAPE

SEQ ID NO: 2878328 - protein, 22 aa, Entamoeba invadens
KTKKENEEKDKKINEKDDELEK

SEQ ID NO: 2878329 - protein, 9 aa, Entamoeba invadens
KTKKENSYH

SEQ ID NO: 2878330 - protein, 9 aa, Entamoeba invadens
KTKKGEKFP

SEQ ID NO: 2878331 - protein, 8 aa, Entamoeba invadens
KTKKGNLN

SEQ ID NO: 2878332 - protein, 6 aa, Entamoeba invadens
KTKKIS

SEQ ID NO: 2878333 - protein, 7 aa, Entamoeba invadens
KTKKKPV

SEQ ID NO: 2878334 - protein, 10 aa, Entamoeba invadens
KTKKLSSEDN

SEQ ID NO: 2878335 - protein, 9 aa, Entamoeba invadens
KTKKPIESI

SEQ ID NO: 2878336 - protein, 9 aa, Entamoeba invadens
KTKKSLERP

SEQ ID NO: 2878337 - protein, 8 aa, Entamoeba invadens
KTKKTKQT

SEQ ID NO: 2878338 - protein, 8 aa, Entamoeba invadens
KTKKTYPL

SEQ ID NO: 2878339 - protein, 6 aa, Entamoeba invadens
KTKKWT

SEQ ID NO: 2878340 - protein, 7 aa, Entamoeba invadens
KTKNAKM

SEQ ID NO: 2878341 - protein, 5 aa, Entamoeba invadens
KTKNC

SEQ ID NO: 2878342 - protein, 10 aa, Entamoeba invadens
KTKNDSQSVS

SEQ ID NO: 2878343 - protein, 6 aa, Entamoeba invadens
KTKNFT

SEQ ID NO: 2878344 - protein, 5 aa, Entamoeba invadens
KTKNM

SEQ ID NO: 2878345 - protein, 10 aa, Entamoeba invadens
KTKNQQKVVN

SEQ ID NO: 2878346 - protein, 8 aa, Entamoeba invadens
KTKNTENI

SEQ ID NO: 2878347 - protein, 6 aa, Entamoeba invadens
KTKNVE

SEQ ID NO: 2878348 - protein, 10 aa, Entamoeba invadens
KTKPDGTTLA

SEQ ID NO: 2878349 - protein, 8 aa, Entamoeba invadens
KTKPIATR

SEQ ID NO: 2878350 - protein, 7 aa, Entamoeba invadens
KTKPIDE

SEQ ID NO: 2878351 - protein, 7 aa, Entamoeba invadens
KTKPKED

SEQ ID NO: 2878352 - protein, 8 aa, Entamoeba invadens
KTKPKTER

SEQ ID NO: 2878353 - protein, 7 aa, Entamoeba invadens
KTKPLEE

SEQ ID NO: 2878354 - protein, 16 aa, Entamoeba invadens
KTKPQGLMNISYCAPK

SEQ ID NO: 2878355 - protein, 24 aa, Entamoeba invadens
KTKPSTLGPLTQKTKPKIPKPTKN

SEQ ID NO: 2878356 - protein, 22 aa, Entamoeba invadens
KTKPTLSYNPLPTSNSTIYDNK

SEQ ID NO: 2878357 - protein, 8 aa, Entamoeba invadens
KTKQAKHT

SEQ ID NO: 2878358 - protein, 15 aa, Entamoeba invadens
KTKQEMEEVQQSTTN

SEQ ID NO: 2878359 - protein, 6 aa, Entamoeba invadens
KTKQEV

SEQ ID NO: 2878360 - protein, 10 aa, Entamoeba invadens
KTKQGNKNVN

SEQ ID NO: 2878361 - protein, 17 aa, Entamoeba invadens
KTKQKANLVKEDNSKVT

SEQ ID NO: 2878362 - protein, 9 aa, Entamoeba invadens
KTKQNTNLI

SEQ ID NO: 2878363 - protein, 6 aa, Entamoeba invadens
KTKQPL

SEQ ID NO: 2878364 - protein, 6 aa, Entamoeba invadens
KTKREV

SEQ ID NO: 2878365 - protein, 8 aa, Entamoeba invadens
KTKRFRNE

SEQ ID NO: 2878366 - protein, 8 aa, Entamoeba invadens
KTKRSEMT

SEQ ID NO: 2878367 - protein, 27 aa, Entamoeba invadens
KTKSDGLEKTPIKQHSRTSSRSTRSFG

SEQ ID NO: 2878368 - protein, 7 aa, Entamoeba invadens
KTKSEIS

SEQ ID NO: 2878369 - protein, 7 aa, Entamoeba invadens
KTKSEQI

SEQ ID NO: 2878370 - protein, 12 aa, Entamoeba invadens
KTKSHDGEPQNG

SEQ ID NO: 2878371 - protein, 9 aa, Entamoeba invadens
KTKSIEDVA

SEQ ID NO: 2878372 - protein, 10 aa, Entamoeba invadens
KTKSKDRDEL

SEQ ID NO: 2878373 - protein, 6 aa, Entamoeba invadens
KTKSKL

SEQ ID NO: 2878374 - protein, 8 aa, Entamoeba invadens
KTKSKRLK

SEQ ID NO: 2878375 - protein, 19 aa, Entamoeba invadens
KTKSNQKLYGNNKHKKCVL

SEQ ID NO: 2878376 - protein, 15 aa, Entamoeba invadens
KTKSNQKLYGTNKHK

SEQ ID NO: 2878377 - protein, 6 aa, Entamoeba invadens
KTKSQQ

SEQ ID NO: 2878378 - protein, 13 aa, Entamoeba invadens
KTKSSGTNHCQPE

SEQ ID NO: 2878379 - protein, 9 aa, Entamoeba invadens
KTKSSWGAQ

SEQ ID NO: 2878380 - protein, 8 aa, Entamoeba invadens
KTKSTDVV

SEQ ID NO: 2878381 - protein, 8 aa, Entamoeba invadens
KTKTAKEL

SEQ ID NO: 2878382 - protein, 9 aa, Entamoeba invadens
KTKTANGKK

SEQ ID NO: 2878383 - protein, 6 aa, Entamoeba invadens
KTKTDL

SEQ ID NO: 2878384 - protein, 5 aa, Entamoeba invadens
KTKTE

SEQ ID NO: 2878385 - protein, 7 aa, Entamoeba invadens
KTKTFSK

SEQ ID NO: 2878386 - protein, 12 aa, Entamoeba invadens
KTKTPKPEPFGD

SEQ ID NO: 2878387 - protein, 9 aa, Entamoeba invadens
KTKTSGANV

SEQ ID NO: 2878388 - protein, 9 aa, Entamoeba invadens
KTKTSGSNV

SEQ ID NO: 2878389 - protein, 5 aa, Entamoeba invadens
KTKTY

SEQ ID NO: 2878390 - protein, 4 aa, Entamoeba invadens
KTKV

SEQ ID NO: 2878391 - protein, 12 aa, Entamoeba invadens
KTKVAEKKVDKS

SEQ ID NO: 2878392 - protein, 5 aa, Entamoeba invadens
KTKVG

SEQ ID NO: 2878393 - protein, 11 aa, Entamoeba invadens
KTKVGLKETIE

SEQ ID NO: 2878394 - protein, 15 aa, Entamoeba invadens
KTKVQPSLSASKKDF

SEQ ID NO: 2878395 - protein, 4 aa, Entamoeba invadens
KTKY

SEQ ID NO: 2878396 - protein, 8 aa, Entamoeba invadens
KTKYDDST

SEQ ID NO: 2878397 - protein, 7 aa, Entamoeba invadens
KTKYGEW

SEQ ID NO: 2878398 - protein, 6 aa, Entamoeba invadens
KTKYTG

SEQ ID NO: 2878399 - protein, 4 aa, Entamoeba invadens
KTLA

SEQ ID NO: 2878400 - protein, 6 aa, Entamoeba invadens
KTLADG

SEQ ID NO: 2878401 - protein, 12 aa, Entamoeba invadens
KTLANTGTYARN

SEQ ID NO: 2878402 - protein, 12 aa, Entamoeba invadens
KTLDGTSAEQIV

SEQ ID NO: 2878403 - protein, 5 aa, Entamoeba invadens
KTLDN

SEQ ID NO: 2878404 - protein, 17 aa, Entamoeba invadens
KTLDTKKELKREESKHG

SEQ ID NO: 2878405 - protein, 4 aa, Entamoeba invadens
KTLE

SEQ ID NO: 2878406 - protein, 39 aa, Entamoeba invadens
KTLEDAKKAKKEKENEEKRKQALEEQKKIQQHNEAEKSR

SEQ ID NO: 2878407 - protein, 12 aa, Entamoeba invadens
KTLEDIKEQVDD

SEQ ID NO: 2878408 - protein, 18 aa, Entamoeba invadens
KTLEEEVQNETNNSNKMK

SEQ ID NO: 2878409 - protein, 6 aa, Entamoeba invadens
KTLEGE

SEQ ID NO: 2878410 - protein, 20 aa, Entamoeba invadens
KTLEGYYQESGRAGRDGEPA

SEQ ID NO: 2878411 - protein, 6 aa, Entamoeba invadens
KTLENG

SEQ ID NO: 2878412 - protein, 6 aa, Entamoeba invadens
KTLENT

SEQ ID NO: 2878413 - protein, 6 aa, Entamoeba invadens
KTLEST

SEQ ID NO: 2878414 - protein, 13 aa, Entamoeba invadens
KTLETKTGDNKKT

SEQ ID NO: 2878415 - protein, 8 aa, Entamoeba invadens
KTLETPRD

SEQ ID NO: 2878416 - protein, 12 aa, Entamoeba invadens
KTLGEMSGSEHL

SEQ ID NO: 2878417 - protein, 8 aa, Entamoeba invadens
KTLGKGKR

SEQ ID NO: 2878418 - protein, 8 aa, Entamoeba invadens
KTLKDTRN

SEQ ID NO: 2878419 - protein, 14 aa, Entamoeba invadens
KTLKEAFTKQEKKN

SEQ ID NO: 2878420 - protein, 10 aa, Entamoeba invadens
KTLKEGDKIQ

SEQ ID NO: 2878421 - protein, 6 aa, Entamoeba invadens
KTLKGG

SEQ ID NO: 2878422 - protein, 19 aa, Entamoeba invadens
KTLKSAGQYTNLERSSIEG

SEQ ID NO: 2878423 - protein, 11 aa, Entamoeba invadens
KTLKSTSKVVK

SEQ ID NO: 2878424 - protein, 4 aa, Entamoeba invadens
KTLN

SEQ ID NO: 2878425 - protein, 4 aa, Entamoeba invadens
KTLP

SEQ ID NO: 2878426 - protein, 6 aa, Entamoeba invadens
KTLPET

SEQ ID NO: 2878427 - protein, 10 aa, Entamoeba invadens
KTLPETEKAK

SEQ ID NO: 2878428 - protein, 6 aa, Entamoeba invadens
KTLPKS

SEQ ID NO: 2878429 - protein, 5 aa, Entamoeba invadens
KTLPN

SEQ ID NO: 2878430 - protein, 8 aa, Entamoeba invadens
KTLPPLNT

SEQ ID NO: 2878431 - protein, 15 aa, Entamoeba invadens
KTLPPLPPKKNDIDD

SEQ ID NO: 2878432 - protein, 6 aa, Entamoeba invadens
KTLPPN

SEQ ID NO: 2878433 - protein, 7 aa, Entamoeba invadens
KTLPPSV

SEQ ID NO: 2878434 - protein, 13 aa, Entamoeba invadens
KTLPQEEQESDWV

SEQ ID NO: 2878435 - protein, 17 aa, Entamoeba invadens
KTLPSFPRYDASAKAGG

SEQ ID NO: 2878436 - protein, 6 aa, Entamoeba invadens
KTLPTT

SEQ ID NO: 2878437 - protein, 16 aa, Entamoeba invadens
KTLQSVTSNQQNSEDL

SEQ ID NO: 2878438 - protein, 6 aa, Entamoeba invadens
KTLQTG

SEQ ID NO: 2878439 - protein, 7 aa, Entamoeba invadens
KTLQTTK

SEQ ID NO: 2878440 - protein, 7 aa, Entamoeba invadens
KTLRGSK

SEQ ID NO: 2878441 - protein, 16 aa, Entamoeba invadens
KTLRTKADDSDKKRYG

SEQ ID NO: 2878442 - protein, 4 aa, Entamoeba invadens
KTLS

SEQ ID NO: 2878443 - protein, 9 aa, Entamoeba invadens
KTLSENTVT

SEQ ID NO: 2878444 - protein, 4 aa, Entamoeba invadens
KTLT

SEQ ID NO: 2878445 - protein, 5 aa, Entamoeba invadens
KTLTD

SEQ ID NO: 2878446 - protein, 9 aa, Entamoeba invadens
KTLTPTDTP

SEQ ID NO: 2878447 - protein, 6 aa, Entamoeba invadens
KTLTSE

SEQ ID NO: 2878448 - protein, 6 aa, Entamoeba invadens
KTLTVP

SEQ ID NO: 2878449 - protein, 5 aa, Entamoeba invadens
KTLVT

SEQ ID NO: 2878450 - protein, 6 aa, Entamoeba invadens
KTLYDD

SEQ ID NO: 2878451 - protein, 9 aa, Entamoeba invadens
KTMAKNEQS

SEQ ID NO: 2878452 - protein, 5 aa, Entamoeba invadens
KTMDE

SEQ ID NO: 2878453 - protein, 8 aa, Entamoeba invadens
KTMEDDED

SEQ ID NO: 2878454 - protein, 17 aa, Entamoeba invadens
KTMKSDEEMKSSSIEEM

SEQ ID NO: 2878455 - protein, 4 aa, Entamoeba invadens
KTMN

SEQ ID NO: 2878456 - protein, 11 aa, Entamoeba invadens
KTMNKRKKEFN

SEQ ID NO: 2878457 - protein, 34 aa, Entamoeba invadens
KTMNYGQNSINTTQQNTITTQRNPNTPQVAPQAQ

SEQ ID NO: 2878458 - protein, 46 aa, Entamoeba invadens
KTMQKKRTAATKTQAEVQRGLNAKTETEENTTPTVAGVPAQKKGVT

SEQ ID NO: 2878459 - protein, 13 aa, Entamoeba invadens
KTMRQKTDVIPEE

SEQ ID NO: 2878460 - protein, 8 aa, Entamoeba invadens
KTMSAGPK

SEQ ID NO: 2878461 - protein, 13 aa, Entamoeba invadens
KTMSEENKKIANE

SEQ ID NO: 2878462 - protein, 9 aa, Entamoeba invadens
KTMSEENKN

SEQ ID NO: 2878463 - protein, 21 aa, Entamoeba invadens
KTMSENGEQPYTKEDGDKLAA

SEQ ID NO: 2878464 - protein, 14 aa, Entamoeba invadens
KTMSSAEEKAFAKQ

SEQ ID NO: 2878465 - protein, 5 aa, Entamoeba invadens
KTMTL

SEQ ID NO: 2878466 - protein, 7 aa, Entamoeba invadens
KTNADVS

SEQ ID NO: 2878467 - protein, 15 aa, Entamoeba invadens
KTNADYSKSISDGVS

SEQ ID NO: 2878468 - protein, 9 aa, Entamoeba invadens
KTNANEADT

SEQ ID NO: 2878469 - protein, 5 aa, Entamoeba invadens
KTNDD

SEQ ID NO: 2878470 - protein, 7 aa, Entamoeba invadens
KTNDEVD

SEQ ID NO: 2878471 - protein, 8 aa, Entamoeba invadens
KTNDFKAD

SEQ ID NO: 2878472 - protein, 6 aa, Entamoeba invadens
KTNDLN

SEQ ID NO: 2878473 - protein, 72 aa, Entamoeba invadens
KTNDNEEKLNKEKEEAELKEKERIAKEEKERLEKEAERLENERLAKEEQLKKEEERLQQEKLAKEEAERIEK

SEQ ID NO: 2878474 - protein, 14 aa, Entamoeba invadens
KTNDPAKEKEKQLD

SEQ ID NO: 2878475 - protein, 6 aa, Entamoeba invadens
KTNDYQ

SEQ ID NO: 2878476 - protein, 4 aa, Entamoeba invadens
KTNE

SEQ ID NO: 2878477 - protein, 9 aa, Entamoeba invadens
KTNEDVDEA

SEQ ID NO: 2878478 - protein, 10 aa, Entamoeba invadens
KTNEDVDEAV

SEQ ID NO: 2878479 - protein, 10 aa, Entamoeba invadens
KTNEEQPNKK

SEQ ID NO: 2878480 - protein, 7 aa, Entamoeba invadens
KTNEEVD

SEQ ID NO: 2878481 - protein, 10 aa, Entamoeba invadens
KTNEKNQEVL

SEQ ID NO: 2878482 - protein, 14 aa, Entamoeba invadens
KTNELSGDLRGHQD

SEQ ID NO: 2878483 - protein, 17 aa, Entamoeba invadens
KTNEPNIKASSEEKRQV

SEQ ID NO: 2878484 - protein, 6 aa, Entamoeba invadens
KTNETI

SEQ ID NO: 2878485 - protein, 8 aa, Entamoeba invadens
KTNEYCED

SEQ ID NO: 2878486 - protein, 5 aa, Entamoeba invadens
KTNGL

SEQ ID NO: 2878487 - protein, 4 aa, Entamoeba invadens
KTNI

SEQ ID NO: 2878488 - protein, 7 aa, Entamoeba invadens
KTNIAKD

SEQ ID NO: 2878489 - protein, 5 aa, Entamoeba invadens
KTNIN

SEQ ID NO: 2878490 - protein, 4 aa, Entamoeba invadens
KTNK

SEQ ID NO: 2878491 - protein, 7 aa, Entamoeba invadens
KTNKANN

SEQ ID NO: 2878492 - protein, 9 aa, Entamoeba invadens
KTNKATEKC

SEQ ID NO: 2878493 - protein, 8 aa, Entamoeba invadens
KTNKDTAQ

SEQ ID NO: 2878494 - protein, 9 aa, Entamoeba invadens
KTNKETKQL

SEQ ID NO: 2878495 - protein, 9 aa, Entamoeba invadens
KTNKLQKSC

SEQ ID NO: 2878496 - protein, 14 aa, Entamoeba invadens
KTNKPIKTGKVKTK

SEQ ID NO: 2878497 - protein, 9 aa, Entamoeba invadens
KTNKQGRVS

SEQ ID NO: 2878498 - protein, 5 aa, Entamoeba invadens
KTNLA

SEQ ID NO: 2878499 - protein, 9 aa, Entamoeba invadens
KTNNGNDKC

SEQ ID NO: 2878500 - protein, 5 aa, Entamoeba invadens
KTNNQ

SEQ ID NO: 2878501 - protein, 16 aa, Entamoeba invadens
KTNNQSNTQQKATCSL

SEQ ID NO: 2878502 - protein, 7 aa, Entamoeba invadens
KTNNQTT

SEQ ID NO: 2878503 - protein, 6 aa, Entamoeba invadens
KTNNVK

SEQ ID NO: 2878504 - protein, 5 aa, Entamoeba invadens
KTNPH

SEQ ID NO: 2878505 - protein, 6 aa, Entamoeba invadens
KTNPHM

SEQ ID NO: 2878506 - protein, 7 aa, Entamoeba invadens
KTNPRQR

SEQ ID NO: 2878507 - protein, 9 aa, Entamoeba invadens
KTNPTFPNT

SEQ ID NO: 2878508 - protein, 11 aa, Entamoeba invadens
KTNPTGPRILP

SEQ ID NO: 2878509 - protein, 15 aa, Entamoeba invadens
KTNPTKFPSIPEAVK

SEQ ID NO: 2878510 - protein, 7 aa, Entamoeba invadens
KTNQEQF

SEQ ID NO: 2878511 - protein, 6 aa, Entamoeba invadens
KTNQFR

SEQ ID NO: 2878512 - protein, 8 aa, Entamoeba invadens
KTNQKARN

SEQ ID NO: 2878513 - protein, 35 aa, Entamoeba invadens
KTNQNENEQKDKELQDLEAKQAEEMQRMLDKIAQW

SEQ ID NO: 2878514 - protein, 17 aa, Entamoeba invadens
KTNQRNETISETTTSEL

SEQ ID NO: 2878515 - protein, 10 aa, Entamoeba invadens
KTNRAKKNEI

SEQ ID NO: 2878516 - protein, 6 aa, Entamoeba invadens
KTNRAR

SEQ ID NO: 2878517 - protein, 7 aa, Entamoeba invadens
KTNRDDW

SEQ ID NO: 2878518 - protein, 7 aa, Entamoeba invadens
KTNREAL

SEQ ID NO: 2878519 - protein, 4 aa, Entamoeba invadens
KTNS

SEQ ID NO: 2878520 - protein, 22 aa, Entamoeba invadens
KTNSAETKIPPTHSSPTFSSPN

SEQ ID NO: 2878521 - protein, 10 aa, Entamoeba invadens
KTNSDSAVSA

SEQ ID NO: 2878522 - protein, 7 aa, Entamoeba invadens
KTNSELM

SEQ ID NO: 2878523 - protein, 8 aa, Entamoeba invadens
KTNSETPH

SEQ ID NO: 2878524 - protein, 5 aa, Entamoeba invadens
KTNSL

SEQ ID NO: 2878525 - protein, 22 aa, Entamoeba invadens
KTNSNSPSPVTSPMKPSQPIEQ

SEQ ID NO: 2878526 - protein, 7 aa, Entamoeba invadens
KTNSNVN

SEQ ID NO: 2878527 - protein, 10 aa, Entamoeba invadens
KTNTDVDDSV

SEQ ID NO: 2878528 - protein, 9 aa, Entamoeba invadens
KTNTEHKEV

SEQ ID NO: 2878529 - protein, 5 aa, Entamoeba invadens
KTNTF

SEQ ID NO: 2878530 - protein, 12 aa, Entamoeba invadens
KTNTIEKQQMDN

SEQ ID NO: 2878531 - protein, 6 aa, Entamoeba invadens
KTNTPI

SEQ ID NO: 2878532 - protein, 11 aa, Entamoeba invadens
KTNTPKVDSRY

SEQ ID NO: 2878533 - protein, 5 aa, Entamoeba invadens
KTNTS

SEQ ID NO: 2878534 - protein, 6 aa, Entamoeba invadens
KTNTSI

SEQ ID NO: 2878535 - protein, 6 aa, Entamoeba invadens
KTNTTI

SEQ ID NO: 2878536 - protein, 8 aa, Entamoeba invadens
KTNTTPEE

SEQ ID NO: 2878537 - protein, 11 aa, Entamoeba invadens
KTNTTQLPTEE

SEQ ID NO: 2878538 - protein, 5 aa, Entamoeba invadens
KTNTY

SEQ ID NO: 2878539 - protein, 5 aa, Entamoeba invadens
KTNVE

SEQ ID NO: 2878540 - protein, 4 aa, Entamoeba invadens
KTNY

SEQ ID NO: 2878541 - protein, 6 aa, Entamoeba invadens
KTNYFS

SEQ ID NO: 2878542 - protein, 8 aa, Entamoeba invadens
KTNYQNSL

SEQ ID NO: 2878543 - protein, 4 aa, Entamoeba invadens
KTPD

SEQ ID NO: 2878544 - protein, 6 aa, Entamoeba invadens
KTPDDY

SEQ ID NO: 2878545 - protein, 7 aa, Entamoeba invadens
KTPDPSK

SEQ ID NO: 2878546 - protein, 7 aa, Entamoeba invadens
KTPDPSL

SEQ ID NO: 2878547 - protein, 7 aa, Entamoeba invadens
KTPDTEK

SEQ ID NO: 2878548 - protein, 6 aa, Entamoeba invadens
KTPEDF

SEQ ID NO: 2878549 - protein, 15 aa, Entamoeba invadens
KTPEDIEDDKMKEEV

SEQ ID NO: 2878550 - protein, 6 aa, Entamoeba invadens
KTPEKE

SEQ ID NO: 2878551 - protein, 14 aa, Entamoeba invadens
KTPELTPTKGHPVK

SEQ ID NO: 2878552 - protein, 6 aa, Entamoeba invadens
KTPEQI

SEQ ID NO: 2878553 - protein, 14 aa, Entamoeba invadens
KTPEQQKAAIEKLN

SEQ ID NO: 2878554 - protein, 6 aa, Entamoeba invadens
KTPETI

SEQ ID NO: 2878555 - protein, 7 aa, Entamoeba invadens
KTPFESY

SEQ ID NO: 2878556 - protein, 6 aa, Entamoeba invadens
KTPFFT

SEQ ID NO: 2878557 - protein, 7 aa, Entamoeba invadens
KTPGVPI

SEQ ID NO: 2878558 - protein, 6 aa, Entamoeba invadens
KTPIES

SEQ ID NO: 2878559 - protein, 4 aa, Entamoeba invadens
KTPK

SEQ ID NO: 2878560 - protein, 10 aa, Entamoeba invadens
KTPKDEKRGN

SEQ ID NO: 2878561 - protein, 7 aa, Entamoeba invadens
KTPKDEV

SEQ ID NO: 2878562 - protein, 12 aa, Entamoeba invadens
KTPKDEVDGATT

SEQ ID NO: 2878563 - protein, 7 aa, Entamoeba invadens
KTPKLTK

SEQ ID NO: 2878564 - protein, 5 aa, Entamoeba invadens
KTPKM

SEQ ID NO: 2878565 - protein, 11 aa, Entamoeba invadens
KTPKPTKPEIR

SEQ ID NO: 2878566 - protein, 5 aa, Entamoeba invadens
KTPKQ

SEQ ID NO: 2878567 - protein, 11 aa, Entamoeba invadens
KTPKRNESAGS

SEQ ID NO: 2878568 - protein, 8 aa, Entamoeba invadens
KTPKTGRD

SEQ ID NO: 2878569 - protein, 5 aa, Entamoeba invadens
KTPKV

SEQ ID NO: 2878570 - protein, 4 aa, Entamoeba invadens
KTPL

SEQ ID NO: 2878571 - protein, 7 aa, Entamoeba invadens
KTPLKEV

SEQ ID NO: 2878572 - protein, 6 aa, Entamoeba invadens
KTPLLE

SEQ ID NO: 2878573 - protein, 17 aa, Entamoeba invadens
KTPLRNKNRVDTSSPEP

SEQ ID NO: 2878574 - protein, 6 aa, Entamoeba invadens
KTPLSE

SEQ ID NO: 2878575 - protein, 18 aa, Entamoeba invadens
KTPLVKTRSDLGSIGVPK

SEQ ID NO: 2878576 - protein, 6 aa, Entamoeba invadens
KTPMDE

SEQ ID NO: 2878577 - protein, 6 aa, Entamoeba invadens
KTPNDD

SEQ ID NO: 2878578 - protein, 9 aa, Entamoeba invadens
KTPNGQMTS

SEQ ID NO: 2878579 - protein, 15 aa, Entamoeba invadens
KTPNIKGEIPLSSKT

SEQ ID NO: 2878580 - protein, 6 aa, Entamoeba invadens
KTPNNK

SEQ ID NO: 2878581 - protein, 5 aa, Entamoeba invadens
KTPPN

SEQ ID NO: 2878582 - protein, 7 aa, Entamoeba invadens
KTPPNIG

SEQ ID NO: 2878583 - protein, 9 aa, Entamoeba invadens
KTPPQRQVV

SEQ ID NO: 2878584 - protein, 6 aa, Entamoeba invadens
KTPPSV

SEQ ID NO: 2878585 - protein, 12 aa, Entamoeba invadens
KTPPTDDSGTPH

SEQ ID NO: 2878586 - protein, 8 aa, Entamoeba invadens
KTPPYDNY

SEQ ID NO: 2878587 - protein, 5 aa, Entamoeba invadens
KTPQE

SEQ ID NO: 2878588 - protein, 13 aa, Entamoeba invadens
KTPQRRGESKPNF

SEQ ID NO: 2878589 - protein, 29 aa, Entamoeba invadens
KTPQSTPSTPTKKIPKKYKDEKQKDELQE

SEQ ID NO: 2878590 - protein, 7 aa, Entamoeba invadens
KTPQSVE

SEQ ID NO: 2878591 - protein, 8 aa, Entamoeba invadens
KTPREENS

SEQ ID NO: 2878592 - protein, 5 aa, Entamoeba invadens
KTPRG

SEQ ID NO: 2878593 - protein, 5 aa, Entamoeba invadens
KTPSD

SEQ ID NO: 2878594 - protein, 8 aa, Entamoeba invadens
KTPSENDY

SEQ ID NO: 2878595 - protein, 28 aa, Entamoeba invadens
KTPSQRFKRGHKHKRSQVDYNSFEDEDK

SEQ ID NO: 2878596 - protein, 7 aa, Entamoeba invadens
KTPSTVN

SEQ ID NO: 2878597 - protein, 6 aa, Entamoeba invadens
KTPTNI

SEQ ID NO: 2878598 - protein, 16 aa, Entamoeba invadens
KTPTQIRDKVNNTKSS

SEQ ID NO: 2878599 - protein, 17 aa, Entamoeba invadens
KTPTQVRDKINNTRSAY

SEQ ID NO: 2878600 - protein, 7 aa, Entamoeba invadens
KTPVENY

SEQ ID NO: 2878601 - protein, 17 aa, Entamoeba invadens
KTPVKKTVTKKKTAKKE

SEQ ID NO: 2878602 - protein, 5 aa, Entamoeba invadens
KTPVL

SEQ ID NO: 2878603 - protein, 5 aa, Entamoeba invadens
KTPVN

SEQ ID NO: 2878604 - protein, 6 aa, Entamoeba invadens
KTPVTE

SEQ ID NO: 2878605 - protein, 5 aa, Entamoeba invadens
KTPVY

SEQ ID NO: 2878606 - protein, 4 aa, Entamoeba invadens
KTQA

SEQ ID NO: 2878607 - protein, 21 aa, Entamoeba invadens
KTQDIPKVEQPPTKKAPRKSL

SEQ ID NO: 2878608 - protein, 24 aa, Entamoeba invadens
KTQDNEPDTPTANTEYAPVFIFDD

SEQ ID NO: 2878609 - protein, 7 aa, Entamoeba invadens
KTQDYTY

SEQ ID NO: 2878610 - protein, 14 aa, Entamoeba invadens
KTQEGKCPIYSEKQ

SEQ ID NO: 2878611 - protein, 6 aa, Entamoeba invadens
KTQEGL

SEQ ID NO: 2878612 - protein, 6 aa, Entamoeba invadens
KTQEKN

SEQ ID NO: 2878613 - protein, 8 aa, Entamoeba invadens
KTQEKSEL

SEQ ID NO: 2878614 - protein, 5 aa, Entamoeba invadens
KTQEL

SEQ ID NO: 2878615 - protein, 5 aa, Entamoeba invadens
KTQEM

SEQ ID NO: 2878616 - protein, 4 aa, Entamoeba invadens
KTQF

SEQ ID NO: 2878617 - protein, 5 aa, Entamoeba invadens
KTQFS

SEQ ID NO: 2878618 - protein, 6 aa, Entamoeba invadens
KTQHDK

SEQ ID NO: 2878619 - protein, 12 aa, Entamoeba invadens
KTQIAETEQHLS

SEQ ID NO: 2878620 - protein, 12 aa, Entamoeba invadens
KTQIDEVKTTTV

SEQ ID NO: 2878621 - protein, 6 aa, Entamoeba invadens
KTQISP

SEQ ID NO: 2878622 - protein, 6 aa, Entamoeba invadens
KTQKAF

SEQ ID NO: 2878623 - protein, 10 aa, Entamoeba invadens
KTQKEQEEIR

SEQ ID NO: 2878624 - protein, 5 aa, Entamoeba invadens
KTQKI

SEQ ID NO: 2878625 - protein, 9 aa, Entamoeba invadens
KTQKSDRIE

SEQ ID NO: 2878626 - protein, 9 aa, Entamoeba invadens
KTQKSRRVY

SEQ ID NO: 2878627 - protein, 68 aa, Entamoeba invadens
KTQLALDDTEKKLDQQVTQNKKASDERDGCNQQLQAEKTKTAALTTAKNAKDKNRKLDSSKKDAQRKI

SEQ ID NO: 2878628 - protein, 9 aa, Entamoeba invadens
KTQLNEEDI

SEQ ID NO: 2878629 - protein, 23 aa, Entamoeba invadens
KTQLSTQLDPDELEEDKKLGEGS

SEQ ID NO: 2878630 - protein, 23 aa, Entamoeba invadens
KTQLSTRLGPDELEEDKKLGEGS

SEQ ID NO: 2878631 - protein, 5 aa, Entamoeba invadens
KTQLT

SEQ ID NO: 2878632 - protein, 7 aa, Entamoeba invadens
KTQLTAE

SEQ ID NO: 2878633 - protein, 8 aa, Entamoeba invadens
KTQLTSTN

SEQ ID NO: 2878634 - protein, 6 aa, Entamoeba invadens
KTQMTT

SEQ ID NO: 2878635 - protein, 4 aa, Entamoeba invadens
KTQN

SEQ ID NO: 2878636 - protein, 6 aa, Entamoeba invadens
KTQNEF

SEQ ID NO: 2878637 - protein, 41 aa, Entamoeba invadens
KTQNGLPQRSLSPCDNALPSDVTTTTKKRRNSISAFTPASS

SEQ ID NO: 2878638 - protein, 6 aa, Entamoeba invadens
KTQNPE

SEQ ID NO: 2878639 - protein, 9 aa, Entamoeba invadens
KTQNQKNLE

SEQ ID NO: 2878640 - protein, 8 aa, Entamoeba invadens
KTQNSYVS

SEQ ID NO: 2878641 - protein, 4 aa, Entamoeba invadens
KTQP

SEQ ID NO: 2878642 - protein, 12 aa, Entamoeba invadens
KTQPEDRISLFL

SEQ ID NO: 2878643 - protein, 9 aa, Entamoeba invadens
KTQPKDTKV

SEQ ID NO: 2878644 - protein, 8 aa, Entamoeba invadens
KTQPKFDE

SEQ ID NO: 2878645 - protein, 12 aa, Entamoeba invadens
KTQPTEKTNGGC

SEQ ID NO: 2878646 - protein, 8 aa, Entamoeba invadens
KTQQDNAI

SEQ ID NO: 2878647 - protein, 5 aa, Entamoeba invadens
KTQQL

SEQ ID NO: 2878648 - protein, 6 aa, Entamoeba invadens
KTQQPE

SEQ ID NO: 2878649 - protein, 7 aa, Entamoeba invadens
KTQSELH

SEQ ID NO: 2878650 - protein, 15 aa, Entamoeba invadens
KTQSKRFDKCDTQSI

SEQ ID NO: 2878651 - protein, 11 aa, Entamoeba invadens
KTQSPKTQKIK

SEQ ID NO: 2878652 - protein, 5 aa, Entamoeba invadens
KTQSV

SEQ ID NO: 2878653 - protein, 7 aa, Entamoeba invadens
KTQSYPG

SEQ ID NO: 2878654 - protein, 8 aa, Entamoeba invadens
KTQTDKTI

SEQ ID NO: 2878655 - protein, 9 aa, Entamoeba invadens
KTQTETTEN

SEQ ID NO: 2878656 - protein, 9 aa, Entamoeba invadens
KTQTETTKG

SEQ ID NO: 2878657 - protein, 9 aa, Entamoeba invadens
KTQTETTKN

SEQ ID NO: 2878658 - protein, 6 aa, Entamoeba invadens
KTQTGH

SEQ ID NO: 2878659 - protein, 5 aa, Entamoeba invadens
KTQTI

SEQ ID NO: 2878660 - protein, 10 aa, Entamoeba invadens
KTQTKKNDMV

SEQ ID NO: 2878661 - protein, 8 aa, Entamoeba invadens
KTQTMTTG

SEQ ID NO: 2878662 - protein, 11 aa, Entamoeba invadens
KTQTNGNTKIE

SEQ ID NO: 2878663 - protein, 19 aa, Entamoeba invadens
KTQTQQNITNKKIKDEQNA

SEQ ID NO: 2878664 - protein, 24 aa, Entamoeba invadens
KTQTRPTHKVSQSIDTTKSKRKCV

SEQ ID NO: 2878665 - protein, 8 aa, Entamoeba invadens
KTQTSECI

SEQ ID NO: 2878666 - protein, 6 aa, Entamoeba invadens
KTQVGQ

SEQ ID NO: 2878667 - protein, 5 aa, Entamoeba invadens
KTQVT

SEQ ID NO: 2878668 - protein, 19 aa, Entamoeba invadens
KTRAESKKMVQQTTQQLNE

SEQ ID NO: 2878669 - protein, 6 aa, Entamoeba invadens
KTRDEV

SEQ ID NO: 2878670 - protein, 6 aa, Entamoeba invadens
KTRDLS

SEQ ID NO: 2878671 - protein, 6 aa, Entamoeba invadens
KTREDC

SEQ ID NO: 2878672 - protein, 6 aa, Entamoeba invadens
KTREES

SEQ ID NO: 2878673 - protein, 20 aa, Entamoeba invadens
KTREIKNDFNKKSPSIQHPQ

SEQ ID NO: 2878674 - protein, 22 aa, Entamoeba invadens
KTREKDNLIEDKDKASQKNQKM

SEQ ID NO: 2878675 - protein, 9 aa, Entamoeba invadens
KTRERSNEF

SEQ ID NO: 2878676 - protein, 7 aa, Entamoeba invadens
KTRFGDP

SEQ ID NO: 2878677 - protein, 9 aa, Entamoeba invadens
KTRGAVSSF

SEQ ID NO: 2878678 - protein, 7 aa, Entamoeba invadens
KTRGELS

SEQ ID NO: 2878679 - protein, 7 aa, Entamoeba invadens
KTRGPKI

SEQ ID NO: 2878680 - protein, 30 aa, Entamoeba invadens
KTRGQKLDFSSSKALSDSLANCESSKDPVV

SEQ ID NO: 2878681 - protein, 9 aa, Entamoeba invadens
KTRITPTTF

SEQ ID NO: 2878682 - protein, 5 aa, Entamoeba invadens
KTRKG

SEQ ID NO: 2878683 - protein, 7 aa, Entamoeba invadens
KTRKGDT

SEQ ID NO: 2878684 - protein, 11 aa, Entamoeba invadens
KTRKITRDDGI

SEQ ID NO: 2878685 - protein, 226 aa, Entamoeba invadens
KTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEIK

SEQ ID NO: 2878686 - protein, 18 aa, Entamoeba invadens
KTRKSTRSFKGPIPKEEL

SEQ ID NO: 2878687 - protein, 6 aa, Entamoeba invadens
KTRKTE

SEQ ID NO: 2878688 - protein, 27 aa, Entamoeba invadens
KTRLPKPNTKNNKFAQNTINSKKNNKR

SEQ ID NO: 2878689 - protein, 10 aa, Entamoeba invadens
KTRLTGQRGS

SEQ ID NO: 2878690 - protein, 6 aa, Entamoeba invadens
KTRMTP

SEQ ID NO: 2878691 - protein, 19 aa, Entamoeba invadens
KTRMTTTTVDAKKKANKAV

SEQ ID NO: 2878692 - protein, 6 aa, Entamoeba invadens
KTRNVS

SEQ ID NO: 2878693 - protein, 7 aa, Entamoeba invadens
KTRQEYS

SEQ ID NO: 2878694 - protein, 8 aa, Entamoeba invadens
KTRRDKSG

SEQ ID NO: 2878695 - protein, 26 aa, Entamoeba invadens
KTRRKKVKKDEEEHEEKKETKPIRKT

SEQ ID NO: 2878696 - protein, 5 aa, Entamoeba invadens
KTRRN

SEQ ID NO: 2878697 - protein, 7 aa, Entamoeba invadens
KTRRSEC

SEQ ID NO: 2878698 - protein, 13 aa, Entamoeba invadens
KTRSENSRIENEN

SEQ ID NO: 2878699 - protein, 20 aa, Entamoeba invadens
KTRSGKKAQDYAIEADNSSQ

SEQ ID NO: 2878700 - protein, 6 aa, Entamoeba invadens
KTRSQY

SEQ ID NO: 2878701 - protein, 6 aa, Entamoeba invadens
KTRSSV

SEQ ID NO: 2878702 - protein, 5 aa, Entamoeba invadens
KTRTI

SEQ ID NO: 2878703 - protein, 5 aa, Entamoeba invadens
KTRTL

SEQ ID NO: 2878704 - protein, 11 aa, Entamoeba invadens
KTRTVGKEKTS

SEQ ID NO: 2878705 - protein, 13 aa, Entamoeba invadens
KTRVERKEEEEKN

SEQ ID NO: 2878706 - protein, 36 aa, Entamoeba invadens
KTSAIKEEEPKPFQKYEGTGYTSNSFTQQKLPNQTF

SEQ ID NO: 2878707 - protein, 6 aa, Entamoeba invadens
KTSANE

SEQ ID NO: 2878708 - protein, 12 aa, Entamoeba invadens
KTSAQDIKANGS

SEQ ID NO: 2878709 - protein, 4 aa, Entamoeba invadens
KTSD

SEQ ID NO: 2878710 - protein, 8 aa, Entamoeba invadens
KTSDDINS

SEQ ID NO: 2878711 - protein, 15 aa, Entamoeba invadens
KTSDKLKEKSKQEYD

SEQ ID NO: 2878712 - protein, 12 aa, Entamoeba invadens
KTSDNSRANKYQ

SEQ ID NO: 2878713 - protein, 7 aa, Entamoeba invadens
KTSDSAI

SEQ ID NO: 2878714 - protein, 7 aa, Entamoeba invadens
KTSEAKM

SEQ ID NO: 2878715 - protein, 6 aa, Entamoeba invadens
KTSEEA

SEQ ID NO: 2878716 - protein, 7 aa, Entamoeba invadens
KTSEEVD

SEQ ID NO: 2878717 - protein, 9 aa, Entamoeba invadens
KTSEGEATV

SEQ ID NO: 2878718 - protein, 14 aa, Entamoeba invadens
KTSEGKGSSTNTKR

SEQ ID NO: 2878719 - protein, 6 aa, Entamoeba invadens
KTSEGV

SEQ ID NO: 2878720 - protein, 11 aa, Entamoeba invadens
KTSEKTEDTLN

SEQ ID NO: 2878721 - protein, 13 aa, Entamoeba invadens
KTSENERKVKDGR

SEQ ID NO: 2878722 - protein, 20 aa, Entamoeba invadens
KTSENYKNVASEGLQALTDE

SEQ ID NO: 2878723 - protein, 17 aa, Entamoeba invadens
KTSEQTEKQMVEEDFKE

SEQ ID NO: 2878724 - protein, 6 aa, Entamoeba invadens
KTSEVL

SEQ ID NO: 2878725 - protein, 6 aa, Entamoeba invadens
KTSFCT

SEQ ID NO: 2878726 - protein, 5 aa, Entamoeba invadens
KTSFL

SEQ ID NO: 2878727 - protein, 9 aa, Entamoeba invadens
KTSFNAPNV

SEQ ID NO: 2878728 - protein, 7 aa, Entamoeba invadens
KTSFRQS

SEQ ID NO: 2878729 - protein, 11 aa, Entamoeba invadens
KTSFSKEKKYK

SEQ ID NO: 2878730 - protein, 8 aa, Entamoeba invadens
KTSGLDKS

SEQ ID NO: 2878731 - protein, 7 aa, Entamoeba invadens
KTSGNFK

SEQ ID NO: 2878732 - protein, 7 aa, Entamoeba invadens
KTSGSNV

SEQ ID NO: 2878733 - protein, 5 aa, Entamoeba invadens
KTSIA

SEQ ID NO: 2878734 - protein, 7 aa, Entamoeba invadens
KTSIEEK

SEQ ID NO: 2878735 - protein, 7 aa, Entamoeba invadens
KTSIQPA

SEQ ID NO: 2878736 - protein, 14 aa, Entamoeba invadens
KTSITEKHEERKKV

SEQ ID NO: 2878737 - protein, 7 aa, Entamoeba invadens
KTSITST

SEQ ID NO: 2878738 - protein, 6 aa, Entamoeba invadens
KTSKMN

SEQ ID NO: 2878739 - protein, 6 aa, Entamoeba invadens
KTSKRV

SEQ ID NO: 2878740 - protein, 10 aa, Entamoeba invadens
KTSKSAATDL

SEQ ID NO: 2878741 - protein, 10 aa, Entamoeba invadens
KTSKSKNEMS

SEQ ID NO: 2878742 - protein, 5 aa, Entamoeba invadens
KTSKV

SEQ ID NO: 2878743 - protein, 26 aa, Entamoeba invadens
KTSMCPQREEHKNERTNDKKEGNKAL

SEQ ID NO: 2878744 - protein, 5 aa, Entamoeba invadens
KTSMQ

SEQ ID NO: 2878745 - protein, 4 aa, Entamoeba invadens
KTSN

SEQ ID NO: 2878746 - protein, 7 aa, Entamoeba invadens
KTSNAKE

SEQ ID NO: 2878747 - protein, 7 aa, Entamoeba invadens
KTSNELN

SEQ ID NO: 2878748 - protein, 10 aa, Entamoeba invadens
KTSNKTSQTA

SEQ ID NO: 2878749 - protein, 9 aa, Entamoeba invadens
KTSNNTSSF

SEQ ID NO: 2878750 - protein, 24 aa, Entamoeba invadens
KTSNSKKRNSLTLTTDKKDKKGLK

SEQ ID NO: 2878751 - protein, 8 aa, Entamoeba invadens
KTSNTPLQ

SEQ ID NO: 2878752 - protein, 4 aa, Entamoeba invadens
KTSP

SEQ ID NO: 2878753 - protein, 12 aa, Entamoeba invadens
KTSPENKENKEV

SEQ ID NO: 2878754 - protein, 5 aa, Entamoeba invadens
KTSPI

SEQ ID NO: 2878755 - protein, 6 aa, Entamoeba invadens
KTSPIV

SEQ ID NO: 2878756 - protein, 6 aa, Entamoeba invadens
KTSPNE

SEQ ID NO: 2878757 - protein, 23 aa, Entamoeba invadens
KTSPPCGAESTSPTLSPSPNQRV

SEQ ID NO: 2878758 - protein, 11 aa, Entamoeba invadens
KTSPPLKTSEI

SEQ ID NO: 2878759 - protein, 8 aa, Entamoeba invadens
KTSPRFKN

SEQ ID NO: 2878760 - protein, 9 aa, Entamoeba invadens
KTSPSSVEI

SEQ ID NO: 2878761 - protein, 13 aa, Entamoeba invadens
KTSQADARKAPYL

SEQ ID NO: 2878762 - protein, 9 aa, Entamoeba invadens
KTSQKEAIE

SEQ ID NO: 2878763 - protein, 10 aa, Entamoeba invadens
KTSQKNTSNY

SEQ ID NO: 2878764 - protein, 5 aa, Entamoeba invadens
KTSQM

SEQ ID NO: 2878765 - protein, 19 aa, Entamoeba invadens
KTSQNVPQKESNKNTLKSN

SEQ ID NO: 2878766 - protein, 5 aa, Entamoeba invadens
KTSQP

SEQ ID NO: 2878767 - protein, 21 aa, Entamoeba invadens
KTSQPQEQQQHSLKNPQDTSY

SEQ ID NO: 2878768 - protein, 6 aa, Entamoeba invadens
KTSQQK

SEQ ID NO: 2878769 - protein, 20 aa, Entamoeba invadens
KTSRGLINDTTKRINEIEGE

SEQ ID NO: 2878770 - protein, 13 aa, Entamoeba invadens
KTSRNTNTTIDLD

SEQ ID NO: 2878771 - protein, 6 aa, Entamoeba invadens
KTSRRK

SEQ ID NO: 2878772 - protein, 4 aa, Entamoeba invadens
KTSS

SEQ ID NO: 2878773 - protein, 43 aa, Entamoeba invadens
KTSSAKSDEKKKEEEQHKLTESKSAQAFGTKQKTPRSNESDKL

SEQ ID NO: 2878774 - protein, 7 aa, Entamoeba invadens
KTSSCPT

SEQ ID NO: 2878775 - protein, 10 aa, Entamoeba invadens
KTSSDKTKYK

SEQ ID NO: 2878776 - protein, 6 aa, Entamoeba invadens
KTSSDV

SEQ ID NO: 2878777 - protein, 9 aa, Entamoeba invadens
KTSSEIPKS

SEQ ID NO: 2878778 - protein, 10 aa, Entamoeba invadens
KTSSESGNEC

SEQ ID NO: 2878779 - protein, 6 aa, Entamoeba invadens
KTSSIK

SEQ ID NO: 2878780 - protein, 19 aa, Entamoeba invadens
KTSSLASSQENDISSLPST

SEQ ID NO: 2878781 - protein, 17 aa, Entamoeba invadens
KTSSNPKYSTSKGVPKY

SEQ ID NO: 2878782 - protein, 6 aa, Entamoeba invadens
KTSSRI

SEQ ID NO: 2878783 - protein, 6 aa, Entamoeba invadens
KTSTEV

SEQ ID NO: 2878784 - protein, 12 aa, Entamoeba invadens
KTSTGFGTHGAK

SEQ ID NO: 2878785 - protein, 18 aa, Entamoeba invadens
KTSTGKEKKTYIAPPSVN

SEQ ID NO: 2878786 - protein, 6 aa, Entamoeba invadens
KTSTLS

SEQ ID NO: 2878787 - protein, 9 aa, Entamoeba invadens
KTSTNTQQL

SEQ ID NO: 2878788 - protein, 9 aa, Entamoeba invadens
KTSTPSALR

SEQ ID NO: 2878789 - protein, 7 aa, Entamoeba invadens
KTSTTAV

SEQ ID NO: 2878790 - protein, 7 aa, Entamoeba invadens
KTSTTRA

SEQ ID NO: 2878791 - protein, 11 aa, Entamoeba invadens
KTSTTTPVNDK

SEQ ID NO: 2878792 - protein, 13 aa, Entamoeba invadens
KTSVQQKGTSKIV

SEQ ID NO: 2878793 - protein, 7 aa, Entamoeba invadens
KTSVSKI

SEQ ID NO: 2878794 - protein, 5 aa, Entamoeba invadens
KTSYD

SEQ ID NO: 2878795 - protein, 12 aa, Entamoeba invadens
KTTAQVTNTNVE

SEQ ID NO: 2878796 - protein, 6 aa, Entamoeba invadens
KTTDGD

SEQ ID NO: 2878797 - protein, 6 aa, Entamoeba invadens
KTTDNS

SEQ ID NO: 2878798 - protein, 8 aa, Entamoeba invadens
KTTDTYKT

SEQ ID NO: 2878799 - protein, 5 aa, Entamoeba invadens
KTTEC

SEQ ID NO: 2878800 - protein, 7 aa, Entamoeba invadens
KTTEEAM

SEQ ID NO: 2878801 - protein, 18 aa, Entamoeba invadens
KTTEELQKNSQPTPLGHD

SEQ ID NO: 2878802 - protein, 8 aa, Entamoeba invadens
KTTEESMT

SEQ ID NO: 2878803 - protein, 6 aa, Entamoeba invadens
KTTESL

SEQ ID NO: 2878804 - protein, 4 aa, Entamoeba invadens
KTTG

SEQ ID NO: 2878805 - protein, 7 aa, Entamoeba invadens
KTTGADK

SEQ ID NO: 2878806 - protein, 5 aa, Entamoeba invadens
KTTGD

SEQ ID NO: 2878807 - protein, 8 aa, Entamoeba invadens
KTTGDDSF

SEQ ID NO: 2878808 - protein, 10 aa, Entamoeba invadens
KTTGDGITEE

SEQ ID NO: 2878809 - protein, 8 aa, Entamoeba invadens
KTTGKIEG

SEQ ID NO: 2878810 - protein, 6 aa, Entamoeba invadens
KTTGKM

SEQ ID NO: 2878811 - protein, 8 aa, Entamoeba invadens
KTTGKSVK

SEQ ID NO: 2878812 - protein, 10 aa, Entamoeba invadens
KTTGPKKENN

SEQ ID NO: 2878813 - protein, 12 aa, Entamoeba invadens
KTTHLSPSDDDK

SEQ ID NO: 2878814 - protein, 4 aa, Entamoeba invadens
KTTI

SEQ ID NO: 2878815 - protein, 24 aa, Entamoeba invadens
KTTIDSKQATVDTQKKHQEKMKEL

SEQ ID NO: 2878816 - protein, 4 aa, Entamoeba invadens
KTTK

SEQ ID NO: 2878817 - protein, 10 aa, Entamoeba invadens
KTTKAGELEN

SEQ ID NO: 2878818 - protein, 9 aa, Entamoeba invadens
KTTKDLPDA

SEQ ID NO: 2878819 - protein, 8 aa, Entamoeba invadens
KTTKEKDE

SEQ ID NO: 2878820 - protein, 10 aa, Entamoeba invadens
KTTKGAMSDN

SEQ ID NO: 2878821 - protein, 8 aa, Entamoeba invadens
KTTKHNKN

SEQ ID NO: 2878822 - protein, 13 aa, Entamoeba invadens
KTTKSALKGDQKW

SEQ ID NO: 2878823 - protein, 7 aa, Entamoeba invadens
KTTKVEA

SEQ ID NO: 2878824 - protein, 5 aa, Entamoeba invadens
KTTKY

SEQ ID NO: 2878825 - protein, 63 aa, Entamoeba invadens
KTTLEAAQRKAAKALKIATEAKEVADSDADAAAKAQEEADAAAAQAEKTVEETQKKVEEAEQY

SEQ ID NO: 2878826 - protein, 47 aa, Entamoeba invadens
KTTLEAAQRKAAKAVKIATEAKEKADSDAAEADKAVEETQKKVEEAE

SEQ ID NO: 2878827 - protein, 56 aa, Entamoeba invadens
KTTLEAAQRKASKALKIATDAKDKATETAQKAEEAKQEADKAKEQADNAEQEAVEA

SEQ ID NO: 2878828 - protein, 11 aa, Entamoeba invadens
KTTLPQNSEYT

SEQ ID NO: 2878829 - protein, 9 aa, Entamoeba invadens
KTTLTADTP

SEQ ID NO: 2878830 - protein, 11 aa, Entamoeba invadens
KTTNAQRNETI

SEQ ID NO: 2878831 - protein, 13 aa, Entamoeba invadens
KTTNDSGDTKQEM

SEQ ID NO: 2878832 - protein, 8 aa, Entamoeba invadens
KTTNGQQF

SEQ ID NO: 2878833 - protein, 6 aa, Entamoeba invadens
KTTNKD

SEQ ID NO: 2878834 - protein, 9 aa, Entamoeba invadens
KTTNKENLL

SEQ ID NO: 2878835 - protein, 6 aa, Entamoeba invadens
KTTNKI

SEQ ID NO: 2878836 - protein, 7 aa, Entamoeba invadens
KTTNNSD

SEQ ID NO: 2878837 - protein, 7 aa, Entamoeba invadens
KTTPDYS

SEQ ID NO: 2878838 - protein, 9 aa, Entamoeba invadens
KTTPEDDVS

SEQ ID NO: 2878839 - protein, 5 aa, Entamoeba invadens
KTTPF

SEQ ID NO: 2878840 - protein, 15 aa, Entamoeba invadens
KTTPLKKQAQELPQS

SEQ ID NO: 2878841 - protein, 13 aa, Entamoeba invadens
KTTPLQTSSAYER

SEQ ID NO: 2878842 - protein, 8 aa, Entamoeba invadens
KTTPLRKD

SEQ ID NO: 2878843 - protein, 13 aa, Entamoeba invadens
KTTPNETDFHPQN

SEQ ID NO: 2878844 - protein, 8 aa, Entamoeba invadens
KTTPNKHP

SEQ ID NO: 2878845 - protein, 7 aa, Entamoeba invadens
KTTPTRW

SEQ ID NO: 2878846 - protein, 4 aa, Entamoeba invadens
KTTQ

SEQ ID NO: 2878847 - protein, 9 aa, Entamoeba invadens
KTTQEIQDT

SEQ ID NO: 2878848 - protein, 19 aa, Entamoeba invadens
KTTQKCGRCSSDSNCNNCK

SEQ ID NO: 2878849 - protein, 14 aa, Entamoeba invadens
KTTQLDEGEALDKQ

SEQ ID NO: 2878850 - protein, 8 aa, Entamoeba invadens
KTTQNLQE

SEQ ID NO: 2878851 - protein, 5 aa, Entamoeba invadens
KTTQQ

SEQ ID NO: 2878852 - protein, 6 aa, Entamoeba invadens
KTTQRL

SEQ ID NO: 2878853 - protein, 7 aa, Entamoeba invadens
KTTQTKF

SEQ ID NO: 2878854 - protein, 7 aa, Entamoeba invadens
KTTQTTQ

SEQ ID NO: 2878855 - protein, 25 aa, Entamoeba invadens
KTTQYSYPKKATQSEDEGVKGTDQN

SEQ ID NO: 2878856 - protein, 7 aa, Entamoeba invadens
KTTRERE

SEQ ID NO: 2878857 - protein, 10 aa, Entamoeba invadens
KTTRKGDKKV

SEQ ID NO: 2878858 - protein, 14 aa, Entamoeba invadens
KTTRTIDTTKQRQL

SEQ ID NO: 2878859 - protein, 6 aa, Entamoeba invadens
KTTSEN

SEQ ID NO: 2878860 - protein, 6 aa, Entamoeba invadens
KTTSLE

SEQ ID NO: 2878861 - protein, 5 aa, Entamoeba invadens
KTTSP

SEQ ID NO: 2878862 - protein, 11 aa, Entamoeba invadens
KTTSPKEEVEN

SEQ ID NO: 2878863 - protein, 9 aa, Entamoeba invadens
KTTSTTTPK

SEQ ID NO: 2878864 - protein, 6 aa, Entamoeba invadens
KTTTRR

SEQ ID NO: 2878865 - protein, 6 aa, Entamoeba invadens
KTTTVS

SEQ ID NO: 2878866 - protein, 7 aa, Entamoeba invadens
KTTTYEE

SEQ ID NO: 2878867 - protein, 16 aa, Entamoeba invadens
KTTTYGKVNKRYKQPV

SEQ ID NO: 2878868 - protein, 7 aa, Entamoeba invadens
KTTTYST

SEQ ID NO: 2878869 - protein, 7 aa, Entamoeba invadens
KTTVSEH

SEQ ID NO: 2878870 - protein, 5 aa, Entamoeba invadens
KTTVV

SEQ ID NO: 2878871 - protein, 11 aa, Entamoeba invadens
KTTYDGQTQAT

SEQ ID NO: 2878872 - protein, 6 aa, Entamoeba invadens
KTTYSS

SEQ ID NO: 2878873 - protein, 12 aa, Entamoeba invadens
KTVAPGQPQTTM

SEQ ID NO: 2878874 - protein, 15 aa, Entamoeba invadens
KTVAVEEDEDAFDAN

SEQ ID NO: 2878875 - protein, 52 aa, Entamoeba invadens
KTVDEKYKTEMDQKAKEREADLASSRAAQAQKLKNQAEEEMRQKNAQREQEV

SEQ ID NO: 2878876 - protein, 6 aa, Entamoeba invadens
KTVDGL

SEQ ID NO: 2878877 - protein, 18 aa, Entamoeba invadens
KTVDKTKGHQHTPSVAKD

SEQ ID NO: 2878878 - protein, 6 aa, Entamoeba invadens
KTVEDR

SEQ ID NO: 2878879 - protein, 7 aa, Entamoeba invadens
KTVEDSS

SEQ ID NO: 2878880 - protein, 10 aa, Entamoeba invadens
KTVEEAKRKE

SEQ ID NO: 2878881 - protein, 16 aa, Entamoeba invadens
KTVEENAFFGSLQFTI

SEQ ID NO: 2878882 - protein, 11 aa, Entamoeba invadens
KTVEKTKELSN

SEQ ID NO: 2878883 - protein, 16 aa, Entamoeba invadens
KTVELSGGKLTPKATE

SEQ ID NO: 2878884 - protein, 7 aa, Entamoeba invadens
KTVENKG

SEQ ID NO: 2878885 - protein, 7 aa, Entamoeba invadens
KTVEQAE

SEQ ID NO: 2878886 - protein, 12 aa, Entamoeba invadens
KTVEQKVEPKIE

SEQ ID NO: 2878887 - protein, 5 aa, Entamoeba invadens
KTVER

SEQ ID NO: 2878888 - protein, 11 aa, Entamoeba invadens
KTVESIPSTTQ

SEQ ID NO: 2878889 - protein, 17 aa, Entamoeba invadens
KTVGEKPNEKLEKRDGD

SEQ ID NO: 2878890 - protein, 7 aa, Entamoeba invadens
KTVGETN

SEQ ID NO: 2878891 - protein, 7 aa, Entamoeba invadens
KTVGGQS

SEQ ID NO: 2878892 - protein, 11 aa, Entamoeba invadens
KTVGKSNDDKL

SEQ ID NO: 2878893 - protein, 5 aa, Entamoeba invadens
KTVIG

SEQ ID NO: 2878894 - protein, 4 aa, Entamoeba invadens
KTVK

SEQ ID NO: 2878895 - protein, 6 aa, Entamoeba invadens
KTVKTI

SEQ ID NO: 2878896 - protein, 13 aa, Entamoeba invadens
KTVKTYSSIILLF

SEQ ID NO: 2878897 - protein, 14 aa, Entamoeba invadens
KTVKVSKSKSVKHG

SEQ ID NO: 2878898 - protein, 5 aa, Entamoeba invadens
KTVNT

SEQ ID NO: 2878899 - protein, 6 aa, Entamoeba invadens
KTVPEL

SEQ ID NO: 2878900 - protein, 11 aa, Entamoeba invadens
KTVPESDRLEQ

SEQ ID NO: 2878901 - protein, 8 aa, Entamoeba invadens
KTVPKDEL

SEQ ID NO: 2878902 - protein, 18 aa, Entamoeba invadens
KTVPNKKALKEAATESVY

SEQ ID NO: 2878903 - protein, 15 aa, Entamoeba invadens
KTVPNKKALKEQPPN

SEQ ID NO: 2878904 - protein, 18 aa, Entamoeba invadens
KTVPNKKALKETATESVY

SEQ ID NO: 2878905 - protein, 20 aa, Entamoeba invadens
KTVQEFNNENEQLKKEKENV

SEQ ID NO: 2878906 - protein, 8 aa, Entamoeba invadens
KTVQNETK

SEQ ID NO: 2878907 - protein, 7 aa, Entamoeba invadens
KTVQTSH

SEQ ID NO: 2878908 - protein, 7 aa, Entamoeba invadens
KTVRKGE

SEQ ID NO: 2878909 - protein, 5 aa, Entamoeba invadens
KTVSC

SEQ ID NO: 2878910 - protein, 5 aa, Entamoeba invadens
KTVSK

SEQ ID NO: 2878911 - protein, 12 aa, Entamoeba invadens
KTVTIKDRKDHL

SEQ ID NO: 2878912 - protein, 5 aa, Entamoeba invadens
KTVTN

SEQ ID NO: 2878913 - protein, 10 aa, Entamoeba invadens
KTVTNSTKQI

SEQ ID NO: 2878914 - protein, 7 aa, Entamoeba invadens
KTVTSLG

SEQ ID NO: 2878915 - protein, 10 aa, Entamoeba invadens
KTWKEESKSA

SEQ ID NO: 2878916 - protein, 10 aa, Entamoeba invadens
KTWKETKSLE

SEQ ID NO: 2878917 - protein, 11 aa, Entamoeba invadens
KTWSSDYKNAN

SEQ ID NO: 2878918 - protein, 6 aa, Entamoeba invadens
KTWTGR

SEQ ID NO: 2878919 - protein, 4 aa, Entamoeba invadens
KTYD

SEQ ID NO: 2878920 - protein, 9 aa, Entamoeba invadens
KTYDEQKEQ

SEQ ID NO: 2878921 - protein, 7 aa, Entamoeba invadens
KTYDKKN

SEQ ID NO: 2878922 - protein, 4 aa, Entamoeba invadens
KTYE

SEQ ID NO: 2878923 - protein, 5 aa, Entamoeba invadens
KTYEA

SEQ ID NO: 2878924 - protein, 5 aa, Entamoeba invadens
KTYED

SEQ ID NO: 2878925 - protein, 20 aa, Entamoeba invadens
KTYEDPSPIKSQKRKKTDTM

SEQ ID NO: 2878926 - protein, 7 aa, Entamoeba invadens
KTYEPNV

SEQ ID NO: 2878927 - protein, 5 aa, Entamoeba invadens
KTYET

SEQ ID NO: 2878928 - protein, 6 aa, Entamoeba invadens
KTYFPN

SEQ ID NO: 2878929 - protein, 10 aa, Entamoeba invadens
KTYGKKGPEI

SEQ ID NO: 2878930 - protein, 4 aa, Entamoeba invadens
KTYH

SEQ ID NO: 2878931 - protein, 5 aa, Entamoeba invadens
KTYIG

SEQ ID NO: 2878932 - protein, 5 aa, Entamoeba invadens
KTYIK

SEQ ID NO: 2878933 - protein, 9 aa, Entamoeba invadens
KTYKDQGMV

SEQ ID NO: 2878934 - protein, 4 aa, Entamoeba invadens
KTYL

SEQ ID NO: 2878935 - protein, 43 aa, Entamoeba invadens
KTYPEKRGDKLSLSGYQDEKAKSNEKDSSDVNQKGEDETTNTD

SEQ ID NO: 2878936 - protein, 16 aa, Entamoeba invadens
KTYPFTSKNSNEFGAG

SEQ ID NO: 2878937 - protein, 8 aa, Entamoeba invadens
KTYPKNNC

SEQ ID NO: 2878938 - protein, 4 aa, Entamoeba invadens
KTYQ

SEQ ID NO: 2878939 - protein, 12 aa, Entamoeba invadens
KTYRESKSKPVN

SEQ ID NO: 2878940 - protein, 10 aa, Entamoeba invadens
KTYSESIGNI

SEQ ID NO: 2878941 - protein, 13 aa, Entamoeba invadens
KTYSNYHPANEWI

SEQ ID NO: 2878942 - protein, 13 aa, Entamoeba invadens
KTYSNYHPCKRVD

SEQ ID NO: 2878943 - protein, 5 aa, Entamoeba invadens
KTYTA

SEQ ID NO: 2878944 - protein, 7 aa, Entamoeba invadens
KTYTEKE

SEQ ID NO: 2878945 - protein, 5 aa, Entamoeba invadens
KTYTN

SEQ ID NO: 2878946 - protein, 7 aa, Entamoeba invadens
KTYTPSD

SEQ ID NO: 2878947 - protein, 6 aa, Entamoeba invadens
KTYTSP

SEQ ID NO: 2878948 - protein, 10 aa, Entamoeba invadens
KTYTTNQDAK

SEQ ID NO: 2878949 - protein, 17 aa, Entamoeba invadens
KTYTTTEEKEEINDATV

SEQ ID NO: 2878950 - protein, 6 aa, Entamoeba invadens
KTYYGK

SEQ ID NO: 2878951 - protein, 8 aa, Entamoeba invadens
KTYYQEDK

SEQ ID NO: 2878952 - protein, 9 aa, Entamoeba invadens
KVAASSAIP

SEQ ID NO: 2878953 - protein, 10 aa, Entamoeba invadens
KVAEEEEKVE

SEQ ID NO: 2878954 - protein, 59 aa, Entamoeba invadens
KVAEREKSKIASLKKRKARIDEEKKINDKAVQRNTKEIDEYTKKIRQEQDRVSDTRRRL

SEQ ID NO: 2878955 - protein, 58 aa, Entamoeba invadens
KVAETEKSKEEVSNKLNASEEENKKKAEELDKTKKDVEEKEKANEELKAKVDETEKAK

SEQ ID NO: 2878956 - protein, 7 aa, Entamoeba invadens
KVAKETV

SEQ ID NO: 2878957 - protein, 26 aa, Entamoeba invadens
KVAKSEQKMEKQEKEIKGGIEKGEEM

SEQ ID NO: 2878958 - protein, 7 aa, Entamoeba invadens
KVAKSPY

SEQ ID NO: 2878959 - protein, 8 aa, Entamoeba invadens
KVAQNTPQ

SEQ ID NO: 2878960 - protein, 8 aa, Entamoeba invadens
KVATEGGF

SEQ ID NO: 2878961 - protein, 108 aa, Entamoeba invadens
KVATSQSRKSDNPFGDTDDEEEEQVTNKSGAKKENPFGDSDDEEDKKQQQRASKGNAITTQTVGNPFGDSSEEEKETKKKSDNPFGDSDDDEEALKSTQTSKSQTKVV

SEQ ID NO: 2878962 - protein, 13 aa, Entamoeba invadens
KVCKESEEEKNEE

SEQ ID NO: 2878963 - protein, 8 aa, Entamoeba invadens
KVDAEKYY

SEQ ID NO: 2878964 - protein, 7 aa, Entamoeba invadens
KVDASQN

SEQ ID NO: 2878965 - protein, 5 aa, Entamoeba invadens
KVDAV

SEQ ID NO: 2878966 - protein, 8 aa, Entamoeba invadens
KVDDDEAK

SEQ ID NO: 2878967 - protein, 5 aa, Entamoeba invadens
KVDDG

SEQ ID NO: 2878968 - protein, 65 aa, Entamoeba invadens
KVDEGIKKYEETSAKNMEEALKEKNEREQRNAEIEKKRMADGEKKNIAVKTEPKSPQKSEKKMTT

SEQ ID NO: 2878969 - protein, 16 aa, Entamoeba invadens
KVDEKKKKENERQEAY

SEQ ID NO: 2878970 - protein, 7 aa, Entamoeba invadens
KVDEKTM

SEQ ID NO: 2878971 - protein, 25 aa, Entamoeba invadens
KVDELNPKKKMPPKVKKDKVANPED

SEQ ID NO: 2878972 - protein, 30 aa, Entamoeba invadens
KVDEPVKQKMEEEGTDDKEYETKEDDEGDV

SEQ ID NO: 2878973 - protein, 10 aa, Entamoeba invadens
KVDGDKQSDF

SEQ ID NO: 2878974 - protein, 7 aa, Entamoeba invadens
KVDGDNK

SEQ ID NO: 2878975 - protein, 31 aa, Entamoeba invadens
KVDHPTELTEPSVQPEPRNEKSLEKEEKEPE

SEQ ID NO: 2878976 - protein, 21 aa, Entamoeba invadens
KVDKPTKTVTTHDGEKFASDK

SEQ ID NO: 2878977 - protein, 7 aa, Entamoeba invadens
KVDKRDI

SEQ ID NO: 2878978 - protein, 7 aa, Entamoeba invadens
KVDNEEI

SEQ ID NO: 2878979 - protein, 5 aa, Entamoeba invadens
KVDNK

SEQ ID NO: 2878980 - protein, 8 aa, Entamoeba invadens
KVDQKEEE

SEQ ID NO: 2878981 - protein, 14 aa, Entamoeba invadens
KVDQNCKDVKQDNI

SEQ ID NO: 2878982 - protein, 7 aa, Entamoeba invadens
KVDQYTD

SEQ ID NO: 2878983 - protein, 8 aa, Entamoeba invadens
KVDRSKVN

SEQ ID NO: 2878984 - protein, 18 aa, Entamoeba invadens
KVDSIPNKDETELTPDEY

SEQ ID NO: 2878985 - protein, 8 aa, Entamoeba invadens
KVDTLSKS

SEQ ID NO: 2878986 - protein, 6 aa, Entamoeba invadens
KVDTSS

SEQ ID NO: 2878987 - protein, 14 aa, Entamoeba invadens
KVDVNAQDEQGNTA

SEQ ID NO: 2878988 - protein, 12 aa, Entamoeba invadens
KVEAANKKMKHK

SEQ ID NO: 2878989 - protein, 7 aa, Entamoeba invadens
KVEATYV

SEQ ID NO: 2878990 - protein, 59 aa, Entamoeba invadens
KVEDDKNKEIADEKETSRKAIEKCGEDFKQKEKELLEAKTKELEQTTKELENEAEQKID

SEQ ID NO: 2878991 - protein, 7 aa, Entamoeba invadens
KVEDKQN

SEQ ID NO: 2878992 - protein, 6 aa, Entamoeba invadens
KVEDNN

SEQ ID NO: 2878993 - protein, 7 aa, Entamoeba invadens
KVEEAER

SEQ ID NO: 2878994 - protein, 7 aa, Entamoeba invadens
KVEEDKN

SEQ ID NO: 2878995 - protein, 9 aa, Entamoeba invadens
KVEEDLEKR

SEQ ID NO: 2878996 - protein, 9 aa, Entamoeba invadens
KVEEKHDNK

SEQ ID NO: 2878997 - protein, 23 aa, Entamoeba invadens
KVEEKKEEKIAPVEPTKTKADTQ

SEQ ID NO: 2878998 - protein, 9 aa, Entamoeba invadens
KVEEKKEIT

SEQ ID NO: 2878999 - protein, 16 aa, Entamoeba invadens
KVEEKKVEKVENKPPK

SEQ ID NO: 2879000 - protein, 13 aa, Entamoeba invadens
KVEEKTEKAEDNK

SEQ ID NO: 2879001 - protein, 13 aa, Entamoeba invadens
KVEEKTEKTEDNK

SEQ ID NO: 2879002 - protein, 20 aa, Entamoeba invadens
KVEENEKSITIEPKKSIEQV

SEQ ID NO: 2879003 - protein, 7 aa, Entamoeba invadens
KVEEQNA

SEQ ID NO: 2879004 - protein, 8 aa, Entamoeba invadens
KVEEQSDA

SEQ ID NO: 2879005 - protein, 12 aa, Entamoeba invadens
KVEESGVELKTE

SEQ ID NO: 2879006 - protein, 18 aa, Entamoeba invadens
KVEESTFREEKHNYPSYK

SEQ ID NO: 2879007 - protein, 8 aa, Entamoeba invadens
KVEETKPF

SEQ ID NO: 2879008 - protein, 17 aa, Entamoeba invadens
KVEEVEKNAAKGSEDLL

SEQ ID NO: 2879009 - protein, 7 aa, Entamoeba invadens
KVEFPSK

SEQ ID NO: 2879010 - protein, 6 aa, Entamoeba invadens
KVEGDV

SEQ ID NO: 2879011 - protein, 5 aa, Entamoeba invadens
KVEGE

SEQ ID NO: 2879012 - protein, 12 aa, Entamoeba invadens
KVEGKNNTKQMF

SEQ ID NO: 2879013 - protein, 4 aa, Entamoeba invadens
KVEK

SEQ ID NO: 2879014 - protein, 48 aa, Entamoeba invadens
KVEKEEKPKKAKTTSKAVETSKPKVGDEDEHKQKKKKRRFSEEETQNL

SEQ ID NO: 2879015 - protein, 8 aa, Entamoeba invadens
KVEKESKV

SEQ ID NO: 2879016 - protein, 15 aa, Entamoeba invadens
KVEKIAEKSNGSIEK

SEQ ID NO: 2879017 - protein, 14 aa, Entamoeba invadens
KVEKKEDVPPPQQP

SEQ ID NO: 2879018 - protein, 5 aa, Entamoeba invadens
KVEKN

SEQ ID NO: 2879019 - protein, 27 aa, Entamoeba invadens
KVEKPEKVEKIENPDQSISSLHKSKDV

SEQ ID NO: 2879020 - protein, 14 aa, Entamoeba invadens
KVEKPIDKATQQDV

SEQ ID NO: 2879021 - protein, 12 aa, Entamoeba invadens
KVEKPVDTGKKK

SEQ ID NO: 2879022 - protein, 24 aa, Entamoeba invadens
KVEKQKLQTCNDREKANGIQTLQD

SEQ ID NO: 2879023 - protein, 15 aa, Entamoeba invadens
KVEKSKNDTLKMPGE

SEQ ID NO: 2879024 - protein, 13 aa, Entamoeba invadens
KVELEEKERLERE

SEQ ID NO: 2879025 - protein, 4 aa, Entamoeba invadens
KVEN

SEQ ID NO: 2879026 - protein, 8 aa, Entamoeba invadens
KVENDRKI

SEQ ID NO: 2879027 - protein, 6 aa, Entamoeba invadens
KVENIN

SEQ ID NO: 2879028 - protein, 12 aa, Entamoeba invadens
KVENNSKKEKID

SEQ ID NO: 2879029 - protein, 5 aa, Entamoeba invadens
KVENP

SEQ ID NO: 2879030 - protein, 61 aa, Entamoeba invadens
KVENQIQQSAPTQYTKSPSPKLQQQPKQTHSYQQEIQRPNYPAKSPSPNTPKEQKKPSIPI

SEQ ID NO: 2879031 - protein, 24 aa, Entamoeba invadens
KVENQNDEKIEAKNLEKREKYLTE

SEQ ID NO: 2879032 - protein, 17 aa, Entamoeba invadens
KVENQRQPRITTNSKKQ

SEQ ID NO: 2879033 - protein, 8 aa, Entamoeba invadens
KVEPNASV

SEQ ID NO: 2879034 - protein, 5 aa, Entamoeba invadens
KVEPP

SEQ ID NO: 2879035 - protein, 7 aa, Entamoeba invadens
KVEPVSH

SEQ ID NO: 2879036 - protein, 16 aa, Entamoeba invadens
KVEQPTKNENKKEDDI

SEQ ID NO: 2879037 - protein, 8 aa, Entamoeba invadens
KVEQPVEQ

SEQ ID NO: 2879038 - protein, 5 aa, Entamoeba invadens
KVEQQ

SEQ ID NO: 2879039 - protein, 9 aa, Entamoeba invadens
KVERGTDEV

SEQ ID NO: 2879040 - protein, 6 aa, Entamoeba invadens
KVERKT

SEQ ID NO: 2879041 - protein, 8 aa, Entamoeba invadens
KVERPTGK

SEQ ID NO: 2879042 - protein, 28 aa, Entamoeba invadens
KVERSVEEMKQTDINSGVSTKTALRRQE

SEQ ID NO: 2879043 - protein, 8 aa, Entamoeba invadens
KVESNQSM

SEQ ID NO: 2879044 - protein, 11 aa, Entamoeba invadens
KVESQRANLHQ

SEQ ID NO: 2879045 - protein, 5 aa, Entamoeba invadens
KVESS

SEQ ID NO: 2879046 - protein, 32 aa, Entamoeba invadens
KVESSESSSDSKELKAEEEEEEKEKEVPQNSL

SEQ ID NO: 2879047 - protein, 8 aa, Entamoeba invadens
KVETEENK

SEQ ID NO: 2879048 - protein, 7 aa, Entamoeba invadens
KVETEKL

SEQ ID NO: 2879049 - protein, 18 aa, Entamoeba invadens
KVETKTENKLPKEKNTVT

SEQ ID NO: 2879050 - protein, 5 aa, Entamoeba invadens
KVETN

SEQ ID NO: 2879051 - protein, 9 aa, Entamoeba invadens
KVETPKPTT

SEQ ID NO: 2879052 - protein, 8 aa, Entamoeba invadens
KVETRYKG

SEQ ID NO: 2879053 - protein, 9 aa, Entamoeba invadens
KVETTNKDN

SEQ ID NO: 2879054 - protein, 34 aa, Entamoeba invadens
KVEVPEEAKQIKRYDPNDDKKATTREADSTEVYT

SEQ ID NO: 2879055 - protein, 5 aa, Entamoeba invadens
KVEWD

SEQ ID NO: 2879056 - protein, 13 aa, Entamoeba invadens
KVGAASDNIGEEV

SEQ ID NO: 2879057 - protein, 16 aa, Entamoeba invadens
KVGALKGEYQDGTPFK

SEQ ID NO: 2879058 - protein, 14 aa, Entamoeba invadens
KVGARFKTKSPPQV

SEQ ID NO: 2879059 - protein, 4 aa, Entamoeba invadens
KVGD

SEQ ID NO: 2879060 - protein, 11 aa, Entamoeba invadens
KVGEDDPVEGL

SEQ ID NO: 2879061 - protein, 7 aa, Entamoeba invadens
KVGEGAM

SEQ ID NO: 2879062 - protein, 9 aa, Entamoeba invadens
KVGEGEGVV

SEQ ID NO: 2879063 - protein, 8 aa, Entamoeba invadens
KVGEGGVG

SEQ ID NO: 2879064 - protein, 7 aa, Entamoeba invadens
KVGENGA

SEQ ID NO: 2879065 - protein, 13 aa, Entamoeba invadens
KVGGKDKKSIEDF

SEQ ID NO: 2879066 - protein, 12 aa, Entamoeba invadens
KVGKGKNRTYST

SEQ ID NO: 2879067 - protein, 33 aa, Entamoeba invadens
KVGKMEKEKEVRETLGDEDELRQAKQDPTQEKI

SEQ ID NO: 2879068 - protein, 6 aa, Entamoeba invadens
KVGKSS

SEQ ID NO: 2879069 - protein, 10 aa, Entamoeba invadens
KVGNKNKCPY

SEQ ID NO: 2879070 - protein, 13 aa, Entamoeba invadens
KVGNLTKKTKTGI

SEQ ID NO: 2879071 - protein, 5 aa, Entamoeba invadens
KVGPL

SEQ ID NO: 2879072 - protein, 14 aa, Entamoeba invadens
KVGQNESEKEVERL

SEQ ID NO: 2879073 - protein, 8 aa, Entamoeba invadens
KVGQRTDS

SEQ ID NO: 2879074 - protein, 8 aa, Entamoeba invadens
KVGQSASL

SEQ ID NO: 2879075 - protein, 9 aa, Entamoeba invadens
KVGQSNERN

SEQ ID NO: 2879076 - protein, 6 aa, Entamoeba invadens
KVGRDK

SEQ ID NO: 2879077 - protein, 7 aa, Entamoeba invadens
KVGRPPF

SEQ ID NO: 2879078 - protein, 17 aa, Entamoeba invadens
KVGSDEAKSVASNVQGS

SEQ ID NO: 2879079 - protein, 12 aa, Entamoeba invadens
KVGSEDKQRNEI

SEQ ID NO: 2879080 - protein, 8 aa, Entamoeba invadens
KVGSEKGV

SEQ ID NO: 2879081 - protein, 23 aa, Entamoeba invadens
KVGSESVKSPTPNPNLADGIEQR

SEQ ID NO: 2879082 - protein, 7 aa, Entamoeba invadens
KVGSETI

SEQ ID NO: 2879083 - protein, 12 aa, Entamoeba invadens
KVGSKIQQTYED

SEQ ID NO: 2879084 - protein, 8 aa, Entamoeba invadens
KVGSTKDT

SEQ ID NO: 2879085 - protein, 6 aa, Entamoeba invadens
KVGSTT

SEQ ID NO: 2879086 - protein, 7 aa, Entamoeba invadens
KVGTAPH

SEQ ID NO: 2879087 - protein, 20 aa, Entamoeba invadens
KVGTPKKSRTPDKSPSKLLK

SEQ ID NO: 2879088 - protein, 25 aa, Entamoeba invadens
KVHKKEEKEENNGWGDLESEEKERN

SEQ ID NO: 2879089 - protein, 7 aa, Entamoeba invadens
KVHPRKL

SEQ ID NO: 2879090 - protein, 7 aa, Entamoeba invadens
KVHSKTT

SEQ ID NO: 2879091 - protein, 13 aa, Entamoeba invadens
KVHSTKSKPDASL

SEQ ID NO: 2879092 - protein, 20 aa, Entamoeba invadens
KVIDDTKLTTPASTKAGEDY

SEQ ID NO: 2879093 - protein, 4 aa, Entamoeba invadens
KVIE

SEQ ID NO: 2879094 - protein, 13 aa, Entamoeba invadens
KVIEKQKEEIESL

SEQ ID NO: 2879095 - protein, 8 aa, Entamoeba invadens
KVIETSKK

SEQ ID NO: 2879096 - protein, 5 aa, Entamoeba invadens
KVIPD

SEQ ID NO: 2879097 - protein, 13 aa, Entamoeba invadens
KVISRNGKNYTQR

SEQ ID NO: 2879098 - protein, 4 aa, Entamoeba invadens
KVIT

SEQ ID NO: 2879099 - protein, 7 aa, Entamoeba invadens
KVKEATF

SEQ ID NO: 2879100 - protein, 6 aa, Entamoeba invadens
KVKEDT

SEQ ID NO: 2879101 - protein, 13 aa, Entamoeba invadens
KVKEEDLNSKRGD

SEQ ID NO: 2879102 - protein, 19 aa, Entamoeba invadens
KVKEEIKREHVDEEKKVDG

SEQ ID NO: 2879103 - protein, 15 aa, Entamoeba invadens
KVKEENKSPREVKDM

SEQ ID NO: 2879104 - protein, 15 aa, Entamoeba invadens
KVKEKAKEKADDIAE

SEQ ID NO: 2879105 - protein, 7 aa, Entamoeba invadens
KVKELSD

SEQ ID NO: 2879106 - protein, 9 aa, Entamoeba invadens
KVKEMKESA

SEQ ID NO: 2879107 - protein, 8 aa, Entamoeba invadens
KVKENEGG

SEQ ID NO: 2879108 - protein, 5 aa, Entamoeba invadens
KVKER

SEQ ID NO: 2879109 - protein, 35 aa, Entamoeba invadens
KVKESQEELETVKETQSQQSHTKENVIEKEKEEIT

SEQ ID NO: 2879110 - protein, 34 aa, Entamoeba invadens
KVKESQEELETVKETSQQSHTKENVIEKEKEEIT

SEQ ID NO: 2879111 - protein, 9 aa, Entamoeba invadens
KVKGEVEAA

SEQ ID NO: 2879112 - protein, 6 aa, Entamoeba invadens
KVKGMS

SEQ ID NO: 2879113 - protein, 28 aa, Entamoeba invadens
KVKGSKKEKPKKEKSSKDKVSKDKGCKN

SEQ ID NO: 2879114 - protein, 5 aa, Entamoeba invadens
KVKGY

SEQ ID NO: 2879115 - protein, 6 aa, Entamoeba invadens
KVKKEE

SEQ ID NO: 2879116 - protein, 5 aa, Entamoeba invadens
KVKKS

SEQ ID NO: 2879117 - protein, 19 aa, Entamoeba invadens
KVKKYEEGYLQSKGLPKEF

SEQ ID NO: 2879118 - protein, 24 aa, Entamoeba invadens
KVKNDTTKAKEGLYENNDQITNDA

SEQ ID NO: 2879119 - protein, 13 aa, Entamoeba invadens
KVKNGTSLENVRS

SEQ ID NO: 2879120 - protein, 7 aa, Entamoeba invadens
KVKNHEK

SEQ ID NO: 2879121 - protein, 7 aa, Entamoeba invadens
KVKPSGK

SEQ ID NO: 2879122 - protein, 21 aa, Entamoeba invadens
KVKPSTQDQNIGKTQVSPTPL

SEQ ID NO: 2879123 - protein, 8 aa, Entamoeba invadens
KVKPTGIK

SEQ ID NO: 2879124 - protein, 8 aa, Entamoeba invadens
KVKQADQI

SEQ ID NO: 2879125 - protein, 6 aa, Entamoeba invadens
KVKQAK

SEQ ID NO: 2879126 - protein, 18 aa, Entamoeba invadens
KVKQNTSSELNMEITRFN

SEQ ID NO: 2879127 - protein, 9 aa, Entamoeba invadens
KVKRQEPVT

SEQ ID NO: 2879128 - protein, 14 aa, Entamoeba invadens
KVKRSKKHQKTIED

SEQ ID NO: 2879129 - protein, 8 aa, Entamoeba invadens
KVKSDDSM

SEQ ID NO: 2879130 - protein, 9 aa, Entamoeba invadens
KVKSGKRET

SEQ ID NO: 2879131 - protein, 8 aa, Entamoeba invadens
KVKSKDDE

SEQ ID NO: 2879132 - protein, 9 aa, Entamoeba invadens
KVKSPKKVN

SEQ ID NO: 2879133 - protein, 8 aa, Entamoeba invadens
KVKTHSPR

SEQ ID NO: 2879134 - protein, 20 aa, Entamoeba invadens
KVKTQKKGKKAPLTLDQLQN

SEQ ID NO: 2879135 - protein, 7 aa, Entamoeba invadens
KVKTQNV

SEQ ID NO: 2879136 - protein, 6 aa, Entamoeba invadens
KVKTRR

SEQ ID NO: 2879137 - protein, 7 aa, Entamoeba invadens
KVLDKEI

SEQ ID NO: 2879138 - protein, 8 aa, Entamoeba invadens
KVLGGNDA

SEQ ID NO: 2879139 - protein, 9 aa, Entamoeba invadens
KVLQKDKKA

SEQ ID NO: 2879140 - protein, 16 aa, Entamoeba invadens
KVMSTKQEKHTNDEKK

SEQ ID NO: 2879141 - protein, 15 aa, Entamoeba invadens
KVNDKDEYTKFSGRK

SEQ ID NO: 2879142 - protein, 8 aa, Entamoeba invadens
KVNDNQYN

SEQ ID NO: 2879143 - protein, 17 aa, Entamoeba invadens
KVNEAQEEIIKLAKQKA

SEQ ID NO: 2879144 - protein, 17 aa, Entamoeba invadens
KVNEESDVQKREKIGKV

SEQ ID NO: 2879145 - protein, 5 aa, Entamoeba invadens
KVNEK

SEQ ID NO: 2879146 - protein, 7 aa, Entamoeba invadens
KVNELKD

SEQ ID NO: 2879147 - protein, 8 aa, Entamoeba invadens
KVNENTLP

SEQ ID NO: 2879148 - protein, 7 aa, Entamoeba invadens
KVNEPHQ

SEQ ID NO: 2879149 - protein, 6 aa, Entamoeba invadens
KVNETK

SEQ ID NO: 2879150 - protein, 7 aa, Entamoeba invadens
KVNETKK

SEQ ID NO: 2879151 - protein, 8 aa, Entamoeba invadens
KVNEVSNV

SEQ ID NO: 2879152 - protein, 20 aa, Entamoeba invadens
KVNGQQGNELSYRKNKLSSQ

SEQ ID NO: 2879153 - protein, 7 aa, Entamoeba invadens
KVNGSAA

SEQ ID NO: 2879154 - protein, 8 aa, Entamoeba invadens
KVNKEISQ

SEQ ID NO: 2879155 - protein, 15 aa, Entamoeba invadens
KVNKGTKNITKEKEK

SEQ ID NO: 2879156 - protein, 5 aa, Entamoeba invadens
KVNKI

SEQ ID NO: 2879157 - protein, 16 aa, Entamoeba invadens
KVNKSAMSEEERKLYD

SEQ ID NO: 2879158 - protein, 19 aa, Entamoeba invadens
KVNKTKELKGEENPTDPIH

SEQ ID NO: 2879159 - protein, 7 aa, Entamoeba invadens
KVNLSSE

SEQ ID NO: 2879160 - protein, 8 aa, Entamoeba invadens
KVNPAKAK

SEQ ID NO: 2879161 - protein, 12 aa, Entamoeba invadens
KVNQGDTQTSMN

SEQ ID NO: 2879162 - protein, 21 aa, Entamoeba invadens
KVNQQLEETTKQKEENDKKVE

SEQ ID NO: 2879163 - protein, 5 aa, Entamoeba invadens
KVNQS

SEQ ID NO: 2879164 - protein, 5 aa, Entamoeba invadens
KVNRV

SEQ ID NO: 2879165 - protein, 8 aa, Entamoeba invadens
KVNSDTEK

SEQ ID NO: 2879166 - protein, 30 aa, Entamoeba invadens
KVNSSKNVTTNDTESGDEQKNVKQTEESNS

SEQ ID NO: 2879167 - protein, 7 aa, Entamoeba invadens
KVNSTDS

SEQ ID NO: 2879168 - protein, 10 aa, Entamoeba invadens
KVNSTVNSEM

SEQ ID NO: 2879169 - protein, 8 aa, Entamoeba invadens
KVNTINDK

SEQ ID NO: 2879170 - protein, 9 aa, Entamoeba invadens
KVNTKKTEH

SEQ ID NO: 2879171 - protein, 6 aa, Entamoeba invadens
KVNTYT

SEQ ID NO: 2879172 - protein, 7 aa, Entamoeba invadens
KVNYDRP

SEQ ID NO: 2879173 - protein, 5 aa, Entamoeba invadens
KVPAD

SEQ ID NO: 2879174 - protein, 10 aa, Entamoeba invadens
KVPAEPKQLK

SEQ ID NO: 2879175 - protein, 9 aa, Entamoeba invadens
KVPANLPRE

SEQ ID NO: 2879176 - protein, 9 aa, Entamoeba invadens
KVPASFKTQ

SEQ ID NO: 2879177 - protein, 4 aa, Entamoeba invadens
KVPC

SEQ ID NO: 2879178 - protein, 24 aa, Entamoeba invadens
KVPDAGPQYGINPAQPAKQQQDGC

SEQ ID NO: 2879179 - protein, 7 aa, Entamoeba invadens
KVPEEFY

SEQ ID NO: 2879180 - protein, 17 aa, Entamoeba invadens
KVPEGELGNSIKQQFED

SEQ ID NO: 2879181 - protein, 10 aa, Entamoeba invadens
KVPEGTTQQE

SEQ ID NO: 2879182 - protein, 8 aa, Entamoeba invadens
KVPEPEDR

SEQ ID NO: 2879183 - protein, 26 aa, Entamoeba invadens
KVPETHEQPNTDKKDGPKKPENKVVI

SEQ ID NO: 2879184 - protein, 36 aa, Entamoeba invadens
KVPETTPAVKKSPEPVKSYKPPTTYKTQQQSTPTTF

SEQ ID NO: 2879185 - protein, 5 aa, Entamoeba invadens
KVPEV

SEQ ID NO: 2879186 - protein, 6 aa, Entamoeba invadens
KVPEVT

SEQ ID NO: 2879187 - protein, 6 aa, Entamoeba invadens
KVPGAL

SEQ ID NO: 2879188 - protein, 10 aa, Entamoeba invadens
KVPGAQFDSD

SEQ ID NO: 2879189 - protein, 7 aa, Entamoeba invadens
KVPKAAK

SEQ ID NO: 2879190 - protein, 6 aa, Entamoeba invadens
KVPKNT

SEQ ID NO: 2879191 - protein, 5 aa, Entamoeba invadens
KVPKP

SEQ ID NO: 2879192 - protein, 8 aa, Entamoeba invadens
KVPKQQTL

SEQ ID NO: 2879193 - protein, 5 aa, Entamoeba invadens
KVPKY

SEQ ID NO: 2879194 - protein, 6 aa, Entamoeba invadens
KVPNDE

SEQ ID NO: 2879195 - protein, 5 aa, Entamoeba invadens
KVPNQ

SEQ ID NO: 2879196 - protein, 6 aa, Entamoeba invadens
KVPNYE

SEQ ID NO: 2879197 - protein, 8 aa, Entamoeba invadens
KVPPGDSV

SEQ ID NO: 2879198 - protein, 8 aa, Entamoeba invadens
KVPPGDTV

SEQ ID NO: 2879199 - protein, 18 aa, Entamoeba invadens
KVPPPIEVKENDEKDGLS

SEQ ID NO: 2879200 - protein, 15 aa, Entamoeba invadens
KVPPQNVDYPREVNT

SEQ ID NO: 2879201 - protein, 7 aa, Entamoeba invadens
KVPPQRD

SEQ ID NO: 2879202 - protein, 7 aa, Entamoeba invadens
KVPPSGL

SEQ ID NO: 2879203 - protein, 8 aa, Entamoeba invadens
KVPPSGLQ

SEQ ID NO: 2879204 - protein, 7 aa, Entamoeba invadens
KVPQERL

SEQ ID NO: 2879205 - protein, 16 aa, Entamoeba invadens
KVPQKAEKSEVKTEDV

SEQ ID NO: 2879206 - protein, 6 aa, Entamoeba invadens
KVPQKI

SEQ ID NO: 2879207 - protein, 7 aa, Entamoeba invadens
KVPQNTS

SEQ ID NO: 2879208 - protein, 8 aa, Entamoeba invadens
KVPQTIDG

SEQ ID NO: 2879209 - protein, 12 aa, Entamoeba invadens
KVPQTPLTTTTT

SEQ ID NO: 2879210 - protein, 7 aa, Entamoeba invadens
KVPRAKE

SEQ ID NO: 2879211 - protein, 6 aa, Entamoeba invadens
KVPSFD

SEQ ID NO: 2879212 - protein, 11 aa, Entamoeba invadens
KVPSKSSSTHL

SEQ ID NO: 2879213 - protein, 5 aa, Entamoeba invadens
KVPSL

SEQ ID NO: 2879214 - protein, 38 aa, Entamoeba invadens
KVPSQQEKIPKMTSEGASPIFSPSSIPALSPRNNLDPV

SEQ ID NO: 2879215 - protein, 27 aa, Entamoeba invadens
KVPSRSSSQDSDVEGSSVKGKKPEETA

SEQ ID NO: 2879216 - protein, 6 aa, Entamoeba invadens
KVPSRV

SEQ ID NO: 2879217 - protein, 24 aa, Entamoeba invadens
KVPSSTQEVKESKDQNESSDPKFA

SEQ ID NO: 2879218 - protein, 6 aa, Entamoeba invadens
KVPSYE

SEQ ID NO: 2879219 - protein, 13 aa, Entamoeba invadens
KVPTASDGASWNA

SEQ ID NO: 2879220 - protein, 17 aa, Entamoeba invadens
KVPTKGGESIKDEQPHF

SEQ ID NO: 2879221 - protein, 23 aa, Entamoeba invadens
KVPTPSRPLPPPPLKKSQQLRQN

SEQ ID NO: 2879222 - protein, 5 aa, Entamoeba invadens
KVPTQ

SEQ ID NO: 2879223 - protein, 7 aa, Entamoeba invadens
KVPTREG

SEQ ID NO: 2879224 - protein, 6 aa, Entamoeba invadens
KVPTSQ

SEQ ID NO: 2879225 - protein, 12 aa, Entamoeba invadens
KVPTTQTHEKKV

SEQ ID NO: 2879226 - protein, 4 aa, Entamoeba invadens
KVPV

SEQ ID NO: 2879227 - protein, 6 aa, Entamoeba invadens
KVPVKE

SEQ ID NO: 2879228 - protein, 10 aa, Entamoeba invadens
KVPVPKPPTK

SEQ ID NO: 2879229 - protein, 6 aa, Entamoeba invadens
KVPVSG

SEQ ID NO: 2879230 - protein, 7 aa, Entamoeba invadens
KVQGEQI

SEQ ID NO: 2879231 - protein, 18 aa, Entamoeba invadens
KVQHKGAAVDAKKMEATM

SEQ ID NO: 2879232 - protein, 7 aa, Entamoeba invadens
KVQKDQM

SEQ ID NO: 2879233 - protein, 12 aa, Entamoeba invadens
KVQKEGRKTSEY

SEQ ID NO: 2879234 - protein, 6 aa, Entamoeba invadens
KVQKKA

SEQ ID NO: 2879235 - protein, 6 aa, Entamoeba invadens
KVQLNN

SEQ ID NO: 2879236 - protein, 4 aa, Entamoeba invadens
KVQN

SEQ ID NO: 2879237 - protein, 7 aa, Entamoeba invadens
KVQPMQN

SEQ ID NO: 2879238 - protein, 10 aa, Entamoeba invadens
KVQPYSPTHS

SEQ ID NO: 2879239 - protein, 6 aa, Entamoeba invadens
KVQRTD

SEQ ID NO: 2879240 - protein, 6 aa, Entamoeba invadens
KVQSGG

SEQ ID NO: 2879241 - protein, 12 aa, Entamoeba invadens
KVQSYKKKADKC

SEQ ID NO: 2879242 - protein, 29 aa, Entamoeba invadens
KVQTEGHTKVQREKTAAFAKNDNKEKLKQ

SEQ ID NO: 2879243 - protein, 7 aa, Entamoeba invadens
KVRDNLE

SEQ ID NO: 2879244 - protein, 5 aa, Entamoeba invadens
KVREE

SEQ ID NO: 2879245 - protein, 22 aa, Entamoeba invadens
KVREEEEDEEEDDRNDNGNDDD

SEQ ID NO: 2879246 - protein, 6 aa, Entamoeba invadens
KVREER

SEQ ID NO: 2879247 - protein, 6 aa, Entamoeba invadens
KVREKI

SEQ ID NO: 2879248 - protein, 5 aa, Entamoeba invadens
KVRER

SEQ ID NO: 2879249 - protein, 10 aa, Entamoeba invadens
KVRKDAESEY

SEQ ID NO: 2879250 - protein, 6 aa, Entamoeba invadens
KVRNGK

SEQ ID NO: 2879251 - protein, 19 aa, Entamoeba invadens
KVRNTKENKLNAENIQKLE

SEQ ID NO: 2879252 - protein, 7 aa, Entamoeba invadens
KVRPELN

SEQ ID NO: 2879253 - protein, 6 aa, Entamoeba invadens
KVRPSA

SEQ ID NO: 2879254 - protein, 6 aa, Entamoeba invadens
KVRRID

SEQ ID NO: 2879255 - protein, 4 aa, Entamoeba invadens
KVRS

SEQ ID NO: 2879256 - protein, 6 aa, Entamoeba invadens
KVRSGK

SEQ ID NO: 2879257 - protein, 9 aa, Entamoeba invadens
KVRSTTKGY

SEQ ID NO: 2879258 - protein, 43 aa, Entamoeba invadens
KVRTTSFNKEKKDQKKNKVSNNNAATYNNKCKEKTSELENVDP

SEQ ID NO: 2879259 - protein, 9 aa, Entamoeba invadens
KVSALTSPV

SEQ ID NO: 2879260 - protein, 9 aa, Entamoeba invadens
KVSASNSTV

SEQ ID NO: 2879261 - protein, 5 aa, Entamoeba invadens
KVSDS

SEQ ID NO: 2879262 - protein, 7 aa, Entamoeba invadens
KVSDSVS

SEQ ID NO: 2879263 - protein, 79 aa, Entamoeba invadens
KVSEESDDEVDNKKDAKATKIDSDDEEEKMRKEEEEERKAEERDEQLKKEAAAKEAERQKKLENEDPAMKRHNEREDRL

SEQ ID NO: 2879264 - protein, 9 aa, Entamoeba invadens
KVSEKEEAA

SEQ ID NO: 2879265 - protein, 26 aa, Entamoeba invadens
KVSEKKNEKVFEKSDEKSFEKSYEER

SEQ ID NO: 2879266 - protein, 9 aa, Entamoeba invadens
KVSELSSEL

SEQ ID NO: 2879267 - protein, 11 aa, Entamoeba invadens
KVSEQTKKQIE

SEQ ID NO: 2879268 - protein, 9 aa, Entamoeba invadens
KVSERSCPS

SEQ ID NO: 2879269 - protein, 11 aa, Entamoeba invadens
KVSGNTTEEFA

SEQ ID NO: 2879270 - protein, 11 aa, Entamoeba invadens
KVSGQQLEKIR

SEQ ID NO: 2879271 - protein, 11 aa, Entamoeba invadens
KVSKKKSGAAG

SEQ ID NO: 2879272 - protein, 9 aa, Entamoeba invadens
KVSKNAQRI

SEQ ID NO: 2879273 - protein, 9 aa, Entamoeba invadens
KVSKNTQRI

SEQ ID NO: 2879274 - protein, 13 aa, Entamoeba invadens
KVSKQSKGRPVRP

SEQ ID NO: 2879275 - protein, 5 aa, Entamoeba invadens
KVSLA

SEQ ID NO: 2879276 - protein, 4 aa, Entamoeba invadens
KVSN

SEQ ID NO: 2879277 - protein, 12 aa, Entamoeba invadens
KVSNNPKATEQD

SEQ ID NO: 2879278 - protein, 6 aa, Entamoeba invadens
KVSNPG

SEQ ID NO: 2879279 - protein, 29 aa, Entamoeba invadens
KVSPPKDLAVPTAPPPVIPNPKIVYNYCY

SEQ ID NO: 2879280 - protein, 15 aa, Entamoeba invadens
KVSQEYQAMSPDEKI

SEQ ID NO: 2879281 - protein, 13 aa, Entamoeba invadens
KVSQHIPTQQPTM

SEQ ID NO: 2879282 - protein, 14 aa, Entamoeba invadens
KVSQNGLSRATETL

SEQ ID NO: 2879283 - protein, 31 aa, Entamoeba invadens
KVSQPKERKKKIERKSLEKKVPEKKLEKKSK

SEQ ID NO: 2879284 - protein, 14 aa, Entamoeba invadens
KVSQTTNELEKSGL

SEQ ID NO: 2879285 - protein, 27 aa, Entamoeba invadens
KVSRSRSKKVRKTSKSPSSESIKSEVT

SEQ ID NO: 2879286 - protein, 14 aa, Entamoeba invadens
KVSSGKKQKKNNYK

SEQ ID NO: 2879287 - protein, 10 aa, Entamoeba invadens
KVSSGRNNTM

SEQ ID NO: 2879288 - protein, 7 aa, Entamoeba invadens
KVSSNAT

SEQ ID NO: 2879289 - protein, 6 aa, Entamoeba invadens
KVSSYS

SEQ ID NO: 2879290 - protein, 8 aa, Entamoeba invadens
KVSTFEPN

SEQ ID NO: 2879291 - protein, 8 aa, Entamoeba invadens
KVSTGKNY

SEQ ID NO: 2879292 - protein, 6 aa, Entamoeba invadens
KVSVPS

SEQ ID NO: 2879293 - protein, 7 aa, Entamoeba invadens
KVTCDAD

SEQ ID NO: 2879294 - protein, 20 aa, Entamoeba invadens
KVTDAEAKLADAGATGASIA

SEQ ID NO: 2879295 - protein, 20 aa, Entamoeba invadens
KVTDAEAKLADSGATGASIA

SEQ ID NO: 2879296 - protein, 17 aa, Entamoeba invadens
KVTDSEAKLADAGATGA

SEQ ID NO: 2879297 - protein, 31 aa, Entamoeba invadens
KVTDSESQNAAAKAKKQAKQYARKVEKAERK

SEQ ID NO: 2879298 - protein, 5 aa, Entamoeba invadens
KVTEE

SEQ ID NO: 2879299 - protein, 19 aa, Entamoeba invadens
KVTEPPDVSQKESNLETNI

SEQ ID NO: 2879300 - protein, 7 aa, Entamoeba invadens
KVTESVQ

SEQ ID NO: 2879301 - protein, 8 aa, Entamoeba invadens
KVTETDEL

SEQ ID NO: 2879302 - protein, 7 aa, Entamoeba invadens
KVTETTS

SEQ ID NO: 2879303 - protein, 6 aa, Entamoeba invadens
KVTGGD

SEQ ID NO: 2879304 - protein, 16 aa, Entamoeba invadens
KVTGPNVMKCIDALFG

SEQ ID NO: 2879305 - protein, 14 aa, Entamoeba invadens
KVTGSETESTSGGV

SEQ ID NO: 2879306 - protein, 6 aa, Entamoeba invadens
KVTGSS

SEQ ID NO: 2879307 - protein, 15 aa, Entamoeba invadens
KVTKEKTQKDERDAD

SEQ ID NO: 2879308 - protein, 19 aa, Entamoeba invadens
KVTKHAAEEVKDEKEEKKE

SEQ ID NO: 2879309 - protein, 9 aa, Entamoeba invadens
KVTKPQQVE

SEQ ID NO: 2879310 - protein, 12 aa, Entamoeba invadens
KVTKRLKSGDLK

SEQ ID NO: 2879311 - protein, 20 aa, Entamoeba invadens
KVTKTPNADLPKSTQTEPAS

SEQ ID NO: 2879312 - protein, 6 aa, Entamoeba invadens
KVTNDK

SEQ ID NO: 2879313 - protein, 12 aa, Entamoeba invadens
KVTNGGADRGSP

SEQ ID NO: 2879314 - protein, 11 aa, Entamoeba invadens
KVTNIGGAPPA

SEQ ID NO: 2879315 - protein, 5 aa, Entamoeba invadens
KVTNS

SEQ ID NO: 2879316 - protein, 21 aa, Entamoeba invadens
KVTNSEAKLVDETGATGASIA

SEQ ID NO: 2879317 - protein, 6 aa, Entamoeba invadens
KVTNTL

SEQ ID NO: 2879318 - protein, 5 aa, Entamoeba invadens
KVTNV

SEQ ID NO: 2879319 - protein, 10 aa, Entamoeba invadens
KVTPAESEEM

SEQ ID NO: 2879320 - protein, 7 aa, Entamoeba invadens
KVTPAVV

SEQ ID NO: 2879321 - protein, 7 aa, Entamoeba invadens
KVTPPSR

SEQ ID NO: 2879322 - protein, 7 aa, Entamoeba invadens
KVTPSKI

SEQ ID NO: 2879323 - protein, 9 aa, Entamoeba invadens
KVTPSTRSQ

SEQ ID NO: 2879324 - protein, 15 aa, Entamoeba invadens
KVTQEEKIEEPQQDV

SEQ ID NO: 2879325 - protein, 5 aa, Entamoeba invadens
KVTRA

SEQ ID NO: 2879326 - protein, 7 aa, Entamoeba invadens
KVTRNGV

SEQ ID NO: 2879327 - protein, 6 aa, Entamoeba invadens
KVTRNY

SEQ ID NO: 2879328 - protein, 28 aa, Entamoeba invadens
KVTRRSKEKSQAATQETPQDISESQNPT

SEQ ID NO: 2879329 - protein, 27 aa, Entamoeba invadens
KVTRSNYQIDTPDGHKVQKDSKKGGKN

SEQ ID NO: 2879330 - protein, 27 aa, Entamoeba invadens
KVTRSNYQIDTPDGHKVQKDSKKSGKK

SEQ ID NO: 2879331 - protein, 6 aa, Entamoeba invadens
KVTSAL

SEQ ID NO: 2879332 - protein, 12 aa, Entamoeba invadens
KVTSEVSEQYES

SEQ ID NO: 2879333 - protein, 5 aa, Entamoeba invadens
KVTSF

SEQ ID NO: 2879334 - protein, 7 aa, Entamoeba invadens
KVTSKVD

SEQ ID NO: 2879335 - protein, 7 aa, Entamoeba invadens
KVTSPNT

SEQ ID NO: 2879336 - protein, 12 aa, Entamoeba invadens
KVTSRVTEEYHD

SEQ ID NO: 2879337 - protein, 7 aa, Entamoeba invadens
KVVATGR

SEQ ID NO: 2879338 - protein, 7 aa, Entamoeba invadens
KVVESTE

SEQ ID NO: 2879339 - protein, 9 aa, Entamoeba invadens
KVVSDDEEI

SEQ ID NO: 2879340 - protein, 10 aa, Entamoeba invadens
KVVSEDEDME

SEQ ID NO: 2879341 - protein, 7 aa, Entamoeba invadens
KVVSTSE

SEQ ID NO: 2879342 - protein, 8 aa, Entamoeba invadens
KVVTQGTQ

SEQ ID NO: 2879343 - protein, 6 aa, Entamoeba invadens
KVYGSG

SEQ ID NO: 2879344 - protein, 13 aa, Entamoeba invadens
KWDDTQWDQQSLE

SEQ ID NO: 2879345 - protein, 16 aa, Entamoeba invadens
KWEEGTAGGNVNNPEA

SEQ ID NO: 2879346 - protein, 13 aa, Entamoeba invadens
KWEENEKSAENTF

SEQ ID NO: 2879347 - protein, 26 aa, Entamoeba invadens
KWEKVDQNDPRKRVKKSTFKGDFKRK

SEQ ID NO: 2879348 - protein, 10 aa, Entamoeba invadens
KWGDEDIDKL

SEQ ID NO: 2879349 - protein, 4 aa, Entamoeba invadens
KWIT

SEQ ID NO: 2879350 - protein, 13 aa, Entamoeba invadens
KWKEKRDALNTLN

SEQ ID NO: 2879351 - protein, 15 aa, Entamoeba invadens
KWKHTPKGDNGEPLK

SEQ ID NO: 2879352 - protein, 24 aa, Entamoeba invadens
KWKPKIDKYNHEKIKTEAEDLAKK

SEQ ID NO: 2879353 - protein, 10 aa, Entamoeba invadens
KWKTENPWKS

SEQ ID NO: 2879354 - protein, 9 aa, Entamoeba invadens
KWKTNNEKN

SEQ ID NO: 2879355 - protein, 7 aa, Entamoeba invadens
KWNEEEY

SEQ ID NO: 2879356 - protein, 4 aa, Entamoeba invadens
KWPD

SEQ ID NO: 2879357 - protein, 7 aa, Entamoeba invadens
KWQETNK

SEQ ID NO: 2879358 - protein, 5 aa, Entamoeba invadens
KWQPE

SEQ ID NO: 2879359 - protein, 4 aa, Entamoeba invadens
KWST

SEQ ID NO: 2879360 - protein, 10 aa, Entamoeba invadens
KWTEEETKMN

SEQ ID NO: 2879361 - protein, 6 aa, Entamoeba invadens
KWTTSG

SEQ ID NO: 2879362 - protein, 6 aa, Entamoeba invadens
KWTVQH

SEQ ID NO: 2879363 - protein, 9 aa, Entamoeba invadens
KYAAPYSEY

SEQ ID NO: 2879364 - protein, 9 aa, Entamoeba invadens
KYAASDNLQ

SEQ ID NO: 2879365 - protein, 6 aa, Entamoeba invadens
KYAASL

SEQ ID NO: 2879366 - protein, 15 aa, Entamoeba invadens
KYAGQKIKDAKTPIR

SEQ ID NO: 2879367 - protein, 5 aa, Entamoeba invadens
KYAGT

SEQ ID NO: 2879368 - protein, 8 aa, Entamoeba invadens
KYANDTQM

SEQ ID NO: 2879369 - protein, 8 aa, Entamoeba invadens
KYANSSRC

SEQ ID NO: 2879370 - protein, 5 aa, Entamoeba invadens
KYAPD

SEQ ID NO: 2879371 - protein, 11 aa, Entamoeba invadens
KYASEKNFETA

SEQ ID NO: 2879372 - protein, 6 aa, Entamoeba invadens
KYCTSD

SEQ ID NO: 2879373 - protein, 13 aa, Entamoeba invadens
KYDAEKDGEEIEV

SEQ ID NO: 2879374 - protein, 9 aa, Entamoeba invadens
KYDAPDLED

SEQ ID NO: 2879375 - protein, 10 aa, Entamoeba invadens
KYDEAEKVCE

SEQ ID NO: 2879376 - protein, 7 aa, Entamoeba invadens
KYDEAPD

SEQ ID NO: 2879377 - protein, 5 aa, Entamoeba invadens
KYDEE

SEQ ID NO: 2879378 - protein, 12 aa, Entamoeba invadens
KYDEVSKKDEDT

SEQ ID NO: 2879379 - protein, 6 aa, Entamoeba invadens
KYDEYE

SEQ ID NO: 2879380 - protein, 11 aa, Entamoeba invadens
KYDGNLSVPST

SEQ ID NO: 2879381 - protein, 8 aa, Entamoeba invadens
KYDGNTTC

SEQ ID NO: 2879382 - protein, 18 aa, Entamoeba invadens
KYDGNVISKDTKPRKNRV

SEQ ID NO: 2879383 - protein, 6 aa, Entamoeba invadens
KYDGRV

SEQ ID NO: 2879384 - protein, 6 aa, Entamoeba invadens
KYDHTG

SEQ ID NO: 2879385 - protein, 18 aa, Entamoeba invadens
KYDNARAEIAALKSEYGL

SEQ ID NO: 2879386 - protein, 6 aa, Entamoeba invadens
KYDNEY

SEQ ID NO: 2879387 - protein, 6 aa, Entamoeba invadens
KYDNTF

SEQ ID NO: 2879388 - protein, 9 aa, Entamoeba invadens
KYDPKTPPI

SEQ ID NO: 2879389 - protein, 5 aa, Entamoeba invadens
KYDPL

SEQ ID NO: 2879390 - protein, 6 aa, Entamoeba invadens
KYDQRL

SEQ ID NO: 2879391 - protein, 38 aa, Entamoeba invadens
KYDRTEQKRTENRKKGRMEETKAKKEKREKTDDAKRRA

SEQ ID NO: 2879392 - protein, 4 aa, Entamoeba invadens
KYDS

SEQ ID NO: 2879393 - protein, 9 aa, Entamoeba invadens
KYDSIGSEY

SEQ ID NO: 2879394 - protein, 9 aa, Entamoeba invadens
KYDSSNGVL

SEQ ID NO: 2879395 - protein, 14 aa, Entamoeba invadens
KYDTHYSPETKNKC

SEQ ID NO: 2879396 - protein, 6 aa, Entamoeba invadens
KYDTSK

SEQ ID NO: 2879397 - protein, 11 aa, Entamoeba invadens
KYDTSKIGVTT

SEQ ID NO: 2879398 - protein, 4 aa, Entamoeba invadens
KYDV

SEQ ID NO: 2879399 - protein, 7 aa, Entamoeba invadens
KYDYQTN

SEQ ID NO: 2879400 - protein, 9 aa, Entamoeba invadens
KYEADSKYE

SEQ ID NO: 2879401 - protein, 11 aa, Entamoeba invadens
KYEAEKPGRDL

SEQ ID NO: 2879402 - protein, 10 aa, Entamoeba invadens
KYEDTSKLGG

SEQ ID NO: 2879403 - protein, 4 aa, Entamoeba invadens
KYEE

SEQ ID NO: 2879404 - protein, 5 aa, Entamoeba invadens
KYEEA

SEQ ID NO: 2879405 - protein, 5 aa, Entamoeba invadens
KYEEE

SEQ ID NO: 2879406 - protein, 22 aa, Entamoeba invadens
KYEEEVPPPTLTQSKSQGGDNK

SEQ ID NO: 2879407 - protein, 5 aa, Entamoeba invadens
KYEEK

SEQ ID NO: 2879408 - protein, 10 aa, Entamoeba invadens
KYEEKKDEEM

SEQ ID NO: 2879409 - protein, 13 aa, Entamoeba invadens
KYEEPEDETKPKH

SEQ ID NO: 2879410 - protein, 13 aa, Entamoeba invadens
KYEEPEDETKPQH

SEQ ID NO: 2879411 - protein, 15 aa, Entamoeba invadens
KYEFEDVEDDETTAP

SEQ ID NO: 2879412 - protein, 6 aa, Entamoeba invadens
KYEGNI

SEQ ID NO: 2879413 - protein, 9 aa, Entamoeba invadens
KYEHDPPLH

SEQ ID NO: 2879414 - protein, 4 aa, Entamoeba invadens
KYEI

SEQ ID NO: 2879415 - protein, 4 aa, Entamoeba invadens
KYEK

SEQ ID NO: 2879416 - protein, 11 aa, Entamoeba invadens
KYEKLKDSEEV

SEQ ID NO: 2879417 - protein, 10 aa, Entamoeba invadens
KYEKNTNYTD

SEQ ID NO: 2879418 - protein, 7 aa, Entamoeba invadens
KYEKQSD

SEQ ID NO: 2879419 - protein, 6 aa, Entamoeba invadens
KYELPQ

SEQ ID NO: 2879420 - protein, 8 aa, Entamoeba invadens
KYELTKTT

SEQ ID NO: 2879421 - protein, 8 aa, Entamoeba invadens
KYENESKF

SEQ ID NO: 2879422 - protein, 10 aa, Entamoeba invadens
KYEPNPAKAK

SEQ ID NO: 2879423 - protein, 11 aa, Entamoeba invadens
KYEQEERERIP

SEQ ID NO: 2879424 - protein, 15 aa, Entamoeba invadens
KYEQTTEGEKTVNSE

SEQ ID NO: 2879425 - protein, 11 aa, Entamoeba invadens
KYERKSNKKKS

SEQ ID NO: 2879426 - protein, 6 aa, Entamoeba invadens
KYESTD

SEQ ID NO: 2879427 - protein, 24 aa, Entamoeba invadens
KYESTELYTTKDEITSVSAKSSKS

SEQ ID NO: 2879428 - protein, 7 aa, Entamoeba invadens
KYETGQK

SEQ ID NO: 2879429 - protein, 8 aa, Entamoeba invadens
KYETNQWT

SEQ ID NO: 2879430 - protein, 4 aa, Entamoeba invadens
KYEV

SEQ ID NO: 2879431 - protein, 13 aa, Entamoeba invadens
KYFPTSGLANSTL

SEQ ID NO: 2879432 - protein, 5 aa, Entamoeba invadens
KYGAE

SEQ ID NO: 2879433 - protein, 9 aa, Entamoeba invadens
KYGAEKEDL

SEQ ID NO: 2879434 - protein, 7 aa, Entamoeba invadens
KYGDGAF

SEQ ID NO: 2879435 - protein, 11 aa, Entamoeba invadens
KYGDGETVPIQ

SEQ ID NO: 2879436 - protein, 5 aa, Entamoeba invadens
KYGDK

SEQ ID NO: 2879437 - protein, 8 aa, Entamoeba invadens
KYGDKFKP

SEQ ID NO: 2879438 - protein, 12 aa, Entamoeba invadens
KYGEEHNTNNIP

SEQ ID NO: 2879439 - protein, 16 aa, Entamoeba invadens
KYGEGTSEGKYKTSID

SEQ ID NO: 2879440 - protein, 8 aa, Entamoeba invadens
KYGETKVE

SEQ ID NO: 2879441 - protein, 62 aa, Entamoeba invadens
KYGHKGKECPESLKSGMKGRKGKNRKEEDDDDESQEEKETKRGKGQIREKDKKEKVSKKMFD

SEQ ID NO: 2879442 - protein, 5 aa, Entamoeba invadens
KYGKK

SEQ ID NO: 2879443 - protein, 8 aa, Entamoeba invadens
KYGKKSEM

SEQ ID NO: 2879444 - protein, 6 aa, Entamoeba invadens
KYGNPA

SEQ ID NO: 2879445 - protein, 6 aa, Entamoeba invadens
KYGNSE

SEQ ID NO: 2879446 - protein, 24 aa, Entamoeba invadens
KYGQDATNVGDEGGFAPNVSGARE

SEQ ID NO: 2879447 - protein, 41 aa, Entamoeba invadens
KYGQKIREETLKTSPELLEENSKEQFDDAIDENEIKRPTMA

SEQ ID NO: 2879448 - protein, 21 aa, Entamoeba invadens
KYGQPTGPQHSASRKDKLRRM

SEQ ID NO: 2879449 - protein, 7 aa, Entamoeba invadens
KYGREKV

SEQ ID NO: 2879450 - protein, 6 aa, Entamoeba invadens
KYGRGD

SEQ ID NO: 2879451 - protein, 11 aa, Entamoeba invadens
KYGRSSYDIQS

SEQ ID NO: 2879452 - protein, 5 aa, Entamoeba invadens
KYGSL

SEQ ID NO: 2879453 - protein, 12 aa, Entamoeba invadens
KYGSQEELEKNP

SEQ ID NO: 2879454 - protein, 5 aa, Entamoeba invadens
KYGTA

SEQ ID NO: 2879455 - protein, 6 aa, Entamoeba invadens
KYGTAN

SEQ ID NO: 2879456 - protein, 7 aa, Entamoeba invadens
KYGTMNQ

SEQ ID NO: 2879457 - protein, 12 aa, Entamoeba invadens
KYGTRGSRENYK

SEQ ID NO: 2879458 - protein, 5 aa, Entamoeba invadens
KYGTY

SEQ ID NO: 2879459 - protein, 7 aa, Entamoeba invadens
KYGVGAG

SEQ ID NO: 2879460 - protein, 6 aa, Entamoeba invadens
KYHPSV

SEQ ID NO: 2879461 - protein, 7 aa, Entamoeba invadens
KYHTHTN

SEQ ID NO: 2879462 - protein, 10 aa, Entamoeba invadens
KYIESQNEDY

SEQ ID NO: 2879463 - protein, 5 aa, Entamoeba invadens
KYING

SEQ ID NO: 2879464 - protein, 16 aa, Entamoeba invadens
KYIPKELRPRTTKKQR

SEQ ID NO: 2879465 - protein, 12 aa, Entamoeba invadens
KYIREKKKSNIA

SEQ ID NO: 2879466 - protein, 5 aa, Entamoeba invadens
KYISR

SEQ ID NO: 2879467 - protein, 7 aa, Entamoeba invadens
KYKAENK

SEQ ID NO: 2879468 - protein, 7 aa, Entamoeba invadens
KYKATMS

SEQ ID NO: 2879469 - protein, 8 aa, Entamoeba invadens
KYKDNTQL

SEQ ID NO: 2879470 - protein, 6 aa, Entamoeba invadens
KYKDQY

SEQ ID NO: 2879471 - protein, 5 aa, Entamoeba invadens
KYKDT

SEQ ID NO: 2879472 - protein, 4 aa, Entamoeba invadens
KYKE

SEQ ID NO: 2879473 - protein, 19 aa, Entamoeba invadens
KYKEENDGRVDEFERNSDA

SEQ ID NO: 2879474 - protein, 11 aa, Entamoeba invadens
KYKENENSDVM

SEQ ID NO: 2879475 - protein, 22 aa, Entamoeba invadens
KYKENPDKYRVKKGESAKEHFK

SEQ ID NO: 2879476 - protein, 10 aa, Entamoeba invadens
KYKESLAPTA

SEQ ID NO: 2879477 - protein, 20 aa, Entamoeba invadens
KYKETEKVSFKQEKEISPYE

SEQ ID NO: 2879478 - protein, 6 aa, Entamoeba invadens
KYKGNM

SEQ ID NO: 2879479 - protein, 5 aa, Entamoeba invadens
KYKGT

SEQ ID NO: 2879480 - protein, 5 aa, Entamoeba invadens
KYKIE

SEQ ID NO: 2879481 - protein, 13 aa, Entamoeba invadens
KYKKDGKSYTEEF

SEQ ID NO: 2879482 - protein, 11 aa, Entamoeba invadens
KYKKDIPGNAR

SEQ ID NO: 2879483 - protein, 6 aa, Entamoeba invadens
KYKKKI

SEQ ID NO: 2879484 - protein, 5 aa, Entamoeba invadens
KYKMP

SEQ ID NO: 2879485 - protein, 6 aa, Entamoeba invadens
KYKMPS

SEQ ID NO: 2879486 - protein, 11 aa, Entamoeba invadens
KYKPKDTTIDE

SEQ ID NO: 2879487 - protein, 8 aa, Entamoeba invadens
KYKPKTDK

SEQ ID NO: 2879488 - protein, 5 aa, Entamoeba invadens
KYKQS

SEQ ID NO: 2879489 - protein, 6 aa, Entamoeba invadens
KYKRQN

SEQ ID NO: 2879490 - protein, 7 aa, Entamoeba invadens
KYKRSEG

SEQ ID NO: 2879491 - protein, 8 aa, Entamoeba invadens
KYKSGERD

SEQ ID NO: 2879492 - protein, 9 aa, Entamoeba invadens
KYKSPSSDF

SEQ ID NO: 2879493 - protein, 9 aa, Entamoeba invadens
KYKSSEEKE

SEQ ID NO: 2879494 - protein, 15 aa, Entamoeba invadens
KYKTQLDADKQNEQL

SEQ ID NO: 2879495 - protein, 9 aa, Entamoeba invadens
KYKTSTMNA

SEQ ID NO: 2879496 - protein, 28 aa, Entamoeba invadens
KYKTTHKIKPKKTKKDGKKSPREKDCYI

SEQ ID NO: 2879497 - protein, 6 aa, Entamoeba invadens
KYKYLT

SEQ ID NO: 2879498 - protein, 7 aa, Entamoeba invadens
KYLGDRG

SEQ ID NO: 2879499 - protein, 11 aa, Entamoeba invadens
KYLSAPQSSIY

SEQ ID NO: 2879500 - protein, 5 aa, Entamoeba invadens
KYLSE

SEQ ID NO: 2879501 - protein, 5 aa, Entamoeba invadens
KYLSS

SEQ ID NO: 2879502 - protein, 5 aa, Entamoeba invadens
KYNDP

SEQ ID NO: 2879503 - protein, 5 aa, Entamoeba invadens
KYNDR

SEQ ID NO: 2879504 - protein, 4 aa, Entamoeba invadens
KYNE

SEQ ID NO: 2879505 - protein, 5 aa, Entamoeba invadens
KYNED

SEQ ID NO: 2879506 - protein, 6 aa, Entamoeba invadens
KYNEER

SEQ ID NO: 2879507 - protein, 5 aa, Entamoeba invadens
KYNET

SEQ ID NO: 2879508 - protein, 22 aa, Entamoeba invadens
KYNGLNKLSGNEFEANELNKTT

SEQ ID NO: 2879509 - protein, 23 aa, Entamoeba invadens
KYNGLNKLSGNEFEANELNKTTV

SEQ ID NO: 2879510 - protein, 6 aa, Entamoeba invadens
KYNGNM

SEQ ID NO: 2879511 - protein, 15 aa, Entamoeba invadens
KYNKDDVSLSTSNEL

SEQ ID NO: 2879512 - protein, 6 aa, Entamoeba invadens
KYNKDV

SEQ ID NO: 2879513 - protein, 21 aa, Entamoeba invadens
KYNNALDSVGNKIESTVTEGA

SEQ ID NO: 2879514 - protein, 12 aa, Entamoeba invadens
KYNNTCQPCANG

SEQ ID NO: 2879515 - protein, 10 aa, Entamoeba invadens
KYNPKERPTI

SEQ ID NO: 2879516 - protein, 6 aa, Entamoeba invadens
KYNPPR

SEQ ID NO: 2879517 - protein, 4 aa, Entamoeba invadens
KYNS

SEQ ID NO: 2879518 - protein, 7 aa, Entamoeba invadens
KYNTKNE

SEQ ID NO: 2879519 - protein, 17 aa, Entamoeba invadens
KYNTKTIHKATKPKHSL

SEQ ID NO: 2879520 - protein, 5 aa, Entamoeba invadens
KYNTT

SEQ ID NO: 2879521 - protein, 198 aa, Entamoeba invadens
KYPALQQAHEDKIKQQQENEEAEKKRLADEEEERKEAERFAAEQAEKARIAAEEAERKRIAEEEAEKARIAAEEAEKARLAAEEAERLRKEKEEAERLAAEEAERARIQAEEAEKARLAAEELERQRQAAQEESERQRIAAEQAEQARIAAEQAEKARIAAEEAEKARLAAEEAEKQRIAAEQAERDRIAAQEAERQR

SEQ ID NO: 2879522 - protein, 5 aa, Entamoeba invadens
KYPDE

SEQ ID NO: 2879523 - protein, 8 aa, Entamoeba invadens
KYPEFSDD

SEQ ID NO: 2879524 - protein, 6 aa, Entamoeba invadens
KYPEIE

SEQ ID NO: 2879525 - protein, 8 aa, Entamoeba invadens
KYPEKTVQ

SEQ ID NO: 2879526 - protein, 6 aa, Entamoeba invadens
KYPEVD

SEQ ID NO: 2879527 - protein, 5 aa, Entamoeba invadens
KYPEW

SEQ ID NO: 2879528 - protein, 4 aa, Entamoeba invadens
KYPF

SEQ ID NO: 2879529 - protein, 5 aa, Entamoeba invadens
KYPFE

SEQ ID NO: 2879530 - protein, 7 aa, Entamoeba invadens
KYPFGAT

SEQ ID NO: 2879531 - protein, 7 aa, Entamoeba invadens
KYPGKNI

SEQ ID NO: 2879532 - protein, 4 aa, Entamoeba invadens
KYPH

SEQ ID NO: 2879533 - protein, 4 aa, Entamoeba invadens
KYPK

SEQ ID NO: 2879534 - protein, 6 aa, Entamoeba invadens
KYPKET

SEQ ID NO: 2879535 - protein, 9 aa, Entamoeba invadens
KYPKKPDIT

SEQ ID NO: 2879536 - protein, 6 aa, Entamoeba invadens
KYPKLS

SEQ ID NO: 2879537 - protein, 5 aa, Entamoeba invadens
KYPKT

SEQ ID NO: 2879538 - protein, 7 aa, Entamoeba invadens
KYPLGNR

SEQ ID NO: 2879539 - protein, 10 aa, Entamoeba invadens
KYPLSKRSNN

SEQ ID NO: 2879540 - protein, 10 aa, Entamoeba invadens
KYPNEDPPII

SEQ ID NO: 2879541 - protein, 19 aa, Entamoeba invadens
KYPNEDPPVITGGDKIPIS

SEQ ID NO: 2879542 - protein, 19 aa, Entamoeba invadens
KYPNENPPVITGGDKIPIS

SEQ ID NO: 2879543 - protein, 6 aa, Entamoeba invadens
KYPPGL

SEQ ID NO: 2879544 - protein, 5 aa, Entamoeba invadens
KYPQA

SEQ ID NO: 2879545 - protein, 5 aa, Entamoeba invadens
KYPQF

SEQ ID NO: 2879546 - protein, 8 aa, Entamoeba invadens
KYPQNDEG

SEQ ID NO: 2879547 - protein, 12 aa, Entamoeba invadens
KYPQPKLECPNE

SEQ ID NO: 2879548 - protein, 12 aa, Entamoeba invadens
KYPRNESATQER

SEQ ID NO: 2879549 - protein, 9 aa, Entamoeba invadens
KYPSEGYST

SEQ ID NO: 2879550 - protein, 6 aa, Entamoeba invadens
KYPSMT

SEQ ID NO: 2879551 - protein, 9 aa, Entamoeba invadens
KYPSPSDGY

SEQ ID NO: 2879552 - protein, 8 aa, Entamoeba invadens
KYPSSRDM

SEQ ID NO: 2879553 - protein, 6 aa, Entamoeba invadens
KYPTNT

SEQ ID NO: 2879554 - protein, 24 aa, Entamoeba invadens
KYPTPLKRKPLTPSHDGKKKNGVR

SEQ ID NO: 2879555 - protein, 7 aa, Entamoeba invadens
KYPYGDN

SEQ ID NO: 2879556 - protein, 7 aa, Entamoeba invadens
KYPYTES

SEQ ID NO: 2879557 - protein, 12 aa, Entamoeba invadens
KYQDELKSYKKD

SEQ ID NO: 2879558 - protein, 6 aa, Entamoeba invadens
KYQDQI

SEQ ID NO: 2879559 - protein, 20 aa, Entamoeba invadens
KYQDSDIKKKALEIVQQTQE

SEQ ID NO: 2879560 - protein, 8 aa, Entamoeba invadens
KYQDSVPD

SEQ ID NO: 2879561 - protein, 7 aa, Entamoeba invadens
KYQEQSE

SEQ ID NO: 2879562 - protein, 5 aa, Entamoeba invadens
KYQGN

SEQ ID NO: 2879563 - protein, 13 aa, Entamoeba invadens
KYQKDLENASKNV

SEQ ID NO: 2879564 - protein, 7 aa, Entamoeba invadens
KYQKGTL

SEQ ID NO: 2879565 - protein, 8 aa, Entamoeba invadens
KYQNDGRV

SEQ ID NO: 2879566 - protein, 6 aa, Entamoeba invadens
KYQPPN

SEQ ID NO: 2879567 - protein, 5 aa, Entamoeba invadens
KYQQE

SEQ ID NO: 2879568 - protein, 14 aa, Entamoeba invadens
KYQQPIKRQEPNVT

SEQ ID NO: 2879569 - protein, 5 aa, Entamoeba invadens
KYQRS

SEQ ID NO: 2879570 - protein, 5 aa, Entamoeba invadens
KYQTD

SEQ ID NO: 2879571 - protein, 4 aa, Entamoeba invadens
KYQV

SEQ ID NO: 2879572 - protein, 7 aa, Entamoeba invadens
KYRAKGR

SEQ ID NO: 2879573 - protein, 7 aa, Entamoeba invadens
KYREAQR

SEQ ID NO: 2879574 - protein, 8 aa, Entamoeba invadens
KYREEELK

SEQ ID NO: 2879575 - protein, 15 aa, Entamoeba invadens
KYRGGLDVKSQSTGL

SEQ ID NO: 2879576 - protein, 7 aa, Entamoeba invadens
KYRGNEV

SEQ ID NO: 2879577 - protein, 6 aa, Entamoeba invadens
KYRGNT

SEQ ID NO: 2879578 - protein, 8 aa, Entamoeba invadens
KYRHNGEH

SEQ ID NO: 2879579 - protein, 4 aa, Entamoeba invadens
KYRK

SEQ ID NO: 2879580 - protein, 13 aa, Entamoeba invadens
KYRKGKDEDTKNG

SEQ ID NO: 2879581 - protein, 12 aa, Entamoeba invadens
KYRKKNKELPEE

SEQ ID NO: 2879582 - protein, 5 aa, Entamoeba invadens
KYRKM

SEQ ID NO: 2879583 - protein, 7 aa, Entamoeba invadens
KYRNNSV

SEQ ID NO: 2879584 - protein, 6 aa, Entamoeba invadens
KYRNTA

SEQ ID NO: 2879585 - protein, 13 aa, Entamoeba invadens
KYRPEKTEEEKLR

SEQ ID NO: 2879586 - protein, 14 aa, Entamoeba invadens
KYRSCSGSPTEEVE

SEQ ID NO: 2879587 - protein, 40 aa, Entamoeba invadens
KYRSCSYSPRGGSASNSSCEDASAPAKTPKKRRSKKTECP

SEQ ID NO: 2879588 - protein, 11 aa, Entamoeba invadens
KYRTNSEFQTA

SEQ ID NO: 2879589 - protein, 16 aa, Entamoeba invadens
KYRTSNLYTGPVDDDV

SEQ ID NO: 2879590 - protein, 16 aa, Entamoeba invadens
KYRYPQIKTSPNSNVK

SEQ ID NO: 2879591 - protein, 5 aa, Entamoeba invadens
KYSAS

SEQ ID NO: 2879592 - protein, 6 aa, Entamoeba invadens
KYSAYG

SEQ ID NO: 2879593 - protein, 18 aa, Entamoeba invadens
KYSDEERRESGSESEEGI

SEQ ID NO: 2879594 - protein, 7 aa, Entamoeba invadens
KYSDKVD

SEQ ID NO: 2879595 - protein, 13 aa, Entamoeba invadens
KYSDVPTAASKSF

SEQ ID NO: 2879596 - protein, 9 aa, Entamoeba invadens
KYSEDQDEW

SEQ ID NO: 2879597 - protein, 9 aa, Entamoeba invadens
KYSEKKKKA

SEQ ID NO: 2879598 - protein, 17 aa, Entamoeba invadens
KYSENKTLSKYLLESCL

SEQ ID NO: 2879599 - protein, 5 aa, Entamoeba invadens
KYSFE

SEQ ID NO: 2879600 - protein, 12 aa, Entamoeba invadens
KYSGNGTPFPTT

SEQ ID NO: 2879601 - protein, 6 aa, Entamoeba invadens
KYSGNM

SEQ ID NO: 2879602 - protein, 22 aa, Entamoeba invadens
KYSGYAQDKSLEITRGRGGAAF

SEQ ID NO: 2879603 - protein, 9 aa, Entamoeba invadens
KYSGYRGGL

SEQ ID NO: 2879604 - protein, 4 aa, Entamoeba invadens
KYSH

SEQ ID NO: 2879605 - protein, 25 aa, Entamoeba invadens
KYSHPSPAPMRDNDRPKMPNKEQQQ

SEQ ID NO: 2879606 - protein, 6 aa, Entamoeba invadens
KYSIEA

SEQ ID NO: 2879607 - protein, 10 aa, Entamoeba invadens
KYSKEDLSHG

SEQ ID NO: 2879608 - protein, 5 aa, Entamoeba invadens
KYSKF

SEQ ID NO: 2879609 - protein, 8 aa, Entamoeba invadens
KYSKKNKK

SEQ ID NO: 2879610 - protein, 9 aa, Entamoeba invadens
KYSKNSIPH

SEQ ID NO: 2879611 - protein, 7 aa, Entamoeba invadens
KYSKSTA

SEQ ID NO: 2879612 - protein, 14 aa, Entamoeba invadens
KYSNKDEDIKNNGP

SEQ ID NO: 2879613 - protein, 7 aa, Entamoeba invadens
KYSNPNT

SEQ ID NO: 2879614 - protein, 6 aa, Entamoeba invadens
KYSNSE

SEQ ID NO: 2879615 - protein, 5 aa, Entamoeba invadens
KYSPI

SEQ ID NO: 2879616 - protein, 8 aa, Entamoeba invadens
KYSPSQIS

SEQ ID NO: 2879617 - protein, 10 aa, Entamoeba invadens
KYSPSQSVTF

SEQ ID NO: 2879618 - protein, 12 aa, Entamoeba invadens
KYSQDGRSKNTP

SEQ ID NO: 2879619 - protein, 6 aa, Entamoeba invadens
KYSRDI

SEQ ID NO: 2879620 - protein, 10 aa, Entamoeba invadens
KYSRKSRQTL

SEQ ID NO: 2879621 - protein, 9 aa, Entamoeba invadens
KYSSEEKKK

SEQ ID NO: 2879622 - protein, 5 aa, Entamoeba invadens
KYSTA

SEQ ID NO: 2879623 - protein, 7 aa, Entamoeba invadens
KYSTRDR

SEQ ID NO: 2879624 - protein, 8 aa, Entamoeba invadens
KYSTSLPP

SEQ ID NO: 2879625 - protein, 9 aa, Entamoeba invadens
KYSTSPWTE

SEQ ID NO: 2879626 - protein, 8 aa, Entamoeba invadens
KYSTYKEK

SEQ ID NO: 2879627 - protein, 9 aa, Entamoeba invadens
KYSWHSPGH

SEQ ID NO: 2879628 - protein, 12 aa, Entamoeba invadens
KYSYDKKGESHY

SEQ ID NO: 2879629 - protein, 11 aa, Entamoeba invadens
KYSYDTDVNRW

SEQ ID NO: 2879630 - protein, 7 aa, Entamoeba invadens
KYTDDEF

SEQ ID NO: 2879631 - protein, 6 aa, Entamoeba invadens
KYTDST

SEQ ID NO: 2879632 - protein, 16 aa, Entamoeba invadens
KYTEALETHQSYSNEL

SEQ ID NO: 2879633 - protein, 26 aa, Entamoeba invadens
KYTEDLRTENEKVKKELQNVQNEKEK

SEQ ID NO: 2879634 - protein, 12 aa, Entamoeba invadens
KYTEQGTSDFEG

SEQ ID NO: 2879635 - protein, 6 aa, Entamoeba invadens
KYTKDD

SEQ ID NO: 2879636 - protein, 15 aa, Entamoeba invadens
KYTKQHSRVQQRITS

SEQ ID NO: 2879637 - protein, 13 aa, Entamoeba invadens
KYTKQKTEEEAEE

SEQ ID NO: 2879638 - protein, 6 aa, Entamoeba invadens
KYTKSA

SEQ ID NO: 2879639 - protein, 7 aa, Entamoeba invadens
KYTKSAD

SEQ ID NO: 2879640 - protein, 32 aa, Entamoeba invadens
KYTKTLKGTDLSLKDRDPKSSACEKKSKQIKE

SEQ ID NO: 2879641 - protein, 8 aa, Entamoeba invadens
KYTLDSEK

SEQ ID NO: 2879642 - protein, 8 aa, Entamoeba invadens
KYTPETQP

SEQ ID NO: 2879643 - protein, 7 aa, Entamoeba invadens
KYTPPHQ

SEQ ID NO: 2879644 - protein, 7 aa, Entamoeba invadens
KYTPTDF

SEQ ID NO: 2879645 - protein, 4 aa, Entamoeba invadens
KYTQ

SEQ ID NO: 2879646 - protein, 9 aa, Entamoeba invadens
KYTQLSKGV

SEQ ID NO: 2879647 - protein, 7 aa, Entamoeba invadens
KYTREEF

SEQ ID NO: 2879648 - protein, 31 aa, Entamoeba invadens
KYTRELAEQKEQKKLDEDQQQKTTEAEIPPF

SEQ ID NO: 2879649 - protein, 7 aa, Entamoeba invadens
KYTSQSF

SEQ ID NO: 2879650 - protein, 6 aa, Entamoeba invadens
KYTTAD

SEQ ID NO: 2879651 - protein, 14 aa, Entamoeba invadens
KYTTFTPKAGIKGE

SEQ ID NO: 2879652 - protein, 5 aa, Entamoeba invadens
KYTTG

SEQ ID NO: 2879653 - protein, 5 aa, Entamoeba invadens
KYTTK

SEQ ID NO: 2879654 - protein, 19 aa, Entamoeba invadens
KYTTKQRSSSIRLGSTRRF

SEQ ID NO: 2879655 - protein, 4 aa, Entamoeba invadens
KYTY

SEQ ID NO: 2879656 - protein, 6 aa, Entamoeba invadens
KYTYEG

SEQ ID NO: 2879657 - protein, 12 aa, Entamoeba invadens
KYVEQNQEALER

SEQ ID NO: 2879658 - protein, 7 aa, Entamoeba invadens
KYVKSSD

SEQ ID NO: 2879659 - protein, 12 aa, Entamoeba invadens
KYVNEKKNDEIE

SEQ ID NO: 2879660 - protein, 6 aa, Entamoeba invadens
KYVPPY

SEQ ID NO: 2879661 - protein, 31 aa, Entamoeba invadens
KYVRRNPRKNMKKKDDGSEVSDKTEKSLKDH

SEQ ID NO: 2879662 - protein, 18 aa, Entamoeba invadens
KYVSGDTIEEFKELKKKL

SEQ ID NO: 2879663 - protein, 17 aa, Entamoeba invadens
KYYEGKAVDTDDEKEVE

SEQ ID NO: 2879664 - protein, 7 aa, Entamoeba invadens
KYYHPSE

SEQ ID NO: 2879665 - protein, 22 aa, Entamoeba invadens
KYYKDTKRAELQRKRTQDLSTS

SEQ ID NO: 2879666 - protein, 5 aa, Entamoeba invadens
KYYSD

SEQ ID NO: 2879667 - protein, 8 aa, Entamoeba invadens
KYYSNSKM

SEQ ID NO: 2879668 - protein, 29 aa, Entamoeba invadens
KYYTSEDKKAEDTNAQKQLGDLEKEKAQI

SEQ ID NO: 2879669 - protein, 23 aa, Entamoeba invadens
LAAAETAKTLENTQAAKGDLESQ

SEQ ID NO: 2879670 - protein, 11 aa, Entamoeba invadens
LAANPKTAAYV

SEQ ID NO: 2879671 - protein, 7 aa, Entamoeba invadens
LAAPKYG

SEQ ID NO: 2879672 - protein, 7 aa, Entamoeba invadens
LAARNDK

SEQ ID NO: 2879673 - protein, 10 aa, Entamoeba invadens
LAASKDDPLR

SEQ ID NO: 2879674 - protein, 24 aa, Entamoeba invadens
LAATTPKQPTKTKKPKPDTTSEDM

SEQ ID NO: 2879675 - protein, 9 aa, Entamoeba invadens
LADAEARKN

SEQ ID NO: 2879676 - protein, 11 aa, Entamoeba invadens
LADAGAIGTSI

SEQ ID NO: 2879677 - protein, 8 aa, Entamoeba invadens
LADDEVKK

SEQ ID NO: 2879678 - protein, 11 aa, Entamoeba invadens
LADDMKTSTFC

SEQ ID NO: 2879679 - protein, 5 aa, Entamoeba invadens
LADDN

SEQ ID NO: 2879680 - protein, 11 aa, Entamoeba invadens
LADEKKDESNV

SEQ ID NO: 2879681 - protein, 16 aa, Entamoeba invadens
LADESGAVQRKRRRKE

SEQ ID NO: 2879682 - protein, 4 aa, Entamoeba invadens
LADF

SEQ ID NO: 2879683 - protein, 6 aa, Entamoeba invadens
LADKQG

SEQ ID NO: 2879684 - protein, 5 aa, Entamoeba invadens
LADNT

SEQ ID NO: 2879685 - protein, 10 aa, Entamoeba invadens
LADQGKNEKE

SEQ ID NO: 2879686 - protein, 9 aa, Entamoeba invadens
LADRQKTVK

SEQ ID NO: 2879687 - protein, 6 aa, Entamoeba invadens
LADSLS

SEQ ID NO: 2879688 - protein, 4 aa, Entamoeba invadens
LADW

SEQ ID NO: 2879689 - protein, 11 aa, Entamoeba invadens
LAEAGATGASI

SEQ ID NO: 2879690 - protein, 9 aa, Entamoeba invadens
LAEATQPDK

SEQ ID NO: 2879691 - protein, 20 aa, Entamoeba invadens
LAEDENTASVYGGKNEVTRM

SEQ ID NO: 2879692 - protein, 6 aa, Entamoeba invadens
LAEDPV

SEQ ID NO: 2879693 - protein, 32 aa, Entamoeba invadens
LAEEAKKVQMRANASRGKLKHEQENEEYDYET

SEQ ID NO: 2879694 - protein, 15 aa, Entamoeba invadens
LAEEEKKSQPKKKEK

SEQ ID NO: 2879695 - protein, 6 aa, Entamoeba invadens
LAEEGT

SEQ ID NO: 2879696 - protein, 7 aa, Entamoeba invadens
LAEEIAK

SEQ ID NO: 2879697 - protein, 13 aa, Entamoeba invadens
LAEEIAKREAAEK

SEQ ID NO: 2879698 - protein, 15 aa, Entamoeba invadens
LAEEIAKREAAEKAL

SEQ ID NO: 2879699 - protein, 15 aa, Entamoeba invadens
LAEEIAKREVAEKAL

SEQ ID NO: 2879700 - protein, 14 aa, Entamoeba invadens
LAEEIAKSEAVEKA

SEQ ID NO: 2879701 - protein, 16 aa, Entamoeba invadens
LAEEIKKREAAEKALS

SEQ ID NO: 2879702 - protein, 6 aa, Entamoeba invadens
LAEEIR

SEQ ID NO: 2879703 - protein, 13 aa, Entamoeba invadens
LAEEITKREAAEK

SEQ ID NO: 2879704 - protein, 27 aa, Entamoeba invadens
LAEEKAKAEAAEKAKLEEEAKRDAERL

SEQ ID NO: 2879705 - protein, 8 aa, Entamoeba invadens
LAEENAKV

SEQ ID NO: 2879706 - protein, 11 aa, Entamoeba invadens
LAEENERLENQ

SEQ ID NO: 2879707 - protein, 6 aa, Entamoeba invadens
LAEESD

SEQ ID NO: 2879708 - protein, 4 aa, Entamoeba invadens
LAEG

SEQ ID NO: 2879709 - protein, 7 aa, Entamoeba invadens
LAEGGEL

SEQ ID NO: 2879710 - protein, 10 aa, Entamoeba invadens
LAEGLSEDIE

SEQ ID NO: 2879711 - protein, 4 aa, Entamoeba invadens
LAEI

SEQ ID NO: 2879712 - protein, 28 aa, Entamoeba invadens
LAEKDKDDEKEKEKKKNGDDEDEDEEED

SEQ ID NO: 2879713 - protein, 11 aa, Entamoeba invadens
LAEKEEELKAA

SEQ ID NO: 2879714 - protein, 11 aa, Entamoeba invadens
LAEKESEYNRC

SEQ ID NO: 2879715 - protein, 9 aa, Entamoeba invadens
LAEKRLSEL

SEQ ID NO: 2879716 - protein, 40 aa, Entamoeba invadens
LAEKTKDDAVKASQTFKEKTEEATKQSTEFQSKKDEIEKE

SEQ ID NO: 2879717 - protein, 4 aa, Entamoeba invadens
LAEL

SEQ ID NO: 2879718 - protein, 19 aa, Entamoeba invadens
LAELQGKGIDAKIASGGGR

SEQ ID NO: 2879719 - protein, 30 aa, Entamoeba invadens
LAEQDSSKKIQEQIEQEEKRKKEKEFEISE

SEQ ID NO: 2879720 - protein, 12 aa, Entamoeba invadens
LAEQSERKEEDI

SEQ ID NO: 2879721 - protein, 8 aa, Entamoeba invadens
LAERVSEE

SEQ ID NO: 2879722 - protein, 12 aa, Entamoeba invadens
LAESADVSGNQP

SEQ ID NO: 2879723 - protein, 14 aa, Entamoeba invadens
LAETESSENPKRVK

SEQ ID NO: 2879724 - protein, 12 aa, Entamoeba invadens
LAETKGDLENPK

SEQ ID NO: 2879725 - protein, 5 aa, Entamoeba invadens
LAETR

SEQ ID NO: 2879726 - protein, 9 aa, Entamoeba invadens
LAETVESAS

SEQ ID NO: 2879727 - protein, 4 aa, Entamoeba invadens
LAEY

SEQ ID NO: 2879728 - protein, 12 aa, Entamoeba invadens
LAGDDVNQSQIP

SEQ ID NO: 2879729 - protein, 5 aa, Entamoeba invadens
LAGEA

SEQ ID NO: 2879730 - protein, 9 aa, Entamoeba invadens
LAGGSTIGP

SEQ ID NO: 2879731 - protein, 12 aa, Entamoeba invadens
LAGKTEETLTEL

SEQ ID NO: 2879732 - protein, 21 aa, Entamoeba invadens
LAGNEAIRNDIDKERSACNKQ

SEQ ID NO: 2879733 - protein, 9 aa, Entamoeba invadens
LAGNHTTNK

SEQ ID NO: 2879734 - protein, 8 aa, Entamoeba invadens
LAGTDMSP

SEQ ID NO: 2879735 - protein, 11 aa, Entamoeba invadens
LAGYKGSDKWD

SEQ ID NO: 2879736 - protein, 4 aa, Entamoeba invadens
LAKD

SEQ ID NO: 2879737 - protein, 6 aa, Entamoeba invadens
LAKDTG

SEQ ID NO: 2879738 - protein, 25 aa, Entamoeba invadens
LAKEEDVKTDAKQTGKEESKEKTVA

SEQ ID NO: 2879739 - protein, 14 aa, Entamoeba invadens
LAKEELVDGAGQRP

SEQ ID NO: 2879740 - protein, 13 aa, Entamoeba invadens
LAKEKTKVKKNFQ

SEQ ID NO: 2879741 - protein, 10 aa, Entamoeba invadens
LAKGIKSPHE

SEQ ID NO: 2879742 - protein, 25 aa, Entamoeba invadens
LAKGKVNQTGGATIGGPNDNKKEGC

SEQ ID NO: 2879743 - protein, 10 aa, Entamoeba invadens
LAKGSGRDIR

SEQ ID NO: 2879744 - protein, 8 aa, Entamoeba invadens
LAKHAKAK

SEQ ID NO: 2879745 - protein, 7 aa, Entamoeba invadens
LAKIESP

SEQ ID NO: 2879746 - protein, 15 aa, Entamoeba invadens
LAKKDESDDSGEADI

SEQ ID NO: 2879747 - protein, 7 aa, Entamoeba invadens
LAKKGKK

SEQ ID NO: 2879748 - protein, 13 aa, Entamoeba invadens
LAKLSEQTMTELN

SEQ ID NO: 2879749 - protein, 48 aa, Entamoeba invadens
LAKNEKDETDDDSSTYSDDESTSEFVPPQSQHPPTFSQVDSSQDYAEE

SEQ ID NO: 2879750 - protein, 12 aa, Entamoeba invadens
LAKNGPTTVTST

SEQ ID NO: 2879751 - protein, 9 aa, Entamoeba invadens
LAKPSGKRH

SEQ ID NO: 2879752 - protein, 9 aa, Entamoeba invadens
LAKQKSDKT

SEQ ID NO: 2879753 - protein, 39 aa, Entamoeba invadens
LAKSDFQVKTKKESLLEDRESLSALEQANEGVQSKKEIT

SEQ ID NO: 2879754 - protein, 9 aa, Entamoeba invadens
LAKSEQNEI

SEQ ID NO: 2879755 - protein, 7 aa, Entamoeba invadens
LAKSTQF

SEQ ID NO: 2879756 - protein, 7 aa, Entamoeba invadens
LAKTEIP

SEQ ID NO: 2879757 - protein, 9 aa, Entamoeba invadens
LAKTPQNTL

SEQ ID NO: 2879758 - protein, 32 aa, Entamoeba invadens
LAKTRSEKGQIEKENQTIKTELEKTKEENEKI

SEQ ID NO: 2879759 - protein, 8 aa, Entamoeba invadens
LAKTTTSF

SEQ ID NO: 2879760 - protein, 81 aa, Entamoeba invadens
LALDDTEKKLDQQVAQNKKVSDERDGYNQQLQAEKTKTAALTSAKNASDKKISALNSDKDELEDKNRKLDSMNKDAQRKIA

SEQ ID NO: 2879761 - protein, 80 aa, Entamoeba invadens
LALDDTEKKLDQQVAQNKKVSDERDGYNQQLQAEKTKTAALTSAKNASDKKISSLNSEKDELEDKNRKLDSSNKDAQRKI

SEQ ID NO: 2879762 - protein, 80 aa, Entamoeba invadens
LALDDTEKKLDQQVAQNKKVSDERNGYNQKLKAGKTKTAALTSAKNASDKKISALNSEKDELEDKNRKFDSSNKDAQRKI

SEQ ID NO: 2879763 - protein, 6 aa, Entamoeba invadens
LALPSL

SEQ ID NO: 2879764 - protein, 19 aa, Entamoeba invadens
LALTPEQKNAKTKKQAQKA

SEQ ID NO: 2879765 - protein, 17 aa, Entamoeba invadens
LALTPEQKNAKTKRQAL

SEQ ID NO: 2879766 - protein, 14 aa, Entamoeba invadens
LANEKSVSNTPTPV

SEQ ID NO: 2879767 - protein, 8 aa, Entamoeba invadens
LANEQENL

SEQ ID NO: 2879768 - protein, 7 aa, Entamoeba invadens
LANGKSI

SEQ ID NO: 2879769 - protein, 46 aa, Entamoeba invadens
LANGSDSASQLNDELNKEKENNRKLEEQNKEKDQSIQTQQTQIEEI

SEQ ID NO: 2879770 - protein, 8 aa, Entamoeba invadens
LANGTSSM

SEQ ID NO: 2879771 - protein, 11 aa, Entamoeba invadens
LANKDKESQTQ

SEQ ID NO: 2879772 - protein, 9 aa, Entamoeba invadens
LANKEAPDA

SEQ ID NO: 2879773 - protein, 9 aa, Entamoeba invadens
LANKEDNYK

SEQ ID NO: 2879774 - protein, 9 aa, Entamoeba invadens
LANLESPKD

SEQ ID NO: 2879775 - protein, 8 aa, Entamoeba invadens
LANPAEHD

SEQ ID NO: 2879776 - protein, 5 aa, Entamoeba invadens
LANPK

SEQ ID NO: 2879777 - protein, 6 aa, Entamoeba invadens
LANPKW

SEQ ID NO: 2879778 - protein, 7 aa, Entamoeba invadens
LANPQKT

SEQ ID NO: 2879779 - protein, 5 aa, Entamoeba invadens
LANQR

SEQ ID NO: 2879780 - protein, 8 aa, Entamoeba invadens
LANQSDLK

SEQ ID NO: 2879781 - protein, 6 aa, Entamoeba invadens
LANQYS

SEQ ID NO: 2879782 - protein, 15 aa, Entamoeba invadens
LANTERLEDKHNKTI

SEQ ID NO: 2879783 - protein, 43 aa, Entamoeba invadens
LANTTKKIKTTKETKETKETKETKETKETKETKETKLKKYNEI

SEQ ID NO: 2879784 - protein, 20 aa, Entamoeba invadens
LAPAKPKPMYADDNQIDNDD

SEQ ID NO: 2879785 - protein, 23 aa, Entamoeba invadens
LAPETTSVTPETSSPDQTKQEEQ

SEQ ID NO: 2879786 - protein, 8 aa, Entamoeba invadens
LAPFSSEK

SEQ ID NO: 2879787 - protein, 11 aa, Entamoeba invadens
LAPKEAPTKAL

SEQ ID NO: 2879788 - protein, 9 aa, Entamoeba invadens
LAPKGPEER

SEQ ID NO: 2879789 - protein, 14 aa, Entamoeba invadens
LAPKRSEDSSGVSR

SEQ ID NO: 2879790 - protein, 7 aa, Entamoeba invadens
LAPNHGQ

SEQ ID NO: 2879791 - protein, 7 aa, Entamoeba invadens
LAPPHPF

SEQ ID NO: 2879792 - protein, 36 aa, Entamoeba invadens
LAPPPGLAPPPLAPPPGGAGAPPPPPPRGSPAGGSM

SEQ ID NO: 2879793 - protein, 6 aa, Entamoeba invadens
LAPPSW

SEQ ID NO: 2879794 - protein, 13 aa, Entamoeba invadens
LAPPTENPVVKEN

SEQ ID NO: 2879795 - protein, 12 aa, Entamoeba invadens
LAPQNTEKQQNE

SEQ ID NO: 2879796 - protein, 7 aa, Entamoeba invadens
LAPRAKK

SEQ ID NO: 2879797 - protein, 13 aa, Entamoeba invadens
LAPSATAQEQEEL

SEQ ID NO: 2879798 - protein, 6 aa, Entamoeba invadens
LAPTED

SEQ ID NO: 2879799 - protein, 5 aa, Entamoeba invadens
LAPTN

SEQ ID NO: 2879800 - protein, 14 aa, Entamoeba invadens
LAPTTKHGVAEQQS

SEQ ID NO: 2879801 - protein, 12 aa, Entamoeba invadens
LAPVQTRSQITG

SEQ ID NO: 2879802 - protein, 15 aa, Entamoeba invadens
LAQPSTKDKKTRHLT

SEQ ID NO: 2879803 - protein, 6 aa, Entamoeba invadens
LAQRKH

SEQ ID NO: 2879804 - protein, 7 aa, Entamoeba invadens
LAQSPQL

SEQ ID NO: 2879805 - protein, 8 aa, Entamoeba invadens
LAQSREGP

SEQ ID NO: 2879806 - protein, 6 aa, Entamoeba invadens
LAQTHT

SEQ ID NO: 2879807 - protein, 40 aa, Entamoeba invadens
LAREQKMKEKMGKKPRNIKTRRNGKPKTIVDSDEITNVEA

SEQ ID NO: 2879808 - protein, 10 aa, Entamoeba invadens
LARERSSRPQ

SEQ ID NO: 2879809 - protein, 7 aa, Entamoeba invadens
LARKAGA

SEQ ID NO: 2879810 - protein, 40 aa, Entamoeba invadens
LARKKEELQDKAKEKRAEEISKAIDEEHKTLDAQADELED

SEQ ID NO: 2879811 - protein, 5 aa, Entamoeba invadens
LARKM

SEQ ID NO: 2879812 - protein, 11 aa, Entamoeba invadens
LARKSKKTKRI

SEQ ID NO: 2879813 - protein, 4 aa, Entamoeba invadens
LARN

SEQ ID NO: 2879814 - protein, 5 aa, Entamoeba invadens
LARPA

SEQ ID NO: 2879815 - protein, 5 aa, Entamoeba invadens
LARPP

SEQ ID NO: 2879816 - protein, 5 aa, Entamoeba invadens
LARPT

SEQ ID NO: 2879817 - protein, 5 aa, Entamoeba invadens
LARSD

SEQ ID NO: 2879818 - protein, 15 aa, Entamoeba invadens
LARTNDGEKKAKYNP

SEQ ID NO: 2879819 - protein, 14 aa, Entamoeba invadens
LARVRTKKEGIADE

SEQ ID NO: 2879820 - protein, 10 aa, Entamoeba invadens
LASDNGGPSN

SEQ ID NO: 2879821 - protein, 7 aa, Entamoeba invadens
LASETHG

SEQ ID NO: 2879822 - protein, 5 aa, Entamoeba invadens
LASGR

SEQ ID NO: 2879823 - protein, 17 aa, Entamoeba invadens
LASGSASGEFMYSNYGI

SEQ ID NO: 2879824 - protein, 4 aa, Entamoeba invadens
LASK

SEQ ID NO: 2879825 - protein, 21 aa, Entamoeba invadens
LASKEEKKPRKKKEVNEDVEE

SEQ ID NO: 2879826 - protein, 27 aa, Entamoeba invadens
LASKGIKYDSSRLGDDETAGIVNILLL

SEQ ID NO: 2879827 - protein, 8 aa, Entamoeba invadens
LASKKKDF

SEQ ID NO: 2879828 - protein, 13 aa, Entamoeba invadens
LASKLNGKVPTLS

SEQ ID NO: 2879829 - protein, 21 aa, Entamoeba invadens
LASKPKTQTVQQPQVRKTLGQ

SEQ ID NO: 2879830 - protein, 4 aa, Entamoeba invadens
LASM

SEQ ID NO: 2879831 - protein, 10 aa, Entamoeba invadens
LASNTSSKKI

SEQ ID NO: 2879832 - protein, 9 aa, Entamoeba invadens
LASPEQKTS

SEQ ID NO: 2879833 - protein, 9 aa, Entamoeba invadens
LASPPADQT

SEQ ID NO: 2879834 - protein, 9 aa, Entamoeba invadens
LASPTPINP

SEQ ID NO: 2879835 - protein, 4 aa, Entamoeba invadens
LASQ

SEQ ID NO: 2879836 - protein, 10 aa, Entamoeba invadens
LASQSRDAVA

SEQ ID NO: 2879837 - protein, 6 aa, Entamoeba invadens
LASRSQ

SEQ ID NO: 2879838 - protein, 6 aa, Entamoeba invadens
LASSHH

SEQ ID NO: 2879839 - protein, 8 aa, Entamoeba invadens
LASTNNDT

SEQ ID NO: 2879840 - protein, 8 aa, Entamoeba invadens
LASTSSLG

SEQ ID NO: 2879841 - protein, 4 aa, Entamoeba invadens
LASY

SEQ ID NO: 2879842 - protein, 5 aa, Entamoeba invadens
LATDP

SEQ ID NO: 2879843 - protein, 10 aa, Entamoeba invadens
LATDRTDEKL

SEQ ID NO: 2879844 - protein, 11 aa, Entamoeba invadens
LATEASRGKQA

SEQ ID NO: 2879845 - protein, 7 aa, Entamoeba invadens
LATEDAR

SEQ ID NO: 2879846 - protein, 7 aa, Entamoeba invadens
LATEEKI

SEQ ID NO: 2879847 - protein, 7 aa, Entamoeba invadens
LATESPV

SEQ ID NO: 2879848 - protein, 4 aa, Entamoeba invadens
LATG

SEQ ID NO: 2879849 - protein, 8 aa, Entamoeba invadens
LATGRSQD

SEQ ID NO: 2879850 - protein, 8 aa, Entamoeba invadens
LATGSSDH

SEQ ID NO: 2879851 - protein, 11 aa, Entamoeba invadens
LATLKKSKTVL

SEQ ID NO: 2879852 - protein, 7 aa, Entamoeba invadens
LATLSSG

SEQ ID NO: 2879853 - protein, 9 aa, Entamoeba invadens
LATLSSGKA

SEQ ID NO: 2879854 - protein, 6 aa, Entamoeba invadens
LATNTL

SEQ ID NO: 2879855 - protein, 9 aa, Entamoeba invadens
LATPPPRGT

SEQ ID NO: 2879856 - protein, 7 aa, Entamoeba invadens
LATPSKR

SEQ ID NO: 2879857 - protein, 8 aa, Entamoeba invadens
LATPSTPT

SEQ ID NO: 2879858 - protein, 11 aa, Entamoeba invadens
LATPTKEEIKE

SEQ ID NO: 2879859 - protein, 10 aa, Entamoeba invadens
LATQPKINAT

SEQ ID NO: 2879860 - protein, 9 aa, Entamoeba invadens
LATRPKISP

SEQ ID NO: 2879861 - protein, 4 aa, Entamoeba invadens
LATS

SEQ ID NO: 2879862 - protein, 11 aa, Entamoeba invadens
LATSEGNTPVE

SEQ ID NO: 2879863 - protein, 6 aa, Entamoeba invadens
LATSGL

SEQ ID NO: 2879864 - protein, 7 aa, Entamoeba invadens
LATSGLS

SEQ ID NO: 2879865 - protein, 7 aa, Entamoeba invadens
LATTRKV

SEQ ID NO: 2879866 - protein, 17 aa, Entamoeba invadens
LCDTQTTRLTRVVVLSF

SEQ ID NO: 2879867 - protein, 8 aa, Entamoeba invadens
LCEGSKSV

SEQ ID NO: 2879868 - protein, 8 aa, Entamoeba invadens
LCEKDGED

SEQ ID NO: 2879869 - protein, 7 aa, Entamoeba invadens
LCETNSK

SEQ ID NO: 2879870 - protein, 6 aa, Entamoeba invadens
LCGDGE

SEQ ID NO: 2879871 - protein, 5 aa, Entamoeba invadens
LCNPE

SEQ ID NO: 2879872 - protein, 5 aa, Entamoeba invadens
LCPNG

SEQ ID NO: 2879873 - protein, 11 aa, Entamoeba invadens
LCQKEKKTELY

SEQ ID NO: 2879874 - protein, 5 aa, Entamoeba invadens
LCSPS

SEQ ID NO: 2879875 - protein, 13 aa, Entamoeba invadens
LCTPSDKQTLEEH

SEQ ID NO: 2879876 - protein, 8 aa, Entamoeba invadens
LDAAENMA

SEQ ID NO: 2879877 - protein, 8 aa, Entamoeba invadens
LDAANDKI

SEQ ID NO: 2879878 - protein, 11 aa, Entamoeba invadens
LDAGKKTEKYF

SEQ ID NO: 2879879 - protein, 8 aa, Entamoeba invadens
LDAGTEGF

SEQ ID NO: 2879880 - protein, 13 aa, Entamoeba invadens
LDAKESGKGVNQT

SEQ ID NO: 2879881 - protein, 12 aa, Entamoeba invadens
LDAKGDDEKVQK

SEQ ID NO: 2879882 - protein, 10 aa, Entamoeba invadens
LDAKKDKEAI

SEQ ID NO: 2879883 - protein, 16 aa, Entamoeba invadens
LDAKPTAKPQKQDDLD

SEQ ID NO: 2879884 - protein, 9 aa, Entamoeba invadens
LDAKSHHKT

SEQ ID NO: 2879885 - protein, 8 aa, Entamoeba invadens
LDANGKRD

SEQ ID NO: 2879886 - protein, 13 aa, Entamoeba invadens
LDANSAPAFTPPK

SEQ ID NO: 2879887 - protein, 15 aa, Entamoeba invadens
LDAPSKRTKVDELSE

SEQ ID NO: 2879888 - protein, 8 aa, Entamoeba invadens
LDAPTQVA

SEQ ID NO: 2879889 - protein, 8 aa, Entamoeba invadens
LDAPTSTV

SEQ ID NO: 2879890 - protein, 4 aa, Entamoeba invadens
LDAS

SEQ ID NO: 2879891 - protein, 15 aa, Entamoeba invadens
LDASQRDKQESEKNI

SEQ ID NO: 2879892 - protein, 7 aa, Entamoeba invadens
LDATHSQ

SEQ ID NO: 2879893 - protein, 18 aa, Entamoeba invadens
LDATKDEKQYSKIQSNVR

SEQ ID NO: 2879894 - protein, 21 aa, Entamoeba invadens
LDATSEDSFTSTSDDPHDAES

SEQ ID NO: 2879895 - protein, 12 aa, Entamoeba invadens
LDATYSSEAERI

SEQ ID NO: 2879896 - protein, 9 aa, Entamoeba invadens
LDDADWSDF

SEQ ID NO: 2879897 - protein, 21 aa, Entamoeba invadens
LDDDETSKPQRQQKGKRFKEN

SEQ ID NO: 2879898 - protein, 5 aa, Entamoeba invadens
LDDDT

SEQ ID NO: 2879899 - protein, 11 aa, Entamoeba invadens
LDDEDNQHISN

SEQ ID NO: 2879900 - protein, 18 aa, Entamoeba invadens
LDDEENNECDDELNNDNK

SEQ ID NO: 2879901 - protein, 8 aa, Entamoeba invadens
LDDEETAK

SEQ ID NO: 2879902 - protein, 24 aa, Entamoeba invadens
LDDGGIASNADEDAEEGAAGEGVE

SEQ ID NO: 2879903 - protein, 17 aa, Entamoeba invadens
LDDGGSDVSNESSEDDI

SEQ ID NO: 2879904 - protein, 6 aa, Entamoeba invadens
LDDGVD

SEQ ID NO: 2879905 - protein, 12 aa, Entamoeba invadens
LDDKAEAEKTTA

SEQ ID NO: 2879906 - protein, 25 aa, Entamoeba invadens
LDDKAKAEKTAADQSDRRKKMEDQV

SEQ ID NO: 2879907 - protein, 51 aa, Entamoeba invadens
LDDKNSGTQISEIQEETEKSETEIKREEENEEESSPTYSDTQSEDQEDLEM

SEQ ID NO: 2879908 - protein, 10 aa, Entamoeba invadens
LDDKPEGKIE

SEQ ID NO: 2879909 - protein, 10 aa, Entamoeba invadens
LDDLKEEEIA

SEQ ID NO: 2879910 - protein, 11 aa, Entamoeba invadens
LDDNGELTRVG

SEQ ID NO: 2879911 - protein, 6 aa, Entamoeba invadens
LDDNYK

SEQ ID NO: 2879912 - protein, 7 aa, Entamoeba invadens
LDDPQAT

SEQ ID NO: 2879913 - protein, 6 aa, Entamoeba invadens
LDDPSV

SEQ ID NO: 2879914 - protein, 9 aa, Entamoeba invadens
LDDQSRSFG

SEQ ID NO: 2879915 - protein, 10 aa, Entamoeba invadens
LDDSDKIHAP

SEQ ID NO: 2879916 - protein, 8 aa, Entamoeba invadens
LDDSEDKH

SEQ ID NO: 2879917 - protein, 11 aa, Entamoeba invadens
LDDSEESEDVK

SEQ ID NO: 2879918 - protein, 10 aa, Entamoeba invadens
LDDSPSQDGY

SEQ ID NO: 2879919 - protein, 17 aa, Entamoeba invadens
LDDTEEEKDRKAKKQIK

SEQ ID NO: 2879920 - protein, 12 aa, Entamoeba invadens
LDDTEKKLDQQV

SEQ ID NO: 2879921 - protein, 67 aa, Entamoeba invadens
LDDTEKKLDQQVAQNKKVSNERDGYNQQLQAEKTKTTALTSAKNASDKKISSLNSEKDELEDKNRKL

SEQ ID NO: 2879922 - protein, 4 aa, Entamoeba invadens
LDDV

SEQ ID NO: 2879923 - protein, 8 aa, Entamoeba invadens
LDDVQDDI

SEQ ID NO: 2879924 - protein, 15 aa, Entamoeba invadens
LDEADMKSQEDQEHI

SEQ ID NO: 2879925 - protein, 15 aa, Entamoeba invadens
LDEADMKSREDQEQF

SEQ ID NO: 2879926 - protein, 11 aa, Entamoeba invadens
LDEAVTKEKTI

SEQ ID NO: 2879927 - protein, 6 aa, Entamoeba invadens
LDEDST

SEQ ID NO: 2879928 - protein, 15 aa, Entamoeba invadens
LDEDTKEEKLNKEQT

SEQ ID NO: 2879929 - protein, 7 aa, Entamoeba invadens
LDEEDSV

SEQ ID NO: 2879930 - protein, 6 aa, Entamoeba invadens
LDEEDY

SEQ ID NO: 2879931 - protein, 10 aa, Entamoeba invadens
LDEEESGSEM

SEQ ID NO: 2879932 - protein, 10 aa, Entamoeba invadens
LDEEKPLPQS

SEQ ID NO: 2879933 - protein, 9 aa, Entamoeba invadens
LDEEKSKAM

SEQ ID NO: 2879934 - protein, 9 aa, Entamoeba invadens
LDEERDTIA

SEQ ID NO: 2879935 - protein, 23 aa, Entamoeba invadens
LDEERQKADSADAARKAAESKLQ

SEQ ID NO: 2879936 - protein, 39 aa, Entamoeba invadens
LDEERQKADSADAARKADSQKELEKERAMKQEADKETQK

SEQ ID NO: 2879937 - protein, 14 aa, Entamoeba invadens
LDEERQKADSADVA

SEQ ID NO: 2879938 - protein, 15 aa, Entamoeba invadens
LDEEYDYETSFNNKS

SEQ ID NO: 2879939 - protein, 12 aa, Entamoeba invadens
LDEGERKKLQEE

SEQ ID NO: 2879940 - protein, 4 aa, Entamoeba invadens
LDEK

SEQ ID NO: 2879941 - protein, 14 aa, Entamoeba invadens
LDEKDERTEETQEM

SEQ ID NO: 2879942 - protein, 80 aa, Entamoeba invadens
LDEKEKVTPPKETSQETQTKEEKEESEENASSESTSTSEESEKEDQKMEEEKITNGKETTQSTEASEEENEEEENDGDFA

SEQ ID NO: 2879943 - protein, 21 aa, Entamoeba invadens
LDEKHQQKLPDEVAKNYNENH

SEQ ID NO: 2879944 - protein, 11 aa, Entamoeba invadens
LDEKKEEAIER

SEQ ID NO: 2879945 - protein, 6 aa, Entamoeba invadens
LDEKKF

SEQ ID NO: 2879946 - protein, 27 aa, Entamoeba invadens
LDEKKKSELLEKERDNLEKTSKTEMDD

SEQ ID NO: 2879947 - protein, 21 aa, Entamoeba invadens
LDEKQNECDKLEDDMSKMKTE

SEQ ID NO: 2879948 - protein, 6 aa, Entamoeba invadens
LDEKQQ

SEQ ID NO: 2879949 - protein, 11 aa, Entamoeba invadens
LDEKRIESRQA

SEQ ID NO: 2879950 - protein, 6 aa, Entamoeba invadens
LDEKTA

SEQ ID NO: 2879951 - protein, 6 aa, Entamoeba invadens
LDEKTI

SEQ ID NO: 2879952 - protein, 4 aa, Entamoeba invadens
LDEL

SEQ ID NO: 2879953 - protein, 6 aa, Entamoeba invadens
LDENDE

SEQ ID NO: 2879954 - protein, 25 aa, Entamoeba invadens
LDEPANKNVKKKTTQRYEGDITGQA

SEQ ID NO: 2879955 - protein, 14 aa, Entamoeba invadens
LDEPQWKKETASKL

SEQ ID NO: 2879956 - protein, 11 aa, Entamoeba invadens
LDEPTKQIKPE

SEQ ID NO: 2879957 - protein, 4 aa, Entamoeba invadens
LDEQ

SEQ ID NO: 2879958 - protein, 6 aa, Entamoeba invadens
LDEQNE

SEQ ID NO: 2879959 - protein, 8 aa, Entamoeba invadens
LDEQNIAE

SEQ ID NO: 2879960 - protein, 5 aa, Entamoeba invadens
LDEQQ

SEQ ID NO: 2879961 - protein, 6 aa, Entamoeba invadens
LDEQTE

SEQ ID NO: 2879962 - protein, 4 aa, Entamoeba invadens
LDER

SEQ ID NO: 2879963 - protein, 4 aa, Entamoeba invadens
LDES

SEQ ID NO: 2879964 - protein, 6 aa, Entamoeba invadens
LDESNR

SEQ ID NO: 2879965 - protein, 9 aa, Entamoeba invadens
LDESNTIKQ

SEQ ID NO: 2879966 - protein, 8 aa, Entamoeba invadens
LDESPVDV

SEQ ID NO: 2879967 - protein, 19 aa, Entamoeba invadens
LDESSAKEIATEKWAPGEE

SEQ ID NO: 2879968 - protein, 7 aa, Entamoeba invadens
LDESYTD

SEQ ID NO: 2879969 - protein, 6 aa, Entamoeba invadens
LDETDL

SEQ ID NO: 2879970 - protein, 15 aa, Entamoeba invadens
LDETDNKLPKKIRNA

SEQ ID NO: 2879971 - protein, 20 aa, Entamoeba invadens
LDETEGVEGGVTVSDVKKAS

SEQ ID NO: 2879972 - protein, 11 aa, Entamoeba invadens
LDETENKEIRD

SEQ ID NO: 2879973 - protein, 45 aa, Entamoeba invadens
LDETKDEDKEKIEELRQKKKEQKVVEKAEAEKERAQKKKGGFSKY

SEQ ID NO: 2879974 - protein, 11 aa, Entamoeba invadens
LDETKEQSEEV

SEQ ID NO: 2879975 - protein, 13 aa, Entamoeba invadens
LDETPKKCKSKQV

SEQ ID NO: 2879976 - protein, 18 aa, Entamoeba invadens
LDETSGEIGGVPSPKVTN

SEQ ID NO: 2879977 - protein, 9 aa, Entamoeba invadens
LDETTSKIY

SEQ ID NO: 2879978 - protein, 6 aa, Entamoeba invadens
LDEVEK

SEQ ID NO: 2879979 - protein, 19 aa, Entamoeba invadens
LDEVNGSNAMESKKDSEIK

SEQ ID NO: 2879980 - protein, 6 aa, Entamoeba invadens
LDEYAT

SEQ ID NO: 2879981 - protein, 13 aa, Entamoeba invadens
LDEYHTKNTLEGF

SEQ ID NO: 2879982 - protein, 6 aa, Entamoeba invadens
LDFEDE

SEQ ID NO: 2879983 - protein, 5 aa, Entamoeba invadens
LDFPD

SEQ ID NO: 2879984 - protein, 8 aa, Entamoeba invadens
LDGDGITS

SEQ ID NO: 2879985 - protein, 16 aa, Entamoeba invadens
LDGDPRVTGEPKKFEY

SEQ ID NO: 2879986 - protein, 7 aa, Entamoeba invadens
LDGDQID

SEQ ID NO: 2879987 - protein, 15 aa, Entamoeba invadens
LDGERNGSLKKEINA

SEQ ID NO: 2879988 - protein, 6 aa, Entamoeba invadens
LDGESA

SEQ ID NO: 2879989 - protein, 7 aa, Entamoeba invadens
LDGETTT

SEQ ID NO: 2879990 - protein, 26 aa, Entamoeba invadens
LDGGAPKQNNNYQQPPVKTAPKDDLD

SEQ ID NO: 2879991 - protein, 12 aa, Entamoeba invadens
LDGGNSKQIEKL

SEQ ID NO: 2879992 - protein, 4 aa, Entamoeba invadens
LDGK

SEQ ID NO: 2879993 - protein, 11 aa, Entamoeba invadens
LDGKDKGSEVS

SEQ ID NO: 2879994 - protein, 6 aa, Entamoeba invadens
LDGKDL

SEQ ID NO: 2879995 - protein, 5 aa, Entamoeba invadens
LDGKE

SEQ ID NO: 2879996 - protein, 9 aa, Entamoeba invadens
LDGKKPATI

SEQ ID NO: 2879997 - protein, 11 aa, Entamoeba invadens
LDGKNGTEALA

SEQ ID NO: 2879998 - protein, 10 aa, Entamoeba invadens
LDGKNKKGDL

SEQ ID NO: 2879999 - protein, 8 aa, Entamoeba invadens
LDGKRKVG

SEQ ID NO: 2880000 - protein, 12 aa, Entamoeba invadens
LDGKSTVNTSKC

SEQ ID NO: 2880001 - protein, 5 aa, Entamoeba invadens
LDGKT

SEQ ID NO: 2880002 - protein, 6 aa, Entamoeba invadens
LDGKWG

SEQ ID NO: 2880003 - protein, 4 aa, Entamoeba invadens
LDGL

SEQ ID NO: 2880004 - protein, 8 aa, Entamoeba invadens
LDGLGGMT

SEQ ID NO: 2880005 - protein, 6 aa, Entamoeba invadens
LDGNKI

SEQ ID NO: 2880006 - protein, 7 aa, Entamoeba invadens
LDGNNVE

SEQ ID NO: 2880007 - protein, 20 aa, Entamoeba invadens
LDGNSERSNTSENSKTSKKS

SEQ ID NO: 2880008 - protein, 12 aa, Entamoeba invadens
LDGPEGKLEDQK

SEQ ID NO: 2880009 - protein, 12 aa, Entamoeba invadens
LDGPEGKLEEQK

SEQ ID NO: 2880010 - protein, 7 aa, Entamoeba invadens
LDGQAQD

SEQ ID NO: 2880011 - protein, 21 aa, Entamoeba invadens
LDGQPCADHDRSSGEGVLPQE

SEQ ID NO: 2880012 - protein, 7 aa, Entamoeba invadens
LDGSNEW

SEQ ID NO: 2880013 - protein, 25 aa, Entamoeba invadens
LDGSSETDIPEEAEKTGQTHKDNAD

SEQ ID NO: 2880014 - protein, 7 aa, Entamoeba invadens
LDGSSNG

SEQ ID NO: 2880015 - protein, 8 aa, Entamoeba invadens
LDGSTKTV

SEQ ID NO: 2880016 - protein, 4 aa, Entamoeba invadens
LDGT

SEQ ID NO: 2880017 - protein, 8 aa, Entamoeba invadens
LDGTATGD

SEQ ID NO: 2880018 - protein, 13 aa, Entamoeba invadens
LDGTCAGYDKRTN

SEQ ID NO: 2880019 - protein, 5 aa, Entamoeba invadens
LDGTD

SEQ ID NO: 2880020 - protein, 6 aa, Entamoeba invadens
LDGTDQ

SEQ ID NO: 2880021 - protein, 6 aa, Entamoeba invadens
LDGTNV

SEQ ID NO: 2880022 - protein, 8 aa, Entamoeba invadens
LDGTNVET

SEQ ID NO: 2880023 - protein, 11 aa, Entamoeba invadens
LDGTQREEERK

SEQ ID NO: 2880024 - protein, 12 aa, Entamoeba invadens
LDGTTCKANMVF

SEQ ID NO: 2880025 - protein, 5 aa, Entamoeba invadens
LDGTV

SEQ ID NO: 2880026 - protein, 4 aa, Entamoeba invadens
LDGV

SEQ ID NO: 2880027 - protein, 9 aa, Entamoeba invadens
LDGVNSTDT

SEQ ID NO: 2880028 - protein, 46 aa, Entamoeba invadens
LDHSNPPETPPEHEELEKAEPLKSPKPKTSKSPRVRKLGSKESSLE

SEQ ID NO: 2880029 - protein, 4 aa, Entamoeba invadens
LDIG

SEQ ID NO: 2880030 - protein, 16 aa, Entamoeba invadens
LDKAESVFQTEDVTRE

SEQ ID NO: 2880031 - protein, 10 aa, Entamoeba invadens
LDKARNDQYS

SEQ ID NO: 2880032 - protein, 9 aa, Entamoeba invadens
LDKASWEDV

SEQ ID NO: 2880033 - protein, 7 aa, Entamoeba invadens
LDKATNK

SEQ ID NO: 2880034 - protein, 10 aa, Entamoeba invadens
LDKDDSIEMS

SEQ ID NO: 2880035 - protein, 5 aa, Entamoeba invadens
LDKDE

SEQ ID NO: 2880036 - protein, 10 aa, Entamoeba invadens
LDKDGKEVKK

SEQ ID NO: 2880037 - protein, 16 aa, Entamoeba invadens
LDKDGTQLVSGSADRK

SEQ ID NO: 2880038 - protein, 17 aa, Entamoeba invadens
LDKDKDKQYSSEEIEEL

SEQ ID NO: 2880039 - protein, 11 aa, Entamoeba invadens
LDKEEKEEILS

SEQ ID NO: 2880040 - protein, 13 aa, Entamoeba invadens
LDKEKKPEKMGKD

SEQ ID NO: 2880041 - protein, 9 aa, Entamoeba invadens
LDKESLQTD

SEQ ID NO: 2880042 - protein, 6 aa, Entamoeba invadens
LDKFNK

SEQ ID NO: 2880043 - protein, 4 aa, Entamoeba invadens
LDKK

SEQ ID NO: 2880044 - protein, 5 aa, Entamoeba invadens
LDKKS

SEQ ID NO: 2880045 - protein, 9 aa, Entamoeba invadens
LDKKYRPSY

SEQ ID NO: 2880046 - protein, 8 aa, Entamoeba invadens
LDKNDDGV

SEQ ID NO: 2880047 - protein, 10 aa, Entamoeba invadens
LDKNDTKVQM

SEQ ID NO: 2880048 - protein, 20 aa, Entamoeba invadens
LDKNKKGGNTPLCPFDCDCC

SEQ ID NO: 2880049 - protein, 29 aa, Entamoeba invadens
LDKNKSVETSPQHPSTPEVRRESNERRIK

SEQ ID NO: 2880050 - protein, 7 aa, Entamoeba invadens
LDKNNKY

SEQ ID NO: 2880051 - protein, 9 aa, Entamoeba invadens
LDKNQNDYI

SEQ ID NO: 2880052 - protein, 8 aa, Entamoeba invadens
LDKPANMD

SEQ ID NO: 2880053 - protein, 9 aa, Entamoeba invadens
LDKPENHKK

SEQ ID NO: 2880054 - protein, 7 aa, Entamoeba invadens
LDKPITQ

SEQ ID NO: 2880055 - protein, 5 aa, Entamoeba invadens
LDKPV

SEQ ID NO: 2880056 - protein, 9 aa, Entamoeba invadens
LDKQYEEYN

SEQ ID NO: 2880057 - protein, 6 aa, Entamoeba invadens
LDKSQS

SEQ ID NO: 2880058 - protein, 9 aa, Entamoeba invadens
LDKSRPWRK

SEQ ID NO: 2880059 - protein, 13 aa, Entamoeba invadens
LDKTKQREDLAST

SEQ ID NO: 2880060 - protein, 7 aa, Entamoeba invadens
LDKTKSF

SEQ ID NO: 2880061 - protein, 6 aa, Entamoeba invadens
LDKTNR

SEQ ID NO: 2880062 - protein, 7 aa, Entamoeba invadens
LDKTTTL

SEQ ID NO: 2880063 - protein, 8 aa, Entamoeba invadens
LDKYPAPN

SEQ ID NO: 2880064 - protein, 6 aa, Entamoeba invadens
LDKYQK

SEQ ID NO: 2880065 - protein, 12 aa, Entamoeba invadens
LDKYTEKENSEF

SEQ ID NO: 2880066 - protein, 5 aa, Entamoeba invadens
LDLPP

SEQ ID NO: 2880067 - protein, 11 aa, Entamoeba invadens
LDLSGNKLKGK

SEQ ID NO: 2880068 - protein, 10 aa, Entamoeba invadens
LDNDQDVDMD

SEQ ID NO: 2880069 - protein, 12 aa, Entamoeba invadens
LDNEKEKAEIKK

SEQ ID NO: 2880070 - protein, 12 aa, Entamoeba invadens
LDNEQNDSEEHE

SEQ ID NO: 2880071 - protein, 6 aa, Entamoeba invadens
LDNERE

SEQ ID NO: 2880072 - protein, 12 aa, Entamoeba invadens
LDNGCKNEIEEV

SEQ ID NO: 2880073 - protein, 7 aa, Entamoeba invadens
LDNGNEI

SEQ ID NO: 2880074 - protein, 6 aa, Entamoeba invadens
LDNGQM

SEQ ID NO: 2880075 - protein, 13 aa, Entamoeba invadens
LDNGTLDKMYDIL

SEQ ID NO: 2880076 - protein, 22 aa, Entamoeba invadens
LDNKAEAEKTAADQSDRRKKKE

SEQ ID NO: 2880077 - protein, 34 aa, Entamoeba invadens
LDNKAEAEKTAADQSDRRWKTNAPASVAQEEEKN

SEQ ID NO: 2880078 - protein, 19 aa, Entamoeba invadens
LDNLSEEGECCAPNPTSFK

SEQ ID NO: 2880079 - protein, 6 aa, Entamoeba invadens
LDNNRK

SEQ ID NO: 2880080 - protein, 5 aa, Entamoeba invadens
LDNPR

SEQ ID NO: 2880081 - protein, 7 aa, Entamoeba invadens
LDNSEDI

SEQ ID NO: 2880082 - protein, 5 aa, Entamoeba invadens
LDNST

SEQ ID NO: 2880083 - protein, 6 aa, Entamoeba invadens
LDNVEN

SEQ ID NO: 2880084 - protein, 9 aa, Entamoeba invadens
LDPEKQRKV

SEQ ID NO: 2880085 - protein, 10 aa, Entamoeba invadens
LDPEMGTRGS

SEQ ID NO: 2880086 - protein, 17 aa, Entamoeba invadens
LDPEMKERDKTKTSKPI

SEQ ID NO: 2880087 - protein, 7 aa, Entamoeba invadens
LDPHSKL

SEQ ID NO: 2880088 - protein, 21 aa, Entamoeba invadens
LDPITSSFKNTEERTRAFSTQ

SEQ ID NO: 2880089 - protein, 16 aa, Entamoeba invadens
LDPKEQNQTSASVQNP

SEQ ID NO: 2880090 - protein, 7 aa, Entamoeba invadens
LDPKKDK

SEQ ID NO: 2880091 - protein, 9 aa, Entamoeba invadens
LDPKQRDLQ

SEQ ID NO: 2880092 - protein, 4 aa, Entamoeba invadens
LDPN

SEQ ID NO: 2880093 - protein, 7 aa, Entamoeba invadens
LDPNSAC

SEQ ID NO: 2880094 - protein, 9 aa, Entamoeba invadens
LDPNTRSQV

SEQ ID NO: 2880095 - protein, 6 aa, Entamoeba invadens
LDPRER

SEQ ID NO: 2880096 - protein, 6 aa, Entamoeba invadens
LDPRGM

SEQ ID NO: 2880097 - protein, 9 aa, Entamoeba invadens
LDPSKCSDC

SEQ ID NO: 2880098 - protein, 5 aa, Entamoeba invadens
LDPSQ

SEQ ID NO: 2880099 - protein, 6 aa, Entamoeba invadens
LDPTDW

SEQ ID NO: 2880100 - protein, 7 aa, Entamoeba invadens
LDPTDWS

SEQ ID NO: 2880101 - protein, 5 aa, Entamoeba invadens
LDPTG

SEQ ID NO: 2880102 - protein, 6 aa, Entamoeba invadens
LDPTKE

SEQ ID NO: 2880103 - protein, 7 aa, Entamoeba invadens
LDPTKTA

SEQ ID NO: 2880104 - protein, 7 aa, Entamoeba invadens
LDPTSSS

SEQ ID NO: 2880105 - protein, 5 aa, Entamoeba invadens
LDQCT

SEQ ID NO: 2880106 - protein, 16 aa, Entamoeba invadens
LDQDASNFSESTSTIS

SEQ ID NO: 2880107 - protein, 13 aa, Entamoeba invadens
LDQETNKSGASAV

SEQ ID NO: 2880108 - protein, 4 aa, Entamoeba invadens
LDQF

SEQ ID NO: 2880109 - protein, 17 aa, Entamoeba invadens
LDQIPDQPQGEEGGVPI

SEQ ID NO: 2880110 - protein, 8 aa, Entamoeba invadens
LDQKDNVQ

SEQ ID NO: 2880111 - protein, 5 aa, Entamoeba invadens
LDQKI

SEQ ID NO: 2880112 - protein, 11 aa, Entamoeba invadens
LDQKLGSGSFG

SEQ ID NO: 2880113 - protein, 15 aa, Entamoeba invadens
LDQKNDTKITDPEFT

SEQ ID NO: 2880114 - protein, 4 aa, Entamoeba invadens
LDQM

SEQ ID NO: 2880115 - protein, 9 aa, Entamoeba invadens
LDQNDTIKN

SEQ ID NO: 2880116 - protein, 13 aa, Entamoeba invadens
LDQNKQASTLQSM

SEQ ID NO: 2880117 - protein, 23 aa, Entamoeba invadens
LDQPRSVDFSTTQPVMKSESPTL

SEQ ID NO: 2880118 - protein, 4 aa, Entamoeba invadens
LDRD

SEQ ID NO: 2880119 - protein, 21 aa, Entamoeba invadens
LDRDRNRRNEVEKESVDGRMR

SEQ ID NO: 2880120 - protein, 7 aa, Entamoeba invadens
LDRGDGT

SEQ ID NO: 2880121 - protein, 4 aa, Entamoeba invadens
LDRK

SEQ ID NO: 2880122 - protein, 11 aa, Entamoeba invadens
LDRKDKKKVKK

SEQ ID NO: 2880123 - protein, 20 aa, Entamoeba invadens
LDRKTGDFAGKTIEEQSEQV

SEQ ID NO: 2880124 - protein, 4 aa, Entamoeba invadens
LDRN

SEQ ID NO: 2880125 - protein, 11 aa, Entamoeba invadens
LDRPDKQSLKS

SEQ ID NO: 2880126 - protein, 22 aa, Entamoeba invadens
LDRPTERPLERSAQIDRPPMER

SEQ ID NO: 2880127 - protein, 9 aa, Entamoeba invadens
LDRQTAKER

SEQ ID NO: 2880128 - protein, 8 aa, Entamoeba invadens
LDRSSDEF

SEQ ID NO: 2880129 - protein, 8 aa, Entamoeba invadens
LDSDGKKK

SEQ ID NO: 2880130 - protein, 13 aa, Entamoeba invadens
LDSDQSSEDVQFI

SEQ ID NO: 2880131 - protein, 18 aa, Entamoeba invadens
LDSDSYDAELKSAKAEFD

SEQ ID NO: 2880132 - protein, 13 aa, Entamoeba invadens
LDSEKQNDVDNKN

SEQ ID NO: 2880133 - protein, 10 aa, Entamoeba invadens
LDSEKRKHYE

SEQ ID NO: 2880134 - protein, 9 aa, Entamoeba invadens
LDSENNKLD

SEQ ID NO: 2880135 - protein, 14 aa, Entamoeba invadens
LDSETLDSTHSEYY

SEQ ID NO: 2880136 - protein, 19 aa, Entamoeba invadens
LDSEVGEDTINKYASEATI

SEQ ID NO: 2880137 - protein, 8 aa, Entamoeba invadens
LDSGQDVC

SEQ ID NO: 2880138 - protein, 7 aa, Entamoeba invadens
LDSGTLG

SEQ ID NO: 2880139 - protein, 10 aa, Entamoeba invadens
LDSNGDGKIT

SEQ ID NO: 2880140 - protein, 22 aa, Entamoeba invadens
LDSNGSDDKTVKDVKDQSERKT

SEQ ID NO: 2880141 - protein, 19 aa, Entamoeba invadens
LDSNSTTRKTMCGTPTSMA

SEQ ID NO: 2880142 - protein, 4 aa, Entamoeba invadens
LDSP

SEQ ID NO: 2880143 - protein, 6 aa, Entamoeba invadens
LDSPMN

SEQ ID NO: 2880144 - protein, 6 aa, Entamoeba invadens
LDSPRV

SEQ ID NO: 2880145 - protein, 5 aa, Entamoeba invadens
LDSPV

SEQ ID NO: 2880146 - protein, 7 aa, Entamoeba invadens
LDSQEVK

SEQ ID NO: 2880147 - protein, 9 aa, Entamoeba invadens
LDSQQIPHP

SEQ ID NO: 2880148 - protein, 8 aa, Entamoeba invadens
LDSQRTKI

SEQ ID NO: 2880149 - protein, 36 aa, Entamoeba invadens
LDSRKNAQKSAVLQSSRRFGTKPSALTSTSDGMNRK

SEQ ID NO: 2880150 - protein, 20 aa, Entamoeba invadens
LDSRLNGEKPETRMERRRKR

SEQ ID NO: 2880151 - protein, 5 aa, Entamoeba invadens
LDSSG

SEQ ID NO: 2880152 - protein, 26 aa, Entamoeba invadens
LDSSISESPDFDPLPPKKKSTHCCVV

SEQ ID NO: 2880153 - protein, 9 aa, Entamoeba invadens
LDSSKDANF

SEQ ID NO: 2880154 - protein, 23 aa, Entamoeba invadens
LDSSKTETAAENDTTVTTDNTET

SEQ ID NO: 2880155 - protein, 4 aa, Entamoeba invadens
LDST

SEQ ID NO: 2880156 - protein, 5 aa, Entamoeba invadens
LDSTE

SEQ ID NO: 2880157 - protein, 18 aa, Entamoeba invadens
LDSTNESLNEASQEIEEV

SEQ ID NO: 2880158 - protein, 7 aa, Entamoeba invadens
LDSTRER

SEQ ID NO: 2880159 - protein, 11 aa, Entamoeba invadens
LDSVSKHTARA

SEQ ID NO: 2880160 - protein, 11 aa, Entamoeba invadens
LDSVTAEKCNL

SEQ ID NO: 2880161 - protein, 27 aa, Entamoeba invadens
LDTANDDKDGNEAIKQKYQDKLKSVRT

SEQ ID NO: 2880162 - protein, 41 aa, Entamoeba invadens
LDTANDDKDGNKAMKQKYQDELKSVRTELDQEKKDHSKTQL

SEQ ID NO: 2880163 - protein, 21 aa, Entamoeba invadens
LDTDDGDVIEEDGNDELMADG

SEQ ID NO: 2880164 - protein, 7 aa, Entamoeba invadens
LDTDPDF

SEQ ID NO: 2880165 - protein, 4 aa, Entamoeba invadens
LDTE

SEQ ID NO: 2880166 - protein, 8 aa, Entamoeba invadens
LDTEGRDE

SEQ ID NO: 2880167 - protein, 10 aa, Entamoeba invadens
LDTEKDVGVD

SEQ ID NO: 2880168 - protein, 10 aa, Entamoeba invadens
LDTERNEDSV

SEQ ID NO: 2880169 - protein, 27 aa, Entamoeba invadens
LDTESSKQQYADPELQSPYMKPSQTFP

SEQ ID NO: 2880170 - protein, 11 aa, Entamoeba invadens
LDTETDEEKQL

SEQ ID NO: 2880171 - protein, 4 aa, Entamoeba invadens
LDTF

SEQ ID NO: 2880172 - protein, 20 aa, Entamoeba invadens
LDTGRDRSPSPPKQYDQNQQ

SEQ ID NO: 2880173 - protein, 10 aa, Entamoeba invadens
LDTKNKLTGE

SEQ ID NO: 2880174 - protein, 15 aa, Entamoeba invadens
LDTKSKEASTDEYDD

SEQ ID NO: 2880175 - protein, 6 aa, Entamoeba invadens
LDTKTY

SEQ ID NO: 2880176 - protein, 17 aa, Entamoeba invadens
LDTNASEDKIKTEEGVE

SEQ ID NO: 2880177 - protein, 10 aa, Entamoeba invadens
LDTNHDGGLD

SEQ ID NO: 2880178 - protein, 64 aa, Entamoeba invadens
LDTNKDTSKKNDELQKKVEDLQKKNTDLEEAQKKIKKENDLHKRRGSSASSTLSIKAESSEATL

SEQ ID NO: 2880179 - protein, 8 aa, Entamoeba invadens
LDTPEDAV

SEQ ID NO: 2880180 - protein, 8 aa, Entamoeba invadens
LDTPPSSL

SEQ ID NO: 2880181 - protein, 43 aa, Entamoeba invadens
LDTPPTSKTRVKDREEKEEGLLTDSDESPNRISCTSQQKEVVR

SEQ ID NO: 2880182 - protein, 11 aa, Entamoeba invadens
LDTPQEEEKEV

SEQ ID NO: 2880183 - protein, 7 aa, Entamoeba invadens
LDTQDQT

SEQ ID NO: 2880184 - protein, 41 aa, Entamoeba invadens
LDTQESPEPEVKRKQLNKRKPLHKAKKTKKIEEMKEEHNDV

SEQ ID NO: 2880185 - protein, 6 aa, Entamoeba invadens
LDTQKA

SEQ ID NO: 2880186 - protein, 5 aa, Entamoeba invadens
LDTRG

SEQ ID NO: 2880187 - protein, 9 aa, Entamoeba invadens
LDTRNDPSI

SEQ ID NO: 2880188 - protein, 7 aa, Entamoeba invadens
LDTSASH

SEQ ID NO: 2880189 - protein, 9 aa, Entamoeba invadens
LDTSKSTLN

SEQ ID NO: 2880190 - protein, 9 aa, Entamoeba invadens
LDTSSKKNL

SEQ ID NO: 2880191 - protein, 46 aa, Entamoeba invadens
LDTSVTKKNIPQPTTQQTKESDKSSKTSSKSSKKSVSRDGTPRAVK

SEQ ID NO: 2880192 - protein, 39 aa, Entamoeba invadens
LDTTKKFNEEITNKMKEKENKLNETAKQLEDTNNKFNTV

SEQ ID NO: 2880193 - protein, 8 aa, Entamoeba invadens
LDTTQQQT

SEQ ID NO: 2880194 - protein, 4 aa, Entamoeba invadens
LDTY

SEQ ID NO: 2880195 - protein, 12 aa, Entamoeba invadens
LDTYGNQRKEPE

SEQ ID NO: 2880196 - protein, 5 aa, Entamoeba invadens
LDTYS

SEQ ID NO: 2880197 - protein, 6 aa, Entamoeba invadens
LDVERN

SEQ ID NO: 2880198 - protein, 5 aa, Entamoeba invadens
LDVET

SEQ ID NO: 2880199 - protein, 10 aa, Entamoeba invadens
LDVKNKKTGE

SEQ ID NO: 2880200 - protein, 6 aa, Entamoeba invadens
LDVKQR

SEQ ID NO: 2880201 - protein, 11 aa, Entamoeba invadens
LDVNNGETGTY

SEQ ID NO: 2880202 - protein, 16 aa, Entamoeba invadens
LDVQGVSECSAKTHEG

SEQ ID NO: 2880203 - protein, 18 aa, Entamoeba invadens
LDVSSSYTPRTPRNQGSV

SEQ ID NO: 2880204 - protein, 4 aa, Entamoeba invadens
LDVT

SEQ ID NO: 2880205 - protein, 17 aa, Entamoeba invadens
LDVTASQDGQNTEIKAQ

SEQ ID NO: 2880206 - protein, 13 aa, Entamoeba invadens
LDVTSNTTGTTSI

SEQ ID NO: 2880207 - protein, 20 aa, Entamoeba invadens
LDYNNKKKTILKDSKKSIQW

SEQ ID NO: 2880208 - protein, 9 aa, Entamoeba invadens
LDYSEDNKG

SEQ ID NO: 2880209 - protein, 19 aa, Entamoeba invadens
LDYTNDDKDGNEAMKQKYQ

SEQ ID NO: 2880210 - protein, 31 aa, Entamoeba invadens
LEAAKDRLNTRNKDVSKLEESKRQANGQSKI

SEQ ID NO: 2880211 - protein, 34 aa, Entamoeba invadens
LEAERAEEKKRKEEEEKKKKEEEALAKARPKYRS

SEQ ID NO: 2880212 - protein, 41 aa, Entamoeba invadens
LEAEREKERLEAVERQKEIDRLENEEARAKLAREEKRAQID

SEQ ID NO: 2880213 - protein, 17 aa, Entamoeba invadens
LEAERQVSTEEAKKLAD

SEQ ID NO: 2880214 - protein, 12 aa, Entamoeba invadens
LEAHPKTQEYMK

SEQ ID NO: 2880215 - protein, 21 aa, Entamoeba invadens
LEAKEDNSKDLETQLHEKEDD

SEQ ID NO: 2880216 - protein, 9 aa, Entamoeba invadens
LEAKEKGVE

SEQ ID NO: 2880217 - protein, 9 aa, Entamoeba invadens
LEAKQEKGV

SEQ ID NO: 2880218 - protein, 10 aa, Entamoeba invadens
LEAKSEVFNS

SEQ ID NO: 2880219 - protein, 6 aa, Entamoeba invadens
LEAKTQ

SEQ ID NO: 2880220 - protein, 8 aa, Entamoeba invadens
LEANDAEL

SEQ ID NO: 2880221 - protein, 6 aa, Entamoeba invadens
LEAPSS

SEQ ID NO: 2880222 - protein, 4 aa, Entamoeba invadens
LEAQ

SEQ ID NO: 2880223 - protein, 5 aa, Entamoeba invadens
LEAQK

SEQ ID NO: 2880224 - protein, 5 aa, Entamoeba invadens
LEAQN

SEQ ID NO: 2880225 - protein, 15 aa, Entamoeba invadens
LEASNSSDKEKIDDL

SEQ ID NO: 2880226 - protein, 10 aa, Entamoeba invadens
LEATKEINGL

SEQ ID NO: 2880227 - protein, 21 aa, Entamoeba invadens
LEATQAALDKSDELKAKIGEE

SEQ ID NO: 2880228 - protein, 9 aa, Entamoeba invadens
LEATQTNDV

SEQ ID NO: 2880229 - protein, 6 aa, Entamoeba invadens
LECNTN

SEQ ID NO: 2880230 - protein, 9 aa, Entamoeba invadens
LEDAEREKA

SEQ ID NO: 2880231 - protein, 23 aa, Entamoeba invadens
LEDAEREKAAFNEEVEAANEKLR

SEQ ID NO: 2880232 - protein, 15 aa, Entamoeba invadens
LEDAEREKAALNEEN

SEQ ID NO: 2880233 - protein, 21 aa, Entamoeba invadens
LEDAEREKAALNEEVEAANEK

SEQ ID NO: 2880234 - protein, 13 aa, Entamoeba invadens
LEDAKKKENELNK

SEQ ID NO: 2880235 - protein, 20 aa, Entamoeba invadens
LEDAKKTKEKDKDETKQFGD

SEQ ID NO: 2880236 - protein, 12 aa, Entamoeba invadens
LEDAKNRKMQSL

SEQ ID NO: 2880237 - protein, 18 aa, Entamoeba invadens
LEDANNAIKYKPGWARGY

SEQ ID NO: 2880238 - protein, 10 aa, Entamoeba invadens
LEDDEARSNV

SEQ ID NO: 2880239 - protein, 7 aa, Entamoeba invadens
LEDDGEA

SEQ ID NO: 2880240 - protein, 8 aa, Entamoeba invadens
LEDDPNDI

SEQ ID NO: 2880241 - protein, 9 aa, Entamoeba invadens
LEDEDDLPL

SEQ ID NO: 2880242 - protein, 10 aa, Entamoeba invadens
LEDEDQRRKY

SEQ ID NO: 2880243 - protein, 6 aa, Entamoeba invadens
LEDEEK

SEQ ID NO: 2880244 - protein, 5 aa, Entamoeba invadens
LEDEG

SEQ ID NO: 2880245 - protein, 11 aa, Entamoeba invadens
LEDEGEKGNIT

SEQ ID NO: 2880246 - protein, 20 aa, Entamoeba invadens
LEDEQKKKEDIRTQQEKENK

SEQ ID NO: 2880247 - protein, 5 aa, Entamoeba invadens
LEDER

SEQ ID NO: 2880248 - protein, 4 aa, Entamoeba invadens
LEDF

SEQ ID NO: 2880249 - protein, 6 aa, Entamoeba invadens
LEDGDS

SEQ ID NO: 2880250 - protein, 8 aa, Entamoeba invadens
LEDGENMA

SEQ ID NO: 2880251 - protein, 9 aa, Entamoeba invadens
LEDGEQKGL

SEQ ID NO: 2880252 - protein, 6 aa, Entamoeba invadens
LEDGNR

SEQ ID NO: 2880253 - protein, 7 aa, Entamoeba invadens
LEDGYER

SEQ ID NO: 2880254 - protein, 22 aa, Entamoeba invadens
LEDIENQRNDLTTQKENLEQNT

SEQ ID NO: 2880255 - protein, 12 aa, Entamoeba invadens
LEDKIDKEAKDA

SEQ ID NO: 2880256 - protein, 5 aa, Entamoeba invadens
LEDKR

SEQ ID NO: 2880257 - protein, 9 aa, Entamoeba invadens
LEDMKKEKK

SEQ ID NO: 2880258 - protein, 5 aa, Entamoeba invadens
LEDNR

SEQ ID NO: 2880259 - protein, 6 aa, Entamoeba invadens
LEDNTT

SEQ ID NO: 2880260 - protein, 19 aa, Entamoeba invadens
LEDPDNEALKEAVEKAKQD

SEQ ID NO: 2880261 - protein, 7 aa, Entamoeba invadens
LEDPYDG

SEQ ID NO: 2880262 - protein, 5 aa, Entamoeba invadens
LEDQD

SEQ ID NO: 2880263 - protein, 6 aa, Entamoeba invadens
LEDQNE

SEQ ID NO: 2880264 - protein, 15 aa, Entamoeba invadens
LEDQPAEAKTKKQAK

SEQ ID NO: 2880265 - protein, 13 aa, Entamoeba invadens
LEDSEIQKSTIPT

SEQ ID NO: 2880266 - protein, 6 aa, Entamoeba invadens
LEDSGN

SEQ ID NO: 2880267 - protein, 9 aa, Entamoeba invadens
LEDSKDDKD

SEQ ID NO: 2880268 - protein, 12 aa, Entamoeba invadens
LEDSKKSDDLSK

SEQ ID NO: 2880269 - protein, 11 aa, Entamoeba invadens
LEDSKRAFSQP

SEQ ID NO: 2880270 - protein, 4 aa, Entamoeba invadens
LEDT

SEQ ID NO: 2880271 - protein, 10 aa, Entamoeba invadens
LEDTKETNLK

SEQ ID NO: 2880272 - protein, 11 aa, Entamoeba invadens
LEDTKKNLEAL

SEQ ID NO: 2880273 - protein, 6 aa, Entamoeba invadens
LEDTLN

SEQ ID NO: 2880274 - protein, 9 aa, Entamoeba invadens
LEDVTNDVK

SEQ ID NO: 2880275 - protein, 6 aa, Entamoeba invadens
LEEAKK

SEQ ID NO: 2880276 - protein, 12 aa, Entamoeba invadens
LEEAKKKESELN

SEQ ID NO: 2880277 - protein, 7 aa, Entamoeba invadens
LEEAQEI

SEQ ID NO: 2880278 - protein, 11 aa, Entamoeba invadens
LEEASKEFYNN

SEQ ID NO: 2880279 - protein, 14 aa, Entamoeba invadens
LEECSQKQSSFENT

SEQ ID NO: 2880280 - protein, 4 aa, Entamoeba invadens
LEED

SEQ ID NO: 2880281 - protein, 39 aa, Entamoeba invadens
LEEDEKREIEPKKRSVSTRVKTKPTPKDLEKSEEEPSAL

SEQ ID NO: 2880282 - protein, 14 aa, Entamoeba invadens
LEEDGNTTLKDQID

SEQ ID NO: 2880283 - protein, 6 aa, Entamoeba invadens
LEEDKS

SEQ ID NO: 2880284 - protein, 5 aa, Entamoeba invadens
LEEDT

SEQ ID NO: 2880285 - protein, 22 aa, Entamoeba invadens
LEEENHRSQEEKEVSVNEQEEK

SEQ ID NO: 2880286 - protein, 6 aa, Entamoeba invadens
LEEENI

SEQ ID NO: 2880287 - protein, 16 aa, Entamoeba invadens
LEEENPELAEQVRQNP

SEQ ID NO: 2880288 - protein, 8 aa, Entamoeba invadens
LEEEPHLN

SEQ ID NO: 2880289 - protein, 21 aa, Entamoeba invadens
LEEEQRQKEEAEKEKLRAREQ

SEQ ID NO: 2880290 - protein, 29 aa, Entamoeba invadens
LEEERKKKEVERQKRELEIQKKKDEEERM

SEQ ID NO: 2880291 - protein, 6 aa, Entamoeba invadens
LEEERL

SEQ ID NO: 2880292 - protein, 7 aa, Entamoeba invadens
LEEGENK

SEQ ID NO: 2880293 - protein, 16 aa, Entamoeba invadens
LEEGETTKKFAEELSK

SEQ ID NO: 2880294 - protein, 5 aa, Entamoeba invadens
LEEGG

SEQ ID NO: 2880295 - protein, 9 aa, Entamoeba invadens
LEEGNTGTL

SEQ ID NO: 2880296 - protein, 6 aa, Entamoeba invadens
LEEGPT

SEQ ID NO: 2880297 - protein, 11 aa, Entamoeba invadens
LEEHERQNEEQ

SEQ ID NO: 2880298 - protein, 4 aa, Entamoeba invadens
LEEK

SEQ ID NO: 2880299 - protein, 10 aa, Entamoeba invadens
LEEKDETKNL

SEQ ID NO: 2880300 - protein, 6 aa, Entamoeba invadens
LEEKDT

SEQ ID NO: 2880301 - protein, 8 aa, Entamoeba invadens
LEEKEEFD

SEQ ID NO: 2880302 - protein, 8 aa, Entamoeba invadens
LEEKEEYA

SEQ ID NO: 2880303 - protein, 9 aa, Entamoeba invadens
LEEKEEYAG

SEQ ID NO: 2880304 - protein, 10 aa, Entamoeba invadens
LEEKEKDLNS

SEQ ID NO: 2880305 - protein, 16 aa, Entamoeba invadens
LEEKEKPSDQVQRHYE

SEQ ID NO: 2880306 - protein, 10 aa, Entamoeba invadens
LEEKGEDVGD

SEQ ID NO: 2880307 - protein, 10 aa, Entamoeba invadens
LEEKKEMTKK

SEQ ID NO: 2880308 - protein, 10 aa, Entamoeba invadens
LEEKKTEKAI

SEQ ID NO: 2880309 - protein, 9 aa, Entamoeba invadens
LEEKPNDAK

SEQ ID NO: 2880310 - protein, 26 aa, Entamoeba invadens
LEEKRGEMNSDLEKKISKLKKDGHAA

SEQ ID NO: 2880311 - protein, 10 aa, Entamoeba invadens
LEELKEKDPD

SEQ ID NO: 2880312 - protein, 17 aa, Entamoeba invadens
LEELKTKGMKGGKQPNK

SEQ ID NO: 2880313 - protein, 14 aa, Entamoeba invadens
LEEMENGLQGRAST

SEQ ID NO: 2880314 - protein, 4 aa, Entamoeba invadens
LEEN

SEQ ID NO: 2880315 - protein, 10 aa, Entamoeba invadens
LEENADPQQI

SEQ ID NO: 2880316 - protein, 8 aa, Entamoeba invadens
LEENETQF

SEQ ID NO: 2880317 - protein, 13 aa, Entamoeba invadens
LEENNKEYTLTDT

SEQ ID NO: 2880318 - protein, 5 aa, Entamoeba invadens
LEENP

SEQ ID NO: 2880319 - protein, 14 aa, Entamoeba invadens
LEENSEKNRDMPVT

SEQ ID NO: 2880320 - protein, 12 aa, Entamoeba invadens
LEEPQHPETMEK

SEQ ID NO: 2880321 - protein, 10 aa, Entamoeba invadens
LEEPWKSKYP

SEQ ID NO: 2880322 - protein, 6 aa, Entamoeba invadens
LEEQDK

SEQ ID NO: 2880323 - protein, 7 aa, Entamoeba invadens
LEEQERF

SEQ ID NO: 2880324 - protein, 11 aa, Entamoeba invadens
LEEQGSTALGP

SEQ ID NO: 2880325 - protein, 26 aa, Entamoeba invadens
LEEQKQKKLVEEEEVKSKQQEEESRL

SEQ ID NO: 2880326 - protein, 14 aa, Entamoeba invadens
LEEQKRKAEGAGQG

SEQ ID NO: 2880327 - protein, 6 aa, Entamoeba invadens
LEEQLN

SEQ ID NO: 2880328 - protein, 43 aa, Entamoeba invadens
LEEQNKNSELTKTLEETQNAMREKEKRSNEEIAKKNENNEQLQ

SEQ ID NO: 2880329 - protein, 26 aa, Entamoeba invadens
LEEQQTLHEQTESERIASLKENSKQQ

SEQ ID NO: 2880330 - protein, 28 aa, Entamoeba invadens
LEEQRKKEFEEEEKKRQVEKQRIEEQNR

SEQ ID NO: 2880331 - protein, 13 aa, Entamoeba invadens
LEEQSQKASSLNS

SEQ ID NO: 2880332 - protein, 17 aa, Entamoeba invadens
LEEQSQKMKKNEKDTIL

SEQ ID NO: 2880333 - protein, 12 aa, Entamoeba invadens
LEEQSQKVSSLN

SEQ ID NO: 2880334 - protein, 14 aa, Entamoeba invadens
LEEQTYGGDATKRF

SEQ ID NO: 2880335 - protein, 4 aa, Entamoeba invadens
LEER

SEQ ID NO: 2880336 - protein, 21 aa, Entamoeba invadens
LEERKDDDIRKGISEETAERR

SEQ ID NO: 2880337 - protein, 15 aa, Entamoeba invadens
LEERPVETSNIDQTE

SEQ ID NO: 2880338 - protein, 11 aa, Entamoeba invadens
LEESIDKSHGE

SEQ ID NO: 2880339 - protein, 12 aa, Entamoeba invadens
LEESQRRESELK

SEQ ID NO: 2880340 - protein, 10 aa, Entamoeba invadens
LEESQSLSIR

SEQ ID NO: 2880341 - protein, 7 aa, Entamoeba invadens
LEETEEK

SEQ ID NO: 2880342 - protein, 11 aa, Entamoeba invadens
LEETKESYQNV

SEQ ID NO: 2880343 - protein, 6 aa, Entamoeba invadens
LEETNT

SEQ ID NO: 2880344 - protein, 14 aa, Entamoeba invadens
LEETQQQKVGCETE

SEQ ID NO: 2880345 - protein, 7 aa, Entamoeba invadens
LEETQSA

SEQ ID NO: 2880346 - protein, 7 aa, Entamoeba invadens
LEETRGD

SEQ ID NO: 2880347 - protein, 11 aa, Entamoeba invadens
LEETTNDYNNA

SEQ ID NO: 2880348 - protein, 5 aa, Entamoeba invadens
LEEVA

SEQ ID NO: 2880349 - protein, 12 aa, Entamoeba invadens
LEEVQRENETMR

SEQ ID NO: 2880350 - protein, 4 aa, Entamoeba invadens
LEEY

SEQ ID NO: 2880351 - protein, 18 aa, Entamoeba invadens
LEEYKQAVDEDRQRDKQR

SEQ ID NO: 2880352 - protein, 6 aa, Entamoeba invadens
LEFGNT

SEQ ID NO: 2880353 - protein, 4 aa, Entamoeba invadens
LEFT

SEQ ID NO: 2880354 - protein, 13 aa, Entamoeba invadens
LEFTPTKGAPSLS

SEQ ID NO: 2880355 - protein, 13 aa, Entamoeba invadens
LEFTPTKGAPSVS

SEQ ID NO: 2880356 - protein, 8 aa, Entamoeba invadens
LEGALTNE

SEQ ID NO: 2880357 - protein, 11 aa, Entamoeba invadens
LEGDNNGPLIN

SEQ ID NO: 2880358 - protein, 7 aa, Entamoeba invadens
LEGDTDI

SEQ ID NO: 2880359 - protein, 5 aa, Entamoeba invadens
LEGDY

SEQ ID NO: 2880360 - protein, 6 aa, Entamoeba invadens
LEGEDL

SEQ ID NO: 2880361 - protein, 9 aa, Entamoeba invadens
LEGEELKGY

SEQ ID NO: 2880362 - protein, 15 aa, Entamoeba invadens
LEGEKKCKPSYLSFP

SEQ ID NO: 2880363 - protein, 10 aa, Entamoeba invadens
LEGENRQNEM

SEQ ID NO: 2880364 - protein, 10 aa, Entamoeba invadens
LEGESSDYDI

SEQ ID NO: 2880365 - protein, 10 aa, Entamoeba invadens
LEGGDKTKKD

SEQ ID NO: 2880366 - protein, 11 aa, Entamoeba invadens
LEGGEPAHSDI

SEQ ID NO: 2880367 - protein, 12 aa, Entamoeba invadens
LEGIKNASKCSK

SEQ ID NO: 2880368 - protein, 4 aa, Entamoeba invadens
LEGK

SEQ ID NO: 2880369 - protein, 8 aa, Entamoeba invadens
LEGKDSKV

SEQ ID NO: 2880370 - protein, 5 aa, Entamoeba invadens
LEGKK

SEQ ID NO: 2880371 - protein, 5 aa, Entamoeba invadens
LEGKP

SEQ ID NO: 2880372 - protein, 5 aa, Entamoeba invadens
LEGKS

SEQ ID NO: 2880373 - protein, 14 aa, Entamoeba invadens
LEGKTASDVPKTEF

SEQ ID NO: 2880374 - protein, 5 aa, Entamoeba invadens
LEGKV

SEQ ID NO: 2880375 - protein, 8 aa, Entamoeba invadens
LEGNPDGV

SEQ ID NO: 2880376 - protein, 5 aa, Entamoeba invadens
LEGPE

SEQ ID NO: 2880377 - protein, 12 aa, Entamoeba invadens
LEGPEGKVEGQT

SEQ ID NO: 2880378 - protein, 10 aa, Entamoeba invadens
LEGQQHKKYA

SEQ ID NO: 2880379 - protein, 4 aa, Entamoeba invadens
LEGR

SEQ ID NO: 2880380 - protein, 11 aa, Entamoeba invadens
LEGRSGNDVKN

SEQ ID NO: 2880381 - protein, 11 aa, Entamoeba invadens
LEGSKIKKATT

SEQ ID NO: 2880382 - protein, 9 aa, Entamoeba invadens
LEGSNTEKV

SEQ ID NO: 2880383 - protein, 14 aa, Entamoeba invadens
LEHDPGDTLTSQET

SEQ ID NO: 2880384 - protein, 5 aa, Entamoeba invadens
LEHED

SEQ ID NO: 2880385 - protein, 7 aa, Entamoeba invadens
LEHNSKG

SEQ ID NO: 2880386 - protein, 4 aa, Entamoeba invadens
LEHP

SEQ ID NO: 2880387 - protein, 18 aa, Entamoeba invadens
LEHPTKNANEEKSKIKEV

SEQ ID NO: 2880388 - protein, 6 aa, Entamoeba invadens
LEHRNS

SEQ ID NO: 2880389 - protein, 9 aa, Entamoeba invadens
LEIEEDATL

SEQ ID NO: 2880390 - protein, 4 aa, Entamoeba invadens
LEIG

SEQ ID NO: 2880391 - protein, 4 aa, Entamoeba invadens
LEIP

SEQ ID NO: 2880392 - protein, 5 aa, Entamoeba invadens
LEIPP

SEQ ID NO: 2880393 - protein, 7 aa, Entamoeba invadens
LEIQKET

SEQ ID NO: 2880394 - protein, 5 aa, Entamoeba invadens
LEIRE

SEQ ID NO: 2880395 - protein, 11 aa, Entamoeba invadens
LEISDNPKSLD

SEQ ID NO: 2880396 - protein, 5 aa, Entamoeba invadens
LEISS

SEQ ID NO: 2880397 - protein, 10 aa, Entamoeba invadens
LEKAEKNRTV

SEQ ID NO: 2880398 - protein, 11 aa, Entamoeba invadens
LEKAGLKTEKL

SEQ ID NO: 2880399 - protein, 18 aa, Entamoeba invadens
LEKAKQAKLLKTKEDELT

SEQ ID NO: 2880400 - protein, 40 aa, Entamoeba invadens
LEKANAVGQVAEQQNSKPTTNPPRPSFQAPRPPKSPELVD

SEQ ID NO: 2880401 - protein, 19 aa, Entamoeba invadens
LEKANENLKQHKENNENGI

SEQ ID NO: 2880402 - protein, 10 aa, Entamoeba invadens
LEKATTPPIN

SEQ ID NO: 2880403 - protein, 16 aa, Entamoeba invadens
LEKDEEQAKCSNPNCD

SEQ ID NO: 2880404 - protein, 14 aa, Entamoeba invadens
LEKDGQGKKAKEIN

SEQ ID NO: 2880405 - protein, 46 aa, Entamoeba invadens
LEKDKEEKERKRQRDDRDSSYRKDRSDRDHHRSRSSSREHRRHSPH

SEQ ID NO: 2880406 - protein, 10 aa, Entamoeba invadens
LEKDSKDMRV

SEQ ID NO: 2880407 - protein, 11 aa, Entamoeba invadens
LEKDSLSMQDG

SEQ ID NO: 2880408 - protein, 10 aa, Entamoeba invadens
LEKEANEGTL

SEQ ID NO: 2880409 - protein, 7 aa, Entamoeba invadens
LEKEDAE

SEQ ID NO: 2880410 - protein, 7 aa, Entamoeba invadens
LEKEDGY

SEQ ID NO: 2880411 - protein, 9 aa, Entamoeba invadens
LEKEEAKEI

SEQ ID NO: 2880412 - protein, 19 aa, Entamoeba invadens
LEKEEENEKPKLIQPQYQT

SEQ ID NO: 2880413 - protein, 46 aa, Entamoeba invadens
LEKEEKKKRKPTKKALPKATLGKKGNEVMDDGDDDVPAYEDLDDDF

SEQ ID NO: 2880414 - protein, 18 aa, Entamoeba invadens
LEKEENTVNEQSAKSMHK

SEQ ID NO: 2880415 - protein, 10 aa, Entamoeba invadens
LEKEESVDAT

SEQ ID NO: 2880416 - protein, 8 aa, Entamoeba invadens
LEKEGKIP

SEQ ID NO: 2880417 - protein, 9 aa, Entamoeba invadens
LEKEGVSKR

SEQ ID NO: 2880418 - protein, 7 aa, Entamoeba invadens
LEKEKLA

SEQ ID NO: 2880419 - protein, 6 aa, Entamoeba invadens
LEKEKN

SEQ ID NO: 2880420 - protein, 31 aa, Entamoeba invadens
LEKERIEKERIEKERIEQERIAKEKAEQERL

SEQ ID NO: 2880421 - protein, 28 aa, Entamoeba invadens
LEKETFDAEVDRDRAEQTLADTTERNQR

SEQ ID NO: 2880422 - protein, 16 aa, Entamoeba invadens
LEKETSQKSEALGDES

SEQ ID NO: 2880423 - protein, 4 aa, Entamoeba invadens
LEKF

SEQ ID NO: 2880424 - protein, 4 aa, Entamoeba invadens
LEKG

SEQ ID NO: 2880425 - protein, 11 aa, Entamoeba invadens
LEKGGETQHER

SEQ ID NO: 2880426 - protein, 41 aa, Entamoeba invadens
LEKGRERRTKRDEEMKSTYGTNYGTFNTSHPQQNFEEGGYN

SEQ ID NO: 2880427 - protein, 7 aa, Entamoeba invadens
LEKGSKT

SEQ ID NO: 2880428 - protein, 9 aa, Entamoeba invadens
LEKGTDKLD

SEQ ID NO: 2880429 - protein, 15 aa, Entamoeba invadens
LEKKEKSALKSKLTP

SEQ ID NO: 2880430 - protein, 7 aa, Entamoeba invadens
LEKKEKV

SEQ ID NO: 2880431 - protein, 39 aa, Entamoeba invadens
LEKKETKESKEKRGKSDTGKNKEKHEKKVKREKDLDEDK

SEQ ID NO: 2880432 - protein, 10 aa, Entamoeba invadens
LEKKKKEYEE

SEQ ID NO: 2880433 - protein, 6 aa, Entamoeba invadens
LEKKLG

SEQ ID NO: 2880434 - protein, 19 aa, Entamoeba invadens
LEKKPRALPSLPAKVNTDK

SEQ ID NO: 2880435 - protein, 17 aa, Entamoeba invadens
LEKKQRVEVNNKRENKE

SEQ ID NO: 2880436 - protein, 7 aa, Entamoeba invadens
LEKKREP

SEQ ID NO: 2880437 - protein, 16 aa, Entamoeba invadens
LEKKTKTLTVYSVLRG

SEQ ID NO: 2880438 - protein, 13 aa, Entamoeba invadens
LEKNEKGEATRIS

SEQ ID NO: 2880439 - protein, 7 aa, Entamoeba invadens
LEKNEKY

SEQ ID NO: 2880440 - protein, 7 aa, Entamoeba invadens
LEKNGNL

SEQ ID NO: 2880441 - protein, 56 aa, Entamoeba invadens
LEKNYSKKSIDRRNRRNSISSCSSAVDEESGVKSSVDPPRSSSTELKKIATKKENS

SEQ ID NO: 2880442 - protein, 4 aa, Entamoeba invadens
LEKP

SEQ ID NO: 2880443 - protein, 6 aa, Entamoeba invadens
LEKPEI

SEQ ID NO: 2880444 - protein, 10 aa, Entamoeba invadens
LEKPGKQSIL

SEQ ID NO: 2880445 - protein, 9 aa, Entamoeba invadens
LEKPKDHKQ

SEQ ID NO: 2880446 - protein, 17 aa, Entamoeba invadens
LEKPSTMKKSPSTEVTH

SEQ ID NO: 2880447 - protein, 7 aa, Entamoeba invadens
LEKPTQQ

SEQ ID NO: 2880448 - protein, 14 aa, Entamoeba invadens
LEKPVAHQTVDNQS

SEQ ID NO: 2880449 - protein, 43 aa, Entamoeba invadens
LEKQAEQLKQVQAEAAAAAAGTTPVLPPKPAQLVKTDEKREVA

SEQ ID NO: 2880450 - protein, 15 aa, Entamoeba invadens
LEKQKRAKEEEDSDD

SEQ ID NO: 2880451 - protein, 38 aa, Entamoeba invadens
LEKQRAQEEKEKKEADKKEEKKDAAPPKEEKKETKEQQ

SEQ ID NO: 2880452 - protein, 13 aa, Entamoeba invadens
LEKRKDDGVNTEN

SEQ ID NO: 2880453 - protein, 8 aa, Entamoeba invadens
LEKRKTKY

SEQ ID NO: 2880454 - protein, 8 aa, Entamoeba invadens
LEKRRDVM

SEQ ID NO: 2880455 - protein, 4 aa, Entamoeba invadens
LEKS

SEQ ID NO: 2880456 - protein, 18 aa, Entamoeba invadens
LEKSAEFATPVDAPLDAK

SEQ ID NO: 2880457 - protein, 11 aa, Entamoeba invadens
LEKSAQYNTTK

SEQ ID NO: 2880458 - protein, 9 aa, Entamoeba invadens
LEKSDRQTA

SEQ ID NO: 2880459 - protein, 9 aa, Entamoeba invadens
LEKSEEATA

SEQ ID NO: 2880460 - protein, 10 aa, Entamoeba invadens
LEKSEKENRR

SEQ ID NO: 2880461 - protein, 9 aa, Entamoeba invadens
LEKSEKNVE

SEQ ID NO: 2880462 - protein, 8 aa, Entamoeba invadens
LEKSELPK

SEQ ID NO: 2880463 - protein, 11 aa, Entamoeba invadens
LEKSESRRDDC

SEQ ID NO: 2880464 - protein, 7 aa, Entamoeba invadens
LEKSKAK

SEQ ID NO: 2880465 - protein, 28 aa, Entamoeba invadens
LEKSKVDTQELTSLSEENIAKEQEVTTL

SEQ ID NO: 2880466 - protein, 8 aa, Entamoeba invadens
LEKSPKGW

SEQ ID NO: 2880467 - protein, 8 aa, Entamoeba invadens
LEKSSKTY

SEQ ID NO: 2880468 - protein, 7 aa, Entamoeba invadens
LEKSSNM

SEQ ID NO: 2880469 - protein, 4 aa, Entamoeba invadens
LEKT

SEQ ID NO: 2880470 - protein, 10 aa, Entamoeba invadens
LEKTGKVPEY

SEQ ID NO: 2880471 - protein, 10 aa, Entamoeba invadens
LEKTKEEKLK

SEQ ID NO: 2880472 - protein, 11 aa, Entamoeba invadens
LEKTKKSPTLE

SEQ ID NO: 2880473 - protein, 9 aa, Entamoeba invadens
LEKTQRLKT

SEQ ID NO: 2880474 - protein, 13 aa, Entamoeba invadens
LEKTRNELSTSEL

SEQ ID NO: 2880475 - protein, 7 aa, Entamoeba invadens
LEKTSGK

SEQ ID NO: 2880476 - protein, 10 aa, Entamoeba invadens
LEKTSTLEKE

SEQ ID NO: 2880477 - protein, 12 aa, Entamoeba invadens
LEKTTSEKTKEL

SEQ ID NO: 2880478 - protein, 37 aa, Entamoeba invadens
LEKVKTELSNVKRERDELKDAKRERDELKKKYEPDTF

SEQ ID NO: 2880479 - protein, 13 aa, Entamoeba invadens
LEKYGTAIPPNVK

SEQ ID NO: 2880480 - protein, 6 aa, Entamoeba invadens
LELDEE

SEQ ID NO: 2880481 - protein, 11 aa, Entamoeba invadens
LELDGNEDENI

SEQ ID NO: 2880482 - protein, 6 aa, Entamoeba invadens
LELNPD

SEQ ID NO: 2880483 - protein, 6 aa, Entamoeba invadens
LELQDD

SEQ ID NO: 2880484 - protein, 4 aa, Entamoeba invadens
LEMR

SEQ ID NO: 2880485 - protein, 8 aa, Entamoeba invadens
LENDEENL

SEQ ID NO: 2880486 - protein, 9 aa, Entamoeba invadens
LENDSAYQD

SEQ ID NO: 2880487 - protein, 8 aa, Entamoeba invadens
LENEDGTA

SEQ ID NO: 2880488 - protein, 13 aa, Entamoeba invadens
LENEELENAVGEE

SEQ ID NO: 2880489 - protein, 8 aa, Entamoeba invadens
LENEIDGN

SEQ ID NO: 2880490 - protein, 35 aa, Entamoeba invadens
LENEKIKEENEKEDLTDDSYYEDDDLDEEEERKKI

SEQ ID NO: 2880491 - protein, 7 aa, Entamoeba invadens
LENEKYP

SEQ ID NO: 2880492 - protein, 7 aa, Entamoeba invadens
LENEMGE

SEQ ID NO: 2880493 - protein, 22 aa, Entamoeba invadens
LENEQASATEEKKEHKVEPKPL

SEQ ID NO: 2880494 - protein, 16 aa, Entamoeba invadens
LENEREVTTENGEELA

SEQ ID NO: 2880495 - protein, 23 aa, Entamoeba invadens
LENEREVTTENGEELANEWDMPF

SEQ ID NO: 2880496 - protein, 7 aa, Entamoeba invadens
LENESTK

SEQ ID NO: 2880497 - protein, 10 aa, Entamoeba invadens
LENGKEGCDL

SEQ ID NO: 2880498 - protein, 18 aa, Entamoeba invadens
LENGRNESDEQSKVTELT

SEQ ID NO: 2880499 - protein, 10 aa, Entamoeba invadens
LENGSKSDNY

SEQ ID NO: 2880500 - protein, 7 aa, Entamoeba invadens
LENHKSC

SEQ ID NO: 2880501 - protein, 4 aa, Entamoeba invadens
LENI

SEQ ID NO: 2880502 - protein, 6 aa, Entamoeba invadens
LENIDG

SEQ ID NO: 2880503 - protein, 6 aa, Entamoeba invadens
LENKDK

SEQ ID NO: 2880504 - protein, 7 aa, Entamoeba invadens
LENKEEV

SEQ ID NO: 2880505 - protein, 20 aa, Entamoeba invadens
LENKGEKKASSQPTSPPLKK

SEQ ID NO: 2880506 - protein, 5 aa, Entamoeba invadens
LENKN

SEQ ID NO: 2880507 - protein, 6 aa, Entamoeba invadens
LENLRK

SEQ ID NO: 2880508 - protein, 4 aa, Entamoeba invadens
LENM

SEQ ID NO: 2880509 - protein, 7 aa, Entamoeba invadens
LENNDKV

SEQ ID NO: 2880510 - protein, 5 aa, Entamoeba invadens
LENNE

SEQ ID NO: 2880511 - protein, 9 aa, Entamoeba invadens
LENNSQTHS

SEQ ID NO: 2880512 - protein, 10 aa, Entamoeba invadens
LENNTNSEYV

SEQ ID NO: 2880513 - protein, 16 aa, Entamoeba invadens
LENNTQSKKEEKEEEN

SEQ ID NO: 2880514 - protein, 5 aa, Entamoeba invadens
LENPA

SEQ ID NO: 2880515 - protein, 4 aa, Entamoeba invadens
LENQ

SEQ ID NO: 2880516 - protein, 8 aa, Entamoeba invadens
LENQKESL

SEQ ID NO: 2880517 - protein, 8 aa, Entamoeba invadens
LENQNTQT

SEQ ID NO: 2880518 - protein, 6 aa, Entamoeba invadens
LENQQT

SEQ ID NO: 2880519 - protein, 10 aa, Entamoeba invadens
LENQSADTLR

SEQ ID NO: 2880520 - protein, 14 aa, Entamoeba invadens
LENRFDDKAKADAV

SEQ ID NO: 2880521 - protein, 11 aa, Entamoeba invadens
LENRRTELTRK

SEQ ID NO: 2880522 - protein, 5 aa, Entamoeba invadens
LENRY

SEQ ID NO: 2880523 - protein, 4 aa, Entamoeba invadens
LENS

SEQ ID NO: 2880524 - protein, 28 aa, Entamoeba invadens
LENTDTSRDTIKTFKENDKIGNNEDPKD

SEQ ID NO: 2880525 - protein, 25 aa, Entamoeba invadens
LENTLSDLKNENQKLKTSKIDLENT

SEQ ID NO: 2880526 - protein, 7 aa, Entamoeba invadens
LENTPER

SEQ ID NO: 2880527 - protein, 9 aa, Entamoeba invadens
LENTPPDEA

SEQ ID NO: 2880528 - protein, 8 aa, Entamoeba invadens
LENTPQRR

SEQ ID NO: 2880529 - protein, 5 aa, Entamoeba invadens
LENTQ

SEQ ID NO: 2880530 - protein, 9 aa, Entamoeba invadens
LENVETSKN

SEQ ID NO: 2880531 - protein, 21 aa, Entamoeba invadens
LENYGSSFSSFNDDKSPRVVS

SEQ ID NO: 2880532 - protein, 10 aa, Entamoeba invadens
LEPAYKAKNL

SEQ ID NO: 2880533 - protein, 4 aa, Entamoeba invadens
LEPD

SEQ ID NO: 2880534 - protein, 4 aa, Entamoeba invadens
LEPE

SEQ ID NO: 2880535 - protein, 7 aa, Entamoeba invadens
LEPGTLD

SEQ ID NO: 2880536 - protein, 9 aa, Entamoeba invadens
LEPGTLGSK

SEQ ID NO: 2880537 - protein, 13 aa, Entamoeba invadens
LEPKVKDKSIKRG

SEQ ID NO: 2880538 - protein, 5 aa, Entamoeba invadens
LEPND

SEQ ID NO: 2880539 - protein, 10 aa, Entamoeba invadens
LEPRTEPITP

SEQ ID NO: 2880540 - protein, 9 aa, Entamoeba invadens
LEPSQLDDE

SEQ ID NO: 2880541 - protein, 6 aa, Entamoeba invadens
LEPSRG

SEQ ID NO: 2880542 - protein, 10 aa, Entamoeba invadens
LEPSRPGGIR

SEQ ID NO: 2880543 - protein, 48 aa, Entamoeba invadens
LEPTDDKSKNSEMKSEGDNKEKRETKELKTAKSMTNSSVTKQPNQKIS

SEQ ID NO: 2880544 - protein, 17 aa, Entamoeba invadens
LEPTKKSKKHKDESDVI

SEQ ID NO: 2880545 - protein, 6 aa, Entamoeba invadens
LEPTNE

SEQ ID NO: 2880546 - protein, 6 aa, Entamoeba invadens
LEPTYE

SEQ ID NO: 2880547 - protein, 4 aa, Entamoeba invadens
LEPV

SEQ ID NO: 2880548 - protein, 16 aa, Entamoeba invadens
LEPVPTKTIEPQTTEV

SEQ ID NO: 2880549 - protein, 40 aa, Entamoeba invadens
LEQAEQKEREERDKNTQQKTAAALAPPSSLPPPNAPPPVI

SEQ ID NO: 2880550 - protein, 6 aa, Entamoeba invadens
LEQDTL

SEQ ID NO: 2880551 - protein, 8 aa, Entamoeba invadens
LEQEIKEK

SEQ ID NO: 2880552 - protein, 5 aa, Entamoeba invadens
LEQEN

SEQ ID NO: 2880553 - protein, 12 aa, Entamoeba invadens
LEQENGKEGCGL

SEQ ID NO: 2880554 - protein, 13 aa, Entamoeba invadens
LEQENGKEGNGLD

SEQ ID NO: 2880555 - protein, 13 aa, Entamoeba invadens
LEQKGEKEGYDAE

SEQ ID NO: 2880556 - protein, 14 aa, Entamoeba invadens
LEQKSDNEKDKEKA

SEQ ID NO: 2880557 - protein, 7 aa, Entamoeba invadens
LEQKTAT

SEQ ID NO: 2880558 - protein, 10 aa, Entamoeba invadens
LEQNEGEVDR

SEQ ID NO: 2880559 - protein, 11 aa, Entamoeba invadens
LEQNETNDECI

SEQ ID NO: 2880560 - protein, 16 aa, Entamoeba invadens
LEQNKDNQTQQQEKQC

SEQ ID NO: 2880561 - protein, 39 aa, Entamoeba invadens
LEQNSDEESDSEFEDTNNDYIDQNENDEKEEREDEKTIK

SEQ ID NO: 2880562 - protein, 4 aa, Entamoeba invadens
LEQP

SEQ ID NO: 2880563 - protein, 8 aa, Entamoeba invadens
LEQPPQYP

SEQ ID NO: 2880564 - protein, 24 aa, Entamoeba invadens
LEQQRQQQSYQQQQYQQPQQQQKN

SEQ ID NO: 2880565 - protein, 12 aa, Entamoeba invadens
LEQRKRERAEKG

SEQ ID NO: 2880566 - protein, 7 aa, Entamoeba invadens
LEQSKTI

SEQ ID NO: 2880567 - protein, 5 aa, Entamoeba invadens
LEQSN

SEQ ID NO: 2880568 - protein, 4 aa, Entamoeba invadens
LEQT

SEQ ID NO: 2880569 - protein, 21 aa, Entamoeba invadens
LEQTAKEINKKLDETIKMVEA

SEQ ID NO: 2880570 - protein, 7 aa, Entamoeba invadens
LEQTNER

SEQ ID NO: 2880571 - protein, 5 aa, Entamoeba invadens
LEQVK

SEQ ID NO: 2880572 - protein, 18 aa, Entamoeba invadens
LEQYSKNFKQSNEIDEQQ

SEQ ID NO: 2880573 - protein, 9 aa, Entamoeba invadens
LERDDTQKK

SEQ ID NO: 2880574 - protein, 42 aa, Entamoeba invadens
LEREEKKKKDKLSALKKKTNDLRTEAQLKEEAAEKKKLESQL

SEQ ID NO: 2880575 - protein, 94 aa, Entamoeba invadens
LERERLEQERIAQEKAEAERLEKERLEKERIEKEKAEKEEKERIEKERIAQEKAEAERLEKERLEQERLEKERLEAERVAKEKAEQEEKERLER

SEQ ID NO: 2880576 - protein, 8 aa, Entamoeba invadens
LERETSTH

SEQ ID NO: 2880577 - protein, 9 aa, Entamoeba invadens
LERGTTTSN

SEQ ID NO: 2880578 - protein, 11 aa, Entamoeba invadens
LERGVNKAEEK

SEQ ID NO: 2880579 - protein, 4 aa, Entamoeba invadens
LERK

SEQ ID NO: 2880580 - protein, 10 aa, Entamoeba invadens
LERKEAKVEV

SEQ ID NO: 2880581 - protein, 13 aa, Entamoeba invadens
LERKERADANETI

SEQ ID NO: 2880582 - protein, 4 aa, Entamoeba invadens
LERN

SEQ ID NO: 2880583 - protein, 17 aa, Entamoeba invadens
LERNEEALAAKRKVRDA

SEQ ID NO: 2880584 - protein, 10 aa, Entamoeba invadens
LERNGSEGST

SEQ ID NO: 2880585 - protein, 11 aa, Entamoeba invadens
LERNTKYKKTT

SEQ ID NO: 2880586 - protein, 4 aa, Entamoeba invadens
LERP

SEQ ID NO: 2880587 - protein, 7 aa, Entamoeba invadens
LERPPLY

SEQ ID NO: 2880588 - protein, 14 aa, Entamoeba invadens
LERQKRIEAGRPRR

SEQ ID NO: 2880589 - protein, 9 aa, Entamoeba invadens
LERREKSGI

SEQ ID NO: 2880590 - protein, 9 aa, Entamoeba invadens
LERSKGAFE

SEQ ID NO: 2880591 - protein, 9 aa, Entamoeba invadens
LERSTSDIE

SEQ ID NO: 2880592 - protein, 7 aa, Entamoeba invadens
LERTEGG

SEQ ID NO: 2880593 - protein, 9 aa, Entamoeba invadens
LERTELNNK

SEQ ID NO: 2880594 - protein, 7 aa, Entamoeba invadens
LERTESL

SEQ ID NO: 2880595 - protein, 19 aa, Entamoeba invadens
LERTPSPEFEKEAEKISVV

SEQ ID NO: 2880596 - protein, 11 aa, Entamoeba invadens
LERTSTPAPSF

SEQ ID NO: 2880597 - protein, 17 aa, Entamoeba invadens
LERTTDQQAKAQKKKYV

SEQ ID NO: 2880598 - protein, 13 aa, Entamoeba invadens
LESAREVKTESGL

SEQ ID NO: 2880599 - protein, 15 aa, Entamoeba invadens
LESASKQSKKGVESD

SEQ ID NO: 2880600 - protein, 15 aa, Entamoeba invadens
LESASQKSLVANAPR

SEQ ID NO: 2880601 - protein, 27 aa, Entamoeba invadens
LESDEEELENDDQTEKRLLDIKNGKDD

SEQ ID NO: 2880602 - protein, 25 aa, Entamoeba invadens
LESDGKEQRENDDKKTRREDDQMEE

SEQ ID NO: 2880603 - protein, 9 aa, Entamoeba invadens
LESDGSINT

SEQ ID NO: 2880604 - protein, 7 aa, Entamoeba invadens
LESDQKN

SEQ ID NO: 2880605 - protein, 9 aa, Entamoeba invadens
LESEADENV

SEQ ID NO: 2880606 - protein, 6 aa, Entamoeba invadens
LESEES

SEQ ID NO: 2880607 - protein, 9 aa, Entamoeba invadens
LESEGEKAV

SEQ ID NO: 2880608 - protein, 9 aa, Entamoeba invadens
LESEKKELR

SEQ ID NO: 2880609 - protein, 10 aa, Entamoeba invadens
LESEKTKSLE

SEQ ID NO: 2880610 - protein, 5 aa, Entamoeba invadens
LESEN

SEQ ID NO: 2880611 - protein, 7 aa, Entamoeba invadens
LESENDK

SEQ ID NO: 2880612 - protein, 8 aa, Entamoeba invadens
LESERQRL

SEQ ID NO: 2880613 - protein, 32 aa, Entamoeba invadens
LESETEYTASNKIKEDKTKGTTNQKPKESLKT

SEQ ID NO: 2880614 - protein, 5 aa, Entamoeba invadens
LESFP

SEQ ID NO: 2880615 - protein, 11 aa, Entamoeba invadens
LESGISESLSE

SEQ ID NO: 2880616 - protein, 7 aa, Entamoeba invadens
LESGKSV

SEQ ID NO: 2880617 - protein, 7 aa, Entamoeba invadens
LESGNSD

SEQ ID NO: 2880618 - protein, 7 aa, Entamoeba invadens
LESGQTT

SEQ ID NO: 2880619 - protein, 9 aa, Entamoeba invadens
LESKATKTS

SEQ ID NO: 2880620 - protein, 11 aa, Entamoeba invadens
LESKKGECEKR

SEQ ID NO: 2880621 - protein, 114 aa, Entamoeba invadens
LESKQEKPVDESTSQISDTKNEGDSSEKKSHSSSKSSDKKSDKKIDEPAKGEDEKVAPKEEEHKEEVQETKEEENKTEEKKEEESPKEEVKEPQETNEDVAKVEEPKVEEHKEE

SEQ ID NO: 2880622 - protein, 41 aa, Entamoeba invadens
LESKTGGSSSNNNSGTSNGKPSSEGFATKPSTSYSAQTKHA

SEQ ID NO: 2880623 - protein, 12 aa, Entamoeba invadens
LESKTNDDKPKM

SEQ ID NO: 2880624 - protein, 6 aa, Entamoeba invadens
LESKTS

SEQ ID NO: 2880625 - protein, 14 aa, Entamoeba invadens
LESLEKEQSTFKTT

SEQ ID NO: 2880626 - protein, 8 aa, Entamoeba invadens
LESLPKSI

SEQ ID NO: 2880627 - protein, 4 aa, Entamoeba invadens
LESN

SEQ ID NO: 2880628 - protein, 8 aa, Entamoeba invadens
LESNQSDG

SEQ ID NO: 2880629 - protein, 4 aa, Entamoeba invadens
LESP

SEQ ID NO: 2880630 - protein, 7 aa, Entamoeba invadens
LESPDKG

SEQ ID NO: 2880631 - protein, 36 aa, Entamoeba invadens
LESPEEEDIEYGKAEDQENLDDEEFEKIQDNNEMED

SEQ ID NO: 2880632 - protein, 8 aa, Entamoeba invadens
LESPLDEG

SEQ ID NO: 2880633 - protein, 13 aa, Entamoeba invadens
LESPQENETHKKE

SEQ ID NO: 2880634 - protein, 7 aa, Entamoeba invadens
LESPRKY

SEQ ID NO: 2880635 - protein, 9 aa, Entamoeba invadens
LESQSDFTP

SEQ ID NO: 2880636 - protein, 10 aa, Entamoeba invadens
LESREKELKN

SEQ ID NO: 2880637 - protein, 8 aa, Entamoeba invadens
LESRRSYE

SEQ ID NO: 2880638 - protein, 5 aa, Entamoeba invadens
LESSQ

SEQ ID NO: 2880639 - protein, 13 aa, Entamoeba invadens
LESSSKQLPPEKY

SEQ ID NO: 2880640 - protein, 8 aa, Entamoeba invadens
LESTEVQT

SEQ ID NO: 2880641 - protein, 6 aa, Entamoeba invadens
LESVTP

SEQ ID NO: 2880642 - protein, 4 aa, Entamoeba invadens
LESY

SEQ ID NO: 2880643 - protein, 14 aa, Entamoeba invadens
LESYDGEESRLNKV

SEQ ID NO: 2880644 - protein, 6 aa, Entamoeba invadens
LESYSP

SEQ ID NO: 2880645 - protein, 4 aa, Entamoeba invadens
LETA

SEQ ID NO: 2880646 - protein, 7 aa, Entamoeba invadens
LETAPNV

SEQ ID NO: 2880647 - protein, 7 aa, Entamoeba invadens
LETARKQ

SEQ ID NO: 2880648 - protein, 5 aa, Entamoeba invadens
LETDG

SEQ ID NO: 2880649 - protein, 22 aa, Entamoeba invadens
LETDNRHHPDTRAVTKQLSGRI

SEQ ID NO: 2880650 - protein, 9 aa, Entamoeba invadens
LETEDSISH

SEQ ID NO: 2880651 - protein, 33 aa, Entamoeba invadens
LETEGANEKQSDIDLKKGKGSDRKKSQKEKCYL

SEQ ID NO: 2880652 - protein, 10 aa, Entamoeba invadens
LETEGYTADK

SEQ ID NO: 2880653 - protein, 11 aa, Entamoeba invadens
LETEGYTADKK

SEQ ID NO: 2880654 - protein, 12 aa, Entamoeba invadens
LETEKETNKNIK

SEQ ID NO: 2880655 - protein, 33 aa, Entamoeba invadens
LETERKNKMAEEKRKQLAEEQRKVNEEKERQRV

SEQ ID NO: 2880656 - protein, 19 aa, Entamoeba invadens
LETFDTDNKGRRNTQGDKV

SEQ ID NO: 2880657 - protein, 10 aa, Entamoeba invadens
LETGASASIE

SEQ ID NO: 2880658 - protein, 8 aa, Entamoeba invadens
LETGKKKL

SEQ ID NO: 2880659 - protein, 14 aa, Entamoeba invadens
LETGSELTSEETVY

SEQ ID NO: 2880660 - protein, 7 aa, Entamoeba invadens
LETGYGD

SEQ ID NO: 2880661 - protein, 20 aa, Entamoeba invadens
LETIAHDNKTQKEQKSEESV

SEQ ID NO: 2880662 - protein, 14 aa, Entamoeba invadens
LETKARTFEPAPPR

SEQ ID NO: 2880663 - protein, 11 aa, Entamoeba invadens
LETKEQREKGA

SEQ ID NO: 2880664 - protein, 5 aa, Entamoeba invadens
LETKG

SEQ ID NO: 2880665 - protein, 10 aa, Entamoeba invadens
LETKPGERLP

SEQ ID NO: 2880666 - protein, 4 aa, Entamoeba invadens
LETL

SEQ ID NO: 2880667 - protein, 11 aa, Entamoeba invadens
LETMKENQTHK

SEQ ID NO: 2880668 - protein, 4 aa, Entamoeba invadens
LETN

SEQ ID NO: 2880669 - protein, 12 aa, Entamoeba invadens
LETNNKRLEEEQ

SEQ ID NO: 2880670 - protein, 12 aa, Entamoeba invadens
LETNNKSVKQIQ

SEQ ID NO: 2880671 - protein, 19 aa, Entamoeba invadens
LETNNRQPRVWEKTIDIYG

SEQ ID NO: 2880672 - protein, 21 aa, Entamoeba invadens
LETNSPSIPKPRAVPKKREGG

SEQ ID NO: 2880673 - protein, 5 aa, Entamoeba invadens
LETNT

SEQ ID NO: 2880674 - protein, 8 aa, Entamoeba invadens
LETNTSVT

SEQ ID NO: 2880675 - protein, 8 aa, Entamoeba invadens
LETPNAAY

SEQ ID NO: 2880676 - protein, 24 aa, Entamoeba invadens
LETPRSGEASKEEKKKISKARDVA

SEQ ID NO: 2880677 - protein, 5 aa, Entamoeba invadens
LETPT

SEQ ID NO: 2880678 - protein, 15 aa, Entamoeba invadens
LETQKEKPKQRGSIK

SEQ ID NO: 2880679 - protein, 5 aa, Entamoeba invadens
LETQP

SEQ ID NO: 2880680 - protein, 9 aa, Entamoeba invadens
LETQSLNEE

SEQ ID NO: 2880681 - protein, 18 aa, Entamoeba invadens
LETQSMSSEDEVDKLEKE

SEQ ID NO: 2880682 - protein, 9 aa, Entamoeba invadens
LETRDEETL

SEQ ID NO: 2880683 - protein, 55 aa, Entamoeba invadens
LETREEEKQQEKSKDQEIREKKARELVKETKKERMEEDQRRQKEALKVPKKKKAV

SEQ ID NO: 2880684 - protein, 20 aa, Entamoeba invadens
LETREQINKNVTQELEEQRK

SEQ ID NO: 2880685 - protein, 11 aa, Entamoeba invadens
LETRQKINTDV

SEQ ID NO: 2880686 - protein, 17 aa, Entamoeba invadens
LETRVNDTASRQDTTEI

SEQ ID NO: 2880687 - protein, 4 aa, Entamoeba invadens
LETS

SEQ ID NO: 2880688 - protein, 6 aa, Entamoeba invadens
LETSDK

SEQ ID NO: 2880689 - protein, 16 aa, Entamoeba invadens
LETSEERSESEDTSFF

SEQ ID NO: 2880690 - protein, 5 aa, Entamoeba invadens
LETSG

SEQ ID NO: 2880691 - protein, 6 aa, Entamoeba invadens
LETSGK

SEQ ID NO: 2880692 - protein, 5 aa, Entamoeba invadens
LETSQ

SEQ ID NO: 2880693 - protein, 7 aa, Entamoeba invadens
LETSQED

SEQ ID NO: 2880694 - protein, 6 aa, Entamoeba invadens
LETSQQ

SEQ ID NO: 2880695 - protein, 12 aa, Entamoeba invadens
LETTEEEKENVT

SEQ ID NO: 2880696 - protein, 10 aa, Entamoeba invadens
LETTPPSQRK

SEQ ID NO: 2880697 - protein, 6 aa, Entamoeba invadens
LETTQP

SEQ ID NO: 2880698 - protein, 6 aa, Entamoeba invadens
LETVKK

SEQ ID NO: 2880699 - protein, 16 aa, Entamoeba invadens
LETYSTESTPRTERKM

SEQ ID NO: 2880700 - protein, 16 aa, Entamoeba invadens
LEVDPTKVDETKCREN

SEQ ID NO: 2880701 - protein, 5 aa, Entamoeba invadens
LEVDT

SEQ ID NO: 2880702 - protein, 10 aa, Entamoeba invadens
LEVESNNTFS

SEQ ID NO: 2880703 - protein, 16 aa, Entamoeba invadens
LEVKEKERIKIEEEEK

SEQ ID NO: 2880704 - protein, 11 aa, Entamoeba invadens
LEVQNNGTAQT

SEQ ID NO: 2880705 - protein, 10 aa, Entamoeba invadens
LEVRKQTVQS

SEQ ID NO: 2880706 - protein, 4 aa, Entamoeba invadens
LEVS

SEQ ID NO: 2880707 - protein, 65 aa, Entamoeba invadens
LEVSDNDKTEVYTKAKDQFDETEAETQDDDTKSKSSVKSKTEGKSPNPFGDDEDDDRQKSPRVNV

SEQ ID NO: 2880708 - protein, 5 aa, Entamoeba invadens
LEVSE

SEQ ID NO: 2880709 - protein, 5 aa, Entamoeba invadens
LEVSG

SEQ ID NO: 2880710 - protein, 4 aa, Entamoeba invadens
LEVT

SEQ ID NO: 2880711 - protein, 12 aa, Entamoeba invadens
LEYPTHKEIDKN

SEQ ID NO: 2880712 - protein, 7 aa, Entamoeba invadens
LEYQSEQ

SEQ ID NO: 2880713 - protein, 4 aa, Entamoeba invadens
LEYS

SEQ ID NO: 2880714 - protein, 13 aa, Entamoeba invadens
LFAKSSKIQERRE

SEQ ID NO: 2880715 - protein, 7 aa, Entamoeba invadens
LFAPPTE

SEQ ID NO: 2880716 - protein, 8 aa, Entamoeba invadens
LFDGKRGY

SEQ ID NO: 2880717 - protein, 15 aa, Entamoeba invadens
LFEDDSSETDTPVVE

SEQ ID NO: 2880718 - protein, 4 aa, Entamoeba invadens
LFEP

SEQ ID NO: 2880719 - protein, 16 aa, Entamoeba invadens
LFKKEKKKERPSPPFK

SEQ ID NO: 2880720 - protein, 10 aa, Entamoeba invadens
LFNPPTKPEF

SEQ ID NO: 2880721 - protein, 4 aa, Entamoeba invadens
LFNT

SEQ ID NO: 2880722 - protein, 9 aa, Entamoeba invadens
LFNTPENRH

SEQ ID NO: 2880723 - protein, 4 aa, Entamoeba invadens
LFPN

SEQ ID NO: 2880724 - protein, 14 aa, Entamoeba invadens
LFPTPQQRQQPQQN

SEQ ID NO: 2880725 - protein, 8 aa, Entamoeba invadens
LGAGREVG

SEQ ID NO: 2880726 - protein, 14 aa, Entamoeba invadens
LGASDGVDVTGGMA

SEQ ID NO: 2880727 - protein, 15 aa, Entamoeba invadens
LGASENKDATYIPAS

SEQ ID NO: 2880728 - protein, 15 aa, Entamoeba invadens
LGDEGEEDSVSGFQT

SEQ ID NO: 2880729 - protein, 5 aa, Entamoeba invadens
LGDEI

SEQ ID NO: 2880730 - protein, 9 aa, Entamoeba invadens
LGDEKREEP

SEQ ID NO: 2880731 - protein, 5 aa, Entamoeba invadens
LGDES

SEQ ID NO: 2880732 - protein, 9 aa, Entamoeba invadens
LGDESKKYF

SEQ ID NO: 2880733 - protein, 9 aa, Entamoeba invadens
LGDKKTARD

SEQ ID NO: 2880734 - protein, 4 aa, Entamoeba invadens
LGDM

SEQ ID NO: 2880735 - protein, 8 aa, Entamoeba invadens
LGDNTTSL

SEQ ID NO: 2880736 - protein, 8 aa, Entamoeba invadens
LGDPNTPE

SEQ ID NO: 2880737 - protein, 8 aa, Entamoeba invadens
LGDPSTEK

SEQ ID NO: 2880738 - protein, 9 aa, Entamoeba invadens
LGDQAKNQP

SEQ ID NO: 2880739 - protein, 10 aa, Entamoeba invadens
LGDQKEDVHY

SEQ ID NO: 2880740 - protein, 10 aa, Entamoeba invadens
LGDQLNSDSF

SEQ ID NO: 2880741 - protein, 7 aa, Entamoeba invadens
LGDSKSL

SEQ ID NO: 2880742 - protein, 8 aa, Entamoeba invadens
LGDSNATS

SEQ ID NO: 2880743 - protein, 8 aa, Entamoeba invadens
LGDSNDRN

SEQ ID NO: 2880744 - protein, 9 aa, Entamoeba invadens
LGDTPLTTI

SEQ ID NO: 2880745 - protein, 5 aa, Entamoeba invadens
LGDYA

SEQ ID NO: 2880746 - protein, 6 aa, Entamoeba invadens
LGDYDD

SEQ ID NO: 2880747 - protein, 9 aa, Entamoeba invadens
LGEATTPVE

SEQ ID NO: 2880748 - protein, 8 aa, Entamoeba invadens
LGEDIKDG

SEQ ID NO: 2880749 - protein, 5 aa, Entamoeba invadens
LGEEN

SEQ ID NO: 2880750 - protein, 13 aa, Entamoeba invadens
LGEGAKNRDDENS

SEQ ID NO: 2880751 - protein, 7 aa, Entamoeba invadens
LGEGATG

SEQ ID NO: 2880752 - protein, 6 aa, Entamoeba invadens
LGEGSF

SEQ ID NO: 2880753 - protein, 6 aa, Entamoeba invadens
LGEGST

SEQ ID NO: 2880754 - protein, 6 aa, Entamoeba invadens
LGEIPN

SEQ ID NO: 2880755 - protein, 4 aa, Entamoeba invadens
LGEK

SEQ ID NO: 2880756 - protein, 10 aa, Entamoeba invadens
LGEKDDEDII

SEQ ID NO: 2880757 - protein, 17 aa, Entamoeba invadens
LGEKDDSGRAAPHPVPG

SEQ ID NO: 2880758 - protein, 18 aa, Entamoeba invadens
LGEKDSTGRSAPRPIPNS

SEQ ID NO: 2880759 - protein, 10 aa, Entamoeba invadens
LGEKEKAIEE

SEQ ID NO: 2880760 - protein, 5 aa, Entamoeba invadens
LGELQ

SEQ ID NO: 2880761 - protein, 5 aa, Entamoeba invadens
LGEMQ

SEQ ID NO: 2880762 - protein, 7 aa, Entamoeba invadens
LGENPIE

SEQ ID NO: 2880763 - protein, 6 aa, Entamoeba invadens
LGENVE

SEQ ID NO: 2880764 - protein, 12 aa, Entamoeba invadens
LGEQKEKKEEVY

SEQ ID NO: 2880765 - protein, 9 aa, Entamoeba invadens
LGEQNCDAN

SEQ ID NO: 2880766 - protein, 9 aa, Entamoeba invadens
LGEQQAKNG

SEQ ID NO: 2880767 - protein, 28 aa, Entamoeba invadens
LGERDNTTNLNEELDKTKREKENVKNEL

SEQ ID NO: 2880768 - protein, 6 aa, Entamoeba invadens
LGESEK

SEQ ID NO: 2880769 - protein, 10 aa, Entamoeba invadens
LGESSEATSL

SEQ ID NO: 2880770 - protein, 8 aa, Entamoeba invadens
LGETKRRS

SEQ ID NO: 2880771 - protein, 7 aa, Entamoeba invadens
LGETLED

SEQ ID NO: 2880772 - protein, 5 aa, Entamoeba invadens
LGETQ

SEQ ID NO: 2880773 - protein, 23 aa, Entamoeba invadens
LGETVTRDSCSIAPSRHQMSLEL

SEQ ID NO: 2880774 - protein, 21 aa, Entamoeba invadens
LGEVKEAKPHQSQQQPPARYL

SEQ ID NO: 2880775 - protein, 5 aa, Entamoeba invadens
LGFGE

SEQ ID NO: 2880776 - protein, 17 aa, Entamoeba invadens
LGFGNEKKIEKRIREES

SEQ ID NO: 2880777 - protein, 14 aa, Entamoeba invadens
LGFPKTTVPPNQNN

SEQ ID NO: 2880778 - protein, 4 aa, Entamoeba invadens
LGGA

SEQ ID NO: 2880779 - protein, 9 aa, Entamoeba invadens
LGGAGAQST

SEQ ID NO: 2880780 - protein, 7 aa, Entamoeba invadens
LGGAQTK

SEQ ID NO: 2880781 - protein, 30 aa, Entamoeba invadens
LGGASLSALSQNTTQPRCPSIRNSSPRTPL

SEQ ID NO: 2880782 - protein, 6 aa, Entamoeba invadens
LGGDEK

SEQ ID NO: 2880783 - protein, 5 aa, Entamoeba invadens
LGGDK

SEQ ID NO: 2880784 - protein, 10 aa, Entamoeba invadens
LGGDNSQNKL

SEQ ID NO: 2880785 - protein, 7 aa, Entamoeba invadens
LGGEEET

SEQ ID NO: 2880786 - protein, 8 aa, Entamoeba invadens
LGGENAVT

SEQ ID NO: 2880787 - protein, 5 aa, Entamoeba invadens
LGGEV

SEQ ID NO: 2880788 - protein, 6 aa, Entamoeba invadens
LGGGDF

SEQ ID NO: 2880789 - protein, 8 aa, Entamoeba invadens
LGGGSQTV

SEQ ID NO: 2880790 - protein, 11 aa, Entamoeba invadens
LGGGTGSGLGT

SEQ ID NO: 2880791 - protein, 5 aa, Entamoeba invadens
LGGKE

SEQ ID NO: 2880792 - protein, 5 aa, Entamoeba invadens
LGGKS

SEQ ID NO: 2880793 - protein, 6 aa, Entamoeba invadens
LGGKSV

SEQ ID NO: 2880794 - protein, 5 aa, Entamoeba invadens
LGGLR

SEQ ID NO: 2880795 - protein, 7 aa, Entamoeba invadens
LGGNGIP

SEQ ID NO: 2880796 - protein, 7 aa, Entamoeba invadens
LGGNGKE

SEQ ID NO: 2880797 - protein, 6 aa, Entamoeba invadens
LGGNPS

SEQ ID NO: 2880798 - protein, 5 aa, Entamoeba invadens
LGGQR

SEQ ID NO: 2880799 - protein, 7 aa, Entamoeba invadens
LGGQSKI

SEQ ID NO: 2880800 - protein, 17 aa, Entamoeba invadens
LGGRNYEYYSEDPRVAG

SEQ ID NO: 2880801 - protein, 10 aa, Entamoeba invadens
LGGRTPTKAF

SEQ ID NO: 2880802 - protein, 7 aa, Entamoeba invadens
LGGTSVS

SEQ ID NO: 2880803 - protein, 6 aa, Entamoeba invadens
LGGVGG

SEQ ID NO: 2880804 - protein, 9 aa, Entamoeba invadens
LGHNEKNQK

SEQ ID NO: 2880805 - protein, 21 aa, Entamoeba invadens
LGIDQSDNNRGNASEAKTEKE

SEQ ID NO: 2880806 - protein, 9 aa, Entamoeba invadens
LGIEEDATL

SEQ ID NO: 2880807 - protein, 8 aa, Entamoeba invadens
LGIEEEKS

SEQ ID NO: 2880808 - protein, 4 aa, Entamoeba invadens
LGIN

SEQ ID NO: 2880809 - protein, 11 aa, Entamoeba invadens
LGISTRGSQPN

SEQ ID NO: 2880810 - protein, 7 aa, Entamoeba invadens
LGITSGS

SEQ ID NO: 2880811 - protein, 4 aa, Entamoeba invadens
LGKA

SEQ ID NO: 2880812 - protein, 4 aa, Entamoeba invadens
LGKD

SEQ ID NO: 2880813 - protein, 21 aa, Entamoeba invadens
LGKDAQKDKQKHTTQSEGYDK

SEQ ID NO: 2880814 - protein, 8 aa, Entamoeba invadens
LGKKERER

SEQ ID NO: 2880815 - protein, 5 aa, Entamoeba invadens
LGKKN

SEQ ID NO: 2880816 - protein, 4 aa, Entamoeba invadens
LGKN

SEQ ID NO: 2880817 - protein, 6 aa, Entamoeba invadens
LGKNEH

SEQ ID NO: 2880818 - protein, 41 aa, Entamoeba invadens
LGKNEKEVGAKSAEELYETNKKKIEENRDIKKDDDEEIDGL

SEQ ID NO: 2880819 - protein, 5 aa, Entamoeba invadens
LGKNM

SEQ ID NO: 2880820 - protein, 13 aa, Entamoeba invadens
LGKNPDETPLSSS

SEQ ID NO: 2880821 - protein, 9 aa, Entamoeba invadens
LGKPKEAFE

SEQ ID NO: 2880822 - protein, 10 aa, Entamoeba invadens
LGKQVAADEE

SEQ ID NO: 2880823 - protein, 11 aa, Entamoeba invadens
LGKQVASDEEM

SEQ ID NO: 2880824 - protein, 9 aa, Entamoeba invadens
LGKSPQDFG

SEQ ID NO: 2880825 - protein, 11 aa, Entamoeba invadens
LGKSPSVEIGT

SEQ ID NO: 2880826 - protein, 9 aa, Entamoeba invadens
LGKSSPIDD

SEQ ID NO: 2880827 - protein, 11 aa, Entamoeba invadens
LGKSTMARDEE

SEQ ID NO: 2880828 - protein, 8 aa, Entamoeba invadens
LGKTDENV

SEQ ID NO: 2880829 - protein, 6 aa, Entamoeba invadens
LGKTEL

SEQ ID NO: 2880830 - protein, 9 aa, Entamoeba invadens
LGKTKEFGE

SEQ ID NO: 2880831 - protein, 18 aa, Entamoeba invadens
LGKVGQSQITPTFTPEQY

SEQ ID NO: 2880832 - protein, 7 aa, Entamoeba invadens
LGKYGGS

SEQ ID NO: 2880833 - protein, 5 aa, Entamoeba invadens
LGLDP

SEQ ID NO: 2880834 - protein, 8 aa, Entamoeba invadens
LGLPDEKN

SEQ ID NO: 2880835 - protein, 8 aa, Entamoeba invadens
LGMGNQTT

SEQ ID NO: 2880836 - protein, 4 aa, Entamoeba invadens
LGMP

SEQ ID NO: 2880837 - protein, 11 aa, Entamoeba invadens
LGNEADSKRGV

SEQ ID NO: 2880838 - protein, 5 aa, Entamoeba invadens
LGNEC

SEQ ID NO: 2880839 - protein, 15 aa, Entamoeba invadens
LGNGEKCTLPVGFLE

SEQ ID NO: 2880840 - protein, 14 aa, Entamoeba invadens
LGNGLDNTNPSAMK

SEQ ID NO: 2880841 - protein, 4 aa, Entamoeba invadens
LGNK

SEQ ID NO: 2880842 - protein, 5 aa, Entamoeba invadens
LGNNA

SEQ ID NO: 2880843 - protein, 11 aa, Entamoeba invadens
LGNNLADGQLS

SEQ ID NO: 2880844 - protein, 26 aa, Entamoeba invadens
LGNPASSTTTASTNTTTTGTTTLGTT

SEQ ID NO: 2880845 - protein, 5 aa, Entamoeba invadens
LGNPR

SEQ ID NO: 2880846 - protein, 9 aa, Entamoeba invadens
LGNRSGQGL

SEQ ID NO: 2880847 - protein, 6 aa, Entamoeba invadens
LGNSDG

SEQ ID NO: 2880848 - protein, 14 aa, Entamoeba invadens
LGNSTSSQNKQNKC

SEQ ID NO: 2880849 - protein, 5 aa, Entamoeba invadens
LGNTN

SEQ ID NO: 2880850 - protein, 7 aa, Entamoeba invadens
LGNTNPR

SEQ ID NO: 2880851 - protein, 6 aa, Entamoeba invadens
LGNTTT

SEQ ID NO: 2880852 - protein, 12 aa, Entamoeba invadens
LGNVASGKTFED

SEQ ID NO: 2880853 - protein, 6 aa, Entamoeba invadens
LGNVNG

SEQ ID NO: 2880854 - protein, 11 aa, Entamoeba invadens
LGNVSKNDGDL

SEQ ID NO: 2880855 - protein, 11 aa, Entamoeba invadens
LGNYAKKCNAY

SEQ ID NO: 2880856 - protein, 6 aa, Entamoeba invadens
LGPDMD

SEQ ID NO: 2880857 - protein, 9 aa, Entamoeba invadens
LGPEEKNKY

SEQ ID NO: 2880858 - protein, 4 aa, Entamoeba invadens
LGPF

SEQ ID NO: 2880859 - protein, 7 aa, Entamoeba invadens
LGPHETE

SEQ ID NO: 2880860 - protein, 10 aa, Entamoeba invadens
LGPMRNEDEK

SEQ ID NO: 2880861 - protein, 12 aa, Entamoeba invadens
LGPRDDAKEFSV

SEQ ID NO: 2880862 - protein, 18 aa, Entamoeba invadens
LGPRHVQTTGGGTTSAGL

SEQ ID NO: 2880863 - protein, 4 aa, Entamoeba invadens
LGPS

SEQ ID NO: 2880864 - protein, 8 aa, Entamoeba invadens
LGPSVTDK

SEQ ID NO: 2880865 - protein, 5 aa, Entamoeba invadens
LGPTL

SEQ ID NO: 2880866 - protein, 7 aa, Entamoeba invadens
LGQAAQA

SEQ ID NO: 2880867 - protein, 6 aa, Entamoeba invadens
LGQGAF

SEQ ID NO: 2880868 - protein, 6 aa, Entamoeba invadens
LGQGGF

SEQ ID NO: 2880869 - protein, 7 aa, Entamoeba invadens
LGQGTFG

SEQ ID NO: 2880870 - protein, 4 aa, Entamoeba invadens
LGQI

SEQ ID NO: 2880871 - protein, 11 aa, Entamoeba invadens
LGQKDKQITES

SEQ ID NO: 2880872 - protein, 13 aa, Entamoeba invadens
LGQKRMTNYTSDL

SEQ ID NO: 2880873 - protein, 7 aa, Entamoeba invadens
LGQNTET

SEQ ID NO: 2880874 - protein, 14 aa, Entamoeba invadens
LGQPSKKSVLTKPS

SEQ ID NO: 2880875 - protein, 7 aa, Entamoeba invadens
LGQPTTN

SEQ ID NO: 2880876 - protein, 6 aa, Entamoeba invadens
LGQSPN

SEQ ID NO: 2880877 - protein, 8 aa, Entamoeba invadens
LGQTAENK

SEQ ID NO: 2880878 - protein, 8 aa, Entamoeba invadens
LGRESKLS

SEQ ID NO: 2880879 - protein, 7 aa, Entamoeba invadens
LGRGATA

SEQ ID NO: 2880880 - protein, 13 aa, Entamoeba invadens
LGRGRKKSTSFNG

SEQ ID NO: 2880881 - protein, 5 aa, Entamoeba invadens
LGRGT

SEQ ID NO: 2880882 - protein, 8 aa, Entamoeba invadens
LGRKPWDN

SEQ ID NO: 2880883 - protein, 9 aa, Entamoeba invadens
LGRNKPKNI

SEQ ID NO: 2880884 - protein, 12 aa, Entamoeba invadens
LGRQGNPKVTEN

SEQ ID NO: 2880885 - protein, 6 aa, Entamoeba invadens
LGRSGT

SEQ ID NO: 2880886 - protein, 27 aa, Entamoeba invadens
LGRSKSPVGSPRLSDTVQRKIEEKEGS

SEQ ID NO: 2880887 - protein, 7 aa, Entamoeba invadens
LGSDKEG

SEQ ID NO: 2880888 - protein, 11 aa, Entamoeba invadens
LGSEAKDNASW

SEQ ID NO: 2880889 - protein, 17 aa, Entamoeba invadens
LGSEARKAHSSKKQIGQ

SEQ ID NO: 2880890 - protein, 17 aa, Entamoeba invadens
LGSEARKTHSSKKQIGQ

SEQ ID NO: 2880891 - protein, 6 aa, Entamoeba invadens
LGSEDT

SEQ ID NO: 2880892 - protein, 5 aa, Entamoeba invadens
LGSEG

SEQ ID NO: 2880893 - protein, 11 aa, Entamoeba invadens
LGSEGDKTVQT

SEQ ID NO: 2880894 - protein, 13 aa, Entamoeba invadens
LGSEKPPKKEGGC

SEQ ID NO: 2880895 - protein, 16 aa, Entamoeba invadens
LGSFGTKRKTPEGSPL

SEQ ID NO: 2880896 - protein, 10 aa, Entamoeba invadens
LGSGEDQAIK

SEQ ID NO: 2880897 - protein, 8 aa, Entamoeba invadens
LGSGESSR

SEQ ID NO: 2880898 - protein, 6 aa, Entamoeba invadens
LGSGGF

SEQ ID NO: 2880899 - protein, 8 aa, Entamoeba invadens
LGSGGSNI

SEQ ID NO: 2880900 - protein, 8 aa, Entamoeba invadens
LGSGNYGK

SEQ ID NO: 2880901 - protein, 6 aa, Entamoeba invadens
LGSKGI

SEQ ID NO: 2880902 - protein, 7 aa, Entamoeba invadens
LGSNEIS

SEQ ID NO: 2880903 - protein, 8 aa, Entamoeba invadens
LGSNNFEE

SEQ ID NO: 2880904 - protein, 18 aa, Entamoeba invadens
LGSNTSSFKVDSIAVFEM

SEQ ID NO: 2880905 - protein, 4 aa, Entamoeba invadens
LGSP

SEQ ID NO: 2880906 - protein, 4 aa, Entamoeba invadens
LGSS

SEQ ID NO: 2880907 - protein, 17 aa, Entamoeba invadens
LGSSAKTKDTPQLPKSV

SEQ ID NO: 2880908 - protein, 14 aa, Entamoeba invadens
LGSSGGKKVSRASF

SEQ ID NO: 2880909 - protein, 8 aa, Entamoeba invadens
LGSSTQFA

SEQ ID NO: 2880910 - protein, 5 aa, Entamoeba invadens
LGSTD

SEQ ID NO: 2880911 - protein, 9 aa, Entamoeba invadens
LGSTFSSAE

SEQ ID NO: 2880912 - protein, 28 aa, Entamoeba invadens
LGSTKPTKKLSASSSGIKMESKKKVSLA

SEQ ID NO: 2880913 - protein, 10 aa, Entamoeba invadens
LGSTTKDEYV

SEQ ID NO: 2880914 - protein, 8 aa, Entamoeba invadens
LGSTVGEN

SEQ ID NO: 2880915 - protein, 10 aa, Entamoeba invadens
LGTAANATGV

SEQ ID NO: 2880916 - protein, 17 aa, Entamoeba invadens
LGTENEKKLIEKQQNEV

SEQ ID NO: 2880917 - protein, 12 aa, Entamoeba invadens
LGTESGAGQIST

SEQ ID NO: 2880918 - protein, 6 aa, Entamoeba invadens
LGTETQ

SEQ ID NO: 2880919 - protein, 8 aa, Entamoeba invadens
LGTGNDLA

SEQ ID NO: 2880920 - protein, 8 aa, Entamoeba invadens
LGTGNNNK

SEQ ID NO: 2880921 - protein, 11 aa, Entamoeba invadens
LGTIPNPQKHR

SEQ ID NO: 2880922 - protein, 8 aa, Entamoeba invadens
LGTKGEEV

SEQ ID NO: 2880923 - protein, 6 aa, Entamoeba invadens
LGTKKA

SEQ ID NO: 2880924 - protein, 6 aa, Entamoeba invadens
LGTKSA

SEQ ID NO: 2880925 - protein, 12 aa, Entamoeba invadens
LGTKVDADNPDH

SEQ ID NO: 2880926 - protein, 6 aa, Entamoeba invadens
LGTNCQ

SEQ ID NO: 2880927 - protein, 16 aa, Entamoeba invadens
LGTPEKTATRRGENTR

SEQ ID NO: 2880928 - protein, 11 aa, Entamoeba invadens
LGTPGPSQAID

SEQ ID NO: 2880929 - protein, 7 aa, Entamoeba invadens
LGTPLDT

SEQ ID NO: 2880930 - protein, 21 aa, Entamoeba invadens
LGTPQYQPPIYDQNQSHIPQQ

SEQ ID NO: 2880931 - protein, 8 aa, Entamoeba invadens
LGTPSNGR

SEQ ID NO: 2880932 - protein, 12 aa, Entamoeba invadens
LGTPTEESWPGI

SEQ ID NO: 2880933 - protein, 10 aa, Entamoeba invadens
LGTQPNKPEL

SEQ ID NO: 2880934 - protein, 8 aa, Entamoeba invadens
LGTRESQA

SEQ ID NO: 2880935 - protein, 5 aa, Entamoeba invadens
LGTSA

SEQ ID NO: 2880936 - protein, 6 aa, Entamoeba invadens
LGTSES

SEQ ID NO: 2880937 - protein, 8 aa, Entamoeba invadens
LGTSQSDV

SEQ ID NO: 2880938 - protein, 14 aa, Entamoeba invadens
LGTSTTPATTTQPF

SEQ ID NO: 2880939 - protein, 13 aa, Entamoeba invadens
LGTTNLGENNKNR

SEQ ID NO: 2880940 - protein, 7 aa, Entamoeba invadens
LGTTNPE

SEQ ID NO: 2880941 - protein, 8 aa, Entamoeba invadens
LGTTPTMN

SEQ ID NO: 2880942 - protein, 4 aa, Entamoeba invadens
LGVD

SEQ ID NO: 2880943 - protein, 5 aa, Entamoeba invadens
LGVES

SEQ ID NO: 2880944 - protein, 12 aa, Entamoeba invadens
LGVPDEDLPPLE

SEQ ID NO: 2880945 - protein, 4 aa, Entamoeba invadens
LGYG

SEQ ID NO: 2880946 - protein, 8 aa, Entamoeba invadens
LGYHSDDG

SEQ ID NO: 2880947 - protein, 4 aa, Entamoeba invadens
LGYT

SEQ ID NO: 2880948 - protein, 5 aa, Entamoeba invadens
LGYYP

SEQ ID NO: 2880949 - protein, 30 aa, Entamoeba invadens
LHDESNEKDPNKERLENSTKQKRTLLDGGS

SEQ ID NO: 2880950 - protein, 5 aa, Entamoeba invadens
LHDGT

SEQ ID NO: 2880951 - protein, 16 aa, Entamoeba invadens
LHEEEKKLYESRNRPD

SEQ ID NO: 2880952 - protein, 46 aa, Entamoeba invadens
LHEEESKDIRMNEEADDEEEKMEEIEEEENDSSSEESVDDGSFPHT

SEQ ID NO: 2880953 - protein, 5 aa, Entamoeba invadens
LHEKD

SEQ ID NO: 2880954 - protein, 6 aa, Entamoeba invadens
LHKEGT

SEQ ID NO: 2880955 - protein, 12 aa, Entamoeba invadens
LHKEKSAGSYDK

SEQ ID NO: 2880956 - protein, 11 aa, Entamoeba invadens
LHNETNDVEDK

SEQ ID NO: 2880957 - protein, 8 aa, Entamoeba invadens
LHNQSAVS

SEQ ID NO: 2880958 - protein, 13 aa, Entamoeba invadens
LHPPNSPLSLESK

SEQ ID NO: 2880959 - protein, 6 aa, Entamoeba invadens
LHPSEI

SEQ ID NO: 2880960 - protein, 30 aa, Entamoeba invadens
LHPSPPSPHPQEETTTPNNSPVDKSEQIQN

SEQ ID NO: 2880961 - protein, 7 aa, Entamoeba invadens
LHPTASM

SEQ ID NO: 2880962 - protein, 25 aa, Entamoeba invadens
LHQETPPSQLEDVPPPTPTLPQRPK

SEQ ID NO: 2880963 - protein, 5 aa, Entamoeba invadens
LHQHP

SEQ ID NO: 2880964 - protein, 22 aa, Entamoeba invadens
LHQNKQQSVMQNTTQSSSLTSK

SEQ ID NO: 2880965 - protein, 8 aa, Entamoeba invadens
LHQQAGSK

SEQ ID NO: 2880966 - protein, 8 aa, Entamoeba invadens
LHRDNTKL

SEQ ID NO: 2880967 - protein, 22 aa, Entamoeba invadens
LHSDYKKKKTQKNTRKSRKSLT

SEQ ID NO: 2880968 - protein, 13 aa, Entamoeba invadens
LHSGREDIEKDSR

SEQ ID NO: 2880969 - protein, 21 aa, Entamoeba invadens
LHSGREDIEKDSRFNGNGSIV

SEQ ID NO: 2880970 - protein, 8 aa, Entamoeba invadens
LHSNPVKA

SEQ ID NO: 2880971 - protein, 9 aa, Entamoeba invadens
LHSPSSTLT

SEQ ID NO: 2880972 - protein, 53 aa, Entamoeba invadens
LHTNTENDGTQNEEKKEEKTTEQLENAQGIQNITEKKSFETSNVNVEQTNEEH

SEQ ID NO: 2880973 - protein, 7 aa, Entamoeba invadens
LHTPGAK

SEQ ID NO: 2880974 - protein, 7 aa, Entamoeba invadens
LHTTSKN

SEQ ID NO: 2880975 - protein, 8 aa, Entamoeba invadens
LIAPASDE

SEQ ID NO: 2880976 - protein, 5 aa, Entamoeba invadens
LIDPS

SEQ ID NO: 2880977 - protein, 11 aa, Entamoeba invadens
LIEGKDNTPQV

SEQ ID NO: 2880978 - protein, 9 aa, Entamoeba invadens
LIEKEKNHG

SEQ ID NO: 2880979 - protein, 25 aa, Entamoeba invadens
LIEPQKESLKPKSKIGKKEDNGIEK

SEQ ID NO: 2880980 - protein, 8 aa, Entamoeba invadens
LIESNEKI

SEQ ID NO: 2880981 - protein, 11 aa, Entamoeba invadens
LIGDAAKNQIA

SEQ ID NO: 2880982 - protein, 7 aa, Entamoeba invadens
LIGENGQ

SEQ ID NO: 2880983 - protein, 13 aa, Entamoeba invadens
LIGGESGKTFNMN

SEQ ID NO: 2880984 - protein, 6 aa, Entamoeba invadens
LIGNET

SEQ ID NO: 2880985 - protein, 11 aa, Entamoeba invadens
LIKDSTGKNTV

SEQ ID NO: 2880986 - protein, 15 aa, Entamoeba invadens
LIKSNKNTHKNNIKL

SEQ ID NO: 2880987 - protein, 7 aa, Entamoeba invadens
LIKTNQN

SEQ ID NO: 2880988 - protein, 11 aa, Entamoeba invadens
LINSPTTSRDS

SEQ ID NO: 2880989 - protein, 17 aa, Entamoeba invadens
LIPPTQNNNTTRRTQRL

SEQ ID NO: 2880990 - protein, 4 aa, Entamoeba invadens
LIPT

SEQ ID NO: 2880991 - protein, 12 aa, Entamoeba invadens
LIRGDSNGATET

SEQ ID NO: 2880992 - protein, 19 aa, Entamoeba invadens
LISPEEVADYQRRGELIGE

SEQ ID NO: 2880993 - protein, 6 aa, Entamoeba invadens
LISTSN

SEQ ID NO: 2880994 - protein, 11 aa, Entamoeba invadens
LITPPNENFQT

SEQ ID NO: 2880995 - protein, 6 aa, Entamoeba invadens
LITPTT

SEQ ID NO: 2880996 - protein, 11 aa, Entamoeba invadens
LITSTTKYDVS

SEQ ID NO: 2880997 - protein, 9 aa, Entamoeba invadens
LKAAKDQNE

SEQ ID NO: 2880998 - protein, 11 aa, Entamoeba invadens
LKAAQKNPNLV

SEQ ID NO: 2880999 - protein, 9 aa, Entamoeba invadens
LKADGSNTK

SEQ ID NO: 2881000 - protein, 7 aa, Entamoeba invadens
LKADPKN

SEQ ID NO: 2881001 - protein, 12 aa, Entamoeba invadens
LKAEEYKEPFTP

SEQ ID NO: 2881002 - protein, 10 aa, Entamoeba invadens
LKAEKRKMGI

SEQ ID NO: 2881003 - protein, 10 aa, Entamoeba invadens
LKAEKSPDDI

SEQ ID NO: 2881004 - protein, 8 aa, Entamoeba invadens
LKAGETAI

SEQ ID NO: 2881005 - protein, 4 aa, Entamoeba invadens
LKAK

SEQ ID NO: 2881006 - protein, 22 aa, Entamoeba invadens
LKAKGKTPPPLLKKEKSGKCVF

SEQ ID NO: 2881007 - protein, 9 aa, Entamoeba invadens
LKANEPDIT

SEQ ID NO: 2881008 - protein, 7 aa, Entamoeba invadens
LKAPEAN

SEQ ID NO: 2881009 - protein, 7 aa, Entamoeba invadens
LKAPRTF

SEQ ID NO: 2881010 - protein, 12 aa, Entamoeba invadens
LKAQADSSSVEL

SEQ ID NO: 2881011 - protein, 80 aa, Entamoeba invadens
LKAQNKETEKQKQSEQQQTPQQPQQSGNTSGAQTNSTNTQQQNVTNPMSQTNTVTQKPQLQTTQQNQTIQQPQQNPNPLG

SEQ ID NO: 2881012 - protein, 7 aa, Entamoeba invadens
LKASDVM

SEQ ID NO: 2881013 - protein, 10 aa, Entamoeba invadens
LKASPKDEYM

SEQ ID NO: 2881014 - protein, 7 aa, Entamoeba invadens
LKASTSL

SEQ ID NO: 2881015 - protein, 6 aa, Entamoeba invadens
LKATSK

SEQ ID NO: 2881016 - protein, 17 aa, Entamoeba invadens
LKATTDPAMKQKLQNSL

SEQ ID NO: 2881017 - protein, 13 aa, Entamoeba invadens
LKAYEGKNHAPEI

SEQ ID NO: 2881018 - protein, 9 aa, Entamoeba invadens
LKAYGPDDR

SEQ ID NO: 2881019 - protein, 10 aa, Entamoeba invadens
LKDADKKIKG

SEQ ID NO: 2881020 - protein, 11 aa, Entamoeba invadens
LKDAEREKAAL

SEQ ID NO: 2881021 - protein, 23 aa, Entamoeba invadens
LKDAEREKAALNEEVEAANEKLR

SEQ ID NO: 2881022 - protein, 18 aa, Entamoeba invadens
LKDAEREKAALNEEVEAV

SEQ ID NO: 2881023 - protein, 9 aa, Entamoeba invadens
LKDAEREKV

SEQ ID NO: 2881024 - protein, 7 aa, Entamoeba invadens
LKDDGMN

SEQ ID NO: 2881025 - protein, 8 aa, Entamoeba invadens
LKDDGVPT

SEQ ID NO: 2881026 - protein, 9 aa, Entamoeba invadens
LKDDNSDVR

SEQ ID NO: 2881027 - protein, 9 aa, Entamoeba invadens
LKDDPTRPS

SEQ ID NO: 2881028 - protein, 18 aa, Entamoeba invadens
LKDDTEKTEKDLAGARKR

SEQ ID NO: 2881029 - protein, 4 aa, Entamoeba invadens
LKDE

SEQ ID NO: 2881030 - protein, 8 aa, Entamoeba invadens
LKDEEKKE

SEQ ID NO: 2881031 - protein, 8 aa, Entamoeba invadens
LKDEKEDL

SEQ ID NO: 2881032 - protein, 12 aa, Entamoeba invadens
LKDEKQKLHLMI

SEQ ID NO: 2881033 - protein, 9 aa, Entamoeba invadens
LKDENDDTW

SEQ ID NO: 2881034 - protein, 7 aa, Entamoeba invadens
LKDENTQ

SEQ ID NO: 2881035 - protein, 8 aa, Entamoeba invadens
LKDGDEIQ

SEQ ID NO: 2881036 - protein, 13 aa, Entamoeba invadens
LKDGGLGKHLLPE

SEQ ID NO: 2881037 - protein, 15 aa, Entamoeba invadens
LKDGNDLQSLAGPQM

SEQ ID NO: 2881038 - protein, 6 aa, Entamoeba invadens
LKDIPN

SEQ ID NO: 2881039 - protein, 18 aa, Entamoeba invadens
LKDKDDLKRFDEKENEYV

SEQ ID NO: 2881040 - protein, 8 aa, Entamoeba invadens
LKDKESTK

SEQ ID NO: 2881041 - protein, 16 aa, Entamoeba invadens
LKDKIGVNDEFKEPKE

SEQ ID NO: 2881042 - protein, 6 aa, Entamoeba invadens
LKDKSD

SEQ ID NO: 2881043 - protein, 14 aa, Entamoeba invadens
LKDNDDQSSKNETI

SEQ ID NO: 2881044 - protein, 12 aa, Entamoeba invadens
LKDNKELKQCNK

SEQ ID NO: 2881045 - protein, 7 aa, Entamoeba invadens
LKDNPSW

SEQ ID NO: 2881046 - protein, 5 aa, Entamoeba invadens
LKDPD

SEQ ID NO: 2881047 - protein, 13 aa, Entamoeba invadens
LKDPEASQNDKTV

SEQ ID NO: 2881048 - protein, 14 aa, Entamoeba invadens
LKDPHNDTSTLSPF

SEQ ID NO: 2881049 - protein, 6 aa, Entamoeba invadens
LKDPNI

SEQ ID NO: 2881050 - protein, 4 aa, Entamoeba invadens
LKDQ

SEQ ID NO: 2881051 - protein, 9 aa, Entamoeba invadens
LKDQDPYVR

SEQ ID NO: 2881052 - protein, 15 aa, Entamoeba invadens
LKDQKNARESSDPSF

SEQ ID NO: 2881053 - protein, 13 aa, Entamoeba invadens
LKDQNTQLDAAFK

SEQ ID NO: 2881054 - protein, 33 aa, Entamoeba invadens
LKDQNTQLDAAKKNMKSDGFGRQSGGREDCRGP

SEQ ID NO: 2881055 - protein, 28 aa, Entamoeba invadens
LKDQNTQLDAAKKNMKSGLSKTQTLNAQ

SEQ ID NO: 2881056 - protein, 22 aa, Entamoeba invadens
LKDQTNEDLNKMTEKVKEMENG

SEQ ID NO: 2881057 - protein, 17 aa, Entamoeba invadens
LKDRPVGTSNTDQTEVI

SEQ ID NO: 2881058 - protein, 6 aa, Entamoeba invadens
LKDRSS

SEQ ID NO: 2881059 - protein, 4 aa, Entamoeba invadens
LKDS

SEQ ID NO: 2881060 - protein, 8 aa, Entamoeba invadens
LKDSDSYV

SEQ ID NO: 2881061 - protein, 19 aa, Entamoeba invadens
LKDSEKHKEINKKPITPEL

SEQ ID NO: 2881062 - protein, 5 aa, Entamoeba invadens
LKDST

SEQ ID NO: 2881063 - protein, 23 aa, Entamoeba invadens
LKDTEREKAALNEEVEAANEKLR

SEQ ID NO: 2881064 - protein, 12 aa, Entamoeba invadens
LKDTEVSGIPQE

SEQ ID NO: 2881065 - protein, 12 aa, Entamoeba invadens
LKDTKQSEPPKY

SEQ ID NO: 2881066 - protein, 12 aa, Entamoeba invadens
LKDTSETSFADK

SEQ ID NO: 2881067 - protein, 10 aa, Entamoeba invadens
LKDVKQSVVT

SEQ ID NO: 2881068 - protein, 9 aa, Entamoeba invadens
LKDVPSSIS

SEQ ID NO: 2881069 - protein, 8 aa, Entamoeba invadens
LKEAEEFK

SEQ ID NO: 2881070 - protein, 10 aa, Entamoeba invadens
LKEATKANND

SEQ ID NO: 2881071 - protein, 12 aa, Entamoeba invadens
LKEDAKNRRNGV

SEQ ID NO: 2881072 - protein, 7 aa, Entamoeba invadens
LKEDIDN

SEQ ID NO: 2881073 - protein, 26 aa, Entamoeba invadens
LKEDIESKKTQLEEADMKSHEDQEHI

SEQ ID NO: 2881074 - protein, 11 aa, Entamoeba invadens
LKEDNEELKSR

SEQ ID NO: 2881075 - protein, 10 aa, Entamoeba invadens
LKEEDGSLKM

SEQ ID NO: 2881076 - protein, 18 aa, Entamoeba invadens
LKEEESDEKDRERKSENL

SEQ ID NO: 2881077 - protein, 6 aa, Entamoeba invadens
LKEEEV

SEQ ID NO: 2881078 - protein, 26 aa, Entamoeba invadens
LKEEGKKEKKEKEEKNQSQDDKKKKK

SEQ ID NO: 2881079 - protein, 18 aa, Entamoeba invadens
LKEEIDKLKSDNEKLKAD

SEQ ID NO: 2881080 - protein, 7 aa, Entamoeba invadens
LKEENDV

SEQ ID NO: 2881081 - protein, 8 aa, Entamoeba invadens
LKEENEEY

SEQ ID NO: 2881082 - protein, 11 aa, Entamoeba invadens
LKEENERMKEN

SEQ ID NO: 2881083 - protein, 11 aa, Entamoeba invadens
LKEENQNKDID

SEQ ID NO: 2881084 - protein, 9 aa, Entamoeba invadens
LKEENTKIR

SEQ ID NO: 2881085 - protein, 7 aa, Entamoeba invadens
LKEETTT

SEQ ID NO: 2881086 - protein, 8 aa, Entamoeba invadens
LKEFESKL

SEQ ID NO: 2881087 - protein, 5 aa, Entamoeba invadens
LKEFP

SEQ ID NO: 2881088 - protein, 6 aa, Entamoeba invadens
LKEGKF

SEQ ID NO: 2881089 - protein, 7 aa, Entamoeba invadens
LKEGSVE

SEQ ID NO: 2881090 - protein, 8 aa, Entamoeba invadens
LKEGTQDQ

SEQ ID NO: 2881091 - protein, 9 aa, Entamoeba invadens
LKEHKKQLQ

SEQ ID NO: 2881092 - protein, 7 aa, Entamoeba invadens
LKEHPTN

SEQ ID NO: 2881093 - protein, 22 aa, Entamoeba invadens
LKEHSDDEEETKSSKRKRNQKD

SEQ ID NO: 2881094 - protein, 6 aa, Entamoeba invadens
LKEHTT

SEQ ID NO: 2881095 - protein, 4 aa, Entamoeba invadens
LKEK

SEQ ID NO: 2881096 - protein, 61 aa, Entamoeba invadens
LKEKEKKKWEENKEKKLQISEQKKEEEKKSTFQKEGSKTKEKGQQKTQKRESRKQRKLNRE

SEQ ID NO: 2881097 - protein, 7 aa, Entamoeba invadens
LKEKELE

SEQ ID NO: 2881098 - protein, 9 aa, Entamoeba invadens
LKEKENNEY

SEQ ID NO: 2881099 - protein, 22 aa, Entamoeba invadens
LKEKETKKADKRMKTQSESRVD

SEQ ID NO: 2881100 - protein, 12 aa, Entamoeba invadens
LKEKGNHRTRGD

SEQ ID NO: 2881101 - protein, 16 aa, Entamoeba invadens
LKEKKINDQLEEKEPF

SEQ ID NO: 2881102 - protein, 8 aa, Entamoeba invadens
LKEKKPGM

SEQ ID NO: 2881103 - protein, 6 aa, Entamoeba invadens
LKEKLK

SEQ ID NO: 2881104 - protein, 6 aa, Entamoeba invadens
LKEKQT

SEQ ID NO: 2881105 - protein, 9 aa, Entamoeba invadens
LKEKQTQFD

SEQ ID NO: 2881106 - protein, 15 aa, Entamoeba invadens
LKEKREDNEMSEDEI

SEQ ID NO: 2881107 - protein, 16 aa, Entamoeba invadens
LKEKSAKKETETPEIS

SEQ ID NO: 2881108 - protein, 10 aa, Entamoeba invadens
LKEKSEEPKR

SEQ ID NO: 2881109 - protein, 10 aa, Entamoeba invadens
LKEKSNDETF

SEQ ID NO: 2881110 - protein, 9 aa, Entamoeba invadens
LKEKSPNQK

SEQ ID NO: 2881111 - protein, 4 aa, Entamoeba invadens
LKEN

SEQ ID NO: 2881112 - protein, 5 aa, Entamoeba invadens
LKENE

SEQ ID NO: 2881113 - protein, 8 aa, Entamoeba invadens
LKENEEKV

SEQ ID NO: 2881114 - protein, 8 aa, Entamoeba invadens
LKENGKVD

SEQ ID NO: 2881115 - protein, 7 aa, Entamoeba invadens
LKENPPP

SEQ ID NO: 2881116 - protein, 7 aa, Entamoeba invadens
LKENQTK

SEQ ID NO: 2881117 - protein, 6 aa, Entamoeba invadens
LKENSP

SEQ ID NO: 2881118 - protein, 5 aa, Entamoeba invadens
LKEPE

SEQ ID NO: 2881119 - protein, 6 aa, Entamoeba invadens
LKEPNI

SEQ ID NO: 2881120 - protein, 7 aa, Entamoeba invadens
LKEPNPD

SEQ ID NO: 2881121 - protein, 12 aa, Entamoeba invadens
LKEPSKSEKIRR

SEQ ID NO: 2881122 - protein, 28 aa, Entamoeba invadens
LKEQERLKKEAELKKIEEEERKRKEIEE

SEQ ID NO: 2881123 - protein, 7 aa, Entamoeba invadens
LKEQKPG

SEQ ID NO: 2881124 - protein, 9 aa, Entamoeba invadens
LKEQNKKLD

SEQ ID NO: 2881125 - protein, 31 aa, Entamoeba invadens
LKEQNTQLDAAKKDMKKQSVEDASKIENYES

SEQ ID NO: 2881126 - protein, 32 aa, Entamoeba invadens
LKEQNTQLDAAKKDMKKQSVEDATKIENNGSH

SEQ ID NO: 2881127 - protein, 32 aa, Entamoeba invadens
LKEQNTRLDAAKKDMKKQSVEDASKIKNYESQ

SEQ ID NO: 2881128 - protein, 15 aa, Entamoeba invadens
LKEQTKKLVAQKKAS

SEQ ID NO: 2881129 - protein, 7 aa, Entamoeba invadens
LKERAET

SEQ ID NO: 2881130 - protein, 5 aa, Entamoeba invadens
LKERE

SEQ ID NO: 2881131 - protein, 7 aa, Entamoeba invadens
LKERGEG

SEQ ID NO: 2881132 - protein, 9 aa, Entamoeba invadens
LKESAEVTT

SEQ ID NO: 2881133 - protein, 6 aa, Entamoeba invadens
LKESAV

SEQ ID NO: 2881134 - protein, 16 aa, Entamoeba invadens
LKESDDFEKATFESQI

SEQ ID NO: 2881135 - protein, 11 aa, Entamoeba invadens
LKESKIKMKEE

SEQ ID NO: 2881136 - protein, 10 aa, Entamoeba invadens
LKESNISAKS

SEQ ID NO: 2881137 - protein, 8 aa, Entamoeba invadens
LKESNKNI

SEQ ID NO: 2881138 - protein, 15 aa, Entamoeba invadens
LKESNYTALTPTDVD

SEQ ID NO: 2881139 - protein, 11 aa, Entamoeba invadens
LKESPSTKENV

SEQ ID NO: 2881140 - protein, 23 aa, Entamoeba invadens
LKESQRNSVTLEKPNVVQDKTTC

SEQ ID NO: 2881141 - protein, 25 aa, Entamoeba invadens
LKESQSSKETPMDSSKNSLNSSESD

SEQ ID NO: 2881142 - protein, 14 aa, Entamoeba invadens
LKESQTQISPRPVT

SEQ ID NO: 2881143 - protein, 8 aa, Entamoeba invadens
LKETAWGK

SEQ ID NO: 2881144 - protein, 11 aa, Entamoeba invadens
LKETCQRNGAT

SEQ ID NO: 2881145 - protein, 9 aa, Entamoeba invadens
LKETDETMS

SEQ ID NO: 2881146 - protein, 4 aa, Entamoeba invadens
LKEV

SEQ ID NO: 2881147 - protein, 6 aa, Entamoeba invadens
LKEVTD

SEQ ID NO: 2881148 - protein, 7 aa, Entamoeba invadens
LKEYSGK

SEQ ID NO: 2881149 - protein, 5 aa, Entamoeba invadens
LKFAS

SEQ ID NO: 2881150 - protein, 13 aa, Entamoeba invadens
LKFDEKDEISTAS

SEQ ID NO: 2881151 - protein, 4 aa, Entamoeba invadens
LKFG

SEQ ID NO: 2881152 - protein, 11 aa, Entamoeba invadens
LKFNAPSNGSY

SEQ ID NO: 2881153 - protein, 14 aa, Entamoeba invadens
LKFSNEPKKINKSV

SEQ ID NO: 2881154 - protein, 4 aa, Entamoeba invadens
LKGD

SEQ ID NO: 2881155 - protein, 15 aa, Entamoeba invadens
LKGDEQGLEKKRHVG

SEQ ID NO: 2881156 - protein, 33 aa, Entamoeba invadens
LKGDKKWKRGRRGKGRWRKKENEDPTKRREKYE

SEQ ID NO: 2881157 - protein, 4 aa, Entamoeba invadens
LKGE

SEQ ID NO: 2881158 - protein, 6 aa, Entamoeba invadens
LKGEDG

SEQ ID NO: 2881159 - protein, 15 aa, Entamoeba invadens
LKGENEKDGNRLDGI

SEQ ID NO: 2881160 - protein, 19 aa, Entamoeba invadens
LKGEQKMKETEAPLVLNFT

SEQ ID NO: 2881161 - protein, 8 aa, Entamoeba invadens
LKGESNSI

SEQ ID NO: 2881162 - protein, 5 aa, Entamoeba invadens
LKGGL

SEQ ID NO: 2881163 - protein, 7 aa, Entamoeba invadens
LKGGSLT

SEQ ID NO: 2881164 - protein, 15 aa, Entamoeba invadens
LKGITDVSTTNSINK

SEQ ID NO: 2881165 - protein, 13 aa, Entamoeba invadens
LKGKEEDEGEEDE

SEQ ID NO: 2881166 - protein, 10 aa, Entamoeba invadens
LKGKIESENM

SEQ ID NO: 2881167 - protein, 13 aa, Entamoeba invadens
LKGKQYKDVDGEP

SEQ ID NO: 2881168 - protein, 5 aa, Entamoeba invadens
LKGKR

SEQ ID NO: 2881169 - protein, 10 aa, Entamoeba invadens
LKGKVDASGD

SEQ ID NO: 2881170 - protein, 12 aa, Entamoeba invadens
LKGLSQDEMAKG

SEQ ID NO: 2881171 - protein, 12 aa, Entamoeba invadens
LKGNDPTQKSDI

SEQ ID NO: 2881172 - protein, 6 aa, Entamoeba invadens
LKGNEK

SEQ ID NO: 2881173 - protein, 7 aa, Entamoeba invadens
LKGNERA

SEQ ID NO: 2881174 - protein, 6 aa, Entamoeba invadens
LKGNEV

SEQ ID NO: 2881175 - protein, 9 aa, Entamoeba invadens
LKGNGNDQV

SEQ ID NO: 2881176 - protein, 7 aa, Entamoeba invadens
LKGPSTE

SEQ ID NO: 2881177 - protein, 9 aa, Entamoeba invadens
LKGQTNITT

SEQ ID NO: 2881178 - protein, 13 aa, Entamoeba invadens
LKGSAETEETTKD

SEQ ID NO: 2881179 - protein, 8 aa, Entamoeba invadens
LKGSKNKG

SEQ ID NO: 2881180 - protein, 7 aa, Entamoeba invadens
LKGSNKH

SEQ ID NO: 2881181 - protein, 10 aa, Entamoeba invadens
LKGTNEPQSV

SEQ ID NO: 2881182 - protein, 7 aa, Entamoeba invadens
LKGTRSA

SEQ ID NO: 2881183 - protein, 8 aa, Entamoeba invadens
LKGTSSSQ

SEQ ID NO: 2881184 - protein, 12 aa, Entamoeba invadens
LKGTTQSDINTF

SEQ ID NO: 2881185 - protein, 14 aa, Entamoeba invadens
LKHEENIEGTYQKE

SEQ ID NO: 2881186 - protein, 15 aa, Entamoeba invadens
LKHKDKIEVPDTTKD

SEQ ID NO: 2881187 - protein, 8 aa, Entamoeba invadens
LKHKTQRI

SEQ ID NO: 2881188 - protein, 24 aa, Entamoeba invadens
LKHNESEVLKDTEHGSKPKEPQQK

SEQ ID NO: 2881189 - protein, 10 aa, Entamoeba invadens
LKHPDDVDTQ

SEQ ID NO: 2881190 - protein, 8 aa, Entamoeba invadens
LKHSSGKQ

SEQ ID NO: 2881191 - protein, 10 aa, Entamoeba invadens
LKIASEDSEI

SEQ ID NO: 2881192 - protein, 6 aa, Entamoeba invadens
LKINEE

SEQ ID NO: 2881193 - protein, 10 aa, Entamoeba invadens
LKIPEETQGR

SEQ ID NO: 2881194 - protein, 11 aa, Entamoeba invadens
LKIPRNPQFEK

SEQ ID NO: 2881195 - protein, 6 aa, Entamoeba invadens
LKIPSN

SEQ ID NO: 2881196 - protein, 8 aa, Entamoeba invadens
LKIPTSEE

SEQ ID NO: 2881197 - protein, 8 aa, Entamoeba invadens
LKISENSE

SEQ ID NO: 2881198 - protein, 6 aa, Entamoeba invadens
LKITSE

SEQ ID NO: 2881199 - protein, 7 aa, Entamoeba invadens
LKKAAPE

SEQ ID NO: 2881200 - protein, 11 aa, Entamoeba invadens
LKKADDTEREL

SEQ ID NO: 2881201 - protein, 15 aa, Entamoeba invadens
LKKAGGADYSTNSGS

SEQ ID NO: 2881202 - protein, 7 aa, Entamoeba invadens
LKKAQNL

SEQ ID NO: 2881203 - protein, 10 aa, Entamoeba invadens
LKKAQNNTNV

SEQ ID NO: 2881204 - protein, 24 aa, Entamoeba invadens
LKKASEDVRASQESAYKVDSYRTE

SEQ ID NO: 2881205 - protein, 10 aa, Entamoeba invadens
LKKDGDKRNK

SEQ ID NO: 2881206 - protein, 11 aa, Entamoeba invadens
LKKDQEESELN

SEQ ID NO: 2881207 - protein, 8 aa, Entamoeba invadens
LKKDTDGC

SEQ ID NO: 2881208 - protein, 8 aa, Entamoeba invadens
LKKEADEI

SEQ ID NO: 2881209 - protein, 43 aa, Entamoeba invadens
LKKEDEDEKEKEKEVDHQDEQKEEVGDDAFEAEGGFEVGGDDD

SEQ ID NO: 2881210 - protein, 12 aa, Entamoeba invadens
LKKEEDELNGFT

SEQ ID NO: 2881211 - protein, 9 aa, Entamoeba invadens
LKKEEERRL

SEQ ID NO: 2881212 - protein, 10 aa, Entamoeba invadens
LKKEETRQTV

SEQ ID NO: 2881213 - protein, 11 aa, Entamoeba invadens
LKKEGNPLQNN

SEQ ID NO: 2881214 - protein, 16 aa, Entamoeba invadens
LKKEKDEKKQEEETHT

SEQ ID NO: 2881215 - protein, 68 aa, Entamoeba invadens
LKKEKEKAERLEQERIAKKKAEKEAREKAEAERLEQEKAAKDLADKLEKEKEAKEKAEQEQKEKEEAL

SEQ ID NO: 2881216 - protein, 24 aa, Entamoeba invadens
LKKEKNEKEKTKLNNKKLLSKADK

SEQ ID NO: 2881217 - protein, 27 aa, Entamoeba invadens
LKKEKNEKSDKHEEKVVTSEGDGTKYT

SEQ ID NO: 2881218 - protein, 12 aa, Entamoeba invadens
LKKEKSGWKCLL

SEQ ID NO: 2881219 - protein, 9 aa, Entamoeba invadens
LKKENHSFQ

SEQ ID NO: 2881220 - protein, 7 aa, Entamoeba invadens
LKKEREV

SEQ ID NO: 2881221 - protein, 10 aa, Entamoeba invadens
LKKESGEAKL

SEQ ID NO: 2881222 - protein, 10 aa, Entamoeba invadens
LKKESNPLQN

SEQ ID NO: 2881223 - protein, 9 aa, Entamoeba invadens
LKKEVEQRN

SEQ ID NO: 2881224 - protein, 9 aa, Entamoeba invadens
LKKGDNSEV

SEQ ID NO: 2881225 - protein, 7 aa, Entamoeba invadens
LKKGEIS

SEQ ID NO: 2881226 - protein, 31 aa, Entamoeba invadens
LKKGKDNEEETVGEKSAKTNAMEIEEPERKD

SEQ ID NO: 2881227 - protein, 7 aa, Entamoeba invadens
LKKGKER

SEQ ID NO: 2881228 - protein, 7 aa, Entamoeba invadens
LKKGNDC

SEQ ID NO: 2881229 - protein, 7 aa, Entamoeba invadens
LKKGSNT

SEQ ID NO: 2881230 - protein, 7 aa, Entamoeba invadens
LKKGSPL

SEQ ID NO: 2881231 - protein, 19 aa, Entamoeba invadens
LKKGTQSSYPNAEEIEKII

SEQ ID NO: 2881232 - protein, 13 aa, Entamoeba invadens
LKKKASGKCPNLF

SEQ ID NO: 2881233 - protein, 8 aa, Entamoeba invadens
LKKKDEIQ

SEQ ID NO: 2881234 - protein, 9 aa, Entamoeba invadens
LKKKDTEMS

SEQ ID NO: 2881235 - protein, 16 aa, Entamoeba invadens
LKKKKSSGLSKSQISL

SEQ ID NO: 2881236 - protein, 9 aa, Entamoeba invadens
LKKKNEKMT

SEQ ID NO: 2881237 - protein, 27 aa, Entamoeba invadens
LKKKNTTTDSKGDGKPTSIVDDDEDII

SEQ ID NO: 2881238 - protein, 16 aa, Entamoeba invadens
LKKKTEMDKKMRADAK

SEQ ID NO: 2881239 - protein, 11 aa, Entamoeba invadens
LKKMSEGLNQK

SEQ ID NO: 2881240 - protein, 7 aa, Entamoeba invadens
LKKPKDV

SEQ ID NO: 2881241 - protein, 23 aa, Entamoeba invadens
LKKPKDVAMPAPKKRAIRKKTKK

SEQ ID NO: 2881242 - protein, 7 aa, Entamoeba invadens
LKKPLED

SEQ ID NO: 2881243 - protein, 8 aa, Entamoeba invadens
LKKPSMED

SEQ ID NO: 2881244 - protein, 27 aa, Entamoeba invadens
LKKPVSKKSKKEKVQKEEKMEKIEKIE

SEQ ID NO: 2881245 - protein, 5 aa, Entamoeba invadens
LKKPW

SEQ ID NO: 2881246 - protein, 5 aa, Entamoeba invadens
LKKPY

SEQ ID NO: 2881247 - protein, 14 aa, Entamoeba invadens
LKKQAEEVKKLMEK

SEQ ID NO: 2881248 - protein, 9 aa, Entamoeba invadens
LKKQEEERI

SEQ ID NO: 2881249 - protein, 7 aa, Entamoeba invadens
LKKQKDL

SEQ ID NO: 2881250 - protein, 11 aa, Entamoeba invadens
LKKQKDSQDVL

SEQ ID NO: 2881251 - protein, 14 aa, Entamoeba invadens
LKKQKSELSQRRAS

SEQ ID NO: 2881252 - protein, 8 aa, Entamoeba invadens
LKKQNDVL

SEQ ID NO: 2881253 - protein, 17 aa, Entamoeba invadens
LKKQNVKLQTENEEAVK

SEQ ID NO: 2881254 - protein, 16 aa, Entamoeba invadens
LKKQTNNYYNKYNEEL

SEQ ID NO: 2881255 - protein, 5 aa, Entamoeba invadens
LKKRD

SEQ ID NO: 2881256 - protein, 6 aa, Entamoeba invadens
LKKRDT

SEQ ID NO: 2881257 - protein, 10 aa, Entamoeba invadens
LKKRENRDLE

SEQ ID NO: 2881258 - protein, 16 aa, Entamoeba invadens
LKKRGASKHMPRVSKD

SEQ ID NO: 2881259 - protein, 12 aa, Entamoeba invadens
LKKRNSLTSSYP

SEQ ID NO: 2881260 - protein, 8 aa, Entamoeba invadens
LKKRSTEI

SEQ ID NO: 2881261 - protein, 9 aa, Entamoeba invadens
LKKSDNADI

SEQ ID NO: 2881262 - protein, 30 aa, Entamoeba invadens
LKKSETKQDGIGPNLASTNPFADTNGFTQV

SEQ ID NO: 2881263 - protein, 17 aa, Entamoeba invadens
LKKSGKVAGMNEGGSDR

SEQ ID NO: 2881264 - protein, 8 aa, Entamoeba invadens
LKKSKGAG

SEQ ID NO: 2881265 - protein, 9 aa, Entamoeba invadens
LKKSPGTYQ

SEQ ID NO: 2881266 - protein, 13 aa, Entamoeba invadens
LKKSQTSLDGMET

SEQ ID NO: 2881267 - protein, 39 aa, Entamoeba invadens
LKKSRNEMKQIEKQRKKPLTKQVSDKPQKVLRFRLLRFS

SEQ ID NO: 2881268 - protein, 28 aa, Entamoeba invadens
LKKSTDTKVDTKNETKNQENFRKNRNYQ

SEQ ID NO: 2881269 - protein, 6 aa, Entamoeba invadens
LKKSVR

SEQ ID NO: 2881270 - protein, 10 aa, Entamoeba invadens
LKKTDEVEKV

SEQ ID NO: 2881271 - protein, 21 aa, Entamoeba invadens
LKKTGTSGASQQPAAAPAMNP

SEQ ID NO: 2881272 - protein, 54 aa, Entamoeba invadens
LKKTQLALDDTEKKLDKQVAQNKKVSDEKDGYNQQLQAEKTKAAALTSANGVND

SEQ ID NO: 2881273 - protein, 7 aa, Entamoeba invadens
LKKTTDN

SEQ ID NO: 2881274 - protein, 11 aa, Entamoeba invadens
LKKVSTAEELT

SEQ ID NO: 2881275 - protein, 23 aa, Entamoeba invadens
LKKVTKDHKATNSDEAKRIQNNG

SEQ ID NO: 2881276 - protein, 47 aa, Entamoeba invadens
LKLEETAKGATKENANVEDSGDNDEEYHAEEGESGDDDLMSEESGDD

SEQ ID NO: 2881277 - protein, 20 aa, Entamoeba invadens
LKLESKKDYDEVSKPGEYAS

SEQ ID NO: 2881278 - protein, 8 aa, Entamoeba invadens
LKLPQSVK

SEQ ID NO: 2881279 - protein, 6 aa, Entamoeba invadens
LKLSDD

SEQ ID NO: 2881280 - protein, 110 aa, Entamoeba invadens
LKLTSSSKSPKPSKSPKPLSPSLEISDPSLISESKTTSEAQPVESNELTKSCSSTNTRDSDKKERASNRKSTSSTHKEEDNPLVEKEKQEKETSPLKSSKEDKEKKTTMS

SEQ ID NO: 2881281 - protein, 11 aa, Entamoeba invadens
LKMSSDIPQSL

SEQ ID NO: 2881282 - protein, 5 aa, Entamoeba invadens
LKNAE

SEQ ID NO: 2881283 - protein, 9 aa, Entamoeba invadens
LKNAKKAAE

SEQ ID NO: 2881284 - protein, 8 aa, Entamoeba invadens
LKNDAFND

SEQ ID NO: 2881285 - protein, 5 aa, Entamoeba invadens
LKNDE

SEQ ID NO: 2881286 - protein, 12 aa, Entamoeba invadens
LKNDIGKGSVRN

SEQ ID NO: 2881287 - protein, 9 aa, Entamoeba invadens
LKNDNSRIP

SEQ ID NO: 2881288 - protein, 9 aa, Entamoeba invadens
LKNDTSEQF

SEQ ID NO: 2881289 - protein, 6 aa, Entamoeba invadens
LKNEDT

SEQ ID NO: 2881290 - protein, 9 aa, Entamoeba invadens
LKNEEDAEK

SEQ ID NO: 2881291 - protein, 19 aa, Entamoeba invadens
LKNEGRNFVSQQSAEEMAK

SEQ ID NO: 2881292 - protein, 7 aa, Entamoeba invadens
LKNELDE

SEQ ID NO: 2881293 - protein, 11 aa, Entamoeba invadens
LKNERGNEKIA

SEQ ID NO: 2881294 - protein, 17 aa, Entamoeba invadens
LKNESEEQHDDLETNCA

SEQ ID NO: 2881295 - protein, 4 aa, Entamoeba invadens
LKNG

SEQ ID NO: 2881296 - protein, 12 aa, Entamoeba invadens
LKNGDDKTKDRM

SEQ ID NO: 2881297 - protein, 9 aa, Entamoeba invadens
LKNGKNDTL

SEQ ID NO: 2881298 - protein, 8 aa, Entamoeba invadens
LKNGKNQE

SEQ ID NO: 2881299 - protein, 18 aa, Entamoeba invadens
LKNKRNIQESYSIDEQTM

SEQ ID NO: 2881300 - protein, 8 aa, Entamoeba invadens
LKNKSDHQ

SEQ ID NO: 2881301 - protein, 6 aa, Entamoeba invadens
LKNLPN

SEQ ID NO: 2881302 - protein, 4 aa, Entamoeba invadens
LKNN

SEQ ID NO: 2881303 - protein, 12 aa, Entamoeba invadens
LKNNNNDENAFP

SEQ ID NO: 2881304 - protein, 8 aa, Entamoeba invadens
LKNNPDVR

SEQ ID NO: 2881305 - protein, 10 aa, Entamoeba invadens
LKNNQQGELR

SEQ ID NO: 2881306 - protein, 15 aa, Entamoeba invadens
LKNNVPTPLTSRTSQ

SEQ ID NO: 2881307 - protein, 20 aa, Entamoeba invadens
LKNPEDKVVEEAKKEDTTAI

SEQ ID NO: 2881308 - protein, 7 aa, Entamoeba invadens
LKNPPEG

SEQ ID NO: 2881309 - protein, 7 aa, Entamoeba invadens
LKNPQAN

SEQ ID NO: 2881310 - protein, 25 aa, Entamoeba invadens
LKNQNETLQTEKEELVKKSEEMQNN

SEQ ID NO: 2881311 - protein, 28 aa, Entamoeba invadens
LKNQPKREQPIPSPQDKILKSDKQSQIK

SEQ ID NO: 2881312 - protein, 9 aa, Entamoeba invadens
LKNQTKEKS

SEQ ID NO: 2881313 - protein, 7 aa, Entamoeba invadens
LKNRAKH

SEQ ID NO: 2881314 - protein, 8 aa, Entamoeba invadens
LKNSGMRE

SEQ ID NO: 2881315 - protein, 106 aa, Entamoeba invadens
LKNSNSRLKEETQKTDTGDNPNPEEHQDSSQPHNQENYAPRGEKPLDDDIDEREESDDVSSQNSSDEEESEEDNSENSNSSNNTSDNDSNVSSGEEESDENYYQNT

SEQ ID NO: 2881316 - protein, 9 aa, Entamoeba invadens
LKNSSNLTE

SEQ ID NO: 2881317 - protein, 4 aa, Entamoeba invadens
LKNT

SEQ ID NO: 2881318 - protein, 8 aa, Entamoeba invadens
LKNTPNDD

SEQ ID NO: 2881319 - protein, 5 aa, Entamoeba invadens
LKNTS

SEQ ID NO: 2881320 - protein, 13 aa, Entamoeba invadens
LKNTSDEKENAEI

SEQ ID NO: 2881321 - protein, 6 aa, Entamoeba invadens
LKNTSV

SEQ ID NO: 2881322 - protein, 13 aa, Entamoeba invadens
LKNTTEKKKKAED

SEQ ID NO: 2881323 - protein, 44 aa, Entamoeba invadens
LKNVERKKAIREKKVQGKSDSKKPMTKEMKEDAKKKKRIKKIKT

SEQ ID NO: 2881324 - protein, 5 aa, Entamoeba invadens
LKNVG

SEQ ID NO: 2881325 - protein, 5 aa, Entamoeba invadens
LKPAA

SEQ ID NO: 2881326 - protein, 21 aa, Entamoeba invadens
LKPDTSIPPDFREPTPGQLTQ

SEQ ID NO: 2881327 - protein, 5 aa, Entamoeba invadens
LKPEE

SEQ ID NO: 2881328 - protein, 8 aa, Entamoeba invadens
LKPEEHDT

SEQ ID NO: 2881329 - protein, 7 aa, Entamoeba invadens
LKPEEVE

SEQ ID NO: 2881330 - protein, 5 aa, Entamoeba invadens
LKPEN

SEQ ID NO: 2881331 - protein, 7 aa, Entamoeba invadens
LKPENTK

SEQ ID NO: 2881332 - protein, 7 aa, Entamoeba invadens
LKPEQIK

SEQ ID NO: 2881333 - protein, 6 aa, Entamoeba invadens
LKPETE

SEQ ID NO: 2881334 - protein, 12 aa, Entamoeba invadens
LKPGEEAIDRPD

SEQ ID NO: 2881335 - protein, 7 aa, Entamoeba invadens
LKPGQTI

SEQ ID NO: 2881336 - protein, 32 aa, Entamoeba invadens
LKPKEIGKLGEEVTEVKKKKDDKKKEESKKFN

SEQ ID NO: 2881337 - protein, 5 aa, Entamoeba invadens
LKPKP

SEQ ID NO: 2881338 - protein, 13 aa, Entamoeba invadens
LKPKTLGIPGEDL

SEQ ID NO: 2881339 - protein, 7 aa, Entamoeba invadens
LKPLEKE

SEQ ID NO: 2881340 - protein, 4 aa, Entamoeba invadens
LKPN

SEQ ID NO: 2881341 - protein, 8 aa, Entamoeba invadens
LKPNDTYA

SEQ ID NO: 2881342 - protein, 6 aa, Entamoeba invadens
LKPNEL

SEQ ID NO: 2881343 - protein, 18 aa, Entamoeba invadens
LKPNESQEVIESGAGSGM

SEQ ID NO: 2881344 - protein, 10 aa, Entamoeba invadens
LKPNNVSEGI

SEQ ID NO: 2881345 - protein, 37 aa, Entamoeba invadens
LKPPKKESKVKKEKEKEKKDDKKEEKKEKEKRERKDV

SEQ ID NO: 2881346 - protein, 14 aa, Entamoeba invadens
LKPRRVNKEKIKKA

SEQ ID NO: 2881347 - protein, 8 aa, Entamoeba invadens
LKPSKRSC

SEQ ID NO: 2881348 - protein, 6 aa, Entamoeba invadens
LKPSQR

SEQ ID NO: 2881349 - protein, 7 aa, Entamoeba invadens
LKPSSSN

SEQ ID NO: 2881350 - protein, 14 aa, Entamoeba invadens
LKPSTSLSQTAIPS

SEQ ID NO: 2881351 - protein, 5 aa, Entamoeba invadens
LKPTA

SEQ ID NO: 2881352 - protein, 10 aa, Entamoeba invadens
LKPTEETKDI

SEQ ID NO: 2881353 - protein, 8 aa, Entamoeba invadens
LKPTGIRA

SEQ ID NO: 2881354 - protein, 5 aa, Entamoeba invadens
LKPTI

SEQ ID NO: 2881355 - protein, 46 aa, Entamoeba invadens
LKPTNATNATVSNSTQTNTTSTNGTTATNTTTPVNITETKKSSKFN

SEQ ID NO: 2881356 - protein, 9 aa, Entamoeba invadens
LKPTTHQER

SEQ ID NO: 2881357 - protein, 8 aa, Entamoeba invadens
LKQDKRTK

SEQ ID NO: 2881358 - protein, 8 aa, Entamoeba invadens
LKQDQDEL

SEQ ID NO: 2881359 - protein, 10 aa, Entamoeba invadens
LKQDRQGKLT

SEQ ID NO: 2881360 - protein, 8 aa, Entamoeba invadens
LKQETNAK

SEQ ID NO: 2881361 - protein, 7 aa, Entamoeba invadens
LKQGENV

SEQ ID NO: 2881362 - protein, 8 aa, Entamoeba invadens
LKQGKEAM

SEQ ID NO: 2881363 - protein, 4 aa, Entamoeba invadens
LKQI

SEQ ID NO: 2881364 - protein, 7 aa, Entamoeba invadens
LKQIPND

SEQ ID NO: 2881365 - protein, 9 aa, Entamoeba invadens
LKQKETEVV

SEQ ID NO: 2881366 - protein, 16 aa, Entamoeba invadens
LKQKGITEGMTTEQAR

SEQ ID NO: 2881367 - protein, 16 aa, Entamoeba invadens
LKQKQRITQSTVNAKE

SEQ ID NO: 2881368 - protein, 22 aa, Entamoeba invadens
LKQKREELTTTIKTQQENDPEV

SEQ ID NO: 2881369 - protein, 8 aa, Entamoeba invadens
LKQKRKTI

SEQ ID NO: 2881370 - protein, 14 aa, Entamoeba invadens
LKQKTKETGKPLKE

SEQ ID NO: 2881371 - protein, 15 aa, Entamoeba invadens
LKQNPGAVPFRSNDT

SEQ ID NO: 2881372 - protein, 13 aa, Entamoeba invadens
LKQNTKNQQQSQM

SEQ ID NO: 2881373 - protein, 9 aa, Entamoeba invadens
LKQPPSPHH

SEQ ID NO: 2881374 - protein, 12 aa, Entamoeba invadens
LKQPQAKKDLEK

SEQ ID NO: 2881375 - protein, 20 aa, Entamoeba invadens
LKQQAGNIKRAAQKYNEEFQ

SEQ ID NO: 2881376 - protein, 17 aa, Entamoeba invadens
LKQQEEEAKRVARRMFG

SEQ ID NO: 2881377 - protein, 24 aa, Entamoeba invadens
LKQQEEKESKKEHVEGSKKPHKVI

SEQ ID NO: 2881378 - protein, 9 aa, Entamoeba invadens
LKQQQQQQL

SEQ ID NO: 2881379 - protein, 6 aa, Entamoeba invadens
LKQRKN

SEQ ID NO: 2881380 - protein, 27 aa, Entamoeba invadens
LKQSDQNTQTDSTKHDKNEIVESAESA

SEQ ID NO: 2881381 - protein, 6 aa, Entamoeba invadens
LKQSGA

SEQ ID NO: 2881382 - protein, 7 aa, Entamoeba invadens
LKQSPSR

SEQ ID NO: 2881383 - protein, 7 aa, Entamoeba invadens
LKQSVQP

SEQ ID NO: 2881384 - protein, 7 aa, Entamoeba invadens
LKQTDDK

SEQ ID NO: 2881385 - protein, 8 aa, Entamoeba invadens
LKQYGGKI

SEQ ID NO: 2881386 - protein, 7 aa, Entamoeba invadens
LKQYSGK

SEQ ID NO: 2881387 - protein, 9 aa, Entamoeba invadens
LKRAKEDGY

SEQ ID NO: 2881388 - protein, 54 aa, Entamoeba invadens
LKRDELDKKDVEELQKEVQQETEKLEKVDNQKEQPANDQEEEIAVQTNFKKFGK

SEQ ID NO: 2881389 - protein, 6 aa, Entamoeba invadens
LKRDGD

SEQ ID NO: 2881390 - protein, 10 aa, Entamoeba invadens
LKREEEEEFS

SEQ ID NO: 2881391 - protein, 13 aa, Entamoeba invadens
LKREERADATEAI

SEQ ID NO: 2881392 - protein, 19 aa, Entamoeba invadens
LKREKDQIEDDLRTKSNEL

SEQ ID NO: 2881393 - protein, 10 aa, Entamoeba invadens
LKRELTDEEI

SEQ ID NO: 2881394 - protein, 12 aa, Entamoeba invadens
LKRERKRAPETS

SEQ ID NO: 2881395 - protein, 12 aa, Entamoeba invadens
LKRESKSFEASQ

SEQ ID NO: 2881396 - protein, 9 aa, Entamoeba invadens
LKRGKRSNL

SEQ ID NO: 2881397 - protein, 11 aa, Entamoeba invadens
LKRHSDKNRVS

SEQ ID NO: 2881398 - protein, 7 aa, Entamoeba invadens
LKRITED

SEQ ID NO: 2881399 - protein, 11 aa, Entamoeba invadens
LKRKDPMEEEQ

SEQ ID NO: 2881400 - protein, 27 aa, Entamoeba invadens
LKRKRAKEYEEKKKEIEDTRRSKEEQR

SEQ ID NO: 2881401 - protein, 4 aa, Entamoeba invadens
LKRN

SEQ ID NO: 2881402 - protein, 13 aa, Entamoeba invadens
LKRPKKVSMRTST

SEQ ID NO: 2881403 - protein, 58 aa, Entamoeba invadens
LKRQEAERKRRDEEEKKRKEEEENDQKKKMERIKKRAEADLEERKKEFTETMAGEDPM

SEQ ID NO: 2881404 - protein, 49 aa, Entamoeba invadens
LKRQERKPRPMQDEEGKPKSEVQKEELNNQIPEKTGLQVEETQHHQNVL

SEQ ID NO: 2881405 - protein, 7 aa, Entamoeba invadens
LKRRDAL

SEQ ID NO: 2881406 - protein, 10 aa, Entamoeba invadens
LKRRGSKVPF

SEQ ID NO: 2881407 - protein, 8 aa, Entamoeba invadens
LKRSGPFG

SEQ ID NO: 2881408 - protein, 25 aa, Entamoeba invadens
LKRSNARDRRERREKEFEGKSQMEG

SEQ ID NO: 2881409 - protein, 8 aa, Entamoeba invadens
LKRSRELR

SEQ ID NO: 2881410 - protein, 8 aa, Entamoeba invadens
LKRSTNSF

SEQ ID NO: 2881411 - protein, 9 aa, Entamoeba invadens
LKRSTSSFI

SEQ ID NO: 2881412 - protein, 12 aa, Entamoeba invadens
LKRYSQNKNSNQ

SEQ ID NO: 2881413 - protein, 9 aa, Entamoeba invadens
LKSAAGTKY

SEQ ID NO: 2881414 - protein, 14 aa, Entamoeba invadens
LKSASEVLLTFLQQ

SEQ ID NO: 2881415 - protein, 7 aa, Entamoeba invadens
LKSDDNV

SEQ ID NO: 2881416 - protein, 9 aa, Entamoeba invadens
LKSDEEKNM

SEQ ID NO: 2881417 - protein, 9 aa, Entamoeba invadens
LKSDESKDA

SEQ ID NO: 2881418 - protein, 8 aa, Entamoeba invadens
LKSDGNFG

SEQ ID NO: 2881419 - protein, 13 aa, Entamoeba invadens
LKSDGNKKVEEEL

SEQ ID NO: 2881420 - protein, 23 aa, Entamoeba invadens
LKSDISTEKKYTTNTKQTDGTIE

SEQ ID NO: 2881421 - protein, 13 aa, Entamoeba invadens
LKSDNASLEVTPR

SEQ ID NO: 2881422 - protein, 9 aa, Entamoeba invadens
LKSDSKVSS

SEQ ID NO: 2881423 - protein, 9 aa, Entamoeba invadens
LKSDSPNVC

SEQ ID NO: 2881424 - protein, 48 aa, Entamoeba invadens
LKSDSQVERNGSPEVKKTCSCKSSALAQDTSSIKSGSDTISEKDDEDC

SEQ ID NO: 2881425 - protein, 7 aa, Entamoeba invadens
LKSEIDK

SEQ ID NO: 2881426 - protein, 7 aa, Entamoeba invadens
LKSEIER

SEQ ID NO: 2881427 - protein, 15 aa, Entamoeba invadens
LKSEKDMKKKTRVPN

SEQ ID NO: 2881428 - protein, 7 aa, Entamoeba invadens
LKSEKGI

SEQ ID NO: 2881429 - protein, 14 aa, Entamoeba invadens
LKSEKGKKRDPNPI

SEQ ID NO: 2881430 - protein, 7 aa, Entamoeba invadens
LKSELTK

SEQ ID NO: 2881431 - protein, 5 aa, Entamoeba invadens
LKSEN

SEQ ID NO: 2881432 - protein, 7 aa, Entamoeba invadens
LKSEQIG

SEQ ID NO: 2881433 - protein, 7 aa, Entamoeba invadens
LKSEQKT

SEQ ID NO: 2881434 - protein, 6 aa, Entamoeba invadens
LKSERD

SEQ ID NO: 2881435 - protein, 8 aa, Entamoeba invadens
LKSFTPKN

SEQ ID NO: 2881436 - protein, 4 aa, Entamoeba invadens
LKSG

SEQ ID NO: 2881437 - protein, 5 aa, Entamoeba invadens
LKSGE

SEQ ID NO: 2881438 - protein, 9 aa, Entamoeba invadens
LKSGEEQRM

SEQ ID NO: 2881439 - protein, 8 aa, Entamoeba invadens
LKSGGRDL

SEQ ID NO: 2881440 - protein, 9 aa, Entamoeba invadens
LKSGNCEDY

SEQ ID NO: 2881441 - protein, 10 aa, Entamoeba invadens
LKSGNKDLAR

SEQ ID NO: 2881442 - protein, 8 aa, Entamoeba invadens
LKSGRLNQ

SEQ ID NO: 2881443 - protein, 10 aa, Entamoeba invadens
LKSKDEEKQM

SEQ ID NO: 2881444 - protein, 9 aa, Entamoeba invadens
LKSKDTANQ

SEQ ID NO: 2881445 - protein, 7 aa, Entamoeba invadens
LKSKKTI

SEQ ID NO: 2881446 - protein, 8 aa, Entamoeba invadens
LKSKNKRD

SEQ ID NO: 2881447 - protein, 17 aa, Entamoeba invadens
LKSKQHVDRTPKNKTMD

SEQ ID NO: 2881448 - protein, 9 aa, Entamoeba invadens
LKSKRRDLA

SEQ ID NO: 2881449 - protein, 4 aa, Entamoeba invadens
LKSL

SEQ ID NO: 2881450 - protein, 39 aa, Entamoeba invadens
LKSLEQKDEKGKEKEKEKKEEEPKEKKDEKDIEREDKDL

SEQ ID NO: 2881451 - protein, 40 aa, Entamoeba invadens
LKSNDEQKVVNKEAQFTKAQENENVTGTSKEEKIGQKMET

SEQ ID NO: 2881452 - protein, 8 aa, Entamoeba invadens
LKSPEDHS

SEQ ID NO: 2881453 - protein, 45 aa, Entamoeba invadens
LKSPEKASFKKRSLSGNKKTEKVMSASSSPISSVQNSPRQRPCSD

SEQ ID NO: 2881454 - protein, 7 aa, Entamoeba invadens
LKSPELQ

SEQ ID NO: 2881455 - protein, 11 aa, Entamoeba invadens
LKSPPSDKTQP

SEQ ID NO: 2881456 - protein, 8 aa, Entamoeba invadens
LKSPSESL

SEQ ID NO: 2881457 - protein, 7 aa, Entamoeba invadens
LKSQETE

SEQ ID NO: 2881458 - protein, 5 aa, Entamoeba invadens
LKSQI

SEQ ID NO: 2881459 - protein, 21 aa, Entamoeba invadens
LKSQKKPIPPEIKEKGGCCSI

SEQ ID NO: 2881460 - protein, 14 aa, Entamoeba invadens
LKSQSELKDLRRTS

SEQ ID NO: 2881461 - protein, 14 aa, Entamoeba invadens
LKSQSQTSPDQRAQ

SEQ ID NO: 2881462 - protein, 11 aa, Entamoeba invadens
LKSRDKELNKE

SEQ ID NO: 2881463 - protein, 13 aa, Entamoeba invadens
LKSRDKGKVDKRV

SEQ ID NO: 2881464 - protein, 7 aa, Entamoeba invadens
LKSRGDI

SEQ ID NO: 2881465 - protein, 15 aa, Entamoeba invadens
LKSRTCQSPFKPVET

SEQ ID NO: 2881466 - protein, 9 aa, Entamoeba invadens
LKSSDFEEK

SEQ ID NO: 2881467 - protein, 8 aa, Entamoeba invadens
LKSSDGHV

SEQ ID NO: 2881468 - protein, 7 aa, Entamoeba invadens
LKSSDGN

SEQ ID NO: 2881469 - protein, 15 aa, Entamoeba invadens
LKSSEEEKTDYDKQI

SEQ ID NO: 2881470 - protein, 6 aa, Entamoeba invadens
LKSSEK

SEQ ID NO: 2881471 - protein, 10 aa, Entamoeba invadens
LKSSENKKID

SEQ ID NO: 2881472 - protein, 9 aa, Entamoeba invadens
LKSSESYEN

SEQ ID NO: 2881473 - protein, 8 aa, Entamoeba invadens
LKSSNKLK

SEQ ID NO: 2881474 - protein, 34 aa, Entamoeba invadens
LKSSSSKTVVKSTSPKVEEEGETELQKKLRLRRG

SEQ ID NO: 2881475 - protein, 37 aa, Entamoeba invadens
LKSSTSQENEKSDEKDEEEKSEEDDEPKKKMKRRIRS

SEQ ID NO: 2881476 - protein, 5 aa, Entamoeba invadens
LKSTE

SEQ ID NO: 2881477 - protein, 12 aa, Entamoeba invadens
LKSTKEYKAGDQ

SEQ ID NO: 2881478 - protein, 9 aa, Entamoeba invadens
LKSTTDEEF

SEQ ID NO: 2881479 - protein, 4 aa, Entamoeba invadens
LKSV

SEQ ID NO: 2881480 - protein, 5 aa, Entamoeba invadens
LKSVG

SEQ ID NO: 2881481 - protein, 14 aa, Entamoeba invadens
LKSVQDEAQKRKQA

SEQ ID NO: 2881482 - protein, 5 aa, Entamoeba invadens
LKSVR

SEQ ID NO: 2881483 - protein, 7 aa, Entamoeba invadens
LKSVRND

SEQ ID NO: 2881484 - protein, 5 aa, Entamoeba invadens
LKSYT

SEQ ID NO: 2881485 - protein, 18 aa, Entamoeba invadens
LKTAAENKSEEKKDEVDR

SEQ ID NO: 2881486 - protein, 8 aa, Entamoeba invadens
LKTAPKTT

SEQ ID NO: 2881487 - protein, 4 aa, Entamoeba invadens
LKTD

SEQ ID NO: 2881488 - protein, 8 aa, Entamoeba invadens
LKTDPKEH

SEQ ID NO: 2881489 - protein, 9 aa, Entamoeba invadens
LKTDQEKEK

SEQ ID NO: 2881490 - protein, 7 aa, Entamoeba invadens
LKTDTSK

SEQ ID NO: 2881491 - protein, 8 aa, Entamoeba invadens
LKTEANNA

SEQ ID NO: 2881492 - protein, 15 aa, Entamoeba invadens
LKTEDTDSNSGSKDS

SEQ ID NO: 2881493 - protein, 9 aa, Entamoeba invadens
LKTEEDVKK

SEQ ID NO: 2881494 - protein, 8 aa, Entamoeba invadens
LKTEEEMK

SEQ ID NO: 2881495 - protein, 10 aa, Entamoeba invadens
LKTEEENYNT

SEQ ID NO: 2881496 - protein, 9 aa, Entamoeba invadens
LKTEKGNRL

SEQ ID NO: 2881497 - protein, 23 aa, Entamoeba invadens
LKTEKVQLEEKDKTLEKRNKNLE

SEQ ID NO: 2881498 - protein, 9 aa, Entamoeba invadens
LKTETTEKL

SEQ ID NO: 2881499 - protein, 6 aa, Entamoeba invadens
LKTEYD

SEQ ID NO: 2881500 - protein, 8 aa, Entamoeba invadens
LKTGENEP

SEQ ID NO: 2881501 - protein, 6 aa, Entamoeba invadens
LKTGGT

SEQ ID NO: 2881502 - protein, 14 aa, Entamoeba invadens
LKTGRSSADGVPIN

SEQ ID NO: 2881503 - protein, 17 aa, Entamoeba invadens
LKTKDDEKIKEEFPTYT

SEQ ID NO: 2881504 - protein, 32 aa, Entamoeba invadens
LKTKETTKDREKTNYEKSENEIEKMRKEQSEI

SEQ ID NO: 2881505 - protein, 7 aa, Entamoeba invadens
LKTNATF

SEQ ID NO: 2881506 - protein, 7 aa, Entamoeba invadens
LKTNQRV

SEQ ID NO: 2881507 - protein, 15 aa, Entamoeba invadens
LKTNTNNTLSNTPKN

SEQ ID NO: 2881508 - protein, 15 aa, Entamoeba invadens
LKTPAATQQPTQNIE

SEQ ID NO: 2881509 - protein, 7 aa, Entamoeba invadens
LKTPEEA

SEQ ID NO: 2881510 - protein, 9 aa, Entamoeba invadens
LKTPERSRL

SEQ ID NO: 2881511 - protein, 18 aa, Entamoeba invadens
LKTPKVRSQSLDKWFVKK

SEQ ID NO: 2881512 - protein, 8 aa, Entamoeba invadens
LKTPPEDR

SEQ ID NO: 2881513 - protein, 13 aa, Entamoeba invadens
LKTPREKAQQTMV

SEQ ID NO: 2881514 - protein, 16 aa, Entamoeba invadens
LKTQQTTLKDKTEQCE

SEQ ID NO: 2881515 - protein, 7 aa, Entamoeba invadens
LKTRDEH

SEQ ID NO: 2881516 - protein, 11 aa, Entamoeba invadens
LKTSAGTPAYM

SEQ ID NO: 2881517 - protein, 8 aa, Entamoeba invadens
LKTSDGRR

SEQ ID NO: 2881518 - protein, 12 aa, Entamoeba invadens
LKTSDIDDKVDA

SEQ ID NO: 2881519 - protein, 5 aa, Entamoeba invadens
LKTSF

SEQ ID NO: 2881520 - protein, 11 aa, Entamoeba invadens
LKTSKGAASNN

SEQ ID NO: 2881521 - protein, 51 aa, Entamoeba invadens
LKTSPQNSSNLSLSTGGQAEKKVGNSLRPKITKRTERQKAEAKAKATGELK

SEQ ID NO: 2881522 - protein, 8 aa, Entamoeba invadens
LKTSQDKD

SEQ ID NO: 2881523 - protein, 7 aa, Entamoeba invadens
LKTSQSK

SEQ ID NO: 2881524 - protein, 25 aa, Entamoeba invadens
LKTTEEEKVKIESELKKKDDELNVA

SEQ ID NO: 2881525 - protein, 11 aa, Entamoeba invadens
LKTTGFKPSLV

SEQ ID NO: 2881526 - protein, 10 aa, Entamoeba invadens
LKTTKSDDFG

SEQ ID NO: 2881527 - protein, 5 aa, Entamoeba invadens
LKTTQ

SEQ ID NO: 2881528 - protein, 8 aa, Entamoeba invadens
LKTTRKSI

SEQ ID NO: 2881529 - protein, 11 aa, Entamoeba invadens
LKTTSAPPHPF

SEQ ID NO: 2881530 - protein, 7 aa, Entamoeba invadens
LKTTTRT

SEQ ID NO: 2881531 - protein, 18 aa, Entamoeba invadens
LKTVQQQKKDLEDIREQR

SEQ ID NO: 2881532 - protein, 6 aa, Entamoeba invadens
LKTYEA

SEQ ID NO: 2881533 - protein, 10 aa, Entamoeba invadens
LKTYENTQRQ

SEQ ID NO: 2881534 - protein, 7 aa, Entamoeba invadens
LKTYSGE

SEQ ID NO: 2881535 - protein, 7 aa, Entamoeba invadens
LKVDPSG

SEQ ID NO: 2881536 - protein, 5 aa, Entamoeba invadens
LKVET

SEQ ID NO: 2881537 - protein, 19 aa, Entamoeba invadens
LKVNANNSKVIQKQEKQKT

SEQ ID NO: 2881538 - protein, 7 aa, Entamoeba invadens
LKVPENR

SEQ ID NO: 2881539 - protein, 5 aa, Entamoeba invadens
LKVQT

SEQ ID NO: 2881540 - protein, 5 aa, Entamoeba invadens
LKVTD

SEQ ID NO: 2881541 - protein, 9 aa, Entamoeba invadens
LKYAPGDAQ

SEQ ID NO: 2881542 - protein, 21 aa, Entamoeba invadens
LKYDKSLKTEPRVPKPTAPVA

SEQ ID NO: 2881543 - protein, 6 aa, Entamoeba invadens
LKYEGN

SEQ ID NO: 2881544 - protein, 5 aa, Entamoeba invadens
LKYRS

SEQ ID NO: 2881545 - protein, 23 aa, Entamoeba invadens
LLADKTDKSSDFRQMKKTESPFI

SEQ ID NO: 2881546 - protein, 5 aa, Entamoeba invadens
LLAQR

SEQ ID NO: 2881547 - protein, 20 aa, Entamoeba invadens
LLDPRKETFAHQDDKKSSLF

SEQ ID NO: 2881548 - protein, 7 aa, Entamoeba invadens
LLEDTGK

SEQ ID NO: 2881549 - protein, 8 aa, Entamoeba invadens
LLEPTNDN

SEQ ID NO: 2881550 - protein, 10 aa, Entamoeba invadens
LLGGNHTTNK

SEQ ID NO: 2881551 - protein, 6 aa, Entamoeba invadens
LLGPNG

SEQ ID NO: 2881552 - protein, 7 aa, Entamoeba invadens
LLGPNSS

SEQ ID NO: 2881553 - protein, 10 aa, Entamoeba invadens
LLKDQSPQLV

SEQ ID NO: 2881554 - protein, 18 aa, Entamoeba invadens
LLKPTKSLKQSRKTNLQK

SEQ ID NO: 2881555 - protein, 5 aa, Entamoeba invadens
LLNEG

SEQ ID NO: 2881556 - protein, 43 aa, Entamoeba invadens
LLNQSSDSFDSEDSNAENNPNNSYPDTPTSDSISNDSYSGDYY

SEQ ID NO: 2881557 - protein, 9 aa, Entamoeba invadens
LLNSTEGGY

SEQ ID NO: 2881558 - protein, 9 aa, Entamoeba invadens
LLPAEGTKK

SEQ ID NO: 2881559 - protein, 31 aa, Entamoeba invadens
LLPDSTSVFPTAENKTQKVPKMKGERNFKNN

SEQ ID NO: 2881560 - protein, 39 aa, Entamoeba invadens
LLPEGESVSPNVPQEKSPVEHKSPLSSSIRPTNEKSLED

SEQ ID NO: 2881561 - protein, 4 aa, Entamoeba invadens
LLPG

SEQ ID NO: 2881562 - protein, 6 aa, Entamoeba invadens
LLPGDG

SEQ ID NO: 2881563 - protein, 9 aa, Entamoeba invadens
LLPGKRGSL

SEQ ID NO: 2881564 - protein, 9 aa, Entamoeba invadens
LLPPKDDER

SEQ ID NO: 2881565 - protein, 7 aa, Entamoeba invadens
LLPPPEV

SEQ ID NO: 2881566 - protein, 37 aa, Entamoeba invadens
LLPPPGLAPPAGLAPPPNIPPPPQSNKQAPAVKPKAS

SEQ ID NO: 2881567 - protein, 48 aa, Entamoeba invadens
LLPPPGMAPPANLPPPPQFNASGAPKLNIPTKSSQQQQPRPSTGSTDL

SEQ ID NO: 2881568 - protein, 6 aa, Entamoeba invadens
LLPPQD

SEQ ID NO: 2881569 - protein, 13 aa, Entamoeba invadens
LLPQNDQYADQNR

SEQ ID NO: 2881570 - protein, 21 aa, Entamoeba invadens
LLQPQEKVTRYSPLTTQHPSN

SEQ ID NO: 2881571 - protein, 29 aa, Entamoeba invadens
LLSDNDTQTPREKQKKTGCMSDREDSGHK

SEQ ID NO: 2881572 - protein, 4 aa, Entamoeba invadens
LLSE

SEQ ID NO: 2881573 - protein, 24 aa, Entamoeba invadens
LLSEEEMKTAEKEMRAKVEEQKYA

SEQ ID NO: 2881574 - protein, 4 aa, Entamoeba invadens
LLSK

SEQ ID NO: 2881575 - protein, 11 aa, Entamoeba invadens
LLSQPQPQSLS

SEQ ID NO: 2881576 - protein, 13 aa, Entamoeba invadens
LLSSEKKKLEDEY

SEQ ID NO: 2881577 - protein, 12 aa, Entamoeba invadens
LLSSEKKKLQYE

SEQ ID NO: 2881578 - protein, 4 aa, Entamoeba invadens
LLTG

SEQ ID NO: 2881579 - protein, 7 aa, Entamoeba invadens
LLTGGKE

SEQ ID NO: 2881580 - protein, 4 aa, Entamoeba invadens
LMES

SEQ ID NO: 2881581 - protein, 4 aa, Entamoeba invadens
LMGG

SEQ ID NO: 2881582 - protein, 7 aa, Entamoeba invadens
LMPDPRR

SEQ ID NO: 2881583 - protein, 9 aa, Entamoeba invadens
LMSGNEGLT

SEQ ID NO: 2881584 - protein, 14 aa, Entamoeba invadens
LMSKPAPEKKKDKK

SEQ ID NO: 2881585 - protein, 4 aa, Entamoeba invadens
LMST

SEQ ID NO: 2881586 - protein, 7 aa, Entamoeba invadens
LNAEQSS

SEQ ID NO: 2881587 - protein, 8 aa, Entamoeba invadens
LNAETTEK

SEQ ID NO: 2881588 - protein, 20 aa, Entamoeba invadens
LNAKKTNSQQFSSLNTSNQC

SEQ ID NO: 2881589 - protein, 16 aa, Entamoeba invadens
LNANGEQAETPRESEL

SEQ ID NO: 2881590 - protein, 24 aa, Entamoeba invadens
LNAPKKECENLGTVQKGAGGKPHD

SEQ ID NO: 2881591 - protein, 25 aa, Entamoeba invadens
LNAPKKECENLGTVQKGQGSGKPHD

SEQ ID NO: 2881592 - protein, 7 aa, Entamoeba invadens
LNAPTPT

SEQ ID NO: 2881593 - protein, 6 aa, Entamoeba invadens
LNAQKA

SEQ ID NO: 2881594 - protein, 18 aa, Entamoeba invadens
LNAQNSQEQILNSTRNKT

SEQ ID NO: 2881595 - protein, 8 aa, Entamoeba invadens
LNARTSKE

SEQ ID NO: 2881596 - protein, 20 aa, Entamoeba invadens
LNASTSHTNDMPQSVKSVDK

SEQ ID NO: 2881597 - protein, 5 aa, Entamoeba invadens
LNCTE

SEQ ID NO: 2881598 - protein, 11 aa, Entamoeba invadens
LNDDDDVTCDN

SEQ ID NO: 2881599 - protein, 11 aa, Entamoeba invadens
LNDDETKRMRT

SEQ ID NO: 2881600 - protein, 21 aa, Entamoeba invadens
LNDDKNGNQIEKSIPSGKITK

SEQ ID NO: 2881601 - protein, 6 aa, Entamoeba invadens
LNDDNV

SEQ ID NO: 2881602 - protein, 5 aa, Entamoeba invadens
LNDDS

SEQ ID NO: 2881603 - protein, 6 aa, Entamoeba invadens
LNDDSV

SEQ ID NO: 2881604 - protein, 19 aa, Entamoeba invadens
LNDEKSVSSSVSKIFDFVK

SEQ ID NO: 2881605 - protein, 7 aa, Entamoeba invadens
LNDENKG

SEQ ID NO: 2881606 - protein, 11 aa, Entamoeba invadens
LNDENKSKRKD

SEQ ID NO: 2881607 - protein, 4 aa, Entamoeba invadens
LNDG

SEQ ID NO: 2881608 - protein, 6 aa, Entamoeba invadens
LNDGEQ

SEQ ID NO: 2881609 - protein, 17 aa, Entamoeba invadens
LNDGETVSQPKSDIVSS

SEQ ID NO: 2881610 - protein, 12 aa, Entamoeba invadens
LNDGETVYQPKA

SEQ ID NO: 2881611 - protein, 8 aa, Entamoeba invadens
LNDGKGNI

SEQ ID NO: 2881612 - protein, 8 aa, Entamoeba invadens
LNDGKKYT

SEQ ID NO: 2881613 - protein, 57 aa, Entamoeba invadens
LNDKDSFDDDESEDSNEEGEEKNEKTKSETMKSEMKEKEKSEEEEEDSEEDFDDDES

SEQ ID NO: 2881614 - protein, 10 aa, Entamoeba invadens
LNDKKPKDFG

SEQ ID NO: 2881615 - protein, 8 aa, Entamoeba invadens
LNDKSKTL

SEQ ID NO: 2881616 - protein, 11 aa, Entamoeba invadens
LNDKSTPVRKN

SEQ ID NO: 2881617 - protein, 6 aa, Entamoeba invadens
LNDKTA

SEQ ID NO: 2881618 - protein, 6 aa, Entamoeba invadens
LNDNGK

SEQ ID NO: 2881619 - protein, 8 aa, Entamoeba invadens
LNDNYKSE

SEQ ID NO: 2881620 - protein, 9 aa, Entamoeba invadens
LNDPKITAN

SEQ ID NO: 2881621 - protein, 8 aa, Entamoeba invadens
LNDQNIAE

SEQ ID NO: 2881622 - protein, 9 aa, Entamoeba invadens
LNDQQKLRG

SEQ ID NO: 2881623 - protein, 6 aa, Entamoeba invadens
LNDSEK

SEQ ID NO: 2881624 - protein, 9 aa, Entamoeba invadens
LNDSGLKQK

SEQ ID NO: 2881625 - protein, 16 aa, Entamoeba invadens
LNDSKAKGTNKKKCVL

SEQ ID NO: 2881626 - protein, 16 aa, Entamoeba invadens
LNDSKQKMEVENEQME

SEQ ID NO: 2881627 - protein, 7 aa, Entamoeba invadens
LNDSNLR

SEQ ID NO: 2881628 - protein, 17 aa, Entamoeba invadens
LNDSSTVEHQNEMEPED

SEQ ID NO: 2881629 - protein, 5 aa, Entamoeba invadens
LNDTC

SEQ ID NO: 2881630 - protein, 10 aa, Entamoeba invadens
LNDTKSGTPL

SEQ ID NO: 2881631 - protein, 7 aa, Entamoeba invadens
LNDTPTV

SEQ ID NO: 2881632 - protein, 6 aa, Entamoeba invadens
LNDVDT

SEQ ID NO: 2881633 - protein, 8 aa, Entamoeba invadens
LNDYSPKI

SEQ ID NO: 2881634 - protein, 12 aa, Entamoeba invadens
LNEAKKKIHADS

SEQ ID NO: 2881635 - protein, 5 aa, Entamoeba invadens
LNEAL

SEQ ID NO: 2881636 - protein, 7 aa, Entamoeba invadens
LNEDECK

SEQ ID NO: 2881637 - protein, 35 aa, Entamoeba invadens
LNEDTTTKATTNQSKKMELPQESVKPNFPRGVPTK

SEQ ID NO: 2881638 - protein, 7 aa, Entamoeba invadens
LNEDYKK

SEQ ID NO: 2881639 - protein, 29 aa, Entamoeba invadens
LNEEDTSTTHCNPPSYTQNRLKDKAREVV

SEQ ID NO: 2881640 - protein, 7 aa, Entamoeba invadens
LNEEEDV

SEQ ID NO: 2881641 - protein, 11 aa, Entamoeba invadens
LNEEGGKRWSK

SEQ ID NO: 2881642 - protein, 13 aa, Entamoeba invadens
LNEEQKKNEEILK

SEQ ID NO: 2881643 - protein, 15 aa, Entamoeba invadens
LNEEREQTPVAPEFS

SEQ ID NO: 2881644 - protein, 31 aa, Entamoeba invadens
LNEESHKLAEKTEVKDKKDVKLDSKLESNST

SEQ ID NO: 2881645 - protein, 15 aa, Entamoeba invadens
LNEESKKEKQENTKI

SEQ ID NO: 2881646 - protein, 10 aa, Entamoeba invadens
LNEGDSKTIN

SEQ ID NO: 2881647 - protein, 6 aa, Entamoeba invadens
LNEGHG

SEQ ID NO: 2881648 - protein, 7 aa, Entamoeba invadens
LNEGKAF

SEQ ID NO: 2881649 - protein, 7 aa, Entamoeba invadens
LNEGTAN

SEQ ID NO: 2881650 - protein, 9 aa, Entamoeba invadens
LNEKDEKKF

SEQ ID NO: 2881651 - protein, 7 aa, Entamoeba invadens
LNEKDRD

SEQ ID NO: 2881652 - protein, 23 aa, Entamoeba invadens
LNEKEDQKGVQQKDAKLNEVHRN

SEQ ID NO: 2881653 - protein, 7 aa, Entamoeba invadens
LNEKESE

SEQ ID NO: 2881654 - protein, 10 aa, Entamoeba invadens
LNEKGESNGF

SEQ ID NO: 2881655 - protein, 5 aa, Entamoeba invadens
LNEKI

SEQ ID NO: 2881656 - protein, 10 aa, Entamoeba invadens
LNEKKESFKE

SEQ ID NO: 2881657 - protein, 8 aa, Entamoeba invadens
LNEKKRDS

SEQ ID NO: 2881658 - protein, 9 aa, Entamoeba invadens
LNEKQKEEW

SEQ ID NO: 2881659 - protein, 6 aa, Entamoeba invadens
LNEKRG

SEQ ID NO: 2881660 - protein, 5 aa, Entamoeba invadens
LNELP

SEQ ID NO: 2881661 - protein, 4 aa, Entamoeba invadens
LNEM

SEQ ID NO: 2881662 - protein, 34 aa, Entamoeba invadens
LNENFERTEKVERSDKLPKAQGYARIEKPDNFDS

SEQ ID NO: 2881663 - protein, 11 aa, Entamoeba invadens
LNENKSLTQKM

SEQ ID NO: 2881664 - protein, 16 aa, Entamoeba invadens
LNENRKRQERLEEEKE

SEQ ID NO: 2881665 - protein, 8 aa, Entamoeba invadens
LNENSANG

SEQ ID NO: 2881666 - protein, 7 aa, Entamoeba invadens
LNENTLE

SEQ ID NO: 2881667 - protein, 9 aa, Entamoeba invadens
LNEPPRTIT

SEQ ID NO: 2881668 - protein, 15 aa, Entamoeba invadens
LNEPQKIKNFFVLQF

SEQ ID NO: 2881669 - protein, 10 aa, Entamoeba invadens
LNEPSKRNAG

SEQ ID NO: 2881670 - protein, 11 aa, Entamoeba invadens
LNEQNETLKKQ

SEQ ID NO: 2881671 - protein, 24 aa, Entamoeba invadens
LNEQNETLKKQLDSTEDKNNNITS

SEQ ID NO: 2881672 - protein, 12 aa, Entamoeba invadens
LNEQQDGMNQNE

SEQ ID NO: 2881673 - protein, 78 aa, Entamoeba invadens
LNEQVEEEVEEKETIEVPEEVKKEEPKKAEEPKEDKKDKKDTPVAEAEKEGENNTKEAPKKMEEEVKKETPPAEPVKP

SEQ ID NO: 2881674 - protein, 14 aa, Entamoeba invadens
LNESDKQNVTDVSN

SEQ ID NO: 2881675 - protein, 8 aa, Entamoeba invadens
LNESNRDD

SEQ ID NO: 2881676 - protein, 11 aa, Entamoeba invadens
LNESPKSCARH

SEQ ID NO: 2881677 - protein, 5 aa, Entamoeba invadens
LNESQ

SEQ ID NO: 2881678 - protein, 5 aa, Entamoeba invadens
LNESY

SEQ ID NO: 2881679 - protein, 4 aa, Entamoeba invadens
LNET

SEQ ID NO: 2881680 - protein, 7 aa, Entamoeba invadens
LNETEKE

SEQ ID NO: 2881681 - protein, 15 aa, Entamoeba invadens
LNETERGSSGFGSTG

SEQ ID NO: 2881682 - protein, 5 aa, Entamoeba invadens
LNETL

SEQ ID NO: 2881683 - protein, 10 aa, Entamoeba invadens
LNETLPSPFS

SEQ ID NO: 2881684 - protein, 16 aa, Entamoeba invadens
LNETNGKDGLVLQYAK

SEQ ID NO: 2881685 - protein, 23 aa, Entamoeba invadens
LNETRSKNRLKNYSKKGLPKRET

SEQ ID NO: 2881686 - protein, 9 aa, Entamoeba invadens
LNEVTNPTT

SEQ ID NO: 2881687 - protein, 6 aa, Entamoeba invadens
LNEYNS

SEQ ID NO: 2881688 - protein, 15 aa, Entamoeba invadens
LNGAEGWIPNNYVKE

SEQ ID NO: 2881689 - protein, 12 aa, Entamoeba invadens
LNGAKAKLKGFQ

SEQ ID NO: 2881690 - protein, 11 aa, Entamoeba invadens
LNGDDEQYANV

SEQ ID NO: 2881691 - protein, 7 aa, Entamoeba invadens
LNGENEW

SEQ ID NO: 2881692 - protein, 9 aa, Entamoeba invadens
LNGEQVGET

SEQ ID NO: 2881693 - protein, 6 aa, Entamoeba invadens
LNGETF

SEQ ID NO: 2881694 - protein, 6 aa, Entamoeba invadens
LNGGDD

SEQ ID NO: 2881695 - protein, 10 aa, Entamoeba invadens
LNGGNKTDVE

SEQ ID NO: 2881696 - protein, 19 aa, Entamoeba invadens
LNGHKGAVTTLATSTARPD

SEQ ID NO: 2881697 - protein, 11 aa, Entamoeba invadens
LNGHRPNQLNE

SEQ ID NO: 2881698 - protein, 12 aa, Entamoeba invadens
LNGIGSKESPIC

SEQ ID NO: 2881699 - protein, 6 aa, Entamoeba invadens
LNGKNV

SEQ ID NO: 2881700 - protein, 9 aa, Entamoeba invadens
LNGKSDTIE

SEQ ID NO: 2881701 - protein, 6 aa, Entamoeba invadens
LNGNGS

SEQ ID NO: 2881702 - protein, 9 aa, Entamoeba invadens
LNGNNSSSI

SEQ ID NO: 2881703 - protein, 6 aa, Entamoeba invadens
LNGNNV

SEQ ID NO: 2881704 - protein, 12 aa, Entamoeba invadens
LNGNSIREIPQD

SEQ ID NO: 2881705 - protein, 7 aa, Entamoeba invadens
LNGNVPI

SEQ ID NO: 2881706 - protein, 14 aa, Entamoeba invadens
LNGPKTSQNPTPFK

SEQ ID NO: 2881707 - protein, 6 aa, Entamoeba invadens
LNGRGT

SEQ ID NO: 2881708 - protein, 13 aa, Entamoeba invadens
LNGRKEEWYPPGH

SEQ ID NO: 2881709 - protein, 13 aa, Entamoeba invadens
LNGSDGASRLTNE

SEQ ID NO: 2881710 - protein, 14 aa, Entamoeba invadens
LNGSKNKSVEESLS

SEQ ID NO: 2881711 - protein, 8 aa, Entamoeba invadens
LNGSQFKD

SEQ ID NO: 2881712 - protein, 6 aa, Entamoeba invadens
LNGTDF

SEQ ID NO: 2881713 - protein, 10 aa, Entamoeba invadens
LNGTKEGLGH

SEQ ID NO: 2881714 - protein, 6 aa, Entamoeba invadens
LNGTKS

SEQ ID NO: 2881715 - protein, 10 aa, Entamoeba invadens
LNGTKVENRK

SEQ ID NO: 2881716 - protein, 6 aa, Entamoeba invadens
LNGTNK

SEQ ID NO: 2881717 - protein, 8 aa, Entamoeba invadens
LNGTQKSL

SEQ ID NO: 2881718 - protein, 10 aa, Entamoeba invadens
LNGTTNETTI

SEQ ID NO: 2881719 - protein, 10 aa, Entamoeba invadens
LNGVKQGNDS

SEQ ID NO: 2881720 - protein, 5 aa, Entamoeba invadens
LNHEK

SEQ ID NO: 2881721 - protein, 4 aa, Entamoeba invadens
LNHP

SEQ ID NO: 2881722 - protein, 28 aa, Entamoeba invadens
LNHQKQRAEDLKGKISGINAEEKDLNDT

SEQ ID NO: 2881723 - protein, 4 aa, Entamoeba invadens
LNIE

SEQ ID NO: 2881724 - protein, 4 aa, Entamoeba invadens
LNIK

SEQ ID NO: 2881725 - protein, 10 aa, Entamoeba invadens
LNIKKQSRKS

SEQ ID NO: 2881726 - protein, 11 aa, Entamoeba invadens
LNITGSSNGIS

SEQ ID NO: 2881727 - protein, 9 aa, Entamoeba invadens
LNKAQRESL

SEQ ID NO: 2881728 - protein, 14 aa, Entamoeba invadens
LNKATAAGQMEGRV

SEQ ID NO: 2881729 - protein, 5 aa, Entamoeba invadens
LNKDG

SEQ ID NO: 2881730 - protein, 9 aa, Entamoeba invadens
LNKDKPFEF

SEQ ID NO: 2881731 - protein, 10 aa, Entamoeba invadens
LNKEDQDSLT

SEQ ID NO: 2881732 - protein, 7 aa, Entamoeba invadens
LNKEENL

SEQ ID NO: 2881733 - protein, 6 aa, Entamoeba invadens
LNKEIS

SEQ ID NO: 2881734 - protein, 7 aa, Entamoeba invadens
LNKEREV

SEQ ID NO: 2881735 - protein, 14 aa, Entamoeba invadens
LNKGEDDNKNTESF

SEQ ID NO: 2881736 - protein, 10 aa, Entamoeba invadens
LNKGTKTTKF

SEQ ID NO: 2881737 - protein, 7 aa, Entamoeba invadens
LNKHSNG

SEQ ID NO: 2881738 - protein, 7 aa, Entamoeba invadens
LNKKQEY

SEQ ID NO: 2881739 - protein, 9 aa, Entamoeba invadens
LNKKRAENV

SEQ ID NO: 2881740 - protein, 4 aa, Entamoeba invadens
LNKN

SEQ ID NO: 2881741 - protein, 9 aa, Entamoeba invadens
LNKPNENGK

SEQ ID NO: 2881742 - protein, 11 aa, Entamoeba invadens
LNKPVTPTTSL

SEQ ID NO: 2881743 - protein, 7 aa, Entamoeba invadens
LNKQSDV

SEQ ID NO: 2881744 - protein, 4 aa, Entamoeba invadens
LNKR

SEQ ID NO: 2881745 - protein, 10 aa, Entamoeba invadens
LNKSGSLGRE

SEQ ID NO: 2881746 - protein, 10 aa, Entamoeba invadens
LNKSRDVRAL

SEQ ID NO: 2881747 - protein, 10 aa, Entamoeba invadens
LNKTEEEPYP

SEQ ID NO: 2881748 - protein, 9 aa, Entamoeba invadens
LNKTETSQM

SEQ ID NO: 2881749 - protein, 11 aa, Entamoeba invadens
LNKTGEKSVLT

SEQ ID NO: 2881750 - protein, 8 aa, Entamoeba invadens
LNKTSDEK

SEQ ID NO: 2881751 - protein, 18 aa, Entamoeba invadens
LNLTSSAEDILNGNKKST

SEQ ID NO: 2881752 - protein, 4 aa, Entamoeba invadens
LNND

SEQ ID NO: 2881753 - protein, 7 aa, Entamoeba invadens
LNNEHPQ

SEQ ID NO: 2881754 - protein, 25 aa, Entamoeba invadens
LNNEKSEHGKEEKILEGAEASISGS

SEQ ID NO: 2881755 - protein, 30 aa, Entamoeba invadens
LNNEKSQTNSTESKKLERSTSLSPQHKTDD

SEQ ID NO: 2881756 - protein, 6 aa, Entamoeba invadens
LNNEKT

SEQ ID NO: 2881757 - protein, 11 aa, Entamoeba invadens
LNNGEEKKSRL

SEQ ID NO: 2881758 - protein, 7 aa, Entamoeba invadens
LNNGVKE

SEQ ID NO: 2881759 - protein, 10 aa, Entamoeba invadens
LNNKDIKEAY

SEQ ID NO: 2881760 - protein, 18 aa, Entamoeba invadens
LNNKKKAEAPRGSWEEKK

SEQ ID NO: 2881761 - protein, 8 aa, Entamoeba invadens
LNNKKTLE

SEQ ID NO: 2881762 - protein, 6 aa, Entamoeba invadens
LNNNEE

SEQ ID NO: 2881763 - protein, 7 aa, Entamoeba invadens
LNNNSHP

SEQ ID NO: 2881764 - protein, 9 aa, Entamoeba invadens
LNNNSSSLE

SEQ ID NO: 2881765 - protein, 5 aa, Entamoeba invadens
LNNNT

SEQ ID NO: 2881766 - protein, 5 aa, Entamoeba invadens
LNNPD

SEQ ID NO: 2881767 - protein, 8 aa, Entamoeba invadens
LNNQKGIN

SEQ ID NO: 2881768 - protein, 4 aa, Entamoeba invadens
LNNR

SEQ ID NO: 2881769 - protein, 14 aa, Entamoeba invadens
LNNRDQRDKHPTLS

SEQ ID NO: 2881770 - protein, 25 aa, Entamoeba invadens
LNNRSSDNLAPSSSLVASSTTTPQI

SEQ ID NO: 2881771 - protein, 18 aa, Entamoeba invadens
LNNSDWRSLRGKGDYAKK

SEQ ID NO: 2881772 - protein, 9 aa, Entamoeba invadens
LNNSGKRTA

SEQ ID NO: 2881773 - protein, 24 aa, Entamoeba invadens
LNNTLNTTSESGNTREDDGERDTV

SEQ ID NO: 2881774 - protein, 12 aa, Entamoeba invadens
LNNTQQSQQQYQ

SEQ ID NO: 2881775 - protein, 7 aa, Entamoeba invadens
LNPAQTQ

SEQ ID NO: 2881776 - protein, 5 aa, Entamoeba invadens
LNPAS

SEQ ID NO: 2881777 - protein, 12 aa, Entamoeba invadens
LNPDNAKAYKMR

SEQ ID NO: 2881778 - protein, 9 aa, Entamoeba invadens
LNPDSTVNE

SEQ ID NO: 2881779 - protein, 8 aa, Entamoeba invadens
LNPEDQEI

SEQ ID NO: 2881780 - protein, 6 aa, Entamoeba invadens
LNPEES

SEQ ID NO: 2881781 - protein, 14 aa, Entamoeba invadens
LNPELKKEYDDLPK

SEQ ID NO: 2881782 - protein, 7 aa, Entamoeba invadens
LNPENNF

SEQ ID NO: 2881783 - protein, 12 aa, Entamoeba invadens
LNPEPQPQRGQD

SEQ ID NO: 2881784 - protein, 7 aa, Entamoeba invadens
LNPETTD

SEQ ID NO: 2881785 - protein, 6 aa, Entamoeba invadens
LNPGIT

SEQ ID NO: 2881786 - protein, 18 aa, Entamoeba invadens
LNPGKKLPTDSKEYKGKM

SEQ ID NO: 2881787 - protein, 15 aa, Entamoeba invadens
LNPIESSGAHGKPIL

SEQ ID NO: 2881788 - protein, 5 aa, Entamoeba invadens
LNPIG

SEQ ID NO: 2881789 - protein, 7 aa, Entamoeba invadens
LNPKDIE

SEQ ID NO: 2881790 - protein, 12 aa, Entamoeba invadens
LNPKEGKTATTN

SEQ ID NO: 2881791 - protein, 21 aa, Entamoeba invadens
LNPKEIQSEKFKSVEDERRKT

SEQ ID NO: 2881792 - protein, 8 aa, Entamoeba invadens
LNPKGELY

SEQ ID NO: 2881793 - protein, 13 aa, Entamoeba invadens
LNPKIKQELRDAD

SEQ ID NO: 2881794 - protein, 6 aa, Entamoeba invadens
LNPKSV

SEQ ID NO: 2881795 - protein, 9 aa, Entamoeba invadens
LNPNDAKFD

SEQ ID NO: 2881796 - protein, 8 aa, Entamoeba invadens
LNPNETSA

SEQ ID NO: 2881797 - protein, 6 aa, Entamoeba invadens
LNPPEV

SEQ ID NO: 2881798 - protein, 5 aa, Entamoeba invadens
LNPPH

SEQ ID NO: 2881799 - protein, 20 aa, Entamoeba invadens
LNPPNNTYQRNANSQRKGNV

SEQ ID NO: 2881800 - protein, 44 aa, Entamoeba invadens
LNPPNSSPLRSSAASPNLPDSSPLSPVTSPDVRSRSSSSAALEQ

SEQ ID NO: 2881801 - protein, 14 aa, Entamoeba invadens
LNPPPETQNEQAPL

SEQ ID NO: 2881802 - protein, 13 aa, Entamoeba invadens
LNPPPKSKPQKRV

SEQ ID NO: 2881803 - protein, 5 aa, Entamoeba invadens
LNPQL

SEQ ID NO: 2881804 - protein, 12 aa, Entamoeba invadens
LNPQSVEKTPQL

SEQ ID NO: 2881805 - protein, 10 aa, Entamoeba invadens
LNPQSYKPTY

SEQ ID NO: 2881806 - protein, 93 aa, Entamoeba invadens
LNPQVSSLKKADSADAVRKTDSQKELEKERAMKQEADKETQRLGAKVTDSEAKLADAELEGIETEKEEAQNTAAKAKKQAKQYARKVEEAERK

SEQ ID NO: 2881807 - protein, 4 aa, Entamoeba invadens
LNPR

SEQ ID NO: 2881808 - protein, 11 aa, Entamoeba invadens
LNPRKRGTRKS

SEQ ID NO: 2881809 - protein, 5 aa, Entamoeba invadens
LNPRW

SEQ ID NO: 2881810 - protein, 20 aa, Entamoeba invadens
LNPSDADDFNVNTKEVDDHY

SEQ ID NO: 2881811 - protein, 7 aa, Entamoeba invadens
LNPSEHP

SEQ ID NO: 2881812 - protein, 5 aa, Entamoeba invadens
LNPSI

SEQ ID NO: 2881813 - protein, 9 aa, Entamoeba invadens
LNPSIGFSE

SEQ ID NO: 2881814 - protein, 39 aa, Entamoeba invadens
LNPSNESPSRTPTQKHEKKENPQNTKVTAREARANKKTI

SEQ ID NO: 2881815 - protein, 17 aa, Entamoeba invadens
LNPSPYSTQSDYKCDNQ

SEQ ID NO: 2881816 - protein, 8 aa, Entamoeba invadens
LNPSREHL

SEQ ID NO: 2881817 - protein, 5 aa, Entamoeba invadens
LNPTD

SEQ ID NO: 2881818 - protein, 7 aa, Entamoeba invadens
LNPTDKG

SEQ ID NO: 2881819 - protein, 5 aa, Entamoeba invadens
LNPTH

SEQ ID NO: 2881820 - protein, 15 aa, Entamoeba invadens
LNPTKKDESASKSSL

SEQ ID NO: 2881821 - protein, 27 aa, Entamoeba invadens
LNPTKQQCEPRSPRSPRKKSDADTSIE

SEQ ID NO: 2881822 - protein, 10 aa, Entamoeba invadens
LNPTTSSSHF

SEQ ID NO: 2881823 - protein, 21 aa, Entamoeba invadens
LNPTTTTDTNGIDESQMNEND

SEQ ID NO: 2881824 - protein, 9 aa, Entamoeba invadens
LNQDKEKNF

SEQ ID NO: 2881825 - protein, 5 aa, Entamoeba invadens
LNQEE

SEQ ID NO: 2881826 - protein, 18 aa, Entamoeba invadens
LNQEGKDPKLNHGNPKTL

SEQ ID NO: 2881827 - protein, 6 aa, Entamoeba invadens
LNQHKG

SEQ ID NO: 2881828 - protein, 10 aa, Entamoeba invadens
LNQKASSEEY

SEQ ID NO: 2881829 - protein, 28 aa, Entamoeba invadens
LNQKEELDRNSKTPQNVKTPLVEEDTTH

SEQ ID NO: 2881830 - protein, 9 aa, Entamoeba invadens
LNQKPKEGY

SEQ ID NO: 2881831 - protein, 12 aa, Entamoeba invadens
LNQKQKNRSTVV

SEQ ID NO: 2881832 - protein, 7 aa, Entamoeba invadens
LNQKTRK

SEQ ID NO: 2881833 - protein, 4 aa, Entamoeba invadens
LNQN

SEQ ID NO: 2881834 - protein, 8 aa, Entamoeba invadens
LNQNDTKY

SEQ ID NO: 2881835 - protein, 7 aa, Entamoeba invadens
LNQQNND

SEQ ID NO: 2881836 - protein, 5 aa, Entamoeba invadens
LNQQT

SEQ ID NO: 2881837 - protein, 5 aa, Entamoeba invadens
LNQSG

SEQ ID NO: 2881838 - protein, 9 aa, Entamoeba invadens
LNQSQKVSE

SEQ ID NO: 2881839 - protein, 7 aa, Entamoeba invadens
LNQSQRA

SEQ ID NO: 2881840 - protein, 9 aa, Entamoeba invadens
LNQTKSQLD

SEQ ID NO: 2881841 - protein, 162 aa, Entamoeba invadens
LNQTQQKQTPQQQSQYPPQQTQGQYPPQQQYQQYPPQGQQQKYPQQPGQYPPQQYQQYPPQGQYPPQQGAYQQQTYPPQGQYNQPGYPPQQYGQQPQGAYPPQGYPPQQYQMQPGQSAPQQGAYPPQQPGQYQQQYPGAQQPQQQYGQYPQPGYPPQQYPPK

SEQ ID NO: 2881842 - protein, 11 aa, Entamoeba invadens
LNQYEKAREGK

SEQ ID NO: 2881843 - protein, 9 aa, Entamoeba invadens
LNRETEQVE

SEQ ID NO: 2881844 - protein, 8 aa, Entamoeba invadens
LNRGKENY

SEQ ID NO: 2881845 - protein, 10 aa, Entamoeba invadens
LNRKASRRTT

SEQ ID NO: 2881846 - protein, 8 aa, Entamoeba invadens
LNRPKQRM

SEQ ID NO: 2881847 - protein, 6 aa, Entamoeba invadens
LNSADY

SEQ ID NO: 2881848 - protein, 5 aa, Entamoeba invadens
LNSAK

SEQ ID NO: 2881849 - protein, 9 aa, Entamoeba invadens
LNSAPQIKS

SEQ ID NO: 2881850 - protein, 12 aa, Entamoeba invadens
LNSASKKYRTVN

SEQ ID NO: 2881851 - protein, 29 aa, Entamoeba invadens
LNSDDGSVKPSLVEPSKFSNKEKKEEKAE

SEQ ID NO: 2881852 - protein, 5 aa, Entamoeba invadens
LNSDM

SEQ ID NO: 2881853 - protein, 6 aa, Entamoeba invadens
LNSEDN

SEQ ID NO: 2881854 - protein, 7 aa, Entamoeba invadens
LNSEEKT

SEQ ID NO: 2881855 - protein, 21 aa, Entamoeba invadens
LNSEGIKSVTQPFPDRSTAVG

SEQ ID NO: 2881856 - protein, 26 aa, Entamoeba invadens
LNSEKDELEDKNRKLDSFNKDAQRKL

SEQ ID NO: 2881857 - protein, 26 aa, Entamoeba invadens
LNSEKDELEDKNRKLDSSNKDAQRKL

SEQ ID NO: 2881858 - protein, 19 aa, Entamoeba invadens
LNSEKTKAVYNSSKELTSV

SEQ ID NO: 2881859 - protein, 6 aa, Entamoeba invadens
LNSENC

SEQ ID NO: 2881860 - protein, 5 aa, Entamoeba invadens
LNSET

SEQ ID NO: 2881861 - protein, 18 aa, Entamoeba invadens
LNSETDKAQYEKIQSSKK

SEQ ID NO: 2881862 - protein, 19 aa, Entamoeba invadens
LNSETDKAQYEKIQTSKRK

SEQ ID NO: 2881863 - protein, 18 aa, Entamoeba invadens
LNSETDKEQYEKIQSSKK

SEQ ID NO: 2881864 - protein, 13 aa, Entamoeba invadens
LNSEVAEGSSLKT

SEQ ID NO: 2881865 - protein, 14 aa, Entamoeba invadens
LNSGEKKKSTLKSR

SEQ ID NO: 2881866 - protein, 13 aa, Entamoeba invadens
LNSGGNEFDAKGP

SEQ ID NO: 2881867 - protein, 8 aa, Entamoeba invadens
LNSGSIPP

SEQ ID NO: 2881868 - protein, 14 aa, Entamoeba invadens
LNSIPERLKRLRES

SEQ ID NO: 2881869 - protein, 8 aa, Entamoeba invadens
LNSNGTCE

SEQ ID NO: 2881870 - protein, 5 aa, Entamoeba invadens
LNSPA

SEQ ID NO: 2881871 - protein, 10 aa, Entamoeba invadens
LNSPESESSF

SEQ ID NO: 2881872 - protein, 13 aa, Entamoeba invadens
LNSPRKSKKSENV

SEQ ID NO: 2881873 - protein, 7 aa, Entamoeba invadens
LNSPTSF

SEQ ID NO: 2881874 - protein, 7 aa, Entamoeba invadens
LNSPTVN

SEQ ID NO: 2881875 - protein, 8 aa, Entamoeba invadens
LNSQAAGN

SEQ ID NO: 2881876 - protein, 20 aa, Entamoeba invadens
LNSQKDQEQKKEGNYFYTEL

SEQ ID NO: 2881877 - protein, 34 aa, Entamoeba invadens
LNSQKESISKEKVEKEKEFAKERDEYKKYKEMTE

SEQ ID NO: 2881878 - protein, 38 aa, Entamoeba invadens
LNSQKQENEKIQQELNTTKDEKDKIENKMKKKTDELDM

SEQ ID NO: 2881879 - protein, 5 aa, Entamoeba invadens
LNSQN

SEQ ID NO: 2881880 - protein, 8 aa, Entamoeba invadens
LNSQSASE

SEQ ID NO: 2881881 - protein, 10 aa, Entamoeba invadens
LNSQSNDFEQ

SEQ ID NO: 2881882 - protein, 8 aa, Entamoeba invadens
LNSQTYPD

SEQ ID NO: 2881883 - protein, 15 aa, Entamoeba invadens
LNSSEKTSKLIESGT

SEQ ID NO: 2881884 - protein, 5 aa, Entamoeba invadens
LNSSK

SEQ ID NO: 2881885 - protein, 33 aa, Entamoeba invadens
LNSSQNISQYNSLTQSPGISPLTPVTPKTPMSF

SEQ ID NO: 2881886 - protein, 10 aa, Entamoeba invadens
LNSTEEEKSK

SEQ ID NO: 2881887 - protein, 5 aa, Entamoeba invadens
LNSTN

SEQ ID NO: 2881888 - protein, 5 aa, Entamoeba invadens
LNSTY

SEQ ID NO: 2881889 - protein, 22 aa, Entamoeba invadens
LNSVNQEKENITKELNKTKDEI

SEQ ID NO: 2881890 - protein, 15 aa, Entamoeba invadens
LNSYEESAKGGNIEA

SEQ ID NO: 2881891 - protein, 9 aa, Entamoeba invadens
LNSYTSSRV

SEQ ID NO: 2881892 - protein, 13 aa, Entamoeba invadens
LNTDNSCKQTPQT

SEQ ID NO: 2881893 - protein, 9 aa, Entamoeba invadens
LNTDPSGQR

SEQ ID NO: 2881894 - protein, 4 aa, Entamoeba invadens
LNTE

SEQ ID NO: 2881895 - protein, 25 aa, Entamoeba invadens
LNTENSNENSVEKNENSNEAPPANF

SEQ ID NO: 2881896 - protein, 18 aa, Entamoeba invadens
LNTISKTVNGNLTFDGSN

SEQ ID NO: 2881897 - protein, 4 aa, Entamoeba invadens
LNTK

SEQ ID NO: 2881898 - protein, 8 aa, Entamoeba invadens
LNTKGSIS

SEQ ID NO: 2881899 - protein, 6 aa, Entamoeba invadens
LNTKTN

SEQ ID NO: 2881900 - protein, 7 aa, Entamoeba invadens
LNTNTSP

SEQ ID NO: 2881901 - protein, 9 aa, Entamoeba invadens
LNTPQRGHP

SEQ ID NO: 2881902 - protein, 7 aa, Entamoeba invadens
LNTPQRS

SEQ ID NO: 2881903 - protein, 5 aa, Entamoeba invadens
LNTPR

SEQ ID NO: 2881904 - protein, 4 aa, Entamoeba invadens
LNTQ

SEQ ID NO: 2881905 - protein, 11 aa, Entamoeba invadens
LNTQEAQKYME

SEQ ID NO: 2881906 - protein, 14 aa, Entamoeba invadens
LNTQKEKTAQQEKL

SEQ ID NO: 2881907 - protein, 16 aa, Entamoeba invadens
LNTQRKVSREDGEKMA

SEQ ID NO: 2881908 - protein, 8 aa, Entamoeba invadens
LNTQTTST

SEQ ID NO: 2881909 - protein, 23 aa, Entamoeba invadens
LNTREKVVKRSKNKKTKNEELDR

SEQ ID NO: 2881910 - protein, 7 aa, Entamoeba invadens
LNTREQN

SEQ ID NO: 2881911 - protein, 9 aa, Entamoeba invadens
LNTRRKTEM

SEQ ID NO: 2881912 - protein, 6 aa, Entamoeba invadens
LNTRSS

SEQ ID NO: 2881913 - protein, 11 aa, Entamoeba invadens
LNTSKENRKVA

SEQ ID NO: 2881914 - protein, 7 aa, Entamoeba invadens
LNTSKGH

SEQ ID NO: 2881915 - protein, 9 aa, Entamoeba invadens
LNTTESNDM

SEQ ID NO: 2881916 - protein, 5 aa, Entamoeba invadens
LNTTK

SEQ ID NO: 2881917 - protein, 13 aa, Entamoeba invadens
LNTTKEQKSHLEE

SEQ ID NO: 2881918 - protein, 9 aa, Entamoeba invadens
LNTTTSSAN

SEQ ID NO: 2881919 - protein, 4 aa, Entamoeba invadens
LNVE

SEQ ID NO: 2881920 - protein, 17 aa, Entamoeba invadens
LNVGGSKKQAPKDMKED

SEQ ID NO: 2881921 - protein, 7 aa, Entamoeba invadens
LNVNPQN

SEQ ID NO: 2881922 - protein, 25 aa, Entamoeba invadens
LNYEDASSRAVNAYDSEYAKSGISD

SEQ ID NO: 2881923 - protein, 6 aa, Entamoeba invadens
LNYHNG

SEQ ID NO: 2881924 - protein, 24 aa, Entamoeba invadens
LNYSEVKEESYLNAEGSCDAGQIQ

SEQ ID NO: 2881925 - protein, 9 aa, Entamoeba invadens
LNYTSGKRG

SEQ ID NO: 2881926 - protein, 11 aa, Entamoeba invadens
LPAARQYENAY

SEQ ID NO: 2881927 - protein, 8 aa, Entamoeba invadens
LPADVQPM

SEQ ID NO: 2881928 - protein, 4 aa, Entamoeba invadens
LPAE

SEQ ID NO: 2881929 - protein, 5 aa, Entamoeba invadens
LPAEN

SEQ ID NO: 2881930 - protein, 4 aa, Entamoeba invadens
LPAF

SEQ ID NO: 2881931 - protein, 6 aa, Entamoeba invadens
LPAGGG

SEQ ID NO: 2881932 - protein, 8 aa, Entamoeba invadens
LPAGNQEL

SEQ ID NO: 2881933 - protein, 4 aa, Entamoeba invadens
LPAI

SEQ ID NO: 2881934 - protein, 7 aa, Entamoeba invadens
LPAKREH

SEQ ID NO: 2881935 - protein, 8 aa, Entamoeba invadens
LPANLNNK

SEQ ID NO: 2881936 - protein, 9 aa, Entamoeba invadens
LPAPKEGDL

SEQ ID NO: 2881937 - protein, 11 aa, Entamoeba invadens
LPAPKKREGEL

SEQ ID NO: 2881938 - protein, 8 aa, Entamoeba invadens
LPASEPKE

SEQ ID NO: 2881939 - protein, 12 aa, Entamoeba invadens
LPASGQSTQNRK

SEQ ID NO: 2881940 - protein, 5 aa, Entamoeba invadens
LPASI

SEQ ID NO: 2881941 - protein, 8 aa, Entamoeba invadens
LPASPGAA

SEQ ID NO: 2881942 - protein, 18 aa, Entamoeba invadens
LPATSPKQIKRNREAQMS

SEQ ID NO: 2881943 - protein, 7 aa, Entamoeba invadens
LPDAPNL

SEQ ID NO: 2881944 - protein, 10 aa, Entamoeba invadens
LPDCPATSDY

SEQ ID NO: 2881945 - protein, 7 aa, Entamoeba invadens
LPDDDKY

SEQ ID NO: 2881946 - protein, 5 aa, Entamoeba invadens
LPDDI

SEQ ID NO: 2881947 - protein, 14 aa, Entamoeba invadens
LPDDLKETADKEEV

SEQ ID NO: 2881948 - protein, 6 aa, Entamoeba invadens
LPDECE

SEQ ID NO: 2881949 - protein, 17 aa, Entamoeba invadens
LPDEDTNEKSWSSVSRK

SEQ ID NO: 2881950 - protein, 16 aa, Entamoeba invadens
LPDEEEPRRKSQCCVV

SEQ ID NO: 2881951 - protein, 12 aa, Entamoeba invadens
LPDEEESEDPKV

SEQ ID NO: 2881952 - protein, 6 aa, Entamoeba invadens
LPDEIN

SEQ ID NO: 2881953 - protein, 8 aa, Entamoeba invadens
LPDEITEI

SEQ ID NO: 2881954 - protein, 5 aa, Entamoeba invadens
LPDEL

SEQ ID NO: 2881955 - protein, 5 aa, Entamoeba invadens
LPDET

SEQ ID NO: 2881956 - protein, 5 aa, Entamoeba invadens
LPDEV

SEQ ID NO: 2881957 - protein, 6 aa, Entamoeba invadens
LPDEVR

SEQ ID NO: 2881958 - protein, 18 aa, Entamoeba invadens
LPDGDFARGYDDKVHGES

SEQ ID NO: 2881959 - protein, 15 aa, Entamoeba invadens
LPDGIQRRRTADDSL

SEQ ID NO: 2881960 - protein, 7 aa, Entamoeba invadens
LPDGREI

SEQ ID NO: 2881961 - protein, 4 aa, Entamoeba invadens
LPDK

SEQ ID NO: 2881962 - protein, 28 aa, Entamoeba invadens
LPDKNHPRSLTQENKLDMTGRKPLPKMN

SEQ ID NO: 2881963 - protein, 4 aa, Entamoeba invadens
LPDN

SEQ ID NO: 2881964 - protein, 5 aa, Entamoeba invadens
LPDNE

SEQ ID NO: 2881965 - protein, 6 aa, Entamoeba invadens
LPDNLT

SEQ ID NO: 2881966 - protein, 11 aa, Entamoeba invadens
LPDNTRKIGEG

SEQ ID NO: 2881967 - protein, 8 aa, Entamoeba invadens
LPDPFGKK

SEQ ID NO: 2881968 - protein, 5 aa, Entamoeba invadens
LPDPI

SEQ ID NO: 2881969 - protein, 5 aa, Entamoeba invadens
LPDPM

SEQ ID NO: 2881970 - protein, 12 aa, Entamoeba invadens
LPDPRTYKSTAI

SEQ ID NO: 2881971 - protein, 18 aa, Entamoeba invadens
LPDQKKNSSRLSKKFKSA

SEQ ID NO: 2881972 - protein, 8 aa, Entamoeba invadens
LPDQKTLP

SEQ ID NO: 2881973 - protein, 5 aa, Entamoeba invadens
LPDRL

SEQ ID NO: 2881974 - protein, 6 aa, Entamoeba invadens
LPDRRQ

SEQ ID NO: 2881975 - protein, 12 aa, Entamoeba invadens
LPDSHISTNQKE

SEQ ID NO: 2881976 - protein, 5 aa, Entamoeba invadens
LPDSN

SEQ ID NO: 2881977 - protein, 9 aa, Entamoeba invadens
LPDSQSCDG

SEQ ID NO: 2881978 - protein, 9 aa, Entamoeba invadens
LPDSQSIQF

SEQ ID NO: 2881979 - protein, 8 aa, Entamoeba invadens
LPDSRTYG

SEQ ID NO: 2881980 - protein, 7 aa, Entamoeba invadens
LPDSSSA

SEQ ID NO: 2881981 - protein, 5 aa, Entamoeba invadens
LPDSV

SEQ ID NO: 2881982 - protein, 7 aa, Entamoeba invadens
LPDSVEQ

SEQ ID NO: 2881983 - protein, 5 aa, Entamoeba invadens
LPDTF

SEQ ID NO: 2881984 - protein, 4 aa, Entamoeba invadens
LPDY

SEQ ID NO: 2881985 - protein, 19 aa, Entamoeba invadens
LPEAKSENSNLKEKTQLKE

SEQ ID NO: 2881986 - protein, 13 aa, Entamoeba invadens
LPEDEKQKQKIEK

SEQ ID NO: 2881987 - protein, 18 aa, Entamoeba invadens
LPEDFNPEDENQEVDEDT

SEQ ID NO: 2881988 - protein, 8 aa, Entamoeba invadens
LPEDKTTI

SEQ ID NO: 2881989 - protein, 10 aa, Entamoeba invadens
LPEDQKKPLA

SEQ ID NO: 2881990 - protein, 14 aa, Entamoeba invadens
LPEDREQTPTTPEF

SEQ ID NO: 2881991 - protein, 4 aa, Entamoeba invadens
LPEE

SEQ ID NO: 2881992 - protein, 6 aa, Entamoeba invadens
LPEEES

SEQ ID NO: 2881993 - protein, 7 aa, Entamoeba invadens
LPEEKEV

SEQ ID NO: 2881994 - protein, 15 aa, Entamoeba invadens
LPEEPNPFESFNPQI

SEQ ID NO: 2881995 - protein, 10 aa, Entamoeba invadens
LPEESWTDTT

SEQ ID NO: 2881996 - protein, 5 aa, Entamoeba invadens
LPEEY

SEQ ID NO: 2881997 - protein, 4 aa, Entamoeba invadens
LPEF

SEQ ID NO: 2881998 - protein, 4 aa, Entamoeba invadens
LPEG

SEQ ID NO: 2881999 - protein, 23 aa, Entamoeba invadens
LPEGDNTLVGDRGSRMSGGQKRR

SEQ ID NO: 2882000 - protein, 11 aa, Entamoeba invadens
LPEGFTSTNTS

SEQ ID NO: 2882001 - protein, 5 aa, Entamoeba invadens
LPEGL

SEQ ID NO: 2882002 - protein, 12 aa, Entamoeba invadens
LPEGYKKDSLEV

SEQ ID NO: 2882003 - protein, 8 aa, Entamoeba invadens
LPEHSSGQ

SEQ ID NO: 2882004 - protein, 28 aa, Entamoeba invadens
LPEKKVEEPPREEENESNEEEEPQKPRM

SEQ ID NO: 2882005 - protein, 6 aa, Entamoeba invadens
LPEKLS

SEQ ID NO: 2882006 - protein, 8 aa, Entamoeba invadens
LPELKTQE

SEQ ID NO: 2882007 - protein, 7 aa, Entamoeba invadens
LPENEGN

SEQ ID NO: 2882008 - protein, 5 aa, Entamoeba invadens
LPENF

SEQ ID NO: 2882009 - protein, 7 aa, Entamoeba invadens
LPENGRL

SEQ ID NO: 2882010 - protein, 8 aa, Entamoeba invadens
LPENKKEV

SEQ ID NO: 2882011 - protein, 11 aa, Entamoeba invadens
LPENTEKISKK

SEQ ID NO: 2882012 - protein, 4 aa, Entamoeba invadens
LPEP

SEQ ID NO: 2882013 - protein, 5 aa, Entamoeba invadens
LPEPK

SEQ ID NO: 2882014 - protein, 6 aa, Entamoeba invadens
LPEQKT

SEQ ID NO: 2882015 - protein, 4 aa, Entamoeba invadens
LPER

SEQ ID NO: 2882016 - protein, 25 aa, Entamoeba invadens
LPESALPKIPETTKTYKTLKPPVPT

SEQ ID NO: 2882017 - protein, 5 aa, Entamoeba invadens
LPESK

SEQ ID NO: 2882018 - protein, 10 aa, Entamoeba invadens
LPESKTQRGM

SEQ ID NO: 2882019 - protein, 5 aa, Entamoeba invadens
LPESL

SEQ ID NO: 2882020 - protein, 6 aa, Entamoeba invadens
LPESVS

SEQ ID NO: 2882021 - protein, 44 aa, Entamoeba invadens
LPETDKEKYQEQAKQNKAKEISAKSDVPPPAAEQPTGPTDENAS

SEQ ID NO: 2882022 - protein, 8 aa, Entamoeba invadens
LPETIETV

SEQ ID NO: 2882023 - protein, 5 aa, Entamoeba invadens
LPETL

SEQ ID NO: 2882024 - protein, 5 aa, Entamoeba invadens
LPETM

SEQ ID NO: 2882025 - protein, 6 aa, Entamoeba invadens
LPETSF

SEQ ID NO: 2882026 - protein, 23 aa, Entamoeba invadens
LPEVQTKESYETNIKNKKNRCNI

SEQ ID NO: 2882027 - protein, 4 aa, Entamoeba invadens
LPFD

SEQ ID NO: 2882028 - protein, 10 aa, Entamoeba invadens
LPFEQTDHTR

SEQ ID NO: 2882029 - protein, 17 aa, Entamoeba invadens
LPFPETQKQNDAQQTEI

SEQ ID NO: 2882030 - protein, 4 aa, Entamoeba invadens
LPGD

SEQ ID NO: 2882031 - protein, 6 aa, Entamoeba invadens
LPGDGD

SEQ ID NO: 2882032 - protein, 5 aa, Entamoeba invadens
LPGDV

SEQ ID NO: 2882033 - protein, 7 aa, Entamoeba invadens
LPGEENS

SEQ ID NO: 2882034 - protein, 6 aa, Entamoeba invadens
LPGGGG

SEQ ID NO: 2882035 - protein, 5 aa, Entamoeba invadens
LPGIA

SEQ ID NO: 2882036 - protein, 5 aa, Entamoeba invadens
LPGND

SEQ ID NO: 2882037 - protein, 10 aa, Entamoeba invadens
LPGNSAAGTT

SEQ ID NO: 2882038 - protein, 7 aa, Entamoeba invadens
LPGPDGS

SEQ ID NO: 2882039 - protein, 11 aa, Entamoeba invadens
LPGRAPNSVKN

SEQ ID NO: 2882040 - protein, 8 aa, Entamoeba invadens
LPGRTANA

SEQ ID NO: 2882041 - protein, 10 aa, Entamoeba invadens
LPGRTANDIK

SEQ ID NO: 2882042 - protein, 5 aa, Entamoeba invadens
LPGSE

SEQ ID NO: 2882043 - protein, 11 aa, Entamoeba invadens
LPGSNPRDNEY

SEQ ID NO: 2882044 - protein, 8 aa, Entamoeba invadens
LPGSYSPI

SEQ ID NO: 2882045 - protein, 9 aa, Entamoeba invadens
LPGTDSTAK

SEQ ID NO: 2882046 - protein, 4 aa, Entamoeba invadens
LPHN

SEQ ID NO: 2882047 - protein, 6 aa, Entamoeba invadens
LPHNNR

SEQ ID NO: 2882048 - protein, 13 aa, Entamoeba invadens
LPHNRAGSKSYMA

SEQ ID NO: 2882049 - protein, 10 aa, Entamoeba invadens
LPHPPPGNRD

SEQ ID NO: 2882050 - protein, 18 aa, Entamoeba invadens
LPHSSGRPDFNPNPNFTG

SEQ ID NO: 2882051 - protein, 9 aa, Entamoeba invadens
LPIDNSETV

SEQ ID NO: 2882052 - protein, 16 aa, Entamoeba invadens
LPIEEKQKQQPQSSGC

SEQ ID NO: 2882053 - protein, 5 aa, Entamoeba invadens
LPIET

SEQ ID NO: 2882054 - protein, 6 aa, Entamoeba invadens
LPIGSQ

SEQ ID NO: 2882055 - protein, 14 aa, Entamoeba invadens
LPIKDQQNLPRQQD

SEQ ID NO: 2882056 - protein, 14 aa, Entamoeba invadens
LPIKRQPVETPVPI

SEQ ID NO: 2882057 - protein, 9 aa, Entamoeba invadens
LPINQSDSV

SEQ ID NO: 2882058 - protein, 12 aa, Entamoeba invadens
LPIPGSGSSAFD

SEQ ID NO: 2882059 - protein, 5 aa, Entamoeba invadens
LPIPP

SEQ ID NO: 2882060 - protein, 14 aa, Entamoeba invadens
LPIPPPIPKQPTVK

SEQ ID NO: 2882061 - protein, 11 aa, Entamoeba invadens
LPIPTSFPKRQ

SEQ ID NO: 2882062 - protein, 4 aa, Entamoeba invadens
LPIS

SEQ ID NO: 2882063 - protein, 8 aa, Entamoeba invadens
LPKAFDSD

SEQ ID NO: 2882064 - protein, 26 aa, Entamoeba invadens
LPKASKMRREKDSRDDRYSRDYEGYR

SEQ ID NO: 2882065 - protein, 21 aa, Entamoeba invadens
LPKDTLDPSLTGFEEEKSCSL

SEQ ID NO: 2882066 - protein, 4 aa, Entamoeba invadens
LPKE

SEQ ID NO: 2882067 - protein, 18 aa, Entamoeba invadens
LPKEDQSGFGILRLVVEI

SEQ ID NO: 2882068 - protein, 9 aa, Entamoeba invadens
LPKEERPRS

SEQ ID NO: 2882069 - protein, 15 aa, Entamoeba invadens
LPKEERSDGSGGTKE

SEQ ID NO: 2882070 - protein, 8 aa, Entamoeba invadens
LPKEFNTK

SEQ ID NO: 2882071 - protein, 6 aa, Entamoeba invadens
LPKEID

SEQ ID NO: 2882072 - protein, 11 aa, Entamoeba invadens
LPKENDSVKYS

SEQ ID NO: 2882073 - protein, 8 aa, Entamoeba invadens
LPKENENI

SEQ ID NO: 2882074 - protein, 6 aa, Entamoeba invadens
LPKEPS

SEQ ID NO: 2882075 - protein, 12 aa, Entamoeba invadens
LPKEQTVDYAQD

SEQ ID NO: 2882076 - protein, 11 aa, Entamoeba invadens
LPKEREKNALE

SEQ ID NO: 2882077 - protein, 5 aa, Entamoeba invadens
LPKET

SEQ ID NO: 2882078 - protein, 9 aa, Entamoeba invadens
LPKEYEERT

SEQ ID NO: 2882079 - protein, 4 aa, Entamoeba invadens
LPKF

SEQ ID NO: 2882080 - protein, 15 aa, Entamoeba invadens
LPKGETAPAEKDTYT

SEQ ID NO: 2882081 - protein, 11 aa, Entamoeba invadens
LPKGNEINQPE

SEQ ID NO: 2882082 - protein, 5 aa, Entamoeba invadens
LPKGY

SEQ ID NO: 2882083 - protein, 6 aa, Entamoeba invadens
LPKKEE

SEQ ID NO: 2882084 - protein, 15 aa, Entamoeba invadens
LPKKKAELQETANQL

SEQ ID NO: 2882085 - protein, 10 aa, Entamoeba invadens
LPKKKKIESN

SEQ ID NO: 2882086 - protein, 61 aa, Entamoeba invadens
LPKKPSSTLPETASTSSCAKTSRSASKVTTASSQISSDIARSAQNERGANGSRADSYASME

SEQ ID NO: 2882087 - protein, 11 aa, Entamoeba invadens
LPKKSDPNNIK

SEQ ID NO: 2882088 - protein, 6 aa, Entamoeba invadens
LPKKYK

SEQ ID NO: 2882089 - protein, 5 aa, Entamoeba invadens
LPKNI

SEQ ID NO: 2882090 - protein, 7 aa, Entamoeba invadens
LPKNLPD

SEQ ID NO: 2882091 - protein, 5 aa, Entamoeba invadens
LPKNT

SEQ ID NO: 2882092 - protein, 15 aa, Entamoeba invadens
LPKPDENSKIDSNEI

SEQ ID NO: 2882093 - protein, 8 aa, Entamoeba invadens
LPKPEGKV

SEQ ID NO: 2882094 - protein, 42 aa, Entamoeba invadens
LPKPELKRDGSARPVSKGVQRYTKPTKTNTAMQPVKKEKKLN

SEQ ID NO: 2882095 - protein, 5 aa, Entamoeba invadens
LPKPI

SEQ ID NO: 2882096 - protein, 7 aa, Entamoeba invadens
LPKPNRN

SEQ ID NO: 2882097 - protein, 11 aa, Entamoeba invadens
LPKPPAAGPSF

SEQ ID NO: 2882098 - protein, 8 aa, Entamoeba invadens
LPKPQEDT

SEQ ID NO: 2882099 - protein, 6 aa, Entamoeba invadens
LPKPSL

SEQ ID NO: 2882100 - protein, 8 aa, Entamoeba invadens
LPKQPSVP

SEQ ID NO: 2882101 - protein, 46 aa, Entamoeba invadens
LPKRDENKEQTPEETEKKKHDEEKKELAKPESDSVKKGEEEDDINE

SEQ ID NO: 2882102 - protein, 7 aa, Entamoeba invadens
LPKRDYE

SEQ ID NO: 2882103 - protein, 29 aa, Entamoeba invadens
LPKRTTPKKEGKSTYSRRNPPVKTGKSEL

SEQ ID NO: 2882104 - protein, 7 aa, Entamoeba invadens
LPKSEID

SEQ ID NO: 2882105 - protein, 7 aa, Entamoeba invadens
LPKSQIS

SEQ ID NO: 2882106 - protein, 15 aa, Entamoeba invadens
LPKSTLNGTYAKIIS

SEQ ID NO: 2882107 - protein, 10 aa, Entamoeba invadens
LPKSTSDEEI

SEQ ID NO: 2882108 - protein, 11 aa, Entamoeba invadens
LPKSVKTVGPR

SEQ ID NO: 2882109 - protein, 8 aa, Entamoeba invadens
LPKSVNSV

SEQ ID NO: 2882110 - protein, 20 aa, Entamoeba invadens
LPKTDEKKKETLLGKMRHLF

SEQ ID NO: 2882111 - protein, 11 aa, Entamoeba invadens
LPKTDKKKKSI

SEQ ID NO: 2882112 - protein, 22 aa, Entamoeba invadens
LPKTDRDNKNEKAEKSDRSEKT

SEQ ID NO: 2882113 - protein, 17 aa, Entamoeba invadens
LPKTEPPKTQEVNPINA

SEQ ID NO: 2882114 - protein, 21 aa, Entamoeba invadens
LPKTEREITKKKKGDDNDDGF

SEQ ID NO: 2882115 - protein, 9 aa, Entamoeba invadens
LPKTETKGT

SEQ ID NO: 2882116 - protein, 6 aa, Entamoeba invadens
LPKTLT

SEQ ID NO: 2882117 - protein, 9 aa, Entamoeba invadens
LPKTPTDMK

SEQ ID NO: 2882118 - protein, 10 aa, Entamoeba invadens
LPKTREELDD

SEQ ID NO: 2882119 - protein, 11 aa, Entamoeba invadens
LPKTSDMSNEQ

SEQ ID NO: 2882120 - protein, 7 aa, Entamoeba invadens
LPKTTDD

SEQ ID NO: 2882121 - protein, 14 aa, Entamoeba invadens
LPKVDGKSYSFPHS

SEQ ID NO: 2882122 - protein, 4 aa, Entamoeba invadens
LPLD

SEQ ID NO: 2882123 - protein, 11 aa, Entamoeba invadens
LPLDSSNKYDL

SEQ ID NO: 2882124 - protein, 10 aa, Entamoeba invadens
LPLEGSSGGF

SEQ ID NO: 2882125 - protein, 8 aa, Entamoeba invadens
LPLGTTNI

SEQ ID NO: 2882126 - protein, 14 aa, Entamoeba invadens
LPLKEKSDYVVFDL

SEQ ID NO: 2882127 - protein, 8 aa, Entamoeba invadens
LPLKPDLP

SEQ ID NO: 2882128 - protein, 6 aa, Entamoeba invadens
LPLNAG

SEQ ID NO: 2882129 - protein, 23 aa, Entamoeba invadens
LPLPNYSPNLNQKIQQKETLDAI

SEQ ID NO: 2882130 - protein, 14 aa, Entamoeba invadens
LPLPPNSEDPNSEY

SEQ ID NO: 2882131 - protein, 6 aa, Entamoeba invadens
LPLQQQ

SEQ ID NO: 2882132 - protein, 7 aa, Entamoeba invadens
LPNAEKS

SEQ ID NO: 2882133 - protein, 10 aa, Entamoeba invadens
LPNAGSAEGK

SEQ ID NO: 2882134 - protein, 6 aa, Entamoeba invadens
LPNALP

SEQ ID NO: 2882135 - protein, 6 aa, Entamoeba invadens
LPNAPQ

SEQ ID NO: 2882136 - protein, 13 aa, Entamoeba invadens
LPNASYEGSQQIV

SEQ ID NO: 2882137 - protein, 8 aa, Entamoeba invadens
LPNAVTDD

SEQ ID NO: 2882138 - protein, 4 aa, Entamoeba invadens
LPNC

SEQ ID NO: 2882139 - protein, 6 aa, Entamoeba invadens
LPNDAE

SEQ ID NO: 2882140 - protein, 8 aa, Entamoeba invadens
LPNDEELT

SEQ ID NO: 2882141 - protein, 5 aa, Entamoeba invadens
LPNDN

SEQ ID NO: 2882142 - protein, 16 aa, Entamoeba invadens
LPNDPTFGVNADTSLP

SEQ ID NO: 2882143 - protein, 5 aa, Entamoeba invadens
LPNDV

SEQ ID NO: 2882144 - protein, 4 aa, Entamoeba invadens
LPNE

SEQ ID NO: 2882145 - protein, 11 aa, Entamoeba invadens
LPNENKKNAMA

SEQ ID NO: 2882146 - protein, 7 aa, Entamoeba invadens
LPNETAE

SEQ ID NO: 2882147 - protein, 27 aa, Entamoeba invadens
LPNETIKQTTKNEETQTDSHCEVSTTK

SEQ ID NO: 2882148 - protein, 6 aa, Entamoeba invadens
LPNETT

SEQ ID NO: 2882149 - protein, 7 aa, Entamoeba invadens
LPNEVRA

SEQ ID NO: 2882150 - protein, 4 aa, Entamoeba invadens
LPNG

SEQ ID NO: 2882151 - protein, 5 aa, Entamoeba invadens
LPNGD

SEQ ID NO: 2882152 - protein, 5 aa, Entamoeba invadens
LPNGE

SEQ ID NO: 2882153 - protein, 9 aa, Entamoeba invadens
LPNGEKPFE

SEQ ID NO: 2882154 - protein, 6 aa, Entamoeba invadens
LPNGGG

SEQ ID NO: 2882155 - protein, 9 aa, Entamoeba invadens
LPNGSKKSV

SEQ ID NO: 2882156 - protein, 16 aa, Entamoeba invadens
LPNGSYEDWKISELII

SEQ ID NO: 2882157 - protein, 6 aa, Entamoeba invadens
LPNGTK

SEQ ID NO: 2882158 - protein, 4 aa, Entamoeba invadens
LPNI

SEQ ID NO: 2882159 - protein, 7 aa, Entamoeba invadens
LPNKDHP

SEQ ID NO: 2882160 - protein, 5 aa, Entamoeba invadens
LPNKL

SEQ ID NO: 2882161 - protein, 16 aa, Entamoeba invadens
LPNKPNEFEQPEPPST

SEQ ID NO: 2882162 - protein, 18 aa, Entamoeba invadens
LPNKQGTCKAHGEPPGAD

SEQ ID NO: 2882163 - protein, 6 aa, Entamoeba invadens
LPNLDR

SEQ ID NO: 2882164 - protein, 7 aa, Entamoeba invadens
LPNNDNA

SEQ ID NO: 2882165 - protein, 12 aa, Entamoeba invadens
LPNPKDYEKAKL

SEQ ID NO: 2882166 - protein, 5 aa, Entamoeba invadens
LPNPN

SEQ ID NO: 2882167 - protein, 13 aa, Entamoeba invadens
LPNQHSPQSFSPQ

SEQ ID NO: 2882168 - protein, 9 aa, Entamoeba invadens
LPNQSPVKE

SEQ ID NO: 2882169 - protein, 4 aa, Entamoeba invadens
LPNR

SEQ ID NO: 2882170 - protein, 4 aa, Entamoeba invadens
LPNS

SEQ ID NO: 2882171 - protein, 7 aa, Entamoeba invadens
LPNSIKS

SEQ ID NO: 2882172 - protein, 14 aa, Entamoeba invadens
LPNSLQKVGEGAFK

SEQ ID NO: 2882173 - protein, 9 aa, Entamoeba invadens
LPNSLTDQD

SEQ ID NO: 2882174 - protein, 5 aa, Entamoeba invadens
LPNSV

SEQ ID NO: 2882175 - protein, 8 aa, Entamoeba invadens
LPNSVSSM

SEQ ID NO: 2882176 - protein, 7 aa, Entamoeba invadens
LPNTKKC

SEQ ID NO: 2882177 - protein, 9 aa, Entamoeba invadens
LPNTKQETI

SEQ ID NO: 2882178 - protein, 10 aa, Entamoeba invadens
LPNTRNQSEM

SEQ ID NO: 2882179 - protein, 14 aa, Entamoeba invadens
LPNTRVNYDRGSGI

SEQ ID NO: 2882180 - protein, 19 aa, Entamoeba invadens
LPNVEAKEDKSENEETERG

SEQ ID NO: 2882181 - protein, 5 aa, Entamoeba invadens
LPPAT

SEQ ID NO: 2882182 - protein, 5 aa, Entamoeba invadens
LPPDI

SEQ ID NO: 2882183 - protein, 15 aa, Entamoeba invadens
LPPDPSNYRQNVQGV

SEQ ID NO: 2882184 - protein, 14 aa, Entamoeba invadens
LPPDYHPGDPSFSY

SEQ ID NO: 2882185 - protein, 12 aa, Entamoeba invadens
LPPEKVPRGSAN

SEQ ID NO: 2882186 - protein, 9 aa, Entamoeba invadens
LPPELQDPY

SEQ ID NO: 2882187 - protein, 9 aa, Entamoeba invadens
LPPEQQDPT

SEQ ID NO: 2882188 - protein, 6 aa, Entamoeba invadens
LPPERS

SEQ ID NO: 2882189 - protein, 13 aa, Entamoeba invadens
LPPETKLTAEQLS

SEQ ID NO: 2882190 - protein, 4 aa, Entamoeba invadens
LPPG

SEQ ID NO: 2882191 - protein, 7 aa, Entamoeba invadens
LPPGETY

SEQ ID NO: 2882192 - protein, 19 aa, Entamoeba invadens
LPPGSKPQTPSSSAAVSRH

SEQ ID NO: 2882193 - protein, 16 aa, Entamoeba invadens
LPPGTDVKDESDRPKR

SEQ ID NO: 2882194 - protein, 33 aa, Entamoeba invadens
LPPIPTRRSQTSLAQRHTATNTSSAQQQKTERF

SEQ ID NO: 2882195 - protein, 25 aa, Entamoeba invadens
LPPISSPNNVAAVPPVNRNTTGKTK

SEQ ID NO: 2882196 - protein, 5 aa, Entamoeba invadens
LPPIT

SEQ ID NO: 2882197 - protein, 8 aa, Entamoeba invadens
LPPKSARY

SEQ ID NO: 2882198 - protein, 5 aa, Entamoeba invadens
LPPLP

SEQ ID NO: 2882199 - protein, 10 aa, Entamoeba invadens
LPPLQQPGQM

SEQ ID NO: 2882200 - protein, 9 aa, Entamoeba invadens
LPPLTPADE

SEQ ID NO: 2882201 - protein, 4 aa, Entamoeba invadens
LPPN

SEQ ID NO: 2882202 - protein, 6 aa, Entamoeba invadens
LPPNIT

SEQ ID NO: 2882203 - protein, 5 aa, Entamoeba invadens
LPPNV

SEQ ID NO: 2882204 - protein, 4 aa, Entamoeba invadens
LPPP

SEQ ID NO: 2882205 - protein, 5 aa, Entamoeba invadens
LPPPE

SEQ ID NO: 2882206 - protein, 31 aa, Entamoeba invadens
LPPPEKQQPKTQKKSKQRGQTPPRQESSHTF

SEQ ID NO: 2882207 - protein, 7 aa, Entamoeba invadens
LPPPESE

SEQ ID NO: 2882208 - protein, 19 aa, Entamoeba invadens
LPPPGLAPPGGMMPPPGGM

SEQ ID NO: 2882209 - protein, 25 aa, Entamoeba invadens
LPPPGLAPPGGMMPPPGLAPPGGMM

SEQ ID NO: 2882210 - protein, 25 aa, Entamoeba invadens
LPPPGLAPPGGMMPPPGMAPPGGMM

SEQ ID NO: 2882211 - protein, 29 aa, Entamoeba invadens
LPPPGMPYGGMPNGYGAQQYPTPYGGYTM

SEQ ID NO: 2882212 - protein, 9 aa, Entamoeba invadens
LPPPKDNEK

SEQ ID NO: 2882213 - protein, 13 aa, Entamoeba invadens
LPPPKPLTQKEYQ

SEQ ID NO: 2882214 - protein, 13 aa, Entamoeba invadens
LPPPNDSPSNRGF

SEQ ID NO: 2882215 - protein, 13 aa, Entamoeba invadens
LPPPRKTQQNTTI

SEQ ID NO: 2882216 - protein, 16 aa, Entamoeba invadens
LPPPSNEHPQGQGIPS

SEQ ID NO: 2882217 - protein, 10 aa, Entamoeba invadens
LPPPTECPAS

SEQ ID NO: 2882218 - protein, 12 aa, Entamoeba invadens
LPPPTQNYKSDA

SEQ ID NO: 2882219 - protein, 4 aa, Entamoeba invadens
LPPQ

SEQ ID NO: 2882220 - protein, 7 aa, Entamoeba invadens
LPPQKAG

SEQ ID NO: 2882221 - protein, 24 aa, Entamoeba invadens
LPPQKEESSDSEDLTQYKDELTQI

SEQ ID NO: 2882222 - protein, 16 aa, Entamoeba invadens
LPPQPFPQNSIDSIDR

SEQ ID NO: 2882223 - protein, 6 aa, Entamoeba invadens
LPPQQN

SEQ ID NO: 2882224 - protein, 15 aa, Entamoeba invadens
LPPQQQQAQRDQQMY

SEQ ID NO: 2882225 - protein, 6 aa, Entamoeba invadens
LPPQSH

SEQ ID NO: 2882226 - protein, 19 aa, Entamoeba invadens
LPPQYPTTIKDGVEKVQTL

SEQ ID NO: 2882227 - protein, 9 aa, Entamoeba invadens
LPPRDPKNL

SEQ ID NO: 2882228 - protein, 5 aa, Entamoeba invadens
LPPRE

SEQ ID NO: 2882229 - protein, 4 aa, Entamoeba invadens
LPPS

SEQ ID NO: 2882230 - protein, 5 aa, Entamoeba invadens
LPPSD

SEQ ID NO: 2882231 - protein, 9 aa, Entamoeba invadens
LPPSEDEAK

SEQ ID NO: 2882232 - protein, 6 aa, Entamoeba invadens
LPPSEF

SEQ ID NO: 2882233 - protein, 5 aa, Entamoeba invadens
LPPSL

SEQ ID NO: 2882234 - protein, 6 aa, Entamoeba invadens
LPPSLK

SEQ ID NO: 2882235 - protein, 6 aa, Entamoeba invadens
LPPSPF

SEQ ID NO: 2882236 - protein, 8 aa, Entamoeba invadens
LPPSPSFK

SEQ ID NO: 2882237 - protein, 5 aa, Entamoeba invadens
LPPSS

SEQ ID NO: 2882238 - protein, 11 aa, Entamoeba invadens
LPPSTKTIDIE

SEQ ID NO: 2882239 - protein, 6 aa, Entamoeba invadens
LPPTIT

SEQ ID NO: 2882240 - protein, 7 aa, Entamoeba invadens
LPPTITS

SEQ ID NO: 2882241 - protein, 7 aa, Entamoeba invadens
LPPTLTK

SEQ ID NO: 2882242 - protein, 7 aa, Entamoeba invadens
LPPTNDR

SEQ ID NO: 2882243 - protein, 21 aa, Entamoeba invadens
LPPTNEPLRTFPPGTQLSPEE

SEQ ID NO: 2882244 - protein, 7 aa, Entamoeba invadens
LPPTPTL

SEQ ID NO: 2882245 - protein, 17 aa, Entamoeba invadens
LPPTSTHGGLADEKESA

SEQ ID NO: 2882246 - protein, 6 aa, Entamoeba invadens
LPPTSV

SEQ ID NO: 2882247 - protein, 7 aa, Entamoeba invadens
LPPTTPV

SEQ ID NO: 2882248 - protein, 6 aa, Entamoeba invadens
LPPTTR

SEQ ID NO: 2882249 - protein, 22 aa, Entamoeba invadens
LPPTTSKNTVTLAAPPPPTISS

SEQ ID NO: 2882250 - protein, 6 aa, Entamoeba invadens
LPPTVV

SEQ ID NO: 2882251 - protein, 17 aa, Entamoeba invadens
LPPTVVSNEAKNGGLEK

SEQ ID NO: 2882252 - protein, 4 aa, Entamoeba invadens
LPPV

SEQ ID NO: 2882253 - protein, 6 aa, Entamoeba invadens
LPPVNQ

SEQ ID NO: 2882254 - protein, 5 aa, Entamoeba invadens
LPPVP

SEQ ID NO: 2882255 - protein, 17 aa, Entamoeba invadens
LPQAKSRLKSQPKSSEY

SEQ ID NO: 2882256 - protein, 5 aa, Entamoeba invadens
LPQED

SEQ ID NO: 2882257 - protein, 24 aa, Entamoeba invadens
LPQEDNPNDYKTTPISKLGSSSKK

SEQ ID NO: 2882258 - protein, 10 aa, Entamoeba invadens
LPQEEEDEIE

SEQ ID NO: 2882259 - protein, 4 aa, Entamoeba invadens
LPQF

SEQ ID NO: 2882260 - protein, 4 aa, Entamoeba invadens
LPQI

SEQ ID NO: 2882261 - protein, 4 aa, Entamoeba invadens
LPQK

SEQ ID NO: 2882262 - protein, 17 aa, Entamoeba invadens
LPQKKTKENKDEPPVQE

SEQ ID NO: 2882263 - protein, 8 aa, Entamoeba invadens
LPQKMGPI

SEQ ID NO: 2882264 - protein, 20 aa, Entamoeba invadens
LPQKQEKSDYDDMEKEEKLD

SEQ ID NO: 2882265 - protein, 6 aa, Entamoeba invadens
LPQLPS

SEQ ID NO: 2882266 - protein, 11 aa, Entamoeba invadens
LPQNDQYAQQN

SEQ ID NO: 2882267 - protein, 8 aa, Entamoeba invadens
LPQNEQQK

SEQ ID NO: 2882268 - protein, 19 aa, Entamoeba invadens
LPQNPSGLESKKPRGSTYF

SEQ ID NO: 2882269 - protein, 9 aa, Entamoeba invadens
LPQPKDDSI

SEQ ID NO: 2882270 - protein, 8 aa, Entamoeba invadens
LPQPPKEF

SEQ ID NO: 2882271 - protein, 4 aa, Entamoeba invadens
LPQQ

SEQ ID NO: 2882272 - protein, 13 aa, Entamoeba invadens
LPQQEDENRLGAT

SEQ ID NO: 2882273 - protein, 6 aa, Entamoeba invadens
LPQQPI

SEQ ID NO: 2882274 - protein, 4 aa, Entamoeba invadens
LPQS

SEQ ID NO: 2882275 - protein, 23 aa, Entamoeba invadens
LPQTSESSPMPDLGGAPTRDNAK

SEQ ID NO: 2882276 - protein, 7 aa, Entamoeba invadens
LPQTTRV

SEQ ID NO: 2882277 - protein, 6 aa, Entamoeba invadens
LPQTVE

SEQ ID NO: 2882278 - protein, 11 aa, Entamoeba invadens
LPQVQTTTTQP

SEQ ID NO: 2882279 - protein, 5 aa, Entamoeba invadens
LPRGP

SEQ ID NO: 2882280 - protein, 8 aa, Entamoeba invadens
LPRPNHVS

SEQ ID NO: 2882281 - protein, 4 aa, Entamoeba invadens
LPRQ

SEQ ID NO: 2882282 - protein, 8 aa, Entamoeba invadens
LPRQNSDY

SEQ ID NO: 2882283 - protein, 5 aa, Entamoeba invadens
LPRSA

SEQ ID NO: 2882284 - protein, 6 aa, Entamoeba invadens
LPRSFS

SEQ ID NO: 2882285 - protein, 46 aa, Entamoeba invadens
LPRSFSSNERISPRSNVPAEQSKEPVNRATLTPYSQRKSSHMTTRS

SEQ ID NO: 2882286 - protein, 8 aa, Entamoeba invadens
LPRSPNLN

SEQ ID NO: 2882287 - protein, 6 aa, Entamoeba invadens
LPRSSD

SEQ ID NO: 2882288 - protein, 11 aa, Entamoeba invadens
LPRSSEVTLPK

SEQ ID NO: 2882289 - protein, 24 aa, Entamoeba invadens
LPRTPENLVGPDQNEVIKSSSSGC

SEQ ID NO: 2882290 - protein, 5 aa, Entamoeba invadens
LPRVK

SEQ ID NO: 2882291 - protein, 12 aa, Entamoeba invadens
LPRVSSPSPIPL

SEQ ID NO: 2882292 - protein, 12 aa, Entamoeba invadens
LPRYCTKSLFFQ

SEQ ID NO: 2882293 - protein, 34 aa, Entamoeba invadens
LPSAESRSPSPFATPRSSMSCTTPISPDFAEDSE

SEQ ID NO: 2882294 - protein, 15 aa, Entamoeba invadens
LPSDDRKSVKIPEDL

SEQ ID NO: 2882295 - protein, 5 aa, Entamoeba invadens
LPSDI

SEQ ID NO: 2882296 - protein, 12 aa, Entamoeba invadens
LPSDVKEIGRSS

SEQ ID NO: 2882297 - protein, 6 aa, Entamoeba invadens
LPSEAT

SEQ ID NO: 2882298 - protein, 6 aa, Entamoeba invadens
LPSEDQ

SEQ ID NO: 2882299 - protein, 7 aa, Entamoeba invadens
LPSETSL

SEQ ID NO: 2882300 - protein, 5 aa, Entamoeba invadens
LPSFS

SEQ ID NO: 2882301 - protein, 11 aa, Entamoeba invadens
LPSFSKNDIQN

SEQ ID NO: 2882302 - protein, 5 aa, Entamoeba invadens
LPSGL

SEQ ID NO: 2882303 - protein, 6 aa, Entamoeba invadens
LPSGPL

SEQ ID NO: 2882304 - protein, 15 aa, Entamoeba invadens
LPSIPQKFQENKVPE

SEQ ID NO: 2882305 - protein, 9 aa, Entamoeba invadens
LPSKITNKE

SEQ ID NO: 2882306 - protein, 17 aa, Entamoeba invadens
LPSKKNTDNFDTKRSDK

SEQ ID NO: 2882307 - protein, 10 aa, Entamoeba invadens
LPSKKSKNTL

SEQ ID NO: 2882308 - protein, 5 aa, Entamoeba invadens
LPSKL

SEQ ID NO: 2882309 - protein, 9 aa, Entamoeba invadens
LPSKNTRGK

SEQ ID NO: 2882310 - protein, 9 aa, Entamoeba invadens
LPSKQTTAL

SEQ ID NO: 2882311 - protein, 4 aa, Entamoeba invadens
LPSL

SEQ ID NO: 2882312 - protein, 36 aa, Entamoeba invadens
LPSLPNKSNNSNSDIPPPLPPPRTTRRKAHEQTMST

SEQ ID NO: 2882313 - protein, 7 aa, Entamoeba invadens
LPSLPQS

SEQ ID NO: 2882314 - protein, 5 aa, Entamoeba invadens
LPSLR

SEQ ID NO: 2882315 - protein, 15 aa, Entamoeba invadens
LPSNFSPKKSFFTKI

SEQ ID NO: 2882316 - protein, 7 aa, Entamoeba invadens
LPSNRSA

SEQ ID NO: 2882317 - protein, 5 aa, Entamoeba invadens
LPSNV

SEQ ID NO: 2882318 - protein, 7 aa, Entamoeba invadens
LPSNVTK

SEQ ID NO: 2882319 - protein, 4 aa, Entamoeba invadens
LPSP

SEQ ID NO: 2882320 - protein, 7 aa, Entamoeba invadens
LPSPGKS

SEQ ID NO: 2882321 - protein, 6 aa, Entamoeba invadens
LPSPPT

SEQ ID NO: 2882322 - protein, 14 aa, Entamoeba invadens
LPSPRRRISYSWCP

SEQ ID NO: 2882323 - protein, 6 aa, Entamoeba invadens
LPSPVN

SEQ ID NO: 2882324 - protein, 8 aa, Entamoeba invadens
LPSQINSL

SEQ ID NO: 2882325 - protein, 6 aa, Entamoeba invadens
LPSQKK

SEQ ID NO: 2882326 - protein, 5 aa, Entamoeba invadens
LPSQL

SEQ ID NO: 2882327 - protein, 9 aa, Entamoeba invadens
LPSQMTTSQ

SEQ ID NO: 2882328 - protein, 6 aa, Entamoeba invadens
LPSRHP

SEQ ID NO: 2882329 - protein, 5 aa, Entamoeba invadens
LPSRM

SEQ ID NO: 2882330 - protein, 7 aa, Entamoeba invadens
LPSSGQL

SEQ ID NO: 2882331 - protein, 7 aa, Entamoeba invadens
LPSSIQT

SEQ ID NO: 2882332 - protein, 6 aa, Entamoeba invadens
LPSSLR

SEQ ID NO: 2882333 - protein, 40 aa, Entamoeba invadens
LPSSNRVSVETEEEAKVPPQLKRDSPTNYTSEEDATQSLQ

SEQ ID NO: 2882334 - protein, 7 aa, Entamoeba invadens
LPSSTQM

SEQ ID NO: 2882335 - protein, 23 aa, Entamoeba invadens
LPSTAETRMRSNSCEKKGKKRTS

SEQ ID NO: 2882336 - protein, 7 aa, Entamoeba invadens
LPSTDAI

SEQ ID NO: 2882337 - protein, 9 aa, Entamoeba invadens
LPSTERFEE

SEQ ID NO: 2882338 - protein, 6 aa, Entamoeba invadens
LPSTGD

SEQ ID NO: 2882339 - protein, 5 aa, Entamoeba invadens
LPSTL

SEQ ID NO: 2882340 - protein, 8 aa, Entamoeba invadens
LPSTQKPY

SEQ ID NO: 2882341 - protein, 14 aa, Entamoeba invadens
LPSTSCIGDSILPS

SEQ ID NO: 2882342 - protein, 13 aa, Entamoeba invadens
LPSTVTSIGGGAF

SEQ ID NO: 2882343 - protein, 19 aa, Entamoeba invadens
LPSVPTKGTREKQTKKIDT

SEQ ID NO: 2882344 - protein, 5 aa, Entamoeba invadens
LPSWE

SEQ ID NO: 2882345 - protein, 13 aa, Entamoeba invadens
LPTAEGKQVISQA

SEQ ID NO: 2882346 - protein, 5 aa, Entamoeba invadens
LPTAS

SEQ ID NO: 2882347 - protein, 10 aa, Entamoeba invadens
LPTATRTTAT

SEQ ID NO: 2882348 - protein, 7 aa, Entamoeba invadens
LPTDGRS

SEQ ID NO: 2882349 - protein, 16 aa, Entamoeba invadens
LPTDSKTPKDPSKLDE

SEQ ID NO: 2882350 - protein, 4 aa, Entamoeba invadens
LPTE

SEQ ID NO: 2882351 - protein, 6 aa, Entamoeba invadens
LPTEEV

SEQ ID NO: 2882352 - protein, 12 aa, Entamoeba invadens
LPTEFSTEKVSK

SEQ ID NO: 2882353 - protein, 4 aa, Entamoeba invadens
LPTG

SEQ ID NO: 2882354 - protein, 8 aa, Entamoeba invadens
LPTGETKN

SEQ ID NO: 2882355 - protein, 6 aa, Entamoeba invadens
LPTGPT

SEQ ID NO: 2882356 - protein, 6 aa, Entamoeba invadens
LPTGTN

SEQ ID NO: 2882357 - protein, 15 aa, Entamoeba invadens
LPTHQQTQDQTLPIT

SEQ ID NO: 2882358 - protein, 6 aa, Entamoeba invadens
LPTKAE

SEQ ID NO: 2882359 - protein, 6 aa, Entamoeba invadens
LPTKKG

SEQ ID NO: 2882360 - protein, 19 aa, Entamoeba invadens
LPTKPPTSSLNPQAQQPSF

SEQ ID NO: 2882361 - protein, 7 aa, Entamoeba invadens
LPTKPSE

SEQ ID NO: 2882362 - protein, 7 aa, Entamoeba invadens
LPTKQGN

SEQ ID NO: 2882363 - protein, 6 aa, Entamoeba invadens
LPTKSH

SEQ ID NO: 2882364 - protein, 13 aa, Entamoeba invadens
LPTKYQRINGGKT

SEQ ID NO: 2882365 - protein, 9 aa, Entamoeba invadens
LPTLPNKTE

SEQ ID NO: 2882366 - protein, 30 aa, Entamoeba invadens
LPTMGETKTDEVAPAATVKTTTKKKTNKKK

SEQ ID NO: 2882367 - protein, 10 aa, Entamoeba invadens
LPTNADGSHL

SEQ ID NO: 2882368 - protein, 13 aa, Entamoeba invadens
LPTNPSTSSSDSS

SEQ ID NO: 2882369 - protein, 11 aa, Entamoeba invadens
LPTNQKYTKEQ

SEQ ID NO: 2882370 - protein, 7 aa, Entamoeba invadens
LPTPLSE

SEQ ID NO: 2882371 - protein, 5 aa, Entamoeba invadens
LPTPT

SEQ ID NO: 2882372 - protein, 10 aa, Entamoeba invadens
LPTPTRDSEA

SEQ ID NO: 2882373 - protein, 32 aa, Entamoeba invadens
LPTQKRMRTASSADKMGNGENDNESKKSRQKR

SEQ ID NO: 2882374 - protein, 18 aa, Entamoeba invadens
LPTQRRAKRTRKAVASVD

SEQ ID NO: 2882375 - protein, 8 aa, Entamoeba invadens
LPTSEKYN

SEQ ID NO: 2882376 - protein, 7 aa, Entamoeba invadens
LPTSSQL

SEQ ID NO: 2882377 - protein, 10 aa, Entamoeba invadens
LPTSSVGTGN

SEQ ID NO: 2882378 - protein, 5 aa, Entamoeba invadens
LPTSV

SEQ ID NO: 2882379 - protein, 7 aa, Entamoeba invadens
LPTSVTN

SEQ ID NO: 2882380 - protein, 9 aa, Entamoeba invadens
LPTTKEQQA

SEQ ID NO: 2882381 - protein, 28 aa, Entamoeba invadens
LPTTPTKVDTQETHDKPVKKSESPENVK

SEQ ID NO: 2882382 - protein, 5 aa, Entamoeba invadens
LPTTV

SEQ ID NO: 2882383 - protein, 7 aa, Entamoeba invadens
LPTYPQE

SEQ ID NO: 2882384 - protein, 4 aa, Entamoeba invadens
LPVA

SEQ ID NO: 2882385 - protein, 77 aa, Entamoeba invadens
LPVNSPNTQPQQNQRPKSMMPQTRPPPIPTQQKNTQTVQQDAQQQKPQEDKGEEKKVEIKTEPPKEPPKEPPKQIPK

SEQ ID NO: 2882386 - protein, 16 aa, Entamoeba invadens
LPVPKESPHQKEQLKI

SEQ ID NO: 2882387 - protein, 11 aa, Entamoeba invadens
LPVPTDEDGNW

SEQ ID NO: 2882388 - protein, 4 aa, Entamoeba invadens
LPVS

SEQ ID NO: 2882389 - protein, 6 aa, Entamoeba invadens
LPVSEG

SEQ ID NO: 2882390 - protein, 7 aa, Entamoeba invadens
LPVSNSE

SEQ ID NO: 2882391 - protein, 5 aa, Entamoeba invadens
LPYEK

SEQ ID NO: 2882392 - protein, 7 aa, Entamoeba invadens
LPYEKPE

SEQ ID NO: 2882393 - protein, 5 aa, Entamoeba invadens
LPYQY

SEQ ID NO: 2882394 - protein, 14 aa, Entamoeba invadens
LPYTPQGENGYQQY

SEQ ID NO: 2882395 - protein, 18 aa, Entamoeba invadens
LQAAKKKKIDLEELAKTF

SEQ ID NO: 2882396 - protein, 15 aa, Entamoeba invadens
LQAEEEMQEETPKVE

SEQ ID NO: 2882397 - protein, 7 aa, Entamoeba invadens
LQAKKSK

SEQ ID NO: 2882398 - protein, 7 aa, Entamoeba invadens
LQAKSPI

SEQ ID NO: 2882399 - protein, 13 aa, Entamoeba invadens
LQAPLQEQLSSPR

SEQ ID NO: 2882400 - protein, 7 aa, Entamoeba invadens
LQAQPTY

SEQ ID NO: 2882401 - protein, 7 aa, Entamoeba invadens
LQARTTL

SEQ ID NO: 2882402 - protein, 9 aa, Entamoeba invadens
LQASSNSET

SEQ ID NO: 2882403 - protein, 9 aa, Entamoeba invadens
LQATQKQIE

SEQ ID NO: 2882404 - protein, 12 aa, Entamoeba invadens
LQATYTKDKQQI

SEQ ID NO: 2882405 - protein, 9 aa, Entamoeba invadens
LQDEENVEY

SEQ ID NO: 2882406 - protein, 10 aa, Entamoeba invadens
LQDGKTQTKN

SEQ ID NO: 2882407 - protein, 7 aa, Entamoeba invadens
LQDGRRG

SEQ ID NO: 2882408 - protein, 26 aa, Entamoeba invadens
LQDKESVDESKRPNSNPPHCDEAATN

SEQ ID NO: 2882409 - protein, 17 aa, Entamoeba invadens
LQDLQRTKQEKKSKNPF

SEQ ID NO: 2882410 - protein, 7 aa, Entamoeba invadens
LQDNGFN

SEQ ID NO: 2882411 - protein, 7 aa, Entamoeba invadens
LQDPENN

SEQ ID NO: 2882412 - protein, 6 aa, Entamoeba invadens
LQDPET

SEQ ID NO: 2882413 - protein, 15 aa, Entamoeba invadens
LQDPPVDSPDADKYS

SEQ ID NO: 2882414 - protein, 9 aa, Entamoeba invadens
LQDQDGDVI

SEQ ID NO: 2882415 - protein, 20 aa, Entamoeba invadens
LQDQPEETELQKVLKKRRGN

SEQ ID NO: 2882416 - protein, 17 aa, Entamoeba invadens
LQDSERDEVDGFYQANY

SEQ ID NO: 2882417 - protein, 6 aa, Entamoeba invadens
LQDTTR

SEQ ID NO: 2882418 - protein, 10 aa, Entamoeba invadens
LQDVKSKELD

SEQ ID NO: 2882419 - protein, 4 aa, Entamoeba invadens
LQEA

SEQ ID NO: 2882420 - protein, 15 aa, Entamoeba invadens
LQEAHEDVYEVIRKD

SEQ ID NO: 2882421 - protein, 16 aa, Entamoeba invadens
LQEAQDKLYQLRKDQY

SEQ ID NO: 2882422 - protein, 7 aa, Entamoeba invadens
LQEDEEK

SEQ ID NO: 2882423 - protein, 7 aa, Entamoeba invadens
LQEDKTT

SEQ ID NO: 2882424 - protein, 37 aa, Entamoeba invadens
LQEDSNGDQKLKREEKLQQQKKQIQETQLQAEANNKL

SEQ ID NO: 2882425 - protein, 13 aa, Entamoeba invadens
LQEEDKTNRITHT

SEQ ID NO: 2882426 - protein, 11 aa, Entamoeba invadens
LQEEKEEEVAA

SEQ ID NO: 2882427 - protein, 7 aa, Entamoeba invadens
LQEEPDR

SEQ ID NO: 2882428 - protein, 15 aa, Entamoeba invadens
LQEGQLDGGPVVLSA

SEQ ID NO: 2882429 - protein, 5 aa, Entamoeba invadens
LQEGS

SEQ ID NO: 2882430 - protein, 5 aa, Entamoeba invadens
LQEKL

SEQ ID NO: 2882431 - protein, 12 aa, Entamoeba invadens
LQEKSLQQNVEP

SEQ ID NO: 2882432 - protein, 11 aa, Entamoeba invadens
LQEKSSEEYKE

SEQ ID NO: 2882433 - protein, 14 aa, Entamoeba invadens
LQEKYNSQAARDYK

SEQ ID NO: 2882434 - protein, 5 aa, Entamoeba invadens
LQELE

SEQ ID NO: 2882435 - protein, 9 aa, Entamoeba invadens
LQEQEKPTL

SEQ ID NO: 2882436 - protein, 11 aa, Entamoeba invadens
LQERSGQMEED

SEQ ID NO: 2882437 - protein, 13 aa, Entamoeba invadens
LQESEQPKEVIGT

SEQ ID NO: 2882438 - protein, 10 aa, Entamoeba invadens
LQESSEDYTQ

SEQ ID NO: 2882439 - protein, 10 aa, Entamoeba invadens
LQESSQDRKR

SEQ ID NO: 2882440 - protein, 6 aa, Entamoeba invadens
LQETAE

SEQ ID NO: 2882441 - protein, 6 aa, Entamoeba invadens
LQETLT

SEQ ID NO: 2882442 - protein, 8 aa, Entamoeba invadens
LQETPEEN

SEQ ID NO: 2882443 - protein, 23 aa, Entamoeba invadens
LQEVETKTKAVQRDIEKNTNEWN

SEQ ID NO: 2882444 - protein, 4 aa, Entamoeba invadens
LQFP

SEQ ID NO: 2882445 - protein, 11 aa, Entamoeba invadens
LQFTTSQETQI

SEQ ID NO: 2882446 - protein, 6 aa, Entamoeba invadens
LQGAPE

SEQ ID NO: 2882447 - protein, 4 aa, Entamoeba invadens
LQGD

SEQ ID NO: 2882448 - protein, 6 aa, Entamoeba invadens
LQGDSY

SEQ ID NO: 2882449 - protein, 14 aa, Entamoeba invadens
LQGKPGKKVKGARE

SEQ ID NO: 2882450 - protein, 8 aa, Entamoeba invadens
LQGKYGRN

SEQ ID NO: 2882451 - protein, 8 aa, Entamoeba invadens
LQGLPPEW

SEQ ID NO: 2882452 - protein, 8 aa, Entamoeba invadens
LQGNDDDS

SEQ ID NO: 2882453 - protein, 5 aa, Entamoeba invadens
LQGRD

SEQ ID NO: 2882454 - protein, 16 aa, Entamoeba invadens
LQGSQGKMSASDPNSA

SEQ ID NO: 2882455 - protein, 16 aa, Entamoeba invadens
LQGTQIETNIRQGGKE

SEQ ID NO: 2882456 - protein, 4 aa, Entamoeba invadens
LQHK

SEQ ID NO: 2882457 - protein, 4 aa, Entamoeba invadens
LQIG

SEQ ID NO: 2882458 - protein, 11 aa, Entamoeba invadens
LQIPQGSAEPL

SEQ ID NO: 2882459 - protein, 76 aa, Entamoeba invadens
LQITPQKKSSPKSLSPTAQQTPEKPKPDLPPRKQQKVFPKKQKIADKPLSFKSETDAGRAPPPPPKKRNDYQQPSI

SEQ ID NO: 2882460 - protein, 14 aa, Entamoeba invadens
LQKADKATKSTSGK

SEQ ID NO: 2882461 - protein, 26 aa, Entamoeba invadens
LQKAEEDDDGQETKYYAGQIRNNKEN

SEQ ID NO: 2882462 - protein, 8 aa, Entamoeba invadens
LQKDETFE

SEQ ID NO: 2882463 - protein, 12 aa, Entamoeba invadens
LQKEGYNDRSYA

SEQ ID NO: 2882464 - protein, 19 aa, Entamoeba invadens
LQKEKDEQMVNTQKEKEVI

SEQ ID NO: 2882465 - protein, 14 aa, Entamoeba invadens
LQKEKKPKKDDSAL

SEQ ID NO: 2882466 - protein, 7 aa, Entamoeba invadens
LQKEKQK

SEQ ID NO: 2882467 - protein, 22 aa, Entamoeba invadens
LQKEPIKESRSRRLEQKRVDRH

SEQ ID NO: 2882468 - protein, 7 aa, Entamoeba invadens
LQKEQKC

SEQ ID NO: 2882469 - protein, 9 aa, Entamoeba invadens
LQKERDNRS

SEQ ID NO: 2882470 - protein, 24 aa, Entamoeba invadens
LQKESADKTRENKEVQQKMKENEE

SEQ ID NO: 2882471 - protein, 5 aa, Entamoeba invadens
LQKEV

SEQ ID NO: 2882472 - protein, 5 aa, Entamoeba invadens
LQKGE

SEQ ID NO: 2882473 - protein, 19 aa, Entamoeba invadens
LQKGEQSLWTSKDERNMQN

SEQ ID NO: 2882474 - protein, 8 aa, Entamoeba invadens
LQKGKEMP

SEQ ID NO: 2882475 - protein, 10 aa, Entamoeba invadens
LQKKDNEIES

SEQ ID NO: 2882476 - protein, 9 aa, Entamoeba invadens
LQKKGTISS

SEQ ID NO: 2882477 - protein, 4 aa, Entamoeba invadens
LQKN

SEQ ID NO: 2882478 - protein, 8 aa, Entamoeba invadens
LQKNEKKR

SEQ ID NO: 2882479 - protein, 12 aa, Entamoeba invadens
LQKNETRTSLHN

SEQ ID NO: 2882480 - protein, 8 aa, Entamoeba invadens
LQKQSGMH

SEQ ID NO: 2882481 - protein, 8 aa, Entamoeba invadens
LQKREKRI

SEQ ID NO: 2882482 - protein, 8 aa, Entamoeba invadens
LQKSDIDR

SEQ ID NO: 2882483 - protein, 13 aa, Entamoeba invadens
LQKSSDMDCPLCL

SEQ ID NO: 2882484 - protein, 7 aa, Entamoeba invadens
LQKSVSE

SEQ ID NO: 2882485 - protein, 6 aa, Entamoeba invadens
LQKTGA

SEQ ID NO: 2882486 - protein, 8 aa, Entamoeba invadens
LQKTGSFK

SEQ ID NO: 2882487 - protein, 22 aa, Entamoeba invadens
LQKTQVSHEKTIDEKNKEIQKI

SEQ ID NO: 2882488 - protein, 6 aa, Entamoeba invadens
LQLEEE

SEQ ID NO: 2882489 - protein, 14 aa, Entamoeba invadens
LQLKTGATRTIKGN

SEQ ID NO: 2882490 - protein, 6 aa, Entamoeba invadens
LQLNQK

SEQ ID NO: 2882491 - protein, 7 aa, Entamoeba invadens
LQMSDSP

SEQ ID NO: 2882492 - protein, 8 aa, Entamoeba invadens
LQNDSSAS

SEQ ID NO: 2882493 - protein, 14 aa, Entamoeba invadens
LQNDTEDVSLQANS

SEQ ID NO: 2882494 - protein, 11 aa, Entamoeba invadens
LQNDTNNTYKH

SEQ ID NO: 2882495 - protein, 8 aa, Entamoeba invadens
LQNEEPVP

SEQ ID NO: 2882496 - protein, 8 aa, Entamoeba invadens
LQNEKKRK

SEQ ID NO: 2882497 - protein, 7 aa, Entamoeba invadens
LQNEKNS

SEQ ID NO: 2882498 - protein, 5 aa, Entamoeba invadens
LQNET

SEQ ID NO: 2882499 - protein, 9 aa, Entamoeba invadens
LQNGTTTAS

SEQ ID NO: 2882500 - protein, 4 aa, Entamoeba invadens
LQNK

SEQ ID NO: 2882501 - protein, 6 aa, Entamoeba invadens
LQNKGV

SEQ ID NO: 2882502 - protein, 6 aa, Entamoeba invadens
LQNNQS

SEQ ID NO: 2882503 - protein, 7 aa, Entamoeba invadens
LQNPDEM

SEQ ID NO: 2882504 - protein, 7 aa, Entamoeba invadens
LQNPRVD

SEQ ID NO: 2882505 - protein, 39 aa, Entamoeba invadens
LQNRKTTGSPIEKNSVEEVANQNNSDESDTFGPASTPQQ

SEQ ID NO: 2882506 - protein, 9 aa, Entamoeba invadens
LQNRNANIT

SEQ ID NO: 2882507 - protein, 5 aa, Entamoeba invadens
LQNSH

SEQ ID NO: 2882508 - protein, 47 aa, Entamoeba invadens
LQNTTGTQNITNPLGTSATSTPAATTTTTTANSSNPTTTTPAANPIN

SEQ ID NO: 2882509 - protein, 20 aa, Entamoeba invadens
LQPANSAPKSSNSSKERTIN

SEQ ID NO: 2882510 - protein, 4 aa, Entamoeba invadens
LQPE

SEQ ID NO: 2882511 - protein, 6 aa, Entamoeba invadens
LQPEEI

SEQ ID NO: 2882512 - protein, 5 aa, Entamoeba invadens
LQPGS

SEQ ID NO: 2882513 - protein, 7 aa, Entamoeba invadens
LQPGVKK

SEQ ID NO: 2882514 - protein, 24 aa, Entamoeba invadens
LQPINSSPSLQSTSTDITNGNCTL

SEQ ID NO: 2882515 - protein, 8 aa, Entamoeba invadens
LQPNPQPY

SEQ ID NO: 2882516 - protein, 6 aa, Entamoeba invadens
LQPPAI

SEQ ID NO: 2882517 - protein, 15 aa, Entamoeba invadens
LQPPAKNASSNSLNP

SEQ ID NO: 2882518 - protein, 18 aa, Entamoeba invadens
LQPPPKKTPQSNSQYKQT

SEQ ID NO: 2882519 - protein, 4 aa, Entamoeba invadens
LQPQ

SEQ ID NO: 2882520 - protein, 6 aa, Entamoeba invadens
LQPQDV

SEQ ID NO: 2882521 - protein, 7 aa, Entamoeba invadens
LQPQPIQ

SEQ ID NO: 2882522 - protein, 44 aa, Entamoeba invadens
LQPQQIPNQVQSQQGQPQAQWRDQQAQPSQSQQTRPQQGSQQSD

SEQ ID NO: 2882523 - protein, 6 aa, Entamoeba invadens
LQPSQF

SEQ ID NO: 2882524 - protein, 9 aa, Entamoeba invadens
LQPSYASKK

SEQ ID NO: 2882525 - protein, 10 aa, Entamoeba invadens
LQPTESQQNL

SEQ ID NO: 2882526 - protein, 7 aa, Entamoeba invadens
LQPTGNG

SEQ ID NO: 2882527 - protein, 7 aa, Entamoeba invadens
LQPTTVS

SEQ ID NO: 2882528 - protein, 72 aa, Entamoeba invadens
LQPYQKKKSNGPRRERKDDRSDRREEKGGRRDRDDKRHERTEKQEKVETKVEKKEEKKDVKVEAKPDQITED

SEQ ID NO: 2882529 - protein, 10 aa, Entamoeba invadens
LQQAQPQQQM

SEQ ID NO: 2882530 - protein, 6 aa, Entamoeba invadens
LQQEIS

SEQ ID NO: 2882531 - protein, 12 aa, Entamoeba invadens
LQQEKKLSKAQV

SEQ ID NO: 2882532 - protein, 14 aa, Entamoeba invadens
LQQEPEKSLADADV

SEQ ID NO: 2882533 - protein, 6 aa, Entamoeba invadens
LQQGDD

SEQ ID NO: 2882534 - protein, 9 aa, Entamoeba invadens
LQQHDTREI

SEQ ID NO: 2882535 - protein, 26 aa, Entamoeba invadens
LQQKKEKREEKIEKHDKDEKSKADIQ

SEQ ID NO: 2882536 - protein, 7 aa, Entamoeba invadens
LQQKTKK

SEQ ID NO: 2882537 - protein, 43 aa, Entamoeba invadens
LQQLREKEKMPETAEEKLERKKTEKQQKSKKKTTMSKLDNSVD

SEQ ID NO: 2882538 - protein, 8 aa, Entamoeba invadens
LQQNQQNV

SEQ ID NO: 2882539 - protein, 6 aa, Entamoeba invadens
LQQNTV

SEQ ID NO: 2882540 - protein, 9 aa, Entamoeba invadens
LQQPGQSVT

SEQ ID NO: 2882541 - protein, 4 aa, Entamoeba invadens
LQQQ

SEQ ID NO: 2882542 - protein, 5 aa, Entamoeba invadens
LQQQK

SEQ ID NO: 2882543 - protein, 13 aa, Entamoeba invadens
LQQQTTNQNSTNI

SEQ ID NO: 2882544 - protein, 7 aa, Entamoeba invadens
LQQRDDK

SEQ ID NO: 2882545 - protein, 21 aa, Entamoeba invadens
LQQSEREKITEIEKNTSELTD

SEQ ID NO: 2882546 - protein, 8 aa, Entamoeba invadens
LQQSGGSF

SEQ ID NO: 2882547 - protein, 7 aa, Entamoeba invadens
LQQSQSK

SEQ ID NO: 2882548 - protein, 30 aa, Entamoeba invadens
LQQTKANITGEIDGLNKTKEATTSEINTLQ

SEQ ID NO: 2882549 - protein, 13 aa, Entamoeba invadens
LQQTSPTSLHDDT

SEQ ID NO: 2882550 - protein, 17 aa, Entamoeba invadens
LQQTTPKVEQKRDTMES

SEQ ID NO: 2882551 - protein, 9 aa, Entamoeba invadens
LQQTTVEQK

SEQ ID NO: 2882552 - protein, 16 aa, Entamoeba invadens
LQREIEEKKKAEAIER

SEQ ID NO: 2882553 - protein, 7 aa, Entamoeba invadens
LQREKKK

SEQ ID NO: 2882554 - protein, 7 aa, Entamoeba invadens
LQRESRV

SEQ ID NO: 2882555 - protein, 47 aa, Entamoeba invadens
LQRKMEEEEAQKAAQESAGVAAVQNGKGPMARGDGVAVPNDTAPMTQ

SEQ ID NO: 2882556 - protein, 12 aa, Entamoeba invadens
LQRQNQNKNEKC

SEQ ID NO: 2882557 - protein, 4 aa, Entamoeba invadens
LQRR

SEQ ID NO: 2882558 - protein, 7 aa, Entamoeba invadens
LQRTTNN

SEQ ID NO: 2882559 - protein, 10 aa, Entamoeba invadens
LQSATTTHKD

SEQ ID NO: 2882560 - protein, 6 aa, Entamoeba invadens
LQSDNF

SEQ ID NO: 2882561 - protein, 9 aa, Entamoeba invadens
LQSDRGEVF

SEQ ID NO: 2882562 - protein, 8 aa, Entamoeba invadens
LQSDTNEK

SEQ ID NO: 2882563 - protein, 9 aa, Entamoeba invadens
LQSEDKKGI

SEQ ID NO: 2882564 - protein, 5 aa, Entamoeba invadens
LQSEG

SEQ ID NO: 2882565 - protein, 11 aa, Entamoeba invadens
LQSEPPKCPSC

SEQ ID NO: 2882566 - protein, 14 aa, Entamoeba invadens
LQSESTLIKPKPTD

SEQ ID NO: 2882567 - protein, 6 aa, Entamoeba invadens
LQSFKG

SEQ ID NO: 2882568 - protein, 4 aa, Entamoeba invadens
LQSI

SEQ ID NO: 2882569 - protein, 11 aa, Entamoeba invadens
LQSKKGKYVAN

SEQ ID NO: 2882570 - protein, 9 aa, Entamoeba invadens
LQSKSRTFR

SEQ ID NO: 2882571 - protein, 5 aa, Entamoeba invadens
LQSKV

SEQ ID NO: 2882572 - protein, 7 aa, Entamoeba invadens
LQSPEDY

SEQ ID NO: 2882573 - protein, 15 aa, Entamoeba invadens
LQSPQQLSPQESKPD

SEQ ID NO: 2882574 - protein, 22 aa, Entamoeba invadens
LQSQNDYLKSADEENKSKIRQM

SEQ ID NO: 2882575 - protein, 22 aa, Entamoeba invadens
LQSQNDYLSGADEENKNKIREM

SEQ ID NO: 2882576 - protein, 9 aa, Entamoeba invadens
LQSQTPQNN

SEQ ID NO: 2882577 - protein, 7 aa, Entamoeba invadens
LQSSATD

SEQ ID NO: 2882578 - protein, 5 aa, Entamoeba invadens
LQSSD

SEQ ID NO: 2882579 - protein, 15 aa, Entamoeba invadens
LQSSGLSKQASPNIQ

SEQ ID NO: 2882580 - protein, 20 aa, Entamoeba invadens
LQSSKPGITDDQMKSEIESN

SEQ ID NO: 2882581 - protein, 6 aa, Entamoeba invadens
LQSSSE

SEQ ID NO: 2882582 - protein, 9 aa, Entamoeba invadens
LQSTELDND

SEQ ID NO: 2882583 - protein, 17 aa, Entamoeba invadens
LQSTHQTSNKEEAITQS

SEQ ID NO: 2882584 - protein, 10 aa, Entamoeba invadens
LQSTQEDEAI

SEQ ID NO: 2882585 - protein, 12 aa, Entamoeba invadens
LQTASDLGVKAD

SEQ ID NO: 2882586 - protein, 5 aa, Entamoeba invadens
LQTAT

SEQ ID NO: 2882587 - protein, 7 aa, Entamoeba invadens
LQTDPIT

SEQ ID NO: 2882588 - protein, 6 aa, Entamoeba invadens
LQTEDQ

SEQ ID NO: 2882589 - protein, 9 aa, Entamoeba invadens
LQTEKQAKN

SEQ ID NO: 2882590 - protein, 4 aa, Entamoeba invadens
LQTF

SEQ ID NO: 2882591 - protein, 7 aa, Entamoeba invadens
LQTGFDE

SEQ ID NO: 2882592 - protein, 8 aa, Entamoeba invadens
LQTGPTTL

SEQ ID NO: 2882593 - protein, 7 aa, Entamoeba invadens
LQTKEEA

SEQ ID NO: 2882594 - protein, 25 aa, Entamoeba invadens
LQTNQQMQGQQEMNTQPQIAPQLVT

SEQ ID NO: 2882595 - protein, 6 aa, Entamoeba invadens
LQTNRN

SEQ ID NO: 2882596 - protein, 11 aa, Entamoeba invadens
LQTNSPSQSFS

SEQ ID NO: 2882597 - protein, 11 aa, Entamoeba invadens
LQTPGSRREQM

SEQ ID NO: 2882598 - protein, 7 aa, Entamoeba invadens
LQTQNSS

SEQ ID NO: 2882599 - protein, 11 aa, Entamoeba invadens
LQTQQKENVAV

SEQ ID NO: 2882600 - protein, 6 aa, Entamoeba invadens
LQTQSG

SEQ ID NO: 2882601 - protein, 13 aa, Entamoeba invadens
LQTRKKRYEKERG

SEQ ID NO: 2882602 - protein, 9 aa, Entamoeba invadens
LQTRVTSST

SEQ ID NO: 2882603 - protein, 6 aa, Entamoeba invadens
LQTSPL

SEQ ID NO: 2882604 - protein, 9 aa, Entamoeba invadens
LQTSPTKKL

SEQ ID NO: 2882605 - protein, 16 aa, Entamoeba invadens
LQTSVSSHDYTGAEYN

SEQ ID NO: 2882606 - protein, 9 aa, Entamoeba invadens
LQTTIESGN

SEQ ID NO: 2882607 - protein, 6 aa, Entamoeba invadens
LQTTTL

SEQ ID NO: 2882608 - protein, 15 aa, Entamoeba invadens
LQTYEKSRSDEKTIK

SEQ ID NO: 2882609 - protein, 4 aa, Entamoeba invadens
LQYE

SEQ ID NO: 2882610 - protein, 8 aa, Entamoeba invadens
LQYPQNYE

SEQ ID NO: 2882611 - protein, 8 aa, Entamoeba invadens
LRAENEEL

SEQ ID NO: 2882612 - protein, 32 aa, Entamoeba invadens
LRAENSRLSDQLSQHKDVKDSLVQSEENINKL

SEQ ID NO: 2882613 - protein, 26 aa, Entamoeba invadens
LRAKQKELETIKKEEQRCDTISTNKR

SEQ ID NO: 2882614 - protein, 17 aa, Entamoeba invadens
LRAQEEKAKKKELDSRK

SEQ ID NO: 2882615 - protein, 5 aa, Entamoeba invadens
LRATD

SEQ ID NO: 2882616 - protein, 4 aa, Entamoeba invadens
LRDD

SEQ ID NO: 2882617 - protein, 16 aa, Entamoeba invadens
LRDEESERGVLCVSLR

SEQ ID NO: 2882618 - protein, 20 aa, Entamoeba invadens
LRDERKTAKGKNKPKRKSSL

SEQ ID NO: 2882619 - protein, 13 aa, Entamoeba invadens
LRDGDKARFGGKG

SEQ ID NO: 2882620 - protein, 15 aa, Entamoeba invadens
LRDGWEAKQDQSGNL

SEQ ID NO: 2882621 - protein, 4 aa, Entamoeba invadens
LRDK

SEQ ID NO: 2882622 - protein, 10 aa, Entamoeba invadens
LRDKKKEVRD

SEQ ID NO: 2882623 - protein, 21 aa, Entamoeba invadens
LRDKREKDRKALKKKNKKLGV

SEQ ID NO: 2882624 - protein, 13 aa, Entamoeba invadens
LRDKTAKDKKKIA

SEQ ID NO: 2882625 - protein, 11 aa, Entamoeba invadens
LRDKTASYFPG

SEQ ID NO: 2882626 - protein, 4 aa, Entamoeba invadens
LRDR

SEQ ID NO: 2882627 - protein, 7 aa, Entamoeba invadens
LRDRDTM

SEQ ID NO: 2882628 - protein, 12 aa, Entamoeba invadens
LRDRTTKNKKKI

SEQ ID NO: 2882629 - protein, 14 aa, Entamoeba invadens
LRDSEGAKTQNEIK

SEQ ID NO: 2882630 - protein, 9 aa, Entamoeba invadens
LRDTARQEC

SEQ ID NO: 2882631 - protein, 11 aa, Entamoeba invadens
LRDTTNNTQEV

SEQ ID NO: 2882632 - protein, 14 aa, Entamoeba invadens
LREDAYKGLSPESM

SEQ ID NO: 2882633 - protein, 10 aa, Entamoeba invadens
LREDDDNYKQ

SEQ ID NO: 2882634 - protein, 7 aa, Entamoeba invadens
LREDETM

SEQ ID NO: 2882635 - protein, 7 aa, Entamoeba invadens
LREDPNC

SEQ ID NO: 2882636 - protein, 21 aa, Entamoeba invadens
LREDRSSSRSSSRGKGDGKSH

SEQ ID NO: 2882637 - protein, 10 aa, Entamoeba invadens
LREEESESIK

SEQ ID NO: 2882638 - protein, 19 aa, Entamoeba invadens
LREEGNKEHTSQPEGTELA

SEQ ID NO: 2882639 - protein, 8 aa, Entamoeba invadens
LREEKNKQ

SEQ ID NO: 2882640 - protein, 7 aa, Entamoeba invadens
LREENKK

SEQ ID NO: 2882641 - protein, 16 aa, Entamoeba invadens
LREKGDFNVSDEEVKE

SEQ ID NO: 2882642 - protein, 8 aa, Entamoeba invadens
LRENETRV

SEQ ID NO: 2882643 - protein, 8 aa, Entamoeba invadens
LRENSDIA

SEQ ID NO: 2882644 - protein, 6 aa, Entamoeba invadens
LRENSF

SEQ ID NO: 2882645 - protein, 4 aa, Entamoeba invadens
LREQ

SEQ ID NO: 2882646 - protein, 14 aa, Entamoeba invadens
LREQEEKERIEKAR

SEQ ID NO: 2882647 - protein, 7 aa, Entamoeba invadens
LREQPPH

SEQ ID NO: 2882648 - protein, 5 aa, Entamoeba invadens
LRERK

SEQ ID NO: 2882649 - protein, 7 aa, Entamoeba invadens
LRESAND

SEQ ID NO: 2882650 - protein, 17 aa, Entamoeba invadens
LRESYDKRKQDEFERNK

SEQ ID NO: 2882651 - protein, 11 aa, Entamoeba invadens
LRGANKKSTIE

SEQ ID NO: 2882652 - protein, 13 aa, Entamoeba invadens
LRGASQTSCQKII

SEQ ID NO: 2882653 - protein, 4 aa, Entamoeba invadens
LRGD

SEQ ID NO: 2882654 - protein, 22 aa, Entamoeba invadens
LRGDEEKPKDTTDEAAAAEDQV

SEQ ID NO: 2882655 - protein, 6 aa, Entamoeba invadens
LRGEKV

SEQ ID NO: 2882656 - protein, 8 aa, Entamoeba invadens
LRGGERND

SEQ ID NO: 2882657 - protein, 7 aa, Entamoeba invadens
LRGISKE

SEQ ID NO: 2882658 - protein, 10 aa, Entamoeba invadens
LRGKNGHMEN

SEQ ID NO: 2882659 - protein, 4 aa, Entamoeba invadens
LRGN

SEQ ID NO: 2882660 - protein, 7 aa, Entamoeba invadens
LRGNETY

SEQ ID NO: 2882661 - protein, 8 aa, Entamoeba invadens
LRGPQGSV

SEQ ID NO: 2882662 - protein, 5 aa, Entamoeba invadens
LRGTN

SEQ ID NO: 2882663 - protein, 5 aa, Entamoeba invadens
LRKEK

SEQ ID NO: 2882664 - protein, 10 aa, Entamoeba invadens
LRKEKGELHN

SEQ ID NO: 2882665 - protein, 11 aa, Entamoeba invadens
LRKGEYAYEPE

SEQ ID NO: 2882666 - protein, 9 aa, Entamoeba invadens
LRKGFNDSI

SEQ ID NO: 2882667 - protein, 5 aa, Entamoeba invadens
LRKGK

SEQ ID NO: 2882668 - protein, 12 aa, Entamoeba invadens
LRKISEKDLEAS

SEQ ID NO: 2882669 - protein, 10 aa, Entamoeba invadens
LRKKDNEKNV

SEQ ID NO: 2882670 - protein, 9 aa, Entamoeba invadens
LRKKSFDEV

SEQ ID NO: 2882671 - protein, 10 aa, Entamoeba invadens
LRKPDQPTLI

SEQ ID NO: 2882672 - protein, 20 aa, Entamoeba invadens
LRKQAEAKRLEEDKKKEEAI

SEQ ID NO: 2882673 - protein, 10 aa, Entamoeba invadens
LRKSQRPKTM

SEQ ID NO: 2882674 - protein, 6 aa, Entamoeba invadens
LRKSTI

SEQ ID NO: 2882675 - protein, 5 aa, Entamoeba invadens
LRKTE

SEQ ID NO: 2882676 - protein, 8 aa, Entamoeba invadens
LRKTNTEL

SEQ ID NO: 2882677 - protein, 24 aa, Entamoeba invadens
LRKTPRETPRQRAEREKSSKTPEL

SEQ ID NO: 2882678 - protein, 7 aa, Entamoeba invadens
LRKTRPN

SEQ ID NO: 2882679 - protein, 5 aa, Entamoeba invadens
LRKVE

SEQ ID NO: 2882680 - protein, 23 aa, Entamoeba invadens
LRNDKTDRSERSDRSDKSISESI

SEQ ID NO: 2882681 - protein, 8 aa, Entamoeba invadens
LRNDPEVK

SEQ ID NO: 2882682 - protein, 9 aa, Entamoeba invadens
LRNDPQTED

SEQ ID NO: 2882683 - protein, 12 aa, Entamoeba invadens
LRNENENLERMS

SEQ ID NO: 2882684 - protein, 9 aa, Entamoeba invadens
LRNETGRKL

SEQ ID NO: 2882685 - protein, 13 aa, Entamoeba invadens
LRNKKNKKGRRAK

SEQ ID NO: 2882686 - protein, 16 aa, Entamoeba invadens
LRNKKVEYQNSQDKKL

SEQ ID NO: 2882687 - protein, 6 aa, Entamoeba invadens
LRNNES

SEQ ID NO: 2882688 - protein, 11 aa, Entamoeba invadens
LRNPSTYDVPS

SEQ ID NO: 2882689 - protein, 6 aa, Entamoeba invadens
LRNRDH

SEQ ID NO: 2882690 - protein, 20 aa, Entamoeba invadens
LRNRSSSAFEPVDKNMFTVC

SEQ ID NO: 2882691 - protein, 14 aa, Entamoeba invadens
LRNSGGSVNKNIDF

SEQ ID NO: 2882692 - protein, 11 aa, Entamoeba invadens
LRNSNNKPTRF

SEQ ID NO: 2882693 - protein, 8 aa, Entamoeba invadens
LRPGRCDG

SEQ ID NO: 2882694 - protein, 36 aa, Entamoeba invadens
LRPKTPKPTEEQALAQGAKPKVQQQKQEEEKQHQKV

SEQ ID NO: 2882695 - protein, 6 aa, Entamoeba invadens
LRPNTE

SEQ ID NO: 2882696 - protein, 7 aa, Entamoeba invadens
LRPPIPP

SEQ ID NO: 2882697 - protein, 7 aa, Entamoeba invadens
LRPPNEY

SEQ ID NO: 2882698 - protein, 9 aa, Entamoeba invadens
LRPQPSAYG

SEQ ID NO: 2882699 - protein, 12 aa, Entamoeba invadens
LRPSEAVSAETA

SEQ ID NO: 2882700 - protein, 11 aa, Entamoeba invadens
LRPSGNSGVKG

SEQ ID NO: 2882701 - protein, 6 aa, Entamoeba invadens
LRPTET

SEQ ID NO: 2882702 - protein, 10 aa, Entamoeba invadens
LRPTEYQNNP

SEQ ID NO: 2882703 - protein, 19 aa, Entamoeba invadens
LRQKEAEMKAQEEKRANAA

SEQ ID NO: 2882704 - protein, 12 aa, Entamoeba invadens
LRQKEEDKTPIR

SEQ ID NO: 2882705 - protein, 15 aa, Entamoeba invadens
LRQKPKLAKEKCFSM

SEQ ID NO: 2882706 - protein, 12 aa, Entamoeba invadens
LRQKTTNGKYGA

SEQ ID NO: 2882707 - protein, 12 aa, Entamoeba invadens
LRQNKDQSSIAG

SEQ ID NO: 2882708 - protein, 12 aa, Entamoeba invadens
LRQSEEDKTAEL

SEQ ID NO: 2882709 - protein, 6 aa, Entamoeba invadens
LRREEV

SEQ ID NO: 2882710 - protein, 6 aa, Entamoeba invadens
LRREND

SEQ ID NO: 2882711 - protein, 7 aa, Entamoeba invadens
LRRENTN

SEQ ID NO: 2882712 - protein, 5 aa, Entamoeba invadens
LRRGE

SEQ ID NO: 2882713 - protein, 8 aa, Entamoeba invadens
LRRPASKL

SEQ ID NO: 2882714 - protein, 4 aa, Entamoeba invadens
LRRQ

SEQ ID NO: 2882715 - protein, 6 aa, Entamoeba invadens
LRRQSN

SEQ ID NO: 2882716 - protein, 23 aa, Entamoeba invadens
LRSAPKASPPPTSWEERLLKCKI

SEQ ID NO: 2882717 - protein, 4 aa, Entamoeba invadens
LRSE

SEQ ID NO: 2882718 - protein, 10 aa, Entamoeba invadens
LRSEKSEDGC

SEQ ID NO: 2882719 - protein, 14 aa, Entamoeba invadens
LRSGKKRKIAKEDF

SEQ ID NO: 2882720 - protein, 6 aa, Entamoeba invadens
LRSGRS

SEQ ID NO: 2882721 - protein, 7 aa, Entamoeba invadens
LRSIEDG

SEQ ID NO: 2882722 - protein, 24 aa, Entamoeba invadens
LRSKTIDLSTNDSSTSSKKDVKEC

SEQ ID NO: 2882723 - protein, 36 aa, Entamoeba invadens
LRSLKEKTEKEKRMSETHGKESGVKEEKNEYSTNER

SEQ ID NO: 2882724 - protein, 9 aa, Entamoeba invadens
LRSQGKLYE

SEQ ID NO: 2882725 - protein, 7 aa, Entamoeba invadens
LRSRGTS

SEQ ID NO: 2882726 - protein, 7 aa, Entamoeba invadens
LRSRSRS

SEQ ID NO: 2882727 - protein, 11 aa, Entamoeba invadens
LRSTKSSNNVM

SEQ ID NO: 2882728 - protein, 9 aa, Entamoeba invadens
LRSTRTEIP

SEQ ID NO: 2882729 - protein, 12 aa, Entamoeba invadens
LRSVESGIQMPM

SEQ ID NO: 2882730 - protein, 21 aa, Entamoeba invadens
LRSYKKEDKENGRNDRFCKIF

SEQ ID NO: 2882731 - protein, 4 aa, Entamoeba invadens
LRTD

SEQ ID NO: 2882732 - protein, 4 aa, Entamoeba invadens
LRTE

SEQ ID NO: 2882733 - protein, 28 aa, Entamoeba invadens
LRTKEEREKKPRAPPKRKRVYFFVEDLD

SEQ ID NO: 2882734 - protein, 14 aa, Entamoeba invadens
LRTLDKARQKMGEM

SEQ ID NO: 2882735 - protein, 9 aa, Entamoeba invadens
LRTNENYTS

SEQ ID NO: 2882736 - protein, 6 aa, Entamoeba invadens
LRTPSQ

SEQ ID NO: 2882737 - protein, 16 aa, Entamoeba invadens
LRTSGKVTPVRDQAQC

SEQ ID NO: 2882738 - protein, 14 aa, Entamoeba invadens
LRVEQPNSGRTRDE

SEQ ID NO: 2882739 - protein, 4 aa, Entamoeba invadens
LRVK

SEQ ID NO: 2882740 - protein, 14 aa, Entamoeba invadens
LRYPKTTVPPNQNN

SEQ ID NO: 2882741 - protein, 5 aa, Entamoeba invadens
LSAAA

SEQ ID NO: 2882742 - protein, 13 aa, Entamoeba invadens
LSAASTPLKLNNT

SEQ ID NO: 2882743 - protein, 4 aa, Entamoeba invadens
LSAD

SEQ ID NO: 2882744 - protein, 17 aa, Entamoeba invadens
LSADDYLSGKDAKPKEV

SEQ ID NO: 2882745 - protein, 14 aa, Entamoeba invadens
LSADNTKQTNFEDK

SEQ ID NO: 2882746 - protein, 30 aa, Entamoeba invadens
LSAEAEGQRQNPNAQYQQPAQVYSDQSRNV

SEQ ID NO: 2882747 - protein, 13 aa, Entamoeba invadens
LSAEDKEKEGKEL

SEQ ID NO: 2882748 - protein, 7 aa, Entamoeba invadens
LSAKDSD

SEQ ID NO: 2882749 - protein, 6 aa, Entamoeba invadens
LSAKNV

SEQ ID NO: 2882750 - protein, 9 aa, Entamoeba invadens
LSAKTPVST

SEQ ID NO: 2882751 - protein, 25 aa, Entamoeba invadens
LSAKTSKTQLITNNNAQRNQIKAER

SEQ ID NO: 2882752 - protein, 25 aa, Entamoeba invadens
LSAKTSKTQVMTNNTAQRNQIKAER

SEQ ID NO: 2882753 - protein, 26 aa, Entamoeba invadens
LSAKTSKTQVMTNNTAQRNQIKEERD

SEQ ID NO: 2882754 - protein, 11 aa, Entamoeba invadens
LSANKARAGSM

SEQ ID NO: 2882755 - protein, 17 aa, Entamoeba invadens
LSANKSTSSCGSTGSSL

SEQ ID NO: 2882756 - protein, 9 aa, Entamoeba invadens
LSANQGIQQ

SEQ ID NO: 2882757 - protein, 9 aa, Entamoeba invadens
LSAPKDSKV

SEQ ID NO: 2882758 - protein, 7 aa, Entamoeba invadens
LSAPKYG

SEQ ID NO: 2882759 - protein, 8 aa, Entamoeba invadens
LSASAGIQ

SEQ ID NO: 2882760 - protein, 5 aa, Entamoeba invadens
LSASE

SEQ ID NO: 2882761 - protein, 9 aa, Entamoeba invadens
LSASIDKGE

SEQ ID NO: 2882762 - protein, 11 aa, Entamoeba invadens
LSASTSPKETI

SEQ ID NO: 2882763 - protein, 9 aa, Entamoeba invadens
LSATEKNKL

SEQ ID NO: 2882764 - protein, 8 aa, Entamoeba invadens
LSATKPNT

SEQ ID NO: 2882765 - protein, 7 aa, Entamoeba invadens
LSATNSL

SEQ ID NO: 2882766 - protein, 25 aa, Entamoeba invadens
LSATTKSDKIKTDISTQKSSTLSEL

SEQ ID NO: 2882767 - protein, 5 aa, Entamoeba invadens
LSCGD

SEQ ID NO: 2882768 - protein, 12 aa, Entamoeba invadens
LSCNKDQRYDFN

SEQ ID NO: 2882769 - protein, 6 aa, Entamoeba invadens
LSDAER

SEQ ID NO: 2882770 - protein, 10 aa, Entamoeba invadens
LSDAERQQNA

SEQ ID NO: 2882771 - protein, 6 aa, Entamoeba invadens
LSDAFG

SEQ ID NO: 2882772 - protein, 8 aa, Entamoeba invadens
LSDATTDK

SEQ ID NO: 2882773 - protein, 13 aa, Entamoeba invadens
LSDCGGSQYSLTT

SEQ ID NO: 2882774 - protein, 9 aa, Entamoeba invadens
LSDDARGFE

SEQ ID NO: 2882775 - protein, 10 aa, Entamoeba invadens
LSDDERQKAE

SEQ ID NO: 2882776 - protein, 7 aa, Entamoeba invadens
LSDDQKQ

SEQ ID NO: 2882777 - protein, 41 aa, Entamoeba invadens
LSDDSEEGTRQHRNRKRDRKDNRQNSRRDVQPVEEQPTLAP

SEQ ID NO: 2882778 - protein, 16 aa, Entamoeba invadens
LSDDYIEDNPDCEDKC

SEQ ID NO: 2882779 - protein, 22 aa, Entamoeba invadens
LSDEEKEKIRRKKRRSSLTPLD

SEQ ID NO: 2882780 - protein, 8 aa, Entamoeba invadens
LSDEELTK

SEQ ID NO: 2882781 - protein, 8 aa, Entamoeba invadens
LSDGETEI

SEQ ID NO: 2882782 - protein, 8 aa, Entamoeba invadens
LSDGNTEI

SEQ ID NO: 2882783 - protein, 4 aa, Entamoeba invadens
LSDI

SEQ ID NO: 2882784 - protein, 9 aa, Entamoeba invadens
LSDKDEDFP

SEQ ID NO: 2882785 - protein, 8 aa, Entamoeba invadens
LSDKEEEI

SEQ ID NO: 2882786 - protein, 9 aa, Entamoeba invadens
LSDKEKTSA

SEQ ID NO: 2882787 - protein, 9 aa, Entamoeba invadens
LSDKKEEVF

SEQ ID NO: 2882788 - protein, 12 aa, Entamoeba invadens
LSDKSQKVEEMT

SEQ ID NO: 2882789 - protein, 7 aa, Entamoeba invadens
LSDKTRF

SEQ ID NO: 2882790 - protein, 4 aa, Entamoeba invadens
LSDL

SEQ ID NO: 2882791 - protein, 11 aa, Entamoeba invadens
LSDLADKKKLQ

SEQ ID NO: 2882792 - protein, 5 aa, Entamoeba invadens
LSDLT

SEQ ID NO: 2882793 - protein, 5 aa, Entamoeba invadens
LSDMD

SEQ ID NO: 2882794 - protein, 19 aa, Entamoeba invadens
LSDMDEEDDVEDVSDYRYG

SEQ ID NO: 2882795 - protein, 7 aa, Entamoeba invadens
LSDNEFE

SEQ ID NO: 2882796 - protein, 5 aa, Entamoeba invadens
LSDNL

SEQ ID NO: 2882797 - protein, 5 aa, Entamoeba invadens
LSDNV

SEQ ID NO: 2882798 - protein, 35 aa, Entamoeba invadens
LSDPKKKEIYDNYGEEGLKSGMGGGNGGFSFGGSD

SEQ ID NO: 2882799 - protein, 38 aa, Entamoeba invadens
LSDPKKKEIYDRYGEDGLKAGMTGEQQYDGMKGFPGGS

SEQ ID NO: 2882800 - protein, 13 aa, Entamoeba invadens
LSDPKQKTRARSG

SEQ ID NO: 2882801 - protein, 8 aa, Entamoeba invadens
LSDPQSKK

SEQ ID NO: 2882802 - protein, 5 aa, Entamoeba invadens
LSDQI

SEQ ID NO: 2882803 - protein, 9 aa, Entamoeba invadens
LSDQKENVP

SEQ ID NO: 2882804 - protein, 15 aa, Entamoeba invadens
LSDQYRSWQNGSKIE

SEQ ID NO: 2882805 - protein, 11 aa, Entamoeba invadens
LSDSESKMQEF

SEQ ID NO: 2882806 - protein, 25 aa, Entamoeba invadens
LSDSKKREVYDRYGKKGLEEGGMSG

SEQ ID NO: 2882807 - protein, 10 aa, Entamoeba invadens
LSDSVAKSNA

SEQ ID NO: 2882808 - protein, 7 aa, Entamoeba invadens
LSDTDEK

SEQ ID NO: 2882809 - protein, 11 aa, Entamoeba invadens
LSDTDGDNEHK

SEQ ID NO: 2882810 - protein, 8 aa, Entamoeba invadens
LSDTERSI

SEQ ID NO: 2882811 - protein, 10 aa, Entamoeba invadens
LSDTKSGKYA

SEQ ID NO: 2882812 - protein, 5 aa, Entamoeba invadens
LSDTN

SEQ ID NO: 2882813 - protein, 6 aa, Entamoeba invadens
LSDTNL

SEQ ID NO: 2882814 - protein, 12 aa, Entamoeba invadens
LSDTNLKRPDLS

SEQ ID NO: 2882815 - protein, 6 aa, Entamoeba invadens
LSDTRD

SEQ ID NO: 2882816 - protein, 34 aa, Entamoeba invadens
LSEAEDDSIQKTPEDSPEKEKGRSLFQQSPTKRI

SEQ ID NO: 2882817 - protein, 8 aa, Entamoeba invadens
LSEAEGQR

SEQ ID NO: 2882818 - protein, 12 aa, Entamoeba invadens
LSEAGPEDNEEK

SEQ ID NO: 2882819 - protein, 5 aa, Entamoeba invadens
LSEAR

SEQ ID NO: 2882820 - protein, 6 aa, Entamoeba invadens
LSEASS

SEQ ID NO: 2882821 - protein, 13 aa, Entamoeba invadens
LSEDDEVEDASNR

SEQ ID NO: 2882822 - protein, 21 aa, Entamoeba invadens
LSEDEKKVYTEEYKKEKDVLD

SEQ ID NO: 2882823 - protein, 11 aa, Entamoeba invadens
LSEDEKQRYIG

SEQ ID NO: 2882824 - protein, 6 aa, Entamoeba invadens
LSEDQK

SEQ ID NO: 2882825 - protein, 8 aa, Entamoeba invadens
LSEDSDIS

SEQ ID NO: 2882826 - protein, 6 aa, Entamoeba invadens
LSEDVA

SEQ ID NO: 2882827 - protein, 6 aa, Entamoeba invadens
LSEDVS

SEQ ID NO: 2882828 - protein, 11 aa, Entamoeba invadens
LSEEDNRTTQT

SEQ ID NO: 2882829 - protein, 9 aa, Entamoeba invadens
LSEEEESEF

SEQ ID NO: 2882830 - protein, 7 aa, Entamoeba invadens
LSEEEME

SEQ ID NO: 2882831 - protein, 10 aa, Entamoeba invadens
LSEEKLEHKQ

SEQ ID NO: 2882832 - protein, 8 aa, Entamoeba invadens
LSEENSFT

SEQ ID NO: 2882833 - protein, 10 aa, Entamoeba invadens
LSEESAPSVT

SEQ ID NO: 2882834 - protein, 6 aa, Entamoeba invadens
LSEESL

SEQ ID NO: 2882835 - protein, 5 aa, Entamoeba invadens
LSEEV

SEQ ID NO: 2882836 - protein, 13 aa, Entamoeba invadens
LSEGASSLSTQLQ

SEQ ID NO: 2882837 - protein, 9 aa, Entamoeba invadens
LSEGSPDVP

SEQ ID NO: 2882838 - protein, 9 aa, Entamoeba invadens
LSEGSSVEI

SEQ ID NO: 2882839 - protein, 8 aa, Entamoeba invadens
LSEGTTDI

SEQ ID NO: 2882840 - protein, 4 aa, Entamoeba invadens
LSEH

SEQ ID NO: 2882841 - protein, 5 aa, Entamoeba invadens
LSEHN

SEQ ID NO: 2882842 - protein, 5 aa, Entamoeba invadens
LSEHV

SEQ ID NO: 2882843 - protein, 4 aa, Entamoeba invadens
LSEI

SEQ ID NO: 2882844 - protein, 20 aa, Entamoeba invadens
LSEKNMNNGDDNENIDERPI

SEQ ID NO: 2882845 - protein, 6 aa, Entamoeba invadens
LSEKPL

SEQ ID NO: 2882846 - protein, 5 aa, Entamoeba invadens
LSEKR

SEQ ID NO: 2882847 - protein, 6 aa, Entamoeba invadens
LSEKSD

SEQ ID NO: 2882848 - protein, 8 aa, Entamoeba invadens
LSEKTAAI

SEQ ID NO: 2882849 - protein, 4 aa, Entamoeba invadens
LSEL

SEQ ID NO: 2882850 - protein, 7 aa, Entamoeba invadens
LSELGTK

SEQ ID NO: 2882851 - protein, 7 aa, Entamoeba invadens
LSELTEK

SEQ ID NO: 2882852 - protein, 9 aa, Entamoeba invadens
LSEMSRNTQ

SEQ ID NO: 2882853 - protein, 4 aa, Entamoeba invadens
LSEN

SEQ ID NO: 2882854 - protein, 22 aa, Entamoeba invadens
LSENDESDSSLSIDREPKTPTF

SEQ ID NO: 2882855 - protein, 5 aa, Entamoeba invadens
LSENE

SEQ ID NO: 2882856 - protein, 11 aa, Entamoeba invadens
LSENKELSDRI

SEQ ID NO: 2882857 - protein, 8 aa, Entamoeba invadens
LSENNSVY

SEQ ID NO: 2882858 - protein, 10 aa, Entamoeba invadens
LSENNTNEKG

SEQ ID NO: 2882859 - protein, 5 aa, Entamoeba invadens
LSENS

SEQ ID NO: 2882860 - protein, 6 aa, Entamoeba invadens
LSEPNI

SEQ ID NO: 2882861 - protein, 6 aa, Entamoeba invadens
LSEPNS

SEQ ID NO: 2882862 - protein, 6 aa, Entamoeba invadens
LSEPSM

SEQ ID NO: 2882863 - protein, 5 aa, Entamoeba invadens
LSEPY

SEQ ID NO: 2882864 - protein, 14 aa, Entamoeba invadens
LSERAQISETLNKA

SEQ ID NO: 2882865 - protein, 6 aa, Entamoeba invadens
LSEREF

SEQ ID NO: 2882866 - protein, 5 aa, Entamoeba invadens
LSERG

SEQ ID NO: 2882867 - protein, 6 aa, Entamoeba invadens
LSERQS

SEQ ID NO: 2882868 - protein, 9 aa, Entamoeba invadens
LSESATASL

SEQ ID NO: 2882869 - protein, 12 aa, Entamoeba invadens
LSESDDFQDETY

SEQ ID NO: 2882870 - protein, 24 aa, Entamoeba invadens
LSESDIQKISNDIENEKEVKKITN

SEQ ID NO: 2882871 - protein, 6 aa, Entamoeba invadens
LSESDP

SEQ ID NO: 2882872 - protein, 13 aa, Entamoeba invadens
LSESEKKKYTDMY

SEQ ID NO: 2882873 - protein, 16 aa, Entamoeba invadens
LSESEQMDNELSASEE

SEQ ID NO: 2882874 - protein, 7 aa, Entamoeba invadens
LSESNHL

SEQ ID NO: 2882875 - protein, 8 aa, Entamoeba invadens
LSESNRRA

SEQ ID NO: 2882876 - protein, 9 aa, Entamoeba invadens
LSESQINAV

SEQ ID NO: 2882877 - protein, 4 aa, Entamoeba invadens
LSET

SEQ ID NO: 2882878 - protein, 9 aa, Entamoeba invadens
LSETATTLD

SEQ ID NO: 2882879 - protein, 13 aa, Entamoeba invadens
LSETKEAKNTREW

SEQ ID NO: 2882880 - protein, 7 aa, Entamoeba invadens
LSETTKP

SEQ ID NO: 2882881 - protein, 7 aa, Entamoeba invadens
LSETTTD

SEQ ID NO: 2882882 - protein, 7 aa, Entamoeba invadens
LSEVDTK

SEQ ID NO: 2882883 - protein, 25 aa, Entamoeba invadens
LSEYTIQPSDEPLKTFPPGSQLNSE

SEQ ID NO: 2882884 - protein, 4 aa, Entamoeba invadens
LSFS

SEQ ID NO: 2882885 - protein, 8 aa, Entamoeba invadens
LSFSNPNT

SEQ ID NO: 2882886 - protein, 11 aa, Entamoeba invadens
LSFSSKGCAND

SEQ ID NO: 2882887 - protein, 6 aa, Entamoeba invadens
LSFTQQ

SEQ ID NO: 2882888 - protein, 12 aa, Entamoeba invadens
LSGAPPPAINPS

SEQ ID NO: 2882889 - protein, 10 aa, Entamoeba invadens
LSGAQSPLGN

SEQ ID NO: 2882890 - protein, 7 aa, Entamoeba invadens
LSGCDSR

SEQ ID NO: 2882891 - protein, 7 aa, Entamoeba invadens
LSGDEIA

SEQ ID NO: 2882892 - protein, 38 aa, Entamoeba invadens
LSGDRARQEKQGKREIDKITKEARRLKRDEKELSTKKQ

SEQ ID NO: 2882893 - protein, 7 aa, Entamoeba invadens
LSGDTSL

SEQ ID NO: 2882894 - protein, 6 aa, Entamoeba invadens
LSGDVT

SEQ ID NO: 2882895 - protein, 4 aa, Entamoeba invadens
LSGE

SEQ ID NO: 2882896 - protein, 11 aa, Entamoeba invadens
LSGEEVKPKLP

SEQ ID NO: 2882897 - protein, 9 aa, Entamoeba invadens
LSGEKSMEA

SEQ ID NO: 2882898 - protein, 5 aa, Entamoeba invadens
LSGEM

SEQ ID NO: 2882899 - protein, 10 aa, Entamoeba invadens
LSGENLTSPC

SEQ ID NO: 2882900 - protein, 17 aa, Entamoeba invadens
LSGENYKKRATYAPGEA

SEQ ID NO: 2882901 - protein, 6 aa, Entamoeba invadens
LSGEPS

SEQ ID NO: 2882902 - protein, 6 aa, Entamoeba invadens
LSGEQD

SEQ ID NO: 2882903 - protein, 8 aa, Entamoeba invadens
LSGERKDV

SEQ ID NO: 2882904 - protein, 6 aa, Entamoeba invadens
LSGERS

SEQ ID NO: 2882905 - protein, 5 aa, Entamoeba invadens
LSGFD

SEQ ID NO: 2882906 - protein, 7 aa, Entamoeba invadens
LSGGQKS

SEQ ID NO: 2882907 - protein, 30 aa, Entamoeba invadens
LSGGSWKLSNEQKKELQKIKNEKKPRTNIA

SEQ ID NO: 2882908 - protein, 10 aa, Entamoeba invadens
LSGGTEGIGV

SEQ ID NO: 2882909 - protein, 6 aa, Entamoeba invadens
LSGHPD

SEQ ID NO: 2882910 - protein, 9 aa, Entamoeba invadens
LSGKALRTE

SEQ ID NO: 2882911 - protein, 14 aa, Entamoeba invadens
LSGKDEKNLNEDEW

SEQ ID NO: 2882912 - protein, 23 aa, Entamoeba invadens
LSGKGKENGRKSGSTPRESGFHE

SEQ ID NO: 2882913 - protein, 15 aa, Entamoeba invadens
LSGKGVVTGGYQGEG

SEQ ID NO: 2882914 - protein, 10 aa, Entamoeba invadens
LSGKKSPQKL

SEQ ID NO: 2882915 - protein, 5 aa, Entamoeba invadens
LSGKP

SEQ ID NO: 2882916 - protein, 9 aa, Entamoeba invadens
LSGKSQDVI

SEQ ID NO: 2882917 - protein, 85 aa, Entamoeba invadens
LSGKTEKDEKKPKTKEQKEDEKKEKKESDKIEQKRNESTDKGLKKEEKPNEKKGNTTEKIQEDGEEQIESKKTMNPSKESKVEEE

SEQ ID NO: 2882918 - protein, 21 aa, Entamoeba invadens
LSGKTKIDENQAIENGTENVK

SEQ ID NO: 2882919 - protein, 5 aa, Entamoeba invadens
LSGKV

SEQ ID NO: 2882920 - protein, 4 aa, Entamoeba invadens
LSGL

SEQ ID NO: 2882921 - protein, 5 aa, Entamoeba invadens
LSGLE

SEQ ID NO: 2882922 - protein, 5 aa, Entamoeba invadens
LSGMP

SEQ ID NO: 2882923 - protein, 4 aa, Entamoeba invadens
LSGN

SEQ ID NO: 2882924 - protein, 18 aa, Entamoeba invadens
LSGNDESFEVTKTPSGFE

SEQ ID NO: 2882925 - protein, 7 aa, Entamoeba invadens
LSGNGEA

SEQ ID NO: 2882926 - protein, 9 aa, Entamoeba invadens
LSGNKKGYL

SEQ ID NO: 2882927 - protein, 9 aa, Entamoeba invadens
LSGNPFKGN

SEQ ID NO: 2882928 - protein, 6 aa, Entamoeba invadens
LSGPTS

SEQ ID NO: 2882929 - protein, 5 aa, Entamoeba invadens
LSGQI

SEQ ID NO: 2882930 - protein, 12 aa, Entamoeba invadens
LSGSSKADNLSE

SEQ ID NO: 2882931 - protein, 6 aa, Entamoeba invadens
LSGSTP

SEQ ID NO: 2882932 - protein, 11 aa, Entamoeba invadens
LSGSVSSEKSV

SEQ ID NO: 2882933 - protein, 6 aa, Entamoeba invadens
LSGSYD

SEQ ID NO: 2882934 - protein, 5 aa, Entamoeba invadens
LSGTE

SEQ ID NO: 2882935 - protein, 17 aa, Entamoeba invadens
LSGTESEFSPQKPDTTK

SEQ ID NO: 2882936 - protein, 30 aa, Entamoeba invadens
LSGTPPKCTSKSGACGDGYYGEAGKCQKCS

SEQ ID NO: 2882937 - protein, 9 aa, Entamoeba invadens
LSGTPVGDH

SEQ ID NO: 2882938 - protein, 12 aa, Entamoeba invadens
LSGTTGNGDKSV

SEQ ID NO: 2882939 - protein, 6 aa, Entamoeba invadens
LSGTTK

SEQ ID NO: 2882940 - protein, 5 aa, Entamoeba invadens
LSGYN

SEQ ID NO: 2882941 - protein, 4 aa, Entamoeba invadens
LSHA

SEQ ID NO: 2882942 - protein, 9 aa, Entamoeba invadens
LSIGGEKET

SEQ ID NO: 2882943 - protein, 17 aa, Entamoeba invadens
LSINPGDSIDVNSKKGE

SEQ ID NO: 2882944 - protein, 5 aa, Entamoeba invadens
LSIPD

SEQ ID NO: 2882945 - protein, 4 aa, Entamoeba invadens
LSIS

SEQ ID NO: 2882946 - protein, 8 aa, Entamoeba invadens
LSISENEK

SEQ ID NO: 2882947 - protein, 8 aa, Entamoeba invadens
LSISNTKT

SEQ ID NO: 2882948 - protein, 15 aa, Entamoeba invadens
LSKAPKLSLPPLSTP

SEQ ID NO: 2882949 - protein, 15 aa, Entamoeba invadens
LSKDATKKKRAHPGA

SEQ ID NO: 2882950 - protein, 9 aa, Entamoeba invadens
LSKDGSGLG

SEQ ID NO: 2882951 - protein, 12 aa, Entamoeba invadens
LSKDNSDGNTAM

SEQ ID NO: 2882952 - protein, 12 aa, Entamoeba invadens
LSKDPKEYAQKT

SEQ ID NO: 2882953 - protein, 7 aa, Entamoeba invadens
LSKDSSI

SEQ ID NO: 2882954 - protein, 8 aa, Entamoeba invadens
LSKDTAVE

SEQ ID NO: 2882955 - protein, 16 aa, Entamoeba invadens
LSKEELDQKNEKGESP

SEQ ID NO: 2882956 - protein, 23 aa, Entamoeba invadens
LSKEGKGQTESDKQQKKVEDDLQ

SEQ ID NO: 2882957 - protein, 5 aa, Entamoeba invadens
LSKEP

SEQ ID NO: 2882958 - protein, 15 aa, Entamoeba invadens
LSKERIQSLPTPIHP

SEQ ID NO: 2882959 - protein, 11 aa, Entamoeba invadens
LSKESYAAKQA

SEQ ID NO: 2882960 - protein, 10 aa, Entamoeba invadens
LSKETQDSIE

SEQ ID NO: 2882961 - protein, 8 aa, Entamoeba invadens
LSKGEKVD

SEQ ID NO: 2882962 - protein, 13 aa, Entamoeba invadens
LSKGFGAHNPADL

SEQ ID NO: 2882963 - protein, 17 aa, Entamoeba invadens
LSKGKSKKCQGKSKFNP

SEQ ID NO: 2882964 - protein, 7 aa, Entamoeba invadens
LSKGKTE

SEQ ID NO: 2882965 - protein, 8 aa, Entamoeba invadens
LSKGNTTI

SEQ ID NO: 2882966 - protein, 6 aa, Entamoeba invadens
LSKIDN

SEQ ID NO: 2882967 - protein, 5 aa, Entamoeba invadens
LSKIG

SEQ ID NO: 2882968 - protein, 6 aa, Entamoeba invadens
LSKISQ

SEQ ID NO: 2882969 - protein, 7 aa, Entamoeba invadens
LSKKDVV

SEQ ID NO: 2882970 - protein, 8 aa, Entamoeba invadens
LSKKRENE

SEQ ID NO: 2882971 - protein, 16 aa, Entamoeba invadens
LSKKRQAEISENDSIT

SEQ ID NO: 2882972 - protein, 10 aa, Entamoeba invadens
LSKKSDKTLQ

SEQ ID NO: 2882973 - protein, 11 aa, Entamoeba invadens
LSKKSKKSLQI

SEQ ID NO: 2882974 - protein, 10 aa, Entamoeba invadens
LSKKSNKTFQ

SEQ ID NO: 2882975 - protein, 10 aa, Entamoeba invadens
LSKKSNKTIQ

SEQ ID NO: 2882976 - protein, 10 aa, Entamoeba invadens
LSKKSSKSFR

SEQ ID NO: 2882977 - protein, 4 aa, Entamoeba invadens
LSKN

SEQ ID NO: 2882978 - protein, 10 aa, Entamoeba invadens
LSKNDNEENI

SEQ ID NO: 2882979 - protein, 7 aa, Entamoeba invadens
LSKNKNA

SEQ ID NO: 2882980 - protein, 8 aa, Entamoeba invadens
LSKNNSSI

SEQ ID NO: 2882981 - protein, 18 aa, Entamoeba invadens
LSKNPNELQNEMGDPRVT

SEQ ID NO: 2882982 - protein, 9 aa, Entamoeba invadens
LSKNPSIEK

SEQ ID NO: 2882983 - protein, 13 aa, Entamoeba invadens
LSKNSMKSIQSEK

SEQ ID NO: 2882984 - protein, 12 aa, Entamoeba invadens
LSKNSMKSIQTE

SEQ ID NO: 2882985 - protein, 13 aa, Entamoeba invadens
LSKNSMKSIQTER

SEQ ID NO: 2882986 - protein, 8 aa, Entamoeba invadens
LSKNTFRK

SEQ ID NO: 2882987 - protein, 7 aa, Entamoeba invadens
LSKNVQS

SEQ ID NO: 2882988 - protein, 11 aa, Entamoeba invadens
LSKPAKNNQRI

SEQ ID NO: 2882989 - protein, 10 aa, Entamoeba invadens
LSKPDMKDDV

SEQ ID NO: 2882990 - protein, 9 aa, Entamoeba invadens
LSKPESCAS

SEQ ID NO: 2882991 - protein, 16 aa, Entamoeba invadens
LSKPPTLPKPKGSVAI

SEQ ID NO: 2882992 - protein, 10 aa, Entamoeba invadens
LSKQELNEHP

SEQ ID NO: 2882993 - protein, 34 aa, Entamoeba invadens
LSKQKKNRQFRHEQQRQEMLGSDDAEEEDSDEAR

SEQ ID NO: 2882994 - protein, 36 aa, Entamoeba invadens
LSKQKKNRQFRHEQQRQEMLGSDDAEEEDSDEARQV

SEQ ID NO: 2882995 - protein, 14 aa, Entamoeba invadens
LSKQSSKPSKISKM

SEQ ID NO: 2882996 - protein, 6 aa, Entamoeba invadens
LSKQTV

SEQ ID NO: 2882997 - protein, 10 aa, Entamoeba invadens
LSKRGTDYSL

SEQ ID NO: 2882998 - protein, 11 aa, Entamoeba invadens
LSKRSKPNQAF

SEQ ID NO: 2882999 - protein, 7 aa, Entamoeba invadens
LSKSDVP

SEQ ID NO: 2883000 - protein, 11 aa, Entamoeba invadens
LSKSKDDVDPK

SEQ ID NO: 2883001 - protein, 7 aa, Entamoeba invadens
LSKSMTR

SEQ ID NO: 2883002 - protein, 7 aa, Entamoeba invadens
LSKSSSL

SEQ ID NO: 2883003 - protein, 19 aa, Entamoeba invadens
LSKSYSRPYLSPRSKFSRT

SEQ ID NO: 2883004 - protein, 6 aa, Entamoeba invadens
LSKTAK

SEQ ID NO: 2883005 - protein, 8 aa, Entamoeba invadens
LSKTEPTK

SEQ ID NO: 2883006 - protein, 8 aa, Entamoeba invadens
LSKTNEAC

SEQ ID NO: 2883007 - protein, 8 aa, Entamoeba invadens
LSKTNKEV

SEQ ID NO: 2883008 - protein, 22 aa, Entamoeba invadens
LSKTPDVQRNGTPKLTPKGTLP

SEQ ID NO: 2883009 - protein, 8 aa, Entamoeba invadens
LSKTTSTL

SEQ ID NO: 2883010 - protein, 9 aa, Entamoeba invadens
LSKTVKKAD

SEQ ID NO: 2883011 - protein, 8 aa, Entamoeba invadens
LSKTVSTY

SEQ ID NO: 2883012 - protein, 10 aa, Entamoeba invadens
LSKVEKPSQN

SEQ ID NO: 2883013 - protein, 9 aa, Entamoeba invadens
LSLDATTKD

SEQ ID NO: 2883014 - protein, 9 aa, Entamoeba invadens
LSLDNPPHL

SEQ ID NO: 2883015 - protein, 4 aa, Entamoeba invadens
LSLE

SEQ ID NO: 2883016 - protein, 33 aa, Entamoeba invadens
LSLGETPTASSSSSESGKVSDNETEKSQTGNVI

SEQ ID NO: 2883017 - protein, 6 aa, Entamoeba invadens
LSLGSS

SEQ ID NO: 2883018 - protein, 8 aa, Entamoeba invadens
LSLNSSKN

SEQ ID NO: 2883019 - protein, 13 aa, Entamoeba invadens
LSLPSADQEPSKP

SEQ ID NO: 2883020 - protein, 12 aa, Entamoeba invadens
LSLSETQRAETQ

SEQ ID NO: 2883021 - protein, 10 aa, Entamoeba invadens
LSLSGKATKL

SEQ ID NO: 2883022 - protein, 7 aa, Entamoeba invadens
LSLSGNK

SEQ ID NO: 2883023 - protein, 12 aa, Entamoeba invadens
LSLTKKNNSLIA

SEQ ID NO: 2883024 - protein, 11 aa, Entamoeba invadens
LSLTNNPNLET

SEQ ID NO: 2883025 - protein, 37 aa, Entamoeba invadens
LSMSNGQGAQAAIQQQNAQMTTEGTTLNNQNVPTTTV

SEQ ID NO: 2883026 - protein, 26 aa, Entamoeba invadens
LSNAPQQKQSANPKQQQQTVAQTSSI

SEQ ID NO: 2883027 - protein, 8 aa, Entamoeba invadens
LSNATDKF

SEQ ID NO: 2883028 - protein, 5 aa, Entamoeba invadens
LSNDD

SEQ ID NO: 2883029 - protein, 72 aa, Entamoeba invadens
LSNDENEEEKTQNKDQLKDIKNTTKTAVKMEEETNSSDDERSSSSSTSSSSEDLSFDAPSIEKEESEESSSI

SEQ ID NO: 2883030 - protein, 14 aa, Entamoeba invadens
LSNDLTESNPEMKA

SEQ ID NO: 2883031 - protein, 5 aa, Entamoeba invadens
LSNDN

SEQ ID NO: 2883032 - protein, 9 aa, Entamoeba invadens
LSNDNKSVR

SEQ ID NO: 2883033 - protein, 12 aa, Entamoeba invadens
LSNDSSNSTNKL

SEQ ID NO: 2883034 - protein, 6 aa, Entamoeba invadens
LSNDSW

SEQ ID NO: 2883035 - protein, 7 aa, Entamoeba invadens
LSNDTYT

SEQ ID NO: 2883036 - protein, 10 aa, Entamoeba invadens
LSNDVKSGLM

SEQ ID NO: 2883037 - protein, 45 aa, Entamoeba invadens
LSNEAKQQAEEAQAKAEEAEKQAIEAQEQAEKAVEDANNKVAEAE

SEQ ID NO: 2883038 - protein, 9 aa, Entamoeba invadens
LSNEDTAVR

SEQ ID NO: 2883039 - protein, 38 aa, Entamoeba invadens
LSNEPSQQNQTKETSQHKRIRRPSQAKEDQVKETKEVK

SEQ ID NO: 2883040 - protein, 8 aa, Entamoeba invadens
LSNEQSYL

SEQ ID NO: 2883041 - protein, 6 aa, Entamoeba invadens
LSNETE

SEQ ID NO: 2883042 - protein, 7 aa, Entamoeba invadens
LSNETSR

SEQ ID NO: 2883043 - protein, 6 aa, Entamoeba invadens
LSNGKG

SEQ ID NO: 2883044 - protein, 5 aa, Entamoeba invadens
LSNGL

SEQ ID NO: 2883045 - protein, 8 aa, Entamoeba invadens
LSNGSESD

SEQ ID NO: 2883046 - protein, 9 aa, Entamoeba invadens
LSNIEDSKV

SEQ ID NO: 2883047 - protein, 10 aa, Entamoeba invadens
LSNKDEMNSI

SEQ ID NO: 2883048 - protein, 8 aa, Entamoeba invadens
LSNKQKNV

SEQ ID NO: 2883049 - protein, 10 aa, Entamoeba invadens
LSNKSESVDV

SEQ ID NO: 2883050 - protein, 14 aa, Entamoeba invadens
LSNKTKRDEKIEKM

SEQ ID NO: 2883051 - protein, 6 aa, Entamoeba invadens
LSNNIS

SEQ ID NO: 2883052 - protein, 9 aa, Entamoeba invadens
LSNNKQSTY

SEQ ID NO: 2883053 - protein, 6 aa, Entamoeba invadens
LSNNNL

SEQ ID NO: 2883054 - protein, 5 aa, Entamoeba invadens
LSNNS

SEQ ID NO: 2883055 - protein, 5 aa, Entamoeba invadens
LSNNT

SEQ ID NO: 2883056 - protein, 8 aa, Entamoeba invadens
LSNNVKEI

SEQ ID NO: 2883057 - protein, 8 aa, Entamoeba invadens
LSNPAEHD

SEQ ID NO: 2883058 - protein, 26 aa, Entamoeba invadens
LSNPAPDPNNVDLSKQKPKDGESSGC

SEQ ID NO: 2883059 - protein, 8 aa, Entamoeba invadens
LSNPDKAC

SEQ ID NO: 2883060 - protein, 6 aa, Entamoeba invadens
LSNPKA

SEQ ID NO: 2883061 - protein, 13 aa, Entamoeba invadens
LSNPLTGRTTGEK

SEQ ID NO: 2883062 - protein, 27 aa, Entamoeba invadens
LSNPPRFSNEGNSMTTLAKSKSDTSLF

SEQ ID NO: 2883063 - protein, 6 aa, Entamoeba invadens
LSNPPV

SEQ ID NO: 2883064 - protein, 10 aa, Entamoeba invadens
LSNPQTSQGV

SEQ ID NO: 2883065 - protein, 10 aa, Entamoeba invadens
LSNPSEFPSN

SEQ ID NO: 2883066 - protein, 22 aa, Entamoeba invadens
LSNPSSTSSSENSGDHTDKQEI

SEQ ID NO: 2883067 - protein, 21 aa, Entamoeba invadens
LSNPYDSVKNGKKYTSNSPEM

SEQ ID NO: 2883068 - protein, 4 aa, Entamoeba invadens
LSNQ

SEQ ID NO: 2883069 - protein, 4 aa, Entamoeba invadens
LSNR

SEQ ID NO: 2883070 - protein, 6 aa, Entamoeba invadens
LSNSDA

SEQ ID NO: 2883071 - protein, 6 aa, Entamoeba invadens
LSNSHP

SEQ ID NO: 2883072 - protein, 16 aa, Entamoeba invadens
LSNSTSGTSAASTGTL

SEQ ID NO: 2883073 - protein, 4 aa, Entamoeba invadens
LSNT

SEQ ID NO: 2883074 - protein, 28 aa, Entamoeba invadens
LSNTAKRTSASEKKDTKEEEKKRKKETI

SEQ ID NO: 2883075 - protein, 8 aa, Entamoeba invadens
LSNTEPKI

SEQ ID NO: 2883076 - protein, 6 aa, Entamoeba invadens
LSNTGL

SEQ ID NO: 2883077 - protein, 10 aa, Entamoeba invadens
LSNTNQEEEA

SEQ ID NO: 2883078 - protein, 7 aa, Entamoeba invadens
LSNTQQL

SEQ ID NO: 2883079 - protein, 12 aa, Entamoeba invadens
LSNTSVDDDGVE

SEQ ID NO: 2883080 - protein, 4 aa, Entamoeba invadens
LSPA

SEQ ID NO: 2883081 - protein, 4 aa, Entamoeba invadens
LSPD

SEQ ID NO: 2883082 - protein, 15 aa, Entamoeba invadens
LSPDELEVGVIEEWG

SEQ ID NO: 2883083 - protein, 7 aa, Entamoeba invadens
LSPDIKT

SEQ ID NO: 2883084 - protein, 9 aa, Entamoeba invadens
LSPDLNSCE

SEQ ID NO: 2883085 - protein, 6 aa, Entamoeba invadens
LSPDQY

SEQ ID NO: 2883086 - protein, 7 aa, Entamoeba invadens
LSPDSSD

SEQ ID NO: 2883087 - protein, 9 aa, Entamoeba invadens
LSPDSVSLT

SEQ ID NO: 2883088 - protein, 5 aa, Entamoeba invadens
LSPEA

SEQ ID NO: 2883089 - protein, 13 aa, Entamoeba invadens
LSPEEADSYRQRG

SEQ ID NO: 2883090 - protein, 6 aa, Entamoeba invadens
LSPEEK

SEQ ID NO: 2883091 - protein, 6 aa, Entamoeba invadens
LSPEIG

SEQ ID NO: 2883092 - protein, 6 aa, Entamoeba invadens
LSPEIK

SEQ ID NO: 2883093 - protein, 5 aa, Entamoeba invadens
LSPEK

SEQ ID NO: 2883094 - protein, 9 aa, Entamoeba invadens
LSPENSSVI

SEQ ID NO: 2883095 - protein, 13 aa, Entamoeba invadens
LSPETKGKIQSEV

SEQ ID NO: 2883096 - protein, 5 aa, Entamoeba invadens
LSPGV

SEQ ID NO: 2883097 - protein, 5 aa, Entamoeba invadens
LSPGY

SEQ ID NO: 2883098 - protein, 25 aa, Entamoeba invadens
LSPHQDNPLQTQPQEVVADKKSQIQ

SEQ ID NO: 2883099 - protein, 4 aa, Entamoeba invadens
LSPI

SEQ ID NO: 2883100 - protein, 5 aa, Entamoeba invadens
LSPID

SEQ ID NO: 2883101 - protein, 5 aa, Entamoeba invadens
LSPIE

SEQ ID NO: 2883102 - protein, 6 aa, Entamoeba invadens
LSPIPE

SEQ ID NO: 2883103 - protein, 4 aa, Entamoeba invadens
LSPK

SEQ ID NO: 2883104 - protein, 21 aa, Entamoeba invadens
LSPKDEKDGKKEKKEKKPEMP

SEQ ID NO: 2883105 - protein, 9 aa, Entamoeba invadens
LSPKDRKKT

SEQ ID NO: 2883106 - protein, 12 aa, Entamoeba invadens
LSPKEDKKSKFL

SEQ ID NO: 2883107 - protein, 11 aa, Entamoeba invadens
LSPKEQETFAN

SEQ ID NO: 2883108 - protein, 5 aa, Entamoeba invadens
LSPKK

SEQ ID NO: 2883109 - protein, 29 aa, Entamoeba invadens
LSPKKPKRKSSSQRVATQSKRGELSPEEF

SEQ ID NO: 2883110 - protein, 42 aa, Entamoeba invadens
LSPKPQDSKSPSIQMNSNDGVLPSSQNYNEDQQKPNDSGNPS

SEQ ID NO: 2883111 - protein, 11 aa, Entamoeba invadens
LSPKQQSPAVK

SEQ ID NO: 2883112 - protein, 9 aa, Entamoeba invadens
LSPKSTDLF

SEQ ID NO: 2883113 - protein, 6 aa, Entamoeba invadens
LSPKTA

SEQ ID NO: 2883114 - protein, 11 aa, Entamoeba invadens
LSPKTKAKNNY

SEQ ID NO: 2883115 - protein, 10 aa, Entamoeba invadens
LSPKTKEQHN

SEQ ID NO: 2883116 - protein, 4 aa, Entamoeba invadens
LSPL

SEQ ID NO: 2883117 - protein, 7 aa, Entamoeba invadens
LSPLTYR

SEQ ID NO: 2883118 - protein, 4 aa, Entamoeba invadens
LSPN

SEQ ID NO: 2883119 - protein, 24 aa, Entamoeba invadens
LSPNDVGEYSTDAFNNTQNVAEVE

SEQ ID NO: 2883120 - protein, 24 aa, Entamoeba invadens
LSPNDVGEYSTNAFNNTQNVAEVE

SEQ ID NO: 2883121 - protein, 7 aa, Entamoeba invadens
LSPNEKS

SEQ ID NO: 2883122 - protein, 5 aa, Entamoeba invadens
LSPNG

SEQ ID NO: 2883123 - protein, 6 aa, Entamoeba invadens
LSPNNE

SEQ ID NO: 2883124 - protein, 9 aa, Entamoeba invadens
LSPNQPNQI

SEQ ID NO: 2883125 - protein, 6 aa, Entamoeba invadens
LSPPPI

SEQ ID NO: 2883126 - protein, 12 aa, Entamoeba invadens
LSPPPPNTTVRR

SEQ ID NO: 2883127 - protein, 11 aa, Entamoeba invadens
LSPPSISTTTS

SEQ ID NO: 2883128 - protein, 6 aa, Entamoeba invadens
LSPPVT

SEQ ID NO: 2883129 - protein, 5 aa, Entamoeba invadens
LSPQT

SEQ ID NO: 2883130 - protein, 8 aa, Entamoeba invadens
LSPRGDTL

SEQ ID NO: 2883131 - protein, 46 aa, Entamoeba invadens
LSPRGTPSQVVKTEKVEQKDMKEKTEKKEKKEKKEKGESKGEKVER

SEQ ID NO: 2883132 - protein, 8 aa, Entamoeba invadens
LSPRKPKF

SEQ ID NO: 2883133 - protein, 6 aa, Entamoeba invadens
LSPRQA

SEQ ID NO: 2883134 - protein, 6 aa, Entamoeba invadens
LSPRSN

SEQ ID NO: 2883135 - protein, 6 aa, Entamoeba invadens
LSPSLK

SEQ ID NO: 2883136 - protein, 5 aa, Entamoeba invadens
LSPSM

SEQ ID NO: 2883137 - protein, 6 aa, Entamoeba invadens
LSPSMK

SEQ ID NO: 2883138 - protein, 11 aa, Entamoeba invadens
LSPSQDLRTSE

SEQ ID NO: 2883139 - protein, 5 aa, Entamoeba invadens
LSPST

SEQ ID NO: 2883140 - protein, 7 aa, Entamoeba invadens
LSPTASV

SEQ ID NO: 2883141 - protein, 5 aa, Entamoeba invadens
LSPTD

SEQ ID NO: 2883142 - protein, 8 aa, Entamoeba invadens
LSPTKEVK

SEQ ID NO: 2883143 - protein, 12 aa, Entamoeba invadens
LSPTKQKSKLTL

SEQ ID NO: 2883144 - protein, 7 aa, Entamoeba invadens
LSPTPEL

SEQ ID NO: 2883145 - protein, 8 aa, Entamoeba invadens
LSPTPPTY

SEQ ID NO: 2883146 - protein, 9 aa, Entamoeba invadens
LSPTPSYES

SEQ ID NO: 2883147 - protein, 6 aa, Entamoeba invadens
LSPTRE

SEQ ID NO: 2883148 - protein, 11 aa, Entamoeba invadens
LSPTSTSEESL

SEQ ID NO: 2883149 - protein, 5 aa, Entamoeba invadens
LSPTY

SEQ ID NO: 2883150 - protein, 46 aa, Entamoeba invadens
LSPVSTQKSQEKWAKPAKTSKSSEQKDSAKKEEKKEKREKEESRIS

SEQ ID NO: 2883151 - protein, 11 aa, Entamoeba invadens
LSPVTETPSEV

SEQ ID NO: 2883152 - protein, 7 aa, Entamoeba invadens
LSPYDRG

SEQ ID NO: 2883153 - protein, 7 aa, Entamoeba invadens
LSPYQYK

SEQ ID NO: 2883154 - protein, 6 aa, Entamoeba invadens
LSQDIE

SEQ ID NO: 2883155 - protein, 4 aa, Entamoeba invadens
LSQE

SEQ ID NO: 2883156 - protein, 9 aa, Entamoeba invadens
LSQEAGETL

SEQ ID NO: 2883157 - protein, 9 aa, Entamoeba invadens
LSQEEDKKY

SEQ ID NO: 2883158 - protein, 7 aa, Entamoeba invadens
LSQEGKD

SEQ ID NO: 2883159 - protein, 24 aa, Entamoeba invadens
LSQETSTMTVSSPQLHSPKSPRSL

SEQ ID NO: 2883160 - protein, 4 aa, Entamoeba invadens
LSQG

SEQ ID NO: 2883161 - protein, 8 aa, Entamoeba invadens
LSQGNGPK

SEQ ID NO: 2883162 - protein, 4 aa, Entamoeba invadens
LSQI

SEQ ID NO: 2883163 - protein, 13 aa, Entamoeba invadens
LSQIKTKNEKEDT

SEQ ID NO: 2883164 - protein, 22 aa, Entamoeba invadens
LSQKGSSHLDAENNVKPEGELK

SEQ ID NO: 2883165 - protein, 16 aa, Entamoeba invadens
LSQKNVEKAYWISKFT

SEQ ID NO: 2883166 - protein, 18 aa, Entamoeba invadens
LSQKTKKRINPTKQREYI

SEQ ID NO: 2883167 - protein, 9 aa, Entamoeba invadens
LSQKTRKYF

SEQ ID NO: 2883168 - protein, 7 aa, Entamoeba invadens
LSQKTWG

SEQ ID NO: 2883169 - protein, 19 aa, Entamoeba invadens
LSQLKADNDNLTKAKSVVD

SEQ ID NO: 2883170 - protein, 4 aa, Entamoeba invadens
LSQN

SEQ ID NO: 2883171 - protein, 13 aa, Entamoeba invadens
LSQNASNDKDNSL

SEQ ID NO: 2883172 - protein, 16 aa, Entamoeba invadens
LSQNGSKGLEKSTNIT

SEQ ID NO: 2883173 - protein, 5 aa, Entamoeba invadens
LSQNI

SEQ ID NO: 2883174 - protein, 11 aa, Entamoeba invadens
LSQNPDDYDED

SEQ ID NO: 2883175 - protein, 5 aa, Entamoeba invadens
LSQNR

SEQ ID NO: 2883176 - protein, 16 aa, Entamoeba invadens
LSQNSNDTDKDDNQRI

SEQ ID NO: 2883177 - protein, 13 aa, Entamoeba invadens
LSQPKSLKPETQI

SEQ ID NO: 2883178 - protein, 5 aa, Entamoeba invadens
LSQPS

SEQ ID NO: 2883179 - protein, 55 aa, Entamoeba invadens
LSQPTTSSQTSTTAGGVKPSEESRQELEQREKAARLKAELEKKKEVEIPKDQMTT

SEQ ID NO: 2883180 - protein, 7 aa, Entamoeba invadens
LSQQDDI

SEQ ID NO: 2883181 - protein, 8 aa, Entamoeba invadens
LSQQSEME

SEQ ID NO: 2883182 - protein, 7 aa, Entamoeba invadens
LSQRDAD

SEQ ID NO: 2883183 - protein, 11 aa, Entamoeba invadens
LSQRDSRIEQL

SEQ ID NO: 2883184 - protein, 5 aa, Entamoeba invadens
LSQRF

SEQ ID NO: 2883185 - protein, 8 aa, Entamoeba invadens
LSQRGVGQ

SEQ ID NO: 2883186 - protein, 16 aa, Entamoeba invadens
LSQRNEKRKWTCEEDS

SEQ ID NO: 2883187 - protein, 9 aa, Entamoeba invadens
LSQSETVQK

SEQ ID NO: 2883188 - protein, 6 aa, Entamoeba invadens
LSQSIR

SEQ ID NO: 2883189 - protein, 32 aa, Entamoeba invadens
LSQSQSGKNNRMSKSAQISPTDNSPKSSPRLR

SEQ ID NO: 2883190 - protein, 8 aa, Entamoeba invadens
LSQSQTDH

SEQ ID NO: 2883191 - protein, 16 aa, Entamoeba invadens
LSQSTKKLKEGGGNAM

SEQ ID NO: 2883192 - protein, 29 aa, Entamoeba invadens
LSQSTLRRVSDTSNPLKDSTKMDKPVTQP

SEQ ID NO: 2883193 - protein, 16 aa, Entamoeba invadens
LSQTEPKPEPKKKGFP

SEQ ID NO: 2883194 - protein, 7 aa, Entamoeba invadens
LSQTSAE

SEQ ID NO: 2883195 - protein, 14 aa, Entamoeba invadens
LSQYQNSSAIGSDD

SEQ ID NO: 2883196 - protein, 16 aa, Entamoeba invadens
LSRDEKSERKAQEWST

SEQ ID NO: 2883197 - protein, 10 aa, Entamoeba invadens
LSRESLERAN

SEQ ID NO: 2883198 - protein, 11 aa, Entamoeba invadens
LSRETLSRSKT

SEQ ID NO: 2883199 - protein, 12 aa, Entamoeba invadens
LSRGDHQDGYDC

SEQ ID NO: 2883200 - protein, 24 aa, Entamoeba invadens
LSRGGYGGHRGGASRGGAPRGRGG

SEQ ID NO: 2883201 - protein, 14 aa, Entamoeba invadens
LSRGNTRTTTKPLT

SEQ ID NO: 2883202 - protein, 5 aa, Entamoeba invadens
LSRHK

SEQ ID NO: 2883203 - protein, 8 aa, Entamoeba invadens
LSRKNDDL

SEQ ID NO: 2883204 - protein, 11 aa, Entamoeba invadens
LSRKSAKTYSI

SEQ ID NO: 2883205 - protein, 14 aa, Entamoeba invadens
LSRKSSGAESTRYR

SEQ ID NO: 2883206 - protein, 12 aa, Entamoeba invadens
LSRKSSKTASIE

SEQ ID NO: 2883207 - protein, 12 aa, Entamoeba invadens
LSRKSTKTHSIE

SEQ ID NO: 2883208 - protein, 6 aa, Entamoeba invadens
LSRNGF

SEQ ID NO: 2883209 - protein, 9 aa, Entamoeba invadens
LSRNTLDRA

SEQ ID NO: 2883210 - protein, 13 aa, Entamoeba invadens
LSRPGKSKDIKKA

SEQ ID NO: 2883211 - protein, 32 aa, Entamoeba invadens
LSRQTASGNYESSTAEPKYPKKWTPPEIAQPG

SEQ ID NO: 2883212 - protein, 6 aa, Entamoeba invadens
LSRQYT

SEQ ID NO: 2883213 - protein, 12 aa, Entamoeba invadens
LSRRQRIADNET

SEQ ID NO: 2883214 - protein, 14 aa, Entamoeba invadens
LSRRRNKGSKRHNN

SEQ ID NO: 2883215 - protein, 5 aa, Entamoeba invadens
LSRSD

SEQ ID NO: 2883216 - protein, 9 aa, Entamoeba invadens
LSRSEKKSI

SEQ ID NO: 2883217 - protein, 15 aa, Entamoeba invadens
LSRSPSPNFNRSPSP

SEQ ID NO: 2883218 - protein, 20 aa, Entamoeba invadens
LSRTIPTKETESVPSGSFTA

SEQ ID NO: 2883219 - protein, 8 aa, Entamoeba invadens
LSRTSSIT

SEQ ID NO: 2883220 - protein, 21 aa, Entamoeba invadens
LSRVNSTKNKLEKDKSALEQN

SEQ ID NO: 2883221 - protein, 28 aa, Entamoeba invadens
LSRYSTTSSSSTQNSPRGSEKAASQQTQ

SEQ ID NO: 2883222 - protein, 4 aa, Entamoeba invadens
LSSA

SEQ ID NO: 2883223 - protein, 9 aa, Entamoeba invadens
LSSAQETDL

SEQ ID NO: 2883224 - protein, 12 aa, Entamoeba invadens
LSSATSVTTVTP

SEQ ID NO: 2883225 - protein, 9 aa, Entamoeba invadens
LSSCTKGRI

SEQ ID NO: 2883226 - protein, 7 aa, Entamoeba invadens
LSSDDEL

SEQ ID NO: 2883227 - protein, 7 aa, Entamoeba invadens
LSSDDPL

SEQ ID NO: 2883228 - protein, 20 aa, Entamoeba invadens
LSSDGAPQNANVGSNGARKY

SEQ ID NO: 2883229 - protein, 6 aa, Entamoeba invadens
LSSDIN

SEQ ID NO: 2883230 - protein, 17 aa, Entamoeba invadens
LSSDKKSAGAAASSVPK

SEQ ID NO: 2883231 - protein, 10 aa, Entamoeba invadens
LSSDPTLSQN

SEQ ID NO: 2883232 - protein, 6 aa, Entamoeba invadens
LSSDQQ

SEQ ID NO: 2883233 - protein, 4 aa, Entamoeba invadens
LSSE

SEQ ID NO: 2883234 - protein, 8 aa, Entamoeba invadens
LSSEAQKK

SEQ ID NO: 2883235 - protein, 7 aa, Entamoeba invadens
LSSEDDR

SEQ ID NO: 2883236 - protein, 7 aa, Entamoeba invadens
LSSEEAK

SEQ ID NO: 2883237 - protein, 7 aa, Entamoeba invadens
LSSEKTL

SEQ ID NO: 2883238 - protein, 7 aa, Entamoeba invadens
LSSELEK

SEQ ID NO: 2883239 - protein, 9 aa, Entamoeba invadens
LSSEMPPSK

SEQ ID NO: 2883240 - protein, 24 aa, Entamoeba invadens
LSSENARTQRVSRYRESKDAKNKL

SEQ ID NO: 2883241 - protein, 5 aa, Entamoeba invadens
LSSER

SEQ ID NO: 2883242 - protein, 26 aa, Entamoeba invadens
LSSESHSKLAKSASKSSVESNERRRS

SEQ ID NO: 2883243 - protein, 13 aa, Entamoeba invadens
LSSGESTFEKSVN

SEQ ID NO: 2883244 - protein, 17 aa, Entamoeba invadens
LSSGKNGTIKAEKIGKI

SEQ ID NO: 2883245 - protein, 8 aa, Entamoeba invadens
LSSGKRVN

SEQ ID NO: 2883246 - protein, 7 aa, Entamoeba invadens
LSSGMTS

SEQ ID NO: 2883247 - protein, 8 aa, Entamoeba invadens
LSSGNEQL

SEQ ID NO: 2883248 - protein, 10 aa, Entamoeba invadens
LSSGNSQEFA

SEQ ID NO: 2883249 - protein, 9 aa, Entamoeba invadens
LSSGSASVN

SEQ ID NO: 2883250 - protein, 20 aa, Entamoeba invadens
LSSIEDERIKEDNEADEEVY

SEQ ID NO: 2883251 - protein, 8 aa, Entamoeba invadens
LSSIEPDA

SEQ ID NO: 2883252 - protein, 7 aa, Entamoeba invadens
LSSIESD

SEQ ID NO: 2883253 - protein, 7 aa, Entamoeba invadens
LSSKDTA

SEQ ID NO: 2883254 - protein, 6 aa, Entamoeba invadens
LSSKEE

SEQ ID NO: 2883255 - protein, 10 aa, Entamoeba invadens
LSSKKKSVGK

SEQ ID NO: 2883256 - protein, 6 aa, Entamoeba invadens
LSSKLD

SEQ ID NO: 2883257 - protein, 9 aa, Entamoeba invadens
LSSKNEELQ

SEQ ID NO: 2883258 - protein, 8 aa, Entamoeba invadens
LSSKNGTC

SEQ ID NO: 2883259 - protein, 8 aa, Entamoeba invadens
LSSKPTFK

SEQ ID NO: 2883260 - protein, 12 aa, Entamoeba invadens
LSSKSKQEQTIN

SEQ ID NO: 2883261 - protein, 7 aa, Entamoeba invadens
LSSKTNF

SEQ ID NO: 2883262 - protein, 15 aa, Entamoeba invadens
LSSLKDSVKSNTVQG

SEQ ID NO: 2883263 - protein, 6 aa, Entamoeba invadens
LSSLSD

SEQ ID NO: 2883264 - protein, 21 aa, Entamoeba invadens
LSSMSPEEDASDEKESVHQSK

SEQ ID NO: 2883265 - protein, 4 aa, Entamoeba invadens
LSSN

SEQ ID NO: 2883266 - protein, 10 aa, Entamoeba invadens
LSSNAVSQPI

SEQ ID NO: 2883267 - protein, 5 aa, Entamoeba invadens
LSSND

SEQ ID NO: 2883268 - protein, 14 aa, Entamoeba invadens
LSSNGASRRQEAQR

SEQ ID NO: 2883269 - protein, 8 aa, Entamoeba invadens
LSSNGNIS

SEQ ID NO: 2883270 - protein, 11 aa, Entamoeba invadens
LSSNKLKDFPN

SEQ ID NO: 2883271 - protein, 7 aa, Entamoeba invadens
LSSNNTE

SEQ ID NO: 2883272 - protein, 7 aa, Entamoeba invadens
LSSNSQI

SEQ ID NO: 2883273 - protein, 14 aa, Entamoeba invadens
LSSNSTDRTVQKRS

SEQ ID NO: 2883274 - protein, 7 aa, Entamoeba invadens
LSSPEYN

SEQ ID NO: 2883275 - protein, 13 aa, Entamoeba invadens
LSSPKGNPRVITM

SEQ ID NO: 2883276 - protein, 9 aa, Entamoeba invadens
LSSPQSTEP

SEQ ID NO: 2883277 - protein, 7 aa, Entamoeba invadens
LSSPRIT

SEQ ID NO: 2883278 - protein, 10 aa, Entamoeba invadens
LSSPSFHGGS

SEQ ID NO: 2883279 - protein, 14 aa, Entamoeba invadens
LSSPSIRSECVTSN

SEQ ID NO: 2883280 - protein, 15 aa, Entamoeba invadens
LSSPTLQPHTQKHSR

SEQ ID NO: 2883281 - protein, 10 aa, Entamoeba invadens
LSSQENKEAT

SEQ ID NO: 2883282 - protein, 7 aa, Entamoeba invadens
LSSQGRR

SEQ ID NO: 2883283 - protein, 11 aa, Entamoeba invadens
LSSQNKETADV

SEQ ID NO: 2883284 - protein, 6 aa, Entamoeba invadens
LSSQNR

SEQ ID NO: 2883285 - protein, 9 aa, Entamoeba invadens
LSSQQSLAD

SEQ ID NO: 2883286 - protein, 8 aa, Entamoeba invadens
LSSQTLSD

SEQ ID NO: 2883287 - protein, 6 aa, Entamoeba invadens
LSSQYD

SEQ ID NO: 2883288 - protein, 6 aa, Entamoeba invadens
LSSRDF

SEQ ID NO: 2883289 - protein, 9 aa, Entamoeba invadens
LSSRISDLP

SEQ ID NO: 2883290 - protein, 25 aa, Entamoeba invadens
LSSRRKARREAREKQENAKYEKTHP

SEQ ID NO: 2883291 - protein, 4 aa, Entamoeba invadens
LSSS

SEQ ID NO: 2883292 - protein, 7 aa, Entamoeba invadens
LSSSDKK

SEQ ID NO: 2883293 - protein, 55 aa, Entamoeba invadens
LSSSENQSENQSKNSNNSFSDEDNSLDESEETSENSLSDDNDPEKDVIGKQNADL

SEQ ID NO: 2883294 - protein, 60 aa, Entamoeba invadens
LSSSESQSASYSSTEKSKTSHSSSSKYSKTSKGSKSSKASKTSEDSSAGTSASDSSQGLQ

SEQ ID NO: 2883295 - protein, 10 aa, Entamoeba invadens
LSSSETSTNS

SEQ ID NO: 2883296 - protein, 6 aa, Entamoeba invadens
LSSSFD

SEQ ID NO: 2883297 - protein, 5 aa, Entamoeba invadens
LSSSG

SEQ ID NO: 2883298 - protein, 8 aa, Entamoeba invadens
LSSSGQDN

SEQ ID NO: 2883299 - protein, 9 aa, Entamoeba invadens
LSSSGRRKE

SEQ ID NO: 2883300 - protein, 6 aa, Entamoeba invadens
LSSSIN

SEQ ID NO: 2883301 - protein, 7 aa, Entamoeba invadens
LSSSLSG

SEQ ID NO: 2883302 - protein, 7 aa, Entamoeba invadens
LSSSNQY

SEQ ID NO: 2883303 - protein, 9 aa, Entamoeba invadens
LSSSPQQTA

SEQ ID NO: 2883304 - protein, 6 aa, Entamoeba invadens
LSSSPR

SEQ ID NO: 2883305 - protein, 11 aa, Entamoeba invadens
LSSSRATADVA

SEQ ID NO: 2883306 - protein, 7 aa, Entamoeba invadens
LSSSRSL

SEQ ID NO: 2883307 - protein, 8 aa, Entamoeba invadens
LSSSSSQI

SEQ ID NO: 2883308 - protein, 8 aa, Entamoeba invadens
LSSSTGQV

SEQ ID NO: 2883309 - protein, 7 aa, Entamoeba invadens
LSSSTLA

SEQ ID NO: 2883310 - protein, 7 aa, Entamoeba invadens
LSSSTTI

SEQ ID NO: 2883311 - protein, 4 aa, Entamoeba invadens
LSST

SEQ ID NO: 2883312 - protein, 14 aa, Entamoeba invadens
LSSTETPIQKSDYE

SEQ ID NO: 2883313 - protein, 8 aa, Entamoeba invadens
LSSTGKVG

SEQ ID NO: 2883314 - protein, 6 aa, Entamoeba invadens
LSSTRG

SEQ ID NO: 2883315 - protein, 10 aa, Entamoeba invadens
LSSTTKEEYV

SEQ ID NO: 2883316 - protein, 12 aa, Entamoeba invadens
LSSVNIPSSVKS

SEQ ID NO: 2883317 - protein, 9 aa, Entamoeba invadens
LSSVTIPTN

SEQ ID NO: 2883318 - protein, 6 aa, Entamoeba invadens
LSTASS

SEQ ID NO: 2883319 - protein, 6 aa, Entamoeba invadens
LSTDQN

SEQ ID NO: 2883320 - protein, 7 aa, Entamoeba invadens
LSTDQNS

SEQ ID NO: 2883321 - protein, 8 aa, Entamoeba invadens
LSTEESLE

SEQ ID NO: 2883322 - protein, 6 aa, Entamoeba invadens
LSTEPY

SEQ ID NO: 2883323 - protein, 11 aa, Entamoeba invadens
LSTESDTGVSK

SEQ ID NO: 2883324 - protein, 12 aa, Entamoeba invadens
LSTEYTNNAKLH

SEQ ID NO: 2883325 - protein, 16 aa, Entamoeba invadens
LSTGGVPTTWNATEDI

SEQ ID NO: 2883326 - protein, 23 aa, Entamoeba invadens
LSTGKKASTQQKKEKKSQQESVE

SEQ ID NO: 2883327 - protein, 18 aa, Entamoeba invadens
LSTGTNLSYKPFSILISH

SEQ ID NO: 2883328 - protein, 7 aa, Entamoeba invadens
LSTHTNP

SEQ ID NO: 2883329 - protein, 8 aa, Entamoeba invadens
LSTHTNPF

SEQ ID NO: 2883330 - protein, 4 aa, Entamoeba invadens
LSTK

SEQ ID NO: 2883331 - protein, 7 aa, Entamoeba invadens
LSTKEIP

SEQ ID NO: 2883332 - protein, 12 aa, Entamoeba invadens
LSTLKDTPPYDP

SEQ ID NO: 2883333 - protein, 41 aa, Entamoeba invadens
LSTLPQEVKEDEMKEKRPKLSRFTGSESASGSETPRTTLAR

SEQ ID NO: 2883334 - protein, 4 aa, Entamoeba invadens
LSTN

SEQ ID NO: 2883335 - protein, 6 aa, Entamoeba invadens
LSTNDD

SEQ ID NO: 2883336 - protein, 7 aa, Entamoeba invadens
LSTNGTY

SEQ ID NO: 2883337 - protein, 5 aa, Entamoeba invadens
LSTNI

SEQ ID NO: 2883338 - protein, 9 aa, Entamoeba invadens
LSTNPFPLT

SEQ ID NO: 2883339 - protein, 12 aa, Entamoeba invadens
LSTNRDAQPKYN

SEQ ID NO: 2883340 - protein, 21 aa, Entamoeba invadens
LSTNSTPCKMREKESDAMKDK

SEQ ID NO: 2883341 - protein, 4 aa, Entamoeba invadens
LSTP

SEQ ID NO: 2883342 - protein, 7 aa, Entamoeba invadens
LSTPAGK

SEQ ID NO: 2883343 - protein, 9 aa, Entamoeba invadens
LSTPQRKRT

SEQ ID NO: 2883344 - protein, 7 aa, Entamoeba invadens
LSTQDAH

SEQ ID NO: 2883345 - protein, 7 aa, Entamoeba invadens
LSTQDDV

SEQ ID NO: 2883346 - protein, 7 aa, Entamoeba invadens
LSTQSSS

SEQ ID NO: 2883347 - protein, 9 aa, Entamoeba invadens
LSTQTEEDI

SEQ ID NO: 2883348 - protein, 4 aa, Entamoeba invadens
LSTR

SEQ ID NO: 2883349 - protein, 10 aa, Entamoeba invadens
LSTRLDPDEL

SEQ ID NO: 2883350 - protein, 8 aa, Entamoeba invadens
LSTRNEKK

SEQ ID NO: 2883351 - protein, 5 aa, Entamoeba invadens
LSTRP

SEQ ID NO: 2883352 - protein, 9 aa, Entamoeba invadens
LSTSDQSEV

SEQ ID NO: 2883353 - protein, 10 aa, Entamoeba invadens
LSTSDSSSIT

SEQ ID NO: 2883354 - protein, 6 aa, Entamoeba invadens
LSTSEI

SEQ ID NO: 2883355 - protein, 5 aa, Entamoeba invadens
LSTSL

SEQ ID NO: 2883356 - protein, 9 aa, Entamoeba invadens
LSTSLESAK

SEQ ID NO: 2883357 - protein, 7 aa, Entamoeba invadens
LSTSLTS

SEQ ID NO: 2883358 - protein, 12 aa, Entamoeba invadens
LSTSPSKSFASS

SEQ ID NO: 2883359 - protein, 8 aa, Entamoeba invadens
LSTSRINV

SEQ ID NO: 2883360 - protein, 5 aa, Entamoeba invadens
LSTSS

SEQ ID NO: 2883361 - protein, 8 aa, Entamoeba invadens
LSTSSIEQ

SEQ ID NO: 2883362 - protein, 11 aa, Entamoeba invadens
LSTSSNKDKQF

SEQ ID NO: 2883363 - protein, 12 aa, Entamoeba invadens
LSTSVTKIGKSS

SEQ ID NO: 2883364 - protein, 4 aa, Entamoeba invadens
LSTT

SEQ ID NO: 2883365 - protein, 13 aa, Entamoeba invadens
LSTTENDEPEVET

SEQ ID NO: 2883366 - protein, 6 aa, Entamoeba invadens
LSTTFN

SEQ ID NO: 2883367 - protein, 5 aa, Entamoeba invadens
LSTTG

SEQ ID NO: 2883368 - protein, 7 aa, Entamoeba invadens
LSTTKKI

SEQ ID NO: 2883369 - protein, 7 aa, Entamoeba invadens
LSTTNER

SEQ ID NO: 2883370 - protein, 8 aa, Entamoeba invadens
LSTTQQRE

SEQ ID NO: 2883371 - protein, 6 aa, Entamoeba invadens
LSTTTY

SEQ ID NO: 2883372 - protein, 38 aa, Entamoeba invadens
LSTTVDSDNGEDAEDDEKEEKDDESLSGDSLSSDDDAM

SEQ ID NO: 2883373 - protein, 6 aa, Entamoeba invadens
LSTVSG

SEQ ID NO: 2883374 - protein, 13 aa, Entamoeba invadens
LSTYSATRWNYIA

SEQ ID NO: 2883375 - protein, 21 aa, Entamoeba invadens
LSVDENGKCSESTKCTEGSVL

SEQ ID NO: 2883376 - protein, 9 aa, Entamoeba invadens
LSVETGEKL

SEQ ID NO: 2883377 - protein, 5 aa, Entamoeba invadens
LSVGS

SEQ ID NO: 2883378 - protein, 19 aa, Entamoeba invadens
LSVNKESKVDQKVSNNDHV

SEQ ID NO: 2883379 - protein, 19 aa, Entamoeba invadens
LSVNQNSLRGIEDCVKFNV

SEQ ID NO: 2883380 - protein, 6 aa, Entamoeba invadens
LSVPED

SEQ ID NO: 2883381 - protein, 5 aa, Entamoeba invadens
LSVPK

SEQ ID NO: 2883382 - protein, 5 aa, Entamoeba invadens
LSVSE

SEQ ID NO: 2883383 - protein, 7 aa, Entamoeba invadens
LSVSQTK

SEQ ID NO: 2883384 - protein, 11 aa, Entamoeba invadens
LSYEAQQSLRR

SEQ ID NO: 2883385 - protein, 4 aa, Entamoeba invadens
LSYP

SEQ ID NO: 2883386 - protein, 6 aa, Entamoeba invadens
LSYPGT

SEQ ID NO: 2883387 - protein, 11 aa, Entamoeba invadens
LSYSDNNTKRA

SEQ ID NO: 2883388 - protein, 9 aa, Entamoeba invadens
LSYSDNNTQ

SEQ ID NO: 2883389 - protein, 10 aa, Entamoeba invadens
LSYSDNNTQR

SEQ ID NO: 2883390 - protein, 5 aa, Entamoeba invadens
LSYSE

SEQ ID NO: 2883391 - protein, 9 aa, Entamoeba invadens
LSYSGGKKA

SEQ ID NO: 2883392 - protein, 18 aa, Entamoeba invadens
LSYSKTTLEAAIKLVLLN

SEQ ID NO: 2883393 - protein, 12 aa, Entamoeba invadens
LSYSSSNSQPVN

SEQ ID NO: 2883394 - protein, 4 aa, Entamoeba invadens
LSYT

SEQ ID NO: 2883395 - protein, 5 aa, Entamoeba invadens
LSYTS

SEQ ID NO: 2883396 - protein, 8 aa, Entamoeba invadens
LTAEEALE

SEQ ID NO: 2883397 - protein, 28 aa, Entamoeba invadens
LTAEEKAAEEQRKAEKAKKVKEEPKGRS

SEQ ID NO: 2883398 - protein, 4 aa, Entamoeba invadens
LTAG

SEQ ID NO: 2883399 - protein, 6 aa, Entamoeba invadens
LTAGEG

SEQ ID NO: 2883400 - protein, 9 aa, Entamoeba invadens
LTAGPSANV

SEQ ID NO: 2883401 - protein, 10 aa, Entamoeba invadens
LTAKTSKDHK

SEQ ID NO: 2883402 - protein, 4 aa, Entamoeba invadens
LTAL

SEQ ID NO: 2883403 - protein, 11 aa, Entamoeba invadens
LTANPTTNKIS

SEQ ID NO: 2883404 - protein, 10 aa, Entamoeba invadens
LTAPDHSTMP

SEQ ID NO: 2883405 - protein, 20 aa, Entamoeba invadens
LTAPQQEVMETPTEATTPSH

SEQ ID NO: 2883406 - protein, 13 aa, Entamoeba invadens
LTAQKNDSECSIP

SEQ ID NO: 2883407 - protein, 10 aa, Entamoeba invadens
LTAQQDNPPL

SEQ ID NO: 2883408 - protein, 10 aa, Entamoeba invadens
LTASEKLQQT

SEQ ID NO: 2883409 - protein, 12 aa, Entamoeba invadens
LTASENLAETNR

SEQ ID NO: 2883410 - protein, 8 aa, Entamoeba invadens
LTASTDKT

SEQ ID NO: 2883411 - protein, 9 aa, Entamoeba invadens
LTASTSAIE

SEQ ID NO: 2883412 - protein, 8 aa, Entamoeba invadens
LTATHEAE

SEQ ID NO: 2883413 - protein, 37 aa, Entamoeba invadens
LTATKNSAEKLEKTENEKKDVEGQLSNLSKTADEYTG

SEQ ID NO: 2883414 - protein, 7 aa, Entamoeba invadens
LTATNER

SEQ ID NO: 2883415 - protein, 19 aa, Entamoeba invadens
LTATNKKLSDQKIKDSEDL

SEQ ID NO: 2883416 - protein, 5 aa, Entamoeba invadens
LTCSP

SEQ ID NO: 2883417 - protein, 11 aa, Entamoeba invadens
LTDAAEGAENH

SEQ ID NO: 2883418 - protein, 11 aa, Entamoeba invadens
LTDADNLSEMS

SEQ ID NO: 2883419 - protein, 12 aa, Entamoeba invadens
LTDAPKKSFKET

SEQ ID NO: 2883420 - protein, 12 aa, Entamoeba invadens
LTDAQKEEAQQM

SEQ ID NO: 2883421 - protein, 5 aa, Entamoeba invadens
LTDDE

SEQ ID NO: 2883422 - protein, 7 aa, Entamoeba invadens
LTDDEKL

SEQ ID NO: 2883423 - protein, 13 aa, Entamoeba invadens
LTDEEKNEKDLEE

SEQ ID NO: 2883424 - protein, 13 aa, Entamoeba invadens
LTDEEKNKNDLEE

SEQ ID NO: 2883425 - protein, 8 aa, Entamoeba invadens
LTDEESSD

SEQ ID NO: 2883426 - protein, 14 aa, Entamoeba invadens
LTDEKKKDEKDLEK

SEQ ID NO: 2883427 - protein, 14 aa, Entamoeba invadens
LTDEKKKNEKNLEE

SEQ ID NO: 2883428 - protein, 15 aa, Entamoeba invadens
LTDEKKKNNEKDLEE

SEQ ID NO: 2883429 - protein, 13 aa, Entamoeba invadens
LTDEKKNENDLEE

SEQ ID NO: 2883430 - protein, 7 aa, Entamoeba invadens
LTDFESA

SEQ ID NO: 2883431 - protein, 18 aa, Entamoeba invadens
LTDFESARNVNTMMTNMT

SEQ ID NO: 2883432 - protein, 7 aa, Entamoeba invadens
LTDFGSA

SEQ ID NO: 2883433 - protein, 8 aa, Entamoeba invadens
LTDFGSAK

SEQ ID NO: 2883434 - protein, 5 aa, Entamoeba invadens
LTDHP

SEQ ID NO: 2883435 - protein, 8 aa, Entamoeba invadens
LTDKAEYQ

SEQ ID NO: 2883436 - protein, 5 aa, Entamoeba invadens
LTDKQ

SEQ ID NO: 2883437 - protein, 50 aa, Entamoeba invadens
LTDLSDDTSLEMSSSTDEKSLPTVTPPSNPPRKRGRPRKSVSDKVEKPPM

SEQ ID NO: 2883438 - protein, 18 aa, Entamoeba invadens
LTDPKTPTGNYGLDNENN

SEQ ID NO: 2883439 - protein, 19 aa, Entamoeba invadens
LTDPQDYKSYIESSRSLGH

SEQ ID NO: 2883440 - protein, 14 aa, Entamoeba invadens
LTDQLRKAEAERDR

SEQ ID NO: 2883441 - protein, 10 aa, Entamoeba invadens
LTDREDMGGI

SEQ ID NO: 2883442 - protein, 8 aa, Entamoeba invadens
LTDSANRA

SEQ ID NO: 2883443 - protein, 6 aa, Entamoeba invadens
LTDSEV

SEQ ID NO: 2883444 - protein, 6 aa, Entamoeba invadens
LTDSLQ

SEQ ID NO: 2883445 - protein, 8 aa, Entamoeba invadens
LTDSNYQG

SEQ ID NO: 2883446 - protein, 8 aa, Entamoeba invadens
LTDSPFPR

SEQ ID NO: 2883447 - protein, 8 aa, Entamoeba invadens
LTDSPNVQ

SEQ ID NO: 2883448 - protein, 26 aa, Entamoeba invadens
LTDSSDEIYQNTNDKQKQFESQSQRT

SEQ ID NO: 2883449 - protein, 7 aa, Entamoeba invadens
LTDSTKY

SEQ ID NO: 2883450 - protein, 16 aa, Entamoeba invadens
LTDTCRSSENTSSVPS

SEQ ID NO: 2883451 - protein, 6 aa, Entamoeba invadens
LTDTQK

SEQ ID NO: 2883452 - protein, 7 aa, Entamoeba invadens
LTDTQKT

SEQ ID NO: 2883453 - protein, 11 aa, Entamoeba invadens
LTDTTQTENAF

SEQ ID NO: 2883454 - protein, 7 aa, Entamoeba invadens
LTEADFS

SEQ ID NO: 2883455 - protein, 5 aa, Entamoeba invadens
LTEAK

SEQ ID NO: 2883456 - protein, 12 aa, Entamoeba invadens
LTEASNSQSFDL

SEQ ID NO: 2883457 - protein, 8 aa, Entamoeba invadens
LTEDEAVE

SEQ ID NO: 2883458 - protein, 6 aa, Entamoeba invadens
LTEDEL

SEQ ID NO: 2883459 - protein, 7 aa, Entamoeba invadens
LTEDQYG

SEQ ID NO: 2883460 - protein, 6 aa, Entamoeba invadens
LTEEDK

SEQ ID NO: 2883461 - protein, 7 aa, Entamoeba invadens
LTEEDSE

SEQ ID NO: 2883462 - protein, 6 aa, Entamoeba invadens
LTEEER

SEQ ID NO: 2883463 - protein, 11 aa, Entamoeba invadens
LTEEETATKEV

SEQ ID NO: 2883464 - protein, 22 aa, Entamoeba invadens
LTEEKEHHAKEIRSRCDKNEKK

SEQ ID NO: 2883465 - protein, 17 aa, Entamoeba invadens
LTEEKKKKKKNENDLEE

SEQ ID NO: 2883466 - protein, 6 aa, Entamoeba invadens
LTEELT

SEQ ID NO: 2883467 - protein, 5 aa, Entamoeba invadens
LTEEQ

SEQ ID NO: 2883468 - protein, 7 aa, Entamoeba invadens
LTEEQEK

SEQ ID NO: 2883469 - protein, 7 aa, Entamoeba invadens
LTEETET

SEQ ID NO: 2883470 - protein, 4 aa, Entamoeba invadens
LTEF

SEQ ID NO: 2883471 - protein, 6 aa, Entamoeba invadens
LTEFPN

SEQ ID NO: 2883472 - protein, 4 aa, Entamoeba invadens
LTEG

SEQ ID NO: 2883473 - protein, 13 aa, Entamoeba invadens
LTEGAARAVLDAL

SEQ ID NO: 2883474 - protein, 10 aa, Entamoeba invadens
LTEGKKDTIK

SEQ ID NO: 2883475 - protein, 6 aa, Entamoeba invadens
LTEGND

SEQ ID NO: 2883476 - protein, 10 aa, Entamoeba invadens
LTEGQKNRCQ

SEQ ID NO: 2883477 - protein, 13 aa, Entamoeba invadens
LTEGTPEGQLNEE

SEQ ID NO: 2883478 - protein, 5 aa, Entamoeba invadens
LTEKI

SEQ ID NO: 2883479 - protein, 6 aa, Entamoeba invadens
LTEKPD

SEQ ID NO: 2883480 - protein, 4 aa, Entamoeba invadens
LTEL

SEQ ID NO: 2883481 - protein, 15 aa, Entamoeba invadens
LTELPKNAFKDDRSL

SEQ ID NO: 2883482 - protein, 22 aa, Entamoeba invadens
LTEMDGDVDGKVNLEEMLKFLT

SEQ ID NO: 2883483 - protein, 4 aa, Entamoeba invadens
LTEN

SEQ ID NO: 2883484 - protein, 11 aa, Entamoeba invadens
LTENAQSMTSD

SEQ ID NO: 2883485 - protein, 7 aa, Entamoeba invadens
LTENEKT

SEQ ID NO: 2883486 - protein, 9 aa, Entamoeba invadens
LTENEVRSA

SEQ ID NO: 2883487 - protein, 5 aa, Entamoeba invadens
LTENK

SEQ ID NO: 2883488 - protein, 9 aa, Entamoeba invadens
LTENPPESK

SEQ ID NO: 2883489 - protein, 5 aa, Entamoeba invadens
LTENQ

SEQ ID NO: 2883490 - protein, 5 aa, Entamoeba invadens
LTENR

SEQ ID NO: 2883491 - protein, 9 aa, Entamoeba invadens
LTEPPQLSG

SEQ ID NO: 2883492 - protein, 23 aa, Entamoeba invadens
LTEPRKEDKKKPKKPKKKTSREL

SEQ ID NO: 2883493 - protein, 11 aa, Entamoeba invadens
LTEQNTKLKAE

SEQ ID NO: 2883494 - protein, 6 aa, Entamoeba invadens
LTEQPN

SEQ ID NO: 2883495 - protein, 4 aa, Entamoeba invadens
LTER

SEQ ID NO: 2883496 - protein, 13 aa, Entamoeba invadens
LTERDMSKEAVTE

SEQ ID NO: 2883497 - protein, 4 aa, Entamoeba invadens
LTES

SEQ ID NO: 2883498 - protein, 16 aa, Entamoeba invadens
LTESEYTTLTQSNSLE

SEQ ID NO: 2883499 - protein, 7 aa, Entamoeba invadens
LTESGDV

SEQ ID NO: 2883500 - protein, 10 aa, Entamoeba invadens
LTESKKSLDD

SEQ ID NO: 2883501 - protein, 10 aa, Entamoeba invadens
LTESSCNSIT

SEQ ID NO: 2883502 - protein, 11 aa, Entamoeba invadens
LTESSCNSITN

SEQ ID NO: 2883503 - protein, 6 aa, Entamoeba invadens
LTESSM

SEQ ID NO: 2883504 - protein, 5 aa, Entamoeba invadens
LTETV

SEQ ID NO: 2883505 - protein, 8 aa, Entamoeba invadens
LTEVPKNE

SEQ ID NO: 2883506 - protein, 5 aa, Entamoeba invadens
LTEVQ

SEQ ID NO: 2883507 - protein, 8 aa, Entamoeba invadens
LTEYTGPL

SEQ ID NO: 2883508 - protein, 6 aa, Entamoeba invadens
LTFNGE

SEQ ID NO: 2883509 - protein, 10 aa, Entamoeba invadens
LTFSNSPDRE

SEQ ID NO: 2883510 - protein, 14 aa, Entamoeba invadens
LTGASKTLFNFCFT

SEQ ID NO: 2883511 - protein, 29 aa, Entamoeba invadens
LTGDDDTGYFSRDTKEVSPTLGENSTGFG

SEQ ID NO: 2883512 - protein, 6 aa, Entamoeba invadens
LTGDDW

SEQ ID NO: 2883513 - protein, 4 aa, Entamoeba invadens
LTGE

SEQ ID NO: 2883514 - protein, 6 aa, Entamoeba invadens
LTGEDI

SEQ ID NO: 2883515 - protein, 64 aa, Entamoeba invadens
LTGEEDANTEKAVKIGRDVKSAKELREDSKAIKKPQEEENEEESEESEEEEVFSENEENKEADR

SEQ ID NO: 2883516 - protein, 7 aa, Entamoeba invadens
LTGEGVK

SEQ ID NO: 2883517 - protein, 7 aa, Entamoeba invadens
LTGENPS

SEQ ID NO: 2883518 - protein, 7 aa, Entamoeba invadens
LTGENTF

SEQ ID NO: 2883519 - protein, 6 aa, Entamoeba invadens
LTGENV

SEQ ID NO: 2883520 - protein, 11 aa, Entamoeba invadens
LTGGDATIERK

SEQ ID NO: 2883521 - protein, 19 aa, Entamoeba invadens
LTGGDLTEQAKAKAKGRGI

SEQ ID NO: 2883522 - protein, 7 aa, Entamoeba invadens
LTGGEDK

SEQ ID NO: 2883523 - protein, 8 aa, Entamoeba invadens
LTGHNGKV

SEQ ID NO: 2883524 - protein, 15 aa, Entamoeba invadens
LTGKGNAIKYDKNPT

SEQ ID NO: 2883525 - protein, 10 aa, Entamoeba invadens
LTGKNTTGDV

SEQ ID NO: 2883526 - protein, 10 aa, Entamoeba invadens
LTGKSKTIST

SEQ ID NO: 2883527 - protein, 10 aa, Entamoeba invadens
LTGKTDDNVR

SEQ ID NO: 2883528 - protein, 18 aa, Entamoeba invadens
LTGMTTQTSTGKGGSPHL

SEQ ID NO: 2883529 - protein, 4 aa, Entamoeba invadens
LTGN

SEQ ID NO: 2883530 - protein, 8 aa, Entamoeba invadens
LTGNDLSS

SEQ ID NO: 2883531 - protein, 12 aa, Entamoeba invadens
LTGNEGVKTKKR

SEQ ID NO: 2883532 - protein, 6 aa, Entamoeba invadens
LTGNEL

SEQ ID NO: 2883533 - protein, 6 aa, Entamoeba invadens
LTGNPN

SEQ ID NO: 2883534 - protein, 46 aa, Entamoeba invadens
LTGNTIPQQQSTSSTSPHTQQQQKVCEEKKEVKQETHKQTTPTAQA

SEQ ID NO: 2883535 - protein, 5 aa, Entamoeba invadens
LTGQS

SEQ ID NO: 2883536 - protein, 4 aa, Entamoeba invadens
LTGR

SEQ ID NO: 2883537 - protein, 6 aa, Entamoeba invadens
LTGRSK

SEQ ID NO: 2883538 - protein, 7 aa, Entamoeba invadens
LTGSKTV

SEQ ID NO: 2883539 - protein, 10 aa, Entamoeba invadens
LTGSNMDSRA

SEQ ID NO: 2883540 - protein, 7 aa, Entamoeba invadens
LTGSPTI

SEQ ID NO: 2883541 - protein, 5 aa, Entamoeba invadens
LTGTK

SEQ ID NO: 2883542 - protein, 5 aa, Entamoeba invadens
LTGTN

SEQ ID NO: 2883543 - protein, 9 aa, Entamoeba invadens
LTGTNKQTF

SEQ ID NO: 2883544 - protein, 4 aa, Entamoeba invadens
LTGV

SEQ ID NO: 2883545 - protein, 4 aa, Entamoeba invadens
LTIP

SEQ ID NO: 2883546 - protein, 8 aa, Entamoeba invadens
LTISPPDD

SEQ ID NO: 2883547 - protein, 4 aa, Entamoeba invadens
LTKA

SEQ ID NO: 2883548 - protein, 13 aa, Entamoeba invadens
LTKAAQKKNISKA

SEQ ID NO: 2883549 - protein, 4 aa, Entamoeba invadens
LTKD

SEQ ID NO: 2883550 - protein, 14 aa, Entamoeba invadens
LTKDEAKNKVSTDI

SEQ ID NO: 2883551 - protein, 7 aa, Entamoeba invadens
LTKDKEQ

SEQ ID NO: 2883552 - protein, 8 aa, Entamoeba invadens
LTKDKIDK

SEQ ID NO: 2883553 - protein, 10 aa, Entamoeba invadens
LTKDLEESGI

SEQ ID NO: 2883554 - protein, 11 aa, Entamoeba invadens
LTKDNNNNTEV

SEQ ID NO: 2883555 - protein, 8 aa, Entamoeba invadens
LTKDTDQV

SEQ ID NO: 2883556 - protein, 21 aa, Entamoeba invadens
LTKEEYNEKGEEIITQKFLIQ

SEQ ID NO: 2883557 - protein, 18 aa, Entamoeba invadens
LTKEGEDPEVYSKANENK

SEQ ID NO: 2883558 - protein, 6 aa, Entamoeba invadens
LTKEGV

SEQ ID NO: 2883559 - protein, 6 aa, Entamoeba invadens
LTKEIS

SEQ ID NO: 2883560 - protein, 19 aa, Entamoeba invadens
LTKELSKDNVLTSDEQNNS

SEQ ID NO: 2883561 - protein, 7 aa, Entamoeba invadens
LTKEQSC

SEQ ID NO: 2883562 - protein, 5 aa, Entamoeba invadens
LTKET

SEQ ID NO: 2883563 - protein, 4 aa, Entamoeba invadens
LTKI

SEQ ID NO: 2883564 - protein, 10 aa, Entamoeba invadens
LTKIDTNGVD

SEQ ID NO: 2883565 - protein, 14 aa, Entamoeba invadens
LTKISEEERKKHIE

SEQ ID NO: 2883566 - protein, 16 aa, Entamoeba invadens
LTKKAKNVEGKKQWPY

SEQ ID NO: 2883567 - protein, 7 aa, Entamoeba invadens
LTKKTKK

SEQ ID NO: 2883568 - protein, 9 aa, Entamoeba invadens
LTKKTRKYF

SEQ ID NO: 2883569 - protein, 14 aa, Entamoeba invadens
LTKLGQSKTPIGEN

SEQ ID NO: 2883570 - protein, 4 aa, Entamoeba invadens
LTKM

SEQ ID NO: 2883571 - protein, 21 aa, Entamoeba invadens
LTKMETENSQIQSSLQNTSDY

SEQ ID NO: 2883572 - protein, 16 aa, Entamoeba invadens
LTKNDEKANQQKLPDT

SEQ ID NO: 2883573 - protein, 19 aa, Entamoeba invadens
LTKPKAVRGVPLSTYFDDD

SEQ ID NO: 2883574 - protein, 7 aa, Entamoeba invadens
LTKQETR

SEQ ID NO: 2883575 - protein, 10 aa, Entamoeba invadens
LTKQKSCRTS

SEQ ID NO: 2883576 - protein, 6 aa, Entamoeba invadens
LTKQKT

SEQ ID NO: 2883577 - protein, 5 aa, Entamoeba invadens
LTKQL

SEQ ID NO: 2883578 - protein, 7 aa, Entamoeba invadens
LTKQNEM

SEQ ID NO: 2883579 - protein, 10 aa, Entamoeba invadens
LTKRDNYIDP

SEQ ID NO: 2883580 - protein, 23 aa, Entamoeba invadens
LTKRTEHKRPKEKTMKRRFAKSS

SEQ ID NO: 2883581 - protein, 8 aa, Entamoeba invadens
LTKSEASR

SEQ ID NO: 2883582 - protein, 11 aa, Entamoeba invadens
LTKSSKHPLGG

SEQ ID NO: 2883583 - protein, 6 aa, Entamoeba invadens
LTKSSL

SEQ ID NO: 2883584 - protein, 4 aa, Entamoeba invadens
LTKT

SEQ ID NO: 2883585 - protein, 22 aa, Entamoeba invadens
LTKTNKKNRHQFTQKEKKTTQS

SEQ ID NO: 2883586 - protein, 11 aa, Entamoeba invadens
LTKVGSDQGFP

SEQ ID NO: 2883587 - protein, 4 aa, Entamoeba invadens
LTLP

SEQ ID NO: 2883588 - protein, 18 aa, Entamoeba invadens
LTLPDNNKEVLRAETNKV

SEQ ID NO: 2883589 - protein, 10 aa, Entamoeba invadens
LTLPKNNTVI

SEQ ID NO: 2883590 - protein, 6 aa, Entamoeba invadens
LTLPSS

SEQ ID NO: 2883591 - protein, 6 aa, Entamoeba invadens
LTLSEP

SEQ ID NO: 2883592 - protein, 5 aa, Entamoeba invadens
LTLSQ

SEQ ID NO: 2883593 - protein, 10 aa, Entamoeba invadens
LTNATDGSNI

SEQ ID NO: 2883594 - protein, 10 aa, Entamoeba invadens
LTNATPEKID

SEQ ID NO: 2883595 - protein, 10 aa, Entamoeba invadens
LTNATPKKID

SEQ ID NO: 2883596 - protein, 5 aa, Entamoeba invadens
LTNDE

SEQ ID NO: 2883597 - protein, 9 aa, Entamoeba invadens
LTNDEKTGA

SEQ ID NO: 2883598 - protein, 10 aa, Entamoeba invadens
LTNDERECSR

SEQ ID NO: 2883599 - protein, 23 aa, Entamoeba invadens
LTNEKAEDSGIKKKRKRRTKKEM

SEQ ID NO: 2883600 - protein, 8 aa, Entamoeba invadens
LTNGNGKT

SEQ ID NO: 2883601 - protein, 6 aa, Entamoeba invadens
LTNGQS

SEQ ID NO: 2883602 - protein, 9 aa, Entamoeba invadens
LTNGTNDLE

SEQ ID NO: 2883603 - protein, 5 aa, Entamoeba invadens
LTNIT

SEQ ID NO: 2883604 - protein, 18 aa, Entamoeba invadens
LTNKGKKTVDSRKDRKKD

SEQ ID NO: 2883605 - protein, 11 aa, Entamoeba invadens
LTNKKESKSGY

SEQ ID NO: 2883606 - protein, 12 aa, Entamoeba invadens
LTNKKGNKTKIG

SEQ ID NO: 2883607 - protein, 4 aa, Entamoeba invadens
LTNN

SEQ ID NO: 2883608 - protein, 10 aa, Entamoeba invadens
LTNNTQNTIT

SEQ ID NO: 2883609 - protein, 4 aa, Entamoeba invadens
LTNP

SEQ ID NO: 2883610 - protein, 11 aa, Entamoeba invadens
LTNPKDGSYPN

SEQ ID NO: 2883611 - protein, 11 aa, Entamoeba invadens
LTNPPNPNVQQ

SEQ ID NO: 2883612 - protein, 8 aa, Entamoeba invadens
LTNPTDDT

SEQ ID NO: 2883613 - protein, 8 aa, Entamoeba invadens
LTNPTTHD

SEQ ID NO: 2883614 - protein, 20 aa, Entamoeba invadens
LTNREETLKDEISEKNEKFI

SEQ ID NO: 2883615 - protein, 23 aa, Entamoeba invadens
LTNSSTESNQNSIDEHKKQMATT

SEQ ID NO: 2883616 - protein, 4 aa, Entamoeba invadens
LTNT

SEQ ID NO: 2883617 - protein, 7 aa, Entamoeba invadens
LTNTAEL

SEQ ID NO: 2883618 - protein, 31 aa, Entamoeba invadens
LTNTDQTEATDIAEDCSSSEIVKEKRANAIQ

SEQ ID NO: 2883619 - protein, 12 aa, Entamoeba invadens
LTNTKEDELNNE

SEQ ID NO: 2883620 - protein, 5 aa, Entamoeba invadens
LTNTL

SEQ ID NO: 2883621 - protein, 5 aa, Entamoeba invadens
LTNTS

SEQ ID NO: 2883622 - protein, 6 aa, Entamoeba invadens
LTPATR

SEQ ID NO: 2883623 - protein, 4 aa, Entamoeba invadens
LTPC

SEQ ID NO: 2883624 - protein, 4 aa, Entamoeba invadens
LTPD

SEQ ID NO: 2883625 - protein, 7 aa, Entamoeba invadens
LTPDESN

SEQ ID NO: 2883626 - protein, 13 aa, Entamoeba invadens
LTPDKKGPAGEGF

SEQ ID NO: 2883627 - protein, 8 aa, Entamoeba invadens
LTPDLTPI

SEQ ID NO: 2883628 - protein, 33 aa, Entamoeba invadens
LTPDMKQNASPQFISDNSSPTNVSKASDTAKLP

SEQ ID NO: 2883629 - protein, 6 aa, Entamoeba invadens
LTPDSS

SEQ ID NO: 2883630 - protein, 5 aa, Entamoeba invadens
LTPDW

SEQ ID NO: 2883631 - protein, 10 aa, Entamoeba invadens
LTPEDSPRIR

SEQ ID NO: 2883632 - protein, 6 aa, Entamoeba invadens
LTPEEI

SEQ ID NO: 2883633 - protein, 6 aa, Entamoeba invadens
LTPEEQ

SEQ ID NO: 2883634 - protein, 8 aa, Entamoeba invadens
LTPEESDK

SEQ ID NO: 2883635 - protein, 8 aa, Entamoeba invadens
LTPEEVKS

SEQ ID NO: 2883636 - protein, 5 aa, Entamoeba invadens
LTPEG

SEQ ID NO: 2883637 - protein, 10 aa, Entamoeba invadens
LTPENQEKMT

SEQ ID NO: 2883638 - protein, 9 aa, Entamoeba invadens
LTPEQKEKV

SEQ ID NO: 2883639 - protein, 6 aa, Entamoeba invadens
LTPESV

SEQ ID NO: 2883640 - protein, 9 aa, Entamoeba invadens
LTPGHPEYH

SEQ ID NO: 2883641 - protein, 6 aa, Entamoeba invadens
LTPGQA

SEQ ID NO: 2883642 - protein, 7 aa, Entamoeba invadens
LTPGRQY

SEQ ID NO: 2883643 - protein, 14 aa, Entamoeba invadens
LTPHDFKERRGELV

SEQ ID NO: 2883644 - protein, 12 aa, Entamoeba invadens
LTPKGKNPITLD

SEQ ID NO: 2883645 - protein, 19 aa, Entamoeba invadens
LTPKPRPSLTSPTKTSGFV

SEQ ID NO: 2883646 - protein, 14 aa, Entamoeba invadens
LTPKRNKTDKTSKK

SEQ ID NO: 2883647 - protein, 6 aa, Entamoeba invadens
LTPKSD

SEQ ID NO: 2883648 - protein, 7 aa, Entamoeba invadens
LTPKTRK

SEQ ID NO: 2883649 - protein, 14 aa, Entamoeba invadens
LTPKYTEQHNPTYT

SEQ ID NO: 2883650 - protein, 10 aa, Entamoeba invadens
LTPLEKARDR

SEQ ID NO: 2883651 - protein, 4 aa, Entamoeba invadens
LTPN

SEQ ID NO: 2883652 - protein, 16 aa, Entamoeba invadens
LTPNDQVTYATREETS

SEQ ID NO: 2883653 - protein, 18 aa, Entamoeba invadens
LTPNSDPQKNYGLDNSEN

SEQ ID NO: 2883654 - protein, 5 aa, Entamoeba invadens
LTPPF

SEQ ID NO: 2883655 - protein, 8 aa, Entamoeba invadens
LTPPGEDG

SEQ ID NO: 2883656 - protein, 6 aa, Entamoeba invadens
LTPPIQ

SEQ ID NO: 2883657 - protein, 8 aa, Entamoeba invadens
LTPPKEMS

SEQ ID NO: 2883658 - protein, 19 aa, Entamoeba invadens
LTPPPPPPPPVAPIDPEKL

SEQ ID NO: 2883659 - protein, 7 aa, Entamoeba invadens
LTPPQNP

SEQ ID NO: 2883660 - protein, 4 aa, Entamoeba invadens
LTPQ

SEQ ID NO: 2883661 - protein, 6 aa, Entamoeba invadens
LTPQES

SEQ ID NO: 2883662 - protein, 11 aa, Entamoeba invadens
LTPQPPTPRTM

SEQ ID NO: 2883663 - protein, 10 aa, Entamoeba invadens
LTPQSKKTPL

SEQ ID NO: 2883664 - protein, 7 aa, Entamoeba invadens
LTPQSTK

SEQ ID NO: 2883665 - protein, 6 aa, Entamoeba invadens
LTPQTA

SEQ ID NO: 2883666 - protein, 13 aa, Entamoeba invadens
LTPQYRKQFNTSA

SEQ ID NO: 2883667 - protein, 10 aa, Entamoeba invadens
LTPRGSSEFK

SEQ ID NO: 2883668 - protein, 9 aa, Entamoeba invadens
LTPRPHRSR

SEQ ID NO: 2883669 - protein, 23 aa, Entamoeba invadens
LTPRSTPLTPKRPIIQRRSSTFT

SEQ ID NO: 2883670 - protein, 9 aa, Entamoeba invadens
LTPRTNELY

SEQ ID NO: 2883671 - protein, 4 aa, Entamoeba invadens
LTPS

SEQ ID NO: 2883672 - protein, 6 aa, Entamoeba invadens
LTPSDI

SEQ ID NO: 2883673 - protein, 7 aa, Entamoeba invadens
LTPSITK

SEQ ID NO: 2883674 - protein, 5 aa, Entamoeba invadens
LTPSK

SEQ ID NO: 2883675 - protein, 6 aa, Entamoeba invadens
LTPSLK

SEQ ID NO: 2883676 - protein, 17 aa, Entamoeba invadens
LTPSLTGQTTYPGKTPP

SEQ ID NO: 2883677 - protein, 26 aa, Entamoeba invadens
LTPSNKPNSSEDIYSEENRTGDRHRD

SEQ ID NO: 2883678 - protein, 6 aa, Entamoeba invadens
LTPSQA

SEQ ID NO: 2883679 - protein, 5 aa, Entamoeba invadens
LTPSY

SEQ ID NO: 2883680 - protein, 6 aa, Entamoeba invadens
LTPTEL

SEQ ID NO: 2883681 - protein, 6 aa, Entamoeba invadens
LTPTFT

SEQ ID NO: 2883682 - protein, 6 aa, Entamoeba invadens
LTPTLS

SEQ ID NO: 2883683 - protein, 7 aa, Entamoeba invadens
LTPTNPE

SEQ ID NO: 2883684 - protein, 15 aa, Entamoeba invadens
LTQASEKSDDFSRNE

SEQ ID NO: 2883685 - protein, 4 aa, Entamoeba invadens
LTQD

SEQ ID NO: 2883686 - protein, 10 aa, Entamoeba invadens
LTQDGKISEQ

SEQ ID NO: 2883687 - protein, 5 aa, Entamoeba invadens
LTQDN

SEQ ID NO: 2883688 - protein, 4 aa, Entamoeba invadens
LTQE

SEQ ID NO: 2883689 - protein, 5 aa, Entamoeba invadens
LTQEE

SEQ ID NO: 2883690 - protein, 7 aa, Entamoeba invadens
LTQEGSK

SEQ ID NO: 2883691 - protein, 23 aa, Entamoeba invadens
LTQENTHDNVGNTKEQEQNRSGV

SEQ ID NO: 2883692 - protein, 13 aa, Entamoeba invadens
LTQEQRAKAKTQF

SEQ ID NO: 2883693 - protein, 10 aa, Entamoeba invadens
LTQESEEAVR

SEQ ID NO: 2883694 - protein, 13 aa, Entamoeba invadens
LTQETTKSQHPPI

SEQ ID NO: 2883695 - protein, 9 aa, Entamoeba invadens
LTQHDGEKC

SEQ ID NO: 2883696 - protein, 14 aa, Entamoeba invadens
LTQKELSQKLTNKV

SEQ ID NO: 2883697 - protein, 9 aa, Entamoeba invadens
LTQKKTKTK

SEQ ID NO: 2883698 - protein, 4 aa, Entamoeba invadens
LTQN

SEQ ID NO: 2883699 - protein, 15 aa, Entamoeba invadens
LTQPNTPNDDSKRSI

SEQ ID NO: 2883700 - protein, 4 aa, Entamoeba invadens
LTQQ

SEQ ID NO: 2883701 - protein, 5 aa, Entamoeba invadens
LTQQA

SEQ ID NO: 2883702 - protein, 6 aa, Entamoeba invadens
LTQQEN

SEQ ID NO: 2883703 - protein, 9 aa, Entamoeba invadens
LTQQNAEKY

SEQ ID NO: 2883704 - protein, 6 aa, Entamoeba invadens
LTQQQT

SEQ ID NO: 2883705 - protein, 15 aa, Entamoeba invadens
LTQRAEGLKPQYESG

SEQ ID NO: 2883706 - protein, 4 aa, Entamoeba invadens
LTQS

SEQ ID NO: 2883707 - protein, 12 aa, Entamoeba invadens
LTQSEGRKKKSF

SEQ ID NO: 2883708 - protein, 7 aa, Entamoeba invadens
LTQSGNI

SEQ ID NO: 2883709 - protein, 13 aa, Entamoeba invadens
LTQSTPPQPKNKY

SEQ ID NO: 2883710 - protein, 6 aa, Entamoeba invadens
LTQTDE

SEQ ID NO: 2883711 - protein, 14 aa, Entamoeba invadens
LTQTKDDKSKIEEQ

SEQ ID NO: 2883712 - protein, 19 aa, Entamoeba invadens
LTQTNGDMGSAIDILANKM

SEQ ID NO: 2883713 - protein, 11 aa, Entamoeba invadens
LTRAKDFADRS

SEQ ID NO: 2883714 - protein, 11 aa, Entamoeba invadens
LTRDDVAASSV

SEQ ID NO: 2883715 - protein, 5 aa, Entamoeba invadens
LTRDQ

SEQ ID NO: 2883716 - protein, 5 aa, Entamoeba invadens
LTREH

SEQ ID NO: 2883717 - protein, 4 aa, Entamoeba invadens
LTRK

SEQ ID NO: 2883718 - protein, 20 aa, Entamoeba invadens
LTRSTRGKKSWTTEQKEYAM

SEQ ID NO: 2883719 - protein, 7 aa, Entamoeba invadens
LTRTETL

SEQ ID NO: 2883720 - protein, 12 aa, Entamoeba invadens
LTRTPQNCKEMK

SEQ ID NO: 2883721 - protein, 4 aa, Entamoeba invadens
LTRV

SEQ ID NO: 2883722 - protein, 5 aa, Entamoeba invadens
LTSCP

SEQ ID NO: 2883723 - protein, 9 aa, Entamoeba invadens
LTSDDALSQ

SEQ ID NO: 2883724 - protein, 7 aa, Entamoeba invadens
LTSDDPL

SEQ ID NO: 2883725 - protein, 10 aa, Entamoeba invadens
LTSDETNDKY

SEQ ID NO: 2883726 - protein, 15 aa, Entamoeba invadens
LTSDYKANPKTLPDY

SEQ ID NO: 2883727 - protein, 14 aa, Entamoeba invadens
LTSEDEKFAKPSWL

SEQ ID NO: 2883728 - protein, 10 aa, Entamoeba invadens
LTSEKPIQKV

SEQ ID NO: 2883729 - protein, 10 aa, Entamoeba invadens
LTSEPQRKKA

SEQ ID NO: 2883730 - protein, 14 aa, Entamoeba invadens
LTSETTKTKFRQNL

SEQ ID NO: 2883731 - protein, 12 aa, Entamoeba invadens
LTSGGCESCNKF

SEQ ID NO: 2883732 - protein, 6 aa, Entamoeba invadens
LTSGGI

SEQ ID NO: 2883733 - protein, 8 aa, Entamoeba invadens
LTSGSEYG

SEQ ID NO: 2883734 - protein, 5 aa, Entamoeba invadens
LTSHG

SEQ ID NO: 2883735 - protein, 4 aa, Entamoeba invadens
LTSI

SEQ ID NO: 2883736 - protein, 7 aa, Entamoeba invadens
LTSIEDD

SEQ ID NO: 2883737 - protein, 7 aa, Entamoeba invadens
LTSIPSL

SEQ ID NO: 2883738 - protein, 10 aa, Entamoeba invadens
LTSKDNDLYG

SEQ ID NO: 2883739 - protein, 8 aa, Entamoeba invadens
LTSKEKVN

SEQ ID NO: 2883740 - protein, 6 aa, Entamoeba invadens
LTSKEQ

SEQ ID NO: 2883741 - protein, 8 aa, Entamoeba invadens
LTSKGLPN

SEQ ID NO: 2883742 - protein, 6 aa, Entamoeba invadens
LTSKKQ

SEQ ID NO: 2883743 - protein, 21 aa, Entamoeba invadens
LTSKNDYYEQKKKTSHDESKR

SEQ ID NO: 2883744 - protein, 6 aa, Entamoeba invadens
LTSKNE

SEQ ID NO: 2883745 - protein, 10 aa, Entamoeba invadens
LTSKSRKTWK

SEQ ID NO: 2883746 - protein, 11 aa, Entamoeba invadens
LTSLGESTKRF

SEQ ID NO: 2883747 - protein, 6 aa, Entamoeba invadens
LTSLPD

SEQ ID NO: 2883748 - protein, 10 aa, Entamoeba invadens
LTSLRTGAVG

SEQ ID NO: 2883749 - protein, 5 aa, Entamoeba invadens
LTSLS

SEQ ID NO: 2883750 - protein, 10 aa, Entamoeba invadens
LTSNGKLNRN

SEQ ID NO: 2883751 - protein, 16 aa, Entamoeba invadens
LTSNKDTVDNAEETNE

SEQ ID NO: 2883752 - protein, 9 aa, Entamoeba invadens
LTSNKSDIL

SEQ ID NO: 2883753 - protein, 5 aa, Entamoeba invadens
LTSNP

SEQ ID NO: 2883754 - protein, 5 aa, Entamoeba invadens
LTSPI

SEQ ID NO: 2883755 - protein, 6 aa, Entamoeba invadens
LTSPIT

SEQ ID NO: 2883756 - protein, 14 aa, Entamoeba invadens
LTSPLSQSNQTTVQ

SEQ ID NO: 2883757 - protein, 8 aa, Entamoeba invadens
LTSPPSED

SEQ ID NO: 2883758 - protein, 10 aa, Entamoeba invadens
LTSPSGTDFS

SEQ ID NO: 2883759 - protein, 6 aa, Entamoeba invadens
LTSPSP

SEQ ID NO: 2883760 - protein, 10 aa, Entamoeba invadens
LTSPTDLRIP

SEQ ID NO: 2883761 - protein, 6 aa, Entamoeba invadens
LTSPTI

SEQ ID NO: 2883762 - protein, 8 aa, Entamoeba invadens
LTSPYDAL

SEQ ID NO: 2883763 - protein, 12 aa, Entamoeba invadens
LTSQRDKRNSIV

SEQ ID NO: 2883764 - protein, 4 aa, Entamoeba invadens
LTSR

SEQ ID NO: 2883765 - protein, 24 aa, Entamoeba invadens
LTSRDAKDMDLKRENANVDGNSSM

SEQ ID NO: 2883766 - protein, 8 aa, Entamoeba invadens
LTSSGDST

SEQ ID NO: 2883767 - protein, 6 aa, Entamoeba invadens
LTSSGM

SEQ ID NO: 2883768 - protein, 17 aa, Entamoeba invadens
LTSSSKTEFKDTNSIND

SEQ ID NO: 2883769 - protein, 6 aa, Entamoeba invadens
LTSSTQ

SEQ ID NO: 2883770 - protein, 12 aa, Entamoeba invadens
LTSSTTPYIPKQ

SEQ ID NO: 2883771 - protein, 7 aa, Entamoeba invadens
LTSSVGE

SEQ ID NO: 2883772 - protein, 13 aa, Entamoeba invadens
LTSTATHRPNISM

SEQ ID NO: 2883773 - protein, 9 aa, Entamoeba invadens
LTSTDGYEH

SEQ ID NO: 2883774 - protein, 32 aa, Entamoeba invadens
LTSTDKTEATDIAEDCSSSEIDKEKRANAIQH

SEQ ID NO: 2883775 - protein, 31 aa, Entamoeba invadens
LTSTDKTEATDIAEDCSSSEIVKEKRANAIQ

SEQ ID NO: 2883776 - protein, 10 aa, Entamoeba invadens
LTSTDQTEAI

SEQ ID NO: 2883777 - protein, 31 aa, Entamoeba invadens
LTSTDQTEATDFAEDCSSSEIVKEKRANAIQ

SEQ ID NO: 2883778 - protein, 32 aa, Entamoeba invadens
LTSTDQTEATDIAEDCSSSEIDKEKRANAIQH

SEQ ID NO: 2883779 - protein, 33 aa, Entamoeba invadens
LTSTDQTEATDIAEDCSSSEIVKEKRANAIQQR

SEQ ID NO: 2883780 - protein, 32 aa, Entamoeba invadens
LTSTDQTEATDIAEDCSSSEIVKEKRANSIQH

SEQ ID NO: 2883781 - protein, 31 aa, Entamoeba invadens
LTSTDQTEATDIAEDCSSSEIVKEKRANTIQ

SEQ ID NO: 2883782 - protein, 19 aa, Entamoeba invadens
LTSTDQTEATDIAEDCSTE

SEQ ID NO: 2883783 - protein, 31 aa, Entamoeba invadens
LTSTDQTEATDIAEDYSSSEIVKEKRATAIQ

SEQ ID NO: 2883784 - protein, 7 aa, Entamoeba invadens
LTSTNAQ

SEQ ID NO: 2883785 - protein, 15 aa, Entamoeba invadens
LTSTPRKKYSDKTQL

SEQ ID NO: 2883786 - protein, 25 aa, Entamoeba invadens
LTSTSGSQKQPLPTGARAVSDPDKM

SEQ ID NO: 2883787 - protein, 7 aa, Entamoeba invadens
LTSVESG

SEQ ID NO: 2883788 - protein, 9 aa, Entamoeba invadens
LTSYNNRGR

SEQ ID NO: 2883789 - protein, 8 aa, Entamoeba invadens
LTSYRGDY

SEQ ID NO: 2883790 - protein, 4 aa, Entamoeba invadens
LTTA

SEQ ID NO: 2883791 - protein, 11 aa, Entamoeba invadens
LTTAQAASYQQ

SEQ ID NO: 2883792 - protein, 8 aa, Entamoeba invadens
LTTASEEM

SEQ ID NO: 2883793 - protein, 4 aa, Entamoeba invadens
LTTD

SEQ ID NO: 2883794 - protein, 8 aa, Entamoeba invadens
LTTDDTEA

SEQ ID NO: 2883795 - protein, 7 aa, Entamoeba invadens
LTTDGFT

SEQ ID NO: 2883796 - protein, 8 aa, Entamoeba invadens
LTTENATR

SEQ ID NO: 2883797 - protein, 8 aa, Entamoeba invadens
LTTENKNS

SEQ ID NO: 2883798 - protein, 10 aa, Entamoeba invadens
LTTENNESYT

SEQ ID NO: 2883799 - protein, 5 aa, Entamoeba invadens
LTTEY

SEQ ID NO: 2883800 - protein, 5 aa, Entamoeba invadens
LTTGE

SEQ ID NO: 2883801 - protein, 6 aa, Entamoeba invadens
LTTGNK

SEQ ID NO: 2883802 - protein, 5 aa, Entamoeba invadens
LTTKE

SEQ ID NO: 2883803 - protein, 13 aa, Entamoeba invadens
LTTKSEQESCGNI

SEQ ID NO: 2883804 - protein, 8 aa, Entamoeba invadens
LTTNATNL

SEQ ID NO: 2883805 - protein, 8 aa, Entamoeba invadens
LTTNEKVD

SEQ ID NO: 2883806 - protein, 6 aa, Entamoeba invadens
LTTNVE

SEQ ID NO: 2883807 - protein, 4 aa, Entamoeba invadens
LTTP

SEQ ID NO: 2883808 - protein, 11 aa, Entamoeba invadens
LTTPRSYSLDT

SEQ ID NO: 2883809 - protein, 6 aa, Entamoeba invadens
LTTPSN

SEQ ID NO: 2883810 - protein, 5 aa, Entamoeba invadens
LTTQS

SEQ ID NO: 2883811 - protein, 7 aa, Entamoeba invadens
LTTQTEE

SEQ ID NO: 2883812 - protein, 8 aa, Entamoeba invadens
LTTQTPND

SEQ ID NO: 2883813 - protein, 6 aa, Entamoeba invadens
LTTQTY

SEQ ID NO: 2883814 - protein, 10 aa, Entamoeba invadens
LTTRNNQLKT

SEQ ID NO: 2883815 - protein, 7 aa, Entamoeba invadens
LTTSERM

SEQ ID NO: 2883816 - protein, 7 aa, Entamoeba invadens
LTTSPNV

SEQ ID NO: 2883817 - protein, 11 aa, Entamoeba invadens
LTTSRRKSKNV

SEQ ID NO: 2883818 - protein, 6 aa, Entamoeba invadens
LTTSSR

SEQ ID NO: 2883819 - protein, 5 aa, Entamoeba invadens
LTTST

SEQ ID NO: 2883820 - protein, 7 aa, Entamoeba invadens
LTTTKKE

SEQ ID NO: 2883821 - protein, 12 aa, Entamoeba invadens
LTTTKRQQDVQA

SEQ ID NO: 2883822 - protein, 10 aa, Entamoeba invadens
LTTTQDDMTQ

SEQ ID NO: 2883823 - protein, 5 aa, Entamoeba invadens
LTTTT

SEQ ID NO: 2883824 - protein, 11 aa, Entamoeba invadens
LTVESDSSDPL

SEQ ID NO: 2883825 - protein, 8 aa, Entamoeba invadens
LTVKEKSK

SEQ ID NO: 2883826 - protein, 6 aa, Entamoeba invadens
LTVPTN

SEQ ID NO: 2883827 - protein, 9 aa, Entamoeba invadens
LTVQPPDGN

SEQ ID NO: 2883828 - protein, 14 aa, Entamoeba invadens
LTYPSLEKKGWFNW

SEQ ID NO: 2883829 - protein, 8 aa, Entamoeba invadens
LTYSQQSE

SEQ ID NO: 2883830 - protein, 23 aa, Entamoeba invadens
LTYTPKMENEEENKKKDGKCCQL

SEQ ID NO: 2883831 - protein, 21 aa, Entamoeba invadens
LVAEEDNSKDLEKQLHEKEDD

SEQ ID NO: 2883832 - protein, 9 aa, Entamoeba invadens
LVDEKGRGA

SEQ ID NO: 2883833 - protein, 4 aa, Entamoeba invadens
LVDG

SEQ ID NO: 2883834 - protein, 15 aa, Entamoeba invadens
LVDKKNKKREVAEKA

SEQ ID NO: 2883835 - protein, 5 aa, Entamoeba invadens
LVEEQ

SEQ ID NO: 2883836 - protein, 8 aa, Entamoeba invadens
LVETSQSV

SEQ ID NO: 2883837 - protein, 5 aa, Entamoeba invadens
LVGDS

SEQ ID NO: 2883838 - protein, 5 aa, Entamoeba invadens
LVGGY

SEQ ID NO: 2883839 - protein, 9 aa, Entamoeba invadens
LVGQEDQEI

SEQ ID NO: 2883840 - protein, 12 aa, Entamoeba invadens
LVGTDSKLSLKT

SEQ ID NO: 2883841 - protein, 5 aa, Entamoeba invadens
LVGTP

SEQ ID NO: 2883842 - protein, 9 aa, Entamoeba invadens
LVHPESPNG

SEQ ID NO: 2883843 - protein, 10 aa, Entamoeba invadens
LVKASDEEQF

SEQ ID NO: 2883844 - protein, 10 aa, Entamoeba invadens
LVKSKTGKRY

SEQ ID NO: 2883845 - protein, 6 aa, Entamoeba invadens
LVNNTK

SEQ ID NO: 2883846 - protein, 9 aa, Entamoeba invadens
LVNPNESNL

SEQ ID NO: 2883847 - protein, 4 aa, Entamoeba invadens
LVPE

SEQ ID NO: 2883848 - protein, 13 aa, Entamoeba invadens
LVPERTKKQCKER

SEQ ID NO: 2883849 - protein, 4 aa, Entamoeba invadens
LVPG

SEQ ID NO: 2883850 - protein, 5 aa, Entamoeba invadens
LVPPG

SEQ ID NO: 2883851 - protein, 14 aa, Entamoeba invadens
LVPPPPSQSNMGMC

SEQ ID NO: 2883852 - protein, 4 aa, Entamoeba invadens
LVQG

SEQ ID NO: 2883853 - protein, 9 aa, Entamoeba invadens
LVSEDDDDM

SEQ ID NO: 2883854 - protein, 8 aa, Entamoeba invadens
LVSESSNK

SEQ ID NO: 2883855 - protein, 10 aa, Entamoeba invadens
LVSGDTPEDC

SEQ ID NO: 2883856 - protein, 14 aa, Entamoeba invadens
LVSGNSQNGSQAME

SEQ ID NO: 2883857 - protein, 9 aa, Entamoeba invadens
LVSGSSDRK

SEQ ID NO: 2883858 - protein, 11 aa, Entamoeba invadens
LVSKSTPLTPI

SEQ ID NO: 2883859 - protein, 17 aa, Entamoeba invadens
LVSQGGSKKKGFNQGTM

SEQ ID NO: 2883860 - protein, 5 aa, Entamoeba invadens
LVSRG

SEQ ID NO: 2883861 - protein, 5 aa, Entamoeba invadens
LVSRN

SEQ ID NO: 2883862 - protein, 17 aa, Entamoeba invadens
LVSSEEQKVSEENTKTL

SEQ ID NO: 2883863 - protein, 11 aa, Entamoeba invadens
LVSTKGADYAK

SEQ ID NO: 2883864 - protein, 9 aa, Entamoeba invadens
LVSTPDTLT

SEQ ID NO: 2883865 - protein, 11 aa, Entamoeba invadens
LVTDDKTKQTV

SEQ ID NO: 2883866 - protein, 9 aa, Entamoeba invadens
LVTKEDGYK

SEQ ID NO: 2883867 - protein, 6 aa, Entamoeba invadens
LVTNPE

SEQ ID NO: 2883868 - protein, 78 aa, Entamoeba invadens
LVTPSNAMETEPIKAEEVKQENTTNSEDSNVPEGEQVQGDLPPKCPSTPSGVPPENKEENKEKSEPVKMEEEPKKEIP

SEQ ID NO: 2883869 - protein, 5 aa, Entamoeba invadens
LVYDS

SEQ ID NO: 2883870 - protein, 7 aa, Entamoeba invadens
LWGRESQ

SEQ ID NO: 2883871 - protein, 6 aa, Entamoeba invadens
LYDNGR

SEQ ID NO: 2883872 - protein, 18 aa, Entamoeba invadens
LYDQPLNDSFTESTTSDF

SEQ ID NO: 2883873 - protein, 13 aa, Entamoeba invadens
LYDSESKSGWNST

SEQ ID NO: 2883874 - protein, 8 aa, Entamoeba invadens
LYEEEREK

SEQ ID NO: 2883875 - protein, 5 aa, Entamoeba invadens
LYEEG

SEQ ID NO: 2883876 - protein, 4 aa, Entamoeba invadens
LYER

SEQ ID NO: 2883877 - protein, 8 aa, Entamoeba invadens
LYESERRN

SEQ ID NO: 2883878 - protein, 7 aa, Entamoeba invadens
LYESGER

SEQ ID NO: 2883879 - protein, 5 aa, Entamoeba invadens
LYETT

SEQ ID NO: 2883880 - protein, 9 aa, Entamoeba invadens
LYETTTEKV

SEQ ID NO: 2883881 - protein, 9 aa, Entamoeba invadens
LYETTTTEK

SEQ ID NO: 2883882 - protein, 11 aa, Entamoeba invadens
LYGEKYSTTIK

SEQ ID NO: 2883883 - protein, 11 aa, Entamoeba invadens
LYGETDRQSSL

SEQ ID NO: 2883884 - protein, 6 aa, Entamoeba invadens
LYHPED

SEQ ID NO: 2883885 - protein, 10 aa, Entamoeba invadens
LYKASEDYDK

SEQ ID NO: 2883886 - protein, 10 aa, Entamoeba invadens
LYKEEKAEKF

SEQ ID NO: 2883887 - protein, 5 aa, Entamoeba invadens
LYKHD

SEQ ID NO: 2883888 - protein, 8 aa, Entamoeba invadens
LYKSDTNE

SEQ ID NO: 2883889 - protein, 4 aa, Entamoeba invadens
LYNG

SEQ ID NO: 2883890 - protein, 10 aa, Entamoeba invadens
LYNGSEQQSL

SEQ ID NO: 2883891 - protein, 4 aa, Entamoeba invadens
LYNQ

SEQ ID NO: 2883892 - protein, 35 aa, Entamoeba invadens
LYNTKEEKDEIENELKEQKEKVEIANKETENIKNE

SEQ ID NO: 2883893 - protein, 5 aa, Entamoeba invadens
LYPEE

SEQ ID NO: 2883894 - protein, 8 aa, Entamoeba invadens
LYPEESKE

SEQ ID NO: 2883895 - protein, 5 aa, Entamoeba invadens
LYPEY

SEQ ID NO: 2883896 - protein, 4 aa, Entamoeba invadens
LYPK

SEQ ID NO: 2883897 - protein, 7 aa, Entamoeba invadens
LYPNGYN

SEQ ID NO: 2883898 - protein, 8 aa, Entamoeba invadens
LYPSDHKP

SEQ ID NO: 2883899 - protein, 5 aa, Entamoeba invadens
LYPSK

SEQ ID NO: 2883900 - protein, 7 aa, Entamoeba invadens
LYQSGDA

SEQ ID NO: 2883901 - protein, 6 aa, Entamoeba invadens
LYSDGT

SEQ ID NO: 2883902 - protein, 10 aa, Entamoeba invadens
LYSGSSDKTI

SEQ ID NO: 2883903 - protein, 6 aa, Entamoeba invadens
LYTDES

SEQ ID NO: 2883904 - protein, 7 aa, Entamoeba invadens
LYTEKSK

SEQ ID NO: 2883905 - protein, 15 aa, Entamoeba invadens
LYTQQNQNWKTDQNQ

SEQ ID NO: 2883906 - protein, 5 aa, Entamoeba invadens
LYTTP

SEQ ID NO: 2883907 - protein, 40 aa, Entamoeba invadens
MAAPPVAAQQVPSQPQQTQPQQQQQQTFPQQPTQPQFPGM

SEQ ID NO: 2883908 - protein, 12 aa, Entamoeba invadens
MAATRSKAAEVT

SEQ ID NO: 2883909 - protein, 8 aa, Entamoeba invadens
MADEVGKG

SEQ ID NO: 2883910 - protein, 6 aa, Entamoeba invadens
MADKET

SEQ ID NO: 2883911 - protein, 5 aa, Entamoeba invadens
MADQD

SEQ ID NO: 2883912 - protein, 16 aa, Entamoeba invadens
MADQNNTFKSGQYNVS

SEQ ID NO: 2883913 - protein, 14 aa, Entamoeba invadens
MAEGGKEKKMEIEP

SEQ ID NO: 2883914 - protein, 4 aa, Entamoeba invadens
MAEI

SEQ ID NO: 2883915 - protein, 8 aa, Entamoeba invadens
MAEKNKNS

SEQ ID NO: 2883916 - protein, 25 aa, Entamoeba invadens
MAENPPEERKRAKKDEKDAKTKKEV

SEQ ID NO: 2883917 - protein, 33 aa, Entamoeba invadens
MAEQADADVKNEEEIDNKLKEQGVDLDMFDDLD

SEQ ID NO: 2883918 - protein, 9 aa, Entamoeba invadens
MAEQEKVKT

SEQ ID NO: 2883919 - protein, 16 aa, Entamoeba invadens
MAEQEKVKTVRDHKTA

SEQ ID NO: 2883920 - protein, 11 aa, Entamoeba invadens
MAEQENVETVR

SEQ ID NO: 2883921 - protein, 18 aa, Entamoeba invadens
MAEQENVETVRDYKTASE

SEQ ID NO: 2883922 - protein, 12 aa, Entamoeba invadens
MAERAKAEEERH

SEQ ID NO: 2883923 - protein, 5 aa, Entamoeba invadens
MAERR

SEQ ID NO: 2883924 - protein, 12 aa, Entamoeba invadens
MAERSDTETEIE

SEQ ID NO: 2883925 - protein, 5 aa, Entamoeba invadens
MAETR

SEQ ID NO: 2883926 - protein, 6 aa, Entamoeba invadens
MAGGDV

SEQ ID NO: 2883927 - protein, 10 aa, Entamoeba invadens
MAGREIPVSD

SEQ ID NO: 2883928 - protein, 5 aa, Entamoeba invadens
MAGSE

SEQ ID NO: 2883929 - protein, 28 aa, Entamoeba invadens
MAKESGVKSDETIEKEKMEELDTNNRIE

SEQ ID NO: 2883930 - protein, 11 aa, Entamoeba invadens
MAKKEKNEEEM

SEQ ID NO: 2883931 - protein, 10 aa, Entamoeba invadens
MAKKSTKTIQ

SEQ ID NO: 2883932 - protein, 8 aa, Entamoeba invadens
MAKNGENA

SEQ ID NO: 2883933 - protein, 34 aa, Entamoeba invadens
MALDDKADDEKTAADQSDRRKKMEDQVKAHNAQV

SEQ ID NO: 2883934 - protein, 26 aa, Entamoeba invadens
MALDDKAEAEKTAADQSDRRKKTKLK

SEQ ID NO: 2883935 - protein, 28 aa, Entamoeba invadens
MALDDKAEAEKTAADQSDRRWKTKRENM

SEQ ID NO: 2883936 - protein, 46 aa, Entamoeba invadens
MALDDKAEAEKTAADQSDRRWKTKSNTQCTTNNTEEKLTKKAKDLT

SEQ ID NO: 2883937 - protein, 15 aa, Entamoeba invadens
MANGSDGMQKLNEEL

SEQ ID NO: 2883938 - protein, 7 aa, Entamoeba invadens
MANQQSN

SEQ ID NO: 2883939 - protein, 20 aa, Entamoeba invadens
MANSPTLPFPEKVEKEKKEV

SEQ ID NO: 2883940 - protein, 23 aa, Entamoeba invadens
MANSQNTQNHDTQQQGDPKDKEE

SEQ ID NO: 2883941 - protein, 10 aa, Entamoeba invadens
MAPDAKQTIK

SEQ ID NO: 2883942 - protein, 9 aa, Entamoeba invadens
MAPGIPSSY

SEQ ID NO: 2883943 - protein, 11 aa, Entamoeba invadens
MAPNDSESVVT

SEQ ID NO: 2883944 - protein, 6 aa, Entamoeba invadens
MAQDSL

SEQ ID NO: 2883945 - protein, 5 aa, Entamoeba invadens
MAQRG

SEQ ID NO: 2883946 - protein, 11 aa, Entamoeba invadens
MARGDTPPLQS

SEQ ID NO: 2883947 - protein, 10 aa, Entamoeba invadens
MARKSGKAMQ

SEQ ID NO: 2883948 - protein, 4 aa, Entamoeba invadens
MASQ

SEQ ID NO: 2883949 - protein, 9 aa, Entamoeba invadens
MASSEDDTV

SEQ ID NO: 2883950 - protein, 11 aa, Entamoeba invadens
MASSPEKLLTT

SEQ ID NO: 2883951 - protein, 7 aa, Entamoeba invadens
MASSPIK

SEQ ID NO: 2883952 - protein, 9 aa, Entamoeba invadens
MASTQNEEL

SEQ ID NO: 2883953 - protein, 8 aa, Entamoeba invadens
MATAGKDG

SEQ ID NO: 2883954 - protein, 9 aa, Entamoeba invadens
MATAGKDGV

SEQ ID NO: 2883955 - protein, 4 aa, Entamoeba invadens
MATD

SEQ ID NO: 2883956 - protein, 4 aa, Entamoeba invadens
MATE

SEQ ID NO: 2883957 - protein, 7 aa, Entamoeba invadens
MATKGDA

SEQ ID NO: 2883958 - protein, 6 aa, Entamoeba invadens
MATLDE

SEQ ID NO: 2883959 - protein, 11 aa, Entamoeba invadens
MATLPEPAVPL

SEQ ID NO: 2883960 - protein, 10 aa, Entamoeba invadens
MATNGSGDLL

SEQ ID NO: 2883961 - protein, 6 aa, Entamoeba invadens
MATPDI

SEQ ID NO: 2883962 - protein, 9 aa, Entamoeba invadens
MAYSNEKSV

SEQ ID NO: 2883963 - protein, 5 aa, Entamoeba invadens
MCGDE

SEQ ID NO: 2883964 - protein, 10 aa, Entamoeba invadens
MCQDEKNSKI

SEQ ID NO: 2883965 - protein, 12 aa, Entamoeba invadens
MCRKSDDKADQF

SEQ ID NO: 2883966 - protein, 12 aa, Entamoeba invadens
MDADSQDDAFET

SEQ ID NO: 2883967 - protein, 20 aa, Entamoeba invadens
MDADVKQKTPINKAPSSDPI

SEQ ID NO: 2883968 - protein, 12 aa, Entamoeba invadens
MDASDNDQILVF

SEQ ID NO: 2883969 - protein, 4 aa, Entamoeba invadens
MDAT

SEQ ID NO: 2883970 - protein, 19 aa, Entamoeba invadens
MDATQTDTHDSSRSQSNIS

SEQ ID NO: 2883971 - protein, 9 aa, Entamoeba invadens
MDDKTKYSL

SEQ ID NO: 2883972 - protein, 8 aa, Entamoeba invadens
MDDNETKI

SEQ ID NO: 2883973 - protein, 12 aa, Entamoeba invadens
MDDTKAIDKRSL

SEQ ID NO: 2883974 - protein, 10 aa, Entamoeba invadens
MDEADNKELY

SEQ ID NO: 2883975 - protein, 6 aa, Entamoeba invadens
MDEDEA

SEQ ID NO: 2883976 - protein, 11 aa, Entamoeba invadens
MDEDPSKHTVN

SEQ ID NO: 2883977 - protein, 5 aa, Entamoeba invadens
MDEEE

SEQ ID NO: 2883978 - protein, 4 aa, Entamoeba invadens
MDEF

SEQ ID NO: 2883979 - protein, 8 aa, Entamoeba invadens
MDEGKDDV

SEQ ID NO: 2883980 - protein, 5 aa, Entamoeba invadens
MDEGR

SEQ ID NO: 2883981 - protein, 4 aa, Entamoeba invadens
MDEK

SEQ ID NO: 2883982 - protein, 20 aa, Entamoeba invadens
MDEKHQNELPKEIAQNYDDD

SEQ ID NO: 2883983 - protein, 25 aa, Entamoeba invadens
MDEKSVRKGGLSKELERAEKSGVTR

SEQ ID NO: 2883984 - protein, 12 aa, Entamoeba invadens
MDENLGNSAEEV

SEQ ID NO: 2883985 - protein, 6 aa, Entamoeba invadens
MDENQL

SEQ ID NO: 2883986 - protein, 32 aa, Entamoeba invadens
MDEPGISTKRSRGRYASYQRRKKDIKEAREGA

SEQ ID NO: 2883987 - protein, 6 aa, Entamoeba invadens
MDESCE

SEQ ID NO: 2883988 - protein, 8 aa, Entamoeba invadens
MDESCTQS

SEQ ID NO: 2883989 - protein, 9 aa, Entamoeba invadens
MDETQPKSS

SEQ ID NO: 2883990 - protein, 8 aa, Entamoeba invadens
MDEVNDQK

SEQ ID NO: 2883991 - protein, 6 aa, Entamoeba invadens
MDEYGD

SEQ ID NO: 2883992 - protein, 12 aa, Entamoeba invadens
MDGAESPRKNAI

SEQ ID NO: 2883993 - protein, 6 aa, Entamoeba invadens
MDGAQK

SEQ ID NO: 2883994 - protein, 6 aa, Entamoeba invadens
MDGEIA

SEQ ID NO: 2883995 - protein, 9 aa, Entamoeba invadens
MDGEQTDKV

SEQ ID NO: 2883996 - protein, 6 aa, Entamoeba invadens
MDGERK

SEQ ID NO: 2883997 - protein, 8 aa, Entamoeba invadens
MDGGASRP

SEQ ID NO: 2883998 - protein, 15 aa, Entamoeba invadens
MDGSPQLNTQNEYDP

SEQ ID NO: 2883999 - protein, 7 aa, Entamoeba invadens
MDGTKKY

SEQ ID NO: 2884000 - protein, 6 aa, Entamoeba invadens
MDGTNV

SEQ ID NO: 2884001 - protein, 7 aa, Entamoeba invadens
MDISSNS

SEQ ID NO: 2884002 - protein, 8 aa, Entamoeba invadens
MDITSEKD

SEQ ID NO: 2884003 - protein, 4 aa, Entamoeba invadens
MDKM

SEQ ID NO: 2884004 - protein, 13 aa, Entamoeba invadens
MDKQDCSEAEFAN

SEQ ID NO: 2884005 - protein, 8 aa, Entamoeba invadens
MDKSAHKG

SEQ ID NO: 2884006 - protein, 6 aa, Entamoeba invadens
MDKYES

SEQ ID NO: 2884007 - protein, 17 aa, Entamoeba invadens
MDNEEDENEEDEDEEEE

SEQ ID NO: 2884008 - protein, 34 aa, Entamoeba invadens
MDNEEDENEEDEDEEEGNEYDDEEENQHNLIEYV

SEQ ID NO: 2884009 - protein, 8 aa, Entamoeba invadens
MDNNKEAI

SEQ ID NO: 2884010 - protein, 6 aa, Entamoeba invadens
MDNPTP

SEQ ID NO: 2884011 - protein, 6 aa, Entamoeba invadens
MDNSGA

SEQ ID NO: 2884012 - protein, 8 aa, Entamoeba invadens
MDNTDNIT

SEQ ID NO: 2884013 - protein, 6 aa, Entamoeba invadens
MDPASF

SEQ ID NO: 2884014 - protein, 14 aa, Entamoeba invadens
MDPDYVPPKDDPRR

SEQ ID NO: 2884015 - protein, 15 aa, Entamoeba invadens
MDPNNKSDSLSSKEF

SEQ ID NO: 2884016 - protein, 10 aa, Entamoeba invadens
MDPPPKGWET

SEQ ID NO: 2884017 - protein, 46 aa, Entamoeba invadens
MDPSDENVEEFEQSSQDEKSEGTEVKLEKSEKEEKIEKIENKEIKT

SEQ ID NO: 2884018 - protein, 4 aa, Entamoeba invadens
MDPT

SEQ ID NO: 2884019 - protein, 18 aa, Entamoeba invadens
MDPTAEANKQKNRKDIRK

SEQ ID NO: 2884020 - protein, 7 aa, Entamoeba invadens
MDQETKE

SEQ ID NO: 2884021 - protein, 21 aa, Entamoeba invadens
MDQKRTTKQKKEEKKEKRKSS

SEQ ID NO: 2884022 - protein, 10 aa, Entamoeba invadens
MDQKTNAPVY

SEQ ID NO: 2884023 - protein, 4 aa, Entamoeba invadens
MDQM

SEQ ID NO: 2884024 - protein, 6 aa, Entamoeba invadens
MDQNEH

SEQ ID NO: 2884025 - protein, 16 aa, Entamoeba invadens
MDQSNAKPTNYYFALE

SEQ ID NO: 2884026 - protein, 8 aa, Entamoeba invadens
MDQSTAND

SEQ ID NO: 2884027 - protein, 10 aa, Entamoeba invadens
MDQSTQPQGV

SEQ ID NO: 2884028 - protein, 8 aa, Entamoeba invadens
MDQTKTQY

SEQ ID NO: 2884029 - protein, 38 aa, Entamoeba invadens
MDRPQEKRYRDDYRDQYRDNYQRRDRQYPQANKEEMDA

SEQ ID NO: 2884030 - protein, 7 aa, Entamoeba invadens
MDRSDPN

SEQ ID NO: 2884031 - protein, 11 aa, Entamoeba invadens
MDSDGDGKVDL

SEQ ID NO: 2884032 - protein, 5 aa, Entamoeba invadens
MDSDN

SEQ ID NO: 2884033 - protein, 6 aa, Entamoeba invadens
MDSGAT

SEQ ID NO: 2884034 - protein, 6 aa, Entamoeba invadens
MDSKRN

SEQ ID NO: 2884035 - protein, 42 aa, Entamoeba invadens
MDSPSQPKVTLNTPTKETHHADKAEKKFSQSLNTSKGDDDWG

SEQ ID NO: 2884036 - protein, 15 aa, Entamoeba invadens
MDSSEDNEVELPISN

SEQ ID NO: 2884037 - protein, 61 aa, Entamoeba invadens
MDSSSTGSATSHSTNHFQNETKPNEVGEPPKIDLRSQEKATEEVKHGNEEKNDNPIDGEES

SEQ ID NO: 2884038 - protein, 18 aa, Entamoeba invadens
MDSTKSEGNGGKETLPSL

SEQ ID NO: 2884039 - protein, 5 aa, Entamoeba invadens
MDSTL

SEQ ID NO: 2884040 - protein, 14 aa, Entamoeba invadens
MDSTQKVNDLSDRM

SEQ ID NO: 2884041 - protein, 9 aa, Entamoeba invadens
MDTPQYATQ

SEQ ID NO: 2884042 - protein, 5 aa, Entamoeba invadens
MDTRR

SEQ ID NO: 2884043 - protein, 7 aa, Entamoeba invadens
MDTSRKM

SEQ ID NO: 2884044 - protein, 6 aa, Entamoeba invadens
MDVNKT

SEQ ID NO: 2884045 - protein, 5 aa, Entamoeba invadens
MEANK

SEQ ID NO: 2884046 - protein, 11 aa, Entamoeba invadens
MEDDNKEEAEI

SEQ ID NO: 2884047 - protein, 8 aa, Entamoeba invadens
MEDGGRPL

SEQ ID NO: 2884048 - protein, 20 aa, Entamoeba invadens
MEDGKEGPEYPTESEWGGAT

SEQ ID NO: 2884049 - protein, 9 aa, Entamoeba invadens
MEDKQQEDA

SEQ ID NO: 2884050 - protein, 21 aa, Entamoeba invadens
MEDQSHDVEAIENDAGISRAV

SEQ ID NO: 2884051 - protein, 9 aa, Entamoeba invadens
MEDSEDANA

SEQ ID NO: 2884052 - protein, 12 aa, Entamoeba invadens
MEDTDLNGTNHP

SEQ ID NO: 2884053 - protein, 7 aa, Entamoeba invadens
MEDVGNK

SEQ ID NO: 2884054 - protein, 36 aa, Entamoeba invadens
MEEDDEEEEEESENSSSESSNDKSEKEEEKEEEEEI

SEQ ID NO: 2884055 - protein, 5 aa, Entamoeba invadens
MEEDT

SEQ ID NO: 2884056 - protein, 10 aa, Entamoeba invadens
MEEEEEEINN

SEQ ID NO: 2884057 - protein, 7 aa, Entamoeba invadens
MEEEEKE

SEQ ID NO: 2884058 - protein, 10 aa, Entamoeba invadens
MEEEEKERHK

SEQ ID NO: 2884059 - protein, 8 aa, Entamoeba invadens
MEEEERQK

SEQ ID NO: 2884060 - protein, 40 aa, Entamoeba invadens
MEEEIENDEMKVEENEEEPQERVEENPKINEEKKPRKIRS

SEQ ID NO: 2884061 - protein, 95 aa, Entamoeba invadens
MEEEKPKKPEVTPMEEESKSYSKSTKEKNQRRSSERRSSRSRSHSRTRSRSDGRSRERRRESYETYRNRGTHDRYERRESERERRSRSRERRRKR

SEQ ID NO: 2884062 - protein, 32 aa, Entamoeba invadens
MEEEKSGSSPSQSEAENIPIANSEDNSKVPEV

SEQ ID NO: 2884063 - protein, 15 aa, Entamoeba invadens
MEEELSVPRPSEIPQ

SEQ ID NO: 2884064 - protein, 20 aa, Entamoeba invadens
MEEEPKIDDDEISDILAKLD

SEQ ID NO: 2884065 - protein, 15 aa, Entamoeba invadens
MEEEPLRPPPMPESE

SEQ ID NO: 2884066 - protein, 7 aa, Entamoeba invadens
MEEEPTE

SEQ ID NO: 2884067 - protein, 30 aa, Entamoeba invadens
MEEEQPKEDLIQGGTQKEEEKCGTQDTPVT

SEQ ID NO: 2884068 - protein, 5 aa, Entamoeba invadens
MEEER

SEQ ID NO: 2884069 - protein, 40 aa, Entamoeba invadens
MEEERPDETDVPNEIQNNGEEKKENNIPQQIQQNTTVPQV

SEQ ID NO: 2884070 - protein, 12 aa, Entamoeba invadens
MEEESAKQVMEA

SEQ ID NO: 2884071 - protein, 32 aa, Entamoeba invadens
MEEESRQTNTEGSKDKVETSNEGITHETNPSF

SEQ ID NO: 2884072 - protein, 20 aa, Entamoeba invadens
MEEESSPQQVPSQQPQSGMV

SEQ ID NO: 2884073 - protein, 13 aa, Entamoeba invadens
MEEETQATQRDNF

SEQ ID NO: 2884074 - protein, 4 aa, Entamoeba invadens
MEEI

SEQ ID NO: 2884075 - protein, 9 aa, Entamoeba invadens
MEEKTRGKE

SEQ ID NO: 2884076 - protein, 4 aa, Entamoeba invadens
MEEL

SEQ ID NO: 2884077 - protein, 11 aa, Entamoeba invadens
MEELNGSDGLR

SEQ ID NO: 2884078 - protein, 10 aa, Entamoeba invadens
MEENEFTDAR

SEQ ID NO: 2884079 - protein, 7 aa, Entamoeba invadens
MEENENA

SEQ ID NO: 2884080 - protein, 10 aa, Entamoeba invadens
MEEQGSSIQI

SEQ ID NO: 2884081 - protein, 32 aa, Entamoeba invadens
MEEQLTKTNDEKMKVEGELNTQKEKTAQQEKL

SEQ ID NO: 2884082 - protein, 8 aa, Entamoeba invadens
MEEQTRTE

SEQ ID NO: 2884083 - protein, 9 aa, Entamoeba invadens
MEEQTRTEI

SEQ ID NO: 2884084 - protein, 22 aa, Entamoeba invadens
MEESELSSSSATPNFKCSSSPR

SEQ ID NO: 2884085 - protein, 9 aa, Entamoeba invadens
MEETEGLDT

SEQ ID NO: 2884086 - protein, 9 aa, Entamoeba invadens
MEETQSIVE

SEQ ID NO: 2884087 - protein, 10 aa, Entamoeba invadens
MEGADGEALS

SEQ ID NO: 2884088 - protein, 4 aa, Entamoeba invadens
MEGF

SEQ ID NO: 2884089 - protein, 4 aa, Entamoeba invadens
MEGK

SEQ ID NO: 2884090 - protein, 8 aa, Entamoeba invadens
MEGSERTN

SEQ ID NO: 2884091 - protein, 12 aa, Entamoeba invadens
MEGTESSKKVAQ

SEQ ID NO: 2884092 - protein, 5 aa, Entamoeba invadens
MEHRK

SEQ ID NO: 2884093 - protein, 13 aa, Entamoeba invadens
MEIEKSPASQNDQ

SEQ ID NO: 2884094 - protein, 11 aa, Entamoeba invadens
MEIQDDESHSD

SEQ ID NO: 2884095 - protein, 19 aa, Entamoeba invadens
MEITPEKREEIVNQPPSTA

SEQ ID NO: 2884096 - protein, 8 aa, Entamoeba invadens
MEKDDGKS

SEQ ID NO: 2884097 - protein, 5 aa, Entamoeba invadens
MEKDE

SEQ ID NO: 2884098 - protein, 7 aa, Entamoeba invadens
MEKDGNP

SEQ ID NO: 2884099 - protein, 11 aa, Entamoeba invadens
MEKEIDTKMQE

SEQ ID NO: 2884100 - protein, 10 aa, Entamoeba invadens
MEKEKEPDIK

SEQ ID NO: 2884101 - protein, 19 aa, Entamoeba invadens
MEKEKEPDNKVTFKDGFYV

SEQ ID NO: 2884102 - protein, 6 aa, Entamoeba invadens
MEKEKK

SEQ ID NO: 2884103 - protein, 8 aa, Entamoeba invadens
MEKEMEEK

SEQ ID NO: 2884104 - protein, 8 aa, Entamoeba invadens
MEKGDGKS

SEQ ID NO: 2884105 - protein, 7 aa, Entamoeba invadens
MEKGEQM

SEQ ID NO: 2884106 - protein, 12 aa, Entamoeba invadens
MEKGGETQNERG

SEQ ID NO: 2884107 - protein, 5 aa, Entamoeba invadens
MEKGK

SEQ ID NO: 2884108 - protein, 4 aa, Entamoeba invadens
MEKI

SEQ ID NO: 2884109 - protein, 19 aa, Entamoeba invadens
MEKKDKETALENERKLKEA

SEQ ID NO: 2884110 - protein, 11 aa, Entamoeba invadens
MEKKSKDSFSQ

SEQ ID NO: 2884111 - protein, 16 aa, Entamoeba invadens
MEKNNESARKSISLED

SEQ ID NO: 2884112 - protein, 21 aa, Entamoeba invadens
MEKPLREAKSLKDHLKSKEHL

SEQ ID NO: 2884113 - protein, 19 aa, Entamoeba invadens
MEKPSSSQSTEEDQDPLGT

SEQ ID NO: 2884114 - protein, 4 aa, Entamoeba invadens
MEKR

SEQ ID NO: 2884115 - protein, 12 aa, Entamoeba invadens
MEKSGVDRYSPP

SEQ ID NO: 2884116 - protein, 7 aa, Entamoeba invadens
MEKTPEN

SEQ ID NO: 2884117 - protein, 13 aa, Entamoeba invadens
MEKTTKKSKCKNY

SEQ ID NO: 2884118 - protein, 16 aa, Entamoeba invadens
MEKYNDKASHINSSED

SEQ ID NO: 2884119 - protein, 4 aa, Entamoeba invadens
MELP

SEQ ID NO: 2884120 - protein, 16 aa, Entamoeba invadens
MENAVKQNKDINKDYP

SEQ ID NO: 2884121 - protein, 10 aa, Entamoeba invadens
MENDGENRFG

SEQ ID NO: 2884122 - protein, 10 aa, Entamoeba invadens
MENETSKMSQ

SEQ ID NO: 2884123 - protein, 7 aa, Entamoeba invadens
MENGSDV

SEQ ID NO: 2884124 - protein, 5 aa, Entamoeba invadens
MENKP

SEQ ID NO: 2884125 - protein, 4 aa, Entamoeba invadens
MENN

SEQ ID NO: 2884126 - protein, 10 aa, Entamoeba invadens
MENSEEPQKV

SEQ ID NO: 2884127 - protein, 6 aa, Entamoeba invadens
MENSPL

SEQ ID NO: 2884128 - protein, 13 aa, Entamoeba invadens
MENTELKSRYSEL

SEQ ID NO: 2884129 - protein, 8 aa, Entamoeba invadens
MENTPKMT

SEQ ID NO: 2884130 - protein, 4 aa, Entamoeba invadens
MEPD

SEQ ID NO: 2884131 - protein, 22 aa, Entamoeba invadens
MEPEKKDEKKEEKKDEKEEKKD

SEQ ID NO: 2884132 - protein, 7 aa, Entamoeba invadens
MEPGDVS

SEQ ID NO: 2884133 - protein, 12 aa, Entamoeba invadens
MEPLSPKSEEYL

SEQ ID NO: 2884134 - protein, 4 aa, Entamoeba invadens
MEPN

SEQ ID NO: 2884135 - protein, 5 aa, Entamoeba invadens
MEPPR

SEQ ID NO: 2884136 - protein, 4 aa, Entamoeba invadens
MEQA

SEQ ID NO: 2884137 - protein, 8 aa, Entamoeba invadens
MEQADNKH

SEQ ID NO: 2884138 - protein, 9 aa, Entamoeba invadens
MEQENGTYI

SEQ ID NO: 2884139 - protein, 7 aa, Entamoeba invadens
MEQENPQ

SEQ ID NO: 2884140 - protein, 4 aa, Entamoeba invadens
MEQP

SEQ ID NO: 2884141 - protein, 23 aa, Entamoeba invadens
MEQQSDEETEEAQYQQPEQYAAN

SEQ ID NO: 2884142 - protein, 12 aa, Entamoeba invadens
MEQRGEFDPSGV

SEQ ID NO: 2884143 - protein, 7 aa, Entamoeba invadens
MERADHS

SEQ ID NO: 2884144 - protein, 7 aa, Entamoeba invadens
MERDETK

SEQ ID NO: 2884145 - protein, 34 aa, Entamoeba invadens
MEREKKEAKTREGPTKKSLTMKRKTAQADGEEIS

SEQ ID NO: 2884146 - protein, 15 aa, Entamoeba invadens
MERERKNGINDKEAL

SEQ ID NO: 2884147 - protein, 10 aa, Entamoeba invadens
MERRQEIPHE

SEQ ID NO: 2884148 - protein, 20 aa, Entamoeba invadens
MERTNGTTATVNNKDDPFDI

SEQ ID NO: 2884149 - protein, 10 aa, Entamoeba invadens
MERYDSDDIE

SEQ ID NO: 2884150 - protein, 4 aa, Entamoeba invadens
MESA

SEQ ID NO: 2884151 - protein, 8 aa, Entamoeba invadens
MESEANSI

SEQ ID NO: 2884152 - protein, 7 aa, Entamoeba invadens
MESEEKL

SEQ ID NO: 2884153 - protein, 41 aa, Entamoeba invadens
MESEESSESNDEEEEKMESPSEENSEDTSTHSDQENEENED

SEQ ID NO: 2884154 - protein, 20 aa, Entamoeba invadens
MESESSILSPRLNQKDVSHI

SEQ ID NO: 2884155 - protein, 8 aa, Entamoeba invadens
MESEVTRP

SEQ ID NO: 2884156 - protein, 30 aa, Entamoeba invadens
MESGSDSDEKETKEKSKTDVKKKKEKKLPN

SEQ ID NO: 2884157 - protein, 8 aa, Entamoeba invadens
MESKATKN

SEQ ID NO: 2884158 - protein, 13 aa, Entamoeba invadens
MESKITEDESTDL

SEQ ID NO: 2884159 - protein, 30 aa, Entamoeba invadens
MESPEEKKTYKQSTKPRKMKKTNKPTRPTR

SEQ ID NO: 2884160 - protein, 5 aa, Entamoeba invadens
MESQE

SEQ ID NO: 2884161 - protein, 5 aa, Entamoeba invadens
MESSG

SEQ ID NO: 2884162 - protein, 11 aa, Entamoeba invadens
MESSSQSQIDK

SEQ ID NO: 2884163 - protein, 32 aa, Entamoeba invadens
MESTTGDADQKRIDLNSKTKESDSKNDGPQVD

SEQ ID NO: 2884164 - protein, 11 aa, Entamoeba invadens
MESVPSPYTIA

SEQ ID NO: 2884165 - protein, 10 aa, Entamoeba invadens
MESYKNADEL

SEQ ID NO: 2884166 - protein, 20 aa, Entamoeba invadens
METANKVKTEFKNNEETKNY

SEQ ID NO: 2884167 - protein, 20 aa, Entamoeba invadens
METDMDKNGNTISDLLIVQL

SEQ ID NO: 2884168 - protein, 8 aa, Entamoeba invadens
METENGSK

SEQ ID NO: 2884169 - protein, 13 aa, Entamoeba invadens
METFTKRNDELQK

SEQ ID NO: 2884170 - protein, 12 aa, Entamoeba invadens
METHKDGDLKEN

SEQ ID NO: 2884171 - protein, 6 aa, Entamoeba invadens
METNDE

SEQ ID NO: 2884172 - protein, 5 aa, Entamoeba invadens
METNL

SEQ ID NO: 2884173 - protein, 5 aa, Entamoeba invadens
METQK

SEQ ID NO: 2884174 - protein, 17 aa, Entamoeba invadens
METREVQQKEALAKGEE

SEQ ID NO: 2884175 - protein, 25 aa, Entamoeba invadens
METSEEMKKRGTTVRVNGKKEPNIV

SEQ ID NO: 2884176 - protein, 12 aa, Entamoeba invadens
METSGVDRYSPP

SEQ ID NO: 2884177 - protein, 5 aa, Entamoeba invadens
METTL

SEQ ID NO: 2884178 - protein, 17 aa, Entamoeba invadens
METVAPNKVEKTGKLEK

SEQ ID NO: 2884179 - protein, 71 aa, Entamoeba invadens
MEVEPPKEETKLEEHKPAMEEEKPKPVIEGENITAKKEEEKPQEDKETTTNKEEKKEEKVEKTEQKLEEVK

SEQ ID NO: 2884180 - protein, 4 aa, Entamoeba invadens
MEVK

SEQ ID NO: 2884181 - protein, 5 aa, Entamoeba invadens
MEYET

SEQ ID NO: 2884182 - protein, 7 aa, Entamoeba invadens
MFGTPKN

SEQ ID NO: 2884183 - protein, 9 aa, Entamoeba invadens
MGAPDDTIP

SEQ ID NO: 2884184 - protein, 6 aa, Entamoeba invadens
MGATPR

SEQ ID NO: 2884185 - protein, 9 aa, Entamoeba invadens
MGDKKEMSY

SEQ ID NO: 2884186 - protein, 10 aa, Entamoeba invadens
MGDQPPYNTE

SEQ ID NO: 2884187 - protein, 4 aa, Entamoeba invadens
MGDS

SEQ ID NO: 2884188 - protein, 69 aa, Entamoeba invadens
MGDSDDMKTPRLSPRPAKTDKKKKKGTGSPDVEEGSSSEKIAEEEKKEEAAKVEKPAVNVKNLRAMFEQ

SEQ ID NO: 2884189 - protein, 15 aa, Entamoeba invadens
MGERDECKKSLEELK

SEQ ID NO: 2884190 - protein, 7 aa, Entamoeba invadens
MGERINA

SEQ ID NO: 2884191 - protein, 10 aa, Entamoeba invadens
MGERISPDTI

SEQ ID NO: 2884192 - protein, 4 aa, Entamoeba invadens
MGGD

SEQ ID NO: 2884193 - protein, 5 aa, Entamoeba invadens
MGGHN

SEQ ID NO: 2884194 - protein, 36 aa, Entamoeba invadens
MGGNKTPQNIAEDIGTDALAKGSNDNVSVVVTLLKW

SEQ ID NO: 2884195 - protein, 21 aa, Entamoeba invadens
MGGQDKVKTATAGLKRSASFS

SEQ ID NO: 2884196 - protein, 10 aa, Entamoeba invadens
MGGQNDKALN

SEQ ID NO: 2884197 - protein, 28 aa, Entamoeba invadens
MGGQQKSLDDNFENGEGNKFQKKESPTL

SEQ ID NO: 2884198 - protein, 4 aa, Entamoeba invadens
MGGT

SEQ ID NO: 2884199 - protein, 7 aa, Entamoeba invadens
MGGVDTV

SEQ ID NO: 2884200 - protein, 4 aa, Entamoeba invadens
MGIN

SEQ ID NO: 2884201 - protein, 10 aa, Entamoeba invadens
MGKEINRTQL

SEQ ID NO: 2884202 - protein, 6 aa, Entamoeba invadens
MGKGKI

SEQ ID NO: 2884203 - protein, 5 aa, Entamoeba invadens
MGKGL

SEQ ID NO: 2884204 - protein, 10 aa, Entamoeba invadens
MGKQTNGTNV

SEQ ID NO: 2884205 - protein, 5 aa, Entamoeba invadens
MGKSI

SEQ ID NO: 2884206 - protein, 11 aa, Entamoeba invadens
MGKSQKEIEEI

SEQ ID NO: 2884207 - protein, 4 aa, Entamoeba invadens
MGLG

SEQ ID NO: 2884208 - protein, 8 aa, Entamoeba invadens
MGLSKKEE

SEQ ID NO: 2884209 - protein, 8 aa, Entamoeba invadens
MGNDSATG

SEQ ID NO: 2884210 - protein, 14 aa, Entamoeba invadens
MGNDSKMSDEERMS

SEQ ID NO: 2884211 - protein, 6 aa, Entamoeba invadens
MGPDVA

SEQ ID NO: 2884212 - protein, 14 aa, Entamoeba invadens
MGPINKEKKKFKRK

SEQ ID NO: 2884213 - protein, 4 aa, Entamoeba invadens
MGPP

SEQ ID NO: 2884214 - protein, 10 aa, Entamoeba invadens
MGQDMSSSPI

SEQ ID NO: 2884215 - protein, 4 aa, Entamoeba invadens
MGQM

SEQ ID NO: 2884216 - protein, 8 aa, Entamoeba invadens
MGQNPPQI

SEQ ID NO: 2884217 - protein, 7 aa, Entamoeba invadens
MGQQQAT

SEQ ID NO: 2884218 - protein, 5 aa, Entamoeba invadens
MGRGA

SEQ ID NO: 2884219 - protein, 4 aa, Entamoeba invadens
MGRK

SEQ ID NO: 2884220 - protein, 9 aa, Entamoeba invadens
MGRNEESQI

SEQ ID NO: 2884221 - protein, 33 aa, Entamoeba invadens
MGRRKSSSAVVSKESVVSSPQVPKQEKGENVEG

SEQ ID NO: 2884222 - protein, 4 aa, Entamoeba invadens
MGSE

SEQ ID NO: 2884223 - protein, 6 aa, Entamoeba invadens
MGSEAD

SEQ ID NO: 2884224 - protein, 7 aa, Entamoeba invadens
MGSGSQV

SEQ ID NO: 2884225 - protein, 6 aa, Entamoeba invadens
MGSKTQ

SEQ ID NO: 2884226 - protein, 14 aa, Entamoeba invadens
MGSNDTAKLTPEEN

SEQ ID NO: 2884227 - protein, 30 aa, Entamoeba invadens
MGSNPNSTASNSAIEGSMGKSDATGSEQLA

SEQ ID NO: 2884228 - protein, 31 aa, Entamoeba invadens
MGSPNTTYNTTTIQQQPTQLKNNPIPQQTQF

SEQ ID NO: 2884229 - protein, 4 aa, Entamoeba invadens
MGSQ

SEQ ID NO: 2884230 - protein, 8 aa, Entamoeba invadens
MGSQTSSG

SEQ ID NO: 2884231 - protein, 19 aa, Entamoeba invadens
MGSRQQQNYNTGYNYNTRS

SEQ ID NO: 2884232 - protein, 11 aa, Entamoeba invadens
MGSSQQAKIND

SEQ ID NO: 2884233 - protein, 6 aa, Entamoeba invadens
MGTGKY

SEQ ID NO: 2884234 - protein, 7 aa, Entamoeba invadens
MGTGSSE

SEQ ID NO: 2884235 - protein, 12 aa, Entamoeba invadens
MGTNTTNPLNGA

SEQ ID NO: 2884236 - protein, 12 aa, Entamoeba invadens
MGTRSAKECQEH

SEQ ID NO: 2884237 - protein, 63 aa, Entamoeba invadens
MGTTTPPDDHESFQSDRPQSISSNLSEGSDTDEKELLDDEERKDLAGAKDSKAPKDKKKKNFL

SEQ ID NO: 2884238 - protein, 5 aa, Entamoeba invadens
MGVPE

SEQ ID NO: 2884239 - protein, 17 aa, Entamoeba invadens
MGVSSKTAGRRAEYNKL

SEQ ID NO: 2884240 - protein, 14 aa, Entamoeba invadens
MGWQSSKKTPNSIY

SEQ ID NO: 2884241 - protein, 12 aa, Entamoeba invadens
MGYPPPQQQGYY

SEQ ID NO: 2884242 - protein, 13 aa, Entamoeba invadens
MHADGGGDGPESV

SEQ ID NO: 2884243 - protein, 18 aa, Entamoeba invadens
MHESDDVQTEESKKKGKL

SEQ ID NO: 2884244 - protein, 12 aa, Entamoeba invadens
MHQPPPQQQVFM

SEQ ID NO: 2884245 - protein, 4 aa, Entamoeba invadens
MHSD

SEQ ID NO: 2884246 - protein, 6 aa, Entamoeba invadens
MHSDDG

SEQ ID NO: 2884247 - protein, 10 aa, Entamoeba invadens
MIGDKGYKKI

SEQ ID NO: 2884248 - protein, 10 aa, Entamoeba invadens
MIGGRTESTI

SEQ ID NO: 2884249 - protein, 21 aa, Entamoeba invadens
MIKDKEPNSMRTSSSAGIAAY

SEQ ID NO: 2884250 - protein, 11 aa, Entamoeba invadens
MIPPPKDYASD

SEQ ID NO: 2884251 - protein, 5 aa, Entamoeba invadens
MITGP

SEQ ID NO: 2884252 - protein, 10 aa, Entamoeba invadens
MITPEEGQSM

SEQ ID NO: 2884253 - protein, 14 aa, Entamoeba invadens
MITPPKQKQGVNKS

SEQ ID NO: 2884254 - protein, 6 aa, Entamoeba invadens
MKAEKK

SEQ ID NO: 2884255 - protein, 8 aa, Entamoeba invadens
MKAETDRA

SEQ ID NO: 2884256 - protein, 4 aa, Entamoeba invadens
MKAQ

SEQ ID NO: 2884257 - protein, 7 aa, Entamoeba invadens
MKARKEY

SEQ ID NO: 2884258 - protein, 19 aa, Entamoeba invadens
MKATENQSARLEQRAMNFY

SEQ ID NO: 2884259 - protein, 13 aa, Entamoeba invadens
MKDADEKLKKLLK

SEQ ID NO: 2884260 - protein, 10 aa, Entamoeba invadens
MKDDNDTEEM

SEQ ID NO: 2884261 - protein, 10 aa, Entamoeba invadens
MKDDTELSDI

SEQ ID NO: 2884262 - protein, 7 aa, Entamoeba invadens
MKDEAKH

SEQ ID NO: 2884263 - protein, 13 aa, Entamoeba invadens
MKDEEDKKKPLDI

SEQ ID NO: 2884264 - protein, 11 aa, Entamoeba invadens
MKDEKESRTGC

SEQ ID NO: 2884265 - protein, 16 aa, Entamoeba invadens
MKDGGYCKKDLSNENC

SEQ ID NO: 2884266 - protein, 7 aa, Entamoeba invadens
MKDKRGV

SEQ ID NO: 2884267 - protein, 6 aa, Entamoeba invadens
MKDNEE

SEQ ID NO: 2884268 - protein, 38 aa, Entamoeba invadens
MKDSEKSVSSLDNERITDKEKKSEQSIKAKSHEISPIK

SEQ ID NO: 2884269 - protein, 7 aa, Entamoeba invadens
MKDSGAL

SEQ ID NO: 2884270 - protein, 6 aa, Entamoeba invadens
MKDTSK

SEQ ID NO: 2884271 - protein, 4 aa, Entamoeba invadens
MKED

SEQ ID NO: 2884272 - protein, 17 aa, Entamoeba invadens
MKEDAKTALETVSGDVR

SEQ ID NO: 2884273 - protein, 30 aa, Entamoeba invadens
MKEDRSKDFSQRNDQLEKENEELKRENEKL

SEQ ID NO: 2884274 - protein, 5 aa, Entamoeba invadens
MKEDT

SEQ ID NO: 2884275 - protein, 29 aa, Entamoeba invadens
MKEDTKEDLKKIKEAEKVDEDDEDEEEDN

SEQ ID NO: 2884276 - protein, 29 aa, Entamoeba invadens
MKEDTKEDLKNIKEAEKVDEDDEEEEENN

SEQ ID NO: 2884277 - protein, 4 aa, Entamoeba invadens
MKEE

SEQ ID NO: 2884278 - protein, 21 aa, Entamoeba invadens
MKEEDEKLKEKIELEKKEKKD

SEQ ID NO: 2884279 - protein, 9 aa, Entamoeba invadens
MKEEIKPKN

SEQ ID NO: 2884280 - protein, 29 aa, Entamoeba invadens
MKEGEKQINDSLEEVPKTKKKQKKDCCLI

SEQ ID NO: 2884281 - protein, 9 aa, Entamoeba invadens
MKEGPTEKL

SEQ ID NO: 2884282 - protein, 6 aa, Entamoeba invadens
MKEGQK

SEQ ID NO: 2884283 - protein, 13 aa, Entamoeba invadens
MKEKDQQECPTNV

SEQ ID NO: 2884284 - protein, 10 aa, Entamoeba invadens
MKEKGKNHSI

SEQ ID NO: 2884285 - protein, 6 aa, Entamoeba invadens
MKEKKH

SEQ ID NO: 2884286 - protein, 26 aa, Entamoeba invadens
MKEKSTVDRNTIEEAKTDLKEKTNEV

SEQ ID NO: 2884287 - protein, 8 aa, Entamoeba invadens
MKENGDID

SEQ ID NO: 2884288 - protein, 10 aa, Entamoeba invadens
MKENIQQASE

SEQ ID NO: 2884289 - protein, 4 aa, Entamoeba invadens
MKEQ

SEQ ID NO: 2884290 - protein, 11 aa, Entamoeba invadens
MKESEEPDPKL

SEQ ID NO: 2884291 - protein, 8 aa, Entamoeba invadens
MKESEERV

SEQ ID NO: 2884292 - protein, 9 aa, Entamoeba invadens
MKESGKTIG

SEQ ID NO: 2884293 - protein, 14 aa, Entamoeba invadens
MKESKQTAKNMEEF

SEQ ID NO: 2884294 - protein, 13 aa, Entamoeba invadens
MKESTGENNDMTE

SEQ ID NO: 2884295 - protein, 7 aa, Entamoeba invadens
MKETAEA

SEQ ID NO: 2884296 - protein, 7 aa, Entamoeba invadens
MKETANM

SEQ ID NO: 2884297 - protein, 7 aa, Entamoeba invadens
MKETANV

SEQ ID NO: 2884298 - protein, 10 aa, Entamoeba invadens
MKGATSPPQI

SEQ ID NO: 2884299 - protein, 9 aa, Entamoeba invadens
MKGAVSSGS

SEQ ID NO: 2884300 - protein, 8 aa, Entamoeba invadens
MKGDESFG

SEQ ID NO: 2884301 - protein, 14 aa, Entamoeba invadens
MKGDESIYSTNGNI

SEQ ID NO: 2884302 - protein, 8 aa, Entamoeba invadens
MKGGDREM

SEQ ID NO: 2884303 - protein, 12 aa, Entamoeba invadens
MKGGEGDKLAQA

SEQ ID NO: 2884304 - protein, 6 aa, Entamoeba invadens
MKGGEL

SEQ ID NO: 2884305 - protein, 16 aa, Entamoeba invadens
MKGKDVKDEKSKEEAM

SEQ ID NO: 2884306 - protein, 10 aa, Entamoeba invadens
MKGKGQTPKM

SEQ ID NO: 2884307 - protein, 8 aa, Entamoeba invadens
MKGNNGVN

SEQ ID NO: 2884308 - protein, 8 aa, Entamoeba invadens
MKGNSGVN

SEQ ID NO: 2884309 - protein, 7 aa, Entamoeba invadens
MKGPKRM

SEQ ID NO: 2884310 - protein, 11 aa, Entamoeba invadens
MKGSDELQQKL

SEQ ID NO: 2884311 - protein, 6 aa, Entamoeba invadens
MKGSQA

SEQ ID NO: 2884312 - protein, 11 aa, Entamoeba invadens
MKGTDHPDFDK

SEQ ID NO: 2884313 - protein, 9 aa, Entamoeba invadens
MKGTDNNVD

SEQ ID NO: 2884314 - protein, 9 aa, Entamoeba invadens
MKGYNKPLQ

SEQ ID NO: 2884315 - protein, 8 aa, Entamoeba invadens
MKHRSKGR

SEQ ID NO: 2884316 - protein, 5 aa, Entamoeba invadens
MKITS

SEQ ID NO: 2884317 - protein, 4 aa, Entamoeba invadens
MKKD

SEQ ID NO: 2884318 - protein, 12 aa, Entamoeba invadens
MKKDAEKKLCQP

SEQ ID NO: 2884319 - protein, 15 aa, Entamoeba invadens
MKKDDNASISLQQLW

SEQ ID NO: 2884320 - protein, 13 aa, Entamoeba invadens
MKKDKETKREEAD

SEQ ID NO: 2884321 - protein, 7 aa, Entamoeba invadens
MKKEDKP

SEQ ID NO: 2884322 - protein, 15 aa, Entamoeba invadens
MKKGRKKRNWSEEED

SEQ ID NO: 2884323 - protein, 17 aa, Entamoeba invadens
MKKGSEDAQKFHRKRKE

SEQ ID NO: 2884324 - protein, 10 aa, Entamoeba invadens
MKKKKKEEIA

SEQ ID NO: 2884325 - protein, 21 aa, Entamoeba invadens
MKKKKVESKPKKKNNKKKRNN

SEQ ID NO: 2884326 - protein, 12 aa, Entamoeba invadens
MKKKNEDKGQLN

SEQ ID NO: 2884327 - protein, 8 aa, Entamoeba invadens
MKKPNELN

SEQ ID NO: 2884328 - protein, 6 aa, Entamoeba invadens
MKKQKD

SEQ ID NO: 2884329 - protein, 13 aa, Entamoeba invadens
MKKREDKGLGTPV

SEQ ID NO: 2884330 - protein, 7 aa, Entamoeba invadens
MKKSDDV

SEQ ID NO: 2884331 - protein, 6 aa, Entamoeba invadens
MKKSSS

SEQ ID NO: 2884332 - protein, 10 aa, Entamoeba invadens
MKKSTKQADT

SEQ ID NO: 2884333 - protein, 4 aa, Entamoeba invadens
MKKT

SEQ ID NO: 2884334 - protein, 10 aa, Entamoeba invadens
MKKYGSSTLP

SEQ ID NO: 2884335 - protein, 7 aa, Entamoeba invadens
MKMNPKD

SEQ ID NO: 2884336 - protein, 9 aa, Entamoeba invadens
MKNAQGQLV

SEQ ID NO: 2884337 - protein, 9 aa, Entamoeba invadens
MKNGGQPME

SEQ ID NO: 2884338 - protein, 11 aa, Entamoeba invadens
MKNGKTETESV

SEQ ID NO: 2884339 - protein, 13 aa, Entamoeba invadens
MKNKDIPEGGSKG

SEQ ID NO: 2884340 - protein, 6 aa, Entamoeba invadens
MKNPPI

SEQ ID NO: 2884341 - protein, 15 aa, Entamoeba invadens
MKNSNDDKDKCDEFE

SEQ ID NO: 2884342 - protein, 11 aa, Entamoeba invadens
MKNSREDNSIG

SEQ ID NO: 2884343 - protein, 9 aa, Entamoeba invadens
MKNSSEKKG

SEQ ID NO: 2884344 - protein, 10 aa, Entamoeba invadens
MKNSTKGKYK

SEQ ID NO: 2884345 - protein, 10 aa, Entamoeba invadens
MKNSTKGNYK

SEQ ID NO: 2884346 - protein, 10 aa, Entamoeba invadens
MKNSYGAIGP

SEQ ID NO: 2884347 - protein, 5 aa, Entamoeba invadens
MKPEA

SEQ ID NO: 2884348 - protein, 6 aa, Entamoeba invadens
MKPFTD

SEQ ID NO: 2884349 - protein, 9 aa, Entamoeba invadens
MKPNASTLR

SEQ ID NO: 2884350 - protein, 7 aa, Entamoeba invadens
MKPNDQR

SEQ ID NO: 2884351 - protein, 14 aa, Entamoeba invadens
MKPQASKKELESSI

SEQ ID NO: 2884352 - protein, 18 aa, Entamoeba invadens
MKPQASRNELESAREIED

SEQ ID NO: 2884353 - protein, 10 aa, Entamoeba invadens
MKPREKNEAN

SEQ ID NO: 2884354 - protein, 14 aa, Entamoeba invadens
MKPSKSSHFGEEKH

SEQ ID NO: 2884355 - protein, 39 aa, Entamoeba invadens
MKPSSMSKSTTSSENPTKRKALAKPVSKAGTMTGSSSLN

SEQ ID NO: 2884356 - protein, 17 aa, Entamoeba invadens
MKPTPLVPKNKKDDFAG

SEQ ID NO: 2884357 - protein, 17 aa, Entamoeba invadens
MKPTPLVPKNKKDDFVG

SEQ ID NO: 2884358 - protein, 7 aa, Entamoeba invadens
MKPTSQK

SEQ ID NO: 2884359 - protein, 7 aa, Entamoeba invadens
MKPYKYS

SEQ ID NO: 2884360 - protein, 8 aa, Entamoeba invadens
MKQGTECA

SEQ ID NO: 2884361 - protein, 8 aa, Entamoeba invadens
MKQKDSEL

SEQ ID NO: 2884362 - protein, 31 aa, Entamoeba invadens
MKQKENKEKEDEAARKKAEEDAKKSEEKPTI

SEQ ID NO: 2884363 - protein, 10 aa, Entamoeba invadens
MKQKTAAEKE

SEQ ID NO: 2884364 - protein, 9 aa, Entamoeba invadens
MKQPVEESL

SEQ ID NO: 2884365 - protein, 7 aa, Entamoeba invadens
MKQRSDK

SEQ ID NO: 2884366 - protein, 13 aa, Entamoeba invadens
MKQSDNKEETISE

SEQ ID NO: 2884367 - protein, 4 aa, Entamoeba invadens
MKQT

SEQ ID NO: 2884368 - protein, 21 aa, Entamoeba invadens
MKQTEDGKTDSGDKSDDEFEK

SEQ ID NO: 2884369 - protein, 11 aa, Entamoeba invadens
MKQTSNQAGLT

SEQ ID NO: 2884370 - protein, 7 aa, Entamoeba invadens
MKRAEKK

SEQ ID NO: 2884371 - protein, 13 aa, Entamoeba invadens
MKRGDAYEKQNDK

SEQ ID NO: 2884372 - protein, 28 aa, Entamoeba invadens
MKRKGTSSKSFGRTTKSDRRHIDCNYGV

SEQ ID NO: 2884373 - protein, 5 aa, Entamoeba invadens
MKRPT

SEQ ID NO: 2884374 - protein, 26 aa, Entamoeba invadens
MKRRANAMEEEDEKFSDDENNMDPNA

SEQ ID NO: 2884375 - protein, 16 aa, Entamoeba invadens
MKRRSKEQTDEKETVD

SEQ ID NO: 2884376 - protein, 9 aa, Entamoeba invadens
MKRSRNQQI

SEQ ID NO: 2884377 - protein, 9 aa, Entamoeba invadens
MKSADQSSD

SEQ ID NO: 2884378 - protein, 4 aa, Entamoeba invadens
MKSD

SEQ ID NO: 2884379 - protein, 6 aa, Entamoeba invadens
MKSDET

SEQ ID NO: 2884380 - protein, 6 aa, Entamoeba invadens
MKSDGR

SEQ ID NO: 2884381 - protein, 7 aa, Entamoeba invadens
MKSEGYD

SEQ ID NO: 2884382 - protein, 8 aa, Entamoeba invadens
MKSEKPQK

SEQ ID NO: 2884383 - protein, 7 aa, Entamoeba invadens
MKSEMSK

SEQ ID NO: 2884384 - protein, 8 aa, Entamoeba invadens
MKSITQSP

SEQ ID NO: 2884385 - protein, 10 aa, Entamoeba invadens
MKSNDFSNIQ

SEQ ID NO: 2884386 - protein, 7 aa, Entamoeba invadens
MKSNPEN

SEQ ID NO: 2884387 - protein, 14 aa, Entamoeba invadens
MKSPDAEKKQEDTK

SEQ ID NO: 2884388 - protein, 15 aa, Entamoeba invadens
MKSPEETKNENESVI

SEQ ID NO: 2884389 - protein, 10 aa, Entamoeba invadens
MKSQEDPKHI

SEQ ID NO: 2884390 - protein, 7 aa, Entamoeba invadens
MKSRDEE

SEQ ID NO: 2884391 - protein, 5 aa, Entamoeba invadens
MKSSE

SEQ ID NO: 2884392 - protein, 8 aa, Entamoeba invadens
MKSSPQNV

SEQ ID NO: 2884393 - protein, 12 aa, Entamoeba invadens
MKTASSGEKNPI

SEQ ID NO: 2884394 - protein, 6 aa, Entamoeba invadens
MKTDNK

SEQ ID NO: 2884395 - protein, 6 aa, Entamoeba invadens
MKTDPW

SEQ ID NO: 2884396 - protein, 76 aa, Entamoeba invadens
MKTEEIETASCENKPLSLEPSPLPTDKIEEKQNSESTVAKDEPTEEGKVEAQTDGINESASQEVQSSQNDQQQTTV

SEQ ID NO: 2884397 - protein, 6 aa, Entamoeba invadens
MKTEEN

SEQ ID NO: 2884398 - protein, 13 aa, Entamoeba invadens
MKTHNASFSPTIH

SEQ ID NO: 2884399 - protein, 4 aa, Entamoeba invadens
MKTN

SEQ ID NO: 2884400 - protein, 7 aa, Entamoeba invadens
MKTPPET

SEQ ID NO: 2884401 - protein, 7 aa, Entamoeba invadens
MKTRKEC

SEQ ID NO: 2884402 - protein, 51 aa, Entamoeba invadens
MKTSSENTSESSSEENVSTQMEVESGNSSENDSKHSEDESQSTSSNKMDES

SEQ ID NO: 2884403 - protein, 4 aa, Entamoeba invadens
MKTT

SEQ ID NO: 2884404 - protein, 7 aa, Entamoeba invadens
MKTTDKG

SEQ ID NO: 2884405 - protein, 12 aa, Entamoeba invadens
MKVENSKPNNTK

SEQ ID NO: 2884406 - protein, 7 aa, Entamoeba invadens
MKYSTKN

SEQ ID NO: 2884407 - protein, 7 aa, Entamoeba invadens
MLDPKPK

SEQ ID NO: 2884408 - protein, 17 aa, Entamoeba invadens
MLNGSDSATSSSQDNQS

SEQ ID NO: 2884409 - protein, 11 aa, Entamoeba invadens
MLPASQQSTQN

SEQ ID NO: 2884410 - protein, 15 aa, Entamoeba invadens
MLPPPGGLAPPGGMM

SEQ ID NO: 2884411 - protein, 17 aa, Entamoeba invadens
MLQTGSPSLSSKVENSI

SEQ ID NO: 2884412 - protein, 17 aa, Entamoeba invadens
MLSKDSTNKKKRAHPGA

SEQ ID NO: 2884413 - protein, 12 aa, Entamoeba invadens
MLTKRKEKRTRM

SEQ ID NO: 2884414 - protein, 8 aa, Entamoeba invadens
MMGSKEGM

SEQ ID NO: 2884415 - protein, 4 aa, Entamoeba invadens
MNAL

SEQ ID NO: 2884416 - protein, 18 aa, Entamoeba invadens
MNAPRPSVANLNKTQKVD

SEQ ID NO: 2884417 - protein, 37 aa, Entamoeba invadens
MNAQAKPDVKKAAALQEQKDDITAKTIKEGDSLRKEY

SEQ ID NO: 2884418 - protein, 6 aa, Entamoeba invadens
MNCEGT

SEQ ID NO: 2884419 - protein, 7 aa, Entamoeba invadens
MNCPSKK

SEQ ID NO: 2884420 - protein, 16 aa, Entamoeba invadens
MNDAERAEAATKDAAY

SEQ ID NO: 2884421 - protein, 15 aa, Entamoeba invadens
MNDASKTVEQVDEQN

SEQ ID NO: 2884422 - protein, 8 aa, Entamoeba invadens
MNDDNATS

SEQ ID NO: 2884423 - protein, 12 aa, Entamoeba invadens
MNDGLNPDVPEL

SEQ ID NO: 2884424 - protein, 4 aa, Entamoeba invadens
MNDI

SEQ ID NO: 2884425 - protein, 11 aa, Entamoeba invadens
MNDIPQSRLGH

SEQ ID NO: 2884426 - protein, 4 aa, Entamoeba invadens
MNDN

SEQ ID NO: 2884427 - protein, 6 aa, Entamoeba invadens
MNDPPV

SEQ ID NO: 2884428 - protein, 10 aa, Entamoeba invadens
MNDPRCNNAN

SEQ ID NO: 2884429 - protein, 10 aa, Entamoeba invadens
MNDSSKDGKV

SEQ ID NO: 2884430 - protein, 8 aa, Entamoeba invadens
MNEAATDR

SEQ ID NO: 2884431 - protein, 5 aa, Entamoeba invadens
MNEDR

SEQ ID NO: 2884432 - protein, 4 aa, Entamoeba invadens
MNEE

SEQ ID NO: 2884433 - protein, 14 aa, Entamoeba invadens
MNEEEKKQKTVTDS

SEQ ID NO: 2884434 - protein, 15 aa, Entamoeba invadens
MNEENKDVDKETRRK

SEQ ID NO: 2884435 - protein, 18 aa, Entamoeba invadens
MNEKRDTFEYSDSPEWSD

SEQ ID NO: 2884436 - protein, 8 aa, Entamoeba invadens
MNEKTNNI

SEQ ID NO: 2884437 - protein, 13 aa, Entamoeba invadens
MNEPDKKGEKSDF

SEQ ID NO: 2884438 - protein, 4 aa, Entamoeba invadens
MNEQ

SEQ ID NO: 2884439 - protein, 5 aa, Entamoeba invadens
MNESE

SEQ ID NO: 2884440 - protein, 4 aa, Entamoeba invadens
MNET

SEQ ID NO: 2884441 - protein, 5 aa, Entamoeba invadens
MNETV

SEQ ID NO: 2884442 - protein, 6 aa, Entamoeba invadens
MNETVV

SEQ ID NO: 2884443 - protein, 6 aa, Entamoeba invadens
MNGAYP

SEQ ID NO: 2884444 - protein, 16 aa, Entamoeba invadens
MNGDGKLNIDEWLNLF

SEQ ID NO: 2884445 - protein, 6 aa, Entamoeba invadens
MNGEEK

SEQ ID NO: 2884446 - protein, 6 aa, Entamoeba invadens
MNGELT

SEQ ID NO: 2884447 - protein, 6 aa, Entamoeba invadens
MNGKAA

SEQ ID NO: 2884448 - protein, 8 aa, Entamoeba invadens
MNGKKSEL

SEQ ID NO: 2884449 - protein, 29 aa, Entamoeba invadens
MNGSKLAPLSVEAPSGLVESSKPKPTSLQ

SEQ ID NO: 2884450 - protein, 18 aa, Entamoeba invadens
MNGTETTLKQAMEKRKEV

SEQ ID NO: 2884451 - protein, 8 aa, Entamoeba invadens
MNGTGLKE

SEQ ID NO: 2884452 - protein, 7 aa, Entamoeba invadens
MNKDDRR

SEQ ID NO: 2884453 - protein, 4 aa, Entamoeba invadens
MNKK

SEQ ID NO: 2884454 - protein, 20 aa, Entamoeba invadens
MNKKKLKEQQKKEATMPRKD

SEQ ID NO: 2884455 - protein, 17 aa, Entamoeba invadens
MNKTSEDPKYTLPDGRQ

SEQ ID NO: 2884456 - protein, 5 aa, Entamoeba invadens
MNLSS

SEQ ID NO: 2884457 - protein, 7 aa, Entamoeba invadens
MNNEETM

SEQ ID NO: 2884458 - protein, 10 aa, Entamoeba invadens
MNNGEESDDL

SEQ ID NO: 2884459 - protein, 7 aa, Entamoeba invadens
MNNKTQY

SEQ ID NO: 2884460 - protein, 7 aa, Entamoeba invadens
MNNNYSK

SEQ ID NO: 2884461 - protein, 10 aa, Entamoeba invadens
MNNQNGQYGA

SEQ ID NO: 2884462 - protein, 5 aa, Entamoeba invadens
MNNRE

SEQ ID NO: 2884463 - protein, 5 aa, Entamoeba invadens
MNNYT

SEQ ID NO: 2884464 - protein, 9 aa, Entamoeba invadens
MNPERTSPL

SEQ ID NO: 2884465 - protein, 5 aa, Entamoeba invadens
MNPGL

SEQ ID NO: 2884466 - protein, 7 aa, Entamoeba invadens
MNPGTVS

SEQ ID NO: 2884467 - protein, 4 aa, Entamoeba invadens
MNPI

SEQ ID NO: 2884468 - protein, 4 aa, Entamoeba invadens
MNPN

SEQ ID NO: 2884469 - protein, 5 aa, Entamoeba invadens
MNPNT

SEQ ID NO: 2884470 - protein, 8 aa, Entamoeba invadens
MNPPKIKS

SEQ ID NO: 2884471 - protein, 15 aa, Entamoeba invadens
MNPSTNKDSPLLTET

SEQ ID NO: 2884472 - protein, 11 aa, Entamoeba invadens
MNQNTESDDTA

SEQ ID NO: 2884473 - protein, 5 aa, Entamoeba invadens
MNQPI

SEQ ID NO: 2884474 - protein, 9 aa, Entamoeba invadens
MNQSSDFQK

SEQ ID NO: 2884475 - protein, 5 aa, Entamoeba invadens
MNQST

SEQ ID NO: 2884476 - protein, 6 aa, Entamoeba invadens
MNQTTK

SEQ ID NO: 2884477 - protein, 9 aa, Entamoeba invadens
MNRAPGPND

SEQ ID NO: 2884478 - protein, 23 aa, Entamoeba invadens
MNSDENVNTHPISGPVKKASDIE

SEQ ID NO: 2884479 - protein, 5 aa, Entamoeba invadens
MNSEN

SEQ ID NO: 2884480 - protein, 20 aa, Entamoeba invadens
MNSKKEKLERAKKENDELKM

SEQ ID NO: 2884481 - protein, 4 aa, Entamoeba invadens
MNSN

SEQ ID NO: 2884482 - protein, 8 aa, Entamoeba invadens
MNSNSDKN

SEQ ID NO: 2884483 - protein, 8 aa, Entamoeba invadens
MNSNVNQD

SEQ ID NO: 2884484 - protein, 6 aa, Entamoeba invadens
MNSPGK

SEQ ID NO: 2884485 - protein, 7 aa, Entamoeba invadens
MNSPTLS

SEQ ID NO: 2884486 - protein, 13 aa, Entamoeba invadens
MNSSQIDTQPVFT

SEQ ID NO: 2884487 - protein, 14 aa, Entamoeba invadens
MNSTENIKGFEVLN

SEQ ID NO: 2884488 - protein, 18 aa, Entamoeba invadens
MNSTKSPKFDENEGPANI

SEQ ID NO: 2884489 - protein, 5 aa, Entamoeba invadens
MNSYP

SEQ ID NO: 2884490 - protein, 84 aa, Entamoeba invadens
MNTDESKFPSFDQQNTQSKFPSFDGQQTTQQNQFPSFGSQSENKFPSFDQQQNTQNKFPSFNQQENKFPSFDGQQSTQQSSQQN

SEQ ID NO: 2884491 - protein, 29 aa, Entamoeba invadens
MNTDTSITLTKSNDNNEKLTFDDESDEYE

SEQ ID NO: 2884492 - protein, 4 aa, Entamoeba invadens
MNTF

SEQ ID NO: 2884493 - protein, 11 aa, Entamoeba invadens
MNTKDSKKVPV

SEQ ID NO: 2884494 - protein, 11 aa, Entamoeba invadens
MNTQQQQPMQQ

SEQ ID NO: 2884495 - protein, 4 aa, Entamoeba invadens
MNTS

SEQ ID NO: 2884496 - protein, 17 aa, Entamoeba invadens
MNTSKSENYQNAKNRYD

SEQ ID NO: 2884497 - protein, 4 aa, Entamoeba invadens
MNTT

SEQ ID NO: 2884498 - protein, 5 aa, Entamoeba invadens
MNTTE

SEQ ID NO: 2884499 - protein, 12 aa, Entamoeba invadens
MNTVTGKNSYQE

SEQ ID NO: 2884500 - protein, 11 aa, Entamoeba invadens
MNYSEEKSLNT

SEQ ID NO: 2884501 - protein, 13 aa, Entamoeba invadens
MNYSSRSSSIIEG

SEQ ID NO: 2884502 - protein, 4 aa, Entamoeba invadens
MPAE

SEQ ID NO: 2884503 - protein, 8 aa, Entamoeba invadens
MPATQSQD

SEQ ID NO: 2884504 - protein, 9 aa, Entamoeba invadens
MPDAHSGYG

SEQ ID NO: 2884505 - protein, 9 aa, Entamoeba invadens
MPDESRDFR

SEQ ID NO: 2884506 - protein, 15 aa, Entamoeba invadens
MPDGATTSDARDEEH

SEQ ID NO: 2884507 - protein, 4 aa, Entamoeba invadens
MPDM

SEQ ID NO: 2884508 - protein, 8 aa, Entamoeba invadens
MPEAREPR

SEQ ID NO: 2884509 - protein, 12 aa, Entamoeba invadens
MPEDKKKKYQDL

SEQ ID NO: 2884510 - protein, 6 aa, Entamoeba invadens
MPEDSD

SEQ ID NO: 2884511 - protein, 5 aa, Entamoeba invadens
MPEGK

SEQ ID NO: 2884512 - protein, 13 aa, Entamoeba invadens
MPEGKPKPKTCHR

SEQ ID NO: 2884513 - protein, 9 aa, Entamoeba invadens
MPFTESGMT

SEQ ID NO: 2884514 - protein, 11 aa, Entamoeba invadens
MPGAVSEQQLR

SEQ ID NO: 2884515 - protein, 11 aa, Entamoeba invadens
MPGCQNEGTSQ

SEQ ID NO: 2884516 - protein, 8 aa, Entamoeba invadens
MPGEGDEA

SEQ ID NO: 2884517 - protein, 12 aa, Entamoeba invadens
MPGGMPGGQSYS

SEQ ID NO: 2884518 - protein, 9 aa, Entamoeba invadens
MPGGQYSNL

SEQ ID NO: 2884519 - protein, 12 aa, Entamoeba invadens
MPGMKKKNDELI

SEQ ID NO: 2884520 - protein, 7 aa, Entamoeba invadens
MPGNPMN

SEQ ID NO: 2884521 - protein, 4 aa, Entamoeba invadens
MPHV

SEQ ID NO: 2884522 - protein, 11 aa, Entamoeba invadens
MPIRKSPGKFG

SEQ ID NO: 2884523 - protein, 17 aa, Entamoeba invadens
MPKKRDDIARPSLAAPE

SEQ ID NO: 2884524 - protein, 17 aa, Entamoeba invadens
MPKSKKSSRSSTHTDNE

SEQ ID NO: 2884525 - protein, 5 aa, Entamoeba invadens
MPKTA

SEQ ID NO: 2884526 - protein, 6 aa, Entamoeba invadens
MPKTPS

SEQ ID NO: 2884527 - protein, 5 aa, Entamoeba invadens
MPLPE

SEQ ID NO: 2884528 - protein, 7 aa, Entamoeba invadens
MPLPTSG

SEQ ID NO: 2884529 - protein, 13 aa, Entamoeba invadens
MPLTTTSKDQNSV

SEQ ID NO: 2884530 - protein, 10 aa, Entamoeba invadens
MPNDTPAPVL

SEQ ID NO: 2884531 - protein, 4 aa, Entamoeba invadens
MPNS

SEQ ID NO: 2884532 - protein, 4 aa, Entamoeba invadens
MPNT

SEQ ID NO: 2884533 - protein, 5 aa, Entamoeba invadens
MPPDE

SEQ ID NO: 2884534 - protein, 8 aa, Entamoeba invadens
MPPEEQKN

SEQ ID NO: 2884535 - protein, 10 aa, Entamoeba invadens
MPPEEQYKMP

SEQ ID NO: 2884536 - protein, 7 aa, Entamoeba invadens
MPPNNDM

SEQ ID NO: 2884537 - protein, 11 aa, Entamoeba invadens
MPPPGGLAPPG

SEQ ID NO: 2884538 - protein, 17 aa, Entamoeba invadens
MPPPGLAPPGAPPGGLM

SEQ ID NO: 2884539 - protein, 8 aa, Entamoeba invadens
MPPPPLTS

SEQ ID NO: 2884540 - protein, 8 aa, Entamoeba invadens
MPPPPPPV

SEQ ID NO: 2884541 - protein, 39 aa, Entamoeba invadens
MPPQPPHMSQERKDYRDEYGGGEKQRLEKKDLNSTSPLG

SEQ ID NO: 2884542 - protein, 9 aa, Entamoeba invadens
MPPRDQRIP

SEQ ID NO: 2884543 - protein, 52 aa, Entamoeba invadens
MPPRGAPRGAPRGAPRGAPAPRGAPRGGRGGMPPPQPQYEEPQEEEEQPQQF

SEQ ID NO: 2884544 - protein, 33 aa, Entamoeba invadens
MPPRGAPRGAPRGAPRGAPAPRGAPRGGRGGRG

SEQ ID NO: 2884545 - protein, 5 aa, Entamoeba invadens
MPPSE

SEQ ID NO: 2884546 - protein, 14 aa, Entamoeba invadens
MPQAPSEKTEESVE

SEQ ID NO: 2884547 - protein, 5 aa, Entamoeba invadens
MPQDE

SEQ ID NO: 2884548 - protein, 6 aa, Entamoeba invadens
MPQEER

SEQ ID NO: 2884549 - protein, 22 aa, Entamoeba invadens
MPQGCQSRCDDGYYKTTENEIA

SEQ ID NO: 2884550 - protein, 10 aa, Entamoeba invadens
MPQGGMPNVQ

SEQ ID NO: 2884551 - protein, 14 aa, Entamoeba invadens
MPQGSRDTAKGLKN

SEQ ID NO: 2884552 - protein, 26 aa, Entamoeba invadens
MPQQGQMQQGQRIQTVGGANTIGVSP

SEQ ID NO: 2884553 - protein, 8 aa, Entamoeba invadens
MPRKGAAI

SEQ ID NO: 2884554 - protein, 5 aa, Entamoeba invadens
MPRPG

SEQ ID NO: 2884555 - protein, 40 aa, Entamoeba invadens
MPRPRRSEPPKTQRDEKIDPKEVEELKKEKKELEKTLKDK

SEQ ID NO: 2884556 - protein, 6 aa, Entamoeba invadens
MPRSPE

SEQ ID NO: 2884557 - protein, 6 aa, Entamoeba invadens
MPSDTI

SEQ ID NO: 2884558 - protein, 4 aa, Entamoeba invadens
MPSE

SEQ ID NO: 2884559 - protein, 15 aa, Entamoeba invadens
MPSGTYESVCFHLFH

SEQ ID NO: 2884560 - protein, 9 aa, Entamoeba invadens
MPSKPGKYG

SEQ ID NO: 2884561 - protein, 6 aa, Entamoeba invadens
MPSLPS

SEQ ID NO: 2884562 - protein, 9 aa, Entamoeba invadens
MPSPRPKKM

SEQ ID NO: 2884563 - protein, 12 aa, Entamoeba invadens
MPSQEKLELSDD

SEQ ID NO: 2884564 - protein, 48 aa, Entamoeba invadens
MPSRGAPRAAPRGAPAPRAAPRSAPRSASRGAPRGGMSSSAQPPPPPM

SEQ ID NO: 2884565 - protein, 46 aa, Entamoeba invadens
MPSRGAPRGAPAPRGTSRGAPAPRSAPRGAPRGGMSSSAQPPPPPM

SEQ ID NO: 2884566 - protein, 4 aa, Entamoeba invadens
MPSS

SEQ ID NO: 2884567 - protein, 10 aa, Entamoeba invadens
MPSTNGSTKS

SEQ ID NO: 2884568 - protein, 6 aa, Entamoeba invadens
MPSYDT

SEQ ID NO: 2884569 - protein, 13 aa, Entamoeba invadens
MPTFGKEKKKAEL

SEQ ID NO: 2884570 - protein, 15 aa, Entamoeba invadens
MPTIPQNNNMPAIPQ

SEQ ID NO: 2884571 - protein, 14 aa, Entamoeba invadens
MPTSQSQQVQQEQA

SEQ ID NO: 2884572 - protein, 14 aa, Entamoeba invadens
MQCSSASDFTSPRL

SEQ ID NO: 2884573 - protein, 8 aa, Entamoeba invadens
MQDASSNF

SEQ ID NO: 2884574 - protein, 59 aa, Entamoeba invadens
MQDEGEEEEPKKKTRKKRTTAGEKGEKGEKKMSRPTKKTTTNKKKKTTKTVKSTFIKPM

SEQ ID NO: 2884575 - protein, 9 aa, Entamoeba invadens
MQEESYTEK

SEQ ID NO: 2884576 - protein, 14 aa, Entamoeba invadens
MQEHGDPSKTELTD

SEQ ID NO: 2884577 - protein, 11 aa, Entamoeba invadens
MQEKQKAEEKM

SEQ ID NO: 2884578 - protein, 20 aa, Entamoeba invadens
MQGDSTVAVGTDGKNLGPNE

SEQ ID NO: 2884579 - protein, 4 aa, Entamoeba invadens
MQGK

SEQ ID NO: 2884580 - protein, 9 aa, Entamoeba invadens
MQKATNGSM

SEQ ID NO: 2884581 - protein, 5 aa, Entamoeba invadens
MQKKE

SEQ ID NO: 2884582 - protein, 10 aa, Entamoeba invadens
MQKNDTSGAC

SEQ ID NO: 2884583 - protein, 12 aa, Entamoeba invadens
MQKPEENANEPA

SEQ ID NO: 2884584 - protein, 13 aa, Entamoeba invadens
MQNDTTDFKKKRG

SEQ ID NO: 2884585 - protein, 4 aa, Entamoeba invadens
MQNK

SEQ ID NO: 2884586 - protein, 17 aa, Entamoeba invadens
MQNSSTKILNSSANPTL

SEQ ID NO: 2884587 - protein, 5 aa, Entamoeba invadens
MQPEV

SEQ ID NO: 2884588 - protein, 17 aa, Entamoeba invadens
MQPNGALPGDRQDLDSY

SEQ ID NO: 2884589 - protein, 7 aa, Entamoeba invadens
MQPPQPI

SEQ ID NO: 2884590 - protein, 10 aa, Entamoeba invadens
MQQENNSSID

SEQ ID NO: 2884591 - protein, 4 aa, Entamoeba invadens
MQQG

SEQ ID NO: 2884592 - protein, 25 aa, Entamoeba invadens
MQQPGMNPYGGAYGGMGAGMGGYGG

SEQ ID NO: 2884593 - protein, 8 aa, Entamoeba invadens
MQQPPGAA

SEQ ID NO: 2884594 - protein, 20 aa, Entamoeba invadens
MQQQKQQGKPAYANPYVNPY

SEQ ID NO: 2884595 - protein, 10 aa, Entamoeba invadens
MQRNGKAKRM

SEQ ID NO: 2884596 - protein, 9 aa, Entamoeba invadens
MQRSGQTEG

SEQ ID NO: 2884597 - protein, 19 aa, Entamoeba invadens
MQSETSQETSFREDTNSIG

SEQ ID NO: 2884598 - protein, 7 aa, Entamoeba invadens
MQSGPDM

SEQ ID NO: 2884599 - protein, 28 aa, Entamoeba invadens
MQSKSENLNLRTENDTLNRKLSNKNDLE

SEQ ID NO: 2884600 - protein, 11 aa, Entamoeba invadens
MQSTGGAEGLT

SEQ ID NO: 2884601 - protein, 14 aa, Entamoeba invadens
MQTAPAQKKKGGVS

SEQ ID NO: 2884602 - protein, 7 aa, Entamoeba invadens
MQTASQM

SEQ ID NO: 2884603 - protein, 6 aa, Entamoeba invadens
MQTEGN

SEQ ID NO: 2884604 - protein, 11 aa, Entamoeba invadens
MQTNGTSIQPI

SEQ ID NO: 2884605 - protein, 7 aa, Entamoeba invadens
MQTTCSG

SEQ ID NO: 2884606 - protein, 16 aa, Entamoeba invadens
MQTTRRPTTPRPGTPI

SEQ ID NO: 2884607 - protein, 9 aa, Entamoeba invadens
MRADNRLNQ

SEQ ID NO: 2884608 - protein, 9 aa, Entamoeba invadens
MRAEKDDEF

SEQ ID NO: 2884609 - protein, 7 aa, Entamoeba invadens
MRAPSLA

SEQ ID NO: 2884610 - protein, 5 aa, Entamoeba invadens
MRCED

SEQ ID NO: 2884611 - protein, 4 aa, Entamoeba invadens
MRDG

SEQ ID NO: 2884612 - protein, 11 aa, Entamoeba invadens
MRDYKTASEEL

SEQ ID NO: 2884613 - protein, 15 aa, Entamoeba invadens
MREAQTTSESAARVT

SEQ ID NO: 2884614 - protein, 5 aa, Entamoeba invadens
MREEF

SEQ ID NO: 2884615 - protein, 15 aa, Entamoeba invadens
MREENERKEKEIIEE

SEQ ID NO: 2884616 - protein, 14 aa, Entamoeba invadens
MREGDINSAKKEEI

SEQ ID NO: 2884617 - protein, 13 aa, Entamoeba invadens
MRENKKRSLSINE

SEQ ID NO: 2884618 - protein, 7 aa, Entamoeba invadens
MRENNDA

SEQ ID NO: 2884619 - protein, 18 aa, Entamoeba invadens
MRENRELKKRIDAKKNSE

SEQ ID NO: 2884620 - protein, 5 aa, Entamoeba invadens
MRERD

SEQ ID NO: 2884621 - protein, 5 aa, Entamoeba invadens
MRGGD

SEQ ID NO: 2884622 - protein, 10 aa, Entamoeba invadens
MRGNSEGQKM

SEQ ID NO: 2884623 - protein, 7 aa, Entamoeba invadens
MRGNSQF

SEQ ID NO: 2884624 - protein, 13 aa, Entamoeba invadens
MRGSHNSGNIVKN

SEQ ID NO: 2884625 - protein, 7 aa, Entamoeba invadens
MRKESDT

SEQ ID NO: 2884626 - protein, 56 aa, Entamoeba invadens
MRKGDRPESIERREKLEREKNERKERIERLEKAKKKAKAAQKQSEEKKPRKQKISV

SEQ ID NO: 2884627 - protein, 19 aa, Entamoeba invadens
MRKKEEEKKEEKKKNSGGL

SEQ ID NO: 2884628 - protein, 5 aa, Entamoeba invadens
MRKND

SEQ ID NO: 2884629 - protein, 9 aa, Entamoeba invadens
MRKNNTKEE

SEQ ID NO: 2884630 - protein, 6 aa, Entamoeba invadens
MRKQEY

SEQ ID NO: 2884631 - protein, 9 aa, Entamoeba invadens
MRKYTTKSF

SEQ ID NO: 2884632 - protein, 9 aa, Entamoeba invadens
MRKYTTQSF

SEQ ID NO: 2884633 - protein, 15 aa, Entamoeba invadens
MRNDENKIEKPTSQE

SEQ ID NO: 2884634 - protein, 6 aa, Entamoeba invadens
MRNDLG

SEQ ID NO: 2884635 - protein, 7 aa, Entamoeba invadens
MRNGNKY

SEQ ID NO: 2884636 - protein, 11 aa, Entamoeba invadens
MRNQDKTEIEK

SEQ ID NO: 2884637 - protein, 4 aa, Entamoeba invadens
MRNT

SEQ ID NO: 2884638 - protein, 4 aa, Entamoeba invadens
MRNY

SEQ ID NO: 2884639 - protein, 8 aa, Entamoeba invadens
MRPAQSPH

SEQ ID NO: 2884640 - protein, 5 aa, Entamoeba invadens
MRPDQ

SEQ ID NO: 2884641 - protein, 4 aa, Entamoeba invadens
MRPE

SEQ ID NO: 2884642 - protein, 17 aa, Entamoeba invadens
MRPQQPGYPQQSPGYLP

SEQ ID NO: 2884643 - protein, 10 aa, Entamoeba invadens
MRPQRATGAA

SEQ ID NO: 2884644 - protein, 5 aa, Entamoeba invadens
MRPRS

SEQ ID NO: 2884645 - protein, 15 aa, Entamoeba invadens
MRQDERTKALETFKK

SEQ ID NO: 2884646 - protein, 11 aa, Entamoeba invadens
MRRDGTSKLKT

SEQ ID NO: 2884647 - protein, 10 aa, Entamoeba invadens
MRRERDLKEV

SEQ ID NO: 2884648 - protein, 4 aa, Entamoeba invadens
MRRN

SEQ ID NO: 2884649 - protein, 5 aa, Entamoeba invadens
MRSED

SEQ ID NO: 2884650 - protein, 13 aa, Entamoeba invadens
MRSEKMNEEREKM

SEQ ID NO: 2884651 - protein, 16 aa, Entamoeba invadens
MRSPQSLDEKEKNEIL

SEQ ID NO: 2884652 - protein, 8 aa, Entamoeba invadens
MRSRAEKA

SEQ ID NO: 2884653 - protein, 25 aa, Entamoeba invadens
MRSSEEETRPSGHSRNSSTSPVTPI

SEQ ID NO: 2884654 - protein, 9 aa, Entamoeba invadens
MRTDKEKNL

SEQ ID NO: 2884655 - protein, 7 aa, Entamoeba invadens
MRTDKGG

SEQ ID NO: 2884656 - protein, 41 aa, Entamoeba invadens
MRTETNDKDEEKNGVPKLAKSTVESVSEEDTQIKPKKPMGI

SEQ ID NO: 2884657 - protein, 8 aa, Entamoeba invadens
MRTQEEKN

SEQ ID NO: 2884658 - protein, 7 aa, Entamoeba invadens
MRTSSGD

SEQ ID NO: 2884659 - protein, 33 aa, Entamoeba invadens
MRVSEGEGAPTENNTKETKEESEKEKQKEIENY

SEQ ID NO: 2884660 - protein, 18 aa, Entamoeba invadens
MSADNTAVGLGENSNNYA

SEQ ID NO: 2884661 - protein, 10 aa, Entamoeba invadens
MSAKIATSSV

SEQ ID NO: 2884662 - protein, 4 aa, Entamoeba invadens
MSAR

SEQ ID NO: 2884663 - protein, 8 aa, Entamoeba invadens
MSASDKKA

SEQ ID NO: 2884664 - protein, 10 aa, Entamoeba invadens
MSASNDHQNE

SEQ ID NO: 2884665 - protein, 7 aa, Entamoeba invadens
MSATEPT

SEQ ID NO: 2884666 - protein, 36 aa, Entamoeba invadens
MSDEDVSSKGSPSDLELPKDSPDVSSEHSDPSTCEK

SEQ ID NO: 2884667 - protein, 18 aa, Entamoeba invadens
MSDEEEKRHTERSQNFNE

SEQ ID NO: 2884668 - protein, 8 aa, Entamoeba invadens
MSDEENEN

SEQ ID NO: 2884669 - protein, 5 aa, Entamoeba invadens
MSDEY

SEQ ID NO: 2884670 - protein, 4 aa, Entamoeba invadens
MSDG

SEQ ID NO: 2884671 - protein, 5 aa, Entamoeba invadens
MSDGS

SEQ ID NO: 2884672 - protein, 4 aa, Entamoeba invadens
MSDI

SEQ ID NO: 2884673 - protein, 4 aa, Entamoeba invadens
MSDN

SEQ ID NO: 2884674 - protein, 10 aa, Entamoeba invadens
MSDNELRETL

SEQ ID NO: 2884675 - protein, 7 aa, Entamoeba invadens
MSDPGGG

SEQ ID NO: 2884676 - protein, 10 aa, Entamoeba invadens
MSDPTSRISQ

SEQ ID NO: 2884677 - protein, 19 aa, Entamoeba invadens
MSDRKSEVGIAERAGRSAD

SEQ ID NO: 2884678 - protein, 6 aa, Entamoeba invadens
MSDRNE

SEQ ID NO: 2884679 - protein, 14 aa, Entamoeba invadens
MSDSTDTFNPNSIS

SEQ ID NO: 2884680 - protein, 19 aa, Entamoeba invadens
MSDTTQEAIDPFIKKIKKK

SEQ ID NO: 2884681 - protein, 6 aa, Entamoeba invadens
MSDVER

SEQ ID NO: 2884682 - protein, 6 aa, Entamoeba invadens
MSEANL

SEQ ID NO: 2884683 - protein, 6 aa, Entamoeba invadens
MSEDSE

SEQ ID NO: 2884684 - protein, 6 aa, Entamoeba invadens
MSEEGD

SEQ ID NO: 2884685 - protein, 9 aa, Entamoeba invadens
MSEEGRNDL

SEQ ID NO: 2884686 - protein, 8 aa, Entamoeba invadens
MSEFESTI

SEQ ID NO: 2884687 - protein, 5 aa, Entamoeba invadens
MSEGV

SEQ ID NO: 2884688 - protein, 6 aa, Entamoeba invadens
MSEKGE

SEQ ID NO: 2884689 - protein, 17 aa, Entamoeba invadens
MSENAQKFAEKRSPSSY

SEQ ID NO: 2884690 - protein, 7 aa, Entamoeba invadens
MSENGAR

SEQ ID NO: 2884691 - protein, 18 aa, Entamoeba invadens
MSESEKRDFKKKPFPPAR

SEQ ID NO: 2884692 - protein, 8 aa, Entamoeba invadens
MSESGEIG

SEQ ID NO: 2884693 - protein, 9 aa, Entamoeba invadens
MSETERSEI

SEQ ID NO: 2884694 - protein, 24 aa, Entamoeba invadens
MSETNAWSEKYRPKKLDEVKGQEE

SEQ ID NO: 2884695 - protein, 33 aa, Entamoeba invadens
MSETSTCGQTMNPPTSNTYPPPVQNPPGYYSGQ

SEQ ID NO: 2884696 - protein, 5 aa, Entamoeba invadens
MSEYE

SEQ ID NO: 2884697 - protein, 5 aa, Entamoeba invadens
MSGDR

SEQ ID NO: 2884698 - protein, 16 aa, Entamoeba invadens
MSGKDRKNSAEISRGA

SEQ ID NO: 2884699 - protein, 5 aa, Entamoeba invadens
MSGMR

SEQ ID NO: 2884700 - protein, 16 aa, Entamoeba invadens
MSGNKSIQYGKNGDVY

SEQ ID NO: 2884701 - protein, 5 aa, Entamoeba invadens
MSGPE

SEQ ID NO: 2884702 - protein, 6 aa, Entamoeba invadens
MSGPTN

SEQ ID NO: 2884703 - protein, 7 aa, Entamoeba invadens
MSGPTNF

SEQ ID NO: 2884704 - protein, 9 aa, Entamoeba invadens
MSGRNGSSV

SEQ ID NO: 2884705 - protein, 9 aa, Entamoeba invadens
MSGSSDVVK

SEQ ID NO: 2884706 - protein, 14 aa, Entamoeba invadens
MSGSSQGELIYYKY

SEQ ID NO: 2884707 - protein, 15 aa, Entamoeba invadens
MSGTTQTEKAKSERL

SEQ ID NO: 2884708 - protein, 6 aa, Entamoeba invadens
MSGVKS

SEQ ID NO: 2884709 - protein, 5 aa, Entamoeba invadens
MSGVT

SEQ ID NO: 2884710 - protein, 11 aa, Entamoeba invadens
MSGWGDQDTNN

SEQ ID NO: 2884711 - protein, 7 aa, Entamoeba invadens
MSHDEDQ

SEQ ID NO: 2884712 - protein, 12 aa, Entamoeba invadens
MSHNEAEYTNNS

SEQ ID NO: 2884713 - protein, 9 aa, Entamoeba invadens
MSKAEQDDI

SEQ ID NO: 2884714 - protein, 11 aa, Entamoeba invadens
MSKDEPKKQVI

SEQ ID NO: 2884715 - protein, 6 aa, Entamoeba invadens
MSKDTT

SEQ ID NO: 2884716 - protein, 5 aa, Entamoeba invadens
MSKEA

SEQ ID NO: 2884717 - protein, 8 aa, Entamoeba invadens
MSKGDAVE

SEQ ID NO: 2884718 - protein, 10 aa, Entamoeba invadens
MSKKSKRGFQ

SEQ ID NO: 2884719 - protein, 18 aa, Entamoeba invadens
MSKNEKEVGAKSAEEVYE

SEQ ID NO: 2884720 - protein, 11 aa, Entamoeba invadens
MSKNSMKSIQS

SEQ ID NO: 2884721 - protein, 10 aa, Entamoeba invadens
MSKQDEEQEK

SEQ ID NO: 2884722 - protein, 28 aa, Entamoeba invadens
MSKSDKAPTPQPDETTNLTQNTTDKKGC

SEQ ID NO: 2884723 - protein, 8 aa, Entamoeba invadens
MSKSSDVI

SEQ ID NO: 2884724 - protein, 6 aa, Entamoeba invadens
MSLGSD

SEQ ID NO: 2884725 - protein, 4 aa, Entamoeba invadens
MSLQ

SEQ ID NO: 2884726 - protein, 4 aa, Entamoeba invadens
MSNA

SEQ ID NO: 2884727 - protein, 7 aa, Entamoeba invadens
MSNAQSQ

SEQ ID NO: 2884728 - protein, 4 aa, Entamoeba invadens
MSND

SEQ ID NO: 2884729 - protein, 4 aa, Entamoeba invadens
MSNE

SEQ ID NO: 2884730 - protein, 11 aa, Entamoeba invadens
MSNGGPAPIEV

SEQ ID NO: 2884731 - protein, 30 aa, Entamoeba invadens
MSNGNKKVEGGLEDSSTSPKKEKRKSLKRR

SEQ ID NO: 2884732 - protein, 30 aa, Entamoeba invadens
MSNGTKGTQQPTPPQPSPPQQQPRQEQGSQ

SEQ ID NO: 2884733 - protein, 4 aa, Entamoeba invadens
MSNK

SEQ ID NO: 2884734 - protein, 13 aa, Entamoeba invadens
MSNKGIESTDENI

SEQ ID NO: 2884735 - protein, 5 aa, Entamoeba invadens
MSNNK

SEQ ID NO: 2884736 - protein, 7 aa, Entamoeba invadens
MSNNTEA

SEQ ID NO: 2884737 - protein, 8 aa, Entamoeba invadens
MSNQPKWN

SEQ ID NO: 2884738 - protein, 14 aa, Entamoeba invadens
MSNTPSTPATPGRN

SEQ ID NO: 2884739 - protein, 11 aa, Entamoeba invadens
MSPDNETRKKA

SEQ ID NO: 2884740 - protein, 6 aa, Entamoeba invadens
MSPEVD

SEQ ID NO: 2884741 - protein, 5 aa, Entamoeba invadens
MSPIE

SEQ ID NO: 2884742 - protein, 12 aa, Entamoeba invadens
MSPISNGKITDY

SEQ ID NO: 2884743 - protein, 11 aa, Entamoeba invadens
MSPKETDVEET

SEQ ID NO: 2884744 - protein, 16 aa, Entamoeba invadens
MSPKSTPRDENEKVEQ

SEQ ID NO: 2884745 - protein, 11 aa, Entamoeba invadens
MSPLKAPPLIS

SEQ ID NO: 2884746 - protein, 7 aa, Entamoeba invadens
MSPLTKP

SEQ ID NO: 2884747 - protein, 7 aa, Entamoeba invadens
MSPPPPM

SEQ ID NO: 2884748 - protein, 9 aa, Entamoeba invadens
MSPQKPEKM

SEQ ID NO: 2884749 - protein, 13 aa, Entamoeba invadens
MSPQTPSRSIERR

SEQ ID NO: 2884750 - protein, 7 aa, Entamoeba invadens
MSPSDTM

SEQ ID NO: 2884751 - protein, 5 aa, Entamoeba invadens
MSPSW

SEQ ID NO: 2884752 - protein, 15 aa, Entamoeba invadens
MSPTTPIKSPPIITF

SEQ ID NO: 2884753 - protein, 12 aa, Entamoeba invadens
MSPYGRKEGQKD

SEQ ID NO: 2884754 - protein, 8 aa, Entamoeba invadens
MSQAETQA

SEQ ID NO: 2884755 - protein, 32 aa, Entamoeba invadens
MSQEDTDGENYHEEEEEENESYEEDPGPVDPS

SEQ ID NO: 2884756 - protein, 21 aa, Entamoeba invadens
MSQGVKESTANERLKKNRLKQ

SEQ ID NO: 2884757 - protein, 7 aa, Entamoeba invadens
MSQPTSL

SEQ ID NO: 2884758 - protein, 5 aa, Entamoeba invadens
MSQYN

SEQ ID NO: 2884759 - protein, 7 aa, Entamoeba invadens
MSRDNKE

SEQ ID NO: 2884760 - protein, 9 aa, Entamoeba invadens
MSREERLKQ

SEQ ID NO: 2884761 - protein, 8 aa, Entamoeba invadens
MSREEVKE

SEQ ID NO: 2884762 - protein, 13 aa, Entamoeba invadens
MSRKTESVKVELD

SEQ ID NO: 2884763 - protein, 10 aa, Entamoeba invadens
MSRNEVKTSA

SEQ ID NO: 2884764 - protein, 8 aa, Entamoeba invadens
MSRSEETM

SEQ ID NO: 2884765 - protein, 7 aa, Entamoeba invadens
MSSDTMQ

SEQ ID NO: 2884766 - protein, 9 aa, Entamoeba invadens
MSSESQSEL

SEQ ID NO: 2884767 - protein, 6 aa, Entamoeba invadens
MSSKGT

SEQ ID NO: 2884768 - protein, 8 aa, Entamoeba invadens
MSSMTSSE

SEQ ID NO: 2884769 - protein, 13 aa, Entamoeba invadens
MSSNDNTSNEDIT

SEQ ID NO: 2884770 - protein, 15 aa, Entamoeba invadens
MSSNEKTIANQREYS

SEQ ID NO: 2884771 - protein, 7 aa, Entamoeba invadens
MSSNTPI

SEQ ID NO: 2884772 - protein, 20 aa, Entamoeba invadens
MSSPKEGLSRPDGEENSEGY

SEQ ID NO: 2884773 - protein, 17 aa, Entamoeba invadens
MSSQAEDAAKMKEEADE

SEQ ID NO: 2884774 - protein, 5 aa, Entamoeba invadens
MSSSA

SEQ ID NO: 2884775 - protein, 7 aa, Entamoeba invadens
MSSSEAN

SEQ ID NO: 2884776 - protein, 9 aa, Entamoeba invadens
MSSSESDQY

SEQ ID NO: 2884777 - protein, 11 aa, Entamoeba invadens
MSSSSSQNTFS

SEQ ID NO: 2884778 - protein, 4 aa, Entamoeba invadens
MSST

SEQ ID NO: 2884779 - protein, 12 aa, Entamoeba invadens
MSSTNLKTIPQN

SEQ ID NO: 2884780 - protein, 20 aa, Entamoeba invadens
MSTALDPDELKKERKLGEGS

SEQ ID NO: 2884781 - protein, 20 aa, Entamoeba invadens
MSTALDPDELKKKRKLGEGS

SEQ ID NO: 2884782 - protein, 10 aa, Entamoeba invadens
MSTALNPDEL

SEQ ID NO: 2884783 - protein, 9 aa, Entamoeba invadens
MSTGINGKY

SEQ ID NO: 2884784 - protein, 6 aa, Entamoeba invadens
MSTGKT

SEQ ID NO: 2884785 - protein, 5 aa, Entamoeba invadens
MSTNS

SEQ ID NO: 2884786 - protein, 9 aa, Entamoeba invadens
MSTPAESAT

SEQ ID NO: 2884787 - protein, 6 aa, Entamoeba invadens
MSTPEE

SEQ ID NO: 2884788 - protein, 10 aa, Entamoeba invadens
MSTPTRPPIN

SEQ ID NO: 2884789 - protein, 20 aa, Entamoeba invadens
MSTRATLETNVPNQEDISER

SEQ ID NO: 2884790 - protein, 12 aa, Entamoeba invadens
MSTSVEDDIEAE

SEQ ID NO: 2884791 - protein, 18 aa, Entamoeba invadens
MSTTDTAITRPTKALSSS

SEQ ID NO: 2884792 - protein, 11 aa, Entamoeba invadens
MSTTPSVGPKV

SEQ ID NO: 2884793 - protein, 8 aa, Entamoeba invadens
MSVPTQPL

SEQ ID NO: 2884794 - protein, 5 aa, Entamoeba invadens
MSYPD

SEQ ID NO: 2884795 - protein, 5 aa, Entamoeba invadens
MSYPN

SEQ ID NO: 2884796 - protein, 25 aa, Entamoeba invadens
MSYPPPSRQAPPEFRPVTQDRRERY

SEQ ID NO: 2884797 - protein, 5 aa, Entamoeba invadens
MTAKR

SEQ ID NO: 2884798 - protein, 11 aa, Entamoeba invadens
MTASKGSTKLV

SEQ ID NO: 2884799 - protein, 13 aa, Entamoeba invadens
MTAVSGEKIDGEN

SEQ ID NO: 2884800 - protein, 5 aa, Entamoeba invadens
MTDAD

SEQ ID NO: 2884801 - protein, 4 aa, Entamoeba invadens
MTDD

SEQ ID NO: 2884802 - protein, 7 aa, Entamoeba invadens
MTDEQKA

SEQ ID NO: 2884803 - protein, 4 aa, Entamoeba invadens
MTDN

SEQ ID NO: 2884804 - protein, 4 aa, Entamoeba invadens
MTDP

SEQ ID NO: 2884805 - protein, 5 aa, Entamoeba invadens
MTDPI

SEQ ID NO: 2884806 - protein, 4 aa, Entamoeba invadens
MTDR

SEQ ID NO: 2884807 - protein, 12 aa, Entamoeba invadens
MTDTESKAAAYE

SEQ ID NO: 2884808 - protein, 4 aa, Entamoeba invadens
MTED

SEQ ID NO: 2884809 - protein, 19 aa, Entamoeba invadens
MTEDKPHSNPFEAATGYEK

SEQ ID NO: 2884810 - protein, 19 aa, Entamoeba invadens
MTEDQVKEAVDDSRQYGLT

SEQ ID NO: 2884811 - protein, 9 aa, Entamoeba invadens
MTEEAGADA

SEQ ID NO: 2884812 - protein, 8 aa, Entamoeba invadens
MTEEDSKV

SEQ ID NO: 2884813 - protein, 12 aa, Entamoeba invadens
MTEESKDYENKE

SEQ ID NO: 2884814 - protein, 6 aa, Entamoeba invadens
MTEETK

SEQ ID NO: 2884815 - protein, 6 aa, Entamoeba invadens
MTEGKD

SEQ ID NO: 2884816 - protein, 10 aa, Entamoeba invadens
MTEKMKEKTK

SEQ ID NO: 2884817 - protein, 10 aa, Entamoeba invadens
MTEKSATNDN

SEQ ID NO: 2884818 - protein, 7 aa, Entamoeba invadens
MTENPPL

SEQ ID NO: 2884819 - protein, 36 aa, Entamoeba invadens
MTEQKKNKKNKKLAPQRQQLTREEKFQRSNEKDIIT

SEQ ID NO: 2884820 - protein, 4 aa, Entamoeba invadens
MTES

SEQ ID NO: 2884821 - protein, 13 aa, Entamoeba invadens
MTESETAVDDDEI

SEQ ID NO: 2884822 - protein, 7 aa, Entamoeba invadens
MTESNAN

SEQ ID NO: 2884823 - protein, 5 aa, Entamoeba invadens
MTETE

SEQ ID NO: 2884824 - protein, 5 aa, Entamoeba invadens
MTETS

SEQ ID NO: 2884825 - protein, 18 aa, Entamoeba invadens
MTFKQQQKKAAKKVAKKK

SEQ ID NO: 2884826 - protein, 8 aa, Entamoeba invadens
MTGDDKNR

SEQ ID NO: 2884827 - protein, 11 aa, Entamoeba invadens
MTGGPDGDVGG

SEQ ID NO: 2884828 - protein, 13 aa, Entamoeba invadens
MTGGSTSVGIKAT

SEQ ID NO: 2884829 - protein, 4 aa, Entamoeba invadens
MTGN

SEQ ID NO: 2884830 - protein, 5 aa, Entamoeba invadens
MTGND

SEQ ID NO: 2884831 - protein, 8 aa, Entamoeba invadens
MTGSECGT

SEQ ID NO: 2884832 - protein, 33 aa, Entamoeba invadens
MTGSNEENTQGNQNGTQNYEGMEEYQQEQNDSF

SEQ ID NO: 2884833 - protein, 11 aa, Entamoeba invadens
MTHDDKKELEK

SEQ ID NO: 2884834 - protein, 6 aa, Entamoeba invadens
MTHNNP

SEQ ID NO: 2884835 - protein, 5 aa, Entamoeba invadens
MTIEP

SEQ ID NO: 2884836 - protein, 5 aa, Entamoeba invadens
MTITH

SEQ ID NO: 2884837 - protein, 10 aa, Entamoeba invadens
MTKAPPELKQ

SEQ ID NO: 2884838 - protein, 4 aa, Entamoeba invadens
MTKD

SEQ ID NO: 2884839 - protein, 7 aa, Entamoeba invadens
MTKDGNA

SEQ ID NO: 2884840 - protein, 6 aa, Entamoeba invadens
MTKEGL

SEQ ID NO: 2884841 - protein, 44 aa, Entamoeba invadens
MTKKESVLKSKKSVKNMEKANAMGERSNGESKSASSMDGDVNKT

SEQ ID NO: 2884842 - protein, 9 aa, Entamoeba invadens
MTKNGFKTI

SEQ ID NO: 2884843 - protein, 5 aa, Entamoeba invadens
MTKQI

SEQ ID NO: 2884844 - protein, 10 aa, Entamoeba invadens
MTLDEDASIS

SEQ ID NO: 2884845 - protein, 15 aa, Entamoeba invadens
MTLTNNTNATPPFQE

SEQ ID NO: 2884846 - protein, 8 aa, Entamoeba invadens
MTNEKEKI

SEQ ID NO: 2884847 - protein, 14 aa, Entamoeba invadens
MTNESPERRPTSEE

SEQ ID NO: 2884848 - protein, 10 aa, Entamoeba invadens
MTNGSTKGKM

SEQ ID NO: 2884849 - protein, 9 aa, Entamoeba invadens
MTNKKYTVD

SEQ ID NO: 2884850 - protein, 7 aa, Entamoeba invadens
MTNKTFE

SEQ ID NO: 2884851 - protein, 8 aa, Entamoeba invadens
MTNNAPPF

SEQ ID NO: 2884852 - protein, 5 aa, Entamoeba invadens
MTNTS

SEQ ID NO: 2884853 - protein, 4 aa, Entamoeba invadens
MTPD

SEQ ID NO: 2884854 - protein, 5 aa, Entamoeba invadens
MTPDS

SEQ ID NO: 2884855 - protein, 17 aa, Entamoeba invadens
MTPDSIEPETQLSPSLE

SEQ ID NO: 2884856 - protein, 30 aa, Entamoeba invadens
MTPEEKKKRQQDEERAKRESERIAAKKAAV

SEQ ID NO: 2884857 - protein, 20 aa, Entamoeba invadens
MTPEGCELTSNDKPYLTSCL

SEQ ID NO: 2884858 - protein, 11 aa, Entamoeba invadens
MTPENYPEDKG

SEQ ID NO: 2884859 - protein, 6 aa, Entamoeba invadens
MTPEPK

SEQ ID NO: 2884860 - protein, 16 aa, Entamoeba invadens
MTPGSIGRDGYMKRKD

SEQ ID NO: 2884861 - protein, 7 aa, Entamoeba invadens
MTPGTGE

SEQ ID NO: 2884862 - protein, 4 aa, Entamoeba invadens
MTPI

SEQ ID NO: 2884863 - protein, 38 aa, Entamoeba invadens
MTPKKSFKSAAAKAVKAVEEKSKEDEVSKQQTQMQQEE

SEQ ID NO: 2884864 - protein, 8 aa, Entamoeba invadens
MTPPTTKK

SEQ ID NO: 2884865 - protein, 6 aa, Entamoeba invadens
MTPQHG

SEQ ID NO: 2884866 - protein, 16 aa, Entamoeba invadens
MTPSSSSIVTTPTTLN

SEQ ID NO: 2884867 - protein, 6 aa, Entamoeba invadens
MTPSVN

SEQ ID NO: 2884868 - protein, 7 aa, Entamoeba invadens
MTPTHAP

SEQ ID NO: 2884869 - protein, 5 aa, Entamoeba invadens
MTQDT

SEQ ID NO: 2884870 - protein, 11 aa, Entamoeba invadens
MTQGSHPYNAK

SEQ ID NO: 2884871 - protein, 8 aa, Entamoeba invadens
MTQSNPKE

SEQ ID NO: 2884872 - protein, 7 aa, Entamoeba invadens
MTQTEQT

SEQ ID NO: 2884873 - protein, 6 aa, Entamoeba invadens
MTQTSN

SEQ ID NO: 2884874 - protein, 9 aa, Entamoeba invadens
MTRANSAPL

SEQ ID NO: 2884875 - protein, 8 aa, Entamoeba invadens
MTREKYDS

SEQ ID NO: 2884876 - protein, 10 aa, Entamoeba invadens
MTRQTEIDKE

SEQ ID NO: 2884877 - protein, 4 aa, Entamoeba invadens
MTRR

SEQ ID NO: 2884878 - protein, 14 aa, Entamoeba invadens
MTSEEDKKKLEEEV

SEQ ID NO: 2884879 - protein, 8 aa, Entamoeba invadens
MTSEEKSY

SEQ ID NO: 2884880 - protein, 15 aa, Entamoeba invadens
MTSEERSEKAPRSPV

SEQ ID NO: 2884881 - protein, 8 aa, Entamoeba invadens
MTSEGTIG

SEQ ID NO: 2884882 - protein, 9 aa, Entamoeba invadens
MTSESFSRM

SEQ ID NO: 2884883 - protein, 11 aa, Entamoeba invadens
MTSKADRSEIF

SEQ ID NO: 2884884 - protein, 12 aa, Entamoeba invadens
MTSKIEKPLTSP

SEQ ID NO: 2884885 - protein, 21 aa, Entamoeba invadens
MTSKREREVQSIKSKKSDDIT

SEQ ID NO: 2884886 - protein, 4 aa, Entamoeba invadens
MTSL

SEQ ID NO: 2884887 - protein, 30 aa, Entamoeba invadens
MTSLKKEDKIKKGKYKDITRETFKTKDYET

SEQ ID NO: 2884888 - protein, 14 aa, Entamoeba invadens
MTSLSDGVFCGNKL

SEQ ID NO: 2884889 - protein, 9 aa, Entamoeba invadens
MTSPQKREK

SEQ ID NO: 2884890 - protein, 18 aa, Entamoeba invadens
MTSPRFSDSKKVTKSERS

SEQ ID NO: 2884891 - protein, 6 aa, Entamoeba invadens
MTSPTM

SEQ ID NO: 2884892 - protein, 6 aa, Entamoeba invadens
MTSSAP

SEQ ID NO: 2884893 - protein, 5 aa, Entamoeba invadens
MTSSD

SEQ ID NO: 2884894 - protein, 19 aa, Entamoeba invadens
MTSTDKQEDCVGEKKSTLK

SEQ ID NO: 2884895 - protein, 5 aa, Entamoeba invadens
MTSTV

SEQ ID NO: 2884896 - protein, 4 aa, Entamoeba invadens
MTSY

SEQ ID NO: 2884897 - protein, 7 aa, Entamoeba invadens
MTSYGDA

SEQ ID NO: 2884898 - protein, 4 aa, Entamoeba invadens
MTTC

SEQ ID NO: 2884899 - protein, 4 aa, Entamoeba invadens
MTTG

SEQ ID NO: 2884900 - protein, 8 aa, Entamoeba invadens
MTTGREMT

SEQ ID NO: 2884901 - protein, 9 aa, Entamoeba invadens
MTTKATLDP

SEQ ID NO: 2884902 - protein, 15 aa, Entamoeba invadens
MTTPAQLKKPKKNDI

SEQ ID NO: 2884903 - protein, 13 aa, Entamoeba invadens
MTTPGIAGARLLH

SEQ ID NO: 2884904 - protein, 15 aa, Entamoeba invadens
MTTPGIAGARLLQKK

SEQ ID NO: 2884905 - protein, 11 aa, Entamoeba invadens
MTTPPDMTDAP

SEQ ID NO: 2884906 - protein, 33 aa, Entamoeba invadens
MTTSEDDMEAQDKRTKTDESLEKRSRNDEESIE

SEQ ID NO: 2884907 - protein, 11 aa, Entamoeba invadens
MTTTALGPNGG

SEQ ID NO: 2884908 - protein, 4 aa, Entamoeba invadens
MTVG

SEQ ID NO: 2884909 - protein, 4 aa, Entamoeba invadens
MTVT

SEQ ID NO: 2884910 - protein, 18 aa, Entamoeba invadens
MTVTTRASRIQEIETANT

SEQ ID NO: 2884911 - protein, 10 aa, Entamoeba invadens
MVETKGLDAA

SEQ ID NO: 2884912 - protein, 23 aa, Entamoeba invadens
MVGEPNVQARREKEISQGTYKKI

SEQ ID NO: 2884913 - protein, 6 aa, Entamoeba invadens
MVNGNN

SEQ ID NO: 2884914 - protein, 14 aa, Entamoeba invadens
MVNRDNKSIQTENG

SEQ ID NO: 2884915 - protein, 6 aa, Entamoeba invadens
MVPPPV

SEQ ID NO: 2884916 - protein, 8 aa, Entamoeba invadens
MVSDGENI

SEQ ID NO: 2884917 - protein, 14 aa, Entamoeba invadens
MYDERGSNVINIYY

SEQ ID NO: 2884918 - protein, 5 aa, Entamoeba invadens
MYGGN

SEQ ID NO: 2884919 - protein, 9 aa, Entamoeba invadens
MYKDTKSEL

SEQ ID NO: 2884920 - protein, 4 aa, Entamoeba invadens
MYPN

SEQ ID NO: 2884921 - protein, 54 aa, Entamoeba invadens
MYPPPMGAYPPPMGGAYPPPMGAYPPPMGAYPPPMGGYPPQAGAYPPMYPPPGY

SEQ ID NO: 2884922 - protein, 66 aa, Entamoeba invadens
MYPPQGQQQRQRINPGNTKKTRQQKSNNEPRSRPVPKKEEYQEEPISKPVPKPQEQVTDEMKNDLG

SEQ ID NO: 2884923 - protein, 18 aa, Entamoeba invadens
MYQQPQQPLFSQQPQQMY

SEQ ID NO: 2884924 - protein, 11 aa, Entamoeba invadens
MYQSNEGQTYC

SEQ ID NO: 2884925 - protein, 11 aa, Entamoeba invadens
MYSDSKKAAIS

SEQ ID NO: 2884926 - protein, 11 aa, Entamoeba invadens
MYTPNSPTNME

SEQ ID NO: 2884927 - protein, 8 aa, Entamoeba invadens
NAAKADSV

SEQ ID NO: 2884928 - protein, 11 aa, Entamoeba invadens
NAALEEKRKQM

SEQ ID NO: 2884929 - protein, 7 aa, Entamoeba invadens
NAANKQV

SEQ ID NO: 2884930 - protein, 6 aa, Entamoeba invadens
NAAQNL

SEQ ID NO: 2884931 - protein, 11 aa, Entamoeba invadens
NAARGCTSDGL

SEQ ID NO: 2884932 - protein, 9 aa, Entamoeba invadens
NAASGGNHF

SEQ ID NO: 2884933 - protein, 8 aa, Entamoeba invadens
NAASTSVN

SEQ ID NO: 2884934 - protein, 12 aa, Entamoeba invadens
NAAVRGECNNGR

SEQ ID NO: 2884935 - protein, 12 aa, Entamoeba invadens
NACNGPNNNQCT

SEQ ID NO: 2884936 - protein, 34 aa, Entamoeba invadens
NACQYPEEVSDEKPRQAQKHRQSATTRMTQTPSI

SEQ ID NO: 2884937 - protein, 8 aa, Entamoeba invadens
NADAENAD

SEQ ID NO: 2884938 - protein, 9 aa, Entamoeba invadens
NADAESKIN

SEQ ID NO: 2884939 - protein, 17 aa, Entamoeba invadens
NADAKTKELEVSQTSKY

SEQ ID NO: 2884940 - protein, 14 aa, Entamoeba invadens
NADDGYYGNPLLQT

SEQ ID NO: 2884941 - protein, 5 aa, Entamoeba invadens
NADDI

SEQ ID NO: 2884942 - protein, 7 aa, Entamoeba invadens
NADDTTD

SEQ ID NO: 2884943 - protein, 15 aa, Entamoeba invadens
NADENTWPKPPPCLG

SEQ ID NO: 2884944 - protein, 14 aa, Entamoeba invadens
NADERTLKRRNQWK

SEQ ID NO: 2884945 - protein, 7 aa, Entamoeba invadens
NADETAL

SEQ ID NO: 2884946 - protein, 6 aa, Entamoeba invadens
NADFDI

SEQ ID NO: 2884947 - protein, 8 aa, Entamoeba invadens
NADGDIDG

SEQ ID NO: 2884948 - protein, 6 aa, Entamoeba invadens
NADGSG

SEQ ID NO: 2884949 - protein, 8 aa, Entamoeba invadens
NADGSVPV

SEQ ID NO: 2884950 - protein, 8 aa, Entamoeba invadens
NADGTPNL

SEQ ID NO: 2884951 - protein, 7 aa, Entamoeba invadens
NADGYYE

SEQ ID NO: 2884952 - protein, 12 aa, Entamoeba invadens
NADKTKWSTDPY

SEQ ID NO: 2884953 - protein, 12 aa, Entamoeba invadens
NADKTYSNYHPC

SEQ ID NO: 2884954 - protein, 9 aa, Entamoeba invadens
NADLSADQS

SEQ ID NO: 2884955 - protein, 15 aa, Entamoeba invadens
NADNDNLTKAKSVVD

SEQ ID NO: 2884956 - protein, 12 aa, Entamoeba invadens
NADQARQNGKNV

SEQ ID NO: 2884957 - protein, 6 aa, Entamoeba invadens
NADRYR

SEQ ID NO: 2884958 - protein, 11 aa, Entamoeba invadens
NADSQTNKYTV

SEQ ID NO: 2884959 - protein, 6 aa, Entamoeba invadens
NADSVS

SEQ ID NO: 2884960 - protein, 6 aa, Entamoeba invadens
NADTCT

SEQ ID NO: 2884961 - protein, 9 aa, Entamoeba invadens
NADTKSQQI

SEQ ID NO: 2884962 - protein, 7 aa, Entamoeba invadens
NADTNKV

SEQ ID NO: 2884963 - protein, 4 aa, Entamoeba invadens
NADY

SEQ ID NO: 2884964 - protein, 5 aa, Entamoeba invadens
NAEAF

SEQ ID NO: 2884965 - protein, 9 aa, Entamoeba invadens
NAEAPKLPK

SEQ ID NO: 2884966 - protein, 9 aa, Entamoeba invadens
NAEASDTDF

SEQ ID NO: 2884967 - protein, 24 aa, Entamoeba invadens
NAEDEREKAVKKLKNELRAVGKAS

SEQ ID NO: 2884968 - protein, 5 aa, Entamoeba invadens
NAEDI

SEQ ID NO: 2884969 - protein, 11 aa, Entamoeba invadens
NAEDLSNTSLN

SEQ ID NO: 2884970 - protein, 31 aa, Entamoeba invadens
NAEDRGDVEEDDEEEEEEEEGEEENEEAEEE

SEQ ID NO: 2884971 - protein, 17 aa, Entamoeba invadens
NAEDSSKACDDVNGTFV

SEQ ID NO: 2884972 - protein, 5 aa, Entamoeba invadens
NAEEA

SEQ ID NO: 2884973 - protein, 8 aa, Entamoeba invadens
NAEEKDVD

SEQ ID NO: 2884974 - protein, 9 aa, Entamoeba invadens
NAEEKTFTE

SEQ ID NO: 2884975 - protein, 4 aa, Entamoeba invadens
NAEG

SEQ ID NO: 2884976 - protein, 6 aa, Entamoeba invadens
NAEGKV

SEQ ID NO: 2884977 - protein, 9 aa, Entamoeba invadens
NAEHEMPTR

SEQ ID NO: 2884978 - protein, 5 aa, Entamoeba invadens
NAEIE

SEQ ID NO: 2884979 - protein, 7 aa, Entamoeba invadens
NAEIGTF

SEQ ID NO: 2884980 - protein, 15 aa, Entamoeba invadens
NAEITRKTIDNGDNE

SEQ ID NO: 2884981 - protein, 8 aa, Entamoeba invadens
NAEKELDG

SEQ ID NO: 2884982 - protein, 42 aa, Entamoeba invadens
NAEKLESEPNEQSVKKDENLVQTESVPSHEEKAEEKEEKKEK

SEQ ID NO: 2884983 - protein, 5 aa, Entamoeba invadens
NAEKQ

SEQ ID NO: 2884984 - protein, 6 aa, Entamoeba invadens
NAEKSE

SEQ ID NO: 2884985 - protein, 65 aa, Entamoeba invadens
NAEKSEKEDSKTLSTDTALTSQDDSEDDSDTNSKEEKGCTEQKDEKKSTKRHKEKKSKKEKKGCD

SEQ ID NO: 2884986 - protein, 9 aa, Entamoeba invadens
NAEKSLTKR

SEQ ID NO: 2884987 - protein, 19 aa, Entamoeba invadens
NAEKSREKIEKNEKERCGE

SEQ ID NO: 2884988 - protein, 12 aa, Entamoeba invadens
NAEKSRKEAPNV

SEQ ID NO: 2884989 - protein, 20 aa, Entamoeba invadens
NAELKKTKNRLKKMQKDDSD

SEQ ID NO: 2884990 - protein, 5 aa, Entamoeba invadens
NAELR

SEQ ID NO: 2884991 - protein, 6 aa, Entamoeba invadens
NAENAF

SEQ ID NO: 2884992 - protein, 8 aa, Entamoeba invadens
NAENEFTI

SEQ ID NO: 2884993 - protein, 9 aa, Entamoeba invadens
NAENMSQAK

SEQ ID NO: 2884994 - protein, 6 aa, Entamoeba invadens
NAENQP

SEQ ID NO: 2884995 - protein, 12 aa, Entamoeba invadens
NAEPIGEEPRGF

SEQ ID NO: 2884996 - protein, 6 aa, Entamoeba invadens
NAEPKV

SEQ ID NO: 2884997 - protein, 6 aa, Entamoeba invadens
NAEPLT

SEQ ID NO: 2884998 - protein, 5 aa, Entamoeba invadens
NAEQD

SEQ ID NO: 2884999 - protein, 9 aa, Entamoeba invadens
NAESGTAAF

SEQ ID NO: 2885000 - protein, 9 aa, Entamoeba invadens
NAETTDPKT

SEQ ID NO: 2885001 - protein, 8 aa, Entamoeba invadens
NAEYNPKR

SEQ ID NO: 2885002 - protein, 6 aa, Entamoeba invadens
NAEYPV

SEQ ID NO: 2885003 - protein, 5 aa, Entamoeba invadens
NAEYT

SEQ ID NO: 2885004 - protein, 9 aa, Entamoeba invadens
NAFAKGKTK

SEQ ID NO: 2885005 - protein, 38 aa, Entamoeba invadens
NAFAQPQQQQSGLGGTFGAQPNAFGATGAFTQQPTSSA

SEQ ID NO: 2885006 - protein, 8 aa, Entamoeba invadens
NAFDPAGL

SEQ ID NO: 2885007 - protein, 6 aa, Entamoeba invadens
NAFEKE

SEQ ID NO: 2885008 - protein, 7 aa, Entamoeba invadens
NAFENAT

SEQ ID NO: 2885009 - protein, 7 aa, Entamoeba invadens
NAFENST

SEQ ID NO: 2885010 - protein, 10 aa, Entamoeba invadens
NAFPAPDVGT

SEQ ID NO: 2885011 - protein, 6 aa, Entamoeba invadens
NAFPNE

SEQ ID NO: 2885012 - protein, 8 aa, Entamoeba invadens
NAFPQESK

SEQ ID NO: 2885013 - protein, 7 aa, Entamoeba invadens
NAFSSAD

SEQ ID NO: 2885014 - protein, 6 aa, Entamoeba invadens
NAFSSS

SEQ ID NO: 2885015 - protein, 5 aa, Entamoeba invadens
NAFVE

SEQ ID NO: 2885016 - protein, 5 aa, Entamoeba invadens
NAGDS

SEQ ID NO: 2885017 - protein, 6 aa, Entamoeba invadens
NAGDSR

SEQ ID NO: 2885018 - protein, 7 aa, Entamoeba invadens
NAGELEA

SEQ ID NO: 2885019 - protein, 15 aa, Entamoeba invadens
NAGHQDFKRQIGSQK

SEQ ID NO: 2885020 - protein, 5 aa, Entamoeba invadens
NAGKE

SEQ ID NO: 2885021 - protein, 6 aa, Entamoeba invadens
NAGKRE

SEQ ID NO: 2885022 - protein, 6 aa, Entamoeba invadens
NAGKTS

SEQ ID NO: 2885023 - protein, 6 aa, Entamoeba invadens
NAGKTT

SEQ ID NO: 2885024 - protein, 5 aa, Entamoeba invadens
NAGLN

SEQ ID NO: 2885025 - protein, 5 aa, Entamoeba invadens
NAGNN

SEQ ID NO: 2885026 - protein, 9 aa, Entamoeba invadens
NAGPGTNGS

SEQ ID NO: 2885027 - protein, 5 aa, Entamoeba invadens
NAGQV

SEQ ID NO: 2885028 - protein, 13 aa, Entamoeba invadens
NAGRNYVTNGDMR

SEQ ID NO: 2885029 - protein, 8 aa, Entamoeba invadens
NAGSDDSF

SEQ ID NO: 2885030 - protein, 7 aa, Entamoeba invadens
NAGTERF

SEQ ID NO: 2885031 - protein, 7 aa, Entamoeba invadens
NAGYDSA

SEQ ID NO: 2885032 - protein, 27 aa, Entamoeba invadens
NAGYQQQQFQQSYPQNTTGGGYSYNPY

SEQ ID NO: 2885033 - protein, 5 aa, Entamoeba invadens
NAHEI

SEQ ID NO: 2885034 - protein, 6 aa, Entamoeba invadens
NAHGNN

SEQ ID NO: 2885035 - protein, 6 aa, Entamoeba invadens
NAHNNS

SEQ ID NO: 2885036 - protein, 67 aa, Entamoeba invadens
NAHQPTTDDTYGKGTEKTTRKTLNPKKASRRLSNKNIDDNTKMTASESGRRKSIKRVDTGKDKPVSK

SEQ ID NO: 2885037 - protein, 13 aa, Entamoeba invadens
NAIDTAKKNGILP

SEQ ID NO: 2885038 - protein, 7 aa, Entamoeba invadens
NAIENSE

SEQ ID NO: 2885039 - protein, 7 aa, Entamoeba invadens
NAINRTT

SEQ ID NO: 2885040 - protein, 4 aa, Entamoeba invadens
NAIP

SEQ ID NO: 2885041 - protein, 11 aa, Entamoeba invadens
NAIPAIASSPT

SEQ ID NO: 2885042 - protein, 12 aa, Entamoeba invadens
NAIPGGMPNGMP

SEQ ID NO: 2885043 - protein, 10 aa, Entamoeba invadens
NAIPKTNEIG

SEQ ID NO: 2885044 - protein, 5 aa, Entamoeba invadens
NAIPS

SEQ ID NO: 2885045 - protein, 6 aa, Entamoeba invadens
NAISKE

SEQ ID NO: 2885046 - protein, 5 aa, Entamoeba invadens
NAIST

SEQ ID NO: 2885047 - protein, 7 aa, Entamoeba invadens
NAITKSN

SEQ ID NO: 2885048 - protein, 4 aa, Entamoeba invadens
NAKA

SEQ ID NO: 2885049 - protein, 4 aa, Entamoeba invadens
NAKD

SEQ ID NO: 2885050 - protein, 14 aa, Entamoeba invadens
NAKDLQKHVASVHK

SEQ ID NO: 2885051 - protein, 10 aa, Entamoeba invadens
NAKDVTKKDL

SEQ ID NO: 2885052 - protein, 12 aa, Entamoeba invadens
NAKEEDKESKHM

SEQ ID NO: 2885053 - protein, 5 aa, Entamoeba invadens
NAKEG

SEQ ID NO: 2885054 - protein, 5 aa, Entamoeba invadens
NAKEI

SEQ ID NO: 2885055 - protein, 7 aa, Entamoeba invadens
NAKELDD

SEQ ID NO: 2885056 - protein, 8 aa, Entamoeba invadens
NAKENYAD

SEQ ID NO: 2885057 - protein, 8 aa, Entamoeba invadens
NAKESSLE

SEQ ID NO: 2885058 - protein, 11 aa, Entamoeba invadens
NAKESSTLSRS

SEQ ID NO: 2885059 - protein, 9 aa, Entamoeba invadens
NAKGEDEKV

SEQ ID NO: 2885060 - protein, 6 aa, Entamoeba invadens
NAKIEE

SEQ ID NO: 2885061 - protein, 12 aa, Entamoeba invadens
NAKKKIDEKKKD

SEQ ID NO: 2885062 - protein, 7 aa, Entamoeba invadens
NAKKNSV

SEQ ID NO: 2885063 - protein, 14 aa, Entamoeba invadens
NAKKTDIKKNPELK

SEQ ID NO: 2885064 - protein, 5 aa, Entamoeba invadens
NAKND

SEQ ID NO: 2885065 - protein, 33 aa, Entamoeba invadens
NAKNENDELKTTFNSQEQKLKEAETTQNEMQSN

SEQ ID NO: 2885066 - protein, 17 aa, Entamoeba invadens
NAKNKKTLEDDSSDVKI

SEQ ID NO: 2885067 - protein, 7 aa, Entamoeba invadens
NAKNPTV

SEQ ID NO: 2885068 - protein, 14 aa, Entamoeba invadens
NAKNRTCADCGDTA

SEQ ID NO: 2885069 - protein, 46 aa, Entamoeba invadens
NAKPESGVETTTEINKKECVNRNEMETTTNSQQQEQQQNTTVTPKD

SEQ ID NO: 2885070 - protein, 7 aa, Entamoeba invadens
NAKPTNV

SEQ ID NO: 2885071 - protein, 7 aa, Entamoeba invadens
NAKQRSE

SEQ ID NO: 2885072 - protein, 8 aa, Entamoeba invadens
NAKRTDDK

SEQ ID NO: 2885073 - protein, 15 aa, Entamoeba invadens
NAKSEIKETLSSEMA

SEQ ID NO: 2885074 - protein, 10 aa, Entamoeba invadens
NAKSLDESKL

SEQ ID NO: 2885075 - protein, 8 aa, Entamoeba invadens
NAKSPTTC

SEQ ID NO: 2885076 - protein, 8 aa, Entamoeba invadens
NAKTETNI

SEQ ID NO: 2885077 - protein, 11 aa, Entamoeba invadens
NAKTQDEKDKA

SEQ ID NO: 2885078 - protein, 8 aa, Entamoeba invadens
NAKTRSDL

SEQ ID NO: 2885079 - protein, 5 aa, Entamoeba invadens
NAKYK

SEQ ID NO: 2885080 - protein, 13 aa, Entamoeba invadens
NALDEESFNTQKE

SEQ ID NO: 2885081 - protein, 8 aa, Entamoeba invadens
NALDTLPD

SEQ ID NO: 2885082 - protein, 4 aa, Entamoeba invadens
NALE

SEQ ID NO: 2885083 - protein, 10 aa, Entamoeba invadens
NALESDHKPV

SEQ ID NO: 2885084 - protein, 4 aa, Entamoeba invadens
NALK

SEQ ID NO: 2885085 - protein, 9 aa, Entamoeba invadens
NALKEESRY

SEQ ID NO: 2885086 - protein, 11 aa, Entamoeba invadens
NALNGNNTDFK

SEQ ID NO: 2885087 - protein, 11 aa, Entamoeba invadens
NALPPDRDYSS

SEQ ID NO: 2885088 - protein, 27 aa, Entamoeba invadens
NALQKKPQLEKKERERAVPKITQRAPR

SEQ ID NO: 2885089 - protein, 19 aa, Entamoeba invadens
NALQRQNTLPAESTDELQR

SEQ ID NO: 2885090 - protein, 11 aa, Entamoeba invadens
NALTETKEQAI

SEQ ID NO: 2885091 - protein, 17 aa, Entamoeba invadens
NALTTQSNEEEKRKREA

SEQ ID NO: 2885092 - protein, 6 aa, Entamoeba invadens
NAMGRN

SEQ ID NO: 2885093 - protein, 6 aa, Entamoeba invadens
NAMTPS

SEQ ID NO: 2885094 - protein, 6 aa, Entamoeba invadens
NANAPD

SEQ ID NO: 2885095 - protein, 9 aa, Entamoeba invadens
NANCSSSES

SEQ ID NO: 2885096 - protein, 8 aa, Entamoeba invadens
NANDAERC

SEQ ID NO: 2885097 - protein, 8 aa, Entamoeba invadens
NANDKEMI

SEQ ID NO: 2885098 - protein, 4 aa, Entamoeba invadens
NANE

SEQ ID NO: 2885099 - protein, 11 aa, Entamoeba invadens
NANEDEIRAEI

SEQ ID NO: 2885100 - protein, 12 aa, Entamoeba invadens
NANETPKTPGNL

SEQ ID NO: 2885101 - protein, 4 aa, Entamoeba invadens
NANF

SEQ ID NO: 2885102 - protein, 8 aa, Entamoeba invadens
NANGNKFD

SEQ ID NO: 2885103 - protein, 8 aa, Entamoeba invadens
NANGSRKL

SEQ ID NO: 2885104 - protein, 7 aa, Entamoeba invadens
NANGYYE

SEQ ID NO: 2885105 - protein, 8 aa, Entamoeba invadens
NANKGNNG

SEQ ID NO: 2885106 - protein, 7 aa, Entamoeba invadens
NANKIDQ

SEQ ID NO: 2885107 - protein, 31 aa, Entamoeba invadens
NANKKDKSTAKQTAALKEKEFKDQAEKTELT

SEQ ID NO: 2885108 - protein, 14 aa, Entamoeba invadens
NANKNKKITTHGKE

SEQ ID NO: 2885109 - protein, 20 aa, Entamoeba invadens
NANNDGSEVEEDEFEEEQQT

SEQ ID NO: 2885110 - protein, 12 aa, Entamoeba invadens
NANNITATESGF

SEQ ID NO: 2885111 - protein, 7 aa, Entamoeba invadens
NANNQKI

SEQ ID NO: 2885112 - protein, 7 aa, Entamoeba invadens
NANNRIE

SEQ ID NO: 2885113 - protein, 5 aa, Entamoeba invadens
NANNS

SEQ ID NO: 2885114 - protein, 5 aa, Entamoeba invadens
NANPL

SEQ ID NO: 2885115 - protein, 6 aa, Entamoeba invadens
NANQTK

SEQ ID NO: 2885116 - protein, 4 aa, Entamoeba invadens
NANS

SEQ ID NO: 2885117 - protein, 9 aa, Entamoeba invadens
NANSSKQMQ

SEQ ID NO: 2885118 - protein, 6 aa, Entamoeba invadens
NANSVA

SEQ ID NO: 2885119 - protein, 10 aa, Entamoeba invadens
NANTAEKFKE

SEQ ID NO: 2885120 - protein, 40 aa, Entamoeba invadens
NANTDIEERLNKNEKKMKEMKSERDCDKSTITKLEKENKE

SEQ ID NO: 2885121 - protein, 40 aa, Entamoeba invadens
NANTDIEERLNKNENKIKEMKSERDCDKSTITKLEKENKE

SEQ ID NO: 2885122 - protein, 7 aa, Entamoeba invadens
NANTEDT

SEQ ID NO: 2885123 - protein, 13 aa, Entamoeba invadens
NANTKPNNGNGTT

SEQ ID NO: 2885124 - protein, 7 aa, Entamoeba invadens
NANTNED

SEQ ID NO: 2885125 - protein, 35 aa, Entamoeba invadens
NANTTSEDDTEELDKKIEATKAKEVAPMEKVEKIE

SEQ ID NO: 2885126 - protein, 6 aa, Entamoeba invadens
NANYDD

SEQ ID NO: 2885127 - protein, 7 aa, Entamoeba invadens
NANYNDN

SEQ ID NO: 2885128 - protein, 7 aa, Entamoeba invadens
NAPDASI

SEQ ID NO: 2885129 - protein, 6 aa, Entamoeba invadens
NAPDLS

SEQ ID NO: 2885130 - protein, 5 aa, Entamoeba invadens
NAPER

SEQ ID NO: 2885131 - protein, 7 aa, Entamoeba invadens
NAPGTFE

SEQ ID NO: 2885132 - protein, 9 aa, Entamoeba invadens
NAPHPQQED

SEQ ID NO: 2885133 - protein, 5 aa, Entamoeba invadens
NAPKN

SEQ ID NO: 2885134 - protein, 7 aa, Entamoeba invadens
NAPKSGE

SEQ ID NO: 2885135 - protein, 10 aa, Entamoeba invadens
NAPKTSGPFL

SEQ ID NO: 2885136 - protein, 4 aa, Entamoeba invadens
NAPL

SEQ ID NO: 2885137 - protein, 7 aa, Entamoeba invadens
NAPNLPT

SEQ ID NO: 2885138 - protein, 5 aa, Entamoeba invadens
NAPPI

SEQ ID NO: 2885139 - protein, 16 aa, Entamoeba invadens
NAPPLAPSATPSVPQN

SEQ ID NO: 2885140 - protein, 11 aa, Entamoeba invadens
NAPPLSPDTDK

SEQ ID NO: 2885141 - protein, 17 aa, Entamoeba invadens
NAPPPKLMTPDDATPAF

SEQ ID NO: 2885142 - protein, 8 aa, Entamoeba invadens
NAPPQQAL

SEQ ID NO: 2885143 - protein, 16 aa, Entamoeba invadens
NAPPQRGGENSVEEKL

SEQ ID NO: 2885144 - protein, 14 aa, Entamoeba invadens
NAPQGANGAELEKA

SEQ ID NO: 2885145 - protein, 14 aa, Entamoeba invadens
NAPQGAQSAEMAKA

SEQ ID NO: 2885146 - protein, 12 aa, Entamoeba invadens
NAPQGGNIEGIE

SEQ ID NO: 2885147 - protein, 13 aa, Entamoeba invadens
NAPQGGNTEELAK

SEQ ID NO: 2885148 - protein, 10 aa, Entamoeba invadens
NAPQKEEGLA

SEQ ID NO: 2885149 - protein, 5 aa, Entamoeba invadens
NAPQV

SEQ ID NO: 2885150 - protein, 16 aa, Entamoeba invadens
NAPRNTLKSKEQPNTA

SEQ ID NO: 2885151 - protein, 9 aa, Entamoeba invadens
NAPTDDYYD

SEQ ID NO: 2885152 - protein, 6 aa, Entamoeba invadens
NAPTNV

SEQ ID NO: 2885153 - protein, 6 aa, Entamoeba invadens
NAPTQQ

SEQ ID NO: 2885154 - protein, 13 aa, Entamoeba invadens
NAPVSSRKGNVPS

SEQ ID NO: 2885155 - protein, 9 aa, Entamoeba invadens
NAPYGEEPE

SEQ ID NO: 2885156 - protein, 8 aa, Entamoeba invadens
NAQAKQRS

SEQ ID NO: 2885157 - protein, 9 aa, Entamoeba invadens
NAQCRDNDF

SEQ ID NO: 2885158 - protein, 25 aa, Entamoeba invadens
NAQESIPDNNNIKSGQGNQDSPFEI

SEQ ID NO: 2885159 - protein, 6 aa, Entamoeba invadens
NAQETA

SEQ ID NO: 2885160 - protein, 6 aa, Entamoeba invadens
NAQETQ

SEQ ID NO: 2885161 - protein, 7 aa, Entamoeba invadens
NAQGEDV

SEQ ID NO: 2885162 - protein, 6 aa, Entamoeba invadens
NAQGKT

SEQ ID NO: 2885163 - protein, 16 aa, Entamoeba invadens
NAQGVEGSVPMNYLAK

SEQ ID NO: 2885164 - protein, 7 aa, Entamoeba invadens
NAQKEGY

SEQ ID NO: 2885165 - protein, 38 aa, Entamoeba invadens
NAQKELQDALNKEKSERENLTNENKSLNEELNNTKEEK

SEQ ID NO: 2885166 - protein, 8 aa, Entamoeba invadens
NAQKTQVP

SEQ ID NO: 2885167 - protein, 17 aa, Entamoeba invadens
NAQNALKTAQQNSTLQK

SEQ ID NO: 2885168 - protein, 5 aa, Entamoeba invadens
NAQNN

SEQ ID NO: 2885169 - protein, 7 aa, Entamoeba invadens
NAQPNVT

SEQ ID NO: 2885170 - protein, 11 aa, Entamoeba invadens
NAQPSGEESDL

SEQ ID NO: 2885171 - protein, 4 aa, Entamoeba invadens
NAQQ

SEQ ID NO: 2885172 - protein, 6 aa, Entamoeba invadens
NAQSKK

SEQ ID NO: 2885173 - protein, 11 aa, Entamoeba invadens
NAQTAIDATKV

SEQ ID NO: 2885174 - protein, 9 aa, Entamoeba invadens
NAQTSPGKV

SEQ ID NO: 2885175 - protein, 17 aa, Entamoeba invadens
NAQVPSVENSPPCDEKE

SEQ ID NO: 2885176 - protein, 12 aa, Entamoeba invadens
NAQYKGIFEHNF

SEQ ID NO: 2885177 - protein, 6 aa, Entamoeba invadens
NARANN

SEQ ID NO: 2885178 - protein, 13 aa, Entamoeba invadens
NARINSKYSEAAC

SEQ ID NO: 2885179 - protein, 27 aa, Entamoeba invadens
NARITQTRKEGVQKLREKEQQAARTSQ

SEQ ID NO: 2885180 - protein, 6 aa, Entamoeba invadens
NARKTR

SEQ ID NO: 2885181 - protein, 7 aa, Entamoeba invadens
NARNAKM

SEQ ID NO: 2885182 - protein, 8 aa, Entamoeba invadens
NARNELQT

SEQ ID NO: 2885183 - protein, 5 aa, Entamoeba invadens
NARPT

SEQ ID NO: 2885184 - protein, 13 aa, Entamoeba invadens
NARSRKDDEISRE

SEQ ID NO: 2885185 - protein, 5 aa, Entamoeba invadens
NARST

SEQ ID NO: 2885186 - protein, 11 aa, Entamoeba invadens
NARTSATQEKN

SEQ ID NO: 2885187 - protein, 8 aa, Entamoeba invadens
NARTSGAL

SEQ ID NO: 2885188 - protein, 14 aa, Entamoeba invadens
NARTYDKKGVTIPS

SEQ ID NO: 2885189 - protein, 11 aa, Entamoeba invadens
NARVPKAEKKL

SEQ ID NO: 2885190 - protein, 5 aa, Entamoeba invadens
NARYQ

SEQ ID NO: 2885191 - protein, 4 aa, Entamoeba invadens
NASA

SEQ ID NO: 2885192 - protein, 13 aa, Entamoeba invadens
NASAPEPCKKRKV

SEQ ID NO: 2885193 - protein, 7 aa, Entamoeba invadens
NASARLT

SEQ ID NO: 2885194 - protein, 18 aa, Entamoeba invadens
NASDKTTNITNCNGEAKE

SEQ ID NO: 2885195 - protein, 6 aa, Entamoeba invadens
NASDRA

SEQ ID NO: 2885196 - protein, 11 aa, Entamoeba invadens
NASEFAEGEIK

SEQ ID NO: 2885197 - protein, 8 aa, Entamoeba invadens
NASERLEP

SEQ ID NO: 2885198 - protein, 6 aa, Entamoeba invadens
NASFPH

SEQ ID NO: 2885199 - protein, 5 aa, Entamoeba invadens
NASGE

SEQ ID NO: 2885200 - protein, 33 aa, Entamoeba invadens
NASGQAQGNVGQGQNVGMQNQSAGGIQQQQNLN

SEQ ID NO: 2885201 - protein, 13 aa, Entamoeba invadens
NASGVDVENKIKA

SEQ ID NO: 2885202 - protein, 6 aa, Entamoeba invadens
NASKSV

SEQ ID NO: 2885203 - protein, 8 aa, Entamoeba invadens
NASKTSGR

SEQ ID NO: 2885204 - protein, 9 aa, Entamoeba invadens
NASKTSNEM

SEQ ID NO: 2885205 - protein, 6 aa, Entamoeba invadens
NASPKF

SEQ ID NO: 2885206 - protein, 6 aa, Entamoeba invadens
NASPNK

SEQ ID NO: 2885207 - protein, 5 aa, Entamoeba invadens
NASQI

SEQ ID NO: 2885208 - protein, 8 aa, Entamoeba invadens
NASQTSSF

SEQ ID NO: 2885209 - protein, 61 aa, Entamoeba invadens
NASQVNTEKSDNEMSQDNDSTSEKEKESESSTKMSEDSESSSDGSKDRKTHKPTLSQRERR

SEQ ID NO: 2885210 - protein, 10 aa, Entamoeba invadens
NASSSSAFSN

SEQ ID NO: 2885211 - protein, 7 aa, Entamoeba invadens
NASVARE

SEQ ID NO: 2885212 - protein, 9 aa, Entamoeba invadens
NASVTVQPP

SEQ ID NO: 2885213 - protein, 8 aa, Entamoeba invadens
NATAQDGI

SEQ ID NO: 2885214 - protein, 8 aa, Entamoeba invadens
NATDAQRT

SEQ ID NO: 2885215 - protein, 7 aa, Entamoeba invadens
NATDEKD

SEQ ID NO: 2885216 - protein, 13 aa, Entamoeba invadens
NATEEKNNEEITK

SEQ ID NO: 2885217 - protein, 9 aa, Entamoeba invadens
NATEKLRQK

SEQ ID NO: 2885218 - protein, 7 aa, Entamoeba invadens
NATESEK

SEQ ID NO: 2885219 - protein, 8 aa, Entamoeba invadens
NATESEQQ

SEQ ID NO: 2885220 - protein, 10 aa, Entamoeba invadens
NATESETSEM

SEQ ID NO: 2885221 - protein, 10 aa, Entamoeba invadens
NATESQFGET

SEQ ID NO: 2885222 - protein, 6 aa, Entamoeba invadens
NATISS

SEQ ID NO: 2885223 - protein, 7 aa, Entamoeba invadens
NATKDPA

SEQ ID NO: 2885224 - protein, 6 aa, Entamoeba invadens
NATKDT

SEQ ID NO: 2885225 - protein, 7 aa, Entamoeba invadens
NATKEEI

SEQ ID NO: 2885226 - protein, 15 aa, Entamoeba invadens
NATKKTKPNLNEGDS

SEQ ID NO: 2885227 - protein, 7 aa, Entamoeba invadens
NATKMSN

SEQ ID NO: 2885228 - protein, 8 aa, Entamoeba invadens
NATKSTVE

SEQ ID NO: 2885229 - protein, 6 aa, Entamoeba invadens
NATNMR

SEQ ID NO: 2885230 - protein, 6 aa, Entamoeba invadens
NATNQI

SEQ ID NO: 2885231 - protein, 11 aa, Entamoeba invadens
NATNTAKKGEF

SEQ ID NO: 2885232 - protein, 6 aa, Entamoeba invadens
NATNTI

SEQ ID NO: 2885233 - protein, 6 aa, Entamoeba invadens
NATPTD

SEQ ID NO: 2885234 - protein, 7 aa, Entamoeba invadens
NATQKLN

SEQ ID NO: 2885235 - protein, 14 aa, Entamoeba invadens
NATQNNGGDDVGKL

SEQ ID NO: 2885236 - protein, 10 aa, Entamoeba invadens
NATQTKIDTE

SEQ ID NO: 2885237 - protein, 8 aa, Entamoeba invadens
NATQTTID

SEQ ID NO: 2885238 - protein, 7 aa, Entamoeba invadens
NATRCSV

SEQ ID NO: 2885239 - protein, 6 aa, Entamoeba invadens
NATSDD

SEQ ID NO: 2885240 - protein, 4 aa, Entamoeba invadens
NATT

SEQ ID NO: 2885241 - protein, 5 aa, Entamoeba invadens
NATTA

SEQ ID NO: 2885242 - protein, 6 aa, Entamoeba invadens
NATTAH

SEQ ID NO: 2885243 - protein, 5 aa, Entamoeba invadens
NATTK

SEQ ID NO: 2885244 - protein, 9 aa, Entamoeba invadens
NATTKVDPE

SEQ ID NO: 2885245 - protein, 9 aa, Entamoeba invadens
NATTTCEST

SEQ ID NO: 2885246 - protein, 13 aa, Entamoeba invadens
NATTTPSNHPFPP

SEQ ID NO: 2885247 - protein, 9 aa, Entamoeba invadens
NAVGYSDDN

SEQ ID NO: 2885248 - protein, 13 aa, Entamoeba invadens
NAVKEKSRNEKQN

SEQ ID NO: 2885249 - protein, 21 aa, Entamoeba invadens
NAVKNMTEEEFNKAAQEQIEE

SEQ ID NO: 2885250 - protein, 10 aa, Entamoeba invadens
NAVKNNTTTL

SEQ ID NO: 2885251 - protein, 8 aa, Entamoeba invadens
NAVSGGEL

SEQ ID NO: 2885252 - protein, 10 aa, Entamoeba invadens
NAVTDAESEG

SEQ ID NO: 2885253 - protein, 6 aa, Entamoeba invadens
NAVTPN

SEQ ID NO: 2885254 - protein, 6 aa, Entamoeba invadens
NAVVGN

SEQ ID NO: 2885255 - protein, 6 aa, Entamoeba invadens
NAVYNK

SEQ ID NO: 2885256 - protein, 7 aa, Entamoeba invadens
NAWKSNT

SEQ ID NO: 2885257 - protein, 11 aa, Entamoeba invadens
NAWPSSPTLTK

SEQ ID NO: 2885258 - protein, 12 aa, Entamoeba invadens
NAWTKSGAYTGE

SEQ ID NO: 2885259 - protein, 5 aa, Entamoeba invadens
NAYGG

SEQ ID NO: 2885260 - protein, 7 aa, Entamoeba invadens
NAYGTDV

SEQ ID NO: 2885261 - protein, 5 aa, Entamoeba invadens
NAYKT

SEQ ID NO: 2885262 - protein, 10 aa, Entamoeba invadens
NAYNEGVDLS

SEQ ID NO: 2885263 - protein, 7 aa, Entamoeba invadens
NAYSGCQ

SEQ ID NO: 2885264 - protein, 8 aa, Entamoeba invadens
NCAKYNPE

SEQ ID NO: 2885265 - protein, 17 aa, Entamoeba invadens
NCAPDTFTTTKMYALEW

SEQ ID NO: 2885266 - protein, 9 aa, Entamoeba invadens
NCATNNTRT

SEQ ID NO: 2885267 - protein, 5 aa, Entamoeba invadens
NCDAR

SEQ ID NO: 2885268 - protein, 12 aa, Entamoeba invadens
NCDGTLDKTEIT

SEQ ID NO: 2885269 - protein, 8 aa, Entamoeba invadens
NCDGTSGI

SEQ ID NO: 2885270 - protein, 7 aa, Entamoeba invadens
NCDNDNV

SEQ ID NO: 2885271 - protein, 5 aa, Entamoeba invadens
NCDTN

SEQ ID NO: 2885272 - protein, 5 aa, Entamoeba invadens
NCELP

SEQ ID NO: 2885273 - protein, 7 aa, Entamoeba invadens
NCENVET

SEQ ID NO: 2885274 - protein, 10 aa, Entamoeba invadens
NCEQCDTNAT

SEQ ID NO: 2885275 - protein, 8 aa, Entamoeba invadens
NCGDGNCH

SEQ ID NO: 2885276 - protein, 4 aa, Entamoeba invadens
NCGK

SEQ ID NO: 2885277 - protein, 21 aa, Entamoeba invadens
NCGNDGEYPCKPYSTEEESDT

SEQ ID NO: 2885278 - protein, 15 aa, Entamoeba invadens
NCGNDMKSKEIESKK

SEQ ID NO: 2885279 - protein, 8 aa, Entamoeba invadens
NCGTPEDA

SEQ ID NO: 2885280 - protein, 8 aa, Entamoeba invadens
NCHDRTAL

SEQ ID NO: 2885281 - protein, 5 aa, Entamoeba invadens
NCHQD

SEQ ID NO: 2885282 - protein, 4 aa, Entamoeba invadens
NCKE

SEQ ID NO: 2885283 - protein, 10 aa, Entamoeba invadens
NCKEKKKKLS

SEQ ID NO: 2885284 - protein, 16 aa, Entamoeba invadens
NCKEKSLAGCQECSNG

SEQ ID NO: 2885285 - protein, 8 aa, Entamoeba invadens
NCKGSDEY

SEQ ID NO: 2885286 - protein, 12 aa, Entamoeba invadens
NCKNEQIPSGGV

SEQ ID NO: 2885287 - protein, 9 aa, Entamoeba invadens
NCKNGTYKL

SEQ ID NO: 2885288 - protein, 13 aa, Entamoeba invadens
NCKPKEGLSPVKN

SEQ ID NO: 2885289 - protein, 6 aa, Entamoeba invadens
NCKSKN

SEQ ID NO: 2885290 - protein, 7 aa, Entamoeba invadens
NCKSPSD

SEQ ID NO: 2885291 - protein, 8 aa, Entamoeba invadens
NCKSTNGW

SEQ ID NO: 2885292 - protein, 8 aa, Entamoeba invadens
NCKSTTGW

SEQ ID NO: 2885293 - protein, 9 aa, Entamoeba invadens
NCKTCSSKE

SEQ ID NO: 2885294 - protein, 9 aa, Entamoeba invadens
NCKTCSSSE

SEQ ID NO: 2885295 - protein, 8 aa, Entamoeba invadens
NCLKGSRP

SEQ ID NO: 2885296 - protein, 15 aa, Entamoeba invadens
NCNEKKAVTTKKKVV

SEQ ID NO: 2885297 - protein, 6 aa, Entamoeba invadens
NCNGRC

SEQ ID NO: 2885298 - protein, 11 aa, Entamoeba invadens
NCNKTTSLSPE

SEQ ID NO: 2885299 - protein, 9 aa, Entamoeba invadens
NCPEGPNIT

SEQ ID NO: 2885300 - protein, 7 aa, Entamoeba invadens
NCPERPE

SEQ ID NO: 2885301 - protein, 7 aa, Entamoeba invadens
NCPKGDP

SEQ ID NO: 2885302 - protein, 19 aa, Entamoeba invadens
NCPKNKGSSFNLVFKRITL

SEQ ID NO: 2885303 - protein, 4 aa, Entamoeba invadens
NCPP

SEQ ID NO: 2885304 - protein, 7 aa, Entamoeba invadens
NCQRNKG

SEQ ID NO: 2885305 - protein, 9 aa, Entamoeba invadens
NCQSGKCSS

SEQ ID NO: 2885306 - protein, 10 aa, Entamoeba invadens
NCRDNESGDM

SEQ ID NO: 2885307 - protein, 4 aa, Entamoeba invadens
NCRG

SEQ ID NO: 2885308 - protein, 5 aa, Entamoeba invadens
NCRYG

SEQ ID NO: 2885309 - protein, 6 aa, Entamoeba invadens
NCSDNS

SEQ ID NO: 2885310 - protein, 26 aa, Entamoeba invadens
NCSEPFDDQENDKENNLTNTKRDMKG

SEQ ID NO: 2885311 - protein, 22 aa, Entamoeba invadens
NCSGMKRKGTSSKSFGRTTKSD

SEQ ID NO: 2885312 - protein, 8 aa, Entamoeba invadens
NCSIGTTT

SEQ ID NO: 2885313 - protein, 6 aa, Entamoeba invadens
NCSKDS

SEQ ID NO: 2885314 - protein, 12 aa, Entamoeba invadens
NCSPHGSRGETF

SEQ ID NO: 2885315 - protein, 6 aa, Entamoeba invadens
NCSSEL

SEQ ID NO: 2885316 - protein, 8 aa, Entamoeba invadens
NCSSSEKE

SEQ ID NO: 2885317 - protein, 11 aa, Entamoeba invadens
NCSTCNGVNEN

SEQ ID NO: 2885318 - protein, 5 aa, Entamoeba invadens
NCSTP

SEQ ID NO: 2885319 - protein, 10 aa, Entamoeba invadens
NCSTSQNVTV

SEQ ID NO: 2885320 - protein, 9 aa, Entamoeba invadens
NCTGSGYTE

SEQ ID NO: 2885321 - protein, 6 aa, Entamoeba invadens
NCTKRK

SEQ ID NO: 2885322 - protein, 6 aa, Entamoeba invadens
NCTNES

SEQ ID NO: 2885323 - protein, 7 aa, Entamoeba invadens
NCTNESY

SEQ ID NO: 2885324 - protein, 10 aa, Entamoeba invadens
NCTSCNSATG

SEQ ID NO: 2885325 - protein, 7 aa, Entamoeba invadens
NCTSTES

SEQ ID NO: 2885326 - protein, 7 aa, Entamoeba invadens
NCTSYKT

SEQ ID NO: 2885327 - protein, 4 aa, Entamoeba invadens
NCTT

SEQ ID NO: 2885328 - protein, 9 aa, Entamoeba invadens
NCTTCDSAT

SEQ ID NO: 2885329 - protein, 11 aa, Entamoeba invadens
NCTTCSQNEGN

SEQ ID NO: 2885330 - protein, 5 aa, Entamoeba invadens
NCTTK

SEQ ID NO: 2885331 - protein, 9 aa, Entamoeba invadens
NCTTNNEGS

SEQ ID NO: 2885332 - protein, 8 aa, Entamoeba invadens
NCVAKTTS

SEQ ID NO: 2885333 - protein, 4 aa, Entamoeba invadens
NCYS

SEQ ID NO: 2885334 - protein, 16 aa, Entamoeba invadens
NDADKQNLQEVSKTMG

SEQ ID NO: 2885335 - protein, 8 aa, Entamoeba invadens
NDADRQRA

SEQ ID NO: 2885336 - protein, 8 aa, Entamoeba invadens
NDADRQRS

SEQ ID NO: 2885337 - protein, 5 aa, Entamoeba invadens
NDAEF

SEQ ID NO: 2885338 - protein, 6 aa, Entamoeba invadens
NDAEHY

SEQ ID NO: 2885339 - protein, 8 aa, Entamoeba invadens
NDAEIQNE

SEQ ID NO: 2885340 - protein, 7 aa, Entamoeba invadens
NDAERKF

SEQ ID NO: 2885341 - protein, 8 aa, Entamoeba invadens
NDAKGELD

SEQ ID NO: 2885342 - protein, 8 aa, Entamoeba invadens
NDAKKVAD

SEQ ID NO: 2885343 - protein, 6 aa, Entamoeba invadens
NDAKYE

SEQ ID NO: 2885344 - protein, 7 aa, Entamoeba invadens
NDAMRNS

SEQ ID NO: 2885345 - protein, 4 aa, Entamoeba invadens
NDAP

SEQ ID NO: 2885346 - protein, 16 aa, Entamoeba invadens
NDAPEKLPSQQNETKD

SEQ ID NO: 2885347 - protein, 5 aa, Entamoeba invadens
NDAPL

SEQ ID NO: 2885348 - protein, 29 aa, Entamoeba invadens
NDAPVPKAQPKVEPPKQQPKPQPPKDDLD

SEQ ID NO: 2885349 - protein, 10 aa, Entamoeba invadens
NDASDGVTDV

SEQ ID NO: 2885350 - protein, 7 aa, Entamoeba invadens
NDATGRC

SEQ ID NO: 2885351 - protein, 14 aa, Entamoeba invadens
NDATIDGTKPIPSV

SEQ ID NO: 2885352 - protein, 7 aa, Entamoeba invadens
NDATTNE

SEQ ID NO: 2885353 - protein, 5 aa, Entamoeba invadens
NDAVN

SEQ ID NO: 2885354 - protein, 7 aa, Entamoeba invadens
NDCGGSI

SEQ ID NO: 2885355 - protein, 9 aa, Entamoeba invadens
NDCKPSYKK

SEQ ID NO: 2885356 - protein, 6 aa, Entamoeba invadens
NDCNRC

SEQ ID NO: 2885357 - protein, 13 aa, Entamoeba invadens
NDCTKAKEAANRW

SEQ ID NO: 2885358 - protein, 8 aa, Entamoeba invadens
NDDAEGIT

SEQ ID NO: 2885359 - protein, 4 aa, Entamoeba invadens
NDDD

SEQ ID NO: 2885360 - protein, 21 aa, Entamoeba invadens
NDDDEQRKLLGEEKKDDNKMY

SEQ ID NO: 2885361 - protein, 14 aa, Entamoeba invadens
NDDDETKPKEAKEM

SEQ ID NO: 2885362 - protein, 10 aa, Entamoeba invadens
NDDDTESQDV

SEQ ID NO: 2885363 - protein, 7 aa, Entamoeba invadens
NDDDYPM

SEQ ID NO: 2885364 - protein, 5 aa, Entamoeba invadens
NDDED

SEQ ID NO: 2885365 - protein, 9 aa, Entamoeba invadens
NDDEDESIV

SEQ ID NO: 2885366 - protein, 7 aa, Entamoeba invadens
NDDEIEN

SEQ ID NO: 2885367 - protein, 7 aa, Entamoeba invadens
NDDENYK

SEQ ID NO: 2885368 - protein, 21 aa, Entamoeba invadens
NDDEQEETFTHGGESLSTTKY

SEQ ID NO: 2885369 - protein, 9 aa, Entamoeba invadens
NDDERVNTI

SEQ ID NO: 2885370 - protein, 11 aa, Entamoeba invadens
NDDFEAKGGEM

SEQ ID NO: 2885371 - protein, 9 aa, Entamoeba invadens
NDDGEITDF

SEQ ID NO: 2885372 - protein, 8 aa, Entamoeba invadens
NDDGGMNE

SEQ ID NO: 2885373 - protein, 7 aa, Entamoeba invadens
NDDGIEE

SEQ ID NO: 2885374 - protein, 36 aa, Entamoeba invadens
NDDGINEEHNDSSYPDRTAHPNTATPPMIDTTQTPI

SEQ ID NO: 2885375 - protein, 36 aa, Entamoeba invadens
NDDGINEEHNDSSYPDRTAQPNTATPPMIDTTQTPI

SEQ ID NO: 2885376 - protein, 18 aa, Entamoeba invadens
NDDIEKEVTSEPKTPKDK

SEQ ID NO: 2885377 - protein, 4 aa, Entamoeba invadens
NDDK

SEQ ID NO: 2885378 - protein, 6 aa, Entamoeba invadens
NDDKFT

SEQ ID NO: 2885379 - protein, 5 aa, Entamoeba invadens
NDDLD

SEQ ID NO: 2885380 - protein, 15 aa, Entamoeba invadens
NDDLPSALTEEDINT

SEQ ID NO: 2885381 - protein, 5 aa, Entamoeba invadens
NDDLS

SEQ ID NO: 2885382 - protein, 13 aa, Entamoeba invadens
NDDLTSMKKSETI

SEQ ID NO: 2885383 - protein, 4 aa, Entamoeba invadens
NDDM

SEQ ID NO: 2885384 - protein, 6 aa, Entamoeba invadens
NDDNEW

SEQ ID NO: 2885385 - protein, 6 aa, Entamoeba invadens
NDDNFG

SEQ ID NO: 2885386 - protein, 5 aa, Entamoeba invadens
NDDNT

SEQ ID NO: 2885387 - protein, 5 aa, Entamoeba invadens
NDDNY

SEQ ID NO: 2885388 - protein, 30 aa, Entamoeba invadens
NDDQDDNNNKTHKNQRVSGNLHESDKDYYN

SEQ ID NO: 2885389 - protein, 6 aa, Entamoeba invadens
NDDQTI

SEQ ID NO: 2885390 - protein, 5 aa, Entamoeba invadens
NDDRT

SEQ ID NO: 2885391 - protein, 12 aa, Entamoeba invadens
NDDSASEDEINE

SEQ ID NO: 2885392 - protein, 7 aa, Entamoeba invadens
NDDSENV

SEQ ID NO: 2885393 - protein, 9 aa, Entamoeba invadens
NDDSFDTRI

SEQ ID NO: 2885394 - protein, 6 aa, Entamoeba invadens
NDDSKT

SEQ ID NO: 2885395 - protein, 23 aa, Entamoeba invadens
NDDTAKKMECESVKKDDRKRGIS

SEQ ID NO: 2885396 - protein, 6 aa, Entamoeba invadens
NDDTIA

SEQ ID NO: 2885397 - protein, 7 aa, Entamoeba invadens
NDDTKYR

SEQ ID NO: 2885398 - protein, 5 aa, Entamoeba invadens
NDDVE

SEQ ID NO: 2885399 - protein, 8 aa, Entamoeba invadens
NDDYNNVT

SEQ ID NO: 2885400 - protein, 6 aa, Entamoeba invadens
NDDYVN

SEQ ID NO: 2885401 - protein, 7 aa, Entamoeba invadens
NDDYVNE

SEQ ID NO: 2885402 - protein, 7 aa, Entamoeba invadens
NDEDGAE

SEQ ID NO: 2885403 - protein, 10 aa, Entamoeba invadens
NDEDLEPETT

SEQ ID NO: 2885404 - protein, 10 aa, Entamoeba invadens
NDEDLETETT

SEQ ID NO: 2885405 - protein, 6 aa, Entamoeba invadens
NDEDPH

SEQ ID NO: 2885406 - protein, 5 aa, Entamoeba invadens
NDEDV

SEQ ID NO: 2885407 - protein, 16 aa, Entamoeba invadens
NDEEEVIEEENRRKEV

SEQ ID NO: 2885408 - protein, 8 aa, Entamoeba invadens
NDEEMSED

SEQ ID NO: 2885409 - protein, 10 aa, Entamoeba invadens
NDEENAPTID

SEQ ID NO: 2885410 - protein, 6 aa, Entamoeba invadens
NDEERG

SEQ ID NO: 2885411 - protein, 5 aa, Entamoeba invadens
NDEET

SEQ ID NO: 2885412 - protein, 6 aa, Entamoeba invadens
NDEETA

SEQ ID NO: 2885413 - protein, 9 aa, Entamoeba invadens
NDEETPLET

SEQ ID NO: 2885414 - protein, 4 aa, Entamoeba invadens
NDEF

SEQ ID NO: 2885415 - protein, 5 aa, Entamoeba invadens
NDEFV

SEQ ID NO: 2885416 - protein, 4 aa, Entamoeba invadens
NDEG

SEQ ID NO: 2885417 - protein, 5 aa, Entamoeba invadens
NDEGE

SEQ ID NO: 2885418 - protein, 8 aa, Entamoeba invadens
NDEGELKE

SEQ ID NO: 2885419 - protein, 5 aa, Entamoeba invadens
NDEGI

SEQ ID NO: 2885420 - protein, 13 aa, Entamoeba invadens
NDEHDEEQEEKDE

SEQ ID NO: 2885421 - protein, 4 aa, Entamoeba invadens
NDEI

SEQ ID NO: 2885422 - protein, 21 aa, Entamoeba invadens
NDEIKKDVKELEKSYKLPDGK

SEQ ID NO: 2885423 - protein, 7 aa, Entamoeba invadens
NDEIKKN

SEQ ID NO: 2885424 - protein, 9 aa, Entamoeba invadens
NDEISQQET

SEQ ID NO: 2885425 - protein, 28 aa, Entamoeba invadens
NDEKDEQELAEAELKKKRVEEDLKKRRV

SEQ ID NO: 2885426 - protein, 7 aa, Entamoeba invadens
NDEKKEI

SEQ ID NO: 2885427 - protein, 47 aa, Entamoeba invadens
NDEKKQNESIDIQNENKKPKRKYRKRQPQSEYKNLGKPKKLRKKTTQ

SEQ ID NO: 2885428 - protein, 8 aa, Entamoeba invadens
NDEKNGSM

SEQ ID NO: 2885429 - protein, 8 aa, Entamoeba invadens
NDEKNQCK

SEQ ID NO: 2885430 - protein, 9 aa, Entamoeba invadens
NDEKSGIMN

SEQ ID NO: 2885431 - protein, 6 aa, Entamoeba invadens
NDEKSK

SEQ ID NO: 2885432 - protein, 39 aa, Entamoeba invadens
NDEKSRSREIKATSQDSMSPKSKKKNLNVKAKGKEVKEI

SEQ ID NO: 2885433 - protein, 24 aa, Entamoeba invadens
NDEKTNDVDTEYSDSASDSENYKD

SEQ ID NO: 2885434 - protein, 5 aa, Entamoeba invadens
NDEKV

SEQ ID NO: 2885435 - protein, 4 aa, Entamoeba invadens
NDEN

SEQ ID NO: 2885436 - protein, 8 aa, Entamoeba invadens
NDENDADI

SEQ ID NO: 2885437 - protein, 8 aa, Entamoeba invadens
NDENDFDD

SEQ ID NO: 2885438 - protein, 6 aa, Entamoeba invadens
NDENFG

SEQ ID NO: 2885439 - protein, 7 aa, Entamoeba invadens
NDENFGN

SEQ ID NO: 2885440 - protein, 8 aa, Entamoeba invadens
NDENGVIS

SEQ ID NO: 2885441 - protein, 11 aa, Entamoeba invadens
NDENPYKRSDG

SEQ ID NO: 2885442 - protein, 9 aa, Entamoeba invadens
NDENREKLE

SEQ ID NO: 2885443 - protein, 9 aa, Entamoeba invadens
NDENTSQNI

SEQ ID NO: 2885444 - protein, 17 aa, Entamoeba invadens
NDENVEKSDDENESVES

SEQ ID NO: 2885445 - protein, 5 aa, Entamoeba invadens
NDENY

SEQ ID NO: 2885446 - protein, 7 aa, Entamoeba invadens
NDEPLPK

SEQ ID NO: 2885447 - protein, 10 aa, Entamoeba invadens
NDEQLNQPDL

SEQ ID NO: 2885448 - protein, 20 aa, Entamoeba invadens
NDERDKVPTYPSIKKDDISS

SEQ ID NO: 2885449 - protein, 7 aa, Entamoeba invadens
NDERKNY

SEQ ID NO: 2885450 - protein, 7 aa, Entamoeba invadens
NDERSGM

SEQ ID NO: 2885451 - protein, 7 aa, Entamoeba invadens
NDESDLD

SEQ ID NO: 2885452 - protein, 13 aa, Entamoeba invadens
NDESKNKPVSSDL

SEQ ID NO: 2885453 - protein, 9 aa, Entamoeba invadens
NDESPRNRQ

SEQ ID NO: 2885454 - protein, 8 aa, Entamoeba invadens
NDESRNVQ

SEQ ID NO: 2885455 - protein, 7 aa, Entamoeba invadens
NDETNAE

SEQ ID NO: 2885456 - protein, 10 aa, Entamoeba invadens
NDETQTKSVF

SEQ ID NO: 2885457 - protein, 5 aa, Entamoeba invadens
NDETV

SEQ ID NO: 2885458 - protein, 13 aa, Entamoeba invadens
NDEYDAKKPTFAS

SEQ ID NO: 2885459 - protein, 6 aa, Entamoeba invadens
NDEYDT

SEQ ID NO: 2885460 - protein, 6 aa, Entamoeba invadens
NDFDTS

SEQ ID NO: 2885461 - protein, 8 aa, Entamoeba invadens
NDFGKGKK

SEQ ID NO: 2885462 - protein, 8 aa, Entamoeba invadens
NDFGPEGV

SEQ ID NO: 2885463 - protein, 4 aa, Entamoeba invadens
NDFI

SEQ ID NO: 2885464 - protein, 4 aa, Entamoeba invadens
NDFK

SEQ ID NO: 2885465 - protein, 11 aa, Entamoeba invadens
NDFKATKTDWE

SEQ ID NO: 2885466 - protein, 12 aa, Entamoeba invadens
NDFNEVSKQNEF

SEQ ID NO: 2885467 - protein, 6 aa, Entamoeba invadens
NDFNGE

SEQ ID NO: 2885468 - protein, 5 aa, Entamoeba invadens
NDFSR

SEQ ID NO: 2885469 - protein, 13 aa, Entamoeba invadens
NDFTKNADDLVKG

SEQ ID NO: 2885470 - protein, 10 aa, Entamoeba invadens
NDGAPAPSLK

SEQ ID NO: 2885471 - protein, 6 aa, Entamoeba invadens
NDGATV

SEQ ID NO: 2885472 - protein, 5 aa, Entamoeba invadens
NDGDI

SEQ ID NO: 2885473 - protein, 44 aa, Entamoeba invadens
NDGEEKGKGRKTLRDTSKEKTPPPSKTSKTPKIKPSVFSFSFGK

SEQ ID NO: 2885474 - protein, 6 aa, Entamoeba invadens
NDGEIA

SEQ ID NO: 2885475 - protein, 9 aa, Entamoeba invadens
NDGGKMSTQ

SEQ ID NO: 2885476 - protein, 6 aa, Entamoeba invadens
NDGIQS

SEQ ID NO: 2885477 - protein, 22 aa, Entamoeba invadens
NDGKFVSKTPKVQHEPQGLKEP

SEQ ID NO: 2885478 - protein, 16 aa, Entamoeba invadens
NDGKSLSKNESMTDEQ

SEQ ID NO: 2885479 - protein, 9 aa, Entamoeba invadens
NDGKTPEIF

SEQ ID NO: 2885480 - protein, 6 aa, Entamoeba invadens
NDGKYA

SEQ ID NO: 2885481 - protein, 7 aa, Entamoeba invadens
NDGMNEH

SEQ ID NO: 2885482 - protein, 7 aa, Entamoeba invadens
NDGNEEF

SEQ ID NO: 2885483 - protein, 6 aa, Entamoeba invadens
NDGNKF

SEQ ID NO: 2885484 - protein, 10 aa, Entamoeba invadens
NDGNKTQTAD

SEQ ID NO: 2885485 - protein, 6 aa, Entamoeba invadens
NDGNVK

SEQ ID NO: 2885486 - protein, 8 aa, Entamoeba invadens
NDGNWTGE

SEQ ID NO: 2885487 - protein, 13 aa, Entamoeba invadens
NDGPFKSERISKY

SEQ ID NO: 2885488 - protein, 4 aa, Entamoeba invadens
NDGQ

SEQ ID NO: 2885489 - protein, 7 aa, Entamoeba invadens
NDGQDDV

SEQ ID NO: 2885490 - protein, 14 aa, Entamoeba invadens
NDGRYSIPNGISPQ

SEQ ID NO: 2885491 - protein, 6 aa, Entamoeba invadens
NDGSKF

SEQ ID NO: 2885492 - protein, 17 aa, Entamoeba invadens
NDGSKKDFKFDLHTVIK

SEQ ID NO: 2885493 - protein, 10 aa, Entamoeba invadens
NDGSLSSVVP

SEQ ID NO: 2885494 - protein, 8 aa, Entamoeba invadens
NDGTLSVY

SEQ ID NO: 2885495 - protein, 9 aa, Entamoeba invadens
NDGTSNAIN

SEQ ID NO: 2885496 - protein, 9 aa, Entamoeba invadens
NDGTTDFSY

SEQ ID NO: 2885497 - protein, 6 aa, Entamoeba invadens
NDGVGK

SEQ ID NO: 2885498 - protein, 14 aa, Entamoeba invadens
NDGVTANERSDNRI

SEQ ID NO: 2885499 - protein, 8 aa, Entamoeba invadens
NDGWEGFG

SEQ ID NO: 2885500 - protein, 26 aa, Entamoeba invadens
NDGYNPQEKRIDGVEEDEEAKETMKN

SEQ ID NO: 2885501 - protein, 19 aa, Entamoeba invadens
NDGYQDKEKKKDKDVNEKF

SEQ ID NO: 2885502 - protein, 8 aa, Entamoeba invadens
NDHHEEKD

SEQ ID NO: 2885503 - protein, 27 aa, Entamoeba invadens
NDHQHKPTQTCKPYNPNKEKDAHDYVN

SEQ ID NO: 2885504 - protein, 4 aa, Entamoeba invadens
NDHS

SEQ ID NO: 2885505 - protein, 5 aa, Entamoeba invadens
NDHTN

SEQ ID NO: 2885506 - protein, 24 aa, Entamoeba invadens
NDIDVDKKNCGSGKCGSASYDYKG

SEQ ID NO: 2885507 - protein, 20 aa, Entamoeba invadens
NDIEDKSTSETREQYDEEGK

SEQ ID NO: 2885508 - protein, 38 aa, Entamoeba invadens
NDIEEKLDKNEKKIKEMKSERDCDKSTITKLEKENKEC

SEQ ID NO: 2885509 - protein, 8 aa, Entamoeba invadens
NDIEESKA

SEQ ID NO: 2885510 - protein, 8 aa, Entamoeba invadens
NDIEKRGR

SEQ ID NO: 2885511 - protein, 5 aa, Entamoeba invadens
NDIEN

SEQ ID NO: 2885512 - protein, 7 aa, Entamoeba invadens
NDIGKSV

SEQ ID NO: 2885513 - protein, 10 aa, Entamoeba invadens
NDIKDSAFTN

SEQ ID NO: 2885514 - protein, 5 aa, Entamoeba invadens
NDIKE

SEQ ID NO: 2885515 - protein, 14 aa, Entamoeba invadens
NDIKSEVRKSCGPV

SEQ ID NO: 2885516 - protein, 20 aa, Entamoeba invadens
NDIKTNNKTTQSDKEEEIER

SEQ ID NO: 2885517 - protein, 12 aa, Entamoeba invadens
NDINDDGDVDDE

SEQ ID NO: 2885518 - protein, 9 aa, Entamoeba invadens
NDINNTKNI

SEQ ID NO: 2885519 - protein, 4 aa, Entamoeba invadens
NDIP

SEQ ID NO: 2885520 - protein, 22 aa, Entamoeba invadens
NDIPEESEFERSERIATHQKSD

SEQ ID NO: 2885521 - protein, 5 aa, Entamoeba invadens
NDIPK

SEQ ID NO: 2885522 - protein, 7 aa, Entamoeba invadens
NDIQDQS

SEQ ID NO: 2885523 - protein, 8 aa, Entamoeba invadens
NDIQTRQY

SEQ ID NO: 2885524 - protein, 14 aa, Entamoeba invadens
NDIRTEEDSDKTPL

SEQ ID NO: 2885525 - protein, 4 aa, Entamoeba invadens
NDIS

SEQ ID NO: 2885526 - protein, 8 aa, Entamoeba invadens
NDISSGGA

SEQ ID NO: 2885527 - protein, 14 aa, Entamoeba invadens
NDKANAKLTDFGSA

SEQ ID NO: 2885528 - protein, 4 aa, Entamoeba invadens
NDKC

SEQ ID NO: 2885529 - protein, 9 aa, Entamoeba invadens
NDKDEEEIR

SEQ ID NO: 2885530 - protein, 8 aa, Entamoeba invadens
NDKDNYKA

SEQ ID NO: 2885531 - protein, 6 aa, Entamoeba invadens
NDKDTD

SEQ ID NO: 2885532 - protein, 4 aa, Entamoeba invadens
NDKE

SEQ ID NO: 2885533 - protein, 15 aa, Entamoeba invadens
NDKEKEDSKDNIGNK

SEQ ID NO: 2885534 - protein, 5 aa, Entamoeba invadens
NDKEM

SEQ ID NO: 2885535 - protein, 5 aa, Entamoeba invadens
NDKET

SEQ ID NO: 2885536 - protein, 19 aa, Entamoeba invadens
NDKETSVKQQNATKQEQVT

SEQ ID NO: 2885537 - protein, 6 aa, Entamoeba invadens
NDKEVV

SEQ ID NO: 2885538 - protein, 18 aa, Entamoeba invadens
NDKGQSGFVPENYVEPIS

SEQ ID NO: 2885539 - protein, 7 aa, Entamoeba invadens
NDKHKTH

SEQ ID NO: 2885540 - protein, 12 aa, Entamoeba invadens
NDKHNTFDTPLT

SEQ ID NO: 2885541 - protein, 11 aa, Entamoeba invadens
NDKHTIKKGER

SEQ ID NO: 2885542 - protein, 5 aa, Entamoeba invadens
NDKIV

SEQ ID NO: 2885543 - protein, 5 aa, Entamoeba invadens
NDKKI

SEQ ID NO: 2885544 - protein, 8 aa, Entamoeba invadens
NDKKQLEN

SEQ ID NO: 2885545 - protein, 7 aa, Entamoeba invadens
NDKKSGY

SEQ ID NO: 2885546 - protein, 4 aa, Entamoeba invadens
NDKL

SEQ ID NO: 2885547 - protein, 5 aa, Entamoeba invadens
NDKLM

SEQ ID NO: 2885548 - protein, 33 aa, Entamoeba invadens
NDKMEQSERMKEDEKNKEKEKLKEEEMKAKEKM

SEQ ID NO: 2885549 - protein, 9 aa, Entamoeba invadens
NDKMKSKVD

SEQ ID NO: 2885550 - protein, 8 aa, Entamoeba invadens
NDKNDTFW

SEQ ID NO: 2885551 - protein, 10 aa, Entamoeba invadens
NDKNEPSEVE

SEQ ID NO: 2885552 - protein, 18 aa, Entamoeba invadens
NDKNTDHSDAAAFGDGSN

SEQ ID NO: 2885553 - protein, 10 aa, Entamoeba invadens
NDKNTNRDNI

SEQ ID NO: 2885554 - protein, 10 aa, Entamoeba invadens
NDKNVNEKNE

SEQ ID NO: 2885555 - protein, 5 aa, Entamoeba invadens
NDKNY

SEQ ID NO: 2885556 - protein, 9 aa, Entamoeba invadens
NDKNYTEND

SEQ ID NO: 2885557 - protein, 15 aa, Entamoeba invadens
NDKNYTRSKEARTNN

SEQ ID NO: 2885558 - protein, 8 aa, Entamoeba invadens
NDKPIGDV

SEQ ID NO: 2885559 - protein, 8 aa, Entamoeba invadens
NDKPKVSS

SEQ ID NO: 2885560 - protein, 7 aa, Entamoeba invadens
NDKQEHD

SEQ ID NO: 2885561 - protein, 7 aa, Entamoeba invadens
NDKQENA

SEQ ID NO: 2885562 - protein, 6 aa, Entamoeba invadens
NDKQKH

SEQ ID NO: 2885563 - protein, 39 aa, Entamoeba invadens
NDKQVELQNEQIDERRLSQDQPVTQKQEKYEKWNEETVR

SEQ ID NO: 2885564 - protein, 14 aa, Entamoeba invadens
NDKQYNRSKEAQVN

SEQ ID NO: 2885565 - protein, 4 aa, Entamoeba invadens
NDKR

SEQ ID NO: 2885566 - protein, 5 aa, Entamoeba invadens
NDKSS

SEQ ID NO: 2885567 - protein, 25 aa, Entamoeba invadens
NDKSTQETKAMRNRSHSRERDRVKD

SEQ ID NO: 2885568 - protein, 6 aa, Entamoeba invadens
NDKTAA

SEQ ID NO: 2885569 - protein, 16 aa, Entamoeba invadens
NDKTETTIYSTEPIKG

SEQ ID NO: 2885570 - protein, 15 aa, Entamoeba invadens
NDKTFDKKLTSEKYQ

SEQ ID NO: 2885571 - protein, 14 aa, Entamoeba invadens
NDKTGRKKLSPEDV

SEQ ID NO: 2885572 - protein, 11 aa, Entamoeba invadens
NDKTQTESDKH

SEQ ID NO: 2885573 - protein, 16 aa, Entamoeba invadens
NDKTRGEHSETVNTPC

SEQ ID NO: 2885574 - protein, 6 aa, Entamoeba invadens
NDKTSQ

SEQ ID NO: 2885575 - protein, 9 aa, Entamoeba invadens
NDKVAKSPY

SEQ ID NO: 2885576 - protein, 6 aa, Entamoeba invadens
NDKVDP

SEQ ID NO: 2885577 - protein, 11 aa, Entamoeba invadens
NDKVGEVDKST

SEQ ID NO: 2885578 - protein, 4 aa, Entamoeba invadens
NDLD

SEQ ID NO: 2885579 - protein, 7 aa, Entamoeba invadens
NDLDQQK

SEQ ID NO: 2885580 - protein, 5 aa, Entamoeba invadens
NDLDT

SEQ ID NO: 2885581 - protein, 13 aa, Entamoeba invadens
NDLEAKKNELGDI

SEQ ID NO: 2885582 - protein, 16 aa, Entamoeba invadens
NDLEATSNDLTTTTNT

SEQ ID NO: 2885583 - protein, 12 aa, Entamoeba invadens
NDLEKKKNSDIK

SEQ ID NO: 2885584 - protein, 12 aa, Entamoeba invadens
NDLGRTKAELDQ

SEQ ID NO: 2885585 - protein, 4 aa, Entamoeba invadens
NDLK

SEQ ID NO: 2885586 - protein, 7 aa, Entamoeba invadens
NDLKGRD

SEQ ID NO: 2885587 - protein, 6 aa, Entamoeba invadens
NDLKIS

SEQ ID NO: 2885588 - protein, 11 aa, Entamoeba invadens
NDLKTPKLYPE

SEQ ID NO: 2885589 - protein, 4 aa, Entamoeba invadens
NDLL

SEQ ID NO: 2885590 - protein, 41 aa, Entamoeba invadens
NDLNAEVDKSQKQLDTANDDKDGNEAMKQKYQDELSSYEKD

SEQ ID NO: 2885591 - protein, 5 aa, Entamoeba invadens
NDLNE

SEQ ID NO: 2885592 - protein, 10 aa, Entamoeba invadens
NDLNPQQVET

SEQ ID NO: 2885593 - protein, 6 aa, Entamoeba invadens
NDLNVD

SEQ ID NO: 2885594 - protein, 7 aa, Entamoeba invadens
NDLPEKD

SEQ ID NO: 2885595 - protein, 6 aa, Entamoeba invadens
NDLPQN

SEQ ID NO: 2885596 - protein, 24 aa, Entamoeba invadens
NDLRREKKKEYTQNHTENHHTESK

SEQ ID NO: 2885597 - protein, 10 aa, Entamoeba invadens
NDLSGRSKKL

SEQ ID NO: 2885598 - protein, 5 aa, Entamoeba invadens
NDLTA

SEQ ID NO: 2885599 - protein, 7 aa, Entamoeba invadens
NDLTEAA

SEQ ID NO: 2885600 - protein, 9 aa, Entamoeba invadens
NDLTQGTFS

SEQ ID NO: 2885601 - protein, 15 aa, Entamoeba invadens
NDLYNNTDKKTKPLI

SEQ ID NO: 2885602 - protein, 17 aa, Entamoeba invadens
NDMEISKGKCSKCETEN

SEQ ID NO: 2885603 - protein, 5 aa, Entamoeba invadens
NDMEP

SEQ ID NO: 2885604 - protein, 7 aa, Entamoeba invadens
NDMNEAD

SEQ ID NO: 2885605 - protein, 6 aa, Entamoeba invadens
NDMPGF

SEQ ID NO: 2885606 - protein, 4 aa, Entamoeba invadens
NDMS

SEQ ID NO: 2885607 - protein, 5 aa, Entamoeba invadens
NDMSD

SEQ ID NO: 2885608 - protein, 6 aa, Entamoeba invadens
NDMSEM

SEQ ID NO: 2885609 - protein, 8 aa, Entamoeba invadens
NDNDGLDE

SEQ ID NO: 2885610 - protein, 5 aa, Entamoeba invadens
NDNDI

SEQ ID NO: 2885611 - protein, 9 aa, Entamoeba invadens
NDNEEKRKY

SEQ ID NO: 2885612 - protein, 16 aa, Entamoeba invadens
NDNEELTDNALQGTLQ

SEQ ID NO: 2885613 - protein, 20 aa, Entamoeba invadens
NDNEKNSNITSKAVEKEHNI

SEQ ID NO: 2885614 - protein, 9 aa, Entamoeba invadens
NDNENSKRE

SEQ ID NO: 2885615 - protein, 5 aa, Entamoeba invadens
NDNEV

SEQ ID NO: 2885616 - protein, 13 aa, Entamoeba invadens
NDNFSDTSNPINH

SEQ ID NO: 2885617 - protein, 13 aa, Entamoeba invadens
NDNGIDPYDGTPL

SEQ ID NO: 2885618 - protein, 36 aa, Entamoeba invadens
NDNGINDEHNDSSYPDRTAQPNTATPPMIDTTQTPI

SEQ ID NO: 2885619 - protein, 36 aa, Entamoeba invadens
NDNGINEDHNDSSYLDRTAQPNTATPPVIDTTQTPI

SEQ ID NO: 2885620 - protein, 7 aa, Entamoeba invadens
NDNGKVI

SEQ ID NO: 2885621 - protein, 23 aa, Entamoeba invadens
NDNGTKTIKYSTGARAYAELGKD

SEQ ID NO: 2885622 - protein, 5 aa, Entamoeba invadens
NDNGW

SEQ ID NO: 2885623 - protein, 9 aa, Entamoeba invadens
NDNIEKSNL

SEQ ID NO: 2885624 - protein, 5 aa, Entamoeba invadens
NDNIP

SEQ ID NO: 2885625 - protein, 9 aa, Entamoeba invadens
NDNKDELNY

SEQ ID NO: 2885626 - protein, 42 aa, Entamoeba invadens
NDNKENDEITDSKVQPVDTDEEPPQLKKTETKMNSSETNEDT

SEQ ID NO: 2885627 - protein, 6 aa, Entamoeba invadens
NDNKTH

SEQ ID NO: 2885628 - protein, 32 aa, Entamoeba invadens
NDNNAGTTELKGDEKIEEKVDDKKKKGRKEKK

SEQ ID NO: 2885629 - protein, 5 aa, Entamoeba invadens
NDNNH

SEQ ID NO: 2885630 - protein, 7 aa, Entamoeba invadens
NDNNSNL

SEQ ID NO: 2885631 - protein, 15 aa, Entamoeba invadens
NDNPGKKSEDDIYQS

SEQ ID NO: 2885632 - protein, 5 aa, Entamoeba invadens
NDNRR

SEQ ID NO: 2885633 - protein, 4 aa, Entamoeba invadens
NDNS

SEQ ID NO: 2885634 - protein, 13 aa, Entamoeba invadens
NDNTHTLSFYLKM

SEQ ID NO: 2885635 - protein, 17 aa, Entamoeba invadens
NDNTKVNKSHSDSELTE

SEQ ID NO: 2885636 - protein, 7 aa, Entamoeba invadens
NDNTNTL

SEQ ID NO: 2885637 - protein, 5 aa, Entamoeba invadens
NDNTT

SEQ ID NO: 2885638 - protein, 5 aa, Entamoeba invadens
NDNVS

SEQ ID NO: 2885639 - protein, 4 aa, Entamoeba invadens
NDNY

SEQ ID NO: 2885640 - protein, 10 aa, Entamoeba invadens
NDNYETSQCT

SEQ ID NO: 2885641 - protein, 5 aa, Entamoeba invadens
NDPAL

SEQ ID NO: 2885642 - protein, 17 aa, Entamoeba invadens
NDPALKRKNLSDRLDAK

SEQ ID NO: 2885643 - protein, 8 aa, Entamoeba invadens
NDPDADRL

SEQ ID NO: 2885644 - protein, 10 aa, Entamoeba invadens
NDPDNKESIV

SEQ ID NO: 2885645 - protein, 10 aa, Entamoeba invadens
NDPDTHQRTL

SEQ ID NO: 2885646 - protein, 5 aa, Entamoeba invadens
NDPDV

SEQ ID NO: 2885647 - protein, 16 aa, Entamoeba invadens
NDPEKRIGAKDGAEEI

SEQ ID NO: 2885648 - protein, 9 aa, Entamoeba invadens
NDPEQVNHK

SEQ ID NO: 2885649 - protein, 13 aa, Entamoeba invadens
NDPETPGFIKALL

SEQ ID NO: 2885650 - protein, 5 aa, Entamoeba invadens
NDPFN

SEQ ID NO: 2885651 - protein, 7 aa, Entamoeba invadens
NDPFTEK

SEQ ID NO: 2885652 - protein, 11 aa, Entamoeba invadens
NDPGDIEFGRE

SEQ ID NO: 2885653 - protein, 39 aa, Entamoeba invadens
NDPIDGSLETEHSGGEDEAHENEEYEGSECNECNEIEDT

SEQ ID NO: 2885654 - protein, 5 aa, Entamoeba invadens
NDPIY

SEQ ID NO: 2885655 - protein, 40 aa, Entamoeba invadens
NDPKAPKPQANAQMKGKRPSTALGSSASSTTVVSSPSSPV

SEQ ID NO: 2885656 - protein, 9 aa, Entamoeba invadens
NDPKEKPTE

SEQ ID NO: 2885657 - protein, 9 aa, Entamoeba invadens
NDPKEVKTN

SEQ ID NO: 2885658 - protein, 9 aa, Entamoeba invadens
NDPKKPNNL

SEQ ID NO: 2885659 - protein, 10 aa, Entamoeba invadens
NDPKNSKGTC

SEQ ID NO: 2885660 - protein, 8 aa, Entamoeba invadens
NDPKSSIK

SEQ ID NO: 2885661 - protein, 4 aa, Entamoeba invadens
NDPL

SEQ ID NO: 2885662 - protein, 6 aa, Entamoeba invadens
NDPNKL

SEQ ID NO: 2885663 - protein, 6 aa, Entamoeba invadens
NDPNPI

SEQ ID NO: 2885664 - protein, 6 aa, Entamoeba invadens
NDPNYN

SEQ ID NO: 2885665 - protein, 8 aa, Entamoeba invadens
NDPQDKYL

SEQ ID NO: 2885666 - protein, 11 aa, Entamoeba invadens
NDPQTIPLPEN

SEQ ID NO: 2885667 - protein, 6 aa, Entamoeba invadens
NDPQTY

SEQ ID NO: 2885668 - protein, 6 aa, Entamoeba invadens
NDPRAN

SEQ ID NO: 2885669 - protein, 7 aa, Entamoeba invadens
NDPRANA

SEQ ID NO: 2885670 - protein, 4 aa, Entamoeba invadens
NDPS

SEQ ID NO: 2885671 - protein, 5 aa, Entamoeba invadens
NDPSY

SEQ ID NO: 2885672 - protein, 4 aa, Entamoeba invadens
NDPT

SEQ ID NO: 2885673 - protein, 6 aa, Entamoeba invadens
NDPTRL

SEQ ID NO: 2885674 - protein, 8 aa, Entamoeba invadens
NDPTTITD

SEQ ID NO: 2885675 - protein, 11 aa, Entamoeba invadens
NDPTVEDKYQV

SEQ ID NO: 2885676 - protein, 5 aa, Entamoeba invadens
NDQDE

SEQ ID NO: 2885677 - protein, 12 aa, Entamoeba invadens
NDQDGGAGKTGV

SEQ ID NO: 2885678 - protein, 7 aa, Entamoeba invadens
NDQDMSV

SEQ ID NO: 2885679 - protein, 8 aa, Entamoeba invadens
NDQEAGEE

SEQ ID NO: 2885680 - protein, 7 aa, Entamoeba invadens
NDQENER

SEQ ID NO: 2885681 - protein, 9 aa, Entamoeba invadens
NDQETQGLD

SEQ ID NO: 2885682 - protein, 21 aa, Entamoeba invadens
NDQGVEMDSEGVGSVASTEQT

SEQ ID NO: 2885683 - protein, 7 aa, Entamoeba invadens
NDQHDKF

SEQ ID NO: 2885684 - protein, 4 aa, Entamoeba invadens
NDQI

SEQ ID NO: 2885685 - protein, 10 aa, Entamoeba invadens
NDQIQSDHCS

SEQ ID NO: 2885686 - protein, 4 aa, Entamoeba invadens
NDQN

SEQ ID NO: 2885687 - protein, 8 aa, Entamoeba invadens
NDQNHTSV

SEQ ID NO: 2885688 - protein, 6 aa, Entamoeba invadens
NDQPFK

SEQ ID NO: 2885689 - protein, 6 aa, Entamoeba invadens
NDQPVD

SEQ ID NO: 2885690 - protein, 12 aa, Entamoeba invadens
NDQQLDKKRHIG

SEQ ID NO: 2885691 - protein, 16 aa, Entamoeba invadens
NDQQLQQLKDEDYQRH

SEQ ID NO: 2885692 - protein, 8 aa, Entamoeba invadens
NDQQNETL

SEQ ID NO: 2885693 - protein, 4 aa, Entamoeba invadens
NDQR

SEQ ID NO: 2885694 - protein, 7 aa, Entamoeba invadens
NDRCTAA

SEQ ID NO: 2885695 - protein, 13 aa, Entamoeba invadens
NDREEFGNNIPRN

SEQ ID NO: 2885696 - protein, 6 aa, Entamoeba invadens
NDRENN

SEQ ID NO: 2885697 - protein, 11 aa, Entamoeba invadens
NDRERLGEAKS

SEQ ID NO: 2885698 - protein, 4 aa, Entamoeba invadens
NDRH

SEQ ID NO: 2885699 - protein, 16 aa, Entamoeba invadens
NDRNRQATFTKRKNGL

SEQ ID NO: 2885700 - protein, 7 aa, Entamoeba invadens
NDRPDSV

SEQ ID NO: 2885701 - protein, 8 aa, Entamoeba invadens
NDRSIKNL

SEQ ID NO: 2885702 - protein, 5 aa, Entamoeba invadens
NDRTK

SEQ ID NO: 2885703 - protein, 5 aa, Entamoeba invadens
NDRVV

SEQ ID NO: 2885704 - protein, 4 aa, Entamoeba invadens
NDRY

SEQ ID NO: 2885705 - protein, 9 aa, Entamoeba invadens
NDSADTFPS

SEQ ID NO: 2885706 - protein, 7 aa, Entamoeba invadens
NDSAESW

SEQ ID NO: 2885707 - protein, 15 aa, Entamoeba invadens
NDSAVTQKKEIDTTQ

SEQ ID NO: 2885708 - protein, 7 aa, Entamoeba invadens
NDSCTTL

SEQ ID NO: 2885709 - protein, 5 aa, Entamoeba invadens
NDSDG

SEQ ID NO: 2885710 - protein, 10 aa, Entamoeba invadens
NDSDKELTEE

SEQ ID NO: 2885711 - protein, 8 aa, Entamoeba invadens
NDSDTSLA

SEQ ID NO: 2885712 - protein, 8 aa, Entamoeba invadens
NDSEAQNR

SEQ ID NO: 2885713 - protein, 6 aa, Entamoeba invadens
NDSEDS

SEQ ID NO: 2885714 - protein, 11 aa, Entamoeba invadens
NDSEKDVAEQL

SEQ ID NO: 2885715 - protein, 20 aa, Entamoeba invadens
NDSENMKETKTVLKPSKRQS

SEQ ID NO: 2885716 - protein, 9 aa, Entamoeba invadens
NDSENTKKL

SEQ ID NO: 2885717 - protein, 4 aa, Entamoeba invadens
NDSF

SEQ ID NO: 2885718 - protein, 8 aa, Entamoeba invadens
NDSFNSST

SEQ ID NO: 2885719 - protein, 7 aa, Entamoeba invadens
NDSGIDD

SEQ ID NO: 2885720 - protein, 14 aa, Entamoeba invadens
NDSIRSSLSTYTSA

SEQ ID NO: 2885721 - protein, 20 aa, Entamoeba invadens
NDSKGPSPVQTKETVKRNQM

SEQ ID NO: 2885722 - protein, 11 aa, Entamoeba invadens
NDSKPVKTKNS

SEQ ID NO: 2885723 - protein, 4 aa, Entamoeba invadens
NDSN

SEQ ID NO: 2885724 - protein, 12 aa, Entamoeba invadens
NDSNCNTPNTEV

SEQ ID NO: 2885725 - protein, 5 aa, Entamoeba invadens
NDSNG

SEQ ID NO: 2885726 - protein, 8 aa, Entamoeba invadens
NDSNNSLA

SEQ ID NO: 2885727 - protein, 6 aa, Entamoeba invadens
NDSNSA

SEQ ID NO: 2885728 - protein, 5 aa, Entamoeba invadens
NDSPN

SEQ ID NO: 2885729 - protein, 15 aa, Entamoeba invadens
NDSQQQATKEAGTIA

SEQ ID NO: 2885730 - protein, 6 aa, Entamoeba invadens
NDSQYE

SEQ ID NO: 2885731 - protein, 4 aa, Entamoeba invadens
NDSR

SEQ ID NO: 2885732 - protein, 5 aa, Entamoeba invadens
NDSRD

SEQ ID NO: 2885733 - protein, 6 aa, Entamoeba invadens
NDSREY

SEQ ID NO: 2885734 - protein, 6 aa, Entamoeba invadens
NDSSDN

SEQ ID NO: 2885735 - protein, 5 aa, Entamoeba invadens
NDSSP

SEQ ID NO: 2885736 - protein, 24 aa, Entamoeba invadens
NDSSQEYTESSCENYSSNKTYHQE

SEQ ID NO: 2885737 - protein, 13 aa, Entamoeba invadens
NDSSSTLANPVSP

SEQ ID NO: 2885738 - protein, 13 aa, Entamoeba invadens
NDSSTSKIGEASI

SEQ ID NO: 2885739 - protein, 18 aa, Entamoeba invadens
NDSSTSRIEGTERDIVSS

SEQ ID NO: 2885740 - protein, 6 aa, Entamoeba invadens
NDSSVA

SEQ ID NO: 2885741 - protein, 4 aa, Entamoeba invadens
NDST

SEQ ID NO: 2885742 - protein, 5 aa, Entamoeba invadens
NDSTF

SEQ ID NO: 2885743 - protein, 5 aa, Entamoeba invadens
NDSTG

SEQ ID NO: 2885744 - protein, 10 aa, Entamoeba invadens
NDSTSNRDLV

SEQ ID NO: 2885745 - protein, 7 aa, Entamoeba invadens
NDSTSTI

SEQ ID NO: 2885746 - protein, 5 aa, Entamoeba invadens
NDSTT

SEQ ID NO: 2885747 - protein, 13 aa, Entamoeba invadens
NDSVDDDEIKEGN

SEQ ID NO: 2885748 - protein, 10 aa, Entamoeba invadens
NDSYGGLSGR

SEQ ID NO: 2885749 - protein, 5 aa, Entamoeba invadens
NDTAL

SEQ ID NO: 2885750 - protein, 7 aa, Entamoeba invadens
NDTANRD

SEQ ID NO: 2885751 - protein, 16 aa, Entamoeba invadens
NDTAPAKKAGNQDELD

SEQ ID NO: 2885752 - protein, 7 aa, Entamoeba invadens
NDTEDYA

SEQ ID NO: 2885753 - protein, 6 aa, Entamoeba invadens
NDTEET

SEQ ID NO: 2885754 - protein, 37 aa, Entamoeba invadens
NDTEPFTDRPDIHKKKRKASFAERPFGVPKEDKNTDL

SEQ ID NO: 2885755 - protein, 6 aa, Entamoeba invadens
NDTERA

SEQ ID NO: 2885756 - protein, 5 aa, Entamoeba invadens
NDTFD

SEQ ID NO: 2885757 - protein, 5 aa, Entamoeba invadens
NDTFT

SEQ ID NO: 2885758 - protein, 12 aa, Entamoeba invadens
NDTHEKVGKAPY

SEQ ID NO: 2885759 - protein, 4 aa, Entamoeba invadens
NDTI

SEQ ID NO: 2885760 - protein, 11 aa, Entamoeba invadens
NDTIERQKKEY

SEQ ID NO: 2885761 - protein, 12 aa, Entamoeba invadens
NDTKAGRTYKRG

SEQ ID NO: 2885762 - protein, 7 aa, Entamoeba invadens
NDTKDVT

SEQ ID NO: 2885763 - protein, 5 aa, Entamoeba invadens
NDTKT

SEQ ID NO: 2885764 - protein, 6 aa, Entamoeba invadens
NDTLAD

SEQ ID NO: 2885765 - protein, 7 aa, Entamoeba invadens
NDTMGEN

SEQ ID NO: 2885766 - protein, 6 aa, Entamoeba invadens
NDTNEI

SEQ ID NO: 2885767 - protein, 7 aa, Entamoeba invadens
NDTNTEV

SEQ ID NO: 2885768 - protein, 7 aa, Entamoeba invadens
NDTPYDE

SEQ ID NO: 2885769 - protein, 8 aa, Entamoeba invadens
NDTQAKQL

SEQ ID NO: 2885770 - protein, 9 aa, Entamoeba invadens
NDTQCEYRP

SEQ ID NO: 2885771 - protein, 6 aa, Entamoeba invadens
NDTRDD

SEQ ID NO: 2885772 - protein, 5 aa, Entamoeba invadens
NDTRP

SEQ ID NO: 2885773 - protein, 7 aa, Entamoeba invadens
NDTSDYY

SEQ ID NO: 2885774 - protein, 7 aa, Entamoeba invadens
NDTSGLN

SEQ ID NO: 2885775 - protein, 7 aa, Entamoeba invadens
NDTSGTV

SEQ ID NO: 2885776 - protein, 11 aa, Entamoeba invadens
NDTSMKESQTR

SEQ ID NO: 2885777 - protein, 6 aa, Entamoeba invadens
NDTSYG

SEQ ID NO: 2885778 - protein, 9 aa, Entamoeba invadens
NDTTANYSL

SEQ ID NO: 2885779 - protein, 5 aa, Entamoeba invadens
NDTTM

SEQ ID NO: 2885780 - protein, 7 aa, Entamoeba invadens
NDTTRLP

SEQ ID NO: 2885781 - protein, 9 aa, Entamoeba invadens
NDTTSGQGQ

SEQ ID NO: 2885782 - protein, 4 aa, Entamoeba invadens
NDTV

SEQ ID NO: 2885783 - protein, 7 aa, Entamoeba invadens
NDTVPHE

SEQ ID NO: 2885784 - protein, 17 aa, Entamoeba invadens
NDVAREEKEYKSRLNKR

SEQ ID NO: 2885785 - protein, 8 aa, Entamoeba invadens
NDVATSDG

SEQ ID NO: 2885786 - protein, 10 aa, Entamoeba invadens
NDVDGDNVDT

SEQ ID NO: 2885787 - protein, 8 aa, Entamoeba invadens
NDVDKTAY

SEQ ID NO: 2885788 - protein, 11 aa, Entamoeba invadens
NDVDPNRYRNT

SEQ ID NO: 2885789 - protein, 9 aa, Entamoeba invadens
NDVDRKTAI

SEQ ID NO: 2885790 - protein, 5 aa, Entamoeba invadens
NDVDY

SEQ ID NO: 2885791 - protein, 6 aa, Entamoeba invadens
NDVEDV

SEQ ID NO: 2885792 - protein, 6 aa, Entamoeba invadens
NDVEED

SEQ ID NO: 2885793 - protein, 9 aa, Entamoeba invadens
NDVEMPEKN

SEQ ID NO: 2885794 - protein, 5 aa, Entamoeba invadens
NDVET

SEQ ID NO: 2885795 - protein, 9 aa, Entamoeba invadens
NDVIENNDP

SEQ ID NO: 2885796 - protein, 25 aa, Entamoeba invadens
NDVKAQEAAKEKKRADLKKKIETAG

SEQ ID NO: 2885797 - protein, 6 aa, Entamoeba invadens
NDVKNF

SEQ ID NO: 2885798 - protein, 6 aa, Entamoeba invadens
NDVKQG

SEQ ID NO: 2885799 - protein, 6 aa, Entamoeba invadens
NDVNGV

SEQ ID NO: 2885800 - protein, 6 aa, Entamoeba invadens
NDVNNE

SEQ ID NO: 2885801 - protein, 27 aa, Entamoeba invadens
NDVPKPKPAVQAQQTQPKPAAPKDDLD

SEQ ID NO: 2885802 - protein, 8 aa, Entamoeba invadens
NDVPPWDY

SEQ ID NO: 2885803 - protein, 7 aa, Entamoeba invadens
NDVPRTA

SEQ ID NO: 2885804 - protein, 4 aa, Entamoeba invadens
NDVQ

SEQ ID NO: 2885805 - protein, 6 aa, Entamoeba invadens
NDVRPN

SEQ ID NO: 2885806 - protein, 5 aa, Entamoeba invadens
NDVSR

SEQ ID NO: 2885807 - protein, 6 aa, Entamoeba invadens
NDVSSL

SEQ ID NO: 2885808 - protein, 7 aa, Entamoeba invadens
NDVSTKV

SEQ ID NO: 2885809 - protein, 26 aa, Entamoeba invadens
NDVSYQKKQLSDRLDKKRAEIRRTSQ

SEQ ID NO: 2885810 - protein, 12 aa, Entamoeba invadens
NDVTKKDTKVPF

SEQ ID NO: 2885811 - protein, 21 aa, Entamoeba invadens
NDVTKKDTKVPSGYPKMPTEI

SEQ ID NO: 2885812 - protein, 8 aa, Entamoeba invadens
NDVTPNTT

SEQ ID NO: 2885813 - protein, 5 aa, Entamoeba invadens
NDVYP

SEQ ID NO: 2885814 - protein, 4 aa, Entamoeba invadens
NDYD

SEQ ID NO: 2885815 - protein, 11 aa, Entamoeba invadens
NDYDEDDQETL

SEQ ID NO: 2885816 - protein, 7 aa, Entamoeba invadens
NDYDVNG

SEQ ID NO: 2885817 - protein, 4 aa, Entamoeba invadens
NDYE

SEQ ID NO: 2885818 - protein, 4 aa, Entamoeba invadens
NDYI

SEQ ID NO: 2885819 - protein, 16 aa, Entamoeba invadens
NDYKNELKNDTGDKNK

SEQ ID NO: 2885820 - protein, 10 aa, Entamoeba invadens
NDYKTVTNNV

SEQ ID NO: 2885821 - protein, 6 aa, Entamoeba invadens
NDYMTK

SEQ ID NO: 2885822 - protein, 7 aa, Entamoeba invadens
NDYNESL

SEQ ID NO: 2885823 - protein, 10 aa, Entamoeba invadens
NDYRMRKEGK

SEQ ID NO: 2885824 - protein, 6 aa, Entamoeba invadens
NDYSAN

SEQ ID NO: 2885825 - protein, 4 aa, Entamoeba invadens
NDYT

SEQ ID NO: 2885826 - protein, 7 aa, Entamoeba invadens
NEAAQVG

SEQ ID NO: 2885827 - protein, 29 aa, Entamoeba invadens
NEACGSDQSAYQKMEEELDDLNNDYDELQ

SEQ ID NO: 2885828 - protein, 8 aa, Entamoeba invadens
NEADPEFP

SEQ ID NO: 2885829 - protein, 14 aa, Entamoeba invadens
NEADVQFASVMQMM

SEQ ID NO: 2885830 - protein, 10 aa, Entamoeba invadens
NEAEKSDEIE

SEQ ID NO: 2885831 - protein, 11 aa, Entamoeba invadens
NEAEPSHVDAQ

SEQ ID NO: 2885832 - protein, 12 aa, Entamoeba invadens
NEAEPSHVDEQS

SEQ ID NO: 2885833 - protein, 9 aa, Entamoeba invadens
NEAFEQRSS

SEQ ID NO: 2885834 - protein, 4 aa, Entamoeba invadens
NEAG

SEQ ID NO: 2885835 - protein, 8 aa, Entamoeba invadens
NEAGDKLE

SEQ ID NO: 2885836 - protein, 5 aa, Entamoeba invadens
NEAKE

SEQ ID NO: 2885837 - protein, 6 aa, Entamoeba invadens
NEAKGC

SEQ ID NO: 2885838 - protein, 9 aa, Entamoeba invadens
NEAKPSRDM

SEQ ID NO: 2885839 - protein, 14 aa, Entamoeba invadens
NEAKTKLSEYNKYE

SEQ ID NO: 2885840 - protein, 12 aa, Entamoeba invadens
NEALDKTSLGKY

SEQ ID NO: 2885841 - protein, 5 aa, Entamoeba invadens
NEALQ

SEQ ID NO: 2885842 - protein, 8 aa, Entamoeba invadens
NEANKAPK

SEQ ID NO: 2885843 - protein, 7 aa, Entamoeba invadens
NEANKTK

SEQ ID NO: 2885844 - protein, 6 aa, Entamoeba invadens
NEAPFD

SEQ ID NO: 2885845 - protein, 8 aa, Entamoeba invadens
NEAPSKIK

SEQ ID NO: 2885846 - protein, 7 aa, Entamoeba invadens
NEAPTTT

SEQ ID NO: 2885847 - protein, 8 aa, Entamoeba invadens
NEARDTRD

SEQ ID NO: 2885848 - protein, 5 aa, Entamoeba invadens
NEARH

SEQ ID NO: 2885849 - protein, 9 aa, Entamoeba invadens
NEARREQSG

SEQ ID NO: 2885850 - protein, 7 aa, Entamoeba invadens
NEASSIK

SEQ ID NO: 2885851 - protein, 6 aa, Entamoeba invadens
NEATPL

SEQ ID NO: 2885852 - protein, 8 aa, Entamoeba invadens
NEATSRRA

SEQ ID NO: 2885853 - protein, 21 aa, Entamoeba invadens
NEAYEKARNRYDEIKPDDDNV

SEQ ID NO: 2885854 - protein, 8 aa, Entamoeba invadens
NECAPLPD

SEQ ID NO: 2885855 - protein, 9 aa, Entamoeba invadens
NECEEYRDS

SEQ ID NO: 2885856 - protein, 6 aa, Entamoeba invadens
NECEKC

SEQ ID NO: 2885857 - protein, 31 aa, Entamoeba invadens
NECFEQKKQEIEKEGKLTTVQEAKEKAIKTH

SEQ ID NO: 2885858 - protein, 6 aa, Entamoeba invadens
NECPPA

SEQ ID NO: 2885859 - protein, 6 aa, Entamoeba invadens
NECSSL

SEQ ID NO: 2885860 - protein, 4 aa, Entamoeba invadens
NEDA

SEQ ID NO: 2885861 - protein, 6 aa, Entamoeba invadens
NEDAPD

SEQ ID NO: 2885862 - protein, 8 aa, Entamoeba invadens
NEDDPMTG

SEQ ID NO: 2885863 - protein, 8 aa, Entamoeba invadens
NEDDPTRY

SEQ ID NO: 2885864 - protein, 9 aa, Entamoeba invadens
NEDDSGDGM

SEQ ID NO: 2885865 - protein, 6 aa, Entamoeba invadens
NEDDVK

SEQ ID NO: 2885866 - protein, 6 aa, Entamoeba invadens
NEDELT

SEQ ID NO: 2885867 - protein, 6 aa, Entamoeba invadens
NEDENE

SEQ ID NO: 2885868 - protein, 5 aa, Entamoeba invadens
NEDEQ

SEQ ID NO: 2885869 - protein, 18 aa, Entamoeba invadens
NEDEQPQYFQRCSNPGIL

SEQ ID NO: 2885870 - protein, 8 aa, Entamoeba invadens
NEDEREEV

SEQ ID NO: 2885871 - protein, 6 aa, Entamoeba invadens
NEDEYP

SEQ ID NO: 2885872 - protein, 21 aa, Entamoeba invadens
NEDFSETEIDDNDITKTSRDL

SEQ ID NO: 2885873 - protein, 4 aa, Entamoeba invadens
NEDG

SEQ ID NO: 2885874 - protein, 7 aa, Entamoeba invadens
NEDGFLE

SEQ ID NO: 2885875 - protein, 16 aa, Entamoeba invadens
NEDGKEDGKHSPKIKR

SEQ ID NO: 2885876 - protein, 8 aa, Entamoeba invadens
NEDGKNWR

SEQ ID NO: 2885877 - protein, 7 aa, Entamoeba invadens
NEDGNID

SEQ ID NO: 2885878 - protein, 6 aa, Entamoeba invadens
NEDGQI

SEQ ID NO: 2885879 - protein, 9 aa, Entamoeba invadens
NEDGWDTKT

SEQ ID NO: 2885880 - protein, 21 aa, Entamoeba invadens
NEDKEKNLKSIEEQEDTIRTI

SEQ ID NO: 2885881 - protein, 33 aa, Entamoeba invadens
NEDKEPTPKERERRPIKTVKRATKSSTYAKFHF

SEQ ID NO: 2885882 - protein, 14 aa, Entamoeba invadens
NEDKTSNYNPTETE

SEQ ID NO: 2885883 - protein, 6 aa, Entamoeba invadens
NEDLEK

SEQ ID NO: 2885884 - protein, 6 aa, Entamoeba invadens
NEDLKE

SEQ ID NO: 2885885 - protein, 18 aa, Entamoeba invadens
NEDLKNGVTQKTVNRRKD

SEQ ID NO: 2885886 - protein, 4 aa, Entamoeba invadens
NEDN

SEQ ID NO: 2885887 - protein, 8 aa, Entamoeba invadens
NEDNSNDL

SEQ ID NO: 2885888 - protein, 5 aa, Entamoeba invadens
NEDPG

SEQ ID NO: 2885889 - protein, 10 aa, Entamoeba invadens
NEDPKKQNKG

SEQ ID NO: 2885890 - protein, 7 aa, Entamoeba invadens
NEDPVGD

SEQ ID NO: 2885891 - protein, 8 aa, Entamoeba invadens
NEDPVNNS

SEQ ID NO: 2885892 - protein, 6 aa, Entamoeba invadens
NEDQAR

SEQ ID NO: 2885893 - protein, 5 aa, Entamoeba invadens
NEDQL

SEQ ID NO: 2885894 - protein, 10 aa, Entamoeba invadens
NEDQQPAVNP

SEQ ID NO: 2885895 - protein, 5 aa, Entamoeba invadens
NEDRI

SEQ ID NO: 2885896 - protein, 14 aa, Entamoeba invadens
NEDSPELPLDKETR

SEQ ID NO: 2885897 - protein, 4 aa, Entamoeba invadens
NEDT

SEQ ID NO: 2885898 - protein, 6 aa, Entamoeba invadens
NEDTIT

SEQ ID NO: 2885899 - protein, 5 aa, Entamoeba invadens
NEDTS

SEQ ID NO: 2885900 - protein, 5 aa, Entamoeba invadens
NEDTV

SEQ ID NO: 2885901 - protein, 7 aa, Entamoeba invadens
NEDWPPQ

SEQ ID NO: 2885902 - protein, 7 aa, Entamoeba invadens
NEDYKED

SEQ ID NO: 2885903 - protein, 9 aa, Entamoeba invadens
NEDYPQSKG

SEQ ID NO: 2885904 - protein, 22 aa, Entamoeba invadens
NEDYYDDDYDESQEQEQEEHPG

SEQ ID NO: 2885905 - protein, 4 aa, Entamoeba invadens
NEEA

SEQ ID NO: 2885906 - protein, 48 aa, Entamoeba invadens
NEEADKKERLQKKEKKEKQEKLEQESTEKETNDIENKEEKGDDKKDDF

SEQ ID NO: 2885907 - protein, 34 aa, Entamoeba invadens
NEEAESDRIGRREDEEELKKAKSSGKRYIDDEDD

SEQ ID NO: 2885908 - protein, 9 aa, Entamoeba invadens
NEEAMEEKD

SEQ ID NO: 2885909 - protein, 8 aa, Entamoeba invadens
NEEDEQME

SEQ ID NO: 2885910 - protein, 12 aa, Entamoeba invadens
NEEDKFSPKGKF

SEQ ID NO: 2885911 - protein, 5 aa, Entamoeba invadens
NEEDL

SEQ ID NO: 2885912 - protein, 11 aa, Entamoeba invadens
NEEDTFAPKGK

SEQ ID NO: 2885913 - protein, 12 aa, Entamoeba invadens
NEEDTKKVFESK

SEQ ID NO: 2885914 - protein, 8 aa, Entamoeba invadens
NEEDYIPS

SEQ ID NO: 2885915 - protein, 4 aa, Entamoeba invadens
NEEE

SEQ ID NO: 2885916 - protein, 11 aa, Entamoeba invadens
NEEEEDSRRGM

SEQ ID NO: 2885917 - protein, 37 aa, Entamoeba invadens
NEEEEESQRSGGIESNGNLKGIRPHDEVEKSGNLTTP

SEQ ID NO: 2885918 - protein, 33 aa, Entamoeba invadens
NEEEESQRNGGIESNGNLKGIRPHDAVSEGESI

SEQ ID NO: 2885919 - protein, 36 aa, Entamoeba invadens
NEEEESQRSGGIESNGNLKGIRPHDAVEKSGNLTTP

SEQ ID NO: 2885920 - protein, 36 aa, Entamoeba invadens
NEEEESQRSGVIENNGNLKGIRPHDAVEKSRNLTTP

SEQ ID NO: 2885921 - protein, 6 aa, Entamoeba invadens
NEEEHN

SEQ ID NO: 2885922 - protein, 5 aa, Entamoeba invadens
NEEEK

SEQ ID NO: 2885923 - protein, 9 aa, Entamoeba invadens
NEEEKDEGW

SEQ ID NO: 2885924 - protein, 11 aa, Entamoeba invadens
NEEEKKRHLEA

SEQ ID NO: 2885925 - protein, 5 aa, Entamoeba invadens
NEEEM

SEQ ID NO: 2885926 - protein, 7 aa, Entamoeba invadens
NEEEPVN

SEQ ID NO: 2885927 - protein, 6 aa, Entamoeba invadens
NEEEQF

SEQ ID NO: 2885928 - protein, 53 aa, Entamoeba invadens
NEEEVEEQDASEDNKMSEDEKSVSEESNPSEDKEKMSEEENAEVSAEDGETDV

SEQ ID NO: 2885929 - protein, 7 aa, Entamoeba invadens
NEEFETV

SEQ ID NO: 2885930 - protein, 6 aa, Entamoeba invadens
NEEFQQ

SEQ ID NO: 2885931 - protein, 7 aa, Entamoeba invadens
NEEGCEK

SEQ ID NO: 2885932 - protein, 15 aa, Entamoeba invadens
NEEGEKEWSEDEQRV

SEQ ID NO: 2885933 - protein, 6 aa, Entamoeba invadens
NEEGFK

SEQ ID NO: 2885934 - protein, 12 aa, Entamoeba invadens
NEEGIAGYDPVN

SEQ ID NO: 2885935 - protein, 5 aa, Entamoeba invadens
NEEGR

SEQ ID NO: 2885936 - protein, 7 aa, Entamoeba invadens
NEEGRLL

SEQ ID NO: 2885937 - protein, 7 aa, Entamoeba invadens
NEEGSLE

SEQ ID NO: 2885938 - protein, 14 aa, Entamoeba invadens
NEEGTEKGKEKNNA

SEQ ID NO: 2885939 - protein, 6 aa, Entamoeba invadens
NEEHWN

SEQ ID NO: 2885940 - protein, 11 aa, Entamoeba invadens
NEEIEKSSTQV

SEQ ID NO: 2885941 - protein, 9 aa, Entamoeba invadens
NEEKFTVDE

SEQ ID NO: 2885942 - protein, 9 aa, Entamoeba invadens
NEEKGKKSD

SEQ ID NO: 2885943 - protein, 7 aa, Entamoeba invadens
NEEKIGK

SEQ ID NO: 2885944 - protein, 15 aa, Entamoeba invadens
NEEKKEEKNSEFRKR

SEQ ID NO: 2885945 - protein, 8 aa, Entamoeba invadens
NEEKRTKV

SEQ ID NO: 2885946 - protein, 6 aa, Entamoeba invadens
NEEKVD

SEQ ID NO: 2885947 - protein, 15 aa, Entamoeba invadens
NEELKNEQSKVSGIN

SEQ ID NO: 2885948 - protein, 11 aa, Entamoeba invadens
NEELKRKDHAN

SEQ ID NO: 2885949 - protein, 5 aa, Entamoeba invadens
NEELY

SEQ ID NO: 2885950 - protein, 29 aa, Entamoeba invadens
NEEMEDRHEKNGTEDKELEHHESVEEQNG

SEQ ID NO: 2885951 - protein, 28 aa, Entamoeba invadens
NEEMEDRHEKNGTEDRELEHHDSGEEQN

SEQ ID NO: 2885952 - protein, 6 aa, Entamoeba invadens
NEEMTK

SEQ ID NO: 2885953 - protein, 4 aa, Entamoeba invadens
NEEN

SEQ ID NO: 2885954 - protein, 10 aa, Entamoeba invadens
NEENDVDENK

SEQ ID NO: 2885955 - protein, 6 aa, Entamoeba invadens
NEENFG

SEQ ID NO: 2885956 - protein, 7 aa, Entamoeba invadens
NEENFGN

SEQ ID NO: 2885957 - protein, 21 aa, Entamoeba invadens
NEENKTPPKDQEEQQNEENVV

SEQ ID NO: 2885958 - protein, 5 aa, Entamoeba invadens
NEENM

SEQ ID NO: 2885959 - protein, 6 aa, Entamoeba invadens
NEENNS

SEQ ID NO: 2885960 - protein, 10 aa, Entamoeba invadens
NEENPNERTE

SEQ ID NO: 2885961 - protein, 5 aa, Entamoeba invadens
NEENQ

SEQ ID NO: 2885962 - protein, 7 aa, Entamoeba invadens
NEENSSK

SEQ ID NO: 2885963 - protein, 7 aa, Entamoeba invadens
NEENTLS

SEQ ID NO: 2885964 - protein, 9 aa, Entamoeba invadens
NEENYYTPE

SEQ ID NO: 2885965 - protein, 13 aa, Entamoeba invadens
NEEQPIDETDPPL

SEQ ID NO: 2885966 - protein, 18 aa, Entamoeba invadens
NEEQTRSNDVSKLTKDQF

SEQ ID NO: 2885967 - protein, 12 aa, Entamoeba invadens
NEERKKEENTNL

SEQ ID NO: 2885968 - protein, 9 aa, Entamoeba invadens
NEERNAGNH

SEQ ID NO: 2885969 - protein, 10 aa, Entamoeba invadens
NEERTPDEKL

SEQ ID NO: 2885970 - protein, 8 aa, Entamoeba invadens
NEESFGNS

SEQ ID NO: 2885971 - protein, 6 aa, Entamoeba invadens
NEESFQ

SEQ ID NO: 2885972 - protein, 8 aa, Entamoeba invadens
NEESGTGL

SEQ ID NO: 2885973 - protein, 5 aa, Entamoeba invadens
NEESI

SEQ ID NO: 2885974 - protein, 23 aa, Entamoeba invadens
NEESLEEHKEGSESSKEPSEVEN

SEQ ID NO: 2885975 - protein, 6 aa, Entamoeba invadens
NEESNE

SEQ ID NO: 2885976 - protein, 4 aa, Entamoeba invadens
NEET

SEQ ID NO: 2885977 - protein, 6 aa, Entamoeba invadens
NEETDE

SEQ ID NO: 2885978 - protein, 25 aa, Entamoeba invadens
NEETEEQKKARRKAHSKVVTTREKS

SEQ ID NO: 2885979 - protein, 5 aa, Entamoeba invadens
NEETL

SEQ ID NO: 2885980 - protein, 5 aa, Entamoeba invadens
NEETN

SEQ ID NO: 2885981 - protein, 8 aa, Entamoeba invadens
NEETRDLE

SEQ ID NO: 2885982 - protein, 7 aa, Entamoeba invadens
NEETSAK

SEQ ID NO: 2885983 - protein, 16 aa, Entamoeba invadens
NEETSDESTNIGSGEV

SEQ ID NO: 2885984 - protein, 9 aa, Entamoeba invadens
NEETTDDNV

SEQ ID NO: 2885985 - protein, 6 aa, Entamoeba invadens
NEETYD

SEQ ID NO: 2885986 - protein, 4 aa, Entamoeba invadens
NEEV

SEQ ID NO: 2885987 - protein, 5 aa, Entamoeba invadens
NEEVK

SEQ ID NO: 2885988 - protein, 9 aa, Entamoeba invadens
NEEVPTEYK

SEQ ID NO: 2885989 - protein, 9 aa, Entamoeba invadens
NEEVPVEER

SEQ ID NO: 2885990 - protein, 6 aa, Entamoeba invadens
NEEYDE

SEQ ID NO: 2885991 - protein, 6 aa, Entamoeba invadens
NEEYIT

SEQ ID NO: 2885992 - protein, 15 aa, Entamoeba invadens
NEEYRKREINRVRKL

SEQ ID NO: 2885993 - protein, 5 aa, Entamoeba invadens
NEEYY

SEQ ID NO: 2885994 - protein, 13 aa, Entamoeba invadens
NEFAGDSKAVDGA

SEQ ID NO: 2885995 - protein, 13 aa, Entamoeba invadens
NEFAQPSQALQER

SEQ ID NO: 2885996 - protein, 11 aa, Entamoeba invadens
NEFDNASGEVS

SEQ ID NO: 2885997 - protein, 8 aa, Entamoeba invadens
NEFDPPHS

SEQ ID NO: 2885998 - protein, 5 aa, Entamoeba invadens
NEFDT

SEQ ID NO: 2885999 - protein, 6 aa, Entamoeba invadens
NEFDTS

SEQ ID NO: 2886000 - protein, 8 aa, Entamoeba invadens
NEFEKGAR

SEQ ID NO: 2886001 - protein, 8 aa, Entamoeba invadens
NEFENPPR

SEQ ID NO: 2886002 - protein, 30 aa, Entamoeba invadens
NEFENQEEEVNEQNNEENDEEGEKDVSNEI

SEQ ID NO: 2886003 - protein, 14 aa, Entamoeba invadens
NEFNDAVDDYDIED

SEQ ID NO: 2886004 - protein, 8 aa, Entamoeba invadens
NEFNERKN

SEQ ID NO: 2886005 - protein, 29 aa, Entamoeba invadens
NEFNGKNSELERTLKEQEAWHKEGDEKKM

SEQ ID NO: 2886006 - protein, 10 aa, Entamoeba invadens
NEFPEELKSE

SEQ ID NO: 2886007 - protein, 6 aa, Entamoeba invadens
NEFPTE

SEQ ID NO: 2886008 - protein, 9 aa, Entamoeba invadens
NEFPTNYTP

SEQ ID NO: 2886009 - protein, 10 aa, Entamoeba invadens
NEFRTQEDLR

SEQ ID NO: 2886010 - protein, 10 aa, Entamoeba invadens
NEFSESDLSR

SEQ ID NO: 2886011 - protein, 4 aa, Entamoeba invadens
NEFT

SEQ ID NO: 2886012 - protein, 12 aa, Entamoeba invadens
NEGAEGSRLSHD

SEQ ID NO: 2886013 - protein, 10 aa, Entamoeba invadens
NEGASDEYQE

SEQ ID NO: 2886014 - protein, 4 aa, Entamoeba invadens
NEGC

SEQ ID NO: 2886015 - protein, 4 aa, Entamoeba invadens
NEGD

SEQ ID NO: 2886016 - protein, 16 aa, Entamoeba invadens
NEGDQKRITPVPTTEE

SEQ ID NO: 2886017 - protein, 4 aa, Entamoeba invadens
NEGE

SEQ ID NO: 2886018 - protein, 7 aa, Entamoeba invadens
NEGEKYA

SEQ ID NO: 2886019 - protein, 6 aa, Entamoeba invadens
NEGELG

SEQ ID NO: 2886020 - protein, 7 aa, Entamoeba invadens
NEGERST

SEQ ID NO: 2886021 - protein, 17 aa, Entamoeba invadens
NEGERTVKQGDESIGQL

SEQ ID NO: 2886022 - protein, 6 aa, Entamoeba invadens
NEGFVG

SEQ ID NO: 2886023 - protein, 6 aa, Entamoeba invadens
NEGGID

SEQ ID NO: 2886024 - protein, 5 aa, Entamoeba invadens
NEGGV

SEQ ID NO: 2886025 - protein, 6 aa, Entamoeba invadens
NEGGYT

SEQ ID NO: 2886026 - protein, 8 aa, Entamoeba invadens
NEGKDYRM

SEQ ID NO: 2886027 - protein, 17 aa, Entamoeba invadens
NEGKEGDKQLSEEDIEN

SEQ ID NO: 2886028 - protein, 7 aa, Entamoeba invadens
NEGKFDE

SEQ ID NO: 2886029 - protein, 5 aa, Entamoeba invadens
NEGKN

SEQ ID NO: 2886030 - protein, 17 aa, Entamoeba invadens
NEGKSHHEEENQDFEEQ

SEQ ID NO: 2886031 - protein, 8 aa, Entamoeba invadens
NEGLERME

SEQ ID NO: 2886032 - protein, 6 aa, Entamoeba invadens
NEGLKR

SEQ ID NO: 2886033 - protein, 5 aa, Entamoeba invadens
NEGMK

SEQ ID NO: 2886034 - protein, 19 aa, Entamoeba invadens
NEGSMEEDVSENSENIEPV

SEQ ID NO: 2886035 - protein, 18 aa, Entamoeba invadens
NEGSQVNGKITDFGSSRN

SEQ ID NO: 2886036 - protein, 5 aa, Entamoeba invadens
NEGSS

SEQ ID NO: 2886037 - protein, 8 aa, Entamoeba invadens
NEGTATTQ

SEQ ID NO: 2886038 - protein, 7 aa, Entamoeba invadens
NEGTQTF

SEQ ID NO: 2886039 - protein, 5 aa, Entamoeba invadens
NEGVL

SEQ ID NO: 2886040 - protein, 8 aa, Entamoeba invadens
NEGYKSDT

SEQ ID NO: 2886041 - protein, 8 aa, Entamoeba invadens
NEHDPKRT

SEQ ID NO: 2886042 - protein, 8 aa, Entamoeba invadens
NEHDTGYF

SEQ ID NO: 2886043 - protein, 5 aa, Entamoeba invadens
NEHGL

SEQ ID NO: 2886044 - protein, 11 aa, Entamoeba invadens
NEHGLTETETS

SEQ ID NO: 2886045 - protein, 17 aa, Entamoeba invadens
NEHKASIEKTMSETKDA

SEQ ID NO: 2886046 - protein, 20 aa, Entamoeba invadens
NEHPKSESDGFLDDRPKRSL

SEQ ID NO: 2886047 - protein, 7 aa, Entamoeba invadens
NEHPTQI

SEQ ID NO: 2886048 - protein, 6 aa, Entamoeba invadens
NEHQAH

SEQ ID NO: 2886049 - protein, 4 aa, Entamoeba invadens
NEID

SEQ ID NO: 2886050 - protein, 5 aa, Entamoeba invadens
NEIDE

SEQ ID NO: 2886051 - protein, 7 aa, Entamoeba invadens
NEIDNRE

SEQ ID NO: 2886052 - protein, 7 aa, Entamoeba invadens
NEIEGKI

SEQ ID NO: 2886053 - protein, 15 aa, Entamoeba invadens
NEIENVGTKKENLVE

SEQ ID NO: 2886054 - protein, 11 aa, Entamoeba invadens
NEIESAATLDE

SEQ ID NO: 2886055 - protein, 10 aa, Entamoeba invadens
NEIGASKKDH

SEQ ID NO: 2886056 - protein, 6 aa, Entamoeba invadens
NEIGEN

SEQ ID NO: 2886057 - protein, 6 aa, Entamoeba invadens
NEIGET

SEQ ID NO: 2886058 - protein, 22 aa, Entamoeba invadens
NEIKESMGSGGNGYMEENDTEL

SEQ ID NO: 2886059 - protein, 9 aa, Entamoeba invadens
NEIKGGKSK

SEQ ID NO: 2886060 - protein, 5 aa, Entamoeba invadens
NEIKK

SEQ ID NO: 2886061 - protein, 10 aa, Entamoeba invadens
NEIKKEDAEK

SEQ ID NO: 2886062 - protein, 7 aa, Entamoeba invadens
NEIKKEK

SEQ ID NO: 2886063 - protein, 14 aa, Entamoeba invadens
NEIKKQARAGRTNT

SEQ ID NO: 2886064 - protein, 5 aa, Entamoeba invadens
NEIKT

SEQ ID NO: 2886065 - protein, 5 aa, Entamoeba invadens
NEILG

SEQ ID NO: 2886066 - protein, 4 aa, Entamoeba invadens
NEIN

SEQ ID NO: 2886067 - protein, 10 aa, Entamoeba invadens
NEINEYRNNG

SEQ ID NO: 2886068 - protein, 5 aa, Entamoeba invadens
NEINK

SEQ ID NO: 2886069 - protein, 7 aa, Entamoeba invadens
NEINKAS

SEQ ID NO: 2886070 - protein, 10 aa, Entamoeba invadens
NEINKRDLKE

SEQ ID NO: 2886071 - protein, 5 aa, Entamoeba invadens
NEINL

SEQ ID NO: 2886072 - protein, 6 aa, Entamoeba invadens
NEINNV

SEQ ID NO: 2886073 - protein, 5 aa, Entamoeba invadens
NEINP

SEQ ID NO: 2886074 - protein, 11 aa, Entamoeba invadens
NEINYNNTKRW

SEQ ID NO: 2886075 - protein, 9 aa, Entamoeba invadens
NEIPKGVTK

SEQ ID NO: 2886076 - protein, 8 aa, Entamoeba invadens
NEIPNEVT

SEQ ID NO: 2886077 - protein, 6 aa, Entamoeba invadens
NEIPSG

SEQ ID NO: 2886078 - protein, 14 aa, Entamoeba invadens
NEIPSLPSGDNLPK

SEQ ID NO: 2886079 - protein, 6 aa, Entamoeba invadens
NEIPST

SEQ ID NO: 2886080 - protein, 7 aa, Entamoeba invadens
NEIPTEK

SEQ ID NO: 2886081 - protein, 24 aa, Entamoeba invadens
NEIQESEEKEKMEEKEVQHEKQEV

SEQ ID NO: 2886082 - protein, 4 aa, Entamoeba invadens
NEIS

SEQ ID NO: 2886083 - protein, 10 aa, Entamoeba invadens
NEISKTSPPL

SEQ ID NO: 2886084 - protein, 16 aa, Entamoeba invadens
NEISNNDKLNEKINEN

SEQ ID NO: 2886085 - protein, 6 aa, Entamoeba invadens
NEISRE

SEQ ID NO: 2886086 - protein, 5 aa, Entamoeba invadens
NEITE

SEQ ID NO: 2886087 - protein, 9 aa, Entamoeba invadens
NEITNKPSV

SEQ ID NO: 2886088 - protein, 6 aa, Entamoeba invadens
NEITNS

SEQ ID NO: 2886089 - protein, 9 aa, Entamoeba invadens
NEITQQSDK

SEQ ID NO: 2886090 - protein, 6 aa, Entamoeba invadens
NEKAAY

SEQ ID NO: 2886091 - protein, 5 aa, Entamoeba invadens
NEKAD

SEQ ID NO: 2886092 - protein, 9 aa, Entamoeba invadens
NEKAEKLGI

SEQ ID NO: 2886093 - protein, 9 aa, Entamoeba invadens
NEKAGEGQI

SEQ ID NO: 2886094 - protein, 6 aa, Entamoeba invadens
NEKAKE

SEQ ID NO: 2886095 - protein, 9 aa, Entamoeba invadens
NEKAKKRVK

SEQ ID NO: 2886096 - protein, 8 aa, Entamoeba invadens
NEKAKQAK

SEQ ID NO: 2886097 - protein, 7 aa, Entamoeba invadens
NEKAQDC

SEQ ID NO: 2886098 - protein, 14 aa, Entamoeba invadens
NEKCAECGKADPEW

SEQ ID NO: 2886099 - protein, 10 aa, Entamoeba invadens
NEKCETYSQH

SEQ ID NO: 2886100 - protein, 4 aa, Entamoeba invadens
NEKD

SEQ ID NO: 2886101 - protein, 9 aa, Entamoeba invadens
NEKDNEIRV

SEQ ID NO: 2886102 - protein, 10 aa, Entamoeba invadens
NEKDNNKLQE

SEQ ID NO: 2886103 - protein, 7 aa, Entamoeba invadens
NEKDPNW

SEQ ID NO: 2886104 - protein, 16 aa, Entamoeba invadens
NEKDPQRKHGRKQHDQ

SEQ ID NO: 2886105 - protein, 9 aa, Entamoeba invadens
NEKDQRCKQ

SEQ ID NO: 2886106 - protein, 7 aa, Entamoeba invadens
NEKDTAD

SEQ ID NO: 2886107 - protein, 8 aa, Entamoeba invadens
NEKDYMKK

SEQ ID NO: 2886108 - protein, 4 aa, Entamoeba invadens
NEKE

SEQ ID NO: 2886109 - protein, 13 aa, Entamoeba invadens
NEKEDDKPEGINT

SEQ ID NO: 2886110 - protein, 36 aa, Entamoeba invadens
NEKEESQRSGGIESNGNLKGIRPHDAVEKSGNLTTP

SEQ ID NO: 2886111 - protein, 6 aa, Entamoeba invadens
NEKEEY

SEQ ID NO: 2886112 - protein, 8 aa, Entamoeba invadens
NEKEIGEV

SEQ ID NO: 2886113 - protein, 13 aa, Entamoeba invadens
NEKEQATGGVSPL

SEQ ID NO: 2886114 - protein, 19 aa, Entamoeba invadens
NEKERAEKEHKEKEEKERM

SEQ ID NO: 2886115 - protein, 35 aa, Entamoeba invadens
NEKESQRSREIESNGNLKGIRPHDAVEKSGNLTTP

SEQ ID NO: 2886116 - protein, 13 aa, Entamoeba invadens
NEKETRPNPVNDD

SEQ ID NO: 2886117 - protein, 5 aa, Entamoeba invadens
NEKGD

SEQ ID NO: 2886118 - protein, 7 aa, Entamoeba invadens
NEKGDRI

SEQ ID NO: 2886119 - protein, 10 aa, Entamoeba invadens
NEKGEALNQE

SEQ ID NO: 2886120 - protein, 6 aa, Entamoeba invadens
NEKGEC

SEQ ID NO: 2886121 - protein, 15 aa, Entamoeba invadens
NEKGENKKLEDVKDT

SEQ ID NO: 2886122 - protein, 6 aa, Entamoeba invadens
NEKGKF

SEQ ID NO: 2886123 - protein, 5 aa, Entamoeba invadens
NEKHE

SEQ ID NO: 2886124 - protein, 8 aa, Entamoeba invadens
NEKHETIL

SEQ ID NO: 2886125 - protein, 13 aa, Entamoeba invadens
NEKHGKFPVGNGD

SEQ ID NO: 2886126 - protein, 4 aa, Entamoeba invadens
NEKI

SEQ ID NO: 2886127 - protein, 14 aa, Entamoeba invadens
NEKIEKEKVKEKGV

SEQ ID NO: 2886128 - protein, 7 aa, Entamoeba invadens
NEKINPA

SEQ ID NO: 2886129 - protein, 10 aa, Entamoeba invadens
NEKINSMGSK

SEQ ID NO: 2886130 - protein, 6 aa, Entamoeba invadens
NEKIPP

SEQ ID NO: 2886131 - protein, 15 aa, Entamoeba invadens
NEKIQKRRGEDSDVS

SEQ ID NO: 2886132 - protein, 4 aa, Entamoeba invadens
NEKK

SEQ ID NO: 2886133 - protein, 9 aa, Entamoeba invadens
NEKKCHNEK

SEQ ID NO: 2886134 - protein, 5 aa, Entamoeba invadens
NEKKE

SEQ ID NO: 2886135 - protein, 31 aa, Entamoeba invadens
NEKKPKTLTEKSEETIEKKKLTKKEEEDSNE

SEQ ID NO: 2886136 - protein, 7 aa, Entamoeba invadens
NEKKSNF

SEQ ID NO: 2886137 - protein, 4 aa, Entamoeba invadens
NEKL

SEQ ID NO: 2886138 - protein, 8 aa, Entamoeba invadens
NEKLAPQA

SEQ ID NO: 2886139 - protein, 17 aa, Entamoeba invadens
NEKLSENVQEGDLTAEL

SEQ ID NO: 2886140 - protein, 8 aa, Entamoeba invadens
NEKMYTAD

SEQ ID NO: 2886141 - protein, 8 aa, Entamoeba invadens
NEKNIRDD

SEQ ID NO: 2886142 - protein, 9 aa, Entamoeba invadens
NEKNRDSVE

SEQ ID NO: 2886143 - protein, 15 aa, Entamoeba invadens
NEKNTTTLKEKEKMA

SEQ ID NO: 2886144 - protein, 7 aa, Entamoeba invadens
NEKNVKN

SEQ ID NO: 2886145 - protein, 6 aa, Entamoeba invadens
NEKPKT

SEQ ID NO: 2886146 - protein, 4 aa, Entamoeba invadens
NEKQ

SEQ ID NO: 2886147 - protein, 5 aa, Entamoeba invadens
NEKQD

SEQ ID NO: 2886148 - protein, 5 aa, Entamoeba invadens
NEKQE

SEQ ID NO: 2886149 - protein, 14 aa, Entamoeba invadens
NEKQEYEANTDPLI

SEQ ID NO: 2886150 - protein, 6 aa, Entamoeba invadens
NEKQKH

SEQ ID NO: 2886151 - protein, 15 aa, Entamoeba invadens
NEKQMNNLRGREEEA

SEQ ID NO: 2886152 - protein, 17 aa, Entamoeba invadens
NEKQSVEDASKIENYES

SEQ ID NO: 2886153 - protein, 8 aa, Entamoeba invadens
NEKQTETF

SEQ ID NO: 2886154 - protein, 6 aa, Entamoeba invadens
NEKRTD

SEQ ID NO: 2886155 - protein, 4 aa, Entamoeba invadens
NEKS

SEQ ID NO: 2886156 - protein, 15 aa, Entamoeba invadens
NEKSEGVERTEKGLP

SEQ ID NO: 2886157 - protein, 5 aa, Entamoeba invadens
NEKSF

SEQ ID NO: 2886158 - protein, 8 aa, Entamoeba invadens
NEKSFESL

SEQ ID NO: 2886159 - protein, 9 aa, Entamoeba invadens
NEKSKFEEK

SEQ ID NO: 2886160 - protein, 8 aa, Entamoeba invadens
NEKSKGTV

SEQ ID NO: 2886161 - protein, 10 aa, Entamoeba invadens
NEKSNQNTDA

SEQ ID NO: 2886162 - protein, 76 aa, Entamoeba invadens
NEKSRSRSKSRKSIRQKKEYSRSSSYSERSGHASRSRSRSQSRERRRRKYSCSSSEYSSTSPSPSRRSSQHHYHDN

SEQ ID NO: 2886163 - protein, 10 aa, Entamoeba invadens
NEKSSIENAR

SEQ ID NO: 2886164 - protein, 4 aa, Entamoeba invadens
NEKT

SEQ ID NO: 2886165 - protein, 22 aa, Entamoeba invadens
NEKTEEAKKMEEESEETDTEAV

SEQ ID NO: 2886166 - protein, 9 aa, Entamoeba invadens
NEKTGQCEN

SEQ ID NO: 2886167 - protein, 9 aa, Entamoeba invadens
NEKTHNDGR

SEQ ID NO: 2886168 - protein, 12 aa, Entamoeba invadens
NEKTIPGNTTCS

SEQ ID NO: 2886169 - protein, 10 aa, Entamoeba invadens
NEKTKVEEQI

SEQ ID NO: 2886170 - protein, 7 aa, Entamoeba invadens
NEKTNVN

SEQ ID NO: 2886171 - protein, 141 aa, Entamoeba invadens
NEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKNI

SEQ ID NO: 2886172 - protein, 8 aa, Entamoeba invadens
NEKTYNKE

SEQ ID NO: 2886173 - protein, 9 aa, Entamoeba invadens
NEKVGEGSF

SEQ ID NO: 2886174 - protein, 5 aa, Entamoeba invadens
NEKVN

SEQ ID NO: 2886175 - protein, 8 aa, Entamoeba invadens
NEKVSQSF

SEQ ID NO: 2886176 - protein, 9 aa, Entamoeba invadens
NEKYGGGMS

SEQ ID NO: 2886177 - protein, 9 aa, Entamoeba invadens
NEKYKNANI

SEQ ID NO: 2886178 - protein, 18 aa, Entamoeba invadens
NEKYRSESDKNNTLLQPH

SEQ ID NO: 2886179 - protein, 9 aa, Entamoeba invadens
NELAQSEAY

SEQ ID NO: 2886180 - protein, 13 aa, Entamoeba invadens
NELEETKKIGEGS

SEQ ID NO: 2886181 - protein, 23 aa, Entamoeba invadens
NELEEVKKSRVQTTENATQQLEE

SEQ ID NO: 2886182 - protein, 14 aa, Entamoeba invadens
NELEGSQSAQKVYE

SEQ ID NO: 2886183 - protein, 21 aa, Entamoeba invadens
NELEKQLKEEKLRNRTDLNSK

SEQ ID NO: 2886184 - protein, 7 aa, Entamoeba invadens
NELEQKK

SEQ ID NO: 2886185 - protein, 6 aa, Entamoeba invadens
NELGEG

SEQ ID NO: 2886186 - protein, 5 aa, Entamoeba invadens
NELGR

SEQ ID NO: 2886187 - protein, 7 aa, Entamoeba invadens
NELGSGS

SEQ ID NO: 2886188 - protein, 7 aa, Entamoeba invadens
NELKDDQ

SEQ ID NO: 2886189 - protein, 24 aa, Entamoeba invadens
NELKDKNDIIETTKKQKEEAEQKL

SEQ ID NO: 2886190 - protein, 5 aa, Entamoeba invadens
NELKE

SEQ ID NO: 2886191 - protein, 11 aa, Entamoeba invadens
NELKEDKKLGE

SEQ ID NO: 2886192 - protein, 8 aa, Entamoeba invadens
NELKEKND

SEQ ID NO: 2886193 - protein, 9 aa, Entamoeba invadens
NELKGKQAK

SEQ ID NO: 2886194 - protein, 19 aa, Entamoeba invadens
NELKNSNTLLEKSKNEMSG

SEQ ID NO: 2886195 - protein, 13 aa, Entamoeba invadens
NELKRNQEPPSRG

SEQ ID NO: 2886196 - protein, 26 aa, Entamoeba invadens
NELLQQENKRISESLNEQTQKAEKAI

SEQ ID NO: 2886197 - protein, 9 aa, Entamoeba invadens
NELNDTNYT

SEQ ID NO: 2886198 - protein, 6 aa, Entamoeba invadens
NELNEP

SEQ ID NO: 2886199 - protein, 16 aa, Entamoeba invadens
NELNSRKRADPSPDNF

SEQ ID NO: 2886200 - protein, 5 aa, Entamoeba invadens
NELPK

SEQ ID NO: 2886201 - protein, 42 aa, Entamoeba invadens
NELPKKIKEMKDSIKTDRKKSEESKEKATKKAKNLKKGDNLK

SEQ ID NO: 2886202 - protein, 25 aa, Entamoeba invadens
NELPKKTQKPLPPIPPKKREDAPII

SEQ ID NO: 2886203 - protein, 14 aa, Entamoeba invadens
NELPKRLTTPEENV

SEQ ID NO: 2886204 - protein, 14 aa, Entamoeba invadens
NELPNAKIAAASDM

SEQ ID NO: 2886205 - protein, 4 aa, Entamoeba invadens
NELQ

SEQ ID NO: 2886206 - protein, 14 aa, Entamoeba invadens
NELQQKTRDPDAYA

SEQ ID NO: 2886207 - protein, 5 aa, Entamoeba invadens
NELRA

SEQ ID NO: 2886208 - protein, 8 aa, Entamoeba invadens
NELRGRSG

SEQ ID NO: 2886209 - protein, 6 aa, Entamoeba invadens
NELRKS

SEQ ID NO: 2886210 - protein, 6 aa, Entamoeba invadens
NELRQT

SEQ ID NO: 2886211 - protein, 4 aa, Entamoeba invadens
NELS

SEQ ID NO: 2886212 - protein, 9 aa, Entamoeba invadens
NELSPPEAS

SEQ ID NO: 2886213 - protein, 6 aa, Entamoeba invadens
NELSQN

SEQ ID NO: 2886214 - protein, 7 aa, Entamoeba invadens
NELYNSE

SEQ ID NO: 2886215 - protein, 9 aa, Entamoeba invadens
NELYQSEEC

SEQ ID NO: 2886216 - protein, 11 aa, Entamoeba invadens
NELYRKQKEKY

SEQ ID NO: 2886217 - protein, 8 aa, Entamoeba invadens
NEMEDDNT

SEQ ID NO: 2886218 - protein, 9 aa, Entamoeba invadens
NEMEDDNTV

SEQ ID NO: 2886219 - protein, 6 aa, Entamoeba invadens
NEMEKV

SEQ ID NO: 2886220 - protein, 9 aa, Entamoeba invadens
NEMENRPKD

SEQ ID NO: 2886221 - protein, 8 aa, Entamoeba invadens
NEMETYKG

SEQ ID NO: 2886222 - protein, 7 aa, Entamoeba invadens
NEMETYP

SEQ ID NO: 2886223 - protein, 6 aa, Entamoeba invadens
NEMGET

SEQ ID NO: 2886224 - protein, 6 aa, Entamoeba invadens
NEMKEL

SEQ ID NO: 2886225 - protein, 10 aa, Entamoeba invadens
NEMKGFEDDE

SEQ ID NO: 2886226 - protein, 6 aa, Entamoeba invadens
NEMQAK

SEQ ID NO: 2886227 - protein, 12 aa, Entamoeba invadens
NEMQEEEQEKKL

SEQ ID NO: 2886228 - protein, 4 aa, Entamoeba invadens
NEMS

SEQ ID NO: 2886229 - protein, 6 aa, Entamoeba invadens
NEMSAD

SEQ ID NO: 2886230 - protein, 6 aa, Entamoeba invadens
NEMTTH

SEQ ID NO: 2886231 - protein, 7 aa, Entamoeba invadens
NEMYDTG

SEQ ID NO: 2886232 - protein, 5 aa, Entamoeba invadens
NENAS

SEQ ID NO: 2886233 - protein, 8 aa, Entamoeba invadens
NENCSINS

SEQ ID NO: 2886234 - protein, 7 aa, Entamoeba invadens
NENDKEV

SEQ ID NO: 2886235 - protein, 12 aa, Entamoeba invadens
NENDLQQKLKTP

SEQ ID NO: 2886236 - protein, 16 aa, Entamoeba invadens
NENDQLKEKVDANEKT

SEQ ID NO: 2886237 - protein, 10 aa, Entamoeba invadens
NENDSDNGNC

SEQ ID NO: 2886238 - protein, 13 aa, Entamoeba invadens
NENDTQKEVPVGV

SEQ ID NO: 2886239 - protein, 7 aa, Entamoeba invadens
NENDTSM

SEQ ID NO: 2886240 - protein, 16 aa, Entamoeba invadens
NENEASYKQTQKGDNH

SEQ ID NO: 2886241 - protein, 8 aa, Entamoeba invadens
NENEDIRK

SEQ ID NO: 2886242 - protein, 6 aa, Entamoeba invadens
NENEDT

SEQ ID NO: 2886243 - protein, 5 aa, Entamoeba invadens
NENEE

SEQ ID NO: 2886244 - protein, 20 aa, Entamoeba invadens
NENEENEEREDEKTIKNKTD

SEQ ID NO: 2886245 - protein, 47 aa, Entamoeba invadens
NENEFGEYKEHAEKSINSLTAQKADSQKQLEKERAMKQKPDKETQRL

SEQ ID NO: 2886246 - protein, 15 aa, Entamoeba invadens
NENEFGEYKEQAEKS

SEQ ID NO: 2886247 - protein, 19 aa, Entamoeba invadens
NENEFGEYKEQAEKSINSL

SEQ ID NO: 2886248 - protein, 47 aa, Entamoeba invadens
NENEFGEYKEQAEKSINSLTAQKADLQKELEKERSLKQEADKETQRL

SEQ ID NO: 2886249 - protein, 48 aa, Entamoeba invadens
NENEFGEYKEQAEKSINSLTDQKAELQKELEKKRAMKQKLTKKTQRLR

SEQ ID NO: 2886250 - protein, 15 aa, Entamoeba invadens
NENEFGEYKEQAENS

SEQ ID NO: 2886251 - protein, 7 aa, Entamoeba invadens
NENEPCN

SEQ ID NO: 2886252 - protein, 8 aa, Entamoeba invadens
NENEPGMK

SEQ ID NO: 2886253 - protein, 6 aa, Entamoeba invadens
NENEPL

SEQ ID NO: 2886254 - protein, 18 aa, Entamoeba invadens
NENEQQVFDTDNAKTLST

SEQ ID NO: 2886255 - protein, 6 aa, Entamoeba invadens
NENEQY

SEQ ID NO: 2886256 - protein, 15 aa, Entamoeba invadens
NENESPDTVISEGQN

SEQ ID NO: 2886257 - protein, 5 aa, Entamoeba invadens
NENET

SEQ ID NO: 2886258 - protein, 5 aa, Entamoeba invadens
NENFS

SEQ ID NO: 2886259 - protein, 4 aa, Entamoeba invadens
NENG

SEQ ID NO: 2886260 - protein, 6 aa, Entamoeba invadens
NENGEI

SEQ ID NO: 2886261 - protein, 8 aa, Entamoeba invadens
NENGNNSR

SEQ ID NO: 2886262 - protein, 7 aa, Entamoeba invadens
NENGQRV

SEQ ID NO: 2886263 - protein, 8 aa, Entamoeba invadens
NENIPTED

SEQ ID NO: 2886264 - protein, 11 aa, Entamoeba invadens
NENIRDNLKDD

SEQ ID NO: 2886265 - protein, 9 aa, Entamoeba invadens
NENISVKGS

SEQ ID NO: 2886266 - protein, 21 aa, Entamoeba invadens
NENKELKEQIEKTLNGENRDE

SEQ ID NO: 2886267 - protein, 6 aa, Entamoeba invadens
NENKER

SEQ ID NO: 2886268 - protein, 11 aa, Entamoeba invadens
NENKKNRIEVE

SEQ ID NO: 2886269 - protein, 7 aa, Entamoeba invadens
NENKNTK

SEQ ID NO: 2886270 - protein, 4 aa, Entamoeba invadens
NENL

SEQ ID NO: 2886271 - protein, 5 aa, Entamoeba invadens
NENNI

SEQ ID NO: 2886272 - protein, 25 aa, Entamoeba invadens
NENNKFSEALESEKRTLDATKSEFV

SEQ ID NO: 2886273 - protein, 6 aa, Entamoeba invadens
NENNTV

SEQ ID NO: 2886274 - protein, 8 aa, Entamoeba invadens
NENPKHPL

SEQ ID NO: 2886275 - protein, 23 aa, Entamoeba invadens
NENQTEENIDKTKYAFKNKSDLN

SEQ ID NO: 2886276 - protein, 8 aa, Entamoeba invadens
NENREGIR

SEQ ID NO: 2886277 - protein, 10 aa, Entamoeba invadens
NENRNAQSCQ

SEQ ID NO: 2886278 - protein, 9 aa, Entamoeba invadens
NENSDNDTE

SEQ ID NO: 2886279 - protein, 6 aa, Entamoeba invadens
NENSGV

SEQ ID NO: 2886280 - protein, 7 aa, Entamoeba invadens
NENSIEN

SEQ ID NO: 2886281 - protein, 7 aa, Entamoeba invadens
NENSTSL

SEQ ID NO: 2886282 - protein, 7 aa, Entamoeba invadens
NENSVAP

SEQ ID NO: 2886283 - protein, 4 aa, Entamoeba invadens
NENT

SEQ ID NO: 2886284 - protein, 5 aa, Entamoeba invadens
NENTE

SEQ ID NO: 2886285 - protein, 10 aa, Entamoeba invadens
NENTKRSPAV

SEQ ID NO: 2886286 - protein, 12 aa, Entamoeba invadens
NENTKTKIHTKD

SEQ ID NO: 2886287 - protein, 6 aa, Entamoeba invadens
NENTLQ

SEQ ID NO: 2886288 - protein, 5 aa, Entamoeba invadens
NENTN

SEQ ID NO: 2886289 - protein, 6 aa, Entamoeba invadens
NENTPT

SEQ ID NO: 2886290 - protein, 6 aa, Entamoeba invadens
NENTTI

SEQ ID NO: 2886291 - protein, 6 aa, Entamoeba invadens
NENYVP

SEQ ID NO: 2886292 - protein, 5 aa, Entamoeba invadens
NEPAV

SEQ ID NO: 2886293 - protein, 12 aa, Entamoeba invadens
NEPCPQPQTSEH

SEQ ID NO: 2886294 - protein, 5 aa, Entamoeba invadens
NEPEE

SEQ ID NO: 2886295 - protein, 5 aa, Entamoeba invadens
NEPEK

SEQ ID NO: 2886296 - protein, 40 aa, Entamoeba invadens
NEPELEEKAKTRRSTQRTKSVTDIKKDTGKKKNTRKGSKV

SEQ ID NO: 2886297 - protein, 8 aa, Entamoeba invadens
NEPENGVH

SEQ ID NO: 2886298 - protein, 19 aa, Entamoeba invadens
NEPERHPTERKTPTTRRGS

SEQ ID NO: 2886299 - protein, 10 aa, Entamoeba invadens
NEPETDDGGL

SEQ ID NO: 2886300 - protein, 5 aa, Entamoeba invadens
NEPEV

SEQ ID NO: 2886301 - protein, 19 aa, Entamoeba invadens
NEPFDSAPEEDSTQQDMEA

SEQ ID NO: 2886302 - protein, 6 aa, Entamoeba invadens
NEPFSK

SEQ ID NO: 2886303 - protein, 5 aa, Entamoeba invadens
NEPGK

SEQ ID NO: 2886304 - protein, 4 aa, Entamoeba invadens
NEPH

SEQ ID NO: 2886305 - protein, 4 aa, Entamoeba invadens
NEPI

SEQ ID NO: 2886306 - protein, 6 aa, Entamoeba invadens
NEPISR

SEQ ID NO: 2886307 - protein, 8 aa, Entamoeba invadens
NEPKERKL

SEQ ID NO: 2886308 - protein, 8 aa, Entamoeba invadens
NEPKGARA

SEQ ID NO: 2886309 - protein, 9 aa, Entamoeba invadens
NEPKGENKG

SEQ ID NO: 2886310 - protein, 8 aa, Entamoeba invadens
NEPKGQIQ

SEQ ID NO: 2886311 - protein, 4 aa, Entamoeba invadens
NEPL

SEQ ID NO: 2886312 - protein, 5 aa, Entamoeba invadens
NEPLK

SEQ ID NO: 2886313 - protein, 8 aa, Entamoeba invadens
NEPLPNQT

SEQ ID NO: 2886314 - protein, 7 aa, Entamoeba invadens
NEPNKLT

SEQ ID NO: 2886315 - protein, 7 aa, Entamoeba invadens
NEPPIQD

SEQ ID NO: 2886316 - protein, 6 aa, Entamoeba invadens
NEPRIT

SEQ ID NO: 2886317 - protein, 6 aa, Entamoeba invadens
NEPSCK

SEQ ID NO: 2886318 - protein, 8 aa, Entamoeba invadens
NEPSDLNN

SEQ ID NO: 2886319 - protein, 9 aa, Entamoeba invadens
NEPSEEEVT

SEQ ID NO: 2886320 - protein, 5 aa, Entamoeba invadens
NEPSV

SEQ ID NO: 2886321 - protein, 6 aa, Entamoeba invadens
NEPTAA

SEQ ID NO: 2886322 - protein, 9 aa, Entamoeba invadens
NEPTAAARA

SEQ ID NO: 2886323 - protein, 13 aa, Entamoeba invadens
NEPTETRKSENVE

SEQ ID NO: 2886324 - protein, 7 aa, Entamoeba invadens
NEPTGFG

SEQ ID NO: 2886325 - protein, 10 aa, Entamoeba invadens
NEPTKVETSK

SEQ ID NO: 2886326 - protein, 6 aa, Entamoeba invadens
NEPTVA

SEQ ID NO: 2886327 - protein, 7 aa, Entamoeba invadens
NEPYHGG

SEQ ID NO: 2886328 - protein, 13 aa, Entamoeba invadens
NEPYTSNANGYYS

SEQ ID NO: 2886329 - protein, 15 aa, Entamoeba invadens
NEPYTSNANGYYSPN

SEQ ID NO: 2886330 - protein, 6 aa, Entamoeba invadens
NEQALK

SEQ ID NO: 2886331 - protein, 14 aa, Entamoeba invadens
NEQASVKIKDKQQV

SEQ ID NO: 2886332 - protein, 6 aa, Entamoeba invadens
NEQDTK

SEQ ID NO: 2886333 - protein, 9 aa, Entamoeba invadens
NEQEGTPFS

SEQ ID NO: 2886334 - protein, 21 aa, Entamoeba invadens
NEQEKTVKGSVTVKNSGKVEG

SEQ ID NO: 2886335 - protein, 18 aa, Entamoeba invadens
NEQFGEGKTGSSEIISYF

SEQ ID NO: 2886336 - protein, 14 aa, Entamoeba invadens
NEQIENEKKAIEGT

SEQ ID NO: 2886337 - protein, 6 aa, Entamoeba invadens
NEQIKE

SEQ ID NO: 2886338 - protein, 7 aa, Entamoeba invadens
NEQISRE

SEQ ID NO: 2886339 - protein, 10 aa, Entamoeba invadens
NEQKAAASAG

SEQ ID NO: 2886340 - protein, 5 aa, Entamoeba invadens
NEQKI

SEQ ID NO: 2886341 - protein, 15 aa, Entamoeba invadens
NEQKKEDEEKSEREK

SEQ ID NO: 2886342 - protein, 16 aa, Entamoeba invadens
NEQKNTLNQSQQTQSI

SEQ ID NO: 2886343 - protein, 20 aa, Entamoeba invadens
NEQNEGKANEREKKDDEKFM

SEQ ID NO: 2886344 - protein, 21 aa, Entamoeba invadens
NEQPERNKEKTQTQSITTGTV

SEQ ID NO: 2886345 - protein, 5 aa, Entamoeba invadens
NEQQI

SEQ ID NO: 2886346 - protein, 12 aa, Entamoeba invadens
NEQQIGRKKHIG

SEQ ID NO: 2886347 - protein, 8 aa, Entamoeba invadens
NEQSAKHL

SEQ ID NO: 2886348 - protein, 8 aa, Entamoeba invadens
NEQSFKSL

SEQ ID NO: 2886349 - protein, 15 aa, Entamoeba invadens
NEQSTSRSKSKGSGD

SEQ ID NO: 2886350 - protein, 4 aa, Entamoeba invadens
NEQT

SEQ ID NO: 2886351 - protein, 8 aa, Entamoeba invadens
NEQTPKQW

SEQ ID NO: 2886352 - protein, 7 aa, Entamoeba invadens
NEQTQEE

SEQ ID NO: 2886353 - protein, 41 aa, Entamoeba invadens
NEQVNESPLDVKTKEKDIKKDNNKKANKEKKPKKDKDTTEV

SEQ ID NO: 2886354 - protein, 5 aa, Entamoeba invadens
NEQYE

SEQ ID NO: 2886355 - protein, 18 aa, Entamoeba invadens
NEQYTPRRSDSFESEKDQ

SEQ ID NO: 2886356 - protein, 7 aa, Entamoeba invadens
NERDGVF

SEQ ID NO: 2886357 - protein, 9 aa, Entamoeba invadens
NERDTGEIL

SEQ ID NO: 2886358 - protein, 8 aa, Entamoeba invadens
NEREKAYD

SEQ ID NO: 2886359 - protein, 42 aa, Entamoeba invadens
NERENRKSTKDIKKPVNGANLHPKKSNVGIEDKNKRNRTVPR

SEQ ID NO: 2886360 - protein, 6 aa, Entamoeba invadens
NERERN

SEQ ID NO: 2886361 - protein, 5 aa, Entamoeba invadens
NEREY

SEQ ID NO: 2886362 - protein, 7 aa, Entamoeba invadens
NERGESG

SEQ ID NO: 2886363 - protein, 7 aa, Entamoeba invadens
NERGMTG

SEQ ID NO: 2886364 - protein, 16 aa, Entamoeba invadens
NERISSEEVVLKLEKV

SEQ ID NO: 2886365 - protein, 10 aa, Entamoeba invadens
NERKPSGLEQ

SEQ ID NO: 2886366 - protein, 8 aa, Entamoeba invadens
NERKRDAF

SEQ ID NO: 2886367 - protein, 14 aa, Entamoeba invadens
NERKRSKLTEKGVQ

SEQ ID NO: 2886368 - protein, 9 aa, Entamoeba invadens
NERKSGNLH

SEQ ID NO: 2886369 - protein, 4 aa, Entamoeba invadens
NERL

SEQ ID NO: 2886370 - protein, 4 aa, Entamoeba invadens
NERM

SEQ ID NO: 2886371 - protein, 12 aa, Entamoeba invadens
NERNADKTINTK

SEQ ID NO: 2886372 - protein, 7 aa, Entamoeba invadens
NERNDTV

SEQ ID NO: 2886373 - protein, 18 aa, Entamoeba invadens
NERNTQRVTQPESFGVGP

SEQ ID NO: 2886374 - protein, 20 aa, Entamoeba invadens
NERPKTPLLGETPDRNQGHE

SEQ ID NO: 2886375 - protein, 6 aa, Entamoeba invadens
NERPNF

SEQ ID NO: 2886376 - protein, 6 aa, Entamoeba invadens
NERPPL

SEQ ID NO: 2886377 - protein, 8 aa, Entamoeba invadens
NERRVERE

SEQ ID NO: 2886378 - protein, 7 aa, Entamoeba invadens
NERSERI

SEQ ID NO: 2886379 - protein, 19 aa, Entamoeba invadens
NERSESPPTESQLKSSQHI

SEQ ID NO: 2886380 - protein, 5 aa, Entamoeba invadens
NERSI

SEQ ID NO: 2886381 - protein, 7 aa, Entamoeba invadens
NERSKLY

SEQ ID NO: 2886382 - protein, 6 aa, Entamoeba invadens
NERSKM

SEQ ID NO: 2886383 - protein, 10 aa, Entamoeba invadens
NERSKMRDSL

SEQ ID NO: 2886384 - protein, 10 aa, Entamoeba invadens
NERSKTAQRE

SEQ ID NO: 2886385 - protein, 7 aa, Entamoeba invadens
NERSVSE

SEQ ID NO: 2886386 - protein, 5 aa, Entamoeba invadens
NERTI

SEQ ID NO: 2886387 - protein, 4 aa, Entamoeba invadens
NERV

SEQ ID NO: 2886388 - protein, 4 aa, Entamoeba invadens
NESA

SEQ ID NO: 2886389 - protein, 13 aa, Entamoeba invadens
NESALKKAVKQQK

SEQ ID NO: 2886390 - protein, 12 aa, Entamoeba invadens
NESCPETVNPSY

SEQ ID NO: 2886391 - protein, 5 aa, Entamoeba invadens
NESDC

SEQ ID NO: 2886392 - protein, 8 aa, Entamoeba invadens
NESDGTWE

SEQ ID NO: 2886393 - protein, 6 aa, Entamoeba invadens
NESDIP

SEQ ID NO: 2886394 - protein, 5 aa, Entamoeba invadens
NESDL

SEQ ID NO: 2886395 - protein, 11 aa, Entamoeba invadens
NESDPAYKDIT

SEQ ID NO: 2886396 - protein, 40 aa, Entamoeba invadens
NESDQSEKEEKSEKEDEEEKEEDVSQSPDRTTRKPCMKSP

SEQ ID NO: 2886397 - protein, 5 aa, Entamoeba invadens
NESDY

SEQ ID NO: 2886398 - protein, 4 aa, Entamoeba invadens
NESE

SEQ ID NO: 2886399 - protein, 14 aa, Entamoeba invadens
NESEDEEMENPENK

SEQ ID NO: 2886400 - protein, 7 aa, Entamoeba invadens
NESEDSH

SEQ ID NO: 2886401 - protein, 5 aa, Entamoeba invadens
NESEE

SEQ ID NO: 2886402 - protein, 24 aa, Entamoeba invadens
NESEEYIKQESTKIGGEVKEEKIE

SEQ ID NO: 2886403 - protein, 9 aa, Entamoeba invadens
NESEKDKYM

SEQ ID NO: 2886404 - protein, 8 aa, Entamoeba invadens
NESEQPIE

SEQ ID NO: 2886405 - protein, 10 aa, Entamoeba invadens
NESEQQTENM

SEQ ID NO: 2886406 - protein, 13 aa, Entamoeba invadens
NESETTEEDEDTC

SEQ ID NO: 2886407 - protein, 9 aa, Entamoeba invadens
NESGALTQL

SEQ ID NO: 2886408 - protein, 12 aa, Entamoeba invadens
NESGDDRVTQHQ

SEQ ID NO: 2886409 - protein, 12 aa, Entamoeba invadens
NESGKSVVNPQK

SEQ ID NO: 2886410 - protein, 12 aa, Entamoeba invadens
NESGLGLTSWWK

SEQ ID NO: 2886411 - protein, 5 aa, Entamoeba invadens
NESGT

SEQ ID NO: 2886412 - protein, 6 aa, Entamoeba invadens
NESGYT

SEQ ID NO: 2886413 - protein, 6 aa, Entamoeba invadens
NESHFD

SEQ ID NO: 2886414 - protein, 6 aa, Entamoeba invadens
NESHID

SEQ ID NO: 2886415 - protein, 23 aa, Entamoeba invadens
NESIRDNLTPEGCTINSNQVGSA

SEQ ID NO: 2886416 - protein, 18 aa, Entamoeba invadens
NESITLGKGSDIIAKFLR

SEQ ID NO: 2886417 - protein, 8 aa, Entamoeba invadens
NESKENFT

SEQ ID NO: 2886418 - protein, 5 aa, Entamoeba invadens
NESKM

SEQ ID NO: 2886419 - protein, 6 aa, Entamoeba invadens
NESKSE

SEQ ID NO: 2886420 - protein, 7 aa, Entamoeba invadens
NESMEDA

SEQ ID NO: 2886421 - protein, 7 aa, Entamoeba invadens
NESMKNN

SEQ ID NO: 2886422 - protein, 48 aa, Entamoeba invadens
NESNDQNDTAQKVEKIEQKSEKTESGENEEQNEENAEGFNAFLDLTQF

SEQ ID NO: 2886423 - protein, 13 aa, Entamoeba invadens
NESNGLNSEEAEA

SEQ ID NO: 2886424 - protein, 11 aa, Entamoeba invadens
NESNKEINKKN

SEQ ID NO: 2886425 - protein, 4 aa, Entamoeba invadens
NESP

SEQ ID NO: 2886426 - protein, 7 aa, Entamoeba invadens
NESQNGR

SEQ ID NO: 2886427 - protein, 8 aa, Entamoeba invadens
NESRDDQE

SEQ ID NO: 2886428 - protein, 5 aa, Entamoeba invadens
NESRE

SEQ ID NO: 2886429 - protein, 11 aa, Entamoeba invadens
NESRESSPISC

SEQ ID NO: 2886430 - protein, 13 aa, Entamoeba invadens
NESSEEDENDDFR

SEQ ID NO: 2886431 - protein, 6 aa, Entamoeba invadens
NESSIL

SEQ ID NO: 2886432 - protein, 8 aa, Entamoeba invadens
NESSKLAS

SEQ ID NO: 2886433 - protein, 6 aa, Entamoeba invadens
NESSLL

SEQ ID NO: 2886434 - protein, 6 aa, Entamoeba invadens
NESSPF

SEQ ID NO: 2886435 - protein, 7 aa, Entamoeba invadens
NESSSFA

SEQ ID NO: 2886436 - protein, 19 aa, Entamoeba invadens
NESSVVETKKEKLETKALE

SEQ ID NO: 2886437 - protein, 7 aa, Entamoeba invadens
NESSYSL

SEQ ID NO: 2886438 - protein, 8 aa, Entamoeba invadens
NESTFKAE

SEQ ID NO: 2886439 - protein, 13 aa, Entamoeba invadens
NESTLDEKKEDVY

SEQ ID NO: 2886440 - protein, 9 aa, Entamoeba invadens
NESTNYADR

SEQ ID NO: 2886441 - protein, 5 aa, Entamoeba invadens
NESTT

SEQ ID NO: 2886442 - protein, 7 aa, Entamoeba invadens
NESTVDK

SEQ ID NO: 2886443 - protein, 18 aa, Entamoeba invadens
NESTWEKKEDLENSEYKP

SEQ ID NO: 2886444 - protein, 12 aa, Entamoeba invadens
NESVAERGKTYK

SEQ ID NO: 2886445 - protein, 13 aa, Entamoeba invadens
NESVKNVNESYSV

SEQ ID NO: 2886446 - protein, 7 aa, Entamoeba invadens
NESWPPK

SEQ ID NO: 2886447 - protein, 6 aa, Entamoeba invadens
NETAEK

SEQ ID NO: 2886448 - protein, 64 aa, Entamoeba invadens
NETAMEENKEDGEQKDVQSTHETNNETTITPQIETPRLNDTKEEIKEETKQQNTKQNESELTED

SEQ ID NO: 2886449 - protein, 4 aa, Entamoeba invadens
NETC

SEQ ID NO: 2886450 - protein, 15 aa, Entamoeba invadens
NETCNNKCNTSDGTC

SEQ ID NO: 2886451 - protein, 4 aa, Entamoeba invadens
NETD

SEQ ID NO: 2886452 - protein, 11 aa, Entamoeba invadens
NETDADELPVS

SEQ ID NO: 2886453 - protein, 7 aa, Entamoeba invadens
NETDEDF

SEQ ID NO: 2886454 - protein, 9 aa, Entamoeba invadens
NETDESLNP

SEQ ID NO: 2886455 - protein, 7 aa, Entamoeba invadens
NETDNGN

SEQ ID NO: 2886456 - protein, 17 aa, Entamoeba invadens
NETDSTSYRIAVENSPV

SEQ ID NO: 2886457 - protein, 9 aa, Entamoeba invadens
NETEEVTGG

SEQ ID NO: 2886458 - protein, 14 aa, Entamoeba invadens
NETEPSIGDSIEKK

SEQ ID NO: 2886459 - protein, 9 aa, Entamoeba invadens
NETESEDHS

SEQ ID NO: 2886460 - protein, 7 aa, Entamoeba invadens
NETEYSP

SEQ ID NO: 2886461 - protein, 4 aa, Entamoeba invadens
NETG

SEQ ID NO: 2886462 - protein, 6 aa, Entamoeba invadens
NETGAR

SEQ ID NO: 2886463 - protein, 6 aa, Entamoeba invadens
NETGDK

SEQ ID NO: 2886464 - protein, 5 aa, Entamoeba invadens
NETGE

SEQ ID NO: 2886465 - protein, 6 aa, Entamoeba invadens
NETGEP

SEQ ID NO: 2886466 - protein, 7 aa, Entamoeba invadens
NETGLNE

SEQ ID NO: 2886467 - protein, 10 aa, Entamoeba invadens
NETGNKVQIT

SEQ ID NO: 2886468 - protein, 6 aa, Entamoeba invadens
NETKEL

SEQ ID NO: 2886469 - protein, 11 aa, Entamoeba invadens
NETKSEGNGEL

SEQ ID NO: 2886470 - protein, 9 aa, Entamoeba invadens
NETKTSVDG

SEQ ID NO: 2886471 - protein, 28 aa, Entamoeba invadens
NETKVNENECPSEEVKKEEMGENQPQGM

SEQ ID NO: 2886472 - protein, 6 aa, Entamoeba invadens
NETKYE

SEQ ID NO: 2886473 - protein, 4 aa, Entamoeba invadens
NETL

SEQ ID NO: 2886474 - protein, 5 aa, Entamoeba invadens
NETLN

SEQ ID NO: 2886475 - protein, 8 aa, Entamoeba invadens
NETLPSPK

SEQ ID NO: 2886476 - protein, 10 aa, Entamoeba invadens
NETLSSSPRV

SEQ ID NO: 2886477 - protein, 7 aa, Entamoeba invadens
NETLTNE

SEQ ID NO: 2886478 - protein, 4 aa, Entamoeba invadens
NETM

SEQ ID NO: 2886479 - protein, 7 aa, Entamoeba invadens
NETNERH

SEQ ID NO: 2886480 - protein, 6 aa, Entamoeba invadens
NETNEV

SEQ ID NO: 2886481 - protein, 8 aa, Entamoeba invadens
NETNPFDA

SEQ ID NO: 2886482 - protein, 5 aa, Entamoeba invadens
NETNT

SEQ ID NO: 2886483 - protein, 4 aa, Entamoeba invadens
NETP

SEQ ID NO: 2886484 - protein, 9 aa, Entamoeba invadens
NETPEQLEE

SEQ ID NO: 2886485 - protein, 14 aa, Entamoeba invadens
NETPIAERKPGMEP

SEQ ID NO: 2886486 - protein, 6 aa, Entamoeba invadens
NETPKN

SEQ ID NO: 2886487 - protein, 9 aa, Entamoeba invadens
NETPRPTTI

SEQ ID NO: 2886488 - protein, 7 aa, Entamoeba invadens
NETPVQI

SEQ ID NO: 2886489 - protein, 24 aa, Entamoeba invadens
NETQEHHENTQTENISEQRREMSK

SEQ ID NO: 2886490 - protein, 6 aa, Entamoeba invadens
NETQEI

SEQ ID NO: 2886491 - protein, 6 aa, Entamoeba invadens
NETQKI

SEQ ID NO: 2886492 - protein, 9 aa, Entamoeba invadens
NETQRPKYM

SEQ ID NO: 2886493 - protein, 5 aa, Entamoeba invadens
NETRG

SEQ ID NO: 2886494 - protein, 6 aa, Entamoeba invadens
NETRNV

SEQ ID NO: 2886495 - protein, 5 aa, Entamoeba invadens
NETRQ

SEQ ID NO: 2886496 - protein, 7 aa, Entamoeba invadens
NETRRGK

SEQ ID NO: 2886497 - protein, 6 aa, Entamoeba invadens
NETSAK

SEQ ID NO: 2886498 - protein, 11 aa, Entamoeba invadens
NETSGNGCSRL

SEQ ID NO: 2886499 - protein, 7 aa, Entamoeba invadens
NETSKRV

SEQ ID NO: 2886500 - protein, 7 aa, Entamoeba invadens
NETSNGI

SEQ ID NO: 2886501 - protein, 7 aa, Entamoeba invadens
NETSNKM

SEQ ID NO: 2886502 - protein, 11 aa, Entamoeba invadens
NETSNTLTDST

SEQ ID NO: 2886503 - protein, 8 aa, Entamoeba invadens
NETSRPQY

SEQ ID NO: 2886504 - protein, 9 aa, Entamoeba invadens
NETSTKKCT

SEQ ID NO: 2886505 - protein, 13 aa, Entamoeba invadens
NETTFKREQSVNG

SEQ ID NO: 2886506 - protein, 14 aa, Entamoeba invadens
NETTFKSEKSVDGK

SEQ ID NO: 2886507 - protein, 6 aa, Entamoeba invadens
NETTID

SEQ ID NO: 2886508 - protein, 9 aa, Entamoeba invadens
NETTPETVD

SEQ ID NO: 2886509 - protein, 8 aa, Entamoeba invadens
NETTQNYY

SEQ ID NO: 2886510 - protein, 8 aa, Entamoeba invadens
NETVDGYE

SEQ ID NO: 2886511 - protein, 5 aa, Entamoeba invadens
NETVP

SEQ ID NO: 2886512 - protein, 7 aa, Entamoeba invadens
NETVPSE

SEQ ID NO: 2886513 - protein, 20 aa, Entamoeba invadens
NETYEEDYIDEEKEKLREEN

SEQ ID NO: 2886514 - protein, 19 aa, Entamoeba invadens
NETYEEDYIDEEKEKMAEE

SEQ ID NO: 2886515 - protein, 6 aa, Entamoeba invadens
NETYNA

SEQ ID NO: 2886516 - protein, 7 aa, Entamoeba invadens
NEVDDTA

SEQ ID NO: 2886517 - protein, 6 aa, Entamoeba invadens
NEVDNF

SEQ ID NO: 2886518 - protein, 5 aa, Entamoeba invadens
NEVED

SEQ ID NO: 2886519 - protein, 16 aa, Entamoeba invadens
NEVEEDVEAKKTMKNL

SEQ ID NO: 2886520 - protein, 6 aa, Entamoeba invadens
NEVEKE

SEQ ID NO: 2886521 - protein, 7 aa, Entamoeba invadens
NEVEPTV

SEQ ID NO: 2886522 - protein, 5 aa, Entamoeba invadens
NEVEV

SEQ ID NO: 2886523 - protein, 4 aa, Entamoeba invadens
NEVG

SEQ ID NO: 2886524 - protein, 7 aa, Entamoeba invadens
NEVGDEA

SEQ ID NO: 2886525 - protein, 6 aa, Entamoeba invadens
NEVGES

SEQ ID NO: 2886526 - protein, 7 aa, Entamoeba invadens
NEVGQEE

SEQ ID NO: 2886527 - protein, 17 aa, Entamoeba invadens
NEVKKQATLKTQEIKPH

SEQ ID NO: 2886528 - protein, 16 aa, Entamoeba invadens
NEVKNLEDENKTQKAK

SEQ ID NO: 2886529 - protein, 16 aa, Entamoeba invadens
NEVKSQEDAKENKKVA

SEQ ID NO: 2886530 - protein, 25 aa, Entamoeba invadens
NEVKSQEEAKENKKAALKKKIETAG

SEQ ID NO: 2886531 - protein, 26 aa, Entamoeba invadens
NEVKSQEEAKENKKAALKKKIETSGL

SEQ ID NO: 2886532 - protein, 6 aa, Entamoeba invadens
NEVKTT

SEQ ID NO: 2886533 - protein, 4 aa, Entamoeba invadens
NEVL

SEQ ID NO: 2886534 - protein, 8 aa, Entamoeba invadens
NEVNDSIQ

SEQ ID NO: 2886535 - protein, 10 aa, Entamoeba invadens
NEVNRQIETK

SEQ ID NO: 2886536 - protein, 16 aa, Entamoeba invadens
NEVNSFKSEEKDSPDR

SEQ ID NO: 2886537 - protein, 4 aa, Entamoeba invadens
NEVP

SEQ ID NO: 2886538 - protein, 16 aa, Entamoeba invadens
NEVPTTDTVTVTADAP

SEQ ID NO: 2886539 - protein, 4 aa, Entamoeba invadens
NEVQ

SEQ ID NO: 2886540 - protein, 18 aa, Entamoeba invadens
NEVSDGSSLLSTQKVGPG

SEQ ID NO: 2886541 - protein, 10 aa, Entamoeba invadens
NEVSQSEQNL

SEQ ID NO: 2886542 - protein, 9 aa, Entamoeba invadens
NEVSSTNRC

SEQ ID NO: 2886543 - protein, 9 aa, Entamoeba invadens
NEVTKDSQV

SEQ ID NO: 2886544 - protein, 8 aa, Entamoeba invadens
NEVTSRRA

SEQ ID NO: 2886545 - protein, 5 aa, Entamoeba invadens
NEWPD

SEQ ID NO: 2886546 - protein, 12 aa, Entamoeba invadens
NEWSPDDPEWEG

SEQ ID NO: 2886547 - protein, 13 aa, Entamoeba invadens
NEYDEENYEEEDF

SEQ ID NO: 2886548 - protein, 8 aa, Entamoeba invadens
NEYDEQSV

SEQ ID NO: 2886549 - protein, 5 aa, Entamoeba invadens
NEYED

SEQ ID NO: 2886550 - protein, 8 aa, Entamoeba invadens
NEYEPEKK

SEQ ID NO: 2886551 - protein, 7 aa, Entamoeba invadens
NEYETNV

SEQ ID NO: 2886552 - protein, 7 aa, Entamoeba invadens
NEYGEYK

SEQ ID NO: 2886553 - protein, 4 aa, Entamoeba invadens
NEYK

SEQ ID NO: 2886554 - protein, 6 aa, Entamoeba invadens
NEYMTK

SEQ ID NO: 2886555 - protein, 11 aa, Entamoeba invadens
NEYRRKGIASQ

SEQ ID NO: 2886556 - protein, 12 aa, Entamoeba invadens
NEYTGNYGEGDT

SEQ ID NO: 2886557 - protein, 5 aa, Entamoeba invadens
NEYVE

SEQ ID NO: 2886558 - protein, 16 aa, Entamoeba invadens
NFAPTGTNDLQQENGF

SEQ ID NO: 2886559 - protein, 5 aa, Entamoeba invadens
NFDDD

SEQ ID NO: 2886560 - protein, 11 aa, Entamoeba invadens
NFDHQKSLSVK

SEQ ID NO: 2886561 - protein, 9 aa, Entamoeba invadens
NFDKPENCS

SEQ ID NO: 2886562 - protein, 4 aa, Entamoeba invadens
NFDS

SEQ ID NO: 2886563 - protein, 7 aa, Entamoeba invadens
NFDSPDA

SEQ ID NO: 2886564 - protein, 7 aa, Entamoeba invadens
NFDTEGE

SEQ ID NO: 2886565 - protein, 12 aa, Entamoeba invadens
NFEDQNNTNPQK

SEQ ID NO: 2886566 - protein, 11 aa, Entamoeba invadens
NFEGKLKRKTE

SEQ ID NO: 2886567 - protein, 6 aa, Entamoeba invadens
NFEGTL

SEQ ID NO: 2886568 - protein, 22 aa, Entamoeba invadens
NFEHGNTVDAPPTNTHTTPTTL

SEQ ID NO: 2886569 - protein, 11 aa, Entamoeba invadens
NFEKQKAVQRN

SEQ ID NO: 2886570 - protein, 5 aa, Entamoeba invadens
NFEKT

SEQ ID NO: 2886571 - protein, 8 aa, Entamoeba invadens
NFENAEEA

SEQ ID NO: 2886572 - protein, 8 aa, Entamoeba invadens
NFENTRRR

SEQ ID NO: 2886573 - protein, 17 aa, Entamoeba invadens
NFEQQAKDKAAGDDEAQ

SEQ ID NO: 2886574 - protein, 7 aa, Entamoeba invadens
NFERNGK

SEQ ID NO: 2886575 - protein, 10 aa, Entamoeba invadens
NFESETLSNC

SEQ ID NO: 2886576 - protein, 4 aa, Entamoeba invadens
NFET

SEQ ID NO: 2886577 - protein, 23 aa, Entamoeba invadens
NFETPNLKKQTPLGRVQDKGRSD

SEQ ID NO: 2886578 - protein, 16 aa, Entamoeba invadens
NFGEKGADNTPPNDKL

SEQ ID NO: 2886579 - protein, 72 aa, Entamoeba invadens
NFGEQTAKSLNTEKSFTDITSTETARKQSIELKKEEEKEQPVDKKDKKEKKSKVSKAKPKKKETPKTKEEHT

SEQ ID NO: 2886580 - protein, 40 aa, Entamoeba invadens
NFGKSQDKLKVETPKQETNRDEAKTPTQKVEEKGNEQLKD

SEQ ID NO: 2886581 - protein, 5 aa, Entamoeba invadens
NFGNE

SEQ ID NO: 2886582 - protein, 17 aa, Entamoeba invadens
NFGRQNSENVGKQVNKF

SEQ ID NO: 2886583 - protein, 10 aa, Entamoeba invadens
NFGSYDEDSN

SEQ ID NO: 2886584 - protein, 5 aa, Entamoeba invadens
NFKDK

SEQ ID NO: 2886585 - protein, 9 aa, Entamoeba invadens
NFKDTQPDK

SEQ ID NO: 2886586 - protein, 7 aa, Entamoeba invadens
NFKENTL

SEQ ID NO: 2886587 - protein, 11 aa, Entamoeba invadens
NFKKTKQLTKC

SEQ ID NO: 2886588 - protein, 11 aa, Entamoeba invadens
NFKNNEKTKKY

SEQ ID NO: 2886589 - protein, 26 aa, Entamoeba invadens
NFKSGTNQNVQDERWKKEYRKKEEEV

SEQ ID NO: 2886590 - protein, 6 aa, Entamoeba invadens
NFKSNK

SEQ ID NO: 2886591 - protein, 14 aa, Entamoeba invadens
NFKTTNPKHFDNQT

SEQ ID NO: 2886592 - protein, 7 aa, Entamoeba invadens
NFNEKSP

SEQ ID NO: 2886593 - protein, 4 aa, Entamoeba invadens
NFPA

SEQ ID NO: 2886594 - protein, 5 aa, Entamoeba invadens
NFPDN

SEQ ID NO: 2886595 - protein, 6 aa, Entamoeba invadens
NFPDNT

SEQ ID NO: 2886596 - protein, 8 aa, Entamoeba invadens
NFPEKNAK

SEQ ID NO: 2886597 - protein, 6 aa, Entamoeba invadens
NFPEST

SEQ ID NO: 2886598 - protein, 12 aa, Entamoeba invadens
NFPGDSALSADD

SEQ ID NO: 2886599 - protein, 4 aa, Entamoeba invadens
NFPK

SEQ ID NO: 2886600 - protein, 11 aa, Entamoeba invadens
NFPPNSAEKAF

SEQ ID NO: 2886601 - protein, 8 aa, Entamoeba invadens
NFPQSTSS

SEQ ID NO: 2886602 - protein, 6 aa, Entamoeba invadens
NFPRSP

SEQ ID NO: 2886603 - protein, 4 aa, Entamoeba invadens
NFPS

SEQ ID NO: 2886604 - protein, 21 aa, Entamoeba invadens
NFPTEEPYSKRPSKLVSGDYA

SEQ ID NO: 2886605 - protein, 9 aa, Entamoeba invadens
NFPTPQRSY

SEQ ID NO: 2886606 - protein, 9 aa, Entamoeba invadens
NFPTQSKTL

SEQ ID NO: 2886607 - protein, 12 aa, Entamoeba invadens
NFPTQSYVPTSP

SEQ ID NO: 2886608 - protein, 4 aa, Entamoeba invadens
NFPY

SEQ ID NO: 2886609 - protein, 8 aa, Entamoeba invadens
NFQEPGRI

SEQ ID NO: 2886610 - protein, 7 aa, Entamoeba invadens
NFQGTNV

SEQ ID NO: 2886611 - protein, 16 aa, Entamoeba invadens
NFQNEQNEKLQSDEVY

SEQ ID NO: 2886612 - protein, 16 aa, Entamoeba invadens
NFQNKTNDNNSASYTT

SEQ ID NO: 2886613 - protein, 4 aa, Entamoeba invadens
NFQV

SEQ ID NO: 2886614 - protein, 4 aa, Entamoeba invadens
NFRG

SEQ ID NO: 2886615 - protein, 7 aa, Entamoeba invadens
NFRKNGI

SEQ ID NO: 2886616 - protein, 9 aa, Entamoeba invadens
NFRKNGIGC

SEQ ID NO: 2886617 - protein, 5 aa, Entamoeba invadens
NFRPD

SEQ ID NO: 2886618 - protein, 11 aa, Entamoeba invadens
NFRSQKKTVNE

SEQ ID NO: 2886619 - protein, 5 aa, Entamoeba invadens
NFSDE

SEQ ID NO: 2886620 - protein, 7 aa, Entamoeba invadens
NFSEEVG

SEQ ID NO: 2886621 - protein, 6 aa, Entamoeba invadens
NFSESE

SEQ ID NO: 2886622 - protein, 8 aa, Entamoeba invadens
NFSGTGVE

SEQ ID NO: 2886623 - protein, 10 aa, Entamoeba invadens
NFSNDDNSME

SEQ ID NO: 2886624 - protein, 6 aa, Entamoeba invadens
NFSPQN

SEQ ID NO: 2886625 - protein, 9 aa, Entamoeba invadens
NFSQPDAPL

SEQ ID NO: 2886626 - protein, 7 aa, Entamoeba invadens
NFSREQS

SEQ ID NO: 2886627 - protein, 11 aa, Entamoeba invadens
NFSSKFEDQNE

SEQ ID NO: 2886628 - protein, 10 aa, Entamoeba invadens
NFSSNEQRFG

SEQ ID NO: 2886629 - protein, 10 aa, Entamoeba invadens
NFSTKGPTKI

SEQ ID NO: 2886630 - protein, 5 aa, Entamoeba invadens
NFSTT

SEQ ID NO: 2886631 - protein, 4 aa, Entamoeba invadens
NFSV

SEQ ID NO: 2886632 - protein, 8 aa, Entamoeba invadens
NFSVPPSA

SEQ ID NO: 2886633 - protein, 5 aa, Entamoeba invadens
NFTIT

SEQ ID NO: 2886634 - protein, 21 aa, Entamoeba invadens
NFTKEENEVKTPQDELADGYK

SEQ ID NO: 2886635 - protein, 5 aa, Entamoeba invadens
NFTKY

SEQ ID NO: 2886636 - protein, 5 aa, Entamoeba invadens
NFTNY

SEQ ID NO: 2886637 - protein, 6 aa, Entamoeba invadens
NFTPTD

SEQ ID NO: 2886638 - protein, 16 aa, Entamoeba invadens
NFTQETVPQPVEENIT

SEQ ID NO: 2886639 - protein, 6 aa, Entamoeba invadens
NFTRRP

SEQ ID NO: 2886640 - protein, 8 aa, Entamoeba invadens
NFTTKRTK

SEQ ID NO: 2886641 - protein, 5 aa, Entamoeba invadens
NFVTG

SEQ ID NO: 2886642 - protein, 4 aa, Entamoeba invadens
NFYE

SEQ ID NO: 2886643 - protein, 10 aa, Entamoeba invadens
NGAAKSSNLD

SEQ ID NO: 2886644 - protein, 13 aa, Entamoeba invadens
NGADADMKDEDDK

SEQ ID NO: 2886645 - protein, 8 aa, Entamoeba invadens
NGADKRNV

SEQ ID NO: 2886646 - protein, 9 aa, Entamoeba invadens
NGADKSVLN

SEQ ID NO: 2886647 - protein, 10 aa, Entamoeba invadens
NGADVTATVG

SEQ ID NO: 2886648 - protein, 5 aa, Entamoeba invadens
NGAEH

SEQ ID NO: 2886649 - protein, 7 aa, Entamoeba invadens
NGAFDED

SEQ ID NO: 2886650 - protein, 12 aa, Entamoeba invadens
NGAIKKDNQSIG

SEQ ID NO: 2886651 - protein, 6 aa, Entamoeba invadens
NGAITK

SEQ ID NO: 2886652 - protein, 15 aa, Entamoeba invadens
NGAKIQTEDEGKESN

SEQ ID NO: 2886653 - protein, 6 aa, Entamoeba invadens
NGARRT

SEQ ID NO: 2886654 - protein, 6 aa, Entamoeba invadens
NGASTT

SEQ ID NO: 2886655 - protein, 7 aa, Entamoeba invadens
NGAVGKT

SEQ ID NO: 2886656 - protein, 10 aa, Entamoeba invadens
NGAYKNRKEF

SEQ ID NO: 2886657 - protein, 5 aa, Entamoeba invadens
NGAYS

SEQ ID NO: 2886658 - protein, 4 aa, Entamoeba invadens
NGCD

SEQ ID NO: 2886659 - protein, 7 aa, Entamoeba invadens
NGCDPAA

SEQ ID NO: 2886660 - protein, 4 aa, Entamoeba invadens
NGCE

SEQ ID NO: 2886661 - protein, 6 aa, Entamoeba invadens
NGCGKS

SEQ ID NO: 2886662 - protein, 7 aa, Entamoeba invadens
NGCKPET

SEQ ID NO: 2886663 - protein, 7 aa, Entamoeba invadens
NGCSETE

SEQ ID NO: 2886664 - protein, 9 aa, Entamoeba invadens
NGCSTTTGD

SEQ ID NO: 2886665 - protein, 6 aa, Entamoeba invadens
NGCSYK

SEQ ID NO: 2886666 - protein, 4 aa, Entamoeba invadens
NGCT

SEQ ID NO: 2886667 - protein, 11 aa, Entamoeba invadens
NGCTNSGTNNC

SEQ ID NO: 2886668 - protein, 6 aa, Entamoeba invadens
NGCWGG

SEQ ID NO: 2886669 - protein, 7 aa, Entamoeba invadens
NGDASDV

SEQ ID NO: 2886670 - protein, 29 aa, Entamoeba invadens
NGDDEASISKGVYDTYTKNNLRYSQNAPL

SEQ ID NO: 2886671 - protein, 7 aa, Entamoeba invadens
NGDDENI

SEQ ID NO: 2886672 - protein, 13 aa, Entamoeba invadens
NGDDIEDEEGQGV

SEQ ID NO: 2886673 - protein, 10 aa, Entamoeba invadens
NGDDNPKEQI

SEQ ID NO: 2886674 - protein, 9 aa, Entamoeba invadens
NGDDNPMEQ

SEQ ID NO: 2886675 - protein, 22 aa, Entamoeba invadens
NGDDTSDYDTGIRYGEKTEVTN

SEQ ID NO: 2886676 - protein, 8 aa, Entamoeba invadens
NGDEVGDR

SEQ ID NO: 2886677 - protein, 11 aa, Entamoeba invadens
NGDFKKNCEAV

SEQ ID NO: 2886678 - protein, 8 aa, Entamoeba invadens
NGDGKPVD

SEQ ID NO: 2886679 - protein, 6 aa, Entamoeba invadens
NGDGTL

SEQ ID NO: 2886680 - protein, 5 aa, Entamoeba invadens
NGDHH

SEQ ID NO: 2886681 - protein, 20 aa, Entamoeba invadens
NGDHKGHDYSLQKSGIGGAC

SEQ ID NO: 2886682 - protein, 6 aa, Entamoeba invadens
NGDIEE

SEQ ID NO: 2886683 - protein, 9 aa, Entamoeba invadens
NGDITQNDK

SEQ ID NO: 2886684 - protein, 7 aa, Entamoeba invadens
NGDKNFD

SEQ ID NO: 2886685 - protein, 8 aa, Entamoeba invadens
NGDNKTLP

SEQ ID NO: 2886686 - protein, 5 aa, Entamoeba invadens
NGDNY

SEQ ID NO: 2886687 - protein, 19 aa, Entamoeba invadens
NGDQIQTNLGNVKEKAEVW

SEQ ID NO: 2886688 - protein, 6 aa, Entamoeba invadens
NGDQTL

SEQ ID NO: 2886689 - protein, 32 aa, Entamoeba invadens
NGDRTTLKYPPFKNNAENTRRQQISVIAQKLS

SEQ ID NO: 2886690 - protein, 7 aa, Entamoeba invadens
NGDSFKK

SEQ ID NO: 2886691 - protein, 6 aa, Entamoeba invadens
NGDSVE

SEQ ID NO: 2886692 - protein, 4 aa, Entamoeba invadens
NGDT

SEQ ID NO: 2886693 - protein, 5 aa, Entamoeba invadens
NGDTI

SEQ ID NO: 2886694 - protein, 6 aa, Entamoeba invadens
NGDTNI

SEQ ID NO: 2886695 - protein, 5 aa, Entamoeba invadens
NGDVL

SEQ ID NO: 2886696 - protein, 11 aa, Entamoeba invadens
NGDYNPIKSLP

SEQ ID NO: 2886697 - protein, 8 aa, Entamoeba invadens
NGDYSEPY

SEQ ID NO: 2886698 - protein, 6 aa, Entamoeba invadens
NGEAKN

SEQ ID NO: 2886699 - protein, 13 aa, Entamoeba invadens
NGECDGSSGNCTN

SEQ ID NO: 2886700 - protein, 8 aa, Entamoeba invadens
NGECSKNR

SEQ ID NO: 2886701 - protein, 5 aa, Entamoeba invadens
NGEDI

SEQ ID NO: 2886702 - protein, 6 aa, Entamoeba invadens
NGEDLS

SEQ ID NO: 2886703 - protein, 13 aa, Entamoeba invadens
NGEEAQPQETEAQ

SEQ ID NO: 2886704 - protein, 5 aa, Entamoeba invadens
NGEEF

SEQ ID NO: 2886705 - protein, 6 aa, Entamoeba invadens
NGEEHD

SEQ ID NO: 2886706 - protein, 7 aa, Entamoeba invadens
NGEELQP

SEQ ID NO: 2886707 - protein, 5 aa, Entamoeba invadens
NGEEQ

SEQ ID NO: 2886708 - protein, 6 aa, Entamoeba invadens
NGEFVE

SEQ ID NO: 2886709 - protein, 4 aa, Entamoeba invadens
NGEG

SEQ ID NO: 2886710 - protein, 4 aa, Entamoeba invadens
NGEI

SEQ ID NO: 2886711 - protein, 5 aa, Entamoeba invadens
NGEIE

SEQ ID NO: 2886712 - protein, 24 aa, Entamoeba invadens
NGEITPAGKPLTALEKDEDKPGMG

SEQ ID NO: 2886713 - protein, 8 aa, Entamoeba invadens
NGEKANQL

SEQ ID NO: 2886714 - protein, 7 aa, Entamoeba invadens
NGEKAYV

SEQ ID NO: 2886715 - protein, 19 aa, Entamoeba invadens
NGEKDEKKFDIKKKKASNA

SEQ ID NO: 2886716 - protein, 15 aa, Entamoeba invadens
NGEKEVYRKKTNGAE

SEQ ID NO: 2886717 - protein, 10 aa, Entamoeba invadens
NGEKTIEGDV

SEQ ID NO: 2886718 - protein, 5 aa, Entamoeba invadens
NGEKV

SEQ ID NO: 2886719 - protein, 4 aa, Entamoeba invadens
NGEL

SEQ ID NO: 2886720 - protein, 6 aa, Entamoeba invadens
NGELHA

SEQ ID NO: 2886721 - protein, 10 aa, Entamoeba invadens
NGEMYKDPKP

SEQ ID NO: 2886722 - protein, 5 aa, Entamoeba invadens
NGENF

SEQ ID NO: 2886723 - protein, 5 aa, Entamoeba invadens
NGENG

SEQ ID NO: 2886724 - protein, 6 aa, Entamoeba invadens
NGENIK

SEQ ID NO: 2886725 - protein, 18 aa, Entamoeba invadens
NGENLTVKAKDKRDEEVL

SEQ ID NO: 2886726 - protein, 8 aa, Entamoeba invadens
NGENSKNL

SEQ ID NO: 2886727 - protein, 13 aa, Entamoeba invadens
NGEPEAFPDTQDE

SEQ ID NO: 2886728 - protein, 37 aa, Entamoeba invadens
NGEPISDVSKGKDKEVCKASREVKKDCDKTKNAMDQE

SEQ ID NO: 2886729 - protein, 7 aa, Entamoeba invadens
NGEPKFR

SEQ ID NO: 2886730 - protein, 5 aa, Entamoeba invadens
NGEPY

SEQ ID NO: 2886731 - protein, 4 aa, Entamoeba invadens
NGEQ

SEQ ID NO: 2886732 - protein, 10 aa, Entamoeba invadens
NGERDEKEQN

SEQ ID NO: 2886733 - protein, 5 aa, Entamoeba invadens
NGERK

SEQ ID NO: 2886734 - protein, 11 aa, Entamoeba invadens
NGERSSIESPQ

SEQ ID NO: 2886735 - protein, 4 aa, Entamoeba invadens
NGES

SEQ ID NO: 2886736 - protein, 7 aa, Entamoeba invadens
NGESFST

SEQ ID NO: 2886737 - protein, 11 aa, Entamoeba invadens
NGESGTKATGI

SEQ ID NO: 2886738 - protein, 12 aa, Entamoeba invadens
NGESLSVPKTRL

SEQ ID NO: 2886739 - protein, 5 aa, Entamoeba invadens
NGESQ

SEQ ID NO: 2886740 - protein, 26 aa, Entamoeba invadens
NGESTTDDAEEDEEDKKNSGKGLGPK

SEQ ID NO: 2886741 - protein, 11 aa, Entamoeba invadens
NGETGTKSVGI

SEQ ID NO: 2886742 - protein, 7 aa, Entamoeba invadens
NGEVDQN

SEQ ID NO: 2886743 - protein, 13 aa, Entamoeba invadens
NGEVHRNAGEWKQ

SEQ ID NO: 2886744 - protein, 4 aa, Entamoeba invadens
NGEY

SEQ ID NO: 2886745 - protein, 7 aa, Entamoeba invadens
NGFDGKL

SEQ ID NO: 2886746 - protein, 12 aa, Entamoeba invadens
NGFDKSQLRSDQ

SEQ ID NO: 2886747 - protein, 12 aa, Entamoeba invadens
NGFENHENTTSC

SEQ ID NO: 2886748 - protein, 8 aa, Entamoeba invadens
NGFEPSTK

SEQ ID NO: 2886749 - protein, 7 aa, Entamoeba invadens
NGFESKE

SEQ ID NO: 2886750 - protein, 6 aa, Entamoeba invadens
NGFETK

SEQ ID NO: 2886751 - protein, 6 aa, Entamoeba invadens
NGFGEQ

SEQ ID NO: 2886752 - protein, 11 aa, Entamoeba invadens
NGFGPNERGTG

SEQ ID NO: 2886753 - protein, 12 aa, Entamoeba invadens
NGFGSKALANTG

SEQ ID NO: 2886754 - protein, 9 aa, Entamoeba invadens
NGFKNETSH

SEQ ID NO: 2886755 - protein, 6 aa, Entamoeba invadens
NGFNAY

SEQ ID NO: 2886756 - protein, 7 aa, Entamoeba invadens
NGFNEDR

SEQ ID NO: 2886757 - protein, 12 aa, Entamoeba invadens
NGFTGGDKPTIG

SEQ ID NO: 2886758 - protein, 6 aa, Entamoeba invadens
NGFTPD

SEQ ID NO: 2886759 - protein, 7 aa, Entamoeba invadens
NGGADDV

SEQ ID NO: 2886760 - protein, 9 aa, Entamoeba invadens
NGGAQPQFP

SEQ ID NO: 2886761 - protein, 5 aa, Entamoeba invadens
NGGAY

SEQ ID NO: 2886762 - protein, 4 aa, Entamoeba invadens
NGGD

SEQ ID NO: 2886763 - protein, 7 aa, Entamoeba invadens
NGGDQLQ

SEQ ID NO: 2886764 - protein, 11 aa, Entamoeba invadens
NGGEKEEISRQ

SEQ ID NO: 2886765 - protein, 10 aa, Entamoeba invadens
NGGEPNRPPF

SEQ ID NO: 2886766 - protein, 5 aa, Entamoeba invadens
NGGER

SEQ ID NO: 2886767 - protein, 6 aa, Entamoeba invadens
NGGFAR

SEQ ID NO: 2886768 - protein, 13 aa, Entamoeba invadens
NGGFDNDEDEAEF

SEQ ID NO: 2886769 - protein, 6 aa, Entamoeba invadens
NGGGAL

SEQ ID NO: 2886770 - protein, 6 aa, Entamoeba invadens
NGGGQE

SEQ ID NO: 2886771 - protein, 48 aa, Entamoeba invadens
NGGHSSRLEKVGKQTILSQSANSSLSSSLSNSPTKSILSQSASSSCIP

SEQ ID NO: 2886772 - protein, 4 aa, Entamoeba invadens
NGGI

SEQ ID NO: 2886773 - protein, 5 aa, Entamoeba invadens
NGGIT

SEQ ID NO: 2886774 - protein, 13 aa, Entamoeba invadens
NGGKGYADNDALT

SEQ ID NO: 2886775 - protein, 25 aa, Entamoeba invadens
NGGKKTWIGSDGTATIKKSCKGPND

SEQ ID NO: 2886776 - protein, 5 aa, Entamoeba invadens
NGGKV

SEQ ID NO: 2886777 - protein, 8 aa, Entamoeba invadens
NGGKVTNC

SEQ ID NO: 2886778 - protein, 12 aa, Entamoeba invadens
NGGNATRGQADG

SEQ ID NO: 2886779 - protein, 6 aa, Entamoeba invadens
NGGNRL

SEQ ID NO: 2886780 - protein, 7 aa, Entamoeba invadens
NGGNRPD

SEQ ID NO: 2886781 - protein, 5 aa, Entamoeba invadens
NGGNV

SEQ ID NO: 2886782 - protein, 8 aa, Entamoeba invadens
NGGQVSKV

SEQ ID NO: 2886783 - protein, 9 aa, Entamoeba invadens
NGGQVTNKK

SEQ ID NO: 2886784 - protein, 4 aa, Entamoeba invadens
NGGS

SEQ ID NO: 2886785 - protein, 7 aa, Entamoeba invadens
NGGSIAD

SEQ ID NO: 2886786 - protein, 6 aa, Entamoeba invadens
NGGSIQ

SEQ ID NO: 2886787 - protein, 8 aa, Entamoeba invadens
NGGSSSNW

SEQ ID NO: 2886788 - protein, 5 aa, Entamoeba invadens
NGGSV

SEQ ID NO: 2886789 - protein, 13 aa, Entamoeba invadens
NGGVGRSAQTKGM

SEQ ID NO: 2886790 - protein, 13 aa, Entamoeba invadens
NGGVGRSGQTKGM

SEQ ID NO: 2886791 - protein, 7 aa, Entamoeba invadens
NGGYKDF

SEQ ID NO: 2886792 - protein, 10 aa, Entamoeba invadens
NGHDHKNSRL

SEQ ID NO: 2886793 - protein, 8 aa, Entamoeba invadens
NGHERTID

SEQ ID NO: 2886794 - protein, 5 aa, Entamoeba invadens
NGHGG

SEQ ID NO: 2886795 - protein, 5 aa, Entamoeba invadens
NGHGS

SEQ ID NO: 2886796 - protein, 4 aa, Entamoeba invadens
NGHI

SEQ ID NO: 2886797 - protein, 6 aa, Entamoeba invadens
NGHKEE

SEQ ID NO: 2886798 - protein, 9 aa, Entamoeba invadens
NGHKEGLHS

SEQ ID NO: 2886799 - protein, 7 aa, Entamoeba invadens
NGHPTPI

SEQ ID NO: 2886800 - protein, 6 aa, Entamoeba invadens
NGHTKN

SEQ ID NO: 2886801 - protein, 10 aa, Entamoeba invadens
NGIDEDEEIR

SEQ ID NO: 2886802 - protein, 5 aa, Entamoeba invadens
NGIDK

SEQ ID NO: 2886803 - protein, 5 aa, Entamoeba invadens
NGIDQ

SEQ ID NO: 2886804 - protein, 13 aa, Entamoeba invadens
NGIEDTQAEEYNV

SEQ ID NO: 2886805 - protein, 13 aa, Entamoeba invadens
NGIERGKSVDGKT

SEQ ID NO: 2886806 - protein, 5 aa, Entamoeba invadens
NGIGG

SEQ ID NO: 2886807 - protein, 12 aa, Entamoeba invadens
NGIGRNTEETKR

SEQ ID NO: 2886808 - protein, 8 aa, Entamoeba invadens
NGIGTDAS

SEQ ID NO: 2886809 - protein, 8 aa, Entamoeba invadens
NGIGTDAT

SEQ ID NO: 2886810 - protein, 14 aa, Entamoeba invadens
NGIKGGGDTGDVEK

SEQ ID NO: 2886811 - protein, 6 aa, Entamoeba invadens
NGIKRR

SEQ ID NO: 2886812 - protein, 4 aa, Entamoeba invadens
NGIL

SEQ ID NO: 2886813 - protein, 6 aa, Entamoeba invadens
NGINGI

SEQ ID NO: 2886814 - protein, 7 aa, Entamoeba invadens
NGINPES

SEQ ID NO: 2886815 - protein, 5 aa, Entamoeba invadens
NGINT

SEQ ID NO: 2886816 - protein, 6 aa, Entamoeba invadens
NGINTV

SEQ ID NO: 2886817 - protein, 13 aa, Entamoeba invadens
NGIPDEDFPPLEP

SEQ ID NO: 2886818 - protein, 9 aa, Entamoeba invadens
NGIPEKTAV

SEQ ID NO: 2886819 - protein, 8 aa, Entamoeba invadens
NGIPESDI

SEQ ID NO: 2886820 - protein, 8 aa, Entamoeba invadens
NGIPESSP

SEQ ID NO: 2886821 - protein, 7 aa, Entamoeba invadens
NGIPPPK

SEQ ID NO: 2886822 - protein, 4 aa, Entamoeba invadens
NGIQ

SEQ ID NO: 2886823 - protein, 7 aa, Entamoeba invadens
NGIQDPG

SEQ ID NO: 2886824 - protein, 5 aa, Entamoeba invadens
NGIRN

SEQ ID NO: 2886825 - protein, 6 aa, Entamoeba invadens
NGISDG

SEQ ID NO: 2886826 - protein, 10 aa, Entamoeba invadens
NGISEIPSKI

SEQ ID NO: 2886827 - protein, 9 aa, Entamoeba invadens
NGISEKTAL

SEQ ID NO: 2886828 - protein, 8 aa, Entamoeba invadens
NGITQKTA

SEQ ID NO: 2886829 - protein, 4 aa, Entamoeba invadens
NGKA

SEQ ID NO: 2886830 - protein, 6 aa, Entamoeba invadens
NGKAID

SEQ ID NO: 2886831 - protein, 8 aa, Entamoeba invadens
NGKAYQRE

SEQ ID NO: 2886832 - protein, 9 aa, Entamoeba invadens
NGKDYLGNN

SEQ ID NO: 2886833 - protein, 4 aa, Entamoeba invadens
NGKE

SEQ ID NO: 2886834 - protein, 5 aa, Entamoeba invadens
NGKEI

SEQ ID NO: 2886835 - protein, 6 aa, Entamoeba invadens
NGKELA

SEQ ID NO: 2886836 - protein, 7 aa, Entamoeba invadens
NGKEMGG

SEQ ID NO: 2886837 - protein, 17 aa, Entamoeba invadens
NGKESMKKYSIEKKDKN

SEQ ID NO: 2886838 - protein, 9 aa, Entamoeba invadens
NGKETGSAE

SEQ ID NO: 2886839 - protein, 4 aa, Entamoeba invadens
NGKF

SEQ ID NO: 2886840 - protein, 9 aa, Entamoeba invadens
NGKFASNGK

SEQ ID NO: 2886841 - protein, 9 aa, Entamoeba invadens
NGKFASNGN

SEQ ID NO: 2886842 - protein, 16 aa, Entamoeba invadens
NGKFEQKKYQVRPKGG

SEQ ID NO: 2886843 - protein, 6 aa, Entamoeba invadens
NGKFSH

SEQ ID NO: 2886844 - protein, 10 aa, Entamoeba invadens
NGKFTKKRKG

SEQ ID NO: 2886845 - protein, 10 aa, Entamoeba invadens
NGKGTKDGCV

SEQ ID NO: 2886846 - protein, 13 aa, Entamoeba invadens
NGKGYSLNTPEMK

SEQ ID NO: 2886847 - protein, 4 aa, Entamoeba invadens
NGKH

SEQ ID NO: 2886848 - protein, 6 aa, Entamoeba invadens
NGKIEG

SEQ ID NO: 2886849 - protein, 6 aa, Entamoeba invadens
NGKIEK

SEQ ID NO: 2886850 - protein, 9 aa, Entamoeba invadens
NGKIKDETK

SEQ ID NO: 2886851 - protein, 11 aa, Entamoeba invadens
NGKINTTIQET

SEQ ID NO: 2886852 - protein, 8 aa, Entamoeba invadens
NGKIPDAN

SEQ ID NO: 2886853 - protein, 8 aa, Entamoeba invadens
NGKKESVE

SEQ ID NO: 2886854 - protein, 8 aa, Entamoeba invadens
NGKKNMGI

SEQ ID NO: 2886855 - protein, 9 aa, Entamoeba invadens
NGKKTPKQV

SEQ ID NO: 2886856 - protein, 4 aa, Entamoeba invadens
NGKL

SEQ ID NO: 2886857 - protein, 9 aa, Entamoeba invadens
NGKLEELKS

SEQ ID NO: 2886858 - protein, 5 aa, Entamoeba invadens
NGKLK

SEQ ID NO: 2886859 - protein, 7 aa, Entamoeba invadens
NGKLQKN

SEQ ID NO: 2886860 - protein, 10 aa, Entamoeba invadens
NGKLSERKTL

SEQ ID NO: 2886861 - protein, 6 aa, Entamoeba invadens
NGKMNA

SEQ ID NO: 2886862 - protein, 9 aa, Entamoeba invadens
NGKNKIKQV

SEQ ID NO: 2886863 - protein, 5 aa, Entamoeba invadens
NGKNL

SEQ ID NO: 2886864 - protein, 6 aa, Entamoeba invadens
NGKNTF

SEQ ID NO: 2886865 - protein, 6 aa, Entamoeba invadens
NGKPKD

SEQ ID NO: 2886866 - protein, 10 aa, Entamoeba invadens
NGKPQECPKG

SEQ ID NO: 2886867 - protein, 8 aa, Entamoeba invadens
NGKPVPER

SEQ ID NO: 2886868 - protein, 8 aa, Entamoeba invadens
NGKQITTS

SEQ ID NO: 2886869 - protein, 9 aa, Entamoeba invadens
NGKQVQSYS

SEQ ID NO: 2886870 - protein, 4 aa, Entamoeba invadens
NGKR

SEQ ID NO: 2886871 - protein, 14 aa, Entamoeba invadens
NGKRGYFPSNYVRT

SEQ ID NO: 2886872 - protein, 15 aa, Entamoeba invadens
NGKRLEKTNSMSNEQ

SEQ ID NO: 2886873 - protein, 8 aa, Entamoeba invadens
NGKSKMED

SEQ ID NO: 2886874 - protein, 8 aa, Entamoeba invadens
NGKSSGDI

SEQ ID NO: 2886875 - protein, 12 aa, Entamoeba invadens
NGKSVKEGTEDA

SEQ ID NO: 2886876 - protein, 5 aa, Entamoeba invadens
NGKTF

SEQ ID NO: 2886877 - protein, 5 aa, Entamoeba invadens
NGKTG

SEQ ID NO: 2886878 - protein, 14 aa, Entamoeba invadens
NGKTGQFPSNYVTL

SEQ ID NO: 2886879 - protein, 7 aa, Entamoeba invadens
NGKTGSW

SEQ ID NO: 2886880 - protein, 8 aa, Entamoeba invadens
NGKTLEKD

SEQ ID NO: 2886881 - protein, 6 aa, Entamoeba invadens
NGKTQE

SEQ ID NO: 2886882 - protein, 8 aa, Entamoeba invadens
NGKTRAQL

SEQ ID NO: 2886883 - protein, 6 aa, Entamoeba invadens
NGKTVT

SEQ ID NO: 2886884 - protein, 5 aa, Entamoeba invadens
NGKVD

SEQ ID NO: 2886885 - protein, 11 aa, Entamoeba invadens
NGKVKESVDEE

SEQ ID NO: 2886886 - protein, 7 aa, Entamoeba invadens
NGKVPEG

SEQ ID NO: 2886887 - protein, 9 aa, Entamoeba invadens
NGKVRDKVD

SEQ ID NO: 2886888 - protein, 9 aa, Entamoeba invadens
NGKVSKAGS

SEQ ID NO: 2886889 - protein, 8 aa, Entamoeba invadens
NGKYCSQN

SEQ ID NO: 2886890 - protein, 36 aa, Entamoeba invadens
NGLGEEPEVKRKQLNKRKPLHKAKKTKQIEDTTKEV

SEQ ID NO: 2886891 - protein, 6 aa, Entamoeba invadens
NGLGEL

SEQ ID NO: 2886892 - protein, 8 aa, Entamoeba invadens
NGLGNGET

SEQ ID NO: 2886893 - protein, 8 aa, Entamoeba invadens
NGLKGVSS

SEQ ID NO: 2886894 - protein, 18 aa, Entamoeba invadens
NGLKPVPERREATRKVRE

SEQ ID NO: 2886895 - protein, 8 aa, Entamoeba invadens
NGLKREKK

SEQ ID NO: 2886896 - protein, 4 aa, Entamoeba invadens
NGLN

SEQ ID NO: 2886897 - protein, 8 aa, Entamoeba invadens
NGLNGGYV

SEQ ID NO: 2886898 - protein, 7 aa, Entamoeba invadens
NGLPDLK

SEQ ID NO: 2886899 - protein, 7 aa, Entamoeba invadens
NGLPDLS

SEQ ID NO: 2886900 - protein, 6 aa, Entamoeba invadens
NGLPND

SEQ ID NO: 2886901 - protein, 15 aa, Entamoeba invadens
NGLRGDTFAQILAGK

SEQ ID NO: 2886902 - protein, 6 aa, Entamoeba invadens
NGLSSE

SEQ ID NO: 2886903 - protein, 6 aa, Entamoeba invadens
NGLSYK

SEQ ID NO: 2886904 - protein, 4 aa, Entamoeba invadens
NGLT

SEQ ID NO: 2886905 - protein, 9 aa, Entamoeba invadens
NGLTDDDGF

SEQ ID NO: 2886906 - protein, 6 aa, Entamoeba invadens
NGLTEF

SEQ ID NO: 2886907 - protein, 6 aa, Entamoeba invadens
NGLTGE

SEQ ID NO: 2886908 - protein, 7 aa, Entamoeba invadens
NGLTHKQ

SEQ ID NO: 2886909 - protein, 6 aa, Entamoeba invadens
NGLTPN

SEQ ID NO: 2886910 - protein, 16 aa, Entamoeba invadens
NGLTQKTAKRRSQAYK

SEQ ID NO: 2886911 - protein, 4 aa, Entamoeba invadens
NGLY

SEQ ID NO: 2886912 - protein, 9 aa, Entamoeba invadens
NGMKEDSDI

SEQ ID NO: 2886913 - protein, 5 aa, Entamoeba invadens
NGMRE

SEQ ID NO: 2886914 - protein, 9 aa, Entamoeba invadens
NGMSTTASF

SEQ ID NO: 2886915 - protein, 12 aa, Entamoeba invadens
NGNCELQNGENE

SEQ ID NO: 2886916 - protein, 5 aa, Entamoeba invadens
NGNCS

SEQ ID NO: 2886917 - protein, 8 aa, Entamoeba invadens
NGNDVTLS

SEQ ID NO: 2886918 - protein, 6 aa, Entamoeba invadens
NGNEEV

SEQ ID NO: 2886919 - protein, 5 aa, Entamoeba invadens
NGNEI

SEQ ID NO: 2886920 - protein, 14 aa, Entamoeba invadens
NGNEIDYGDGDNFV

SEQ ID NO: 2886921 - protein, 6 aa, Entamoeba invadens
NGNEKV

SEQ ID NO: 2886922 - protein, 11 aa, Entamoeba invadens
NGNEPTEAELT

SEQ ID NO: 2886923 - protein, 9 aa, Entamoeba invadens
NGNESSEER

SEQ ID NO: 2886924 - protein, 5 aa, Entamoeba invadens
NGNFD

SEQ ID NO: 2886925 - protein, 6 aa, Entamoeba invadens
NGNGVN

SEQ ID NO: 2886926 - protein, 4 aa, Entamoeba invadens
NGNH

SEQ ID NO: 2886927 - protein, 7 aa, Entamoeba invadens
NGNHEYY

SEQ ID NO: 2886928 - protein, 9 aa, Entamoeba invadens
NGNHKGHDV

SEQ ID NO: 2886929 - protein, 6 aa, Entamoeba invadens
NGNKAA

SEQ ID NO: 2886930 - protein, 15 aa, Entamoeba invadens
NGNKDDFANSKTTFD

SEQ ID NO: 2886931 - protein, 9 aa, Entamoeba invadens
NGNKENFSR

SEQ ID NO: 2886932 - protein, 9 aa, Entamoeba invadens
NGNKKDYNS

SEQ ID NO: 2886933 - protein, 23 aa, Entamoeba invadens
NGNKTRSDKNENDENQDNEKVEY

SEQ ID NO: 2886934 - protein, 9 aa, Entamoeba invadens
NGNKYTGTL

SEQ ID NO: 2886935 - protein, 13 aa, Entamoeba invadens
NGNLSSVKNYEEQ

SEQ ID NO: 2886936 - protein, 5 aa, Entamoeba invadens
NGNLT

SEQ ID NO: 2886937 - protein, 7 aa, Entamoeba invadens
NGNLTEK

SEQ ID NO: 2886938 - protein, 6 aa, Entamoeba invadens
NGNNDQ

SEQ ID NO: 2886939 - protein, 10 aa, Entamoeba invadens
NGNNNECDET

SEQ ID NO: 2886940 - protein, 6 aa, Entamoeba invadens
NGNNSL

SEQ ID NO: 2886941 - protein, 8 aa, Entamoeba invadens
NGNPEERM

SEQ ID NO: 2886942 - protein, 10 aa, Entamoeba invadens
NGNPIQNEPN

SEQ ID NO: 2886943 - protein, 13 aa, Entamoeba invadens
NGNQLASELTEKS

SEQ ID NO: 2886944 - protein, 4 aa, Entamoeba invadens
NGNS

SEQ ID NO: 2886945 - protein, 9 aa, Entamoeba invadens
NGNSIRDSR

SEQ ID NO: 2886946 - protein, 8 aa, Entamoeba invadens
NGNTERGL

SEQ ID NO: 2886947 - protein, 9 aa, Entamoeba invadens
NGNTVTSKA

SEQ ID NO: 2886948 - protein, 5 aa, Entamoeba invadens
NGNVK

SEQ ID NO: 2886949 - protein, 19 aa, Entamoeba invadens
NGNVKGKKRPNPNSINESF

SEQ ID NO: 2886950 - protein, 6 aa, Entamoeba invadens
NGNVPH

SEQ ID NO: 2886951 - protein, 8 aa, Entamoeba invadens
NGNVRTRK

SEQ ID NO: 2886952 - protein, 5 aa, Entamoeba invadens
NGNWQ

SEQ ID NO: 2886953 - protein, 13 aa, Entamoeba invadens
NGNYSGQPNVFGG

SEQ ID NO: 2886954 - protein, 7 aa, Entamoeba invadens
NGNYTTA

SEQ ID NO: 2886955 - protein, 8 aa, Entamoeba invadens
NGPARKVE

SEQ ID NO: 2886956 - protein, 10 aa, Entamoeba invadens
NGPASEPAKY

SEQ ID NO: 2886957 - protein, 11 aa, Entamoeba invadens
NGPENSPFEGG

SEQ ID NO: 2886958 - protein, 6 aa, Entamoeba invadens
NGPERI

SEQ ID NO: 2886959 - protein, 12 aa, Entamoeba invadens
NGPKEMKVPPGV

SEQ ID NO: 2886960 - protein, 4 aa, Entamoeba invadens
NGPL

SEQ ID NO: 2886961 - protein, 5 aa, Entamoeba invadens
NGPLK

SEQ ID NO: 2886962 - protein, 7 aa, Entamoeba invadens
NGPQSGM

SEQ ID NO: 2886963 - protein, 5 aa, Entamoeba invadens
NGPRM

SEQ ID NO: 2886964 - protein, 5 aa, Entamoeba invadens
NGPSS

SEQ ID NO: 2886965 - protein, 8 aa, Entamoeba invadens
NGPTIPAD

SEQ ID NO: 2886966 - protein, 4 aa, Entamoeba invadens
NGQA

SEQ ID NO: 2886967 - protein, 7 aa, Entamoeba invadens
NGQDEYG

SEQ ID NO: 2886968 - protein, 33 aa, Entamoeba invadens
NGQENAEEENAEDGDFEDNEQAEKTKKTHNEEI

SEQ ID NO: 2886969 - protein, 4 aa, Entamoeba invadens
NGQH

SEQ ID NO: 2886970 - protein, 4 aa, Entamoeba invadens
NGQK

SEQ ID NO: 2886971 - protein, 5 aa, Entamoeba invadens
NGQLK

SEQ ID NO: 2886972 - protein, 13 aa, Entamoeba invadens
NGQLKKDFATPSQ

SEQ ID NO: 2886973 - protein, 14 aa, Entamoeba invadens
NGQLTEKSELTEEV

SEQ ID NO: 2886974 - protein, 5 aa, Entamoeba invadens
NGQPN

SEQ ID NO: 2886975 - protein, 14 aa, Entamoeba invadens
NGQQGYFPYNYTTP

SEQ ID NO: 2886976 - protein, 7 aa, Entamoeba invadens
NGQRAER

SEQ ID NO: 2886977 - protein, 6 aa, Entamoeba invadens
NGQRQK

SEQ ID NO: 2886978 - protein, 11 aa, Entamoeba invadens
NGQSDKTESEA

SEQ ID NO: 2886979 - protein, 6 aa, Entamoeba invadens
NGQSQK

SEQ ID NO: 2886980 - protein, 6 aa, Entamoeba invadens
NGQTVT

SEQ ID NO: 2886981 - protein, 4 aa, Entamoeba invadens
NGQW

SEQ ID NO: 2886982 - protein, 16 aa, Entamoeba invadens
NGRAGTDGTTESTEYA

SEQ ID NO: 2886983 - protein, 28 aa, Entamoeba invadens
NGRAQKKQKITVSKAQQTQSNVRTENFQ

SEQ ID NO: 2886984 - protein, 6 aa, Entamoeba invadens
NGRCST

SEQ ID NO: 2886985 - protein, 8 aa, Entamoeba invadens
NGRDTNDV

SEQ ID NO: 2886986 - protein, 11 aa, Entamoeba invadens
NGREVPDNTDS

SEQ ID NO: 2886987 - protein, 4 aa, Entamoeba invadens
NGRF

SEQ ID NO: 2886988 - protein, 8 aa, Entamoeba invadens
NGRGIPTR

SEQ ID NO: 2886989 - protein, 8 aa, Entamoeba invadens
NGRISPVS

SEQ ID NO: 2886990 - protein, 21 aa, Entamoeba invadens
NGRKNPNLAKKRFGKKNAPVN

SEQ ID NO: 2886991 - protein, 7 aa, Entamoeba invadens
NGRLGSP

SEQ ID NO: 2886992 - protein, 14 aa, Entamoeba invadens
NGRNHKKPATVPEK

SEQ ID NO: 2886993 - protein, 9 aa, Entamoeba invadens
NGRSDVDGA

SEQ ID NO: 2886994 - protein, 8 aa, Entamoeba invadens
NGRSEISP

SEQ ID NO: 2886995 - protein, 8 aa, Entamoeba invadens
NGRSERPL

SEQ ID NO: 2886996 - protein, 8 aa, Entamoeba invadens
NGRSSHDS

SEQ ID NO: 2886997 - protein, 4 aa, Entamoeba invadens
NGRT

SEQ ID NO: 2886998 - protein, 7 aa, Entamoeba invadens
NGRTRAG

SEQ ID NO: 2886999 - protein, 8 aa, Entamoeba invadens
NGRTTTSF

SEQ ID NO: 2887000 - protein, 23 aa, Entamoeba invadens
NGSASVDGGWKRSGSITVESGNV

SEQ ID NO: 2887001 - protein, 17 aa, Entamoeba invadens
NGSDTNYAADKSNKEHI

SEQ ID NO: 2887002 - protein, 8 aa, Entamoeba invadens
NGSENIDN

SEQ ID NO: 2887003 - protein, 51 aa, Entamoeba invadens
NGSENYSQTIRQNKDKNSSIDVNESVQNTTTPSTMSKSKGGANISMEDNDK

SEQ ID NO: 2887004 - protein, 5 aa, Entamoeba invadens
NGSEV

SEQ ID NO: 2887005 - protein, 5 aa, Entamoeba invadens
NGSFG

SEQ ID NO: 2887006 - protein, 14 aa, Entamoeba invadens
NGSGEVPTSRFTIL

SEQ ID NO: 2887007 - protein, 9 aa, Entamoeba invadens
NGSGHVDSD

SEQ ID NO: 2887008 - protein, 7 aa, Entamoeba invadens
NGSGNID

SEQ ID NO: 2887009 - protein, 4 aa, Entamoeba invadens
NGSI

SEQ ID NO: 2887010 - protein, 8 aa, Entamoeba invadens
NGSIPKDD

SEQ ID NO: 2887011 - protein, 10 aa, Entamoeba invadens
NGSKASIEGR

SEQ ID NO: 2887012 - protein, 7 aa, Entamoeba invadens
NGSKSRL

SEQ ID NO: 2887013 - protein, 4 aa, Entamoeba invadens
NGSL

SEQ ID NO: 2887014 - protein, 12 aa, Entamoeba invadens
NGSLSKTVTSKG

SEQ ID NO: 2887015 - protein, 8 aa, Entamoeba invadens
NGSNELTS

SEQ ID NO: 2887016 - protein, 7 aa, Entamoeba invadens
NGSNSNN

SEQ ID NO: 2887017 - protein, 9 aa, Entamoeba invadens
NGSNTERSC

SEQ ID NO: 2887018 - protein, 6 aa, Entamoeba invadens
NGSPAT

SEQ ID NO: 2887019 - protein, 7 aa, Entamoeba invadens
NGSPCPT

SEQ ID NO: 2887020 - protein, 6 aa, Entamoeba invadens
NGSPQI

SEQ ID NO: 2887021 - protein, 8 aa, Entamoeba invadens
NGSPQNTL

SEQ ID NO: 2887022 - protein, 4 aa, Entamoeba invadens
NGSR

SEQ ID NO: 2887023 - protein, 13 aa, Entamoeba invadens
NGSRESLKETTTY

SEQ ID NO: 2887024 - protein, 16 aa, Entamoeba invadens
NGSSAIKSGFAGDDNP

SEQ ID NO: 2887025 - protein, 8 aa, Entamoeba invadens
NGSSEISL

SEQ ID NO: 2887026 - protein, 5 aa, Entamoeba invadens
NGSSH

SEQ ID NO: 2887027 - protein, 10 aa, Entamoeba invadens
NGSSISDKID

SEQ ID NO: 2887028 - protein, 9 aa, Entamoeba invadens
NGSSTIRAG

SEQ ID NO: 2887029 - protein, 17 aa, Entamoeba invadens
NGSSYDVQEMEWETLDN

SEQ ID NO: 2887030 - protein, 4 aa, Entamoeba invadens
NGST

SEQ ID NO: 2887031 - protein, 5 aa, Entamoeba invadens
NGSTD

SEQ ID NO: 2887032 - protein, 6 aa, Entamoeba invadens
NGSTIN

SEQ ID NO: 2887033 - protein, 6 aa, Entamoeba invadens
NGSTPE

SEQ ID NO: 2887034 - protein, 7 aa, Entamoeba invadens
NGSTWNG

SEQ ID NO: 2887035 - protein, 7 aa, Entamoeba invadens
NGSVNPD

SEQ ID NO: 2887036 - protein, 7 aa, Entamoeba invadens
NGSYHED

SEQ ID NO: 2887037 - protein, 4 aa, Entamoeba invadens
NGTA

SEQ ID NO: 2887038 - protein, 7 aa, Entamoeba invadens
NGTAEAH

SEQ ID NO: 2887039 - protein, 9 aa, Entamoeba invadens
NGTAKYGSS

SEQ ID NO: 2887040 - protein, 10 aa, Entamoeba invadens
NGTDNAKKAV

SEQ ID NO: 2887041 - protein, 4 aa, Entamoeba invadens
NGTE

SEQ ID NO: 2887042 - protein, 5 aa, Entamoeba invadens
NGTFA

SEQ ID NO: 2887043 - protein, 5 aa, Entamoeba invadens
NGTFR

SEQ ID NO: 2887044 - protein, 8 aa, Entamoeba invadens
NGTGPRII

SEQ ID NO: 2887045 - protein, 16 aa, Entamoeba invadens
NGTIYQQGQQQAQQFT

SEQ ID NO: 2887046 - protein, 5 aa, Entamoeba invadens
NGTKD

SEQ ID NO: 2887047 - protein, 5 aa, Entamoeba invadens
NGTKF

SEQ ID NO: 2887048 - protein, 6 aa, Entamoeba invadens
NGTKIP

SEQ ID NO: 2887049 - protein, 18 aa, Entamoeba invadens
NGTKQSSSASSQTKTCPE

SEQ ID NO: 2887050 - protein, 13 aa, Entamoeba invadens
NGTLGEKRRTTAQ

SEQ ID NO: 2887051 - protein, 14 aa, Entamoeba invadens
NGTLRGSPMNEEDR

SEQ ID NO: 2887052 - protein, 12 aa, Entamoeba invadens
NGTLTRCSNGGF

SEQ ID NO: 2887053 - protein, 4 aa, Entamoeba invadens
NGTN

SEQ ID NO: 2887054 - protein, 9 aa, Entamoeba invadens
NGTNENEIR

SEQ ID NO: 2887055 - protein, 5 aa, Entamoeba invadens
NGTNI

SEQ ID NO: 2887056 - protein, 8 aa, Entamoeba invadens
NGTPSQYD

SEQ ID NO: 2887057 - protein, 10 aa, Entamoeba invadens
NGTQCDNNTE

SEQ ID NO: 2887058 - protein, 10 aa, Entamoeba invadens
NGTQNAKEYI

SEQ ID NO: 2887059 - protein, 8 aa, Entamoeba invadens
NGTQSKEL

SEQ ID NO: 2887060 - protein, 8 aa, Entamoeba invadens
NGTQTTYD

SEQ ID NO: 2887061 - protein, 8 aa, Entamoeba invadens
NGTQTTYN

SEQ ID NO: 2887062 - protein, 9 aa, Entamoeba invadens
NGTRNKKTF

SEQ ID NO: 2887063 - protein, 13 aa, Entamoeba invadens
NGTRSVSEIRTRQ

SEQ ID NO: 2887064 - protein, 9 aa, Entamoeba invadens
NGTSPSLPE

SEQ ID NO: 2887065 - protein, 12 aa, Entamoeba invadens
NGTTDECTQTPY

SEQ ID NO: 2887066 - protein, 7 aa, Entamoeba invadens
NGTTIDG

SEQ ID NO: 2887067 - protein, 11 aa, Entamoeba invadens
NGTTKEFTTGT

SEQ ID NO: 2887068 - protein, 6 aa, Entamoeba invadens
NGTTKT

SEQ ID NO: 2887069 - protein, 4 aa, Entamoeba invadens
NGTV

SEQ ID NO: 2887070 - protein, 15 aa, Entamoeba invadens
NGTVVNTTFDLSRVI

SEQ ID NO: 2887071 - protein, 6 aa, Entamoeba invadens
NGTYNL

SEQ ID NO: 2887072 - protein, 14 aa, Entamoeba invadens
NGTYRSINKENVNS

SEQ ID NO: 2887073 - protein, 7 aa, Entamoeba invadens
NGVAHTK

SEQ ID NO: 2887074 - protein, 6 aa, Entamoeba invadens
NGVAKG

SEQ ID NO: 2887075 - protein, 6 aa, Entamoeba invadens
NGVESI

SEQ ID NO: 2887076 - protein, 5 aa, Entamoeba invadens
NGVEY

SEQ ID NO: 2887077 - protein, 13 aa, Entamoeba invadens
NGVGKVSESQARE

SEQ ID NO: 2887078 - protein, 7 aa, Entamoeba invadens
NGVIPEK

SEQ ID NO: 2887079 - protein, 11 aa, Entamoeba invadens
NGVKEVEDGAF

SEQ ID NO: 2887080 - protein, 8 aa, Entamoeba invadens
NGVKKNAN

SEQ ID NO: 2887081 - protein, 23 aa, Entamoeba invadens
NGVKNTIKKGVTTVKGKVTGGLN

SEQ ID NO: 2887082 - protein, 29 aa, Entamoeba invadens
NGVLSEDEHPIEVGSSEMKGRRPSMQDTT

SEQ ID NO: 2887083 - protein, 5 aa, Entamoeba invadens
NGVNG

SEQ ID NO: 2887084 - protein, 81 aa, Entamoeba invadens
NGVNLNKNNTAVMSDKTGDADKESKKSESPGSSDDYSGKYSESDQSSHSSKSSSKGSTKSSEGDDDSTGTDSEGSSGGAKE

SEQ ID NO: 2887085 - protein, 9 aa, Entamoeba invadens
NGVNRTDFQ

SEQ ID NO: 2887086 - protein, 13 aa, Entamoeba invadens
NGVPNEEKPISIP

SEQ ID NO: 2887087 - protein, 10 aa, Entamoeba invadens
NGVPNNNKLR

SEQ ID NO: 2887088 - protein, 4 aa, Entamoeba invadens
NGVR

SEQ ID NO: 2887089 - protein, 6 aa, Entamoeba invadens
NGVSDI

SEQ ID NO: 2887090 - protein, 15 aa, Entamoeba invadens
NGVSEKTASRRQTTY

SEQ ID NO: 2887091 - protein, 14 aa, Entamoeba invadens
NGVSGKTAERRKNT

SEQ ID NO: 2887092 - protein, 5 aa, Entamoeba invadens
NGVSK

SEQ ID NO: 2887093 - protein, 8 aa, Entamoeba invadens
NGVSTFDE

SEQ ID NO: 2887094 - protein, 4 aa, Entamoeba invadens
NGVT

SEQ ID NO: 2887095 - protein, 8 aa, Entamoeba invadens
NGVTEQTA

SEQ ID NO: 2887096 - protein, 5 aa, Entamoeba invadens
NGVTP

SEQ ID NO: 2887097 - protein, 6 aa, Entamoeba invadens
NGVTSI

SEQ ID NO: 2887098 - protein, 11 aa, Entamoeba invadens
NGVVKSTRSTW

SEQ ID NO: 2887099 - protein, 4 aa, Entamoeba invadens
NGVY

SEQ ID NO: 2887100 - protein, 5 aa, Entamoeba invadens
NGVYT

SEQ ID NO: 2887101 - protein, 8 aa, Entamoeba invadens
NGVYTSEQ

SEQ ID NO: 2887102 - protein, 4 aa, Entamoeba invadens
NGWG

SEQ ID NO: 2887103 - protein, 9 aa, Entamoeba invadens
NGWKDDDVG

SEQ ID NO: 2887104 - protein, 11 aa, Entamoeba invadens
NGWSSNNSSVQ

SEQ ID NO: 2887105 - protein, 5 aa, Entamoeba invadens
NGYAQ

SEQ ID NO: 2887106 - protein, 5 aa, Entamoeba invadens
NGYCT

SEQ ID NO: 2887107 - protein, 4 aa, Entamoeba invadens
NGYD

SEQ ID NO: 2887108 - protein, 16 aa, Entamoeba invadens
NGYDVETSFENNKRNV

SEQ ID NO: 2887109 - protein, 7 aa, Entamoeba invadens
NGYEEKG

SEQ ID NO: 2887110 - protein, 13 aa, Entamoeba invadens
NGYKGTKEYKQRG

SEQ ID NO: 2887111 - protein, 14 aa, Entamoeba invadens
NGYLTDSGTLNATH

SEQ ID NO: 2887112 - protein, 4 aa, Entamoeba invadens
NGYN

SEQ ID NO: 2887113 - protein, 11 aa, Entamoeba invadens
NGYNKKSKCQN

SEQ ID NO: 2887114 - protein, 12 aa, Entamoeba invadens
NGYNSDDSFSVA

SEQ ID NO: 2887115 - protein, 9 aa, Entamoeba invadens
NGYQDDPYK

SEQ ID NO: 2887116 - protein, 6 aa, Entamoeba invadens
NGYSED

SEQ ID NO: 2887117 - protein, 5 aa, Entamoeba invadens
NGYSP

SEQ ID NO: 2887118 - protein, 11 aa, Entamoeba invadens
NGYSTPLSETT

SEQ ID NO: 2887119 - protein, 5 aa, Entamoeba invadens
NGYYQ

SEQ ID NO: 2887120 - protein, 7 aa, Entamoeba invadens
NHAEGCD

SEQ ID NO: 2887121 - protein, 14 aa, Entamoeba invadens
NHAQFGKSDQNDAH

SEQ ID NO: 2887122 - protein, 14 aa, Entamoeba invadens
NHASHPNYIETSEK

SEQ ID NO: 2887123 - protein, 7 aa, Entamoeba invadens
NHASRTS

SEQ ID NO: 2887124 - protein, 4 aa, Entamoeba invadens
NHCT

SEQ ID NO: 2887125 - protein, 10 aa, Entamoeba invadens
NHDDADPKQC

SEQ ID NO: 2887126 - protein, 9 aa, Entamoeba invadens
NHDEEKNPL

SEQ ID NO: 2887127 - protein, 9 aa, Entamoeba invadens
NHDGVLSKD

SEQ ID NO: 2887128 - protein, 4 aa, Entamoeba invadens
NHDI

SEQ ID NO: 2887129 - protein, 4 aa, Entamoeba invadens
NHDM

SEQ ID NO: 2887130 - protein, 5 aa, Entamoeba invadens
NHDVS

SEQ ID NO: 2887131 - protein, 5 aa, Entamoeba invadens
NHEAS

SEQ ID NO: 2887132 - protein, 7 aa, Entamoeba invadens
NHENEQR

SEQ ID NO: 2887133 - protein, 7 aa, Entamoeba invadens
NHEQTDI

SEQ ID NO: 2887134 - protein, 6 aa, Entamoeba invadens
NHESAA

SEQ ID NO: 2887135 - protein, 7 aa, Entamoeba invadens
NHESENV

SEQ ID NO: 2887136 - protein, 15 aa, Entamoeba invadens
NHESKETEKMSKDDI

SEQ ID NO: 2887137 - protein, 6 aa, Entamoeba invadens
NHESRA

SEQ ID NO: 2887138 - protein, 7 aa, Entamoeba invadens
NHESRQV

SEQ ID NO: 2887139 - protein, 8 aa, Entamoeba invadens
NHESRTMT

SEQ ID NO: 2887140 - protein, 10 aa, Entamoeba invadens
NHESRTMTQN

SEQ ID NO: 2887141 - protein, 5 aa, Entamoeba invadens
NHETE

SEQ ID NO: 2887142 - protein, 7 aa, Entamoeba invadens
NHETQDM

SEQ ID NO: 2887143 - protein, 8 aa, Entamoeba invadens
NHETRGMT

SEQ ID NO: 2887144 - protein, 6 aa, Entamoeba invadens
NHETRK

SEQ ID NO: 2887145 - protein, 8 aa, Entamoeba invadens
NHETRQIS

SEQ ID NO: 2887146 - protein, 9 aa, Entamoeba invadens
NHETRQISQ

SEQ ID NO: 2887147 - protein, 10 aa, Entamoeba invadens
NHETRTMSQS

SEQ ID NO: 2887148 - protein, 5 aa, Entamoeba invadens
NHETS

SEQ ID NO: 2887149 - protein, 11 aa, Entamoeba invadens
NHFDKNSTFEE

SEQ ID NO: 2887150 - protein, 7 aa, Entamoeba invadens
NHGAEKE

SEQ ID NO: 2887151 - protein, 6 aa, Entamoeba invadens
NHGNTP

SEQ ID NO: 2887152 - protein, 13 aa, Entamoeba invadens
NHGSGLYETKNVT

SEQ ID NO: 2887153 - protein, 5 aa, Entamoeba invadens
NHHTS

SEQ ID NO: 2887154 - protein, 13 aa, Entamoeba invadens
NHKAKDPDERKRI

SEQ ID NO: 2887155 - protein, 22 aa, Entamoeba invadens
NHKATQKKLEDQKLDNEDLRGQ

SEQ ID NO: 2887156 - protein, 19 aa, Entamoeba invadens
NHKDEDKTEDGEKYYNEDE

SEQ ID NO: 2887157 - protein, 6 aa, Entamoeba invadens
NHKGDE

SEQ ID NO: 2887158 - protein, 24 aa, Entamoeba invadens
NHKKKPKKNAEEEKKFKDDIEQEK

SEQ ID NO: 2887159 - protein, 12 aa, Entamoeba invadens
NHKNHSKGSHPI

SEQ ID NO: 2887160 - protein, 11 aa, Entamoeba invadens
NHKPTPRYPTH

SEQ ID NO: 2887161 - protein, 5 aa, Entamoeba invadens
NHKTF

SEQ ID NO: 2887162 - protein, 6 aa, Entamoeba invadens
NHKTKS

SEQ ID NO: 2887163 - protein, 12 aa, Entamoeba invadens
NHKWTNKTKDGF

SEQ ID NO: 2887164 - protein, 4 aa, Entamoeba invadens
NHLG

SEQ ID NO: 2887165 - protein, 4 aa, Entamoeba invadens
NHLQ

SEQ ID NO: 2887166 - protein, 7 aa, Entamoeba invadens
NHLQNQE

SEQ ID NO: 2887167 - protein, 11 aa, Entamoeba invadens
NHNGTIDKNEL

SEQ ID NO: 2887168 - protein, 7 aa, Entamoeba invadens
NHNPNYS

SEQ ID NO: 2887169 - protein, 20 aa, Entamoeba invadens
NHNSSHPPQNNSKNNNTATI

SEQ ID NO: 2887170 - protein, 8 aa, Entamoeba invadens
NHNTETKV

SEQ ID NO: 2887171 - protein, 8 aa, Entamoeba invadens
NHNTPKEI

SEQ ID NO: 2887172 - protein, 5 aa, Entamoeba invadens
NHPDS

SEQ ID NO: 2887173 - protein, 5 aa, Entamoeba invadens
NHPIQ

SEQ ID NO: 2887174 - protein, 12 aa, Entamoeba invadens
NHPITEEMGTNT

SEQ ID NO: 2887175 - protein, 7 aa, Entamoeba invadens
NHPLNGR

SEQ ID NO: 2887176 - protein, 8 aa, Entamoeba invadens
NHPPRIPS

SEQ ID NO: 2887177 - protein, 19 aa, Entamoeba invadens
NHPSSLTAANNKKPRPPHS

SEQ ID NO: 2887178 - protein, 4 aa, Entamoeba invadens
NHPV

SEQ ID NO: 2887179 - protein, 4 aa, Entamoeba invadens
NHQK

SEQ ID NO: 2887180 - protein, 17 aa, Entamoeba invadens
NHQRDINAKQSDANKKL

SEQ ID NO: 2887181 - protein, 17 aa, Entamoeba invadens
NHQSADSIKIERKNSEL

SEQ ID NO: 2887182 - protein, 5 aa, Entamoeba invadens
NHRNG

SEQ ID NO: 2887183 - protein, 14 aa, Entamoeba invadens
NHRNTCEKYTDPKY

SEQ ID NO: 2887184 - protein, 4 aa, Entamoeba invadens
NHRT

SEQ ID NO: 2887185 - protein, 6 aa, Entamoeba invadens
NHSAPI

SEQ ID NO: 2887186 - protein, 7 aa, Entamoeba invadens
NHSEGDY

SEQ ID NO: 2887187 - protein, 7 aa, Entamoeba invadens
NHSENSP

SEQ ID NO: 2887188 - protein, 10 aa, Entamoeba invadens
NHSENTQVSS

SEQ ID NO: 2887189 - protein, 9 aa, Entamoeba invadens
NHSGSLAGG

SEQ ID NO: 2887190 - protein, 10 aa, Entamoeba invadens
NHSGSLGGGH

SEQ ID NO: 2887191 - protein, 23 aa, Entamoeba invadens
NHSKRSERKDKTSERNKTSDFYN

SEQ ID NO: 2887192 - protein, 5 aa, Entamoeba invadens
NHSNL

SEQ ID NO: 2887193 - protein, 8 aa, Entamoeba invadens
NHSQTTRV

SEQ ID NO: 2887194 - protein, 7 aa, Entamoeba invadens
NHSTITN

SEQ ID NO: 2887195 - protein, 6 aa, Entamoeba invadens
NHTCEP

SEQ ID NO: 2887196 - protein, 29 aa, Entamoeba invadens
NHTEKTQNKNNTNGDETDKMERSPRSPRK

SEQ ID NO: 2887197 - protein, 5 aa, Entamoeba invadens
NHTFN

SEQ ID NO: 2887198 - protein, 5 aa, Entamoeba invadens
NHTIN

SEQ ID NO: 2887199 - protein, 6 aa, Entamoeba invadens
NHTKGL

SEQ ID NO: 2887200 - protein, 7 aa, Entamoeba invadens
NHTNKMT

SEQ ID NO: 2887201 - protein, 8 aa, Entamoeba invadens
NHTNQPEI

SEQ ID NO: 2887202 - protein, 7 aa, Entamoeba invadens
NHTQHPS

SEQ ID NO: 2887203 - protein, 7 aa, Entamoeba invadens
NHTQNSY

SEQ ID NO: 2887204 - protein, 7 aa, Entamoeba invadens
NHTTTVG

SEQ ID NO: 2887205 - protein, 4 aa, Entamoeba invadens
NHVE

SEQ ID NO: 2887206 - protein, 7 aa, Entamoeba invadens
NHVEDGD

SEQ ID NO: 2887207 - protein, 12 aa, Entamoeba invadens
NIADREEQKEYL

SEQ ID NO: 2887208 - protein, 5 aa, Entamoeba invadens
NIAND

SEQ ID NO: 2887209 - protein, 9 aa, Entamoeba invadens
NIAPKTNDT

SEQ ID NO: 2887210 - protein, 7 aa, Entamoeba invadens
NIAPTDA

SEQ ID NO: 2887211 - protein, 4 aa, Entamoeba invadens
NIAR

SEQ ID NO: 2887212 - protein, 7 aa, Entamoeba invadens
NIARAYT

SEQ ID NO: 2887213 - protein, 5 aa, Entamoeba invadens
NIATN

SEQ ID NO: 2887214 - protein, 9 aa, Entamoeba invadens
NIATNTRDG

SEQ ID NO: 2887215 - protein, 10 aa, Entamoeba invadens
NIDAQKEAKS

SEQ ID NO: 2887216 - protein, 4 aa, Entamoeba invadens
NIDD

SEQ ID NO: 2887217 - protein, 5 aa, Entamoeba invadens
NIDEK

SEQ ID NO: 2887218 - protein, 6 aa, Entamoeba invadens
NIDERT

SEQ ID NO: 2887219 - protein, 7 aa, Entamoeba invadens
NIDGKSL

SEQ ID NO: 2887220 - protein, 44 aa, Entamoeba invadens
NIDGTFKPTTISGKAMETEGETTEGRKEKTTEDYMNEDGNEMSE

SEQ ID NO: 2887221 - protein, 6 aa, Entamoeba invadens
NIDGTN

SEQ ID NO: 2887222 - protein, 8 aa, Entamoeba invadens
NIDKRNEG

SEQ ID NO: 2887223 - protein, 6 aa, Entamoeba invadens
NIDNET

SEQ ID NO: 2887224 - protein, 7 aa, Entamoeba invadens
NIDQTEV

SEQ ID NO: 2887225 - protein, 4 aa, Entamoeba invadens
NIDS

SEQ ID NO: 2887226 - protein, 17 aa, Entamoeba invadens
NIDSYSTTNDAGNERGS

SEQ ID NO: 2887227 - protein, 14 aa, Entamoeba invadens
NIDTEIQNESTLKA

SEQ ID NO: 2887228 - protein, 8 aa, Entamoeba invadens
NIDTEKHK

SEQ ID NO: 2887229 - protein, 9 aa, Entamoeba invadens
NIDVQKNSV

SEQ ID NO: 2887230 - protein, 39 aa, Entamoeba invadens
NIEDENESDFEEATEAVKKRRELKKKADEKKKNFTSAAP

SEQ ID NO: 2887231 - protein, 8 aa, Entamoeba invadens
NIEDNDDL

SEQ ID NO: 2887232 - protein, 6 aa, Entamoeba invadens
NIEEYD

SEQ ID NO: 2887233 - protein, 8 aa, Entamoeba invadens
NIEGKKQQ

SEQ ID NO: 2887234 - protein, 16 aa, Entamoeba invadens
NIEIQQPKSPKTPPLT

SEQ ID NO: 2887235 - protein, 26 aa, Entamoeba invadens
NIEKISSDVNDIKNKTKTSSGKVGKV

SEQ ID NO: 2887236 - protein, 37 aa, Entamoeba invadens
NIEKQAKDQKREVSSRLESTEMEKKSLEDKLSEVEKE

SEQ ID NO: 2887237 - protein, 6 aa, Entamoeba invadens
NIEKYT

SEQ ID NO: 2887238 - protein, 11 aa, Entamoeba invadens
NIENKEGEISD

SEQ ID NO: 2887239 - protein, 13 aa, Entamoeba invadens
NIENSTTSVPVTA

SEQ ID NO: 2887240 - protein, 5 aa, Entamoeba invadens
NIEPT

SEQ ID NO: 2887241 - protein, 14 aa, Entamoeba invadens
NIEQRTLGDPMSDK

SEQ ID NO: 2887242 - protein, 5 aa, Entamoeba invadens
NIESG

SEQ ID NO: 2887243 - protein, 15 aa, Entamoeba invadens
NIETKDKKYKGKVSL

SEQ ID NO: 2887244 - protein, 5 aa, Entamoeba invadens
NIFSN

SEQ ID NO: 2887245 - protein, 5 aa, Entamoeba invadens
NIGAV

SEQ ID NO: 2887246 - protein, 7 aa, Entamoeba invadens
NIGEESV

SEQ ID NO: 2887247 - protein, 13 aa, Entamoeba invadens
NIGGKEAGEVSPP

SEQ ID NO: 2887248 - protein, 4 aa, Entamoeba invadens
NIGK

SEQ ID NO: 2887249 - protein, 6 aa, Entamoeba invadens
NIGKNR

SEQ ID NO: 2887250 - protein, 4 aa, Entamoeba invadens
NIGN

SEQ ID NO: 2887251 - protein, 21 aa, Entamoeba invadens
NIGNNDVDEDNEYIDENEDDY

SEQ ID NO: 2887252 - protein, 5 aa, Entamoeba invadens
NIGPQ

SEQ ID NO: 2887253 - protein, 8 aa, Entamoeba invadens
NIGRSNEV

SEQ ID NO: 2887254 - protein, 9 aa, Entamoeba invadens
NIGTDREIS

SEQ ID NO: 2887255 - protein, 7 aa, Entamoeba invadens
NIGTHQE

SEQ ID NO: 2887256 - protein, 7 aa, Entamoeba invadens
NIGTPTY

SEQ ID NO: 2887257 - protein, 5 aa, Entamoeba invadens
NIKAL

SEQ ID NO: 2887258 - protein, 10 aa, Entamoeba invadens
NIKDDTNKDK

SEQ ID NO: 2887259 - protein, 5 aa, Entamoeba invadens
NIKEA

SEQ ID NO: 2887260 - protein, 7 aa, Entamoeba invadens
NIKEDGM

SEQ ID NO: 2887261 - protein, 49 aa, Entamoeba invadens
NIKKGSQGKQKSHNTKKAEKVYSQITPKKKEVNNSVTNTCNTKEEQEQI

SEQ ID NO: 2887262 - protein, 5 aa, Entamoeba invadens
NIKKS

SEQ ID NO: 2887263 - protein, 8 aa, Entamoeba invadens
NIKKTDVK

SEQ ID NO: 2887264 - protein, 6 aa, Entamoeba invadens
NIKNGE

SEQ ID NO: 2887265 - protein, 13 aa, Entamoeba invadens
NIKNKEEKTAVDL

SEQ ID NO: 2887266 - protein, 7 aa, Entamoeba invadens
NIKNSQR

SEQ ID NO: 2887267 - protein, 11 aa, Entamoeba invadens
NIKPGNDTEKV

SEQ ID NO: 2887268 - protein, 13 aa, Entamoeba invadens
NIKPNVEGKTKKK

SEQ ID NO: 2887269 - protein, 11 aa, Entamoeba invadens
NIKPPKKHSPL

SEQ ID NO: 2887270 - protein, 10 aa, Entamoeba invadens
NIKQRSSNKK

SEQ ID NO: 2887271 - protein, 20 aa, Entamoeba invadens
NIKQVTKQSLANLGADSVTI

SEQ ID NO: 2887272 - protein, 16 aa, Entamoeba invadens
NIKRGKEDLSKLTTEY

SEQ ID NO: 2887273 - protein, 20 aa, Entamoeba invadens
NIKSGFKKDQKSQDSDLKDI

SEQ ID NO: 2887274 - protein, 19 aa, Entamoeba invadens
NIKSGYKKDQKGLSDSFGK

SEQ ID NO: 2887275 - protein, 66 aa, Entamoeba invadens
NIKSSPSCSPDISNHSSPRISKSKPNRKVPQPTPKKLDAEKRKRRSVPDSATISVAQSRNKNRFSL

SEQ ID NO: 2887276 - protein, 25 aa, Entamoeba invadens
NIKTEIPKIENSNPKFAHQTTDNPK

SEQ ID NO: 2887277 - protein, 6 aa, Entamoeba invadens
NILPEN

SEQ ID NO: 2887278 - protein, 8 aa, Entamoeba invadens
NILTGSQD

SEQ ID NO: 2887279 - protein, 5 aa, Entamoeba invadens
NINDR

SEQ ID NO: 2887280 - protein, 14 aa, Entamoeba invadens
NINDRSLRGDRDTE

SEQ ID NO: 2887281 - protein, 5 aa, Entamoeba invadens
NINEE

SEQ ID NO: 2887282 - protein, 8 aa, Entamoeba invadens
NINEKRKN

SEQ ID NO: 2887283 - protein, 16 aa, Entamoeba invadens
NINGGSNSGSLNNSTH

SEQ ID NO: 2887284 - protein, 5 aa, Entamoeba invadens
NINGN

SEQ ID NO: 2887285 - protein, 14 aa, Entamoeba invadens
NINKESPQKQTKYC

SEQ ID NO: 2887286 - protein, 15 aa, Entamoeba invadens
NINKQNEKIKTLNGS

SEQ ID NO: 2887287 - protein, 12 aa, Entamoeba invadens
NINNNSKGNHNM

SEQ ID NO: 2887288 - protein, 11 aa, Entamoeba invadens
NINNSKPQKEY

SEQ ID NO: 2887289 - protein, 8 aa, Entamoeba invadens
NINPFKSK

SEQ ID NO: 2887290 - protein, 9 aa, Entamoeba invadens
NINPNSKST

SEQ ID NO: 2887291 - protein, 5 aa, Entamoeba invadens
NINRA

SEQ ID NO: 2887292 - protein, 6 aa, Entamoeba invadens
NINSPF

SEQ ID NO: 2887293 - protein, 9 aa, Entamoeba invadens
NINSPTSDT

SEQ ID NO: 2887294 - protein, 4 aa, Entamoeba invadens
NINT

SEQ ID NO: 2887295 - protein, 4 aa, Entamoeba invadens
NIPD

SEQ ID NO: 2887296 - protein, 9 aa, Entamoeba invadens
NIPDGNYNK

SEQ ID NO: 2887297 - protein, 6 aa, Entamoeba invadens
NIPDPS

SEQ ID NO: 2887298 - protein, 6 aa, Entamoeba invadens
NIPGGH

SEQ ID NO: 2887299 - protein, 20 aa, Entamoeba invadens
NIPGGKGLGKGYKMSKDKTV

SEQ ID NO: 2887300 - protein, 5 aa, Entamoeba invadens
NIPGS

SEQ ID NO: 2887301 - protein, 7 aa, Entamoeba invadens
NIPIDGT

SEQ ID NO: 2887302 - protein, 24 aa, Entamoeba invadens
NIPIPETKEAEEDMSETSEENITE

SEQ ID NO: 2887303 - protein, 4 aa, Entamoeba invadens
NIPK

SEQ ID NO: 2887304 - protein, 12 aa, Entamoeba invadens
NIPKEFTSNAGK

SEQ ID NO: 2887305 - protein, 7 aa, Entamoeba invadens
NIPLNKN

SEQ ID NO: 2887306 - protein, 4 aa, Entamoeba invadens
NIPN

SEQ ID NO: 2887307 - protein, 6 aa, Entamoeba invadens
NIPNDS

SEQ ID NO: 2887308 - protein, 6 aa, Entamoeba invadens
NIPNEK

SEQ ID NO: 2887309 - protein, 12 aa, Entamoeba invadens
NIPNKTTSLGES

SEQ ID NO: 2887310 - protein, 40 aa, Entamoeba invadens
NIPNPPNQDDDNNSDSDNENDEFERQNEVTQLNPEQLEKR

SEQ ID NO: 2887311 - protein, 5 aa, Entamoeba invadens
NIPNS

SEQ ID NO: 2887312 - protein, 6 aa, Entamoeba invadens
NIPNTV

SEQ ID NO: 2887313 - protein, 10 aa, Entamoeba invadens
NIPPKQPPYR

SEQ ID NO: 2887314 - protein, 7 aa, Entamoeba invadens
NIPPNDL

SEQ ID NO: 2887315 - protein, 9 aa, Entamoeba invadens
NIPPSIKSI

SEQ ID NO: 2887316 - protein, 17 aa, Entamoeba invadens
NIPPSPSKKTKKQSVTF

SEQ ID NO: 2887317 - protein, 12 aa, Entamoeba invadens
NIPPSVKSIGDE

SEQ ID NO: 2887318 - protein, 9 aa, Entamoeba invadens
NIPQEYKER

SEQ ID NO: 2887319 - protein, 6 aa, Entamoeba invadens
NIPQNR

SEQ ID NO: 2887320 - protein, 6 aa, Entamoeba invadens
NIPQSV

SEQ ID NO: 2887321 - protein, 7 aa, Entamoeba invadens
NIPREET

SEQ ID NO: 2887322 - protein, 7 aa, Entamoeba invadens
NIPSNAT

SEQ ID NO: 2887323 - protein, 19 aa, Entamoeba invadens
NIPSSCSDWESSSNGRECS

SEQ ID NO: 2887324 - protein, 7 aa, Entamoeba invadens
NIPSSLT

SEQ ID NO: 2887325 - protein, 6 aa, Entamoeba invadens
NIPSSV

SEQ ID NO: 2887326 - protein, 6 aa, Entamoeba invadens
NIPSTV

SEQ ID NO: 2887327 - protein, 18 aa, Entamoeba invadens
NIPTQSTKYQNPITPATS

SEQ ID NO: 2887328 - protein, 17 aa, Entamoeba invadens
NIPTSSTKYATQSEHLA

SEQ ID NO: 2887329 - protein, 5 aa, Entamoeba invadens
NIQDS

SEQ ID NO: 2887330 - protein, 15 aa, Entamoeba invadens
NIQKAPSNFFLNLFA

SEQ ID NO: 2887331 - protein, 15 aa, Entamoeba invadens
NIQKEEDDNISHQEV

SEQ ID NO: 2887332 - protein, 26 aa, Entamoeba invadens
NIQKNKKTGDLTERGKEQMKDAGTSF

SEQ ID NO: 2887333 - protein, 4 aa, Entamoeba invadens
NIQN

SEQ ID NO: 2887334 - protein, 5 aa, Entamoeba invadens
NIQNE

SEQ ID NO: 2887335 - protein, 5 aa, Entamoeba invadens
NIQQG

SEQ ID NO: 2887336 - protein, 6 aa, Entamoeba invadens
NIQQKS

SEQ ID NO: 2887337 - protein, 26 aa, Entamoeba invadens
NIQQSEDDPTVGSWSKKTGMLLPPGN

SEQ ID NO: 2887338 - protein, 5 aa, Entamoeba invadens
NIQSL

SEQ ID NO: 2887339 - protein, 7 aa, Entamoeba invadens
NIQSSNG

SEQ ID NO: 2887340 - protein, 16 aa, Entamoeba invadens
NIQTRQSRDKKTKEVA

SEQ ID NO: 2887341 - protein, 4 aa, Entamoeba invadens
NIRE

SEQ ID NO: 2887342 - protein, 5 aa, Entamoeba invadens
NIRNS

SEQ ID NO: 2887343 - protein, 6 aa, Entamoeba invadens
NIRNYG

SEQ ID NO: 2887344 - protein, 9 aa, Entamoeba invadens
NIRSEDENA

SEQ ID NO: 2887345 - protein, 6 aa, Entamoeba invadens
NIRSYD

SEQ ID NO: 2887346 - protein, 8 aa, Entamoeba invadens
NIRTGGDS

SEQ ID NO: 2887347 - protein, 12 aa, Entamoeba invadens
NISDKGGDKKIA

SEQ ID NO: 2887348 - protein, 8 aa, Entamoeba invadens
NISDYAKN

SEQ ID NO: 2887349 - protein, 9 aa, Entamoeba invadens
NISDYNNDR

SEQ ID NO: 2887350 - protein, 8 aa, Entamoeba invadens
NISGEVQT

SEQ ID NO: 2887351 - protein, 5 aa, Entamoeba invadens
NISGV

SEQ ID NO: 2887352 - protein, 12 aa, Entamoeba invadens
NISKNKETETME

SEQ ID NO: 2887353 - protein, 10 aa, Entamoeba invadens
NISLGGKVGD

SEQ ID NO: 2887354 - protein, 4 aa, Entamoeba invadens
NISN

SEQ ID NO: 2887355 - protein, 5 aa, Entamoeba invadens
NISNE

SEQ ID NO: 2887356 - protein, 7 aa, Entamoeba invadens
NISNEEN

SEQ ID NO: 2887357 - protein, 8 aa, Entamoeba invadens
NISNEMEK

SEQ ID NO: 2887358 - protein, 6 aa, Entamoeba invadens
NISNKP

SEQ ID NO: 2887359 - protein, 8 aa, Entamoeba invadens
NISNSSKM

SEQ ID NO: 2887360 - protein, 8 aa, Entamoeba invadens
NISPKQKV

SEQ ID NO: 2887361 - protein, 8 aa, Entamoeba invadens
NISPSPNP

SEQ ID NO: 2887362 - protein, 7 aa, Entamoeba invadens
NISPSQY

SEQ ID NO: 2887363 - protein, 8 aa, Entamoeba invadens
NISQTDLP

SEQ ID NO: 2887364 - protein, 4 aa, Entamoeba invadens
NISR

SEQ ID NO: 2887365 - protein, 7 aa, Entamoeba invadens
NISSEQH

SEQ ID NO: 2887366 - protein, 9 aa, Entamoeba invadens
NISSTASLS

SEQ ID NO: 2887367 - protein, 10 aa, Entamoeba invadens
NISSTRVGEM

SEQ ID NO: 2887368 - protein, 5 aa, Entamoeba invadens
NISTP

SEQ ID NO: 2887369 - protein, 10 aa, Entamoeba invadens
NISVENKNEV

SEQ ID NO: 2887370 - protein, 5 aa, Entamoeba invadens
NITDE

SEQ ID NO: 2887371 - protein, 13 aa, Entamoeba invadens
NITDTEGKTLEES

SEQ ID NO: 2887372 - protein, 10 aa, Entamoeba invadens
NITDTSSNGT

SEQ ID NO: 2887373 - protein, 4 aa, Entamoeba invadens
NITF

SEQ ID NO: 2887374 - protein, 4 aa, Entamoeba invadens
NITH

SEQ ID NO: 2887375 - protein, 5 aa, Entamoeba invadens
NITIP

SEQ ID NO: 2887376 - protein, 16 aa, Entamoeba invadens
NITKPNEEFTLSPSSA

SEQ ID NO: 2887377 - protein, 4 aa, Entamoeba invadens
NITN

SEQ ID NO: 2887378 - protein, 6 aa, Entamoeba invadens
NITNHD

SEQ ID NO: 2887379 - protein, 12 aa, Entamoeba invadens
NITNKEKPSYEN

SEQ ID NO: 2887380 - protein, 5 aa, Entamoeba invadens
NITNN

SEQ ID NO: 2887381 - protein, 9 aa, Entamoeba invadens
NITNPELNK

SEQ ID NO: 2887382 - protein, 5 aa, Entamoeba invadens
NITNS

SEQ ID NO: 2887383 - protein, 9 aa, Entamoeba invadens
NITNTKQVT

SEQ ID NO: 2887384 - protein, 4 aa, Entamoeba invadens
NITP

SEQ ID NO: 2887385 - protein, 6 aa, Entamoeba invadens
NITPTT

SEQ ID NO: 2887386 - protein, 15 aa, Entamoeba invadens
NITQEDTQVKSPPLL

SEQ ID NO: 2887387 - protein, 9 aa, Entamoeba invadens
NITQGSNPL

SEQ ID NO: 2887388 - protein, 5 aa, Entamoeba invadens
NITQK

SEQ ID NO: 2887389 - protein, 27 aa, Entamoeba invadens
NITQTAPNSPLKKSNTATNTPLSSPPH

SEQ ID NO: 2887390 - protein, 6 aa, Entamoeba invadens
NITSAD

SEQ ID NO: 2887391 - protein, 8 aa, Entamoeba invadens
NITSGNKK

SEQ ID NO: 2887392 - protein, 9 aa, Entamoeba invadens
NITSIPDGR

SEQ ID NO: 2887393 - protein, 11 aa, Entamoeba invadens
NITSKSATFEK

SEQ ID NO: 2887394 - protein, 13 aa, Entamoeba invadens
NITSQDVNHGSEI

SEQ ID NO: 2887395 - protein, 9 aa, Entamoeba invadens
NITTETKSA

SEQ ID NO: 2887396 - protein, 8 aa, Entamoeba invadens
NITTPRNI

SEQ ID NO: 2887397 - protein, 18 aa, Entamoeba invadens
NITTQNKPLKRNKKGCNI

SEQ ID NO: 2887398 - protein, 6 aa, Entamoeba invadens
NITTTS

SEQ ID NO: 2887399 - protein, 7 aa, Entamoeba invadens
NIVDGEQ

SEQ ID NO: 2887400 - protein, 33 aa, Entamoeba invadens
NIVPQQSQPIQQSAQMPQTLPQQAQQQQNPPMS

SEQ ID NO: 2887401 - protein, 6 aa, Entamoeba invadens
NIVPQT

SEQ ID NO: 2887402 - protein, 11 aa, Entamoeba invadens
NIWESGDETVI

SEQ ID NO: 2887403 - protein, 7 aa, Entamoeba invadens
NIYSSGQ

SEQ ID NO: 2887404 - protein, 14 aa, Entamoeba invadens
NKAAGGGYEDEDRY

SEQ ID NO: 2887405 - protein, 14 aa, Entamoeba invadens
NKAAGGGYEDENTY

SEQ ID NO: 2887406 - protein, 6 aa, Entamoeba invadens
NKADIE

SEQ ID NO: 2887407 - protein, 23 aa, Entamoeba invadens
NKADKDAVKNVPTEQAAEFAKQE

SEQ ID NO: 2887408 - protein, 18 aa, Entamoeba invadens
NKADNGKQVSKDVTQDFA

SEQ ID NO: 2887409 - protein, 7 aa, Entamoeba invadens
NKADQER

SEQ ID NO: 2887410 - protein, 4 aa, Entamoeba invadens
NKAE

SEQ ID NO: 2887411 - protein, 15 aa, Entamoeba invadens
NKAEKPRSTAKRDEL

SEQ ID NO: 2887412 - protein, 7 aa, Entamoeba invadens
NKAEPRA

SEQ ID NO: 2887413 - protein, 5 aa, Entamoeba invadens
NKAEY

SEQ ID NO: 2887414 - protein, 4 aa, Entamoeba invadens
NKAF

SEQ ID NO: 2887415 - protein, 7 aa, Entamoeba invadens
NKAFGDT

SEQ ID NO: 2887416 - protein, 16 aa, Entamoeba invadens
NKAGTVPNKEDHQYIE

SEQ ID NO: 2887417 - protein, 8 aa, Entamoeba invadens
NKAISELD

SEQ ID NO: 2887418 - protein, 8 aa, Entamoeba invadens
NKAKAKSL

SEQ ID NO: 2887419 - protein, 9 aa, Entamoeba invadens
NKAKDVRTQ

SEQ ID NO: 2887420 - protein, 17 aa, Entamoeba invadens
NKAKESYSQTMKEESHP

SEQ ID NO: 2887421 - protein, 12 aa, Entamoeba invadens
NKAKNLPKAKKI

SEQ ID NO: 2887422 - protein, 24 aa, Entamoeba invadens
NKAKSDPSKVESAREKAERAKKTI

SEQ ID NO: 2887423 - protein, 16 aa, Entamoeba invadens
NKAKTESLSQEEEGKL

SEQ ID NO: 2887424 - protein, 6 aa, Entamoeba invadens
NKAKYT

SEQ ID NO: 2887425 - protein, 5 aa, Entamoeba invadens
NKALS

SEQ ID NO: 2887426 - protein, 14 aa, Entamoeba invadens
NKANAKLTDFGTSR

SEQ ID NO: 2887427 - protein, 12 aa, Entamoeba invadens
NKANGSDEDRQK

SEQ ID NO: 2887428 - protein, 31 aa, Entamoeba invadens
NKAPHKGSYNTRNTNTPSRGLPITKAKTLEP

SEQ ID NO: 2887429 - protein, 18 aa, Entamoeba invadens
NKARTEINIGNKKNNQRI

SEQ ID NO: 2887430 - protein, 9 aa, Entamoeba invadens
NKASGDKLA

SEQ ID NO: 2887431 - protein, 8 aa, Entamoeba invadens
NKASPFAR

SEQ ID NO: 2887432 - protein, 8 aa, Entamoeba invadens
NKCDNNNN

SEQ ID NO: 2887433 - protein, 4 aa, Entamoeba invadens
NKCE

SEQ ID NO: 2887434 - protein, 9 aa, Entamoeba invadens
NKCEPKDAH

SEQ ID NO: 2887435 - protein, 6 aa, Entamoeba invadens
NKCISN

SEQ ID NO: 2887436 - protein, 8 aa, Entamoeba invadens
NKCKENSI

SEQ ID NO: 2887437 - protein, 7 aa, Entamoeba invadens
NKCNTTG

SEQ ID NO: 2887438 - protein, 8 aa, Entamoeba invadens
NKCPKDIQ

SEQ ID NO: 2887439 - protein, 6 aa, Entamoeba invadens
NKCQAL

SEQ ID NO: 2887440 - protein, 15 aa, Entamoeba invadens
NKCTNDPLTTRFTSV

SEQ ID NO: 2887441 - protein, 10 aa, Entamoeba invadens
NKCVPDTNSH

SEQ ID NO: 2887442 - protein, 8 aa, Entamoeba invadens
NKDAMNTA

SEQ ID NO: 2887443 - protein, 4 aa, Entamoeba invadens
NKDC

SEQ ID NO: 2887444 - protein, 11 aa, Entamoeba invadens
NKDCPDTVNPS

SEQ ID NO: 2887445 - protein, 6 aa, Entamoeba invadens
NKDDET

SEQ ID NO: 2887446 - protein, 6 aa, Entamoeba invadens
NKDDIS

SEQ ID NO: 2887447 - protein, 8 aa, Entamoeba invadens
NKDDSGLT

SEQ ID NO: 2887448 - protein, 6 aa, Entamoeba invadens
NKDDSV

SEQ ID NO: 2887449 - protein, 9 aa, Entamoeba invadens
NKDDTKKMM

SEQ ID NO: 2887450 - protein, 9 aa, Entamoeba invadens
NKDEAFNDL

SEQ ID NO: 2887451 - protein, 18 aa, Entamoeba invadens
NKDEEEVERKSKEERGEG

SEQ ID NO: 2887452 - protein, 20 aa, Entamoeba invadens
NKDEENATVDKSGKNDEEVN

SEQ ID NO: 2887453 - protein, 6 aa, Entamoeba invadens
NKDEIV

SEQ ID NO: 2887454 - protein, 9 aa, Entamoeba invadens
NKDEKDVKK

SEQ ID NO: 2887455 - protein, 27 aa, Entamoeba invadens
NKDEKSDWEKESEEIQKQQSEKESEER

SEQ ID NO: 2887456 - protein, 7 aa, Entamoeba invadens
NKDELTR

SEQ ID NO: 2887457 - protein, 9 aa, Entamoeba invadens
NKDEPSGIP

SEQ ID NO: 2887458 - protein, 8 aa, Entamoeba invadens
NKDERSGI

SEQ ID NO: 2887459 - protein, 9 aa, Entamoeba invadens
NKDESSVTL

SEQ ID NO: 2887460 - protein, 7 aa, Entamoeba invadens
NKDETKI

SEQ ID NO: 2887461 - protein, 36 aa, Entamoeba invadens
NKDFKSQNYREFPTKLKSDNLKEIGERKLKENPNYN

SEQ ID NO: 2887462 - protein, 9 aa, Entamoeba invadens
NKDFNERSE

SEQ ID NO: 2887463 - protein, 20 aa, Entamoeba invadens
NKDGEEKVKAEPETQQDKPV

SEQ ID NO: 2887464 - protein, 7 aa, Entamoeba invadens
NKDGFIE

SEQ ID NO: 2887465 - protein, 9 aa, Entamoeba invadens
NKDGKVTYD

SEQ ID NO: 2887466 - protein, 12 aa, Entamoeba invadens
NKDGLISQKEAA

SEQ ID NO: 2887467 - protein, 9 aa, Entamoeba invadens
NKDGPLSTY

SEQ ID NO: 2887468 - protein, 5 aa, Entamoeba invadens
NKDKN

SEQ ID NO: 2887469 - protein, 11 aa, Entamoeba invadens
NKDKNEKVASE

SEQ ID NO: 2887470 - protein, 9 aa, Entamoeba invadens
NKDKNPLNP

SEQ ID NO: 2887471 - protein, 6 aa, Entamoeba invadens
NKDKPI

SEQ ID NO: 2887472 - protein, 8 aa, Entamoeba invadens
NKDKPTLD

SEQ ID NO: 2887473 - protein, 14 aa, Entamoeba invadens
NKDKSAAKKEKRKQ

SEQ ID NO: 2887474 - protein, 7 aa, Entamoeba invadens
NKDKTID

SEQ ID NO: 2887475 - protein, 14 aa, Entamoeba invadens
NKDLTHKITEADKN

SEQ ID NO: 2887476 - protein, 9 aa, Entamoeba invadens
NKDNEITYS

SEQ ID NO: 2887477 - protein, 5 aa, Entamoeba invadens
NKDNL

SEQ ID NO: 2887478 - protein, 7 aa, Entamoeba invadens
NKDPNTS

SEQ ID NO: 2887479 - protein, 9 aa, Entamoeba invadens
NKDPQVDSV

SEQ ID NO: 2887480 - protein, 9 aa, Entamoeba invadens
NKDPTIEMP

SEQ ID NO: 2887481 - protein, 8 aa, Entamoeba invadens
NKDQASPN

SEQ ID NO: 2887482 - protein, 8 aa, Entamoeba invadens
NKDQNTWK

SEQ ID NO: 2887483 - protein, 5 aa, Entamoeba invadens
NKDRN

SEQ ID NO: 2887484 - protein, 7 aa, Entamoeba invadens
NKDSAAN

SEQ ID NO: 2887485 - protein, 5 aa, Entamoeba invadens
NKDSF

SEQ ID NO: 2887486 - protein, 28 aa, Entamoeba invadens
NKDSKIAPSTPIPEKPISPLNSPDLERK

SEQ ID NO: 2887487 - protein, 8 aa, Entamoeba invadens
NKDSPDRI

SEQ ID NO: 2887488 - protein, 17 aa, Entamoeba invadens
NKDSQKEKANEEQRKEY

SEQ ID NO: 2887489 - protein, 17 aa, Entamoeba invadens
NKDTEIIKNGERSKRKK

SEQ ID NO: 2887490 - protein, 6 aa, Entamoeba invadens
NKDTGC

SEQ ID NO: 2887491 - protein, 7 aa, Entamoeba invadens
NKDTKMA

SEQ ID NO: 2887492 - protein, 6 aa, Entamoeba invadens
NKDTQK

SEQ ID NO: 2887493 - protein, 5 aa, Entamoeba invadens
NKDTR

SEQ ID NO: 2887494 - protein, 9 aa, Entamoeba invadens
NKDTSPSAV

SEQ ID NO: 2887495 - protein, 15 aa, Entamoeba invadens
NKDTYVGDEAQSKRG

SEQ ID NO: 2887496 - protein, 14 aa, Entamoeba invadens
NKDVQTETVKNENT

SEQ ID NO: 2887497 - protein, 9 aa, Entamoeba invadens
NKDVTPDIT

SEQ ID NO: 2887498 - protein, 6 aa, Entamoeba invadens
NKDWEE

SEQ ID NO: 2887499 - protein, 4 aa, Entamoeba invadens
NKDY

SEQ ID NO: 2887500 - protein, 9 aa, Entamoeba invadens
NKDYGDPKV

SEQ ID NO: 2887501 - protein, 6 aa, Entamoeba invadens
NKDYQD

SEQ ID NO: 2887502 - protein, 4 aa, Entamoeba invadens
NKEA

SEQ ID NO: 2887503 - protein, 7 aa, Entamoeba invadens
NKEAKEY

SEQ ID NO: 2887504 - protein, 10 aa, Entamoeba invadens
NKEANDQAFT

SEQ ID NO: 2887505 - protein, 9 aa, Entamoeba invadens
NKECQGQKD

SEQ ID NO: 2887506 - protein, 6 aa, Entamoeba invadens
NKEDEF

SEQ ID NO: 2887507 - protein, 8 aa, Entamoeba invadens
NKEDGCNE

SEQ ID NO: 2887508 - protein, 7 aa, Entamoeba invadens
NKEDLNV

SEQ ID NO: 2887509 - protein, 6 aa, Entamoeba invadens
NKEDVE

SEQ ID NO: 2887510 - protein, 9 aa, Entamoeba invadens
NKEEDRPKL

SEQ ID NO: 2887511 - protein, 5 aa, Entamoeba invadens
NKEEE

SEQ ID NO: 2887512 - protein, 8 aa, Entamoeba invadens
NKEEEYKK

SEQ ID NO: 2887513 - protein, 5 aa, Entamoeba invadens
NKEEH

SEQ ID NO: 2887514 - protein, 19 aa, Entamoeba invadens
NKEEKDVMTEEERNESEVS

SEQ ID NO: 2887515 - protein, 9 aa, Entamoeba invadens
NKEENEQKI

SEQ ID NO: 2887516 - protein, 6 aa, Entamoeba invadens
NKEENG

SEQ ID NO: 2887517 - protein, 5 aa, Entamoeba invadens
NKEER

SEQ ID NO: 2887518 - protein, 24 aa, Entamoeba invadens
NKEERRREWKAKTAEVKANIKGKY

SEQ ID NO: 2887519 - protein, 12 aa, Entamoeba invadens
NKEETTQSPPKI

SEQ ID NO: 2887520 - protein, 6 aa, Entamoeba invadens
NKEFDA

SEQ ID NO: 2887521 - protein, 10 aa, Entamoeba invadens
NKEGHVPYRN

SEQ ID NO: 2887522 - protein, 8 aa, Entamoeba invadens
NKEGINDE

SEQ ID NO: 2887523 - protein, 20 aa, Entamoeba invadens
NKEGKKGKKGFRQVQNQKKR

SEQ ID NO: 2887524 - protein, 7 aa, Entamoeba invadens
NKEGQQI

SEQ ID NO: 2887525 - protein, 14 aa, Entamoeba invadens
NKEIEEKQSPLKQN

SEQ ID NO: 2887526 - protein, 5 aa, Entamoeba invadens
NKEIP

SEQ ID NO: 2887527 - protein, 7 aa, Entamoeba invadens
NKEITGS

SEQ ID NO: 2887528 - protein, 7 aa, Entamoeba invadens
NKEKDQK

SEQ ID NO: 2887529 - protein, 11 aa, Entamoeba invadens
NKEKEEMTDPG

SEQ ID NO: 2887530 - protein, 7 aa, Entamoeba invadens
NKEKGAA

SEQ ID NO: 2887531 - protein, 9 aa, Entamoeba invadens
NKEKINESD

SEQ ID NO: 2887532 - protein, 8 aa, Entamoeba invadens
NKEKRVES

SEQ ID NO: 2887533 - protein, 9 aa, Entamoeba invadens
NKEKSSPIL

SEQ ID NO: 2887534 - protein, 6 aa, Entamoeba invadens
NKEKTD

SEQ ID NO: 2887535 - protein, 10 aa, Entamoeba invadens
NKEKVAKSPY

SEQ ID NO: 2887536 - protein, 19 aa, Entamoeba invadens
NKEKVSFNARKDHENDSFD

SEQ ID NO: 2887537 - protein, 10 aa, Entamoeba invadens
NKELEKEDKS

SEQ ID NO: 2887538 - protein, 6 aa, Entamoeba invadens
NKELND

SEQ ID NO: 2887539 - protein, 9 aa, Entamoeba invadens
NKEMPKQEG

SEQ ID NO: 2887540 - protein, 7 aa, Entamoeba invadens
NKENATV

SEQ ID NO: 2887541 - protein, 17 aa, Entamoeba invadens
NKENEKKTTKLRKEEAK

SEQ ID NO: 2887542 - protein, 12 aa, Entamoeba invadens
NKENGDKKDCEN

SEQ ID NO: 2887543 - protein, 8 aa, Entamoeba invadens
NKENIRSD

SEQ ID NO: 2887544 - protein, 11 aa, Entamoeba invadens
NKENPPTQETI

SEQ ID NO: 2887545 - protein, 18 aa, Entamoeba invadens
NKENQSMTTEDGNESNDI

SEQ ID NO: 2887546 - protein, 8 aa, Entamoeba invadens
NKENSRIN

SEQ ID NO: 2887547 - protein, 10 aa, Entamoeba invadens
NKENVEEKNV

SEQ ID NO: 2887548 - protein, 11 aa, Entamoeba invadens
NKENYESTEVN

SEQ ID NO: 2887549 - protein, 4 aa, Entamoeba invadens
NKEP

SEQ ID NO: 2887550 - protein, 10 aa, Entamoeba invadens
NKEPEKESAW

SEQ ID NO: 2887551 - protein, 8 aa, Entamoeba invadens
NKEPPSEV

SEQ ID NO: 2887552 - protein, 18 aa, Entamoeba invadens
NKEPSPPTFVGTTKRSAF

SEQ ID NO: 2887553 - protein, 6 aa, Entamoeba invadens
NKEQDV

SEQ ID NO: 2887554 - protein, 9 aa, Entamoeba invadens
NKEQKETSF

SEQ ID NO: 2887555 - protein, 8 aa, Entamoeba invadens
NKEQQEEI

SEQ ID NO: 2887556 - protein, 4 aa, Entamoeba invadens
NKER

SEQ ID NO: 2887557 - protein, 5 aa, Entamoeba invadens
NKERC

SEQ ID NO: 2887558 - protein, 10 aa, Entamoeba invadens
NKEREFEKNK

SEQ ID NO: 2887559 - protein, 10 aa, Entamoeba invadens
NKERNKPIKT

SEQ ID NO: 2887560 - protein, 7 aa, Entamoeba invadens
NKERQGL

SEQ ID NO: 2887561 - protein, 11 aa, Entamoeba invadens
NKERRKRTDAH

SEQ ID NO: 2887562 - protein, 5 aa, Entamoeba invadens
NKESA

SEQ ID NO: 2887563 - protein, 7 aa, Entamoeba invadens
NKESAAK

SEQ ID NO: 2887564 - protein, 15 aa, Entamoeba invadens
NKESDIIEDKTSHQL

SEQ ID NO: 2887565 - protein, 7 aa, Entamoeba invadens
NKESGIF

SEQ ID NO: 2887566 - protein, 11 aa, Entamoeba invadens
NKESGRRNKLQ

SEQ ID NO: 2887567 - protein, 9 aa, Entamoeba invadens
NKESKPARR

SEQ ID NO: 2887568 - protein, 7 aa, Entamoeba invadens
NKESPLI

SEQ ID NO: 2887569 - protein, 4 aa, Entamoeba invadens
NKET

SEQ ID NO: 2887570 - protein, 8 aa, Entamoeba invadens
NKETERVG

SEQ ID NO: 2887571 - protein, 7 aa, Entamoeba invadens
NKETFKP

SEQ ID NO: 2887572 - protein, 8 aa, Entamoeba invadens
NKETKPYQ

SEQ ID NO: 2887573 - protein, 5 aa, Entamoeba invadens
NKETL

SEQ ID NO: 2887574 - protein, 7 aa, Entamoeba invadens
NKETNVE

SEQ ID NO: 2887575 - protein, 22 aa, Entamoeba invadens
NKETQNDQSKTEDEAMEDTRTI

SEQ ID NO: 2887576 - protein, 8 aa, Entamoeba invadens
NKETREAL

SEQ ID NO: 2887577 - protein, 6 aa, Entamoeba invadens
NKETSL

SEQ ID NO: 2887578 - protein, 6 aa, Entamoeba invadens
NKETTE

SEQ ID NO: 2887579 - protein, 8 aa, Entamoeba invadens
NKETTETI

SEQ ID NO: 2887580 - protein, 32 aa, Entamoeba invadens
NKEVDTIQEPADEGKQFEGERYPRKEGMEYRE

SEQ ID NO: 2887581 - protein, 7 aa, Entamoeba invadens
NKEVKSE

SEQ ID NO: 2887582 - protein, 6 aa, Entamoeba invadens
NKEVKT

SEQ ID NO: 2887583 - protein, 7 aa, Entamoeba invadens
NKEVNGI

SEQ ID NO: 2887584 - protein, 5 aa, Entamoeba invadens
NKEVR

SEQ ID NO: 2887585 - protein, 6 aa, Entamoeba invadens
NKEVTF

SEQ ID NO: 2887586 - protein, 5 aa, Entamoeba invadens
NKEYA

SEQ ID NO: 2887587 - protein, 7 aa, Entamoeba invadens
NKEYADE

SEQ ID NO: 2887588 - protein, 9 aa, Entamoeba invadens
NKEYNGPSF

SEQ ID NO: 2887589 - protein, 7 aa, Entamoeba invadens
NKEYSDF

SEQ ID NO: 2887590 - protein, 10 aa, Entamoeba invadens
NKEYTTSIRP

SEQ ID NO: 2887591 - protein, 17 aa, Entamoeba invadens
NKFPEKMARSKSAISDP

SEQ ID NO: 2887592 - protein, 7 aa, Entamoeba invadens
NKFPIES

SEQ ID NO: 2887593 - protein, 7 aa, Entamoeba invadens
NKFPPFS

SEQ ID NO: 2887594 - protein, 5 aa, Entamoeba invadens
NKFQE

SEQ ID NO: 2887595 - protein, 9 aa, Entamoeba invadens
NKFSENITT

SEQ ID NO: 2887596 - protein, 11 aa, Entamoeba invadens
NKFSENKGSVH

SEQ ID NO: 2887597 - protein, 14 aa, Entamoeba invadens
NKFSTSTNSQQKKM

SEQ ID NO: 2887598 - protein, 11 aa, Entamoeba invadens
NKFTDSDVSNV

SEQ ID NO: 2887599 - protein, 7 aa, Entamoeba invadens
NKFTPKS

SEQ ID NO: 2887600 - protein, 16 aa, Entamoeba invadens
NKFTQGVQNTPPSPVV

SEQ ID NO: 2887601 - protein, 8 aa, Entamoeba invadens
NKGAEKEL

SEQ ID NO: 2887602 - protein, 5 aa, Entamoeba invadens
NKGAI

SEQ ID NO: 2887603 - protein, 8 aa, Entamoeba invadens
NKGCQRCR

SEQ ID NO: 2887604 - protein, 7 aa, Entamoeba invadens
NKGCREA

SEQ ID NO: 2887605 - protein, 11 aa, Entamoeba invadens
NKGDFSKATDL

SEQ ID NO: 2887606 - protein, 10 aa, Entamoeba invadens
NKGEEKKEIP

SEQ ID NO: 2887607 - protein, 9 aa, Entamoeba invadens
NKGFGDDEV

SEQ ID NO: 2887608 - protein, 9 aa, Entamoeba invadens
NKGGEEMKT

SEQ ID NO: 2887609 - protein, 7 aa, Entamoeba invadens
NKGGETP

SEQ ID NO: 2887610 - protein, 8 aa, Entamoeba invadens
NKGGRAMN

SEQ ID NO: 2887611 - protein, 17 aa, Entamoeba invadens
NKGGVKALEEARKEGYP

SEQ ID NO: 2887612 - protein, 5 aa, Entamoeba invadens
NKGIE

SEQ ID NO: 2887613 - protein, 11 aa, Entamoeba invadens
NKGIERSSNCS

SEQ ID NO: 2887614 - protein, 4 aa, Entamoeba invadens
NKGK

SEQ ID NO: 2887615 - protein, 5 aa, Entamoeba invadens
NKGKE

SEQ ID NO: 2887616 - protein, 6 aa, Entamoeba invadens
NKGKEM

SEQ ID NO: 2887617 - protein, 12 aa, Entamoeba invadens
NKGKKVSGADKL

SEQ ID NO: 2887618 - protein, 20 aa, Entamoeba invadens
NKGKNVPILPGGAKNLNIPN

SEQ ID NO: 2887619 - protein, 10 aa, Entamoeba invadens
NKGKSDSGRY

SEQ ID NO: 2887620 - protein, 4 aa, Entamoeba invadens
NKGL

SEQ ID NO: 2887621 - protein, 5 aa, Entamoeba invadens
NKGMN

SEQ ID NO: 2887622 - protein, 4 aa, Entamoeba invadens
NKGN

SEQ ID NO: 2887623 - protein, 6 aa, Entamoeba invadens
NKGNCI

SEQ ID NO: 2887624 - protein, 6 aa, Entamoeba invadens
NKGNDV

SEQ ID NO: 2887625 - protein, 9 aa, Entamoeba invadens
NKGNINSRT

SEQ ID NO: 2887626 - protein, 5 aa, Entamoeba invadens
NKGNV

SEQ ID NO: 2887627 - protein, 5 aa, Entamoeba invadens
NKGPY

SEQ ID NO: 2887628 - protein, 4 aa, Entamoeba invadens
NKGQ

SEQ ID NO: 2887629 - protein, 4 aa, Entamoeba invadens
NKGS

SEQ ID NO: 2887630 - protein, 10 aa, Entamoeba invadens
NKGSAEDTTN

SEQ ID NO: 2887631 - protein, 10 aa, Entamoeba invadens
NKGTAKGNVT

SEQ ID NO: 2887632 - protein, 9 aa, Entamoeba invadens
NKGTGISGG

SEQ ID NO: 2887633 - protein, 7 aa, Entamoeba invadens
NKGTREQ

SEQ ID NO: 2887634 - protein, 5 aa, Entamoeba invadens
NKGTT

SEQ ID NO: 2887635 - protein, 9 aa, Entamoeba invadens
NKGTVESKL

SEQ ID NO: 2887636 - protein, 6 aa, Entamoeba invadens
NKGTYV

SEQ ID NO: 2887637 - protein, 8 aa, Entamoeba invadens
NKGVEIPS

SEQ ID NO: 2887638 - protein, 10 aa, Entamoeba invadens
NKGVTVGEKD

SEQ ID NO: 2887639 - protein, 8 aa, Entamoeba invadens
NKGYNSTE

SEQ ID NO: 2887640 - protein, 7 aa, Entamoeba invadens
NKGYQYP

SEQ ID NO: 2887641 - protein, 5 aa, Entamoeba invadens
NKGYR

SEQ ID NO: 2887642 - protein, 5 aa, Entamoeba invadens
NKGYT

SEQ ID NO: 2887643 - protein, 7 aa, Entamoeba invadens
NKGYTTE

SEQ ID NO: 2887644 - protein, 7 aa, Entamoeba invadens
NKHEQAC

SEQ ID NO: 2887645 - protein, 10 aa, Entamoeba invadens
NKHKNDVNTT

SEQ ID NO: 2887646 - protein, 8 aa, Entamoeba invadens
NKHSAAAI

SEQ ID NO: 2887647 - protein, 6 aa, Entamoeba invadens
NKHTKT

SEQ ID NO: 2887648 - protein, 4 aa, Entamoeba invadens
NKHW

SEQ ID NO: 2887649 - protein, 10 aa, Entamoeba invadens
NKIATIPNGM

SEQ ID NO: 2887650 - protein, 11 aa, Entamoeba invadens
NKIATTPNGMS

SEQ ID NO: 2887651 - protein, 10 aa, Entamoeba invadens
NKIDKGEDVE

SEQ ID NO: 2887652 - protein, 7 aa, Entamoeba invadens
NKIDSAE

SEQ ID NO: 2887653 - protein, 4 aa, Entamoeba invadens
NKIE

SEQ ID NO: 2887654 - protein, 77 aa, Entamoeba invadens
NKIEDTKKDELSNNQMDDIKKEEKKSSSEEVNQQNEPIINTPKESTIEPPKEDLEKKTEPNKTEPQKPEMGENETKQ

SEQ ID NO: 2887655 - protein, 10 aa, Entamoeba invadens
NKIEEREEIE

SEQ ID NO: 2887656 - protein, 6 aa, Entamoeba invadens
NKIEET

SEQ ID NO: 2887657 - protein, 7 aa, Entamoeba invadens
NKIEPSA

SEQ ID NO: 2887658 - protein, 5 aa, Entamoeba invadens
NKIER

SEQ ID NO: 2887659 - protein, 8 aa, Entamoeba invadens
NKIESGGS

SEQ ID NO: 2887660 - protein, 11 aa, Entamoeba invadens
NKIKKNPPPVL

SEQ ID NO: 2887661 - protein, 8 aa, Entamoeba invadens
NKIKSIGD

SEQ ID NO: 2887662 - protein, 6 aa, Entamoeba invadens
NKINRI

SEQ ID NO: 2887663 - protein, 7 aa, Entamoeba invadens
NKINSPL

SEQ ID NO: 2887664 - protein, 10 aa, Entamoeba invadens
NKIPENLPSA

SEQ ID NO: 2887665 - protein, 5 aa, Entamoeba invadens
NKIPQ

SEQ ID NO: 2887666 - protein, 7 aa, Entamoeba invadens
NKIPSLE

SEQ ID NO: 2887667 - protein, 6 aa, Entamoeba invadens
NKIQNQ

SEQ ID NO: 2887668 - protein, 12 aa, Entamoeba invadens
NKIRAKRGMERR

SEQ ID NO: 2887669 - protein, 7 aa, Entamoeba invadens
NKIRPEL

SEQ ID NO: 2887670 - protein, 12 aa, Entamoeba invadens
NKIRSRNGGNIS

SEQ ID NO: 2887671 - protein, 9 aa, Entamoeba invadens
NKIRTPQDV

SEQ ID NO: 2887672 - protein, 7 aa, Entamoeba invadens
NKISKIP

SEQ ID NO: 2887673 - protein, 4 aa, Entamoeba invadens
NKIT

SEQ ID NO: 2887674 - protein, 6 aa, Entamoeba invadens
NKITSF

SEQ ID NO: 2887675 - protein, 7 aa, Entamoeba invadens
NKITSLP

SEQ ID NO: 2887676 - protein, 8 aa, Entamoeba invadens
NKITTKMN

SEQ ID NO: 2887677 - protein, 4 aa, Entamoeba invadens
NKIV

SEQ ID NO: 2887678 - protein, 15 aa, Entamoeba invadens
NKKADADGFAGVFAS

SEQ ID NO: 2887679 - protein, 7 aa, Entamoeba invadens
NKKAQDA

SEQ ID NO: 2887680 - protein, 8 aa, Entamoeba invadens
NKKCPNVT

SEQ ID NO: 2887681 - protein, 6 aa, Entamoeba invadens
NKKDAK

SEQ ID NO: 2887682 - protein, 8 aa, Entamoeba invadens
NKKDEKDL

SEQ ID NO: 2887683 - protein, 11 aa, Entamoeba invadens
NKKDESDDKSK

SEQ ID NO: 2887684 - protein, 7 aa, Entamoeba invadens
NKKDEVG

SEQ ID NO: 2887685 - protein, 8 aa, Entamoeba invadens
NKKDGKDF

SEQ ID NO: 2887686 - protein, 12 aa, Entamoeba invadens
NKKDKNHDFSNT

SEQ ID NO: 2887687 - protein, 9 aa, Entamoeba invadens
NKKDQTGNI

SEQ ID NO: 2887688 - protein, 6 aa, Entamoeba invadens
NKKDVA

SEQ ID NO: 2887689 - protein, 4 aa, Entamoeba invadens
NKKE

SEQ ID NO: 2887690 - protein, 13 aa, Entamoeba invadens
NKKECVKRNEKQK

SEQ ID NO: 2887691 - protein, 8 aa, Entamoeba invadens
NKKEDASI

SEQ ID NO: 2887692 - protein, 13 aa, Entamoeba invadens
NKKEEEKKDIPQA

SEQ ID NO: 2887693 - protein, 14 aa, Entamoeba invadens
NKKEEKKEDAPQAF

SEQ ID NO: 2887694 - protein, 8 aa, Entamoeba invadens
NKKEGDVE

SEQ ID NO: 2887695 - protein, 8 aa, Entamoeba invadens
NKKELECT

SEQ ID NO: 2887696 - protein, 8 aa, Entamoeba invadens
NKKENVRI

SEQ ID NO: 2887697 - protein, 7 aa, Entamoeba invadens
NKKERSD

SEQ ID NO: 2887698 - protein, 7 aa, Entamoeba invadens
NKKETPL

SEQ ID NO: 2887699 - protein, 5 aa, Entamoeba invadens
NKKEV

SEQ ID NO: 2887700 - protein, 10 aa, Entamoeba invadens
NKKEVENKGI

SEQ ID NO: 2887701 - protein, 4 aa, Entamoeba invadens
NKKF

SEQ ID NO: 2887702 - protein, 11 aa, Entamoeba invadens
NKKGDDVSEDL

SEQ ID NO: 2887703 - protein, 13 aa, Entamoeba invadens
NKKGKGKESRTNL

SEQ ID NO: 2887704 - protein, 10 aa, Entamoeba invadens
NKKGQYPDDV

SEQ ID NO: 2887705 - protein, 7 aa, Entamoeba invadens
NKKHPTK

SEQ ID NO: 2887706 - protein, 38 aa, Entamoeba invadens
NKKHSQESESVTPAKTETVEIPKSQDLKNFKNSEELEE

SEQ ID NO: 2887707 - protein, 4 aa, Entamoeba invadens
NKKI

SEQ ID NO: 2887708 - protein, 7 aa, Entamoeba invadens
NKKIDDQ

SEQ ID NO: 2887709 - protein, 11 aa, Entamoeba invadens
NKKIGNGDEIG

SEQ ID NO: 2887710 - protein, 13 aa, Entamoeba invadens
NKKISKDNATTDY

SEQ ID NO: 2887711 - protein, 14 aa, Entamoeba invadens
NKKISSAPGKKTTW

SEQ ID NO: 2887712 - protein, 16 aa, Entamoeba invadens
NKKKGEKASQKKRMEN

SEQ ID NO: 2887713 - protein, 22 aa, Entamoeba invadens
NKKKGGVSNNEEKKSTEKSEEV

SEQ ID NO: 2887714 - protein, 10 aa, Entamoeba invadens
NKKKKREFSP

SEQ ID NO: 2887715 - protein, 9 aa, Entamoeba invadens
NKKKPIPKS

SEQ ID NO: 2887716 - protein, 9 aa, Entamoeba invadens
NKKKQSSGF

SEQ ID NO: 2887717 - protein, 13 aa, Entamoeba invadens
NKKKSRRSLDPNC

SEQ ID NO: 2887718 - protein, 10 aa, Entamoeba invadens
NKKKVDMETS

SEQ ID NO: 2887719 - protein, 6 aa, Entamoeba invadens
NKKKYK

SEQ ID NO: 2887720 - protein, 9 aa, Entamoeba invadens
NKKLGNENN

SEQ ID NO: 2887721 - protein, 9 aa, Entamoeba invadens
NKKLGNGNN

SEQ ID NO: 2887722 - protein, 12 aa, Entamoeba invadens
NKKMDEEARKRK

SEQ ID NO: 2887723 - protein, 8 aa, Entamoeba invadens
NKKMQTKI

SEQ ID NO: 2887724 - protein, 6 aa, Entamoeba invadens
NKKMTD

SEQ ID NO: 2887725 - protein, 8 aa, Entamoeba invadens
NKKNDTVS

SEQ ID NO: 2887726 - protein, 11 aa, Entamoeba invadens
NKKNEEAPKEV

SEQ ID NO: 2887727 - protein, 7 aa, Entamoeba invadens
NKKNEIL

SEQ ID NO: 2887728 - protein, 6 aa, Entamoeba invadens
NKKNSE

SEQ ID NO: 2887729 - protein, 9 aa, Entamoeba invadens
NKKNYDGNT

SEQ ID NO: 2887730 - protein, 19 aa, Entamoeba invadens
NKKPKVQQRRKEDLKPRKS

SEQ ID NO: 2887731 - protein, 5 aa, Entamoeba invadens
NKKPQ

SEQ ID NO: 2887732 - protein, 7 aa, Entamoeba invadens
NKKPYEK

SEQ ID NO: 2887733 - protein, 7 aa, Entamoeba invadens
NKKQEER

SEQ ID NO: 2887734 - protein, 5 aa, Entamoeba invadens
NKKQK

SEQ ID NO: 2887735 - protein, 6 aa, Entamoeba invadens
NKKQKS

SEQ ID NO: 2887736 - protein, 6 aa, Entamoeba invadens
NKKQKV

SEQ ID NO: 2887737 - protein, 20 aa, Entamoeba invadens
NKKQNLINKKEKTKRGEKKK

SEQ ID NO: 2887738 - protein, 8 aa, Entamoeba invadens
NKKQQTEL

SEQ ID NO: 2887739 - protein, 7 aa, Entamoeba invadens
NKKRKSV

SEQ ID NO: 2887740 - protein, 9 aa, Entamoeba invadens
NKKRPSKGV

SEQ ID NO: 2887741 - protein, 7 aa, Entamoeba invadens
NKKRRET

SEQ ID NO: 2887742 - protein, 10 aa, Entamoeba invadens
NKKSDAIANL

SEQ ID NO: 2887743 - protein, 6 aa, Entamoeba invadens
NKKSEI

SEQ ID NO: 2887744 - protein, 10 aa, Entamoeba invadens
NKKSEQSPSL

SEQ ID NO: 2887745 - protein, 6 aa, Entamoeba invadens
NKKSFD

SEQ ID NO: 2887746 - protein, 12 aa, Entamoeba invadens
NKKSFDIESGES

SEQ ID NO: 2887747 - protein, 10 aa, Entamoeba invadens
NKKSKSKNYT

SEQ ID NO: 2887748 - protein, 8 aa, Entamoeba invadens
NKKSPPLI

SEQ ID NO: 2887749 - protein, 7 aa, Entamoeba invadens
NKKSQIT

SEQ ID NO: 2887750 - protein, 10 aa, Entamoeba invadens
NKKSTEADNT

SEQ ID NO: 2887751 - protein, 17 aa, Entamoeba invadens
NKKTETLENELKEKKEE

SEQ ID NO: 2887752 - protein, 8 aa, Entamoeba invadens
NKKTGESV

SEQ ID NO: 2887753 - protein, 9 aa, Entamoeba invadens
NKKTGHGDQ

SEQ ID NO: 2887754 - protein, 9 aa, Entamoeba invadens
NKKTSEISN

SEQ ID NO: 2887755 - protein, 15 aa, Entamoeba invadens
NKKTSPQNDPPKCPK

SEQ ID NO: 2887756 - protein, 45 aa, Entamoeba invadens
NKKTTRRTRKSDKAKKDKETVEKKPKKEVEHKSRKSTKRESTIEE

SEQ ID NO: 2887757 - protein, 8 aa, Entamoeba invadens
NKKVPSRD

SEQ ID NO: 2887758 - protein, 7 aa, Entamoeba invadens
NKKVSDF

SEQ ID NO: 2887759 - protein, 4 aa, Entamoeba invadens
NKKY

SEQ ID NO: 2887760 - protein, 9 aa, Entamoeba invadens
NKKYPDKSG

SEQ ID NO: 2887761 - protein, 7 aa, Entamoeba invadens
NKLADKN

SEQ ID NO: 2887762 - protein, 14 aa, Entamoeba invadens
NKLAEKDQTIENEI

SEQ ID NO: 2887763 - protein, 7 aa, Entamoeba invadens
NKLDAEN

SEQ ID NO: 2887764 - protein, 16 aa, Entamoeba invadens
NKLEAEEDNSNDLETQ

SEQ ID NO: 2887765 - protein, 20 aa, Entamoeba invadens
NKLEAEENNSKDLETIARKG

SEQ ID NO: 2887766 - protein, 7 aa, Entamoeba invadens
NKLEKLP

SEQ ID NO: 2887767 - protein, 7 aa, Entamoeba invadens
NKLESLP

SEQ ID NO: 2887768 - protein, 4 aa, Entamoeba invadens
NKLG

SEQ ID NO: 2887769 - protein, 7 aa, Entamoeba invadens
NKLGEGS

SEQ ID NO: 2887770 - protein, 7 aa, Entamoeba invadens
NKLGTET

SEQ ID NO: 2887771 - protein, 9 aa, Entamoeba invadens
NKLKDGQQI

SEQ ID NO: 2887772 - protein, 9 aa, Entamoeba invadens
NKLKKYSQK

SEQ ID NO: 2887773 - protein, 13 aa, Entamoeba invadens
NKLKTDSGKYFAA

SEQ ID NO: 2887774 - protein, 5 aa, Entamoeba invadens
NKLNC

SEQ ID NO: 2887775 - protein, 7 aa, Entamoeba invadens
NKLPDNQ

SEQ ID NO: 2887776 - protein, 15 aa, Entamoeba invadens
NKLPEELKKENSELR

SEQ ID NO: 2887777 - protein, 7 aa, Entamoeba invadens
NKLPEGL

SEQ ID NO: 2887778 - protein, 62 aa, Entamoeba invadens
NKLQEETKQKENTQAALQSANSLTAELKGTISNKENEAAEMKKTIEEKENKKNQLEKEIEDL

SEQ ID NO: 2887779 - protein, 16 aa, Entamoeba invadens
NKLQELKQKEKTDPVP

SEQ ID NO: 2887780 - protein, 5 aa, Entamoeba invadens
NKLSE

SEQ ID NO: 2887781 - protein, 10 aa, Entamoeba invadens
NKLSEQQRGM

SEQ ID NO: 2887782 - protein, 10 aa, Entamoeba invadens
NKLSYNAAKK

SEQ ID NO: 2887783 - protein, 5 aa, Entamoeba invadens
NKLTT

SEQ ID NO: 2887784 - protein, 18 aa, Entamoeba invadens
NKMAKSKLGYGKLSETTI

SEQ ID NO: 2887785 - protein, 7 aa, Entamoeba invadens
NKMDETN

SEQ ID NO: 2887786 - protein, 8 aa, Entamoeba invadens
NKMDTNGN

SEQ ID NO: 2887787 - protein, 42 aa, Entamoeba invadens
NKMKEERLSSGSGFTSENSENEGEGVDDPRVEKEQLENERTK

SEQ ID NO: 2887788 - protein, 7 aa, Entamoeba invadens
NKMNGRD

SEQ ID NO: 2887789 - protein, 5 aa, Entamoeba invadens
NKMNN

SEQ ID NO: 2887790 - protein, 7 aa, Entamoeba invadens
NKMNPRD

SEQ ID NO: 2887791 - protein, 4 aa, Entamoeba invadens
NKMQ

SEQ ID NO: 2887792 - protein, 6 aa, Entamoeba invadens
NKMQQE

SEQ ID NO: 2887793 - protein, 9 aa, Entamoeba invadens
NKMSKDGFI

SEQ ID NO: 2887794 - protein, 7 aa, Entamoeba invadens
NKMTPNN

SEQ ID NO: 2887795 - protein, 14 aa, Entamoeba invadens
NKMTPTKSSLSPKI

SEQ ID NO: 2887796 - protein, 28 aa, Entamoeba invadens
NKMVQTKRSQTTTLQPKTPSPRRSEEQS

SEQ ID NO: 2887797 - protein, 4 aa, Entamoeba invadens
NKNA

SEQ ID NO: 2887798 - protein, 15 aa, Entamoeba invadens
NKNAPTKVFQPDNSK

SEQ ID NO: 2887799 - protein, 8 aa, Entamoeba invadens
NKNARKEI

SEQ ID NO: 2887800 - protein, 7 aa, Entamoeba invadens
NKNCEKS

SEQ ID NO: 2887801 - protein, 9 aa, Entamoeba invadens
NKNDENNNS

SEQ ID NO: 2887802 - protein, 8 aa, Entamoeba invadens
NKNDNEFK

SEQ ID NO: 2887803 - protein, 12 aa, Entamoeba invadens
NKNEEDRKGIND

SEQ ID NO: 2887804 - protein, 9 aa, Entamoeba invadens
NKNEEEKEM

SEQ ID NO: 2887805 - protein, 10 aa, Entamoeba invadens
NKNETYSKET

SEQ ID NO: 2887806 - protein, 7 aa, Entamoeba invadens
NKNGCSK

SEQ ID NO: 2887807 - protein, 6 aa, Entamoeba invadens
NKNGKI

SEQ ID NO: 2887808 - protein, 7 aa, Entamoeba invadens
NKNGTFN

SEQ ID NO: 2887809 - protein, 5 aa, Entamoeba invadens
NKNIK

SEQ ID NO: 2887810 - protein, 9 aa, Entamoeba invadens
NKNIQPSSR

SEQ ID NO: 2887811 - protein, 9 aa, Entamoeba invadens
NKNKEIDRI

SEQ ID NO: 2887812 - protein, 7 aa, Entamoeba invadens
NKNKGFS

SEQ ID NO: 2887813 - protein, 5 aa, Entamoeba invadens
NKNKK

SEQ ID NO: 2887814 - protein, 10 aa, Entamoeba invadens
NKNKKEIEKM

SEQ ID NO: 2887815 - protein, 9 aa, Entamoeba invadens
NKNKKREMT

SEQ ID NO: 2887816 - protein, 8 aa, Entamoeba invadens
NKNKRISH

SEQ ID NO: 2887817 - protein, 8 aa, Entamoeba invadens
NKNKVPRA

SEQ ID NO: 2887818 - protein, 9 aa, Entamoeba invadens
NKNKYNSSV

SEQ ID NO: 2887819 - protein, 7 aa, Entamoeba invadens
NKNKYQA

SEQ ID NO: 2887820 - protein, 5 aa, Entamoeba invadens
NKNNE

SEQ ID NO: 2887821 - protein, 8 aa, Entamoeba invadens
NKNNQQDE

SEQ ID NO: 2887822 - protein, 7 aa, Entamoeba invadens
NKNNVIR

SEQ ID NO: 2887823 - protein, 8 aa, Entamoeba invadens
NKNPTKYT

SEQ ID NO: 2887824 - protein, 5 aa, Entamoeba invadens
NKNRI

SEQ ID NO: 2887825 - protein, 13 aa, Entamoeba invadens
NKNRKSVLKKDSI

SEQ ID NO: 2887826 - protein, 6 aa, Entamoeba invadens
NKNRKT

SEQ ID NO: 2887827 - protein, 30 aa, Entamoeba invadens
NKNRKTGEMKQNKDKLNTMNTEKNKKTCLL

SEQ ID NO: 2887828 - protein, 28 aa, Entamoeba invadens
NKNSADPTKSYAEGPGVNGGANSRDPAE

SEQ ID NO: 2887829 - protein, 18 aa, Entamoeba invadens
NKNSAKSLVKRKNGSEWD

SEQ ID NO: 2887830 - protein, 9 aa, Entamoeba invadens
NKNSEENKT

SEQ ID NO: 2887831 - protein, 5 aa, Entamoeba invadens
NKNSF

SEQ ID NO: 2887832 - protein, 12 aa, Entamoeba invadens
NKNSPTQKSGFD

SEQ ID NO: 2887833 - protein, 7 aa, Entamoeba invadens
NKNSTLT

SEQ ID NO: 2887834 - protein, 8 aa, Entamoeba invadens
NKNTDKGL

SEQ ID NO: 2887835 - protein, 7 aa, Entamoeba invadens
NKNTECP

SEQ ID NO: 2887836 - protein, 10 aa, Entamoeba invadens
NKNTFSGKDA

SEQ ID NO: 2887837 - protein, 5 aa, Entamoeba invadens
NKNTN

SEQ ID NO: 2887838 - protein, 5 aa, Entamoeba invadens
NKNTT

SEQ ID NO: 2887839 - protein, 8 aa, Entamoeba invadens
NKNVPTEI

SEQ ID NO: 2887840 - protein, 7 aa, Entamoeba invadens
NKNVPVS

SEQ ID NO: 2887841 - protein, 4 aa, Entamoeba invadens
NKNY

SEQ ID NO: 2887842 - protein, 8 aa, Entamoeba invadens
NKNYEEVS

SEQ ID NO: 2887843 - protein, 22 aa, Entamoeba invadens
NKPARKQTDTYTPFTPNRSGDY

SEQ ID NO: 2887844 - protein, 6 aa, Entamoeba invadens
NKPAYF

SEQ ID NO: 2887845 - protein, 7 aa, Entamoeba invadens
NKPAYYR

SEQ ID NO: 2887846 - protein, 6 aa, Entamoeba invadens
NKPDAL

SEQ ID NO: 2887847 - protein, 7 aa, Entamoeba invadens
NKPDITT

SEQ ID NO: 2887848 - protein, 6 aa, Entamoeba invadens
NKPEGL

SEQ ID NO: 2887849 - protein, 5 aa, Entamoeba invadens
NKPEM

SEQ ID NO: 2887850 - protein, 7 aa, Entamoeba invadens
NKPENLR

SEQ ID NO: 2887851 - protein, 6 aa, Entamoeba invadens
NKPFNA

SEQ ID NO: 2887852 - protein, 19 aa, Entamoeba invadens
NKPIAPNKEEKGETTINRK

SEQ ID NO: 2887853 - protein, 5 aa, Entamoeba invadens
NKPIE

SEQ ID NO: 2887854 - protein, 23 aa, Entamoeba invadens
NKPINLNKETPPQTVEQKPKRDR

SEQ ID NO: 2887855 - protein, 13 aa, Entamoeba invadens
NKPKTTITETTQK

SEQ ID NO: 2887856 - protein, 6 aa, Entamoeba invadens
NKPMNE

SEQ ID NO: 2887857 - protein, 9 aa, Entamoeba invadens
NKPMNGDYI

SEQ ID NO: 2887858 - protein, 4 aa, Entamoeba invadens
NKPN

SEQ ID NO: 2887859 - protein, 7 aa, Entamoeba invadens
NKPNKHI

SEQ ID NO: 2887860 - protein, 7 aa, Entamoeba invadens
NKPNSFS

SEQ ID NO: 2887861 - protein, 5 aa, Entamoeba invadens
NKPNV

SEQ ID NO: 2887862 - protein, 5 aa, Entamoeba invadens
NKPNY

SEQ ID NO: 2887863 - protein, 7 aa, Entamoeba invadens
NKPSEAL

SEQ ID NO: 2887864 - protein, 9 aa, Entamoeba invadens
NKPSYSNYK

SEQ ID NO: 2887865 - protein, 14 aa, Entamoeba invadens
NKPTFTRNRTPENI

SEQ ID NO: 2887866 - protein, 7 aa, Entamoeba invadens
NKPTNKL

SEQ ID NO: 2887867 - protein, 12 aa, Entamoeba invadens
NKPTPPDYLSKT

SEQ ID NO: 2887868 - protein, 17 aa, Entamoeba invadens
NKPTQQIEKKMEEENKP

SEQ ID NO: 2887869 - protein, 7 aa, Entamoeba invadens
NKPTVVN

SEQ ID NO: 2887870 - protein, 16 aa, Entamoeba invadens
NKPVEPPKEEEEQDAY

SEQ ID NO: 2887871 - protein, 9 aa, Entamoeba invadens
NKQADEELK

SEQ ID NO: 2887872 - protein, 5 aa, Entamoeba invadens
NKQAI

SEQ ID NO: 2887873 - protein, 9 aa, Entamoeba invadens
NKQDDKEVE

SEQ ID NO: 2887874 - protein, 7 aa, Entamoeba invadens
NKQDPPN

SEQ ID NO: 2887875 - protein, 8 aa, Entamoeba invadens
NKQDSSYS

SEQ ID NO: 2887876 - protein, 6 aa, Entamoeba invadens
NKQDTM

SEQ ID NO: 2887877 - protein, 8 aa, Entamoeba invadens
NKQELDRT

SEQ ID NO: 2887878 - protein, 7 aa, Entamoeba invadens
NKQENMR

SEQ ID NO: 2887879 - protein, 17 aa, Entamoeba invadens
NKQERELQQTQDTPFNI

SEQ ID NO: 2887880 - protein, 9 aa, Entamoeba invadens
NKQFDPKTL

SEQ ID NO: 2887881 - protein, 5 aa, Entamoeba invadens
NKQGI

SEQ ID NO: 2887882 - protein, 6 aa, Entamoeba invadens
NKQIDE

SEQ ID NO: 2887883 - protein, 9 aa, Entamoeba invadens
NKQIEAPEE

SEQ ID NO: 2887884 - protein, 12 aa, Entamoeba invadens
NKQIKAQQQKVR

SEQ ID NO: 2887885 - protein, 6 aa, Entamoeba invadens
NKQKEF

SEQ ID NO: 2887886 - protein, 8 aa, Entamoeba invadens
NKQKETRG

SEQ ID NO: 2887887 - protein, 7 aa, Entamoeba invadens
NKQKGIL

SEQ ID NO: 2887888 - protein, 12 aa, Entamoeba invadens
NKQLRQIKLLSV

SEQ ID NO: 2887889 - protein, 11 aa, Entamoeba invadens
NKQLRQKNEEK

SEQ ID NO: 2887890 - protein, 13 aa, Entamoeba invadens
NKQLTSIETNGVD

SEQ ID NO: 2887891 - protein, 6 aa, Entamoeba invadens
NKQNAK

SEQ ID NO: 2887892 - protein, 12 aa, Entamoeba invadens
NKQNCPSKKNIE

SEQ ID NO: 2887893 - protein, 7 aa, Entamoeba invadens
NKQNEGM

SEQ ID NO: 2887894 - protein, 8 aa, Entamoeba invadens
NKQNFENE

SEQ ID NO: 2887895 - protein, 6 aa, Entamoeba invadens
NKQNKP

SEQ ID NO: 2887896 - protein, 7 aa, Entamoeba invadens
NKQNNTV

SEQ ID NO: 2887897 - protein, 8 aa, Entamoeba invadens
NKQNSPMT

SEQ ID NO: 2887898 - protein, 5 aa, Entamoeba invadens
NKQNV

SEQ ID NO: 2887899 - protein, 7 aa, Entamoeba invadens
NKQNYDE

SEQ ID NO: 2887900 - protein, 28 aa, Entamoeba invadens
NKQPRRIESSQDANEVAEDEGDEDEEVV

SEQ ID NO: 2887901 - protein, 7 aa, Entamoeba invadens
NKQQKMK

SEQ ID NO: 2887902 - protein, 9 aa, Entamoeba invadens
NKQQNRRIS

SEQ ID NO: 2887903 - protein, 15 aa, Entamoeba invadens
NKQRNSMKRRTARKS

SEQ ID NO: 2887904 - protein, 10 aa, Entamoeba invadens
NKQSPSDVIS

SEQ ID NO: 2887905 - protein, 5 aa, Entamoeba invadens
NKQSV

SEQ ID NO: 2887906 - protein, 5 aa, Entamoeba invadens
NKQTL

SEQ ID NO: 2887907 - protein, 6 aa, Entamoeba invadens
NKQVGT

SEQ ID NO: 2887908 - protein, 9 aa, Entamoeba invadens
NKQYGSEQV

SEQ ID NO: 2887909 - protein, 4 aa, Entamoeba invadens
NKRA

SEQ ID NO: 2887910 - protein, 5 aa, Entamoeba invadens
NKRAN

SEQ ID NO: 2887911 - protein, 40 aa, Entamoeba invadens
NKRDIHKDASKKPSETTEVKEQQEDPKGSQTDSQSKDNLN

SEQ ID NO: 2887912 - protein, 10 aa, Entamoeba invadens
NKRDSNTQLV

SEQ ID NO: 2887913 - protein, 7 aa, Entamoeba invadens
NKREDIG

SEQ ID NO: 2887914 - protein, 5 aa, Entamoeba invadens
NKREN

SEQ ID NO: 2887915 - protein, 7 aa, Entamoeba invadens
NKRESAE

SEQ ID NO: 2887916 - protein, 6 aa, Entamoeba invadens
NKREVG

SEQ ID NO: 2887917 - protein, 17 aa, Entamoeba invadens
NKRGERYGTAAERFLAH

SEQ ID NO: 2887918 - protein, 6 aa, Entamoeba invadens
NKRGEV

SEQ ID NO: 2887919 - protein, 4 aa, Entamoeba invadens
NKRH

SEQ ID NO: 2887920 - protein, 7 aa, Entamoeba invadens
NKRHRRY

SEQ ID NO: 2887921 - protein, 4 aa, Entamoeba invadens
NKRI

SEQ ID NO: 2887922 - protein, 7 aa, Entamoeba invadens
NKRIQAA

SEQ ID NO: 2887923 - protein, 21 aa, Entamoeba invadens
NKRKAGNKQIKKNEFMFVAME

SEQ ID NO: 2887924 - protein, 9 aa, Entamoeba invadens
NKRKEFKDN

SEQ ID NO: 2887925 - protein, 7 aa, Entamoeba invadens
NKRKEVN

SEQ ID NO: 2887926 - protein, 63 aa, Entamoeba invadens
NKRKEVTQKMEEDFSKANNLKDTTSDKQVAITSNNISNNISNNISNNISNEASEYPEKPQEKI

SEQ ID NO: 2887927 - protein, 11 aa, Entamoeba invadens
NKRKRKDKKKF

SEQ ID NO: 2887928 - protein, 12 aa, Entamoeba invadens
NKRKSGRQTMAP

SEQ ID NO: 2887929 - protein, 8 aa, Entamoeba invadens
NKRKSVMG

SEQ ID NO: 2887930 - protein, 9 aa, Entamoeba invadens
NKRKSVTEK

SEQ ID NO: 2887931 - protein, 4 aa, Entamoeba invadens
NKRL

SEQ ID NO: 2887932 - protein, 6 aa, Entamoeba invadens
NKRLEG

SEQ ID NO: 2887933 - protein, 4 aa, Entamoeba invadens
NKRN

SEQ ID NO: 2887934 - protein, 12 aa, Entamoeba invadens
NKRQKTKNKKDD

SEQ ID NO: 2887935 - protein, 5 aa, Entamoeba invadens
NKRQN

SEQ ID NO: 2887936 - protein, 4 aa, Entamoeba invadens
NKRR

SEQ ID NO: 2887937 - protein, 15 aa, Entamoeba invadens
NKRRITDPETPNVGM

SEQ ID NO: 2887938 - protein, 8 aa, Entamoeba invadens
NKRRNSTL

SEQ ID NO: 2887939 - protein, 8 aa, Entamoeba invadens
NKRSDTRL

SEQ ID NO: 2887940 - protein, 5 aa, Entamoeba invadens
NKRSF

SEQ ID NO: 2887941 - protein, 5 aa, Entamoeba invadens
NKRSR

SEQ ID NO: 2887942 - protein, 12 aa, Entamoeba invadens
NKRTKEAESMAS

SEQ ID NO: 2887943 - protein, 7 aa, Entamoeba invadens
NKRTNTI

SEQ ID NO: 2887944 - protein, 7 aa, Entamoeba invadens
NKRTQRE

SEQ ID NO: 2887945 - protein, 7 aa, Entamoeba invadens
NKRVAKG

SEQ ID NO: 2887946 - protein, 8 aa, Entamoeba invadens
NKRYESGS

SEQ ID NO: 2887947 - protein, 11 aa, Entamoeba invadens
NKRYSNTKNVE

SEQ ID NO: 2887948 - protein, 5 aa, Entamoeba invadens
NKRYT

SEQ ID NO: 2887949 - protein, 17 aa, Entamoeba invadens
NKSAKEVQQKIGYNTAT

SEQ ID NO: 2887950 - protein, 7 aa, Entamoeba invadens
NKSAYYT

SEQ ID NO: 2887951 - protein, 8 aa, Entamoeba invadens
NKSDAKNI

SEQ ID NO: 2887952 - protein, 12 aa, Entamoeba invadens
NKSDETQRDVTY

SEQ ID NO: 2887953 - protein, 20 aa, Entamoeba invadens
NKSDLEEERAVKKEDAQSVA

SEQ ID NO: 2887954 - protein, 7 aa, Entamoeba invadens
NKSDLLS

SEQ ID NO: 2887955 - protein, 12 aa, Entamoeba invadens
NKSDNKSGPKRV

SEQ ID NO: 2887956 - protein, 11 aa, Entamoeba invadens
NKSDNSNVNDI

SEQ ID NO: 2887957 - protein, 9 aa, Entamoeba invadens
NKSDNTHVN

SEQ ID NO: 2887958 - protein, 9 aa, Entamoeba invadens
NKSDPDELY

SEQ ID NO: 2887959 - protein, 6 aa, Entamoeba invadens
NKSDRV

SEQ ID NO: 2887960 - protein, 7 aa, Entamoeba invadens
NKSDSFS

SEQ ID NO: 2887961 - protein, 13 aa, Entamoeba invadens
NKSDSGKKAEKVM

SEQ ID NO: 2887962 - protein, 7 aa, Entamoeba invadens
NKSDSLN

SEQ ID NO: 2887963 - protein, 7 aa, Entamoeba invadens
NKSDVDE

SEQ ID NO: 2887964 - protein, 5 aa, Entamoeba invadens
NKSDY

SEQ ID NO: 2887965 - protein, 10 aa, Entamoeba invadens
NKSDYTEREL

SEQ ID NO: 2887966 - protein, 14 aa, Entamoeba invadens
NKSECAVSGDGQKC

SEQ ID NO: 2887967 - protein, 23 aa, Entamoeba invadens
NKSEDERKEQLNQIRKSRTTKSI

SEQ ID NO: 2887968 - protein, 10 aa, Entamoeba invadens
NKSEERVGGE

SEQ ID NO: 2887969 - protein, 12 aa, Entamoeba invadens
NKSEESQKMRQK

SEQ ID NO: 2887970 - protein, 5 aa, Entamoeba invadens
NKSEF

SEQ ID NO: 2887971 - protein, 61 aa, Entamoeba invadens
NKSEGRKDIQIEETKKEEKSQEIPKPSSKPTPPMRTPSPKTSSPTSSSPKATKSSPPVQQK

SEQ ID NO: 2887972 - protein, 8 aa, Entamoeba invadens
NKSEGTFK

SEQ ID NO: 2887973 - protein, 10 aa, Entamoeba invadens
NKSEKEFSEL

SEQ ID NO: 2887974 - protein, 40 aa, Entamoeba invadens
NKSEPPKPKPELQKQKTEKLEKPKTPEKSDKNLKVSKTET

SEQ ID NO: 2887975 - protein, 9 aa, Entamoeba invadens
NKSGEEHEQ

SEQ ID NO: 2887976 - protein, 14 aa, Entamoeba invadens
NKSGEKKSSLSQEM

SEQ ID NO: 2887977 - protein, 6 aa, Entamoeba invadens
NKSGSH

SEQ ID NO: 2887978 - protein, 7 aa, Entamoeba invadens
NKSGTSL

SEQ ID NO: 2887979 - protein, 8 aa, Entamoeba invadens
NKSGYIEP

SEQ ID NO: 2887980 - protein, 7 aa, Entamoeba invadens
NKSHDRA

SEQ ID NO: 2887981 - protein, 6 aa, Entamoeba invadens
NKSHTT

SEQ ID NO: 2887982 - protein, 4 aa, Entamoeba invadens
NKSI

SEQ ID NO: 2887983 - protein, 7 aa, Entamoeba invadens
NKSIETP

SEQ ID NO: 2887984 - protein, 8 aa, Entamoeba invadens
NKSIETSV

SEQ ID NO: 2887985 - protein, 13 aa, Entamoeba invadens
NKSKEKRKQQVKQ

SEQ ID NO: 2887986 - protein, 8 aa, Entamoeba invadens
NKSKNNLK

SEQ ID NO: 2887987 - protein, 7 aa, Entamoeba invadens
NKSKNTI

SEQ ID NO: 2887988 - protein, 9 aa, Entamoeba invadens
NKSKNTSKI

SEQ ID NO: 2887989 - protein, 10 aa, Entamoeba invadens
NKSKRQSYQI

SEQ ID NO: 2887990 - protein, 9 aa, Entamoeba invadens
NKSKYPMSS

SEQ ID NO: 2887991 - protein, 10 aa, Entamoeba invadens
NKSLPTGDPE

SEQ ID NO: 2887992 - protein, 9 aa, Entamoeba invadens
NKSMSSSSL

SEQ ID NO: 2887993 - protein, 8 aa, Entamoeba invadens
NKSNEVEK

SEQ ID NO: 2887994 - protein, 5 aa, Entamoeba invadens
NKSNG

SEQ ID NO: 2887995 - protein, 17 aa, Entamoeba invadens
NKSNGEVEEENPEVITT

SEQ ID NO: 2887996 - protein, 9 aa, Entamoeba invadens
NKSNTHYNP

SEQ ID NO: 2887997 - protein, 8 aa, Entamoeba invadens
NKSPLERN

SEQ ID NO: 2887998 - protein, 6 aa, Entamoeba invadens
NKSPNM

SEQ ID NO: 2887999 - protein, 7 aa, Entamoeba invadens
NKSPTDV

SEQ ID NO: 2888000 - protein, 14 aa, Entamoeba invadens
NKSQDNKKTVKEKL

SEQ ID NO: 2888001 - protein, 7 aa, Entamoeba invadens
NKSQGQS

SEQ ID NO: 2888002 - protein, 20 aa, Entamoeba invadens
NKSQKELERDDAATKRGGLN

SEQ ID NO: 2888003 - protein, 27 aa, Entamoeba invadens
NKSQKKIKENIEEKKEDVLSKKQRMRR

SEQ ID NO: 2888004 - protein, 7 aa, Entamoeba invadens
NKSRSSQ

SEQ ID NO: 2888005 - protein, 8 aa, Entamoeba invadens
NKSRTGKL

SEQ ID NO: 2888006 - protein, 4 aa, Entamoeba invadens
NKSS

SEQ ID NO: 2888007 - protein, 6 aa, Entamoeba invadens
NKSSEI

SEQ ID NO: 2888008 - protein, 9 aa, Entamoeba invadens
NKSSTETMT

SEQ ID NO: 2888009 - protein, 5 aa, Entamoeba invadens
NKSSV

SEQ ID NO: 2888010 - protein, 4 aa, Entamoeba invadens
NKST

SEQ ID NO: 2888011 - protein, 8 aa, Entamoeba invadens
NKSTGKSH

SEQ ID NO: 2888012 - protein, 7 aa, Entamoeba invadens
NKSTGTF

SEQ ID NO: 2888013 - protein, 8 aa, Entamoeba invadens
NKSTIKGR

SEQ ID NO: 2888014 - protein, 12 aa, Entamoeba invadens
NKSTIYQANCIL

SEQ ID NO: 2888015 - protein, 8 aa, Entamoeba invadens
NKSTKNEF

SEQ ID NO: 2888016 - protein, 7 aa, Entamoeba invadens
NKSTKTY

SEQ ID NO: 2888017 - protein, 6 aa, Entamoeba invadens
NKSTLD

SEQ ID NO: 2888018 - protein, 7 aa, Entamoeba invadens
NKSTNGF

SEQ ID NO: 2888019 - protein, 17 aa, Entamoeba invadens
NKSTNRKSQVSKPKLED

SEQ ID NO: 2888020 - protein, 14 aa, Entamoeba invadens
NKSTSLFSNFWSFF

SEQ ID NO: 2888021 - protein, 8 aa, Entamoeba invadens
NKSTSTSR

SEQ ID NO: 2888022 - protein, 8 aa, Entamoeba invadens
NKSTSTSV

SEQ ID NO: 2888023 - protein, 7 aa, Entamoeba invadens
NKSTTGI

SEQ ID NO: 2888024 - protein, 25 aa, Entamoeba invadens
NKSTVNTHKNQIQKTMTKTNENIEI

SEQ ID NO: 2888025 - protein, 7 aa, Entamoeba invadens
NKSVPNL

SEQ ID NO: 2888026 - protein, 7 aa, Entamoeba invadens
NKSVSEM

SEQ ID NO: 2888027 - protein, 6 aa, Entamoeba invadens
NKSVTD

SEQ ID NO: 2888028 - protein, 4 aa, Entamoeba invadens
NKSY

SEQ ID NO: 2888029 - protein, 15 aa, Entamoeba invadens
NKSYEYDQYKERTEG

SEQ ID NO: 2888030 - protein, 8 aa, Entamoeba invadens
NKSYPPIR

SEQ ID NO: 2888031 - protein, 6 aa, Entamoeba invadens
NKSYRD

SEQ ID NO: 2888032 - protein, 10 aa, Entamoeba invadens
NKSYSTKDFN

SEQ ID NO: 2888033 - protein, 14 aa, Entamoeba invadens
NKTAECTEKENTIK

SEQ ID NO: 2888034 - protein, 7 aa, Entamoeba invadens
NKTDDMK

SEQ ID NO: 2888035 - protein, 25 aa, Entamoeba invadens
NKTDLEKKTDDAEVNSTVTSANATK

SEQ ID NO: 2888036 - protein, 6 aa, Entamoeba invadens
NKTDNP

SEQ ID NO: 2888037 - protein, 8 aa, Entamoeba invadens
NKTDSFAA

SEQ ID NO: 2888038 - protein, 14 aa, Entamoeba invadens
NKTDVPVPSCLDLV

SEQ ID NO: 2888039 - protein, 12 aa, Entamoeba invadens
NKTEASSRDLTD

SEQ ID NO: 2888040 - protein, 6 aa, Entamoeba invadens
NKTEDV

SEQ ID NO: 2888041 - protein, 11 aa, Entamoeba invadens
NKTEGLADKER

SEQ ID NO: 2888042 - protein, 8 aa, Entamoeba invadens
NKTEKEVR

SEQ ID NO: 2888043 - protein, 8 aa, Entamoeba invadens
NKTEKVCR

SEQ ID NO: 2888044 - protein, 6 aa, Entamoeba invadens
NKTELG

SEQ ID NO: 2888045 - protein, 16 aa, Entamoeba invadens
NKTENIKPLFTILNIA

SEQ ID NO: 2888046 - protein, 8 aa, Entamoeba invadens
NKTENSDR

SEQ ID NO: 2888047 - protein, 6 aa, Entamoeba invadens
NKTENW

SEQ ID NO: 2888048 - protein, 15 aa, Entamoeba invadens
NKTEPPASLGRPRDY

SEQ ID NO: 2888049 - protein, 7 aa, Entamoeba invadens
NKTERIG

SEQ ID NO: 2888050 - protein, 14 aa, Entamoeba invadens
NKTFDYTKKATKEV

SEQ ID NO: 2888051 - protein, 5 aa, Entamoeba invadens
NKTFE

SEQ ID NO: 2888052 - protein, 11 aa, Entamoeba invadens
NKTFKKEQAEL

SEQ ID NO: 2888053 - protein, 8 aa, Entamoeba invadens
NKTFKTTN

SEQ ID NO: 2888054 - protein, 6 aa, Entamoeba invadens
NKTFQK

SEQ ID NO: 2888055 - protein, 6 aa, Entamoeba invadens
NKTGAT

SEQ ID NO: 2888056 - protein, 8 aa, Entamoeba invadens
NKTGELSK

SEQ ID NO: 2888057 - protein, 7 aa, Entamoeba invadens
NKTGFGI

SEQ ID NO: 2888058 - protein, 10 aa, Entamoeba invadens
NKTGRDEYVD

SEQ ID NO: 2888059 - protein, 40 aa, Entamoeba invadens
NKTGSSEEKKEMIKKERKEKGKEKQKNEKKPRKAKSETTI

SEQ ID NO: 2888060 - protein, 15 aa, Entamoeba invadens
NKTGTNAYNLSRGEG

SEQ ID NO: 2888061 - protein, 6 aa, Entamoeba invadens
NKTHYP

SEQ ID NO: 2888062 - protein, 4 aa, Entamoeba invadens
NKTI

SEQ ID NO: 2888063 - protein, 9 aa, Entamoeba invadens
NKTIERTQH

SEQ ID NO: 2888064 - protein, 7 aa, Entamoeba invadens
NKTIETK

SEQ ID NO: 2888065 - protein, 15 aa, Entamoeba invadens
NKTIGNEKNKPKRGE

SEQ ID NO: 2888066 - protein, 21 aa, Entamoeba invadens
NKTIRPVEKETTVSRNESRMA

SEQ ID NO: 2888067 - protein, 8 aa, Entamoeba invadens
NKTKGMKK

SEQ ID NO: 2888068 - protein, 6 aa, Entamoeba invadens
NKTKGY

SEQ ID NO: 2888069 - protein, 6 aa, Entamoeba invadens
NKTKIG

SEQ ID NO: 2888070 - protein, 5 aa, Entamoeba invadens
NKTKK

SEQ ID NO: 2888071 - protein, 8 aa, Entamoeba invadens
NKTKNNQF

SEQ ID NO: 2888072 - protein, 6 aa, Entamoeba invadens
NKTKQT

SEQ ID NO: 2888073 - protein, 12 aa, Entamoeba invadens
NKTLEKTNNEMY

SEQ ID NO: 2888074 - protein, 7 aa, Entamoeba invadens
NKTLSKN

SEQ ID NO: 2888075 - protein, 11 aa, Entamoeba invadens
NKTMSEKDCEH

SEQ ID NO: 2888076 - protein, 7 aa, Entamoeba invadens
NKTMTDD

SEQ ID NO: 2888077 - protein, 6 aa, Entamoeba invadens
NKTNAD

SEQ ID NO: 2888078 - protein, 7 aa, Entamoeba invadens
NKTNDAY

SEQ ID NO: 2888079 - protein, 6 aa, Entamoeba invadens
NKTNEN

SEQ ID NO: 2888080 - protein, 5 aa, Entamoeba invadens
NKTNF

SEQ ID NO: 2888081 - protein, 6 aa, Entamoeba invadens
NKTNGM

SEQ ID NO: 2888082 - protein, 8 aa, Entamoeba invadens
NKTNSTAI

SEQ ID NO: 2888083 - protein, 8 aa, Entamoeba invadens
NKTPASND

SEQ ID NO: 2888084 - protein, 10 aa, Entamoeba invadens
NKTPGLGKAT

SEQ ID NO: 2888085 - protein, 7 aa, Entamoeba invadens
NKTPLGD

SEQ ID NO: 2888086 - protein, 13 aa, Entamoeba invadens
NKTPRTQETVSTS

SEQ ID NO: 2888087 - protein, 8 aa, Entamoeba invadens
NKTPSAFG

SEQ ID NO: 2888088 - protein, 8 aa, Entamoeba invadens
NKTPSKDD

SEQ ID NO: 2888089 - protein, 18 aa, Entamoeba invadens
NKTPTPNADREKCTQSPK

SEQ ID NO: 2888090 - protein, 24 aa, Entamoeba invadens
NKTQLEKKPKKVAEKKRSTEGKRV

SEQ ID NO: 2888091 - protein, 8 aa, Entamoeba invadens
NKTQYAQV

SEQ ID NO: 2888092 - protein, 8 aa, Entamoeba invadens
NKTRDEKM

SEQ ID NO: 2888093 - protein, 7 aa, Entamoeba invadens
NKTREEK

SEQ ID NO: 2888094 - protein, 6 aa, Entamoeba invadens
NKTRRN

SEQ ID NO: 2888095 - protein, 6 aa, Entamoeba invadens
NKTRSK

SEQ ID NO: 2888096 - protein, 9 aa, Entamoeba invadens
NKTSEGGIN

SEQ ID NO: 2888097 - protein, 8 aa, Entamoeba invadens
NKTSEIKE

SEQ ID NO: 2888098 - protein, 8 aa, Entamoeba invadens
NKTSEVNE

SEQ ID NO: 2888099 - protein, 10 aa, Entamoeba invadens
NKTSKMDYSG

SEQ ID NO: 2888100 - protein, 8 aa, Entamoeba invadens
NKTSNKSA

SEQ ID NO: 2888101 - protein, 10 aa, Entamoeba invadens
NKTSNQEGVV

SEQ ID NO: 2888102 - protein, 7 aa, Entamoeba invadens
NKTSPNE

SEQ ID NO: 2888103 - protein, 5 aa, Entamoeba invadens
NKTSV

SEQ ID NO: 2888104 - protein, 4 aa, Entamoeba invadens
NKTT

SEQ ID NO: 2888105 - protein, 7 aa, Entamoeba invadens
NKTTEEH

SEQ ID NO: 2888106 - protein, 5 aa, Entamoeba invadens
NKTTH

SEQ ID NO: 2888107 - protein, 12 aa, Entamoeba invadens
NKTTSDTKGLES

SEQ ID NO: 2888108 - protein, 7 aa, Entamoeba invadens
NKTTSGC

SEQ ID NO: 2888109 - protein, 6 aa, Entamoeba invadens
NKTTSH

SEQ ID NO: 2888110 - protein, 8 aa, Entamoeba invadens
NKTTTNVE

SEQ ID NO: 2888111 - protein, 6 aa, Entamoeba invadens
NKTTVG

SEQ ID NO: 2888112 - protein, 6 aa, Entamoeba invadens
NKTVPD

SEQ ID NO: 2888113 - protein, 8 aa, Entamoeba invadens
NKTVTDLT

SEQ ID NO: 2888114 - protein, 6 aa, Entamoeba invadens
NKTYDK

SEQ ID NO: 2888115 - protein, 6 aa, Entamoeba invadens
NKTYGN

SEQ ID NO: 2888116 - protein, 9 aa, Entamoeba invadens
NKTYKEASS

SEQ ID NO: 2888117 - protein, 6 aa, Entamoeba invadens
NKTYKY

SEQ ID NO: 2888118 - protein, 54 aa, Entamoeba invadens
NKTYQEKMTDYRNKTSELEDTISKQSKKLNSLERKAERLEKDLEEEKANNGETI

SEQ ID NO: 2888119 - protein, 5 aa, Entamoeba invadens
NKVAN

SEQ ID NO: 2888120 - protein, 13 aa, Entamoeba invadens
NKVDKVENLNTSK

SEQ ID NO: 2888121 - protein, 7 aa, Entamoeba invadens
NKVDTSE

SEQ ID NO: 2888122 - protein, 6 aa, Entamoeba invadens
NKVEDP

SEQ ID NO: 2888123 - protein, 15 aa, Entamoeba invadens
NKVGTGEVGSGSLSL

SEQ ID NO: 2888124 - protein, 11 aa, Entamoeba invadens
NKVGVENGEFP

SEQ ID NO: 2888125 - protein, 4 aa, Entamoeba invadens
NKVI

SEQ ID NO: 2888126 - protein, 10 aa, Entamoeba invadens
NKVKDKEKVI

SEQ ID NO: 2888127 - protein, 5 aa, Entamoeba invadens
NKVNA

SEQ ID NO: 2888128 - protein, 14 aa, Entamoeba invadens
NKVNGKLTDFGSSR

SEQ ID NO: 2888129 - protein, 11 aa, Entamoeba invadens
NKVNKNYEDLS

SEQ ID NO: 2888130 - protein, 10 aa, Entamoeba invadens
NKVNQEPLIE

SEQ ID NO: 2888131 - protein, 12 aa, Entamoeba invadens
NKVNSDGIGAPP

SEQ ID NO: 2888132 - protein, 13 aa, Entamoeba invadens
NKVNTSISSNNSR

SEQ ID NO: 2888133 - protein, 10 aa, Entamoeba invadens
NKVQKVSGKP

SEQ ID NO: 2888134 - protein, 7 aa, Entamoeba invadens
NKVREKL

SEQ ID NO: 2888135 - protein, 9 aa, Entamoeba invadens
NKVSPADMD

SEQ ID NO: 2888136 - protein, 8 aa, Entamoeba invadens
NKVSQSDL

SEQ ID NO: 2888137 - protein, 5 aa, Entamoeba invadens
NKVSS

SEQ ID NO: 2888138 - protein, 7 aa, Entamoeba invadens
NKVTQIE

SEQ ID NO: 2888139 - protein, 6 aa, Entamoeba invadens
NKWESP

SEQ ID NO: 2888140 - protein, 9 aa, Entamoeba invadens
NKYDPTPID

SEQ ID NO: 2888141 - protein, 5 aa, Entamoeba invadens
NKYES

SEQ ID NO: 2888142 - protein, 4 aa, Entamoeba invadens
NKYF

SEQ ID NO: 2888143 - protein, 10 aa, Entamoeba invadens
NKYGCSSQYN

SEQ ID NO: 2888144 - protein, 7 aa, Entamoeba invadens
NKYKEKY

SEQ ID NO: 2888145 - protein, 15 aa, Entamoeba invadens
NKYKSESSKIVSDTK

SEQ ID NO: 2888146 - protein, 7 aa, Entamoeba invadens
NKYNYPN

SEQ ID NO: 2888147 - protein, 8 aa, Entamoeba invadens
NKYPDDVN

SEQ ID NO: 2888148 - protein, 7 aa, Entamoeba invadens
NKYPTAD

SEQ ID NO: 2888149 - protein, 5 aa, Entamoeba invadens
NKYPV

SEQ ID NO: 2888150 - protein, 4 aa, Entamoeba invadens
NKYR

SEQ ID NO: 2888151 - protein, 10 aa, Entamoeba invadens
NKYRKEYKEE

SEQ ID NO: 2888152 - protein, 5 aa, Entamoeba invadens
NKYSV

SEQ ID NO: 2888153 - protein, 7 aa, Entamoeba invadens
NKYTTKN

SEQ ID NO: 2888154 - protein, 6 aa, Entamoeba invadens
NKYVGD

SEQ ID NO: 2888155 - protein, 4 aa, Entamoeba invadens
NKYY

SEQ ID NO: 2888156 - protein, 5 aa, Entamoeba invadens
NLADA

SEQ ID NO: 2888157 - protein, 6 aa, Entamoeba invadens
NLAEAT

SEQ ID NO: 2888158 - protein, 27 aa, Entamoeba invadens
NLAGEFKRKKQKYKVYSQADNETKATI

SEQ ID NO: 2888159 - protein, 7 aa, Entamoeba invadens
NLAGETA

SEQ ID NO: 2888160 - protein, 8 aa, Entamoeba invadens
NLAKGDGL

SEQ ID NO: 2888161 - protein, 7 aa, Entamoeba invadens
NLAKRDQ

SEQ ID NO: 2888162 - protein, 5 aa, Entamoeba invadens
NLANE

SEQ ID NO: 2888163 - protein, 6 aa, Entamoeba invadens
NLANGS

SEQ ID NO: 2888164 - protein, 6 aa, Entamoeba invadens
NLAPGS

SEQ ID NO: 2888165 - protein, 20 aa, Entamoeba invadens
NLAYDKDQLSSEKKKLQDEY

SEQ ID NO: 2888166 - protein, 5 aa, Entamoeba invadens
NLDDL

SEQ ID NO: 2888167 - protein, 6 aa, Entamoeba invadens
NLDDPS

SEQ ID NO: 2888168 - protein, 4 aa, Entamoeba invadens
NLDE

SEQ ID NO: 2888169 - protein, 9 aa, Entamoeba invadens
NLDEAEKLA

SEQ ID NO: 2888170 - protein, 16 aa, Entamoeba invadens
NLDEDYAGQTQEMQQE

SEQ ID NO: 2888171 - protein, 14 aa, Entamoeba invadens
NLDEPNDYLCLLYI

SEQ ID NO: 2888172 - protein, 10 aa, Entamoeba invadens
NLDEQKDAIR

SEQ ID NO: 2888173 - protein, 16 aa, Entamoeba invadens
NLDETENELKSSSTVA

SEQ ID NO: 2888174 - protein, 15 aa, Entamoeba invadens
NLDKDGQSFSSSTSE

SEQ ID NO: 2888175 - protein, 17 aa, Entamoeba invadens
NLDKKHPNQLNDDKDIQ

SEQ ID NO: 2888176 - protein, 17 aa, Entamoeba invadens
NLDKKRPNQMNADKDIQ

SEQ ID NO: 2888177 - protein, 13 aa, Entamoeba invadens
NLDNKESNLENDL

SEQ ID NO: 2888178 - protein, 11 aa, Entamoeba invadens
NLDNTSAQQIT

SEQ ID NO: 2888179 - protein, 5 aa, Entamoeba invadens
NLDPS

SEQ ID NO: 2888180 - protein, 15 aa, Entamoeba invadens
NLDQDTSGSQTYEQS

SEQ ID NO: 2888181 - protein, 9 aa, Entamoeba invadens
NLDRTQNVE

SEQ ID NO: 2888182 - protein, 20 aa, Entamoeba invadens
NLDSDDLESDFESDSNSNYS

SEQ ID NO: 2888183 - protein, 5 aa, Entamoeba invadens
NLDTE

SEQ ID NO: 2888184 - protein, 10 aa, Entamoeba invadens
NLEDEADSTV

SEQ ID NO: 2888185 - protein, 21 aa, Entamoeba invadens
NLEDNDPIPRRAQTMQTAQSE

SEQ ID NO: 2888186 - protein, 9 aa, Entamoeba invadens
NLEDSKQKI

SEQ ID NO: 2888187 - protein, 5 aa, Entamoeba invadens
NLEEA

SEQ ID NO: 2888188 - protein, 14 aa, Entamoeba invadens
NLEEDLEDSRDEDD

SEQ ID NO: 2888189 - protein, 11 aa, Entamoeba invadens
NLEEKVNTLQT

SEQ ID NO: 2888190 - protein, 7 aa, Entamoeba invadens
NLEEYRK

SEQ ID NO: 2888191 - protein, 8 aa, Entamoeba invadens
NLEGDGIE

SEQ ID NO: 2888192 - protein, 7 aa, Entamoeba invadens
NLEGGGL

SEQ ID NO: 2888193 - protein, 5 aa, Entamoeba invadens
NLEKN

SEQ ID NO: 2888194 - protein, 6 aa, Entamoeba invadens
NLEKSK

SEQ ID NO: 2888195 - protein, 19 aa, Entamoeba invadens
NLEKTDSIEGNHQTVTRKQ

SEQ ID NO: 2888196 - protein, 8 aa, Entamoeba invadens
NLEKTSED

SEQ ID NO: 2888197 - protein, 25 aa, Entamoeba invadens
NLENDLEDTESQNLTDEKVCVLLLF

SEQ ID NO: 2888198 - protein, 24 aa, Entamoeba invadens
NLENENENQSDEITEKRKLNKCLI

SEQ ID NO: 2888199 - protein, 15 aa, Entamoeba invadens
NLENRAKKTVLEASQ

SEQ ID NO: 2888200 - protein, 43 aa, Entamoeba invadens
NLENTKEDLDKTEVELADTKKKLKDAIKEKEDLEQNYSSGNSI

SEQ ID NO: 2888201 - protein, 5 aa, Entamoeba invadens
NLEPN

SEQ ID NO: 2888202 - protein, 34 aa, Entamoeba invadens
NLEQTNTNVNDELEKTKNETNEFAEELSKANAEL

SEQ ID NO: 2888203 - protein, 41 aa, Entamoeba invadens
NLERNERYERSEKIDKGETSEKILTPRNKSEEKCEKKVTLL

SEQ ID NO: 2888204 - protein, 9 aa, Entamoeba invadens
NLESTAPGI

SEQ ID NO: 2888205 - protein, 9 aa, Entamoeba invadens
NLESTKTHF

SEQ ID NO: 2888206 - protein, 5 aa, Entamoeba invadens
NLETG

SEQ ID NO: 2888207 - protein, 11 aa, Entamoeba invadens
NLETSASHSNP

SEQ ID NO: 2888208 - protein, 11 aa, Entamoeba invadens
NLGASEGGKGR

SEQ ID NO: 2888209 - protein, 7 aa, Entamoeba invadens
NLGATLD

SEQ ID NO: 2888210 - protein, 5 aa, Entamoeba invadens
NLGEA

SEQ ID NO: 2888211 - protein, 10 aa, Entamoeba invadens
NLGEKMDEER

SEQ ID NO: 2888212 - protein, 5 aa, Entamoeba invadens
NLGEP

SEQ ID NO: 2888213 - protein, 6 aa, Entamoeba invadens
NLGEQG

SEQ ID NO: 2888214 - protein, 7 aa, Entamoeba invadens
NLGHRGA

SEQ ID NO: 2888215 - protein, 4 aa, Entamoeba invadens
NLGK

SEQ ID NO: 2888216 - protein, 6 aa, Entamoeba invadens
NLGKDR

SEQ ID NO: 2888217 - protein, 11 aa, Entamoeba invadens
NLGKNDSLGKT

SEQ ID NO: 2888218 - protein, 5 aa, Entamoeba invadens
NLGKR

SEQ ID NO: 2888219 - protein, 6 aa, Entamoeba invadens
NLGQLK

SEQ ID NO: 2888220 - protein, 10 aa, Entamoeba invadens
NLGSPDPRLA

SEQ ID NO: 2888221 - protein, 17 aa, Entamoeba invadens
NLGTQPISFSPDSSDQR

SEQ ID NO: 2888222 - protein, 7 aa, Entamoeba invadens
NLIGETP

SEQ ID NO: 2888223 - protein, 8 aa, Entamoeba invadens
NLINTTDQ

SEQ ID NO: 2888224 - protein, 6 aa, Entamoeba invadens
NLIPTT

SEQ ID NO: 2888225 - protein, 12 aa, Entamoeba invadens
NLISETTITAAQ

SEQ ID NO: 2888226 - protein, 7 aa, Entamoeba invadens
NLKAKKM

SEQ ID NO: 2888227 - protein, 10 aa, Entamoeba invadens
NLKDESFDLP

SEQ ID NO: 2888228 - protein, 5 aa, Entamoeba invadens
NLKDG

SEQ ID NO: 2888229 - protein, 8 aa, Entamoeba invadens
NLKDTNTV

SEQ ID NO: 2888230 - protein, 5 aa, Entamoeba invadens
NLKEE

SEQ ID NO: 2888231 - protein, 59 aa, Entamoeba invadens
NLKEEKARLEQHKVEEQKAAEVAQKEEKAKKEALEKQKEIEDKENEEKKIEKEKQEKAD

SEQ ID NO: 2888232 - protein, 15 aa, Entamoeba invadens
NLKEPCGDVSIVLCR

SEQ ID NO: 2888233 - protein, 8 aa, Entamoeba invadens
NLKEYGGK

SEQ ID NO: 2888234 - protein, 27 aa, Entamoeba invadens
NLKGDDDSSSSTSGSDDDDHKPDEPIK

SEQ ID NO: 2888235 - protein, 7 aa, Entamoeba invadens
NLKKDPI

SEQ ID NO: 2888236 - protein, 12 aa, Entamoeba invadens
NLKKLDKNACQN

SEQ ID NO: 2888237 - protein, 11 aa, Entamoeba invadens
NLKKNENKSVN

SEQ ID NO: 2888238 - protein, 13 aa, Entamoeba invadens
NLKNEESPYAKTR

SEQ ID NO: 2888239 - protein, 16 aa, Entamoeba invadens
NLKNKNFDDVLYNYDC

SEQ ID NO: 2888240 - protein, 12 aa, Entamoeba invadens
NLKNPPVVSNKI

SEQ ID NO: 2888241 - protein, 12 aa, Entamoeba invadens
NLKNSGKDDTIQ

SEQ ID NO: 2888242 - protein, 25 aa, Entamoeba invadens
NLKPEEKESAAFAEEGLDAEENKKA

SEQ ID NO: 2888243 - protein, 18 aa, Entamoeba invadens
NLKQEEEQQHLTKQTKQR

SEQ ID NO: 2888244 - protein, 7 aa, Entamoeba invadens
NLKQKKN

SEQ ID NO: 2888245 - protein, 13 aa, Entamoeba invadens
NLKQSDLKKYIIE

SEQ ID NO: 2888246 - protein, 10 aa, Entamoeba invadens
NLKSKNLEKL

SEQ ID NO: 2888247 - protein, 10 aa, Entamoeba invadens
NLKTEKQKVE

SEQ ID NO: 2888248 - protein, 5 aa, Entamoeba invadens
NLKTI

SEQ ID NO: 2888249 - protein, 12 aa, Entamoeba invadens
NLKTPKLTPKTT

SEQ ID NO: 2888250 - protein, 5 aa, Entamoeba invadens
NLKTR

SEQ ID NO: 2888251 - protein, 7 aa, Entamoeba invadens
NLKTTSA

SEQ ID NO: 2888252 - protein, 9 aa, Entamoeba invadens
NLNANAKKR

SEQ ID NO: 2888253 - protein, 4 aa, Entamoeba invadens
NLNE

SEQ ID NO: 2888254 - protein, 14 aa, Entamoeba invadens
NLNEEDMKEEQPVV

SEQ ID NO: 2888255 - protein, 9 aa, Entamoeba invadens
NLNEPDNQY

SEQ ID NO: 2888256 - protein, 6 aa, Entamoeba invadens
NLNGTQ

SEQ ID NO: 2888257 - protein, 7 aa, Entamoeba invadens
NLNKGYN

SEQ ID NO: 2888258 - protein, 6 aa, Entamoeba invadens
NLNKND

SEQ ID NO: 2888259 - protein, 5 aa, Entamoeba invadens
NLNNK

SEQ ID NO: 2888260 - protein, 12 aa, Entamoeba invadens
NLNNKENNLEND

SEQ ID NO: 2888261 - protein, 6 aa, Entamoeba invadens
NLNPKY

SEQ ID NO: 2888262 - protein, 18 aa, Entamoeba invadens
NLNPSSLADTDIPQIAPH

SEQ ID NO: 2888263 - protein, 9 aa, Entamoeba invadens
NLNPTNNPI

SEQ ID NO: 2888264 - protein, 9 aa, Entamoeba invadens
NLNRKTGNL

SEQ ID NO: 2888265 - protein, 5 aa, Entamoeba invadens
NLNSN

SEQ ID NO: 2888266 - protein, 5 aa, Entamoeba invadens
NLNSQ

SEQ ID NO: 2888267 - protein, 8 aa, Entamoeba invadens
NLNSTSLE

SEQ ID NO: 2888268 - protein, 6 aa, Entamoeba invadens
NLNTDD

SEQ ID NO: 2888269 - protein, 7 aa, Entamoeba invadens
NLNTKSA

SEQ ID NO: 2888270 - protein, 20 aa, Entamoeba invadens
NLNTPKKAFESTKSPNFTSK

SEQ ID NO: 2888271 - protein, 6 aa, Entamoeba invadens
NLPAEE

SEQ ID NO: 2888272 - protein, 7 aa, Entamoeba invadens
NLPDGTE

SEQ ID NO: 2888273 - protein, 21 aa, Entamoeba invadens
NLPDSTDDGVGVNPEGDKKKC

SEQ ID NO: 2888274 - protein, 7 aa, Entamoeba invadens
NLPEANP

SEQ ID NO: 2888275 - protein, 14 aa, Entamoeba invadens
NLPEDEPTTAEEVL

SEQ ID NO: 2888276 - protein, 6 aa, Entamoeba invadens
NLPEEV

SEQ ID NO: 2888277 - protein, 5 aa, Entamoeba invadens
NLPEG

SEQ ID NO: 2888278 - protein, 10 aa, Entamoeba invadens
NLPEQNDKAI

SEQ ID NO: 2888279 - protein, 5 aa, Entamoeba invadens
NLPES

SEQ ID NO: 2888280 - protein, 9 aa, Entamoeba invadens
NLPETKNKK

SEQ ID NO: 2888281 - protein, 5 aa, Entamoeba invadens
NLPGA

SEQ ID NO: 2888282 - protein, 5 aa, Entamoeba invadens
NLPGP

SEQ ID NO: 2888283 - protein, 8 aa, Entamoeba invadens
NLPGQSAW

SEQ ID NO: 2888284 - protein, 12 aa, Entamoeba invadens
NLPKADPTGLSD

SEQ ID NO: 2888285 - protein, 12 aa, Entamoeba invadens
NLPKDEEKTKLH

SEQ ID NO: 2888286 - protein, 6 aa, Entamoeba invadens
NLPNPY

SEQ ID NO: 2888287 - protein, 5 aa, Entamoeba invadens
NLPNY

SEQ ID NO: 2888288 - protein, 11 aa, Entamoeba invadens
NLPPLKKRKEN

SEQ ID NO: 2888289 - protein, 21 aa, Entamoeba invadens
NLPPLSPPQQQSLPPGRYEQF

SEQ ID NO: 2888290 - protein, 40 aa, Entamoeba invadens
NLPPSLPQSYRTDFEQNNTTKKEQRDDIPVEEEKPPRPLW

SEQ ID NO: 2888291 - protein, 7 aa, Entamoeba invadens
NLPPTGK

SEQ ID NO: 2888292 - protein, 6 aa, Entamoeba invadens
NLPQEG

SEQ ID NO: 2888293 - protein, 7 aa, Entamoeba invadens
NLPQEGA

SEQ ID NO: 2888294 - protein, 5 aa, Entamoeba invadens
NLPQQ

SEQ ID NO: 2888295 - protein, 6 aa, Entamoeba invadens
NLPSGK

SEQ ID NO: 2888296 - protein, 11 aa, Entamoeba invadens
NLPSKVSSLGN

SEQ ID NO: 2888297 - protein, 9 aa, Entamoeba invadens
NLPSPKKEL

SEQ ID NO: 2888298 - protein, 6 aa, Entamoeba invadens
NLPSTL

SEQ ID NO: 2888299 - protein, 10 aa, Entamoeba invadens
NLPYSSKSDL

SEQ ID NO: 2888300 - protein, 10 aa, Entamoeba invadens
NLQDSLKSTT

SEQ ID NO: 2888301 - protein, 18 aa, Entamoeba invadens
NLQEEDSDTEEENPPTPI

SEQ ID NO: 2888302 - protein, 8 aa, Entamoeba invadens
NLQETETT

SEQ ID NO: 2888303 - protein, 8 aa, Entamoeba invadens
NLQGKNLQ

SEQ ID NO: 2888304 - protein, 14 aa, Entamoeba invadens
NLQGTEIKASDISD

SEQ ID NO: 2888305 - protein, 9 aa, Entamoeba invadens
NLQIKTGRV

SEQ ID NO: 2888306 - protein, 4 aa, Entamoeba invadens
NLQK

SEQ ID NO: 2888307 - protein, 16 aa, Entamoeba invadens
NLQKENGVITFKDTEI

SEQ ID NO: 2888308 - protein, 12 aa, Entamoeba invadens
NLQKPQTNPNYP

SEQ ID NO: 2888309 - protein, 8 aa, Entamoeba invadens
NLQKSQKL

SEQ ID NO: 2888310 - protein, 11 aa, Entamoeba invadens
NLQKSRQSNLS

SEQ ID NO: 2888311 - protein, 9 aa, Entamoeba invadens
NLQNDENYQ

SEQ ID NO: 2888312 - protein, 15 aa, Entamoeba invadens
NLQPSGTAQGTSSLR

SEQ ID NO: 2888313 - protein, 11 aa, Entamoeba invadens
NLQRQNSLTLN

SEQ ID NO: 2888314 - protein, 8 aa, Entamoeba invadens
NLQSTKSL

SEQ ID NO: 2888315 - protein, 10 aa, Entamoeba invadens
NLQTPGEEYT

SEQ ID NO: 2888316 - protein, 8 aa, Entamoeba invadens
NLQTPRTG

SEQ ID NO: 2888317 - protein, 17 aa, Entamoeba invadens
NLQTQKNSNNQGLEDEW

SEQ ID NO: 2888318 - protein, 6 aa, Entamoeba invadens
NLRAGD

SEQ ID NO: 2888319 - protein, 12 aa, Entamoeba invadens
NLRDEINNTTEI

SEQ ID NO: 2888320 - protein, 31 aa, Entamoeba invadens
NLREKHSKSHLQTSEKIDKKENERVSDDELR

SEQ ID NO: 2888321 - protein, 10 aa, Entamoeba invadens
NLRKDRQNLS

SEQ ID NO: 2888322 - protein, 16 aa, Entamoeba invadens
NLRNKTLTDTQSFESD

SEQ ID NO: 2888323 - protein, 9 aa, Entamoeba invadens
NLRNQTINS

SEQ ID NO: 2888324 - protein, 27 aa, Entamoeba invadens
NLRPKEQRKPVSTPAHPQTQQRKTVKS

SEQ ID NO: 2888325 - protein, 13 aa, Entamoeba invadens
NLRPTQKLDDKGD

SEQ ID NO: 2888326 - protein, 5 aa, Entamoeba invadens
NLRSG

SEQ ID NO: 2888327 - protein, 11 aa, Entamoeba invadens
NLRTKEGQKVV

SEQ ID NO: 2888328 - protein, 10 aa, Entamoeba invadens
NLSDRLDAQR

SEQ ID NO: 2888329 - protein, 5 aa, Entamoeba invadens
NLSEE

SEQ ID NO: 2888330 - protein, 43 aa, Entamoeba invadens
NLSESGNDDTPENTSKPIIKEATDDSDEWKGGEKPKKEGYTGK

SEQ ID NO: 2888331 - protein, 30 aa, Entamoeba invadens
NLSGGTDDIEESKRDKYDDTSSFDVPPNLE

SEQ ID NO: 2888332 - protein, 15 aa, Entamoeba invadens
NLSIKDPKNETQQKV

SEQ ID NO: 2888333 - protein, 12 aa, Entamoeba invadens
NLSKDSQSSIEK

SEQ ID NO: 2888334 - protein, 11 aa, Entamoeba invadens
NLSKDTQTSIE

SEQ ID NO: 2888335 - protein, 12 aa, Entamoeba invadens
NLSKGRTPLYSD

SEQ ID NO: 2888336 - protein, 14 aa, Entamoeba invadens
NLSLSQRKMEQNHD

SEQ ID NO: 2888337 - protein, 6 aa, Entamoeba invadens
NLSPQK

SEQ ID NO: 2888338 - protein, 13 aa, Entamoeba invadens
NLSPSNPPTQTIA

SEQ ID NO: 2888339 - protein, 6 aa, Entamoeba invadens
NLSPSR

SEQ ID NO: 2888340 - protein, 10 aa, Entamoeba invadens
NLSQDEKNKA

SEQ ID NO: 2888341 - protein, 7 aa, Entamoeba invadens
NLSQRDY

SEQ ID NO: 2888342 - protein, 28 aa, Entamoeba invadens
NLSREEASKRLNSQPSQEEYDKKANVTF

SEQ ID NO: 2888343 - protein, 11 aa, Entamoeba invadens
NLSRSRNDDEI

SEQ ID NO: 2888344 - protein, 7 aa, Entamoeba invadens
NLSRSSN

SEQ ID NO: 2888345 - protein, 7 aa, Entamoeba invadens
NLSSPPV

SEQ ID NO: 2888346 - protein, 11 aa, Entamoeba invadens
NLSSSQPRNVN

SEQ ID NO: 2888347 - protein, 6 aa, Entamoeba invadens
NLSTDD

SEQ ID NO: 2888348 - protein, 7 aa, Entamoeba invadens
NLSTDQI

SEQ ID NO: 2888349 - protein, 7 aa, Entamoeba invadens
NLTDEKM

SEQ ID NO: 2888350 - protein, 12 aa, Entamoeba invadens
NLTDGYSGSDMK

SEQ ID NO: 2888351 - protein, 7 aa, Entamoeba invadens
NLTEEPV

SEQ ID NO: 2888352 - protein, 6 aa, Entamoeba invadens
NLTENG

SEQ ID NO: 2888353 - protein, 5 aa, Entamoeba invadens
NLTEP

SEQ ID NO: 2888354 - protein, 7 aa, Entamoeba invadens
NLTEQQK

SEQ ID NO: 2888355 - protein, 8 aa, Entamoeba invadens
NLTGEQRR

SEQ ID NO: 2888356 - protein, 11 aa, Entamoeba invadens
NLTKIDTNGVD

SEQ ID NO: 2888357 - protein, 8 aa, Entamoeba invadens
NLTKKTNE

SEQ ID NO: 2888358 - protein, 9 aa, Entamoeba invadens
NLTKLPDAA

SEQ ID NO: 2888359 - protein, 13 aa, Entamoeba invadens
NLTKSRGAMTGAR

SEQ ID NO: 2888360 - protein, 8 aa, Entamoeba invadens
NLTNEATK

SEQ ID NO: 2888361 - protein, 7 aa, Entamoeba invadens
NLTNNEN

SEQ ID NO: 2888362 - protein, 7 aa, Entamoeba invadens
NLTNPGS

SEQ ID NO: 2888363 - protein, 4 aa, Entamoeba invadens
NLTP

SEQ ID NO: 2888364 - protein, 6 aa, Entamoeba invadens
NLTPEA

SEQ ID NO: 2888365 - protein, 5 aa, Entamoeba invadens
NLTPK

SEQ ID NO: 2888366 - protein, 6 aa, Entamoeba invadens
NLTPYK

SEQ ID NO: 2888367 - protein, 4 aa, Entamoeba invadens
NLTT

SEQ ID NO: 2888368 - protein, 5 aa, Entamoeba invadens
NLTTF

SEQ ID NO: 2888369 - protein, 5 aa, Entamoeba invadens
NLTTP

SEQ ID NO: 2888370 - protein, 16 aa, Entamoeba invadens
NLTTTTSAWTNPTASA

SEQ ID NO: 2888371 - protein, 7 aa, Entamoeba invadens
NLTYSRS

SEQ ID NO: 2888372 - protein, 8 aa, Entamoeba invadens
NLYNKENE

SEQ ID NO: 2888373 - protein, 7 aa, Entamoeba invadens
NLYPEEC

SEQ ID NO: 2888374 - protein, 7 aa, Entamoeba invadens
NLYQTNP

SEQ ID NO: 2888375 - protein, 23 aa, Entamoeba invadens
NMAGSLNPVDSSGAKGKYSLQES

SEQ ID NO: 2888376 - protein, 15 aa, Entamoeba invadens
NMASSKKIETHPREN

SEQ ID NO: 2888377 - protein, 7 aa, Entamoeba invadens
NMDEEDD

SEQ ID NO: 2888378 - protein, 14 aa, Entamoeba invadens
NMEEQLTKTNDEKM

SEQ ID NO: 2888379 - protein, 5 aa, Entamoeba invadens
NMEEY

SEQ ID NO: 2888380 - protein, 12 aa, Entamoeba invadens
NMEKKENGDISR

SEQ ID NO: 2888381 - protein, 10 aa, Entamoeba invadens
NMENDSRARY

SEQ ID NO: 2888382 - protein, 45 aa, Entamoeba invadens
NMENFNEEDENTSDEDETLKENDKKPIKKPQEDKKPKKLTHKSKQ

SEQ ID NO: 2888383 - protein, 12 aa, Entamoeba invadens
NMENNPKNRCSD

SEQ ID NO: 2888384 - protein, 9 aa, Entamoeba invadens
NMENTENDS

SEQ ID NO: 2888385 - protein, 10 aa, Entamoeba invadens
NMESSNSGMV

SEQ ID NO: 2888386 - protein, 9 aa, Entamoeba invadens
NMESTRNSL

SEQ ID NO: 2888387 - protein, 15 aa, Entamoeba invadens
NMESVDKEMEEVSEG

SEQ ID NO: 2888388 - protein, 8 aa, Entamoeba invadens
NMETSATH

SEQ ID NO: 2888389 - protein, 13 aa, Entamoeba invadens
NMGDANDKGINSG

SEQ ID NO: 2888390 - protein, 4 aa, Entamoeba invadens
NMGN

SEQ ID NO: 2888391 - protein, 4 aa, Entamoeba invadens
NMGS

SEQ ID NO: 2888392 - protein, 12 aa, Entamoeba invadens
NMGSTATSQTNT

SEQ ID NO: 2888393 - protein, 8 aa, Entamoeba invadens
NMKADNDM

SEQ ID NO: 2888394 - protein, 16 aa, Entamoeba invadens
NMKARKYSSVANENRK

SEQ ID NO: 2888395 - protein, 9 aa, Entamoeba invadens
NMKEEDSCD

SEQ ID NO: 2888396 - protein, 9 aa, Entamoeba invadens
NMKEEETAE

SEQ ID NO: 2888397 - protein, 41 aa, Entamoeba invadens
NMKEQQAATGETKEEKPVAEAKEAEKPAATEADDGYVPNEE

SEQ ID NO: 2888398 - protein, 7 aa, Entamoeba invadens
NMKKENF

SEQ ID NO: 2888399 - protein, 8 aa, Entamoeba invadens
NMKRPITN

SEQ ID NO: 2888400 - protein, 9 aa, Entamoeba invadens
NMKSSSRFS

SEQ ID NO: 2888401 - protein, 4 aa, Entamoeba invadens
NMNA

SEQ ID NO: 2888402 - protein, 6 aa, Entamoeba invadens
NMNGGY

SEQ ID NO: 2888403 - protein, 10 aa, Entamoeba invadens
NMPEASSAVE

SEQ ID NO: 2888404 - protein, 6 aa, Entamoeba invadens
NMPNEA

SEQ ID NO: 2888405 - protein, 4 aa, Entamoeba invadens
NMPT

SEQ ID NO: 2888406 - protein, 11 aa, Entamoeba invadens
NMQEHKPKQNQ

SEQ ID NO: 2888407 - protein, 4 aa, Entamoeba invadens
NMQG

SEQ ID NO: 2888408 - protein, 11 aa, Entamoeba invadens
NMRQANAKSEE

SEQ ID NO: 2888409 - protein, 8 aa, Entamoeba invadens
NMRSRGYN

SEQ ID NO: 2888410 - protein, 12 aa, Entamoeba invadens
NMSDKNHTIQNE

SEQ ID NO: 2888411 - protein, 4 aa, Entamoeba invadens
NMSK

SEQ ID NO: 2888412 - protein, 8 aa, Entamoeba invadens
NMSPDTFA

SEQ ID NO: 2888413 - protein, 5 aa, Entamoeba invadens
NMSSQ

SEQ ID NO: 2888414 - protein, 9 aa, Entamoeba invadens
NMTAQQKKV

SEQ ID NO: 2888415 - protein, 6 aa, Entamoeba invadens
NMTDPH

SEQ ID NO: 2888416 - protein, 8 aa, Entamoeba invadens
NMTEGSPH

SEQ ID NO: 2888417 - protein, 4 aa, Entamoeba invadens
NMTK

SEQ ID NO: 2888418 - protein, 4 aa, Entamoeba invadens
NMTN

SEQ ID NO: 2888419 - protein, 7 aa, Entamoeba invadens
NMTQNGN

SEQ ID NO: 2888420 - protein, 4 aa, Entamoeba invadens
NMTS

SEQ ID NO: 2888421 - protein, 14 aa, Entamoeba invadens
NMTSNDQVEDEDDF

SEQ ID NO: 2888422 - protein, 8 aa, Entamoeba invadens
NMTSPRGK

SEQ ID NO: 2888423 - protein, 7 aa, Entamoeba invadens
NMTSTEN

SEQ ID NO: 2888424 - protein, 9 aa, Entamoeba invadens
NMTTRDDAE

SEQ ID NO: 2888425 - protein, 10 aa, Entamoeba invadens
NMYPSPDTGK

SEQ ID NO: 2888426 - protein, 10 aa, Entamoeba invadens
NNAAKDERNR

SEQ ID NO: 2888427 - protein, 7 aa, Entamoeba invadens
NNACQST

SEQ ID NO: 2888428 - protein, 8 aa, Entamoeba invadens
NNADGINK

SEQ ID NO: 2888429 - protein, 15 aa, Entamoeba invadens
NNADSKGNSEQYKSA

SEQ ID NO: 2888430 - protein, 25 aa, Entamoeba invadens
NNADTDAVDKKKLNKTVNESNKKIE

SEQ ID NO: 2888431 - protein, 9 aa, Entamoeba invadens
NNAEKTKDY

SEQ ID NO: 2888432 - protein, 10 aa, Entamoeba invadens
NNAEKTKDYD

SEQ ID NO: 2888433 - protein, 7 aa, Entamoeba invadens
NNAESDH

SEQ ID NO: 2888434 - protein, 4 aa, Entamoeba invadens
NNAK

SEQ ID NO: 2888435 - protein, 13 aa, Entamoeba invadens
NNAKDSSAIVDEL

SEQ ID NO: 2888436 - protein, 10 aa, Entamoeba invadens
NNAKKTKDYD

SEQ ID NO: 2888437 - protein, 14 aa, Entamoeba invadens
NNAKQAEEKDRVKH

SEQ ID NO: 2888438 - protein, 8 aa, Entamoeba invadens
NNALSQLP

SEQ ID NO: 2888439 - protein, 4 aa, Entamoeba invadens
NNAM

SEQ ID NO: 2888440 - protein, 4 aa, Entamoeba invadens
NNAN

SEQ ID NO: 2888441 - protein, 7 aa, Entamoeba invadens
NNANFST

SEQ ID NO: 2888442 - protein, 5 aa, Entamoeba invadens
NNANV

SEQ ID NO: 2888443 - protein, 6 aa, Entamoeba invadens
NNANVA

SEQ ID NO: 2888444 - protein, 14 aa, Entamoeba invadens
NNAPMAPRKKNSVS

SEQ ID NO: 2888445 - protein, 10 aa, Entamoeba invadens
NNAPSDIDQI

SEQ ID NO: 2888446 - protein, 15 aa, Entamoeba invadens
NNAPYYETSAQNNIN

SEQ ID NO: 2888447 - protein, 9 aa, Entamoeba invadens
NNAQKSMRE

SEQ ID NO: 2888448 - protein, 8 aa, Entamoeba invadens
NNASALAD

SEQ ID NO: 2888449 - protein, 9 aa, Entamoeba invadens
NNASNTEGI

SEQ ID NO: 2888450 - protein, 6 aa, Entamoeba invadens
NNASRS

SEQ ID NO: 2888451 - protein, 8 aa, Entamoeba invadens
NNATAQEN

SEQ ID NO: 2888452 - protein, 6 aa, Entamoeba invadens
NNAVNS

SEQ ID NO: 2888453 - protein, 10 aa, Entamoeba invadens
NNAYTDKNGK

SEQ ID NO: 2888454 - protein, 8 aa, Entamoeba invadens
NNCDTTKA

SEQ ID NO: 2888455 - protein, 4 aa, Entamoeba invadens
NNCE

SEQ ID NO: 2888456 - protein, 7 aa, Entamoeba invadens
NNCGDER

SEQ ID NO: 2888457 - protein, 12 aa, Entamoeba invadens
NNCNSCNNTEKS

SEQ ID NO: 2888458 - protein, 5 aa, Entamoeba invadens
NNCTF

SEQ ID NO: 2888459 - protein, 5 aa, Entamoeba invadens
NNCYR

SEQ ID NO: 2888460 - protein, 29 aa, Entamoeba invadens
NNDDEKEENENKNKKGPNGERRSNTRKRC

SEQ ID NO: 2888461 - protein, 4 aa, Entamoeba invadens
NNDE

SEQ ID NO: 2888462 - protein, 12 aa, Entamoeba invadens
NNDEDIKPETTV

SEQ ID NO: 2888463 - protein, 11 aa, Entamoeba invadens
NNDEDLETETT

SEQ ID NO: 2888464 - protein, 9 aa, Entamoeba invadens
NNDEEEERL

SEQ ID NO: 2888465 - protein, 5 aa, Entamoeba invadens
NNDEI

SEQ ID NO: 2888466 - protein, 11 aa, Entamoeba invadens
NNDENDNTINF

SEQ ID NO: 2888467 - protein, 7 aa, Entamoeba invadens
NNDFSVA

SEQ ID NO: 2888468 - protein, 4 aa, Entamoeba invadens
NNDG

SEQ ID NO: 2888469 - protein, 21 aa, Entamoeba invadens
NNDGEEQEGDKKLEEEGKDKS

SEQ ID NO: 2888470 - protein, 7 aa, Entamoeba invadens
NNDGGVN

SEQ ID NO: 2888471 - protein, 8 aa, Entamoeba invadens
NNDGTYDV

SEQ ID NO: 2888472 - protein, 6 aa, Entamoeba invadens
NNDKDI

SEQ ID NO: 2888473 - protein, 9 aa, Entamoeba invadens
NNDKEGATV

SEQ ID NO: 2888474 - protein, 11 aa, Entamoeba invadens
NNDLKKNISTL

SEQ ID NO: 2888475 - protein, 6 aa, Entamoeba invadens
NNDNFL

SEQ ID NO: 2888476 - protein, 11 aa, Entamoeba invadens
NNDNNMDNNYN

SEQ ID NO: 2888477 - protein, 7 aa, Entamoeba invadens
NNDNQFD

SEQ ID NO: 2888478 - protein, 4 aa, Entamoeba invadens
NNDP

SEQ ID NO: 2888479 - protein, 6 aa, Entamoeba invadens
NNDPKE

SEQ ID NO: 2888480 - protein, 22 aa, Entamoeba invadens
NNDQGVEMDSEGVGSVASTEQT

SEQ ID NO: 2888481 - protein, 30 aa, Entamoeba invadens
NNDRPRSESRDRNGEQRQDRAEQRERHKPS

SEQ ID NO: 2888482 - protein, 6 aa, Entamoeba invadens
NNDSNV

SEQ ID NO: 2888483 - protein, 4 aa, Entamoeba invadens
NNDT

SEQ ID NO: 2888484 - protein, 8 aa, Entamoeba invadens
NNDTDKTN

SEQ ID NO: 2888485 - protein, 5 aa, Entamoeba invadens
NNDTE

SEQ ID NO: 2888486 - protein, 5 aa, Entamoeba invadens
NNDTI

SEQ ID NO: 2888487 - protein, 34 aa, Entamoeba invadens
NNDTTKNSDIDVGKCGSKYNKCTPTRYTAQSGDL

SEQ ID NO: 2888488 - protein, 5 aa, Entamoeba invadens
NNDVP

SEQ ID NO: 2888489 - protein, 5 aa, Entamoeba invadens
NNEAI

SEQ ID NO: 2888490 - protein, 15 aa, Entamoeba invadens
NNEDDKEISVNEESR

SEQ ID NO: 2888491 - protein, 7 aa, Entamoeba invadens
NNEDDVK

SEQ ID NO: 2888492 - protein, 10 aa, Entamoeba invadens
NNEDKKDING

SEQ ID NO: 2888493 - protein, 14 aa, Entamoeba invadens
NNEDKSMDCDYEVK

SEQ ID NO: 2888494 - protein, 4 aa, Entamoeba invadens
NNEE

SEQ ID NO: 2888495 - protein, 8 aa, Entamoeba invadens
NNEEETPW

SEQ ID NO: 2888496 - protein, 4 aa, Entamoeba invadens
NNEG

SEQ ID NO: 2888497 - protein, 6 aa, Entamoeba invadens
NNEGKS

SEQ ID NO: 2888498 - protein, 7 aa, Entamoeba invadens
NNEGLGE

SEQ ID NO: 2888499 - protein, 5 aa, Entamoeba invadens
NNEID

SEQ ID NO: 2888500 - protein, 26 aa, Entamoeba invadens
NNEIKEIKPGYTDNKNTKRAKNQEAY

SEQ ID NO: 2888501 - protein, 10 aa, Entamoeba invadens
NNEINEHTSS

SEQ ID NO: 2888502 - protein, 6 aa, Entamoeba invadens
NNEISS

SEQ ID NO: 2888503 - protein, 5 aa, Entamoeba invadens
NNEIT

SEQ ID NO: 2888504 - protein, 10 aa, Entamoeba invadens
NNEITSIPKE

SEQ ID NO: 2888505 - protein, 8 aa, Entamoeba invadens
NNEKETPW

SEQ ID NO: 2888506 - protein, 17 aa, Entamoeba invadens
NNEKGVQRKMYRVMNFK

SEQ ID NO: 2888507 - protein, 5 aa, Entamoeba invadens
NNEKS

SEQ ID NO: 2888508 - protein, 16 aa, Entamoeba invadens
NNEKTFKKYKENVPNT

SEQ ID NO: 2888509 - protein, 7 aa, Entamoeba invadens
NNELQAK

SEQ ID NO: 2888510 - protein, 18 aa, Entamoeba invadens
NNELQTDQTTGKCGETTW

SEQ ID NO: 2888511 - protein, 5 aa, Entamoeba invadens
NNENI

SEQ ID NO: 2888512 - protein, 6 aa, Entamoeba invadens
NNENIE

SEQ ID NO: 2888513 - protein, 5 aa, Entamoeba invadens
NNENK

SEQ ID NO: 2888514 - protein, 9 aa, Entamoeba invadens
NNENKDIYE

SEQ ID NO: 2888515 - protein, 11 aa, Entamoeba invadens
NNENNDDPHID

SEQ ID NO: 2888516 - protein, 12 aa, Entamoeba invadens
NNENRRKDMKYS

SEQ ID NO: 2888517 - protein, 7 aa, Entamoeba invadens
NNEPFKT

SEQ ID NO: 2888518 - protein, 15 aa, Entamoeba invadens
NNEQARQITKKECAD

SEQ ID NO: 2888519 - protein, 14 aa, Entamoeba invadens
NNEQQLDKKKHIGN

SEQ ID NO: 2888520 - protein, 5 aa, Entamoeba invadens
NNEQR

SEQ ID NO: 2888521 - protein, 5 aa, Entamoeba invadens
NNEQV

SEQ ID NO: 2888522 - protein, 8 aa, Entamoeba invadens
NNEQYKEV

SEQ ID NO: 2888523 - protein, 4 aa, Entamoeba invadens
NNER

SEQ ID NO: 2888524 - protein, 8 aa, Entamoeba invadens
NNEREDVQ

SEQ ID NO: 2888525 - protein, 38 aa, Entamoeba invadens
NNERERMEENRDGNKMSDEDSDSEDDWDSDDGLTTTLS

SEQ ID NO: 2888526 - protein, 5 aa, Entamoeba invadens
NNERF

SEQ ID NO: 2888527 - protein, 11 aa, Entamoeba invadens
NNERLNRNGVK

SEQ ID NO: 2888528 - protein, 26 aa, Entamoeba invadens
NNERRPVYNRRRRNEAPKSEEKQEFS

SEQ ID NO: 2888529 - protein, 5 aa, Entamoeba invadens
NNESC

SEQ ID NO: 2888530 - protein, 7 aa, Entamoeba invadens
NNESCGV

SEQ ID NO: 2888531 - protein, 9 aa, Entamoeba invadens
NNESCGVSS

SEQ ID NO: 2888532 - protein, 5 aa, Entamoeba invadens
NNESI

SEQ ID NO: 2888533 - protein, 5 aa, Entamoeba invadens
NNESV

SEQ ID NO: 2888534 - protein, 6 aa, Entamoeba invadens
NNESVP

SEQ ID NO: 2888535 - protein, 6 aa, Entamoeba invadens
NNETEI

SEQ ID NO: 2888536 - protein, 7 aa, Entamoeba invadens
NNETHSK

SEQ ID NO: 2888537 - protein, 10 aa, Entamoeba invadens
NNETSTKECT

SEQ ID NO: 2888538 - protein, 9 aa, Entamoeba invadens
NNETSTRRC

SEQ ID NO: 2888539 - protein, 5 aa, Entamoeba invadens
NNETY

SEQ ID NO: 2888540 - protein, 26 aa, Entamoeba invadens
NNEVKEIKPEYTDNKNEKRAKNQEEY

SEQ ID NO: 2888541 - protein, 9 aa, Entamoeba invadens
NNEVKESAA

SEQ ID NO: 2888542 - protein, 5 aa, Entamoeba invadens
NNEVT

SEQ ID NO: 2888543 - protein, 12 aa, Entamoeba invadens
NNEVTGKNTWDV

SEQ ID NO: 2888544 - protein, 10 aa, Entamoeba invadens
NNEVTTASQQ

SEQ ID NO: 2888545 - protein, 5 aa, Entamoeba invadens
NNFAT

SEQ ID NO: 2888546 - protein, 12 aa, Entamoeba invadens
NNFDETKTTITP

SEQ ID NO: 2888547 - protein, 5 aa, Entamoeba invadens
NNFDG

SEQ ID NO: 2888548 - protein, 7 aa, Entamoeba invadens
NNFDGSD

SEQ ID NO: 2888549 - protein, 11 aa, Entamoeba invadens
NNFGKTIKERE

SEQ ID NO: 2888550 - protein, 5 aa, Entamoeba invadens
NNFGL

SEQ ID NO: 2888551 - protein, 11 aa, Entamoeba invadens
NNFKPPPKVES

SEQ ID NO: 2888552 - protein, 13 aa, Entamoeba invadens
NNFKTSKKHKEEV

SEQ ID NO: 2888553 - protein, 4 aa, Entamoeba invadens
NNFL

SEQ ID NO: 2888554 - protein, 4 aa, Entamoeba invadens
NNFQ

SEQ ID NO: 2888555 - protein, 4 aa, Entamoeba invadens
NNFT

SEQ ID NO: 2888556 - protein, 6 aa, Entamoeba invadens
NNFTPN

SEQ ID NO: 2888557 - protein, 6 aa, Entamoeba invadens
NNFTQN

SEQ ID NO: 2888558 - protein, 6 aa, Entamoeba invadens
NNGAMT

SEQ ID NO: 2888559 - protein, 16 aa, Entamoeba invadens
NNGCGDNISVIVCKLM

SEQ ID NO: 2888560 - protein, 4 aa, Entamoeba invadens
NNGD

SEQ ID NO: 2888561 - protein, 8 aa, Entamoeba invadens
NNGDFENA

SEQ ID NO: 2888562 - protein, 7 aa, Entamoeba invadens
NNGEMKT

SEQ ID NO: 2888563 - protein, 8 aa, Entamoeba invadens
NNGENEIT

SEQ ID NO: 2888564 - protein, 8 aa, Entamoeba invadens
NNGFKPYS

SEQ ID NO: 2888565 - protein, 6 aa, Entamoeba invadens
NNGGNP

SEQ ID NO: 2888566 - protein, 10 aa, Entamoeba invadens
NNGKCYKDED

SEQ ID NO: 2888567 - protein, 5 aa, Entamoeba invadens
NNGKE

SEQ ID NO: 2888568 - protein, 7 aa, Entamoeba invadens
NNGKGIP

SEQ ID NO: 2888569 - protein, 8 aa, Entamoeba invadens
NNGKLSVG

SEQ ID NO: 2888570 - protein, 5 aa, Entamoeba invadens
NNGKN

SEQ ID NO: 2888571 - protein, 8 aa, Entamoeba invadens
NNGMEDPL

SEQ ID NO: 2888572 - protein, 4 aa, Entamoeba invadens
NNGN

SEQ ID NO: 2888573 - protein, 8 aa, Entamoeba invadens
NNGNCVPE

SEQ ID NO: 2888574 - protein, 8 aa, Entamoeba invadens
NNGNDKPL

SEQ ID NO: 2888575 - protein, 8 aa, Entamoeba invadens
NNGNDKPV

SEQ ID NO: 2888576 - protein, 6 aa, Entamoeba invadens
NNGNRL

SEQ ID NO: 2888577 - protein, 5 aa, Entamoeba invadens
NNGNV

SEQ ID NO: 2888578 - protein, 15 aa, Entamoeba invadens
NNGPHAGQSIEPSEY

SEQ ID NO: 2888579 - protein, 8 aa, Entamoeba invadens
NNGQESGH

SEQ ID NO: 2888580 - protein, 6 aa, Entamoeba invadens
NNGQVI

SEQ ID NO: 2888581 - protein, 5 aa, Entamoeba invadens
NNGQY

SEQ ID NO: 2888582 - protein, 4 aa, Entamoeba invadens
NNGR

SEQ ID NO: 2888583 - protein, 6 aa, Entamoeba invadens
NNGRKY

SEQ ID NO: 2888584 - protein, 9 aa, Entamoeba invadens
NNGSNGDIM

SEQ ID NO: 2888585 - protein, 8 aa, Entamoeba invadens
NNGSSITP

SEQ ID NO: 2888586 - protein, 6 aa, Entamoeba invadens
NNGTGV

SEQ ID NO: 2888587 - protein, 6 aa, Entamoeba invadens
NNGTLN

SEQ ID NO: 2888588 - protein, 4 aa, Entamoeba invadens
NNGV

SEQ ID NO: 2888589 - protein, 7 aa, Entamoeba invadens
NNGVQPV

SEQ ID NO: 2888590 - protein, 21 aa, Entamoeba invadens
NNGVSEKTSARRFKTNKRAES

SEQ ID NO: 2888591 - protein, 9 aa, Entamoeba invadens
NNGVVKRDE

SEQ ID NO: 2888592 - protein, 6 aa, Entamoeba invadens
NNGYIN

SEQ ID NO: 2888593 - protein, 14 aa, Entamoeba invadens
NNHKGHEQSRRDDL

SEQ ID NO: 2888594 - protein, 14 aa, Entamoeba invadens
NNHKGREQSRRDDL

SEQ ID NO: 2888595 - protein, 15 aa, Entamoeba invadens
NNHKGYEQSRRDDLE

SEQ ID NO: 2888596 - protein, 7 aa, Entamoeba invadens
NNHKTKQ

SEQ ID NO: 2888597 - protein, 10 aa, Entamoeba invadens
NNHSEELTQR

SEQ ID NO: 2888598 - protein, 7 aa, Entamoeba invadens
NNHTDLR

SEQ ID NO: 2888599 - protein, 9 aa, Entamoeba invadens
NNHTNPVKA

SEQ ID NO: 2888600 - protein, 34 aa, Entamoeba invadens
NNIADAPNQQVRRGWKKENEKVRDKLRNERTQNV

SEQ ID NO: 2888601 - protein, 5 aa, Entamoeba invadens
NNIDD

SEQ ID NO: 2888602 - protein, 10 aa, Entamoeba invadens
NNIDEKSYSD

SEQ ID NO: 2888603 - protein, 8 aa, Entamoeba invadens
NNIDSDTI

SEQ ID NO: 2888604 - protein, 14 aa, Entamoeba invadens
NNIDTEFEAKKTLI

SEQ ID NO: 2888605 - protein, 12 aa, Entamoeba invadens
NNIEAKQETTNQ

SEQ ID NO: 2888606 - protein, 16 aa, Entamoeba invadens
NNIESDAKTKQETINQ

SEQ ID NO: 2888607 - protein, 9 aa, Entamoeba invadens
NNIETTTDS

SEQ ID NO: 2888608 - protein, 39 aa, Entamoeba invadens
NNIGANSERAEQIHKEQAAQLEAAEKEKQSQNSTEKKEE

SEQ ID NO: 2888609 - protein, 16 aa, Entamoeba invadens
NNIGKEMARKEAIGNT

SEQ ID NO: 2888610 - protein, 18 aa, Entamoeba invadens
NNIGTKLEADKNEIKPWT

SEQ ID NO: 2888611 - protein, 24 aa, Entamoeba invadens
NNIKEEKDKITNQIKTTEEEKEYI

SEQ ID NO: 2888612 - protein, 5 aa, Entamoeba invadens
NNIKP

SEQ ID NO: 2888613 - protein, 7 aa, Entamoeba invadens
NNINKSD

SEQ ID NO: 2888614 - protein, 18 aa, Entamoeba invadens
NNIPEKTAKRRTEANKVN

SEQ ID NO: 2888615 - protein, 9 aa, Entamoeba invadens
NNIPRNVTS

SEQ ID NO: 2888616 - protein, 6 aa, Entamoeba invadens
NNIPST

SEQ ID NO: 2888617 - protein, 6 aa, Entamoeba invadens
NNIQAG

SEQ ID NO: 2888618 - protein, 7 aa, Entamoeba invadens
NNIQGLP

SEQ ID NO: 2888619 - protein, 7 aa, Entamoeba invadens
NNISDET

SEQ ID NO: 2888620 - protein, 9 aa, Entamoeba invadens
NNISDYAKK

SEQ ID NO: 2888621 - protein, 7 aa, Entamoeba invadens
NNISPTA

SEQ ID NO: 2888622 - protein, 8 aa, Entamoeba invadens
NNITSANV

SEQ ID NO: 2888623 - protein, 13 aa, Entamoeba invadens
NNIYTNSKTSSYI

SEQ ID NO: 2888624 - protein, 15 aa, Entamoeba invadens
NNKANAKLTDFGASR

SEQ ID NO: 2888625 - protein, 12 aa, Entamoeba invadens
NNKCESPSGNCT

SEQ ID NO: 2888626 - protein, 9 aa, Entamoeba invadens
NNKDDVTEA

SEQ ID NO: 2888627 - protein, 9 aa, Entamoeba invadens
NNKEDEENF

SEQ ID NO: 2888628 - protein, 17 aa, Entamoeba invadens
NNKEDKEPQSIESEPVD

SEQ ID NO: 2888629 - protein, 10 aa, Entamoeba invadens
NNKENTEQII

SEQ ID NO: 2888630 - protein, 6 aa, Entamoeba invadens
NNKESL

SEQ ID NO: 2888631 - protein, 7 aa, Entamoeba invadens
NNKEVQQ

SEQ ID NO: 2888632 - protein, 5 aa, Entamoeba invadens
NNKFE

SEQ ID NO: 2888633 - protein, 6 aa, Entamoeba invadens
NNKGCE

SEQ ID NO: 2888634 - protein, 8 aa, Entamoeba invadens
NNKIDGNA

SEQ ID NO: 2888635 - protein, 8 aa, Entamoeba invadens
NNKITPKN

SEQ ID NO: 2888636 - protein, 7 aa, Entamoeba invadens
NNKKARE

SEQ ID NO: 2888637 - protein, 7 aa, Entamoeba invadens
NNKKFDD

SEQ ID NO: 2888638 - protein, 7 aa, Entamoeba invadens
NNKKGNM

SEQ ID NO: 2888639 - protein, 10 aa, Entamoeba invadens
NNKKKNVKKQ

SEQ ID NO: 2888640 - protein, 8 aa, Entamoeba invadens
NNKKKRQF

SEQ ID NO: 2888641 - protein, 9 aa, Entamoeba invadens
NNKKPIGKI

SEQ ID NO: 2888642 - protein, 9 aa, Entamoeba invadens
NNKKYTNEE

SEQ ID NO: 2888643 - protein, 7 aa, Entamoeba invadens
NNKLSDI

SEQ ID NO: 2888644 - protein, 10 aa, Entamoeba invadens
NNKLSDKEQL

SEQ ID NO: 2888645 - protein, 10 aa, Entamoeba invadens
NNKMTDEEIS

SEQ ID NO: 2888646 - protein, 9 aa, Entamoeba invadens
NNKNEAPFE

SEQ ID NO: 2888647 - protein, 5 aa, Entamoeba invadens
NNKNI

SEQ ID NO: 2888648 - protein, 9 aa, Entamoeba invadens
NNKNKTIQA

SEQ ID NO: 2888649 - protein, 5 aa, Entamoeba invadens
NNKNL

SEQ ID NO: 2888650 - protein, 26 aa, Entamoeba invadens
NNKNNFKSNGKKRDQPQKYEKQSKKQ

SEQ ID NO: 2888651 - protein, 13 aa, Entamoeba invadens
NNKNPLQGSHPTA

SEQ ID NO: 2888652 - protein, 19 aa, Entamoeba invadens
NNKNQELENCKTENSQNKQ

SEQ ID NO: 2888653 - protein, 19 aa, Entamoeba invadens
NNKNQELENYKTENNQNKQ

SEQ ID NO: 2888654 - protein, 10 aa, Entamoeba invadens
NNKNQTLRNE

SEQ ID NO: 2888655 - protein, 4 aa, Entamoeba invadens
NNKQ

SEQ ID NO: 2888656 - protein, 7 aa, Entamoeba invadens
NNKQISG

SEQ ID NO: 2888657 - protein, 5 aa, Entamoeba invadens
NNKQK

SEQ ID NO: 2888658 - protein, 13 aa, Entamoeba invadens
NNKQQMQKTVEQP

SEQ ID NO: 2888659 - protein, 9 aa, Entamoeba invadens
NNKQSHIKN

SEQ ID NO: 2888660 - protein, 4 aa, Entamoeba invadens
NNKR

SEQ ID NO: 2888661 - protein, 11 aa, Entamoeba invadens
NNKRKQRLTSQ

SEQ ID NO: 2888662 - protein, 13 aa, Entamoeba invadens
NNKSKCAYNPSKE

SEQ ID NO: 2888663 - protein, 8 aa, Entamoeba invadens
NNKTHKKT

SEQ ID NO: 2888664 - protein, 9 aa, Entamoeba invadens
NNKTKSAGI

SEQ ID NO: 2888665 - protein, 20 aa, Entamoeba invadens
NNKTNKKCQSRLYDNENENN

SEQ ID NO: 2888666 - protein, 7 aa, Entamoeba invadens
NNKTTFP

SEQ ID NO: 2888667 - protein, 133 aa, Entamoeba invadens
NNKVNDKKPNPFGDDSDDVKENTKTPPKTKEKVQKKPNPFGEDTDDDESEESNIKKSDMKQTKKPNPFGEDSDDDNEKSDGKKNTQTVQTKKPNPFGEDSDEEEQQKEKQNIQGKKPNPFGEDSDDDVKGEPF

SEQ ID NO: 2888668 - protein, 8 aa, Entamoeba invadens
NNKYNTKE

SEQ ID NO: 2888669 - protein, 8 aa, Entamoeba invadens
NNLDGGKY

SEQ ID NO: 2888670 - protein, 13 aa, Entamoeba invadens
NNLDNDETKELKK

SEQ ID NO: 2888671 - protein, 4 aa, Entamoeba invadens
NNLE

SEQ ID NO: 2888672 - protein, 20 aa, Entamoeba invadens
NNLENEKNKKQLESDNALMS

SEQ ID NO: 2888673 - protein, 4 aa, Entamoeba invadens
NNLI

SEQ ID NO: 2888674 - protein, 4 aa, Entamoeba invadens
NNLL

SEQ ID NO: 2888675 - protein, 11 aa, Entamoeba invadens
NNLNNSSDQIR

SEQ ID NO: 2888676 - protein, 4 aa, Entamoeba invadens
NNLP

SEQ ID NO: 2888677 - protein, 6 aa, Entamoeba invadens
NNLPEN

SEQ ID NO: 2888678 - protein, 5 aa, Entamoeba invadens
NNLPS

SEQ ID NO: 2888679 - protein, 6 aa, Entamoeba invadens
NNLQSI

SEQ ID NO: 2888680 - protein, 9 aa, Entamoeba invadens
NNLSEVPND

SEQ ID NO: 2888681 - protein, 8 aa, Entamoeba invadens
NNLTQQAD

SEQ ID NO: 2888682 - protein, 6 aa, Entamoeba invadens
NNLTTQ

SEQ ID NO: 2888683 - protein, 6 aa, Entamoeba invadens
NNLYKK

SEQ ID NO: 2888684 - protein, 7 aa, Entamoeba invadens
NNLYKKD

SEQ ID NO: 2888685 - protein, 6 aa, Entamoeba invadens
NNMPKY

SEQ ID NO: 2888686 - protein, 9 aa, Entamoeba invadens
NNMSEGGIT

SEQ ID NO: 2888687 - protein, 14 aa, Entamoeba invadens
NNMSSFSDPSETVK

SEQ ID NO: 2888688 - protein, 11 aa, Entamoeba invadens
NNNANRNGTYF

SEQ ID NO: 2888689 - protein, 7 aa, Entamoeba invadens
NNNAPEF

SEQ ID NO: 2888690 - protein, 8 aa, Entamoeba invadens
NNNDDTFN

SEQ ID NO: 2888691 - protein, 13 aa, Entamoeba invadens
NNNDEDGDDGDTR

SEQ ID NO: 2888692 - protein, 14 aa, Entamoeba invadens
NNNDFEKNLRNGYE

SEQ ID NO: 2888693 - protein, 6 aa, Entamoeba invadens
NNNDYK

SEQ ID NO: 2888694 - protein, 8 aa, Entamoeba invadens
NNNEEDAL

SEQ ID NO: 2888695 - protein, 14 aa, Entamoeba invadens
NNNEETSPRKTPLN

SEQ ID NO: 2888696 - protein, 8 aa, Entamoeba invadens
NNNENETE

SEQ ID NO: 2888697 - protein, 13 aa, Entamoeba invadens
NNNENRYRYGSDN

SEQ ID NO: 2888698 - protein, 16 aa, Entamoeba invadens
NNNERFNANPIPYDKT

SEQ ID NO: 2888699 - protein, 11 aa, Entamoeba invadens
NNNFKDQNGNC

SEQ ID NO: 2888700 - protein, 5 aa, Entamoeba invadens
NNNGF

SEQ ID NO: 2888701 - protein, 27 aa, Entamoeba invadens
NNNGTGQGSTTLQTGQREGKEEKKELC

SEQ ID NO: 2888702 - protein, 10 aa, Entamoeba invadens
NNNGYNQQRR

SEQ ID NO: 2888703 - protein, 4 aa, Entamoeba invadens
NNNI

SEQ ID NO: 2888704 - protein, 14 aa, Entamoeba invadens
NNNIKTTPQDTSLA

SEQ ID NO: 2888705 - protein, 6 aa, Entamoeba invadens
NNNINK

SEQ ID NO: 2888706 - protein, 5 aa, Entamoeba invadens
NNNKL

SEQ ID NO: 2888707 - protein, 7 aa, Entamoeba invadens
NNNKRIY

SEQ ID NO: 2888708 - protein, 5 aa, Entamoeba invadens
NNNKS

SEQ ID NO: 2888709 - protein, 7 aa, Entamoeba invadens
NNNKTIE

SEQ ID NO: 2888710 - protein, 5 aa, Entamoeba invadens
NNNKV

SEQ ID NO: 2888711 - protein, 7 aa, Entamoeba invadens
NNNNECG

SEQ ID NO: 2888712 - protein, 7 aa, Entamoeba invadens
NNNNECK

SEQ ID NO: 2888713 - protein, 13 aa, Entamoeba invadens
NNNNEDEEEDVVE

SEQ ID NO: 2888714 - protein, 11 aa, Entamoeba invadens
NNNNERSKSID

SEQ ID NO: 2888715 - protein, 7 aa, Entamoeba invadens
NNNNKFG

SEQ ID NO: 2888716 - protein, 7 aa, Entamoeba invadens
NNNNKYI

SEQ ID NO: 2888717 - protein, 16 aa, Entamoeba invadens
NNNNNNNTINNSNRVT

SEQ ID NO: 2888718 - protein, 8 aa, Entamoeba invadens
NNNNNTSA

SEQ ID NO: 2888719 - protein, 7 aa, Entamoeba invadens
NNNNNYI

SEQ ID NO: 2888720 - protein, 6 aa, Entamoeba invadens
NNNNRT

SEQ ID NO: 2888721 - protein, 5 aa, Entamoeba invadens
NNNNT

SEQ ID NO: 2888722 - protein, 5 aa, Entamoeba invadens
NNNPE

SEQ ID NO: 2888723 - protein, 14 aa, Entamoeba invadens
NNNPEVNSINTKDL

SEQ ID NO: 2888724 - protein, 6 aa, Entamoeba invadens
NNNPHA

SEQ ID NO: 2888725 - protein, 6 aa, Entamoeba invadens
NNNPLR

SEQ ID NO: 2888726 - protein, 6 aa, Entamoeba invadens
NNNQET

SEQ ID NO: 2888727 - protein, 5 aa, Entamoeba invadens
NNNQI

SEQ ID NO: 2888728 - protein, 8 aa, Entamoeba invadens
NNNSGLSK

SEQ ID NO: 2888729 - protein, 11 aa, Entamoeba invadens
NNNSLKTPPSF

SEQ ID NO: 2888730 - protein, 12 aa, Entamoeba invadens
NNNSNISNAYGD

SEQ ID NO: 2888731 - protein, 5 aa, Entamoeba invadens
NNNSS

SEQ ID NO: 2888732 - protein, 14 aa, Entamoeba invadens
NNNSVTIARNNGTL

SEQ ID NO: 2888733 - protein, 9 aa, Entamoeba invadens
NNNTENPIY

SEQ ID NO: 2888734 - protein, 7 aa, Entamoeba invadens
NNNTGEY

SEQ ID NO: 2888735 - protein, 13 aa, Entamoeba invadens
NNNTKKDEEIEEL

SEQ ID NO: 2888736 - protein, 5 aa, Entamoeba invadens
NNNTT

SEQ ID NO: 2888737 - protein, 8 aa, Entamoeba invadens
NNNTTDAR

SEQ ID NO: 2888738 - protein, 13 aa, Entamoeba invadens
NNNTTPEQNAEAT

SEQ ID NO: 2888739 - protein, 5 aa, Entamoeba invadens
NNNVA

SEQ ID NO: 2888740 - protein, 5 aa, Entamoeba invadens
NNNVN

SEQ ID NO: 2888741 - protein, 4 aa, Entamoeba invadens
NNNW

SEQ ID NO: 2888742 - protein, 9 aa, Entamoeba invadens
NNNYAQDGN

SEQ ID NO: 2888743 - protein, 8 aa, Entamoeba invadens
NNPDGQLS

SEQ ID NO: 2888744 - protein, 6 aa, Entamoeba invadens
NNPDLQ

SEQ ID NO: 2888745 - protein, 17 aa, Entamoeba invadens
NNPEQYTERRKQLDEIG

SEQ ID NO: 2888746 - protein, 9 aa, Entamoeba invadens
NNPERLDEL

SEQ ID NO: 2888747 - protein, 6 aa, Entamoeba invadens
NNPESQ

SEQ ID NO: 2888748 - protein, 8 aa, Entamoeba invadens
NNPEYKKL

SEQ ID NO: 2888749 - protein, 7 aa, Entamoeba invadens
NNPFPLN

SEQ ID NO: 2888750 - protein, 7 aa, Entamoeba invadens
NNPGTKT

SEQ ID NO: 2888751 - protein, 18 aa, Entamoeba invadens
NNPHESLKAQKKSNADKL

SEQ ID NO: 2888752 - protein, 5 aa, Entamoeba invadens
NNPIA

SEQ ID NO: 2888753 - protein, 5 aa, Entamoeba invadens
NNPIQ

SEQ ID NO: 2888754 - protein, 11 aa, Entamoeba invadens
NNPISGVPPNF

SEQ ID NO: 2888755 - protein, 12 aa, Entamoeba invadens
NNPKANAESFDK

SEQ ID NO: 2888756 - protein, 6 aa, Entamoeba invadens
NNPKEL

SEQ ID NO: 2888757 - protein, 6 aa, Entamoeba invadens
NNPKGI

SEQ ID NO: 2888758 - protein, 7 aa, Entamoeba invadens
NNPKKEI

SEQ ID NO: 2888759 - protein, 7 aa, Entamoeba invadens
NNPKNPI

SEQ ID NO: 2888760 - protein, 17 aa, Entamoeba invadens
NNPKSNECQSCTSFDSK

SEQ ID NO: 2888761 - protein, 6 aa, Entamoeba invadens
NNPLTQ

SEQ ID NO: 2888762 - protein, 10 aa, Entamoeba invadens
NNPNCDNQNG

SEQ ID NO: 2888763 - protein, 9 aa, Entamoeba invadens
NNPNDKVNA

SEQ ID NO: 2888764 - protein, 5 aa, Entamoeba invadens
NNPNN

SEQ ID NO: 2888765 - protein, 9 aa, Entamoeba invadens
NNPPEGMTQ

SEQ ID NO: 2888766 - protein, 10 aa, Entamoeba invadens
NNPPTSDFED

SEQ ID NO: 2888767 - protein, 15 aa, Entamoeba invadens
NNPQGQQQTKEGGGC

SEQ ID NO: 2888768 - protein, 7 aa, Entamoeba invadens
NNPQNPF

SEQ ID NO: 2888769 - protein, 15 aa, Entamoeba invadens
NNPQQFTKELAQKVK

SEQ ID NO: 2888770 - protein, 8 aa, Entamoeba invadens
NNPSIRKS

SEQ ID NO: 2888771 - protein, 7 aa, Entamoeba invadens
NNPSLGE

SEQ ID NO: 2888772 - protein, 13 aa, Entamoeba invadens
NNPSMWKDPKSVQ

SEQ ID NO: 2888773 - protein, 6 aa, Entamoeba invadens
NNPSSF

SEQ ID NO: 2888774 - protein, 6 aa, Entamoeba invadens
NNPSYY

SEQ ID NO: 2888775 - protein, 4 aa, Entamoeba invadens
NNPT

SEQ ID NO: 2888776 - protein, 13 aa, Entamoeba invadens
NNPTANKESYTED

SEQ ID NO: 2888777 - protein, 8 aa, Entamoeba invadens
NNPTASDM

SEQ ID NO: 2888778 - protein, 7 aa, Entamoeba invadens
NNPTDAH

SEQ ID NO: 2888779 - protein, 6 aa, Entamoeba invadens
NNPTET

SEQ ID NO: 2888780 - protein, 9 aa, Entamoeba invadens
NNPTKKREV

SEQ ID NO: 2888781 - protein, 5 aa, Entamoeba invadens
NNPTN

SEQ ID NO: 2888782 - protein, 7 aa, Entamoeba invadens
NNPVPIN

SEQ ID NO: 2888783 - protein, 18 aa, Entamoeba invadens
NNPWTSEEVKEEKNESAI

SEQ ID NO: 2888784 - protein, 6 aa, Entamoeba invadens
NNPYEE

SEQ ID NO: 2888785 - protein, 7 aa, Entamoeba invadens
NNPYMSQ

SEQ ID NO: 2888786 - protein, 6 aa, Entamoeba invadens
NNQDDT

SEQ ID NO: 2888787 - protein, 7 aa, Entamoeba invadens
NNQDELD

SEQ ID NO: 2888788 - protein, 12 aa, Entamoeba invadens
NNQDLSDRSVEN

SEQ ID NO: 2888789 - protein, 12 aa, Entamoeba invadens
NNQEIESYEKDE

SEQ ID NO: 2888790 - protein, 9 aa, Entamoeba invadens
NNQETSREY

SEQ ID NO: 2888791 - protein, 16 aa, Entamoeba invadens
NNQGYQPTKFKPKSMT

SEQ ID NO: 2888792 - protein, 6 aa, Entamoeba invadens
NNQIDS

SEQ ID NO: 2888793 - protein, 9 aa, Entamoeba invadens
NNQNEGGVI

SEQ ID NO: 2888794 - protein, 7 aa, Entamoeba invadens
NNQNEKN

SEQ ID NO: 2888795 - protein, 7 aa, Entamoeba invadens
NNQNKDA

SEQ ID NO: 2888796 - protein, 7 aa, Entamoeba invadens
NNQPEGI

SEQ ID NO: 2888797 - protein, 19 aa, Entamoeba invadens
NNQPPTAVPNSQYSATKRS

SEQ ID NO: 2888798 - protein, 5 aa, Entamoeba invadens
NNQRA

SEQ ID NO: 2888799 - protein, 16 aa, Entamoeba invadens
NNQRGKERRESGRTSV

SEQ ID NO: 2888800 - protein, 7 aa, Entamoeba invadens
NNQRKEQ

SEQ ID NO: 2888801 - protein, 13 aa, Entamoeba invadens
NNQRNSPDITQET

SEQ ID NO: 2888802 - protein, 5 aa, Entamoeba invadens
NNQRT

SEQ ID NO: 2888803 - protein, 18 aa, Entamoeba invadens
NNQTEESCQLQVSKLCDD

SEQ ID NO: 2888804 - protein, 5 aa, Entamoeba invadens
NNQTF

SEQ ID NO: 2888805 - protein, 6 aa, Entamoeba invadens
NNQTYP

SEQ ID NO: 2888806 - protein, 7 aa, Entamoeba invadens
NNQVCPK

SEQ ID NO: 2888807 - protein, 26 aa, Entamoeba invadens
NNQYVQEDGTCGDTCPEKHRKGDGVC

SEQ ID NO: 2888808 - protein, 4 aa, Entamoeba invadens
NNRA

SEQ ID NO: 2888809 - protein, 7 aa, Entamoeba invadens
NNRAQTI

SEQ ID NO: 2888810 - protein, 14 aa, Entamoeba invadens
NNREHTDKHPTTQI

SEQ ID NO: 2888811 - protein, 13 aa, Entamoeba invadens
NNREKMDKSPTLS

SEQ ID NO: 2888812 - protein, 10 aa, Entamoeba invadens
NNRELNEKKL

SEQ ID NO: 2888813 - protein, 5 aa, Entamoeba invadens
NNRIE

SEQ ID NO: 2888814 - protein, 5 aa, Entamoeba invadens
NNRIP

SEQ ID NO: 2888815 - protein, 4 aa, Entamoeba invadens
NNRK

SEQ ID NO: 2888816 - protein, 5 aa, Entamoeba invadens
NNRKN

SEQ ID NO: 2888817 - protein, 7 aa, Entamoeba invadens
NNRKRQE

SEQ ID NO: 2888818 - protein, 4 aa, Entamoeba invadens
NNRL

SEQ ID NO: 2888819 - protein, 5 aa, Entamoeba invadens
NNRLT

SEQ ID NO: 2888820 - protein, 6 aa, Entamoeba invadens
NNRPWM

SEQ ID NO: 2888821 - protein, 7 aa, Entamoeba invadens
NNRQEQN

SEQ ID NO: 2888822 - protein, 16 aa, Entamoeba invadens
NNRQPRVWEKTIDIYG

SEQ ID NO: 2888823 - protein, 9 aa, Entamoeba invadens
NNRTKQTPF

SEQ ID NO: 2888824 - protein, 6 aa, Entamoeba invadens
NNRTQK

SEQ ID NO: 2888825 - protein, 4 aa, Entamoeba invadens
NNRV

SEQ ID NO: 2888826 - protein, 10 aa, Entamoeba invadens
NNSANEITAK

SEQ ID NO: 2888827 - protein, 9 aa, Entamoeba invadens
NNSDAVDLN

SEQ ID NO: 2888828 - protein, 7 aa, Entamoeba invadens
NNSDQMK

SEQ ID NO: 2888829 - protein, 18 aa, Entamoeba invadens
NNSDTLRVNPADEESHTL

SEQ ID NO: 2888830 - protein, 22 aa, Entamoeba invadens
NNSEDTNNTKTEENASKTGNCD

SEQ ID NO: 2888831 - protein, 10 aa, Entamoeba invadens
NNSEKPTIGS

SEQ ID NO: 2888832 - protein, 5 aa, Entamoeba invadens
NNSEL

SEQ ID NO: 2888833 - protein, 9 aa, Entamoeba invadens
NNSEQRQKL

SEQ ID NO: 2888834 - protein, 7 aa, Entamoeba invadens
NNSERTM

SEQ ID NO: 2888835 - protein, 4 aa, Entamoeba invadens
NNSF

SEQ ID NO: 2888836 - protein, 5 aa, Entamoeba invadens
NNSFT

SEQ ID NO: 2888837 - protein, 16 aa, Entamoeba invadens
NNSGEAEEIKKVIENN

SEQ ID NO: 2888838 - protein, 6 aa, Entamoeba invadens
NNSGMA

SEQ ID NO: 2888839 - protein, 13 aa, Entamoeba invadens
NNSHSSQQPSSPV

SEQ ID NO: 2888840 - protein, 13 aa, Entamoeba invadens
NNSIEDKDRENDL

SEQ ID NO: 2888841 - protein, 7 aa, Entamoeba invadens
NNSIQDN

SEQ ID NO: 2888842 - protein, 10 aa, Entamoeba invadens
NNSKAKTRID

SEQ ID NO: 2888843 - protein, 6 aa, Entamoeba invadens
NNSKHT

SEQ ID NO: 2888844 - protein, 7 aa, Entamoeba invadens
NNSKNNL

SEQ ID NO: 2888845 - protein, 8 aa, Entamoeba invadens
NNSKSESV

SEQ ID NO: 2888846 - protein, 7 aa, Entamoeba invadens
NNSKSSY

SEQ ID NO: 2888847 - protein, 10 aa, Entamoeba invadens
NNSKTENTLK

SEQ ID NO: 2888848 - protein, 9 aa, Entamoeba invadens
NNSLENEDE

SEQ ID NO: 2888849 - protein, 5 aa, Entamoeba invadens
NNSLS

SEQ ID NO: 2888850 - protein, 27 aa, Entamoeba invadens
NNSMSSKIDKKPNKKISPVPVLPIISV

SEQ ID NO: 2888851 - protein, 4 aa, Entamoeba invadens
NNSN

SEQ ID NO: 2888852 - protein, 5 aa, Entamoeba invadens
NNSNF

SEQ ID NO: 2888853 - protein, 9 aa, Entamoeba invadens
NNSNGELDG

SEQ ID NO: 2888854 - protein, 9 aa, Entamoeba invadens
NNSNGTITN

SEQ ID NO: 2888855 - protein, 9 aa, Entamoeba invadens
NNSNNQPNE

SEQ ID NO: 2888856 - protein, 6 aa, Entamoeba invadens
NNSPLT

SEQ ID NO: 2888857 - protein, 7 aa, Entamoeba invadens
NNSQESV

SEQ ID NO: 2888858 - protein, 5 aa, Entamoeba invadens
NNSQI

SEQ ID NO: 2888859 - protein, 7 aa, Entamoeba invadens
NNSQKKM

SEQ ID NO: 2888860 - protein, 8 aa, Entamoeba invadens
NNSQSLQK

SEQ ID NO: 2888861 - protein, 6 aa, Entamoeba invadens
NNSQTK

SEQ ID NO: 2888862 - protein, 6 aa, Entamoeba invadens
NNSRTI

SEQ ID NO: 2888863 - protein, 5 aa, Entamoeba invadens
NNSSH

SEQ ID NO: 2888864 - protein, 9 aa, Entamoeba invadens
NNSSNIDNC

SEQ ID NO: 2888865 - protein, 10 aa, Entamoeba invadens
NNSSNTINTL

SEQ ID NO: 2888866 - protein, 6 aa, Entamoeba invadens
NNSTAA

SEQ ID NO: 2888867 - protein, 14 aa, Entamoeba invadens
NNSTGKKEGSTQAS

SEQ ID NO: 2888868 - protein, 17 aa, Entamoeba invadens
NNSTQKYFNSESEKEAL

SEQ ID NO: 2888869 - protein, 13 aa, Entamoeba invadens
NNSTTKTDDDDLL

SEQ ID NO: 2888870 - protein, 13 aa, Entamoeba invadens
NNSVKIKNKNSIP

SEQ ID NO: 2888871 - protein, 4 aa, Entamoeba invadens
NNTD

SEQ ID NO: 2888872 - protein, 6 aa, Entamoeba invadens
NNTDFR

SEQ ID NO: 2888873 - protein, 19 aa, Entamoeba invadens
NNTDNKLNLQDDEASTTNA

SEQ ID NO: 2888874 - protein, 6 aa, Entamoeba invadens
NNTDVG

SEQ ID NO: 2888875 - protein, 6 aa, Entamoeba invadens
NNTDYQ

SEQ ID NO: 2888876 - protein, 6 aa, Entamoeba invadens
NNTEDP

SEQ ID NO: 2888877 - protein, 12 aa, Entamoeba invadens
NNTEKNEDCENK

SEQ ID NO: 2888878 - protein, 14 aa, Entamoeba invadens
NNTETITNDHPKLK

SEQ ID NO: 2888879 - protein, 9 aa, Entamoeba invadens
NNTEYGKKE

SEQ ID NO: 2888880 - protein, 4 aa, Entamoeba invadens
NNTF

SEQ ID NO: 2888881 - protein, 19 aa, Entamoeba invadens
NNTFTNSSKTSIISSTSEL

SEQ ID NO: 2888882 - protein, 4 aa, Entamoeba invadens
NNTG

SEQ ID NO: 2888883 - protein, 10 aa, Entamoeba invadens
NNTGAGQPVS

SEQ ID NO: 2888884 - protein, 8 aa, Entamoeba invadens
NNTGDQPR

SEQ ID NO: 2888885 - protein, 7 aa, Entamoeba invadens
NNTHPEM

SEQ ID NO: 2888886 - protein, 7 aa, Entamoeba invadens
NNTIELG

SEQ ID NO: 2888887 - protein, 9 aa, Entamoeba invadens
NNTIGGYGT

SEQ ID NO: 2888888 - protein, 13 aa, Entamoeba invadens
NNTIQEKNTENEL

SEQ ID NO: 2888889 - protein, 7 aa, Entamoeba invadens
NNTISQH

SEQ ID NO: 2888890 - protein, 5 aa, Entamoeba invadens
NNTIT

SEQ ID NO: 2888891 - protein, 12 aa, Entamoeba invadens
NNTITKPNMEQK

SEQ ID NO: 2888892 - protein, 9 aa, Entamoeba invadens
NNTIVEENK

SEQ ID NO: 2888893 - protein, 4 aa, Entamoeba invadens
NNTK

SEQ ID NO: 2888894 - protein, 16 aa, Entamoeba invadens
NNTKDMKNKRKWEDQN

SEQ ID NO: 2888895 - protein, 5 aa, Entamoeba invadens
NNTKE

SEQ ID NO: 2888896 - protein, 13 aa, Entamoeba invadens
NNTKENKDCENKT

SEQ ID NO: 2888897 - protein, 6 aa, Entamoeba invadens
NNTKFK

SEQ ID NO: 2888898 - protein, 24 aa, Entamoeba invadens
NNTKISNTKGDVGGTNISTSTTES

SEQ ID NO: 2888899 - protein, 6 aa, Entamoeba invadens
NNTKIT

SEQ ID NO: 2888900 - protein, 7 aa, Entamoeba invadens
NNTKLEK

SEQ ID NO: 2888901 - protein, 5 aa, Entamoeba invadens
NNTKN

SEQ ID NO: 2888902 - protein, 9 aa, Entamoeba invadens
NNTKNDEFE

SEQ ID NO: 2888903 - protein, 26 aa, Entamoeba invadens
NNTKNVTKYDDGVQKGMSNMIDIIKS

SEQ ID NO: 2888904 - protein, 8 aa, Entamoeba invadens
NNTKTTAL

SEQ ID NO: 2888905 - protein, 4 aa, Entamoeba invadens
NNTL

SEQ ID NO: 2888906 - protein, 5 aa, Entamoeba invadens
NNTMK

SEQ ID NO: 2888907 - protein, 4 aa, Entamoeba invadens
NNTN

SEQ ID NO: 2888908 - protein, 11 aa, Entamoeba invadens
NNTNAQGKQYQ

SEQ ID NO: 2888909 - protein, 5 aa, Entamoeba invadens
NNTNI

SEQ ID NO: 2888910 - protein, 5 aa, Entamoeba invadens
NNTNK

SEQ ID NO: 2888911 - protein, 10 aa, Entamoeba invadens
NNTNLQQPSA

SEQ ID NO: 2888912 - protein, 7 aa, Entamoeba invadens
NNTNPRF

SEQ ID NO: 2888913 - protein, 8 aa, Entamoeba invadens
NNTNTYPL

SEQ ID NO: 2888914 - protein, 13 aa, Entamoeba invadens
NNTNYKPTKNDIS

SEQ ID NO: 2888915 - protein, 8 aa, Entamoeba invadens
NNTPDTLN

SEQ ID NO: 2888916 - protein, 7 aa, Entamoeba invadens
NNTPENT

SEQ ID NO: 2888917 - protein, 20 aa, Entamoeba invadens
NNTPMKTAKRRYQTNKKTDG

SEQ ID NO: 2888918 - protein, 28 aa, Entamoeba invadens
NNTPMQVEPPQIRETTTPINTIPKQPVQ

SEQ ID NO: 2888919 - protein, 17 aa, Entamoeba invadens
NNTPNKTDALQKEQENN

SEQ ID NO: 2888920 - protein, 20 aa, Entamoeba invadens
NNTQAYSNTGGHHSKASPEG

SEQ ID NO: 2888921 - protein, 6 aa, Entamoeba invadens
NNTQDT

SEQ ID NO: 2888922 - protein, 6 aa, Entamoeba invadens
NNTQGD

SEQ ID NO: 2888923 - protein, 10 aa, Entamoeba invadens
NNTQLKTVQT

SEQ ID NO: 2888924 - protein, 6 aa, Entamoeba invadens
NNTQLP

SEQ ID NO: 2888925 - protein, 7 aa, Entamoeba invadens
NNTQTRI

SEQ ID NO: 2888926 - protein, 8 aa, Entamoeba invadens
NNTREKEL

SEQ ID NO: 2888927 - protein, 13 aa, Entamoeba invadens
NNTRKAKDLTQPT

SEQ ID NO: 2888928 - protein, 8 aa, Entamoeba invadens
NNTRNGKP

SEQ ID NO: 2888929 - protein, 5 aa, Entamoeba invadens
NNTRS

SEQ ID NO: 2888930 - protein, 22 aa, Entamoeba invadens
NNTSGKRQARTAKELNATIDGK

SEQ ID NO: 2888931 - protein, 10 aa, Entamoeba invadens
NNTSNSRNVG

SEQ ID NO: 2888932 - protein, 6 aa, Entamoeba invadens
NNTSSL

SEQ ID NO: 2888933 - protein, 9 aa, Entamoeba invadens
NNTSTSEAP

SEQ ID NO: 2888934 - protein, 9 aa, Entamoeba invadens
NNTTATPEA

SEQ ID NO: 2888935 - protein, 15 aa, Entamoeba invadens
NNTTCNTYTKNWCKI

SEQ ID NO: 2888936 - protein, 6 aa, Entamoeba invadens
NNTTDF

SEQ ID NO: 2888937 - protein, 5 aa, Entamoeba invadens
NNTTG

SEQ ID NO: 2888938 - protein, 42 aa, Entamoeba invadens
NNTTITNYSYSTSTSNVTSQLKEKVQANTEYLDGQSSGFTSS

SEQ ID NO: 2888939 - protein, 7 aa, Entamoeba invadens
NNTTRGS

SEQ ID NO: 2888940 - protein, 7 aa, Entamoeba invadens
NNTTTLQ

SEQ ID NO: 2888941 - protein, 15 aa, Entamoeba invadens
NNTTVCCEPYHLTLI

SEQ ID NO: 2888942 - protein, 7 aa, Entamoeba invadens
NNTTYPH

SEQ ID NO: 2888943 - protein, 7 aa, Entamoeba invadens
NNTVEKF

SEQ ID NO: 2888944 - protein, 5 aa, Entamoeba invadens
NNTVN

SEQ ID NO: 2888945 - protein, 4 aa, Entamoeba invadens
NNVD

SEQ ID NO: 2888946 - protein, 4 aa, Entamoeba invadens
NNVE

SEQ ID NO: 2888947 - protein, 9 aa, Entamoeba invadens
NNVEKGKYY

SEQ ID NO: 2888948 - protein, 19 aa, Entamoeba invadens
NNVEKSGTIYGDGTTETED

SEQ ID NO: 2888949 - protein, 10 aa, Entamoeba invadens
NNVGAKEPLT

SEQ ID NO: 2888950 - protein, 6 aa, Entamoeba invadens
NNVGKT

SEQ ID NO: 2888951 - protein, 7 aa, Entamoeba invadens
NNVGKTS

SEQ ID NO: 2888952 - protein, 13 aa, Entamoeba invadens
NNVGTISESGEYE

SEQ ID NO: 2888953 - protein, 5 aa, Entamoeba invadens
NNVKS

SEQ ID NO: 2888954 - protein, 4 aa, Entamoeba invadens
NNVN

SEQ ID NO: 2888955 - protein, 5 aa, Entamoeba invadens
NNVRL

SEQ ID NO: 2888956 - protein, 4 aa, Entamoeba invadens
NNVS

SEQ ID NO: 2888957 - protein, 5 aa, Entamoeba invadens
NNVSH

SEQ ID NO: 2888958 - protein, 15 aa, Entamoeba invadens
NNVSRTQKVATVRKE

SEQ ID NO: 2888959 - protein, 5 aa, Entamoeba invadens
NNVTD

SEQ ID NO: 2888960 - protein, 7 aa, Entamoeba invadens
NNVTEIG

SEQ ID NO: 2888961 - protein, 12 aa, Entamoeba invadens
NNVTTNVTQKSP

SEQ ID NO: 2888962 - protein, 7 aa, Entamoeba invadens
NNVYGPH

SEQ ID NO: 2888963 - protein, 6 aa, Entamoeba invadens
NNWKER

SEQ ID NO: 2888964 - protein, 4 aa, Entamoeba invadens
NNYA

SEQ ID NO: 2888965 - protein, 23 aa, Entamoeba invadens
NNYAKPNDEGFTTTGFKKQSGIG

SEQ ID NO: 2888966 - protein, 6 aa, Entamoeba invadens
NNYDEF

SEQ ID NO: 2888967 - protein, 6 aa, Entamoeba invadens
NNYDNT

SEQ ID NO: 2888968 - protein, 12 aa, Entamoeba invadens
NNYEDSDENTQI

SEQ ID NO: 2888969 - protein, 6 aa, Entamoeba invadens
NNYERS

SEQ ID NO: 2888970 - protein, 6 aa, Entamoeba invadens
NNYGKV

SEQ ID NO: 2888971 - protein, 16 aa, Entamoeba invadens
NNYGKVATKNKKGKQV

SEQ ID NO: 2888972 - protein, 6 aa, Entamoeba invadens
NNYKEA

SEQ ID NO: 2888973 - protein, 6 aa, Entamoeba invadens
NNYKEG

SEQ ID NO: 2888974 - protein, 11 aa, Entamoeba invadens
NNYKQTKQSKP

SEQ ID NO: 2888975 - protein, 11 aa, Entamoeba invadens
NNYLSKTNQTK

SEQ ID NO: 2888976 - protein, 10 aa, Entamoeba invadens
NNYNRTPVEQ

SEQ ID NO: 2888977 - protein, 8 aa, Entamoeba invadens
NNYPDSTG

SEQ ID NO: 2888978 - protein, 9 aa, Entamoeba invadens
NNYPTQSSD

SEQ ID NO: 2888979 - protein, 15 aa, Entamoeba invadens
NNYSYSNYNNSSSMY

SEQ ID NO: 2888980 - protein, 4 aa, Entamoeba invadens
NNYT

SEQ ID NO: 2888981 - protein, 9 aa, Entamoeba invadens
NPAEKTARK

SEQ ID NO: 2888982 - protein, 6 aa, Entamoeba invadens
NPANYN

SEQ ID NO: 2888983 - protein, 8 aa, Entamoeba invadens
NPAPRPKI

SEQ ID NO: 2888984 - protein, 5 aa, Entamoeba invadens
NPASF

SEQ ID NO: 2888985 - protein, 7 aa, Entamoeba invadens
NPASKNY

SEQ ID NO: 2888986 - protein, 6 aa, Entamoeba invadens
NPAVNY

SEQ ID NO: 2888987 - protein, 6 aa, Entamoeba invadens
NPAVQK

SEQ ID NO: 2888988 - protein, 8 aa, Entamoeba invadens
NPCGRGSK

SEQ ID NO: 2888989 - protein, 7 aa, Entamoeba invadens
NPDALTT

SEQ ID NO: 2888990 - protein, 8 aa, Entamoeba invadens
NPDDPTHT

SEQ ID NO: 2888991 - protein, 8 aa, Entamoeba invadens
NPDECNSS

SEQ ID NO: 2888992 - protein, 8 aa, Entamoeba invadens
NPDFEDTT

SEQ ID NO: 2888993 - protein, 5 aa, Entamoeba invadens
NPDGF

SEQ ID NO: 2888994 - protein, 5 aa, Entamoeba invadens
NPDHA

SEQ ID NO: 2888995 - protein, 8 aa, Entamoeba invadens
NPDKRTPR

SEQ ID NO: 2888996 - protein, 15 aa, Entamoeba invadens
NPDNGSEDSEEEEQV

SEQ ID NO: 2888997 - protein, 7 aa, Entamoeba invadens
NPDPAGD

SEQ ID NO: 2888998 - protein, 13 aa, Entamoeba invadens
NPDPTGKPTYPAN

SEQ ID NO: 2888999 - protein, 8 aa, Entamoeba invadens
NPDQDPKQ

SEQ ID NO: 2889000 - protein, 10 aa, Entamoeba invadens
NPDSESDRAL

SEQ ID NO: 2889001 - protein, 6 aa, Entamoeba invadens
NPDSFR

SEQ ID NO: 2889002 - protein, 11 aa, Entamoeba invadens
NPDSNVTQAAG

SEQ ID NO: 2889003 - protein, 7 aa, Entamoeba invadens
NPDSPEF

SEQ ID NO: 2889004 - protein, 11 aa, Entamoeba invadens
NPDTDSEESFY

SEQ ID NO: 2889005 - protein, 5 aa, Entamoeba invadens
NPDTE

SEQ ID NO: 2889006 - protein, 30 aa, Entamoeba invadens
NPEALKGLSQELQPKGTNQDPIGGKTTSIE

SEQ ID NO: 2889007 - protein, 9 aa, Entamoeba invadens
NPEEEEQQR

SEQ ID NO: 2889008 - protein, 7 aa, Entamoeba invadens
NPEEHQR

SEQ ID NO: 2889009 - protein, 17 aa, Entamoeba invadens
NPEEKVTASLQTPQGTL

SEQ ID NO: 2889010 - protein, 5 aa, Entamoeba invadens
NPEFE

SEQ ID NO: 2889011 - protein, 22 aa, Entamoeba invadens
NPEGKEQKPKVIDRGNGKYDVK

SEQ ID NO: 2889012 - protein, 8 aa, Entamoeba invadens
NPEGLQDL

SEQ ID NO: 2889013 - protein, 5 aa, Entamoeba invadens
NPEGP

SEQ ID NO: 2889014 - protein, 4 aa, Entamoeba invadens
NPEH

SEQ ID NO: 2889015 - protein, 26 aa, Entamoeba invadens
NPEIPKRSQAKVRDPREDLYAKVNKR

SEQ ID NO: 2889016 - protein, 6 aa, Entamoeba invadens
NPEIPP

SEQ ID NO: 2889017 - protein, 8 aa, Entamoeba invadens
NPEKEVEK

SEQ ID NO: 2889018 - protein, 8 aa, Entamoeba invadens
NPEKGNLE

SEQ ID NO: 2889019 - protein, 5 aa, Entamoeba invadens
NPEKR

SEQ ID NO: 2889020 - protein, 7 aa, Entamoeba invadens
NPEKRFS

SEQ ID NO: 2889021 - protein, 12 aa, Entamoeba invadens
NPEKTEGEQVTT

SEQ ID NO: 2889022 - protein, 5 aa, Entamoeba invadens
NPEKV

SEQ ID NO: 2889023 - protein, 5 aa, Entamoeba invadens
NPEKY

SEQ ID NO: 2889024 - protein, 19 aa, Entamoeba invadens
NPELQNTHPSKQHDNSNYQ

SEQ ID NO: 2889025 - protein, 6 aa, Entamoeba invadens
NPENKS

SEQ ID NO: 2889026 - protein, 6 aa, Entamoeba invadens
NPENNI

SEQ ID NO: 2889027 - protein, 7 aa, Entamoeba invadens
NPENNTE

SEQ ID NO: 2889028 - protein, 8 aa, Entamoeba invadens
NPENPYKF

SEQ ID NO: 2889029 - protein, 9 aa, Entamoeba invadens
NPEPSTYTP

SEQ ID NO: 2889030 - protein, 15 aa, Entamoeba invadens
NPEQRLTTEGSVNNP

SEQ ID NO: 2889031 - protein, 7 aa, Entamoeba invadens
NPESLTK

SEQ ID NO: 2889032 - protein, 17 aa, Entamoeba invadens
NPESPYTKIPKVEGKGI

SEQ ID NO: 2889033 - protein, 16 aa, Entamoeba invadens
NPESTEGAGKEIKEDY

SEQ ID NO: 2889034 - protein, 9 aa, Entamoeba invadens
NPETAENIA

SEQ ID NO: 2889035 - protein, 26 aa, Entamoeba invadens
NPETATQYDRHNQRVEDENKNFDRDR

SEQ ID NO: 2889036 - protein, 16 aa, Entamoeba invadens
NPETFNATDRWKDDLE

SEQ ID NO: 2889037 - protein, 16 aa, Entamoeba invadens
NPETGFISGGNEANCG

SEQ ID NO: 2889038 - protein, 10 aa, Entamoeba invadens
NPETKKWGQA

SEQ ID NO: 2889039 - protein, 8 aa, Entamoeba invadens
NPETRENG

SEQ ID NO: 2889040 - protein, 14 aa, Entamoeba invadens
NPETRQYRPKDEKD

SEQ ID NO: 2889041 - protein, 4 aa, Entamoeba invadens
NPEV

SEQ ID NO: 2889042 - protein, 5 aa, Entamoeba invadens
NPEYD

SEQ ID NO: 2889043 - protein, 6 aa, Entamoeba invadens
NPEYKD

SEQ ID NO: 2889044 - protein, 5 aa, Entamoeba invadens
NPEYM

SEQ ID NO: 2889045 - protein, 7 aa, Entamoeba invadens
NPFDSSF

SEQ ID NO: 2889046 - protein, 4 aa, Entamoeba invadens
NPFE

SEQ ID NO: 2889047 - protein, 8 aa, Entamoeba invadens
NPFEESSV

SEQ ID NO: 2889048 - protein, 39 aa, Entamoeba invadens
NPFENSIEKSLDQSDGEQEASEYEDSEFSETNEEKDPNV

SEQ ID NO: 2889049 - protein, 4 aa, Entamoeba invadens
NPFF

SEQ ID NO: 2889050 - protein, 8 aa, Entamoeba invadens
NPFKKGKS

SEQ ID NO: 2889051 - protein, 6 aa, Entamoeba invadens
NPFKKT

SEQ ID NO: 2889052 - protein, 28 aa, Entamoeba invadens
NPFPTTKYEKHRKTRSYRKSRSDKSERV

SEQ ID NO: 2889053 - protein, 6 aa, Entamoeba invadens
NPFQPQ

SEQ ID NO: 2889054 - protein, 19 aa, Entamoeba invadens
NPFSDTQNLPQTTESGVDI

SEQ ID NO: 2889055 - protein, 29 aa, Entamoeba invadens
NPFTNTEGETTKKQKEEEQKQKEEERKKD

SEQ ID NO: 2889056 - protein, 74 aa, Entamoeba invadens
NPFTQTPQQSPYYTQPQGSQMQGTTTQNIQNAQQELQQQIQQDPQMGPTNYYTQPKQGIREEVDPIQKTSEGYP

SEQ ID NO: 2889057 - protein, 6 aa, Entamoeba invadens
NPFYDR

SEQ ID NO: 2889058 - protein, 6 aa, Entamoeba invadens
NPFYSE

SEQ ID NO: 2889059 - protein, 9 aa, Entamoeba invadens
NPFYSPDTL

SEQ ID NO: 2889060 - protein, 9 aa, Entamoeba invadens
NPGDFAPVS

SEQ ID NO: 2889061 - protein, 6 aa, Entamoeba invadens
NPGDRA

SEQ ID NO: 2889062 - protein, 6 aa, Entamoeba invadens
NPGEPV

SEQ ID NO: 2889063 - protein, 11 aa, Entamoeba invadens
NPGGDFGKREL

SEQ ID NO: 2889064 - protein, 4 aa, Entamoeba invadens
NPGK

SEQ ID NO: 2889065 - protein, 7 aa, Entamoeba invadens
NPGTKKT

SEQ ID NO: 2889066 - protein, 12 aa, Entamoeba invadens
NPGYKQYTDSYA

SEQ ID NO: 2889067 - protein, 7 aa, Entamoeba invadens
NPHDPIQ

SEQ ID NO: 2889068 - protein, 7 aa, Entamoeba invadens
NPHEDAK

SEQ ID NO: 2889069 - protein, 4 aa, Entamoeba invadens
NPHK

SEQ ID NO: 2889070 - protein, 13 aa, Entamoeba invadens
NPHLEKDKEDLEK

SEQ ID NO: 2889071 - protein, 4 aa, Entamoeba invadens
NPHN

SEQ ID NO: 2889072 - protein, 12 aa, Entamoeba invadens
NPHNGEHSAENE

SEQ ID NO: 2889073 - protein, 7 aa, Entamoeba invadens
NPHNTQP

SEQ ID NO: 2889074 - protein, 14 aa, Entamoeba invadens
NPIDPSKKKITSKL

SEQ ID NO: 2889075 - protein, 4 aa, Entamoeba invadens
NPIE

SEQ ID NO: 2889076 - protein, 12 aa, Entamoeba invadens
NPIKVRSNSNNE

SEQ ID NO: 2889077 - protein, 9 aa, Entamoeba invadens
NPINSLPND

SEQ ID NO: 2889078 - protein, 4 aa, Entamoeba invadens
NPIP

SEQ ID NO: 2889079 - protein, 5 aa, Entamoeba invadens
NPIPA

SEQ ID NO: 2889080 - protein, 5 aa, Entamoeba invadens
NPIPD

SEQ ID NO: 2889081 - protein, 14 aa, Entamoeba invadens
NPIPGNTQGNNNIK

SEQ ID NO: 2889082 - protein, 6 aa, Entamoeba invadens
NPIPID

SEQ ID NO: 2889083 - protein, 4 aa, Entamoeba invadens
NPIQ

SEQ ID NO: 2889084 - protein, 9 aa, Entamoeba invadens
NPIQKNGGC

SEQ ID NO: 2889085 - protein, 26 aa, Entamoeba invadens
NPIRSTSKIDTNKKTRQFSKYNGQLT

SEQ ID NO: 2889086 - protein, 10 aa, Entamoeba invadens
NPISEGKAKE

SEQ ID NO: 2889087 - protein, 5 aa, Entamoeba invadens
NPISI

SEQ ID NO: 2889088 - protein, 6 aa, Entamoeba invadens
NPISIN

SEQ ID NO: 2889089 - protein, 5 aa, Entamoeba invadens
NPISL

SEQ ID NO: 2889090 - protein, 6 aa, Entamoeba invadens
NPISLN

SEQ ID NO: 2889091 - protein, 11 aa, Entamoeba invadens
NPISSVPSNFT

SEQ ID NO: 2889092 - protein, 6 aa, Entamoeba invadens
NPITGR

SEQ ID NO: 2889093 - protein, 13 aa, Entamoeba invadens
NPKAQKLIEPPED

SEQ ID NO: 2889094 - protein, 4 aa, Entamoeba invadens
NPKC

SEQ ID NO: 2889095 - protein, 14 aa, Entamoeba invadens
NPKCKTSVANCPLL

SEQ ID NO: 2889096 - protein, 5 aa, Entamoeba invadens
NPKCT

SEQ ID NO: 2889097 - protein, 14 aa, Entamoeba invadens
NPKDKDYKDMPKDK

SEQ ID NO: 2889098 - protein, 12 aa, Entamoeba invadens
NPKDKGLSPEQI

SEQ ID NO: 2889099 - protein, 9 aa, Entamoeba invadens
NPKDKPEVR

SEQ ID NO: 2889100 - protein, 6 aa, Entamoeba invadens
NPKDKR

SEQ ID NO: 2889101 - protein, 7 aa, Entamoeba invadens
NPKDPNI

SEQ ID NO: 2889102 - protein, 7 aa, Entamoeba invadens
NPKECHS

SEQ ID NO: 2889103 - protein, 8 aa, Entamoeba invadens
NPKERLTA

SEQ ID NO: 2889104 - protein, 15 aa, Entamoeba invadens
NPKFLPKRSREKVGR

SEQ ID NO: 2889105 - protein, 5 aa, Entamoeba invadens
NPKGE

SEQ ID NO: 2889106 - protein, 8 aa, Entamoeba invadens
NPKGKAQN

SEQ ID NO: 2889107 - protein, 9 aa, Entamoeba invadens
NPKGNKEEI

SEQ ID NO: 2889108 - protein, 6 aa, Entamoeba invadens
NPKKAY

SEQ ID NO: 2889109 - protein, 5 aa, Entamoeba invadens
NPKKK

SEQ ID NO: 2889110 - protein, 5 aa, Entamoeba invadens
NPKKL

SEQ ID NO: 2889111 - protein, 5 aa, Entamoeba invadens
NPKLS

SEQ ID NO: 2889112 - protein, 8 aa, Entamoeba invadens
NPKNDRNK

SEQ ID NO: 2889113 - protein, 12 aa, Entamoeba invadens
NPKNDTTESDNN

SEQ ID NO: 2889114 - protein, 5 aa, Entamoeba invadens
NPKNT

SEQ ID NO: 2889115 - protein, 4 aa, Entamoeba invadens
NPKQ

SEQ ID NO: 2889116 - protein, 7 aa, Entamoeba invadens
NPKQEKM

SEQ ID NO: 2889117 - protein, 7 aa, Entamoeba invadens
NPKQQEN

SEQ ID NO: 2889118 - protein, 6 aa, Entamoeba invadens
NPKQTL

SEQ ID NO: 2889119 - protein, 10 aa, Entamoeba invadens
NPKRNKKSKY

SEQ ID NO: 2889120 - protein, 14 aa, Entamoeba invadens
NPKSDISPLPGSIE

SEQ ID NO: 2889121 - protein, 8 aa, Entamoeba invadens
NPKSDKVE

SEQ ID NO: 2889122 - protein, 9 aa, Entamoeba invadens
NPKSGDSEL

SEQ ID NO: 2889123 - protein, 10 aa, Entamoeba invadens
NPKSGGQTGL

SEQ ID NO: 2889124 - protein, 8 aa, Entamoeba invadens
NPKSKSNE

SEQ ID NO: 2889125 - protein, 10 aa, Entamoeba invadens
NPKSVDAESL

SEQ ID NO: 2889126 - protein, 28 aa, Entamoeba invadens
NPKSVPSKPTQKNQPLAAPENIKAPDEQ

SEQ ID NO: 2889127 - protein, 5 aa, Entamoeba invadens
NPKTR

SEQ ID NO: 2889128 - protein, 5 aa, Entamoeba invadens
NPKTT

SEQ ID NO: 2889129 - protein, 6 aa, Entamoeba invadens
NPKTVK

SEQ ID NO: 2889130 - protein, 6 aa, Entamoeba invadens
NPKVRS

SEQ ID NO: 2889131 - protein, 10 aa, Entamoeba invadens
NPKYEATKET

SEQ ID NO: 2889132 - protein, 6 aa, Entamoeba invadens
NPKYGR

SEQ ID NO: 2889133 - protein, 11 aa, Entamoeba invadens
NPKYKDSKTEI

SEQ ID NO: 2889134 - protein, 4 aa, Entamoeba invadens
NPLA

SEQ ID NO: 2889135 - protein, 13 aa, Entamoeba invadens
NPLAPQQPYPGQA

SEQ ID NO: 2889136 - protein, 13 aa, Entamoeba invadens
NPLDPEDEEAPHR

SEQ ID NO: 2889137 - protein, 22 aa, Entamoeba invadens
NPLDSYSSDANLIGPDQDEFVG

SEQ ID NO: 2889138 - protein, 4 aa, Entamoeba invadens
NPLE

SEQ ID NO: 2889139 - protein, 12 aa, Entamoeba invadens
NPLGAQTGINPN

SEQ ID NO: 2889140 - protein, 32 aa, Entamoeba invadens
NPLGAQTGINPNVNYAQQPNTQQQTNYNNPLG

SEQ ID NO: 2889141 - protein, 6 aa, Entamoeba invadens
NPLGDH

SEQ ID NO: 2889142 - protein, 5 aa, Entamoeba invadens
NPLNV

SEQ ID NO: 2889143 - protein, 6 aa, Entamoeba invadens
NPLPND

SEQ ID NO: 2889144 - protein, 5 aa, Entamoeba invadens
NPLQN

SEQ ID NO: 2889145 - protein, 4 aa, Entamoeba invadens
NPLS

SEQ ID NO: 2889146 - protein, 6 aa, Entamoeba invadens
NPLSDY

SEQ ID NO: 2889147 - protein, 11 aa, Entamoeba invadens
NPLSGGDKQIP

SEQ ID NO: 2889148 - protein, 19 aa, Entamoeba invadens
NPLSSKEPSTVDTNKNEPF

SEQ ID NO: 2889149 - protein, 8 aa, Entamoeba invadens
NPLTTERY

SEQ ID NO: 2889150 - protein, 4 aa, Entamoeba invadens
NPLY

SEQ ID NO: 2889151 - protein, 26 aa, Entamoeba invadens
NPMATTSTPSQQPNNGQSGTTQNTTI

SEQ ID NO: 2889152 - protein, 7 aa, Entamoeba invadens
NPMGTQQ

SEQ ID NO: 2889153 - protein, 4 aa, Entamoeba invadens
NPMK

SEQ ID NO: 2889154 - protein, 11 aa, Entamoeba invadens
NPMKGKAETRK

SEQ ID NO: 2889155 - protein, 13 aa, Entamoeba invadens
NPMKVSTREVDEV

SEQ ID NO: 2889156 - protein, 4 aa, Entamoeba invadens
NPMN

SEQ ID NO: 2889157 - protein, 7 aa, Entamoeba invadens
NPMNQSN

SEQ ID NO: 2889158 - protein, 7 aa, Entamoeba invadens
NPMQQSQ

SEQ ID NO: 2889159 - protein, 19 aa, Entamoeba invadens
NPMSAGQPQTQERPMSSSQ

SEQ ID NO: 2889160 - protein, 9 aa, Entamoeba invadens
NPMSDKTKH

SEQ ID NO: 2889161 - protein, 9 aa, Entamoeba invadens
NPNDDEFED

SEQ ID NO: 2889162 - protein, 7 aa, Entamoeba invadens
NPNDETV

SEQ ID NO: 2889163 - protein, 6 aa, Entamoeba invadens
NPNDPL

SEQ ID NO: 2889164 - protein, 6 aa, Entamoeba invadens
NPNEEY

SEQ ID NO: 2889165 - protein, 16 aa, Entamoeba invadens
NPNEKKRLSARGVEEV

SEQ ID NO: 2889166 - protein, 8 aa, Entamoeba invadens
NPNERQKM

SEQ ID NO: 2889167 - protein, 9 aa, Entamoeba invadens
NPNGNPTSL

SEQ ID NO: 2889168 - protein, 22 aa, Entamoeba invadens
NPNHDSVDRKKEKNGLKSPKAE

SEQ ID NO: 2889169 - protein, 5 aa, Entamoeba invadens
NPNIP

SEQ ID NO: 2889170 - protein, 7 aa, Entamoeba invadens
NPNIPQI

SEQ ID NO: 2889171 - protein, 29 aa, Entamoeba invadens
NPNKKIPQQVQQQQPKPQSDQIQQSSSYA

SEQ ID NO: 2889172 - protein, 21 aa, Entamoeba invadens
NPNKKNKKKNKKGSVKKDQFD

SEQ ID NO: 2889173 - protein, 8 aa, Entamoeba invadens
NPNKLHAG

SEQ ID NO: 2889174 - protein, 7 aa, Entamoeba invadens
NPNKNYL

SEQ ID NO: 2889175 - protein, 7 aa, Entamoeba invadens
NPNLDDP

SEQ ID NO: 2889176 - protein, 7 aa, Entamoeba invadens
NPNLPSS

SEQ ID NO: 2889177 - protein, 7 aa, Entamoeba invadens
NPNLQQG

SEQ ID NO: 2889178 - protein, 6 aa, Entamoeba invadens
NPNLTV

SEQ ID NO: 2889179 - protein, 6 aa, Entamoeba invadens
NPNNAK

SEQ ID NO: 2889180 - protein, 8 aa, Entamoeba invadens
NPNNDEEQ

SEQ ID NO: 2889181 - protein, 5 aa, Entamoeba invadens
NPNNE

SEQ ID NO: 2889182 - protein, 10 aa, Entamoeba invadens
NPNNITGSDN

SEQ ID NO: 2889183 - protein, 4 aa, Entamoeba invadens
NPNP

SEQ ID NO: 2889184 - protein, 8 aa, Entamoeba invadens
NPNPEDGQ

SEQ ID NO: 2889185 - protein, 6 aa, Entamoeba invadens
NPNPVS

SEQ ID NO: 2889186 - protein, 4 aa, Entamoeba invadens
NPNQ

SEQ ID NO: 2889187 - protein, 9 aa, Entamoeba invadens
NPNQRASIK

SEQ ID NO: 2889188 - protein, 18 aa, Entamoeba invadens
NPNRNVDDEESGDDDDDS

SEQ ID NO: 2889189 - protein, 7 aa, Entamoeba invadens
NPNRQPI

SEQ ID NO: 2889190 - protein, 33 aa, Entamoeba invadens
NPNSEDQSEKSEESGDIKSKQHKDENKDDGIEI

SEQ ID NO: 2889191 - protein, 11 aa, Entamoeba invadens
NPNSQHGNITD

SEQ ID NO: 2889192 - protein, 8 aa, Entamoeba invadens
NPNTDEKK

SEQ ID NO: 2889193 - protein, 6 aa, Entamoeba invadens
NPNTDV

SEQ ID NO: 2889194 - protein, 9 aa, Entamoeba invadens
NPNTKFTNR

SEQ ID NO: 2889195 - protein, 33 aa, Entamoeba invadens
NPNTRFRPQPNPNQNYNRFPQPNYNTFSPNPYY

SEQ ID NO: 2889196 - protein, 8 aa, Entamoeba invadens
NPNTTETI

SEQ ID NO: 2889197 - protein, 4 aa, Entamoeba invadens
NPNV

SEQ ID NO: 2889198 - protein, 7 aa, Entamoeba invadens
NPNVGKS

SEQ ID NO: 2889199 - protein, 9 aa, Entamoeba invadens
NPNVPGEGE

SEQ ID NO: 2889200 - protein, 9 aa, Entamoeba invadens
NPNYAKGYG

SEQ ID NO: 2889201 - protein, 7 aa, Entamoeba invadens
NPNYEKC

SEQ ID NO: 2889202 - protein, 8 aa, Entamoeba invadens
NPNYRPQL

SEQ ID NO: 2889203 - protein, 6 aa, Entamoeba invadens
NPNYSA

SEQ ID NO: 2889204 - protein, 6 aa, Entamoeba invadens
NPNYSL

SEQ ID NO: 2889205 - protein, 5 aa, Entamoeba invadens
NPNYT

SEQ ID NO: 2889206 - protein, 6 aa, Entamoeba invadens
NPPAQY

SEQ ID NO: 2889207 - protein, 15 aa, Entamoeba invadens
NPPFQKTSPTRSSYN

SEQ ID NO: 2889208 - protein, 14 aa, Entamoeba invadens
NPPFQLEPKTQKNF

SEQ ID NO: 2889209 - protein, 8 aa, Entamoeba invadens
NPPIPTPA

SEQ ID NO: 2889210 - protein, 11 aa, Entamoeba invadens
NPPISTSEIPN

SEQ ID NO: 2889211 - protein, 5 aa, Entamoeba invadens
NPPIT

SEQ ID NO: 2889212 - protein, 8 aa, Entamoeba invadens
NPPKHVKE

SEQ ID NO: 2889213 - protein, 6 aa, Entamoeba invadens
NPPKNI

SEQ ID NO: 2889214 - protein, 7 aa, Entamoeba invadens
NPPKVTS

SEQ ID NO: 2889215 - protein, 20 aa, Entamoeba invadens
NPPKYKNNHKSAVTKISEEE

SEQ ID NO: 2889216 - protein, 4 aa, Entamoeba invadens
NPPL

SEQ ID NO: 2889217 - protein, 13 aa, Entamoeba invadens
NPPLSDAPGTNNQ

SEQ ID NO: 2889218 - protein, 13 aa, Entamoeba invadens
NPPLSDAPGTTNQ

SEQ ID NO: 2889219 - protein, 12 aa, Entamoeba invadens
NPPLSNAPGTVN

SEQ ID NO: 2889220 - protein, 10 aa, Entamoeba invadens
NPPLSSDPKD

SEQ ID NO: 2889221 - protein, 5 aa, Entamoeba invadens
NPPMP

SEQ ID NO: 2889222 - protein, 11 aa, Entamoeba invadens
NPPNFSTTTNI

SEQ ID NO: 2889223 - protein, 7 aa, Entamoeba invadens
NPPNTNW

SEQ ID NO: 2889224 - protein, 12 aa, Entamoeba invadens
NPPPKLKNENEH

SEQ ID NO: 2889225 - protein, 73 aa, Entamoeba invadens
NPPPLPPKSYQKDKKEREKDKKQQEKENERLKEQKEKLDKKKKSDEKKAKQEKEIASQSQLKERSLPNRGKSY

SEQ ID NO: 2889226 - protein, 6 aa, Entamoeba invadens
NPPPVY

SEQ ID NO: 2889227 - protein, 9 aa, Entamoeba invadens
NPPQFETTP

SEQ ID NO: 2889228 - protein, 24 aa, Entamoeba invadens
NPPQQQYKYDDKGRDGYQYHNNYK

SEQ ID NO: 2889229 - protein, 4 aa, Entamoeba invadens
NPPS

SEQ ID NO: 2889230 - protein, 4 aa, Entamoeba invadens
NPPV

SEQ ID NO: 2889231 - protein, 12 aa, Entamoeba invadens
NPQARNDLTKNI

SEQ ID NO: 2889232 - protein, 13 aa, Entamoeba invadens
NPQDGWSSSGTVS

SEQ ID NO: 2889233 - protein, 10 aa, Entamoeba invadens
NPQDVDTDTA

SEQ ID NO: 2889234 - protein, 6 aa, Entamoeba invadens
NPQEFQ

SEQ ID NO: 2889235 - protein, 7 aa, Entamoeba invadens
NPQENAR

SEQ ID NO: 2889236 - protein, 8 aa, Entamoeba invadens
NPQINTTE

SEQ ID NO: 2889237 - protein, 6 aa, Entamoeba invadens
NPQKGN

SEQ ID NO: 2889238 - protein, 17 aa, Entamoeba invadens
NPQKVDPKVKLTESTEF

SEQ ID NO: 2889239 - protein, 5 aa, Entamoeba invadens
NPQLI

SEQ ID NO: 2889240 - protein, 10 aa, Entamoeba invadens
NPQLPPPKEY

SEQ ID NO: 2889241 - protein, 11 aa, Entamoeba invadens
NPQLPTEQEVQ

SEQ ID NO: 2889242 - protein, 7 aa, Entamoeba invadens
NPQNGKM

SEQ ID NO: 2889243 - protein, 13 aa, Entamoeba invadens
NPQNRDDLSKNIN

SEQ ID NO: 2889244 - protein, 6 aa, Entamoeba invadens
NPQNRY

SEQ ID NO: 2889245 - protein, 8 aa, Entamoeba invadens
NPQNSEAR

SEQ ID NO: 2889246 - protein, 8 aa, Entamoeba invadens
NPQNTSAR

SEQ ID NO: 2889247 - protein, 7 aa, Entamoeba invadens
NPQNYEA

SEQ ID NO: 2889248 - protein, 18 aa, Entamoeba invadens
NPQPRPLKEEPPKSMGDL

SEQ ID NO: 2889249 - protein, 6 aa, Entamoeba invadens
NPQQKL

SEQ ID NO: 2889250 - protein, 8 aa, Entamoeba invadens
NPQSGPQN

SEQ ID NO: 2889251 - protein, 13 aa, Entamoeba invadens
NPQSNVKNGNEGG

SEQ ID NO: 2889252 - protein, 12 aa, Entamoeba invadens
NPQSQPKTSPKI

SEQ ID NO: 2889253 - protein, 7 aa, Entamoeba invadens
NPQSQQC

SEQ ID NO: 2889254 - protein, 6 aa, Entamoeba invadens
NPQSQR

SEQ ID NO: 2889255 - protein, 6 aa, Entamoeba invadens
NPQSQY

SEQ ID NO: 2889256 - protein, 6 aa, Entamoeba invadens
NPQTER

SEQ ID NO: 2889257 - protein, 6 aa, Entamoeba invadens
NPQTSI

SEQ ID NO: 2889258 - protein, 6 aa, Entamoeba invadens
NPQWNE

SEQ ID NO: 2889259 - protein, 26 aa, Entamoeba invadens
NPQYAPSKSDLSEEDKQIKSDFDEKK

SEQ ID NO: 2889260 - protein, 5 aa, Entamoeba invadens
NPQYE

SEQ ID NO: 2889261 - protein, 5 aa, Entamoeba invadens
NPRAE

SEQ ID NO: 2889262 - protein, 4 aa, Entamoeba invadens
NPRD

SEQ ID NO: 2889263 - protein, 4 aa, Entamoeba invadens
NPRE

SEQ ID NO: 2889264 - protein, 6 aa, Entamoeba invadens
NPRENS

SEQ ID NO: 2889265 - protein, 6 aa, Entamoeba invadens
NPRKEP

SEQ ID NO: 2889266 - protein, 8 aa, Entamoeba invadens
NPRKKTVI

SEQ ID NO: 2889267 - protein, 9 aa, Entamoeba invadens
NPRKKTVIG

SEQ ID NO: 2889268 - protein, 5 aa, Entamoeba invadens
NPRNC

SEQ ID NO: 2889269 - protein, 8 aa, Entamoeba invadens
NPRNEKAR

SEQ ID NO: 2889270 - protein, 5 aa, Entamoeba invadens
NPRNT

SEQ ID NO: 2889271 - protein, 8 aa, Entamoeba invadens
NPRQPLED

SEQ ID NO: 2889272 - protein, 14 aa, Entamoeba invadens
NPRQRGDDNEGDDY

SEQ ID NO: 2889273 - protein, 5 aa, Entamoeba invadens
NPRVP

SEQ ID NO: 2889274 - protein, 30 aa, Entamoeba invadens
NPSAPNSPKPYSNANSPQKPQTTAGRIPQS

SEQ ID NO: 2889275 - protein, 20 aa, Entamoeba invadens
NPSAPVSTKTIAPKKKKCVL

SEQ ID NO: 2889276 - protein, 11 aa, Entamoeba invadens
NPSATAHTTTE

SEQ ID NO: 2889277 - protein, 6 aa, Entamoeba invadens
NPSCPL

SEQ ID NO: 2889278 - protein, 4 aa, Entamoeba invadens
NPSD

SEQ ID NO: 2889279 - protein, 9 aa, Entamoeba invadens
NPSDKDKLA

SEQ ID NO: 2889280 - protein, 7 aa, Entamoeba invadens
NPSDQVK

SEQ ID NO: 2889281 - protein, 4 aa, Entamoeba invadens
NPSE

SEQ ID NO: 2889282 - protein, 74 aa, Entamoeba invadens
  misc_feature (48)..(49): Xaa can be any naturally occurring amino acid
NPSESITEEEQPPVIEPTPIARNTRKQASMEKAQDEDNEKKLTRKFDXXSRKEYVRLKKLKPKVEEEDSDDVVD

SEQ ID NO: 2889283 - protein, 5 aa, Entamoeba invadens
NPSFP

SEQ ID NO: 2889284 - protein, 6 aa, Entamoeba invadens
NPSFSL

SEQ ID NO: 2889285 - protein, 4 aa, Entamoeba invadens
NPSG

SEQ ID NO: 2889286 - protein, 7 aa, Entamoeba invadens
NPSGGED

SEQ ID NO: 2889287 - protein, 6 aa, Entamoeba invadens
NPSGNV

SEQ ID NO: 2889288 - protein, 9 aa, Entamoeba invadens
NPSGPVGSK

SEQ ID NO: 2889289 - protein, 4 aa, Entamoeba invadens
NPSI

SEQ ID NO: 2889290 - protein, 8 aa, Entamoeba invadens
NPSIKESS

SEQ ID NO: 2889291 - protein, 7 aa, Entamoeba invadens
NPSIQQD

SEQ ID NO: 2889292 - protein, 9 aa, Entamoeba invadens
NPSKHRNDE

SEQ ID NO: 2889293 - protein, 6 aa, Entamoeba invadens
NPSKRR

SEQ ID NO: 2889294 - protein, 7 aa, Entamoeba invadens
NPSKSRL

SEQ ID NO: 2889295 - protein, 6 aa, Entamoeba invadens
NPSKVT

SEQ ID NO: 2889296 - protein, 4 aa, Entamoeba invadens
NPSL

SEQ ID NO: 2889297 - protein, 14 aa, Entamoeba invadens
NPSLHKEQRPETPA

SEQ ID NO: 2889298 - protein, 7 aa, Entamoeba invadens
NPSLRQD

SEQ ID NO: 2889299 - protein, 4 aa, Entamoeba invadens
NPSM

SEQ ID NO: 2889300 - protein, 5 aa, Entamoeba invadens
NPSMV

SEQ ID NO: 2889301 - protein, 8 aa, Entamoeba invadens
NPSNEYTD

SEQ ID NO: 2889302 - protein, 9 aa, Entamoeba invadens
NPSNSTPVS

SEQ ID NO: 2889303 - protein, 6 aa, Entamoeba invadens
NPSPRI

SEQ ID NO: 2889304 - protein, 13 aa, Entamoeba invadens
NPSPRMEMNLKEI

SEQ ID NO: 2889305 - protein, 8 aa, Entamoeba invadens
NPSQSRSG

SEQ ID NO: 2889306 - protein, 4 aa, Entamoeba invadens
NPSR

SEQ ID NO: 2889307 - protein, 8 aa, Entamoeba invadens
NPSSASPH

SEQ ID NO: 2889308 - protein, 6 aa, Entamoeba invadens
NPSTEQ

SEQ ID NO: 2889309 - protein, 8 aa, Entamoeba invadens
NPSTGETI

SEQ ID NO: 2889310 - protein, 5 aa, Entamoeba invadens
NPSTK

SEQ ID NO: 2889311 - protein, 9 aa, Entamoeba invadens
NPSTLSSDP

SEQ ID NO: 2889312 - protein, 5 aa, Entamoeba invadens
NPSTY

SEQ ID NO: 2889313 - protein, 15 aa, Entamoeba invadens
NPSVFPPKPTFGYNS

SEQ ID NO: 2889314 - protein, 6 aa, Entamoeba invadens
NPSWYE

SEQ ID NO: 2889315 - protein, 5 aa, Entamoeba invadens
NPSYF

SEQ ID NO: 2889316 - protein, 15 aa, Entamoeba invadens
NPSYIPKYPKEGENI

SEQ ID NO: 2889317 - protein, 33 aa, Entamoeba invadens
NPSYSPSPSPLSSDVSISENDEKKAGDSDFSRK

SEQ ID NO: 2889318 - protein, 7 aa, Entamoeba invadens
NPTAPSQ

SEQ ID NO: 2889319 - protein, 4 aa, Entamoeba invadens
NPTD

SEQ ID NO: 2889320 - protein, 5 aa, Entamoeba invadens
NPTEK

SEQ ID NO: 2889321 - protein, 13 aa, Entamoeba invadens
NPTEQQKTSTTLG

SEQ ID NO: 2889322 - protein, 13 aa, Entamoeba invadens
NPTETENAFTEDG

SEQ ID NO: 2889323 - protein, 9 aa, Entamoeba invadens
NPTIEDSYA

SEQ ID NO: 2889324 - protein, 4 aa, Entamoeba invadens
NPTK

SEQ ID NO: 2889325 - protein, 6 aa, Entamoeba invadens
NPTKDA

SEQ ID NO: 2889326 - protein, 5 aa, Entamoeba invadens
NPTKE

SEQ ID NO: 2889327 - protein, 7 aa, Entamoeba invadens
NPTKNEA

SEQ ID NO: 2889328 - protein, 28 aa, Entamoeba invadens
NPTKSAKRDSLRETKNTSAAEIDSQASL

SEQ ID NO: 2889329 - protein, 8 aa, Entamoeba invadens
NPTKTSPI

SEQ ID NO: 2889330 - protein, 7 aa, Entamoeba invadens
NPTLPTH

SEQ ID NO: 2889331 - protein, 7 aa, Entamoeba invadens
NPTMEDQ

SEQ ID NO: 2889332 - protein, 4 aa, Entamoeba invadens
NPTN

SEQ ID NO: 2889333 - protein, 5 aa, Entamoeba invadens
NPTNM

SEQ ID NO: 2889334 - protein, 10 aa, Entamoeba invadens
NPTNPNDKDE

SEQ ID NO: 2889335 - protein, 5 aa, Entamoeba invadens
NPTNS

SEQ ID NO: 2889336 - protein, 9 aa, Entamoeba invadens
NPTNYPPTR

SEQ ID NO: 2889337 - protein, 7 aa, Entamoeba invadens
NPTPFNP

SEQ ID NO: 2889338 - protein, 6 aa, Entamoeba invadens
NPTPGG

SEQ ID NO: 2889339 - protein, 12 aa, Entamoeba invadens
NPTPINSIPQSG

SEQ ID NO: 2889340 - protein, 7 aa, Entamoeba invadens
NPTPTQL

SEQ ID NO: 2889341 - protein, 5 aa, Entamoeba invadens
NPTSC

SEQ ID NO: 2889342 - protein, 9 aa, Entamoeba invadens
NPTSKMSPK

SEQ ID NO: 2889343 - protein, 5 aa, Entamoeba invadens
NPTSL

SEQ ID NO: 2889344 - protein, 6 aa, Entamoeba invadens
NPTSLT

SEQ ID NO: 2889345 - protein, 5 aa, Entamoeba invadens
NPTSN

SEQ ID NO: 2889346 - protein, 10 aa, Entamoeba invadens
NPTSPFPQAK

SEQ ID NO: 2889347 - protein, 31 aa, Entamoeba invadens
NPTSQKEIPPKAESPQPKFQAAKKRDSINGR

SEQ ID NO: 2889348 - protein, 5 aa, Entamoeba invadens
NPTTF

SEQ ID NO: 2889349 - protein, 7 aa, Entamoeba invadens
NPTTRRK

SEQ ID NO: 2889350 - protein, 15 aa, Entamoeba invadens
NPVDDQEASEDSWGE

SEQ ID NO: 2889351 - protein, 21 aa, Entamoeba invadens
NPVDPKRTSIKPNAPPPPKST

SEQ ID NO: 2889352 - protein, 5 aa, Entamoeba invadens
NPVEE

SEQ ID NO: 2889353 - protein, 8 aa, Entamoeba invadens
NPVEEDSH

SEQ ID NO: 2889354 - protein, 5 aa, Entamoeba invadens
NPVGS

SEQ ID NO: 2889355 - protein, 7 aa, Entamoeba invadens
NPVPINT

SEQ ID NO: 2889356 - protein, 8 aa, Entamoeba invadens
NPVPIPPQ

SEQ ID NO: 2889357 - protein, 10 aa, Entamoeba invadens
NPVSGTSSLF

SEQ ID NO: 2889358 - protein, 7 aa, Entamoeba invadens
NPVVGDS

SEQ ID NO: 2889359 - protein, 27 aa, Entamoeba invadens
NPVVPPKPKQIHSRTQALGSNTSRLSR

SEQ ID NO: 2889360 - protein, 6 aa, Entamoeba invadens
NPYNTK

SEQ ID NO: 2889361 - protein, 4 aa, Entamoeba invadens
NPYP

SEQ ID NO: 2889362 - protein, 9 aa, Entamoeba invadens
NPYPSVSPL

SEQ ID NO: 2889363 - protein, 7 aa, Entamoeba invadens
NPYTEGE

SEQ ID NO: 2889364 - protein, 7 aa, Entamoeba invadens
NQAENVE

SEQ ID NO: 2889365 - protein, 4 aa, Entamoeba invadens
NQAH

SEQ ID NO: 2889366 - protein, 4 aa, Entamoeba invadens
NQAK

SEQ ID NO: 2889367 - protein, 8 aa, Entamoeba invadens
NQAKRESM

SEQ ID NO: 2889368 - protein, 10 aa, Entamoeba invadens
NQANEKWTPM

SEQ ID NO: 2889369 - protein, 17 aa, Entamoeba invadens
NQAQQFQATTNSLRHAR

SEQ ID NO: 2889370 - protein, 4 aa, Entamoeba invadens
NQAS

SEQ ID NO: 2889371 - protein, 19 aa, Entamoeba invadens
NQATVTKKVNQEKKPRKKK

SEQ ID NO: 2889372 - protein, 23 aa, Entamoeba invadens
NQCRRGRNAQVPKKEVEENTLPF

SEQ ID NO: 2889373 - protein, 7 aa, Entamoeba invadens
NQDCRNK

SEQ ID NO: 2889374 - protein, 19 aa, Entamoeba invadens
NQDEDTATEIASETVTEQL

SEQ ID NO: 2889375 - protein, 11 aa, Entamoeba invadens
NQDELSARSFN

SEQ ID NO: 2889376 - protein, 18 aa, Entamoeba invadens
NQDESVITGGAGKKSDVL

SEQ ID NO: 2889377 - protein, 6 aa, Entamoeba invadens
NQDGEV

SEQ ID NO: 2889378 - protein, 13 aa, Entamoeba invadens
NQDKKTNNSLSKN

SEQ ID NO: 2889379 - protein, 26 aa, Entamoeba invadens
NQDPTLKESASVQEGKKKGKGKKCII

SEQ ID NO: 2889380 - protein, 6 aa, Entamoeba invadens
NQDQHK

SEQ ID NO: 2889381 - protein, 6 aa, Entamoeba invadens
NQDTPV

SEQ ID NO: 2889382 - protein, 5 aa, Entamoeba invadens
NQDWN

SEQ ID NO: 2889383 - protein, 6 aa, Entamoeba invadens
NQEDAS

SEQ ID NO: 2889384 - protein, 6 aa, Entamoeba invadens
NQEDKN

SEQ ID NO: 2889385 - protein, 9 aa, Entamoeba invadens
NQEDPEEGK

SEQ ID NO: 2889386 - protein, 6 aa, Entamoeba invadens
NQEEEN

SEQ ID NO: 2889387 - protein, 25 aa, Entamoeba invadens
NQEFEKVEEKVEEEIKKEEEEVKEM

SEQ ID NO: 2889388 - protein, 8 aa, Entamoeba invadens
NQEGDDSV

SEQ ID NO: 2889389 - protein, 7 aa, Entamoeba invadens
NQEIPHE

SEQ ID NO: 2889390 - protein, 5 aa, Entamoeba invadens
NQENI

SEQ ID NO: 2889391 - protein, 8 aa, Entamoeba invadens
NQEQKTAY

SEQ ID NO: 2889392 - protein, 17 aa, Entamoeba invadens
NQEQLDSLRSQNKISQI

SEQ ID NO: 2889393 - protein, 22 aa, Entamoeba invadens
NQEQVKPKEEIEKDSRQRVEEL

SEQ ID NO: 2889394 - protein, 11 aa, Entamoeba invadens
NQERGHDDDQI

SEQ ID NO: 2889395 - protein, 7 aa, Entamoeba invadens
NQESGTD

SEQ ID NO: 2889396 - protein, 6 aa, Entamoeba invadens
NQESIS

SEQ ID NO: 2889397 - protein, 7 aa, Entamoeba invadens
NQESKEY

SEQ ID NO: 2889398 - protein, 4 aa, Entamoeba invadens
NQET

SEQ ID NO: 2889399 - protein, 7 aa, Entamoeba invadens
NQETERM

SEQ ID NO: 2889400 - protein, 5 aa, Entamoeba invadens
NQEYF

SEQ ID NO: 2889401 - protein, 11 aa, Entamoeba invadens
NQFSSTSATPT

SEQ ID NO: 2889402 - protein, 8 aa, Entamoeba invadens
NQFSTGEK

SEQ ID NO: 2889403 - protein, 9 aa, Entamoeba invadens
NQGEEEDDD

SEQ ID NO: 2889404 - protein, 4 aa, Entamoeba invadens
NQGF

SEQ ID NO: 2889405 - protein, 8 aa, Entamoeba invadens
NQGGSMDK

SEQ ID NO: 2889406 - protein, 11 aa, Entamoeba invadens
NQGKKDDVKKK

SEQ ID NO: 2889407 - protein, 8 aa, Entamoeba invadens
NQGNAELT

SEQ ID NO: 2889408 - protein, 10 aa, Entamoeba invadens
NQGNINSNTN

SEQ ID NO: 2889409 - protein, 9 aa, Entamoeba invadens
NQGYVESSS

SEQ ID NO: 2889410 - protein, 7 aa, Entamoeba invadens
NQHEPES

SEQ ID NO: 2889411 - protein, 9 aa, Entamoeba invadens
NQHGLTAGE

SEQ ID NO: 2889412 - protein, 8 aa, Entamoeba invadens
NQHNPPDQ

SEQ ID NO: 2889413 - protein, 7 aa, Entamoeba invadens
NQHNSPL

SEQ ID NO: 2889414 - protein, 14 aa, Entamoeba invadens
NQHNTQDNQYQGSL

SEQ ID NO: 2889415 - protein, 11 aa, Entamoeba invadens
NQHPEKSFAHK

SEQ ID NO: 2889416 - protein, 5 aa, Entamoeba invadens
NQHSI

SEQ ID NO: 2889417 - protein, 14 aa, Entamoeba invadens
NQIGTKFEKKDCGD

SEQ ID NO: 2889418 - protein, 9 aa, Entamoeba invadens
NQIHPQPSV

SEQ ID NO: 2889419 - protein, 5 aa, Entamoeba invadens
NQIHT

SEQ ID NO: 2889420 - protein, 10 aa, Entamoeba invadens
NQIKKKEEVF

SEQ ID NO: 2889421 - protein, 10 aa, Entamoeba invadens
NQISDVTPLT

SEQ ID NO: 2889422 - protein, 4 aa, Entamoeba invadens
NQIT

SEQ ID NO: 2889423 - protein, 5 aa, Entamoeba invadens
NQITE

SEQ ID NO: 2889424 - protein, 6 aa, Entamoeba invadens
NQKDEH

SEQ ID NO: 2889425 - protein, 7 aa, Entamoeba invadens
NQKDESV

SEQ ID NO: 2889426 - protein, 9 aa, Entamoeba invadens
NQKDFATKN

SEQ ID NO: 2889427 - protein, 9 aa, Entamoeba invadens
NQKDQQSTF

SEQ ID NO: 2889428 - protein, 51 aa, Entamoeba invadens
NQKEAKAVKKLQDENVEKNVRKRKRTQPTPRKTPENSESSDDDISSDIDKE

SEQ ID NO: 2889429 - protein, 22 aa, Entamoeba invadens
NQKEEYSVSEEGDEIEETVDEQ

SEQ ID NO: 2889430 - protein, 6 aa, Entamoeba invadens
NQKETL

SEQ ID NO: 2889431 - protein, 13 aa, Entamoeba invadens
NQKFDDEVVFEYL

SEQ ID NO: 2889432 - protein, 11 aa, Entamoeba invadens
NQKGGVDHKDE

SEQ ID NO: 2889433 - protein, 8 aa, Entamoeba invadens
NQKHGTLQ

SEQ ID NO: 2889434 - protein, 12 aa, Entamoeba invadens
NQKITNQSSGEH

SEQ ID NO: 2889435 - protein, 9 aa, Entamoeba invadens
NQKKEKMTQ

SEQ ID NO: 2889436 - protein, 28 aa, Entamoeba invadens
NQKLETQLKESNERANGLQKAHEVQKRD

SEQ ID NO: 2889437 - protein, 10 aa, Entamoeba invadens
NQKLGNYKEA

SEQ ID NO: 2889438 - protein, 7 aa, Entamoeba invadens
NQKLKED

SEQ ID NO: 2889439 - protein, 6 aa, Entamoeba invadens
NQKNPT

SEQ ID NO: 2889440 - protein, 12 aa, Entamoeba invadens
NQKPKERKTVEN

SEQ ID NO: 2889441 - protein, 62 aa, Entamoeba invadens
NQKQQKKVNPFGEDSDDDSEDTKKRPIVKQSPKSVGKKPNPFGDSSSDESEETKVNPSPISL

SEQ ID NO: 2889442 - protein, 14 aa, Entamoeba invadens
NQKRGLVPSNFLEK

SEQ ID NO: 2889443 - protein, 11 aa, Entamoeba invadens
NQKRVEEDTKM

SEQ ID NO: 2889444 - protein, 4 aa, Entamoeba invadens
NQKS

SEQ ID NO: 2889445 - protein, 10 aa, Entamoeba invadens
NQKSENPNRD

SEQ ID NO: 2889446 - protein, 10 aa, Entamoeba invadens
NQKSEVNGEY

SEQ ID NO: 2889447 - protein, 8 aa, Entamoeba invadens
NQKSEVQP

SEQ ID NO: 2889448 - protein, 10 aa, Entamoeba invadens
NQKSRDFNKN

SEQ ID NO: 2889449 - protein, 10 aa, Entamoeba invadens
NQKSTGNNAL

SEQ ID NO: 2889450 - protein, 10 aa, Entamoeba invadens
NQKTNELPQK

SEQ ID NO: 2889451 - protein, 8 aa, Entamoeba invadens
NQKTQSQE

SEQ ID NO: 2889452 - protein, 28 aa, Entamoeba invadens
NQKTTQVTATLTPQGVKGIQPGVTITPK

SEQ ID NO: 2889453 - protein, 8 aa, Entamoeba invadens
NQKTVTTY

SEQ ID NO: 2889454 - protein, 4 aa, Entamoeba invadens
NQKV

SEQ ID NO: 2889455 - protein, 6 aa, Entamoeba invadens
NQKYTK

SEQ ID NO: 2889456 - protein, 5 aa, Entamoeba invadens
NQLDG

SEQ ID NO: 2889457 - protein, 9 aa, Entamoeba invadens
NQLDKNEEN

SEQ ID NO: 2889458 - protein, 13 aa, Entamoeba invadens
NQLDTDCKTNDVE

SEQ ID NO: 2889459 - protein, 7 aa, Entamoeba invadens
NQLDTQP

SEQ ID NO: 2889460 - protein, 18 aa, Entamoeba invadens
NQLEEENQQISAAPNEDD

SEQ ID NO: 2889461 - protein, 15 aa, Entamoeba invadens
NQLENNEKAQKDLQN

SEQ ID NO: 2889462 - protein, 19 aa, Entamoeba invadens
NQLGNASGELKHQQRNKED

SEQ ID NO: 2889463 - protein, 4 aa, Entamoeba invadens
NQLK

SEQ ID NO: 2889464 - protein, 18 aa, Entamoeba invadens
NQLKKQTKKPTMKKPTVK

SEQ ID NO: 2889465 - protein, 8 aa, Entamoeba invadens
NQLSGDEM

SEQ ID NO: 2889466 - protein, 7 aa, Entamoeba invadens
NQLSQSN

SEQ ID NO: 2889467 - protein, 5 aa, Entamoeba invadens
NQLSS

SEQ ID NO: 2889468 - protein, 4 aa, Entamoeba invadens
NQLT

SEQ ID NO: 2889469 - protein, 17 aa, Entamoeba invadens
NQLTESKKTLKSPSQVQ

SEQ ID NO: 2889470 - protein, 22 aa, Entamoeba invadens
NQMGGQQNQMNTQGQQQGQQQN

SEQ ID NO: 2889471 - protein, 6 aa, Entamoeba invadens
NQMNET

SEQ ID NO: 2889472 - protein, 5 aa, Entamoeba invadens
NQMPT

SEQ ID NO: 2889473 - protein, 7 aa, Entamoeba invadens
NQMSETE

SEQ ID NO: 2889474 - protein, 7 aa, Entamoeba invadens
NQMSGKE

SEQ ID NO: 2889475 - protein, 7 aa, Entamoeba invadens
NQNAKDN

SEQ ID NO: 2889476 - protein, 8 aa, Entamoeba invadens
NQNAQNYS

SEQ ID NO: 2889477 - protein, 4 aa, Entamoeba invadens
NQND

SEQ ID NO: 2889478 - protein, 10 aa, Entamoeba invadens
NQNDRHDNTS

SEQ ID NO: 2889479 - protein, 25 aa, Entamoeba invadens
NQNEDSNDSLSRSVSRSASRSSSAM

SEQ ID NO: 2889480 - protein, 11 aa, Entamoeba invadens
NQNEEEAKSLK

SEQ ID NO: 2889481 - protein, 13 aa, Entamoeba invadens
NQNEQHGGQSIPN

SEQ ID NO: 2889482 - protein, 5 aa, Entamoeba invadens
NQNEV

SEQ ID NO: 2889483 - protein, 11 aa, Entamoeba invadens
NQNFSQPEKVQ

SEQ ID NO: 2889484 - protein, 4 aa, Entamoeba invadens
NQNG

SEQ ID NO: 2889485 - protein, 9 aa, Entamoeba invadens
NQNGELTLR

SEQ ID NO: 2889486 - protein, 12 aa, Entamoeba invadens
NQNGEYNDKRIP

SEQ ID NO: 2889487 - protein, 6 aa, Entamoeba invadens
NQNGKL

SEQ ID NO: 2889488 - protein, 9 aa, Entamoeba invadens
NQNGNFPQK

SEQ ID NO: 2889489 - protein, 8 aa, Entamoeba invadens
NQNGNQNT

SEQ ID NO: 2889490 - protein, 8 aa, Entamoeba invadens
NQNIPYDR

SEQ ID NO: 2889491 - protein, 9 aa, Entamoeba invadens
NQNKNEEYE

SEQ ID NO: 2889492 - protein, 8 aa, Entamoeba invadens
NQNKSSLH

SEQ ID NO: 2889493 - protein, 14 aa, Entamoeba invadens
NQNLRTEKKLEREC

SEQ ID NO: 2889494 - protein, 8 aa, Entamoeba invadens
NQNNENAE

SEQ ID NO: 2889495 - protein, 11 aa, Entamoeba invadens
NQNNSDNLKEN

SEQ ID NO: 2889496 - protein, 13 aa, Entamoeba invadens
NQNNSEKQRLNSP

SEQ ID NO: 2889497 - protein, 7 aa, Entamoeba invadens
NQNPEFK

SEQ ID NO: 2889498 - protein, 5 aa, Entamoeba invadens
NQNPH

SEQ ID NO: 2889499 - protein, 8 aa, Entamoeba invadens
NQNPKERL

SEQ ID NO: 2889500 - protein, 11 aa, Entamoeba invadens
NQNPSSVKTPL

SEQ ID NO: 2889501 - protein, 7 aa, Entamoeba invadens
NQNRHGN

SEQ ID NO: 2889502 - protein, 10 aa, Entamoeba invadens
NQNSNLMEEE

SEQ ID NO: 2889503 - protein, 10 aa, Entamoeba invadens
NQNSSTNTYS

SEQ ID NO: 2889504 - protein, 18 aa, Entamoeba invadens
NQNTCDSCSGSNAVCTTQ

SEQ ID NO: 2889505 - protein, 11 aa, Entamoeba invadens
NQNTISGGLSG

SEQ ID NO: 2889506 - protein, 6 aa, Entamoeba invadens
NQNTKE

SEQ ID NO: 2889507 - protein, 6 aa, Entamoeba invadens
NQNTRV

SEQ ID NO: 2889508 - protein, 24 aa, Entamoeba invadens
NQNTSEELTSIPSDITEINSNLNL

SEQ ID NO: 2889509 - protein, 7 aa, Entamoeba invadens
NQNTVYN

SEQ ID NO: 2889510 - protein, 5 aa, Entamoeba invadens
NQNVQ

SEQ ID NO: 2889511 - protein, 4 aa, Entamoeba invadens
NQNY

SEQ ID NO: 2889512 - protein, 9 aa, Entamoeba invadens
NQNYPSPQC

SEQ ID NO: 2889513 - protein, 8 aa, Entamoeba invadens
NQPAKPFQ

SEQ ID NO: 2889514 - protein, 5 aa, Entamoeba invadens
NQPDV

SEQ ID NO: 2889515 - protein, 11 aa, Entamoeba invadens
NQPEIKQNQIY

SEQ ID NO: 2889516 - protein, 5 aa, Entamoeba invadens
NQPEW

SEQ ID NO: 2889517 - protein, 5 aa, Entamoeba invadens
NQPHI

SEQ ID NO: 2889518 - protein, 6 aa, Entamoeba invadens
NQPLYQ

SEQ ID NO: 2889519 - protein, 15 aa, Entamoeba invadens
NQPMGQPAAPTSDFV

SEQ ID NO: 2889520 - protein, 7 aa, Entamoeba invadens
NQPNDRR

SEQ ID NO: 2889521 - protein, 15 aa, Entamoeba invadens
NQPNPDSPANTEAAE

SEQ ID NO: 2889522 - protein, 9 aa, Entamoeba invadens
NQPNSTNQI

SEQ ID NO: 2889523 - protein, 20 aa, Entamoeba invadens
NQPPIGYENTNTAINEKPYD

SEQ ID NO: 2889524 - protein, 12 aa, Entamoeba invadens
NQPPKEQTPPMS

SEQ ID NO: 2889525 - protein, 6 aa, Entamoeba invadens
NQPQNL

SEQ ID NO: 2889526 - protein, 6 aa, Entamoeba invadens
NQPTTF

SEQ ID NO: 2889527 - protein, 4 aa, Entamoeba invadens
NQQA

SEQ ID NO: 2889528 - protein, 6 aa, Entamoeba invadens
NQQDER

SEQ ID NO: 2889529 - protein, 36 aa, Entamoeba invadens
NQQESIQPKQRRSRHDATHKDKNTEIDSLKESGNES

SEQ ID NO: 2889530 - protein, 6 aa, Entamoeba invadens
NQQETF

SEQ ID NO: 2889531 - protein, 8 aa, Entamoeba invadens
NQQGTASV

SEQ ID NO: 2889532 - protein, 4 aa, Entamoeba invadens
NQQI

SEQ ID NO: 2889533 - protein, 11 aa, Entamoeba invadens
NQQINQQMGQP

SEQ ID NO: 2889534 - protein, 5 aa, Entamoeba invadens
NQQKI

SEQ ID NO: 2889535 - protein, 7 aa, Entamoeba invadens
NQQKTKR

SEQ ID NO: 2889536 - protein, 13 aa, Entamoeba invadens
NQQKTSGKNARFN

SEQ ID NO: 2889537 - protein, 5 aa, Entamoeba invadens
NQQLE

SEQ ID NO: 2889538 - protein, 17 aa, Entamoeba invadens
NQQLEEATKQKEEIEQK

SEQ ID NO: 2889539 - protein, 4 aa, Entamoeba invadens
NQQN

SEQ ID NO: 2889540 - protein, 31 aa, Entamoeba invadens
NQQNEEIKSPKFGSKTREDKKEDISGVGSPK

SEQ ID NO: 2889541 - protein, 18 aa, Entamoeba invadens
NQQPTVVQQQANTSIGTA

SEQ ID NO: 2889542 - protein, 25 aa, Entamoeba invadens
NQQQPKKKKDALEDDTSTEDITQTD

SEQ ID NO: 2889543 - protein, 16 aa, Entamoeba invadens
NQQQRQQQVQPPPPQY

SEQ ID NO: 2889544 - protein, 20 aa, Entamoeba invadens
NQQREPYQTRRLTPTDDIIE

SEQ ID NO: 2889545 - protein, 5 aa, Entamoeba invadens
NQQRR

SEQ ID NO: 2889546 - protein, 9 aa, Entamoeba invadens
NQQTAKECD

SEQ ID NO: 2889547 - protein, 5 aa, Entamoeba invadens
NQQVG

SEQ ID NO: 2889548 - protein, 7 aa, Entamoeba invadens
NQQWDER

SEQ ID NO: 2889549 - protein, 5 aa, Entamoeba invadens
NQRAQ

SEQ ID NO: 2889550 - protein, 13 aa, Entamoeba invadens
NQRDEEDKIQVSQ

SEQ ID NO: 2889551 - protein, 14 aa, Entamoeba invadens
NQRDEEDKIQVSQR

SEQ ID NO: 2889552 - protein, 5 aa, Entamoeba invadens
NQRES

SEQ ID NO: 2889553 - protein, 22 aa, Entamoeba invadens
NQRLQNGITEHKATIAKKDSVI

SEQ ID NO: 2889554 - protein, 6 aa, Entamoeba invadens
NQRLRR

SEQ ID NO: 2889555 - protein, 6 aa, Entamoeba invadens
NQRNIN

SEQ ID NO: 2889556 - protein, 4 aa, Entamoeba invadens
NQRP

SEQ ID NO: 2889557 - protein, 7 aa, Entamoeba invadens
NQRSSTF

SEQ ID NO: 2889558 - protein, 5 aa, Entamoeba invadens
NQRTV

SEQ ID NO: 2889559 - protein, 4 aa, Entamoeba invadens
NQRV

SEQ ID NO: 2889560 - protein, 6 aa, Entamoeba invadens
NQSDYT

SEQ ID NO: 2889561 - protein, 4 aa, Entamoeba invadens
NQSE

SEQ ID NO: 2889562 - protein, 6 aa, Entamoeba invadens
NQSEKC

SEQ ID NO: 2889563 - protein, 6 aa, Entamoeba invadens
NQSELH

SEQ ID NO: 2889564 - protein, 4 aa, Entamoeba invadens
NQSF

SEQ ID NO: 2889565 - protein, 4 aa, Entamoeba invadens
NQSG

SEQ ID NO: 2889566 - protein, 15 aa, Entamoeba invadens
NQSGGTSESQSFPQD

SEQ ID NO: 2889567 - protein, 8 aa, Entamoeba invadens
NQSGTKTC

SEQ ID NO: 2889568 - protein, 4 aa, Entamoeba invadens
NQSI

SEQ ID NO: 2889569 - protein, 11 aa, Entamoeba invadens
NQSIQNEVGGE

SEQ ID NO: 2889570 - protein, 5 aa, Entamoeba invadens
NQSKF

SEQ ID NO: 2889571 - protein, 9 aa, Entamoeba invadens
NQSLDEATK

SEQ ID NO: 2889572 - protein, 8 aa, Entamoeba invadens
NQSLKSIP

SEQ ID NO: 2889573 - protein, 24 aa, Entamoeba invadens
NQSLYDKKKQAVAESPEYKKEEED

SEQ ID NO: 2889574 - protein, 8 aa, Entamoeba invadens
NQSNGNVI

SEQ ID NO: 2889575 - protein, 9 aa, Entamoeba invadens
NQSNKNKMD

SEQ ID NO: 2889576 - protein, 13 aa, Entamoeba invadens
NQSNLDIRTTNDH

SEQ ID NO: 2889577 - protein, 7 aa, Entamoeba invadens
NQSNLQE

SEQ ID NO: 2889578 - protein, 9 aa, Entamoeba invadens
NQSPNPNPV

SEQ ID NO: 2889579 - protein, 8 aa, Entamoeba invadens
NQSQNDYS

SEQ ID NO: 2889580 - protein, 8 aa, Entamoeba invadens
NQSQRDQF

SEQ ID NO: 2889581 - protein, 16 aa, Entamoeba invadens
NQSQSQQQKISTRVKT

SEQ ID NO: 2889582 - protein, 10 aa, Entamoeba invadens
NQSRYNGSIP

SEQ ID NO: 2889583 - protein, 10 aa, Entamoeba invadens
NQSSAVQSEE

SEQ ID NO: 2889584 - protein, 5 aa, Entamoeba invadens
NQSSD

SEQ ID NO: 2889585 - protein, 7 aa, Entamoeba invadens
NQSSLQS

SEQ ID NO: 2889586 - protein, 7 aa, Entamoeba invadens
NQSTTTF

SEQ ID NO: 2889587 - protein, 4 aa, Entamoeba invadens
NQSV

SEQ ID NO: 2889588 - protein, 9 aa, Entamoeba invadens
NQSVETQQA

SEQ ID NO: 2889589 - protein, 15 aa, Entamoeba invadens
NQSVVESTKIDNSAI

SEQ ID NO: 2889590 - protein, 6 aa, Entamoeba invadens
NQSYSN

SEQ ID NO: 2889591 - protein, 13 aa, Entamoeba invadens
NQSYSPELNTVVL

SEQ ID NO: 2889592 - protein, 10 aa, Entamoeba invadens
NQSYYTSNGT

SEQ ID NO: 2889593 - protein, 35 aa, Entamoeba invadens
NQTAETAAPVAAAAAQPTAQAAAPPKKEKKGKCTL

SEQ ID NO: 2889594 - protein, 5 aa, Entamoeba invadens
NQTDI

SEQ ID NO: 2889595 - protein, 9 aa, Entamoeba invadens
NQTDKHKNT

SEQ ID NO: 2889596 - protein, 4 aa, Entamoeba invadens
NQTE

SEQ ID NO: 2889597 - protein, 34 aa, Entamoeba invadens
NQTEDNPIKPKPKEIVENPQSKEKKIEKVNKSNF

SEQ ID NO: 2889598 - protein, 4 aa, Entamoeba invadens
NQTF

SEQ ID NO: 2889599 - protein, 6 aa, Entamoeba invadens
NQTGMQ

SEQ ID NO: 2889600 - protein, 6 aa, Entamoeba invadens
NQTHYS

SEQ ID NO: 2889601 - protein, 5 aa, Entamoeba invadens
NQTIK

SEQ ID NO: 2889602 - protein, 7 aa, Entamoeba invadens
NQTISHP

SEQ ID NO: 2889603 - protein, 5 aa, Entamoeba invadens
NQTLI

SEQ ID NO: 2889604 - protein, 6 aa, Entamoeba invadens
NQTNEI

SEQ ID NO: 2889605 - protein, 7 aa, Entamoeba invadens
NQTNTAR

SEQ ID NO: 2889606 - protein, 10 aa, Entamoeba invadens
NQTNTPSQFG

SEQ ID NO: 2889607 - protein, 7 aa, Entamoeba invadens
NQTPGGV

SEQ ID NO: 2889608 - protein, 5 aa, Entamoeba invadens
NQTPH

SEQ ID NO: 2889609 - protein, 12 aa, Entamoeba invadens
NQTPPVNSTQSA

SEQ ID NO: 2889610 - protein, 13 aa, Entamoeba invadens
NQTPYYQTQGEDI

SEQ ID NO: 2889611 - protein, 4 aa, Entamoeba invadens
NQTQ

SEQ ID NO: 2889612 - protein, 8 aa, Entamoeba invadens
NQTQQTFS

SEQ ID NO: 2889613 - protein, 4 aa, Entamoeba invadens
NQTS

SEQ ID NO: 2889614 - protein, 4 aa, Entamoeba invadens
NQTT

SEQ ID NO: 2889615 - protein, 5 aa, Entamoeba invadens
NQTTC

SEQ ID NO: 2889616 - protein, 15 aa, Entamoeba invadens
NQTTEKRETKTKKER

SEQ ID NO: 2889617 - protein, 10 aa, Entamoeba invadens
NQTTKRATQT

SEQ ID NO: 2889618 - protein, 9 aa, Entamoeba invadens
NQTTTSQKI

SEQ ID NO: 2889619 - protein, 17 aa, Entamoeba invadens
NQTYSKYKDYTGSKYEK

SEQ ID NO: 2889620 - protein, 7 aa, Entamoeba invadens
NQTYSTF

SEQ ID NO: 2889621 - protein, 6 aa, Entamoeba invadens
NQVDKS

SEQ ID NO: 2889622 - protein, 7 aa, Entamoeba invadens
NQVDQSS

SEQ ID NO: 2889623 - protein, 16 aa, Entamoeba invadens
NQVEDSSEEEEDTGDL

SEQ ID NO: 2889624 - protein, 7 aa, Entamoeba invadens
NQVRTQP

SEQ ID NO: 2889625 - protein, 7 aa, Entamoeba invadens
NQVTPQS

SEQ ID NO: 2889626 - protein, 6 aa, Entamoeba invadens
NQVTSD

SEQ ID NO: 2889627 - protein, 9 aa, Entamoeba invadens
NQYNPEKNE

SEQ ID NO: 2889628 - protein, 6 aa, Entamoeba invadens
NQYQDT

SEQ ID NO: 2889629 - protein, 4 aa, Entamoeba invadens
NQYS

SEQ ID NO: 2889630 - protein, 8 aa, Entamoeba invadens
NRAAKENR

SEQ ID NO: 2889631 - protein, 6 aa, Entamoeba invadens
NRAEDI

SEQ ID NO: 2889632 - protein, 14 aa, Entamoeba invadens
NRAEFTKDEKKKKI

SEQ ID NO: 2889633 - protein, 4 aa, Entamoeba invadens
NRAH

SEQ ID NO: 2889634 - protein, 12 aa, Entamoeba invadens
NRAIQSGSSTKC

SEQ ID NO: 2889635 - protein, 5 aa, Entamoeba invadens
NRANL

SEQ ID NO: 2889636 - protein, 9 aa, Entamoeba invadens
NRANSQTMA

SEQ ID NO: 2889637 - protein, 15 aa, Entamoeba invadens
NRANVGNKVADGEDP

SEQ ID NO: 2889638 - protein, 26 aa, Entamoeba invadens
NRAPAPRESSLGELKEESQSPMSEAD

SEQ ID NO: 2889639 - protein, 5 aa, Entamoeba invadens
NRARG

SEQ ID NO: 2889640 - protein, 6 aa, Entamoeba invadens
NRASRD

SEQ ID NO: 2889641 - protein, 8 aa, Entamoeba invadens
NRATERGS

SEQ ID NO: 2889642 - protein, 6 aa, Entamoeba invadens
NRATHI

SEQ ID NO: 2889643 - protein, 5 aa, Entamoeba invadens
NRCTH

SEQ ID NO: 2889644 - protein, 10 aa, Entamoeba invadens
NRDAKGRIDF

SEQ ID NO: 2889645 - protein, 15 aa, Entamoeba invadens
NRDAKGRIDYNSPKR

SEQ ID NO: 2889646 - protein, 13 aa, Entamoeba invadens
NRDDKEESRRASA

SEQ ID NO: 2889647 - protein, 12 aa, Entamoeba invadens
NRDDTSSKQLHP

SEQ ID NO: 2889648 - protein, 8 aa, Entamoeba invadens
NRDDYASK

SEQ ID NO: 2889649 - protein, 5 aa, Entamoeba invadens
NRDEA

SEQ ID NO: 2889650 - protein, 11 aa, Entamoeba invadens
NRDEKSRKTHF

SEQ ID NO: 2889651 - protein, 10 aa, Entamoeba invadens
NRDETISEKV

SEQ ID NO: 2889652 - protein, 8 aa, Entamoeba invadens
NRDETTRK

SEQ ID NO: 2889653 - protein, 4 aa, Entamoeba invadens
NRDF

SEQ ID NO: 2889654 - protein, 12 aa, Entamoeba invadens
NRDIKGSPWVQN

SEQ ID NO: 2889655 - protein, 9 aa, Entamoeba invadens
NRDKAEELA

SEQ ID NO: 2889656 - protein, 11 aa, Entamoeba invadens
NRDKEVGYVQG

SEQ ID NO: 2889657 - protein, 5 aa, Entamoeba invadens
NRDKI

SEQ ID NO: 2889658 - protein, 7 aa, Entamoeba invadens
NRDQRLA

SEQ ID NO: 2889659 - protein, 7 aa, Entamoeba invadens
NRDSLSV

SEQ ID NO: 2889660 - protein, 8 aa, Entamoeba invadens
NRDTKITS

SEQ ID NO: 2889661 - protein, 7 aa, Entamoeba invadens
NRDTNQT

SEQ ID NO: 2889662 - protein, 4 aa, Entamoeba invadens
NRDW

SEQ ID NO: 2889663 - protein, 9 aa, Entamoeba invadens
NREFTYPDK

SEQ ID NO: 2889664 - protein, 6 aa, Entamoeba invadens
NREGDI

SEQ ID NO: 2889665 - protein, 55 aa, Entamoeba invadens
NREGENRINEDERTSGDEKNDGMSEEKEHNEIDKRESGRNESTDEAKKTKEEVEE

SEQ ID NO: 2889666 - protein, 6 aa, Entamoeba invadens
NREGIR

SEQ ID NO: 2889667 - protein, 7 aa, Entamoeba invadens
NREGSSY

SEQ ID NO: 2889668 - protein, 5 aa, Entamoeba invadens
NREGY

SEQ ID NO: 2889669 - protein, 5 aa, Entamoeba invadens
NREIV

SEQ ID NO: 2889670 - protein, 13 aa, Entamoeba invadens
NREKVKEEGFTGN

SEQ ID NO: 2889671 - protein, 7 aa, Entamoeba invadens
NREMTQS

SEQ ID NO: 2889672 - protein, 13 aa, Entamoeba invadens
NREMTSKDKEHYR

SEQ ID NO: 2889673 - protein, 4 aa, Entamoeba invadens
NREN

SEQ ID NO: 2889674 - protein, 19 aa, Entamoeba invadens
NRERFSNPQYIKSSDKMHT

SEQ ID NO: 2889675 - protein, 5 aa, Entamoeba invadens
NRERV

SEQ ID NO: 2889676 - protein, 7 aa, Entamoeba invadens
NRESAAK

SEQ ID NO: 2889677 - protein, 12 aa, Entamoeba invadens
NRESEKKNQCVR

SEQ ID NO: 2889678 - protein, 9 aa, Entamoeba invadens
NRESGQEEA

SEQ ID NO: 2889679 - protein, 7 aa, Entamoeba invadens
NRESNTK

SEQ ID NO: 2889680 - protein, 33 aa, Entamoeba invadens
NRESQKLDGKKEKKEKSKKGKKEKKEKKWKEKH

SEQ ID NO: 2889681 - protein, 6 aa, Entamoeba invadens
NRETPL

SEQ ID NO: 2889682 - protein, 28 aa, Entamoeba invadens
NRETPVDEDMTTNSEHNNCSEMEDEKIE

SEQ ID NO: 2889683 - protein, 16 aa, Entamoeba invadens
NRETVAAKETKPIETK

SEQ ID NO: 2889684 - protein, 4 aa, Entamoeba invadens
NREV

SEQ ID NO: 2889685 - protein, 4 aa, Entamoeba invadens
NRFT

SEQ ID NO: 2889686 - protein, 7 aa, Entamoeba invadens
NRFTNRE

SEQ ID NO: 2889687 - protein, 23 aa, Entamoeba invadens
NRGCNTCTNKQYVDSTSKKCVPC

SEQ ID NO: 2889688 - protein, 8 aa, Entamoeba invadens
NRGEGKGM

SEQ ID NO: 2889689 - protein, 5 aa, Entamoeba invadens
NRGER

SEQ ID NO: 2889690 - protein, 6 aa, Entamoeba invadens
NRGFQD

SEQ ID NO: 2889691 - protein, 5 aa, Entamoeba invadens
NRGGA

SEQ ID NO: 2889692 - protein, 5 aa, Entamoeba invadens
NRGGT

SEQ ID NO: 2889693 - protein, 6 aa, Entamoeba invadens
NRGITN

SEQ ID NO: 2889694 - protein, 4 aa, Entamoeba invadens
NRGN

SEQ ID NO: 2889695 - protein, 6 aa, Entamoeba invadens
NRGPKM

SEQ ID NO: 2889696 - protein, 8 aa, Entamoeba invadens
NRGPYAET

SEQ ID NO: 2889697 - protein, 5 aa, Entamoeba invadens
NRGQL

SEQ ID NO: 2889698 - protein, 9 aa, Entamoeba invadens
NRGSGPAVN

SEQ ID NO: 2889699 - protein, 10 aa, Entamoeba invadens
NRGSRYDEEI

SEQ ID NO: 2889700 - protein, 6 aa, Entamoeba invadens
NRGSYQ

SEQ ID NO: 2889701 - protein, 7 aa, Entamoeba invadens
NRGYKPS

SEQ ID NO: 2889702 - protein, 5 aa, Entamoeba invadens
NRGYT

SEQ ID NO: 2889703 - protein, 10 aa, Entamoeba invadens
NRHKHGSNIP

SEQ ID NO: 2889704 - protein, 9 aa, Entamoeba invadens
NRHSKVPSH

SEQ ID NO: 2889705 - protein, 4 aa, Entamoeba invadens
NRIE

SEQ ID NO: 2889706 - protein, 9 aa, Entamoeba invadens
NRINEPLKK

SEQ ID NO: 2889707 - protein, 6 aa, Entamoeba invadens
NRITSS

SEQ ID NO: 2889708 - protein, 6 aa, Entamoeba invadens
NRITTT

SEQ ID NO: 2889709 - protein, 7 aa, Entamoeba invadens
NRITTTQ

SEQ ID NO: 2889710 - protein, 35 aa, Entamoeba invadens
NRKDKKNTVSVGGEYKNDKFNVKGNAKVEGGDRSV

SEQ ID NO: 2889711 - protein, 5 aa, Entamoeba invadens
NRKEE

SEQ ID NO: 2889712 - protein, 6 aa, Entamoeba invadens
NRKEED

SEQ ID NO: 2889713 - protein, 6 aa, Entamoeba invadens
NRKETP

SEQ ID NO: 2889714 - protein, 13 aa, Entamoeba invadens
NRKGDRRNEYYIK

SEQ ID NO: 2889715 - protein, 8 aa, Entamoeba invadens
NRKGFKDP

SEQ ID NO: 2889716 - protein, 20 aa, Entamoeba invadens
NRKGRRPNTNEPTGEAESLY

SEQ ID NO: 2889717 - protein, 9 aa, Entamoeba invadens
NRKHREEQT

SEQ ID NO: 2889718 - protein, 5 aa, Entamoeba invadens
NRKIE

SEQ ID NO: 2889719 - protein, 20 aa, Entamoeba invadens
NRKKEIEKSQNEDDEKLRTL

SEQ ID NO: 2889720 - protein, 8 aa, Entamoeba invadens
NRKKNDLY

SEQ ID NO: 2889721 - protein, 20 aa, Entamoeba invadens
NRKLEEEKKQKELEDKRNQL

SEQ ID NO: 2889722 - protein, 7 aa, Entamoeba invadens
NRKLQTE

SEQ ID NO: 2889723 - protein, 9 aa, Entamoeba invadens
NRKNYSPGD

SEQ ID NO: 2889724 - protein, 12 aa, Entamoeba invadens
NRKPSNDKANLN

SEQ ID NO: 2889725 - protein, 16 aa, Entamoeba invadens
NRKPVPKKICKKCNDG

SEQ ID NO: 2889726 - protein, 7 aa, Entamoeba invadens
NRKQCRE

SEQ ID NO: 2889727 - protein, 21 aa, Entamoeba invadens
NRKREATSTTVDEYKPLRGIS

SEQ ID NO: 2889728 - protein, 13 aa, Entamoeba invadens
NRKRGDLFVTLKI

SEQ ID NO: 2889729 - protein, 8 aa, Entamoeba invadens
NRKSTARE

SEQ ID NO: 2889730 - protein, 8 aa, Entamoeba invadens
NRKTENIK

SEQ ID NO: 2889731 - protein, 8 aa, Entamoeba invadens
NRKTTADQ

SEQ ID NO: 2889732 - protein, 7 aa, Entamoeba invadens
NRKYTKP

SEQ ID NO: 2889733 - protein, 6 aa, Entamoeba invadens
NRLAEP

SEQ ID NO: 2889734 - protein, 8 aa, Entamoeba invadens
NRLDKPRR

SEQ ID NO: 2889735 - protein, 23 aa, Entamoeba invadens
NRLKRTKACDAANTIKHNERQGK

SEQ ID NO: 2889736 - protein, 6 aa, Entamoeba invadens
NRLNEC

SEQ ID NO: 2889737 - protein, 4 aa, Entamoeba invadens
NRLP

SEQ ID NO: 2889738 - protein, 7 aa, Entamoeba invadens
NRLPKSA

SEQ ID NO: 2889739 - protein, 14 aa, Entamoeba invadens
NRLQKRRRAVNEEL

SEQ ID NO: 2889740 - protein, 6 aa, Entamoeba invadens
NRMPSQ

SEQ ID NO: 2889741 - protein, 15 aa, Entamoeba invadens
NRNAEHKKETEKQRK

SEQ ID NO: 2889742 - protein, 4 aa, Entamoeba invadens
NRND

SEQ ID NO: 2889743 - protein, 8 aa, Entamoeba invadens
NRNDDKMP

SEQ ID NO: 2889744 - protein, 5 aa, Entamoeba invadens
NRNDY

SEQ ID NO: 2889745 - protein, 7 aa, Entamoeba invadens
NRNEFTS

SEQ ID NO: 2889746 - protein, 6 aa, Entamoeba invadens
NRNEGI

SEQ ID NO: 2889747 - protein, 5 aa, Entamoeba invadens
NRNEI

SEQ ID NO: 2889748 - protein, 5 aa, Entamoeba invadens
NRNEK

SEQ ID NO: 2889749 - protein, 5 aa, Entamoeba invadens
NRNGC

SEQ ID NO: 2889750 - protein, 8 aa, Entamoeba invadens
NRNKNRNI

SEQ ID NO: 2889751 - protein, 8 aa, Entamoeba invadens
NRNKPVDC

SEQ ID NO: 2889752 - protein, 6 aa, Entamoeba invadens
NRNNCH

SEQ ID NO: 2889753 - protein, 6 aa, Entamoeba invadens
NRNPKM

SEQ ID NO: 2889754 - protein, 6 aa, Entamoeba invadens
NRNRYS

SEQ ID NO: 2889755 - protein, 23 aa, Entamoeba invadens
NRNSNTCPPLQQRDTQTDSQRKI

SEQ ID NO: 2889756 - protein, 5 aa, Entamoeba invadens
NRNST

SEQ ID NO: 2889757 - protein, 8 aa, Entamoeba invadens
NRNTATAV

SEQ ID NO: 2889758 - protein, 7 aa, Entamoeba invadens
NRNTGLI

SEQ ID NO: 2889759 - protein, 8 aa, Entamoeba invadens
NRNTIDKS

SEQ ID NO: 2889760 - protein, 12 aa, Entamoeba invadens
NRNTSKSKQNAN

SEQ ID NO: 2889761 - protein, 18 aa, Entamoeba invadens
NRNVQTNAETAASTNTQA

SEQ ID NO: 2889762 - protein, 5 aa, Entamoeba invadens
NRPAY

SEQ ID NO: 2889763 - protein, 5 aa, Entamoeba invadens
NRPDC

SEQ ID NO: 2889764 - protein, 5 aa, Entamoeba invadens
NRPDI

SEQ ID NO: 2889765 - protein, 8 aa, Entamoeba invadens
NRPDTLDP

SEQ ID NO: 2889766 - protein, 12 aa, Entamoeba invadens
NRPEPIKPEQLA

SEQ ID NO: 2889767 - protein, 13 aa, Entamoeba invadens
NRPIGSNDNSIGF

SEQ ID NO: 2889768 - protein, 104 aa, Entamoeba invadens
NRPKRVPRRTAGYVRNGNRRFNDRREDRRNAPEKKEEKEEKPQKEEKQERQQEERREERPQEERRYKGSAYPRSGNSGYRNQRYDRPRYGGDRNNYGRYEGHYE

SEQ ID NO: 2889769 - protein, 7 aa, Entamoeba invadens
NRPNNRK

SEQ ID NO: 2889770 - protein, 7 aa, Entamoeba invadens
NRPPEGV

SEQ ID NO: 2889771 - protein, 7 aa, Entamoeba invadens
NRPPPPP

SEQ ID NO: 2889772 - protein, 9 aa, Entamoeba invadens
NRPPPPPMS

SEQ ID NO: 2889773 - protein, 121 aa, Entamoeba invadens
NRPPQPDRPSLDRTPNDVRQPIDSRQPLDSRTPLDSRQPPIDPRQPIDSRPPPIDTRPPPMDTRQQETKPEKPMERPLPSDARDQRGSLDRARPPLTDARPPPIQDPRPQSIDRRDPRDPA

SEQ ID NO: 2889774 - protein, 6 aa, Entamoeba invadens
NRPPYM

SEQ ID NO: 2889775 - protein, 6 aa, Entamoeba invadens
NRPRIA

SEQ ID NO: 2889776 - protein, 8 aa, Entamoeba invadens
NRPTYAAY

SEQ ID NO: 2889777 - protein, 5 aa, Entamoeba invadens
NRPVR

SEQ ID NO: 2889778 - protein, 5 aa, Entamoeba invadens
NRPYP

SEQ ID NO: 2889779 - protein, 9 aa, Entamoeba invadens
NRQASGQGY

SEQ ID NO: 2889780 - protein, 11 aa, Entamoeba invadens
NRQETCQKGSL

SEQ ID NO: 2889781 - protein, 12 aa, Entamoeba invadens
NRQEVKTTNPSI

SEQ ID NO: 2889782 - protein, 8 aa, Entamoeba invadens
NRQGRKSV

SEQ ID NO: 2889783 - protein, 8 aa, Entamoeba invadens
NRQHEQRN

SEQ ID NO: 2889784 - protein, 7 aa, Entamoeba invadens
NRQLKYQ

SEQ ID NO: 2889785 - protein, 11 aa, Entamoeba invadens
NRQPEGHLQRS

SEQ ID NO: 2889786 - protein, 7 aa, Entamoeba invadens
NRQPPKY

SEQ ID NO: 2889787 - protein, 6 aa, Entamoeba invadens
NRQQEI

SEQ ID NO: 2889788 - protein, 5 aa, Entamoeba invadens
NRQSA

SEQ ID NO: 2889789 - protein, 4 aa, Entamoeba invadens
NRQT

SEQ ID NO: 2889790 - protein, 11 aa, Entamoeba invadens
NRQTRKNEEIN

SEQ ID NO: 2889791 - protein, 6 aa, Entamoeba invadens
NRRDVK

SEQ ID NO: 2889792 - protein, 13 aa, Entamoeba invadens
NRRENGDSGNETV

SEQ ID NO: 2889793 - protein, 21 aa, Entamoeba invadens
NRRKDIQDDEESEEASDDEWS

SEQ ID NO: 2889794 - protein, 13 aa, Entamoeba invadens
NRRKTRKKHEDDD

SEQ ID NO: 2889795 - protein, 4 aa, Entamoeba invadens
NRRN

SEQ ID NO: 2889796 - protein, 6 aa, Entamoeba invadens
NRRNFT

SEQ ID NO: 2889797 - protein, 6 aa, Entamoeba invadens
NRRSNA

SEQ ID NO: 2889798 - protein, 7 aa, Entamoeba invadens
NRRTPLG

SEQ ID NO: 2889799 - protein, 4 aa, Entamoeba invadens
NRRY

SEQ ID NO: 2889800 - protein, 6 aa, Entamoeba invadens
NRSDKS

SEQ ID NO: 2889801 - protein, 13 aa, Entamoeba invadens
NRSDRVENGKDNF

SEQ ID NO: 2889802 - protein, 11 aa, Entamoeba invadens
NRSETKKSYKT

SEQ ID NO: 2889803 - protein, 15 aa, Entamoeba invadens
NRSETLKQTETNTTE

SEQ ID NO: 2889804 - protein, 9 aa, Entamoeba invadens
NRSFAPTEL

SEQ ID NO: 2889805 - protein, 6 aa, Entamoeba invadens
NRSGED

SEQ ID NO: 2889806 - protein, 9 aa, Entamoeba invadens
NRSGKGTTS

SEQ ID NO: 2889807 - protein, 6 aa, Entamoeba invadens
NRSGLS

SEQ ID NO: 2889808 - protein, 7 aa, Entamoeba invadens
NRSGLSD

SEQ ID NO: 2889809 - protein, 11 aa, Entamoeba invadens
NRSKFKTRSEY

SEQ ID NO: 2889810 - protein, 53 aa, Entamoeba invadens
NRSKTEMKKAKKAAKNSTKQIEKKEKKEQKAFTSEQTKHQKSVDKKEKHRRKV

SEQ ID NO: 2889811 - protein, 6 aa, Entamoeba invadens
NRSNEK

SEQ ID NO: 2889812 - protein, 9 aa, Entamoeba invadens
NRSNQVRRG

SEQ ID NO: 2889813 - protein, 7 aa, Entamoeba invadens
NRSNQYT

SEQ ID NO: 2889814 - protein, 8 aa, Entamoeba invadens
NRSPNAVK

SEQ ID NO: 2889815 - protein, 5 aa, Entamoeba invadens
NRSRR

SEQ ID NO: 2889816 - protein, 9 aa, Entamoeba invadens
NRSSNRNVE

SEQ ID NO: 2889817 - protein, 9 aa, Entamoeba invadens
NRSSSTAST

SEQ ID NO: 2889818 - protein, 4 aa, Entamoeba invadens
NRST

SEQ ID NO: 2889819 - protein, 7 aa, Entamoeba invadens
NRSTIQT

SEQ ID NO: 2889820 - protein, 17 aa, Entamoeba invadens
NRSVAETEYNTTSSRSH

SEQ ID NO: 2889821 - protein, 7 aa, Entamoeba invadens
NRSVNDE

SEQ ID NO: 2889822 - protein, 10 aa, Entamoeba invadens
NRTARATRNR

SEQ ID NO: 2889823 - protein, 11 aa, Entamoeba invadens
NRTARATRNRY

SEQ ID NO: 2889824 - protein, 20 aa, Entamoeba invadens
NRTDEINECEEKARKRDKKF

SEQ ID NO: 2889825 - protein, 5 aa, Entamoeba invadens
NRTFN

SEQ ID NO: 2889826 - protein, 5 aa, Entamoeba invadens
NRTGS

SEQ ID NO: 2889827 - protein, 4 aa, Entamoeba invadens
NRTH

SEQ ID NO: 2889828 - protein, 7 aa, Entamoeba invadens
NRTKDTF

SEQ ID NO: 2889829 - protein, 8 aa, Entamoeba invadens
NRTKEEAE

SEQ ID NO: 2889830 - protein, 8 aa, Entamoeba invadens
NRTKTTGI

SEQ ID NO: 2889831 - protein, 10 aa, Entamoeba invadens
NRTMTEENKS

SEQ ID NO: 2889832 - protein, 11 aa, Entamoeba invadens
NRTPGESVYGE

SEQ ID NO: 2889833 - protein, 8 aa, Entamoeba invadens
NRTPIDSG

SEQ ID NO: 2889834 - protein, 8 aa, Entamoeba invadens
NRTPITKQ

SEQ ID NO: 2889835 - protein, 20 aa, Entamoeba invadens
NRTPIVQRPNEEKVASSVVP

SEQ ID NO: 2889836 - protein, 8 aa, Entamoeba invadens
NRTPQSDV

SEQ ID NO: 2889837 - protein, 8 aa, Entamoeba invadens
NRTPQTDK

SEQ ID NO: 2889838 - protein, 4 aa, Entamoeba invadens
NRTS

SEQ ID NO: 2889839 - protein, 16 aa, Entamoeba invadens
NRTSFTKSSSPLLGQA

SEQ ID NO: 2889840 - protein, 11 aa, Entamoeba invadens
NRTTCEGISTN

SEQ ID NO: 2889841 - protein, 4 aa, Entamoeba invadens
NRTV

SEQ ID NO: 2889842 - protein, 4 aa, Entamoeba invadens
NRVA

SEQ ID NO: 2889843 - protein, 7 aa, Entamoeba invadens
NRVADNY

SEQ ID NO: 2889844 - protein, 11 aa, Entamoeba invadens
NRVADSPNHPV

SEQ ID NO: 2889845 - protein, 5 aa, Entamoeba invadens
NRVGR

SEQ ID NO: 2889846 - protein, 9 aa, Entamoeba invadens
NRVKGTNMA

SEQ ID NO: 2889847 - protein, 4 aa, Entamoeba invadens
NRVQ

SEQ ID NO: 2889848 - protein, 12 aa, Entamoeba invadens
NRYEKRISGNNL

SEQ ID NO: 2889849 - protein, 8 aa, Entamoeba invadens
NRYGRGFS

SEQ ID NO: 2889850 - protein, 4 aa, Entamoeba invadens
NRYN

SEQ ID NO: 2889851 - protein, 5 aa, Entamoeba invadens
NRYSP

SEQ ID NO: 2889852 - protein, 11 aa, Entamoeba invadens
NRYTDRDEIAY

SEQ ID NO: 2889853 - protein, 10 aa, Entamoeba invadens
NSAAKKYDSQ

SEQ ID NO: 2889854 - protein, 8 aa, Entamoeba invadens
NSAAQHTD

SEQ ID NO: 2889855 - protein, 6 aa, Entamoeba invadens
NSADIK

SEQ ID NO: 2889856 - protein, 6 aa, Entamoeba invadens
NSADLS

SEQ ID NO: 2889857 - protein, 4 aa, Entamoeba invadens
NSAE

SEQ ID NO: 2889858 - protein, 5 aa, Entamoeba invadens
NSAEE

SEQ ID NO: 2889859 - protein, 7 aa, Entamoeba invadens
NSAEENS

SEQ ID NO: 2889860 - protein, 23 aa, Entamoeba invadens
NSAEVAAKKRGKSGSHKLPSSPR

SEQ ID NO: 2889861 - protein, 12 aa, Entamoeba invadens
NSAFDGNVMMLK

SEQ ID NO: 2889862 - protein, 9 aa, Entamoeba invadens
NSAFEDNNK

SEQ ID NO: 2889863 - protein, 6 aa, Entamoeba invadens
NSAFSE

SEQ ID NO: 2889864 - protein, 8 aa, Entamoeba invadens
NSAGRGQE

SEQ ID NO: 2889865 - protein, 5 aa, Entamoeba invadens
NSAIE

SEQ ID NO: 2889866 - protein, 7 aa, Entamoeba invadens
NSAKKIT

SEQ ID NO: 2889867 - protein, 5 aa, Entamoeba invadens
NSANA

SEQ ID NO: 2889868 - protein, 6 aa, Entamoeba invadens
NSANTH

SEQ ID NO: 2889869 - protein, 9 aa, Entamoeba invadens
NSAPHSNTE

SEQ ID NO: 2889870 - protein, 17 aa, Entamoeba invadens
NSAPITPRKSTDQNNLD

SEQ ID NO: 2889871 - protein, 5 aa, Entamoeba invadens
NSAPL

SEQ ID NO: 2889872 - protein, 7 aa, Entamoeba invadens
NSAPSVN

SEQ ID NO: 2889873 - protein, 13 aa, Entamoeba invadens
NSAQDPKKNDWRS

SEQ ID NO: 2889874 - protein, 6 aa, Entamoeba invadens
NSAQLS

SEQ ID NO: 2889875 - protein, 6 aa, Entamoeba invadens
NSAREK

SEQ ID NO: 2889876 - protein, 7 aa, Entamoeba invadens
NSARNSI

SEQ ID NO: 2889877 - protein, 13 aa, Entamoeba invadens
NSASAPVKTIWVL

SEQ ID NO: 2889878 - protein, 9 aa, Entamoeba invadens
NSASSKNEV

SEQ ID NO: 2889879 - protein, 8 aa, Entamoeba invadens
NSATKPLL

SEQ ID NO: 2889880 - protein, 8 aa, Entamoeba invadens
NSATSLNY

SEQ ID NO: 2889881 - protein, 8 aa, Entamoeba invadens
NSATYRKS

SEQ ID NO: 2889882 - protein, 11 aa, Entamoeba invadens
NSAYGYDQSQR

SEQ ID NO: 2889883 - protein, 4 aa, Entamoeba invadens
NSCD

SEQ ID NO: 2889884 - protein, 9 aa, Entamoeba invadens
NSCDQSSGL

SEQ ID NO: 2889885 - protein, 5 aa, Entamoeba invadens
NSCEK

SEQ ID NO: 2889886 - protein, 6 aa, Entamoeba invadens
NSCEPT

SEQ ID NO: 2889887 - protein, 9 aa, Entamoeba invadens
NSCSDSTGF

SEQ ID NO: 2889888 - protein, 6 aa, Entamoeba invadens
NSCYTD

SEQ ID NO: 2889889 - protein, 7 aa, Entamoeba invadens
NSDAFSD

SEQ ID NO: 2889890 - protein, 11 aa, Entamoeba invadens
NSDANSNTKNR

SEQ ID NO: 2889891 - protein, 6 aa, Entamoeba invadens
NSDAYQ

SEQ ID NO: 2889892 - protein, 4 aa, Entamoeba invadens
NSDD

SEQ ID NO: 2889893 - protein, 14 aa, Entamoeba invadens
NSDDEKDNTNDISN

SEQ ID NO: 2889894 - protein, 7 aa, Entamoeba invadens
NSDDELN

SEQ ID NO: 2889895 - protein, 6 aa, Entamoeba invadens
NSDDFS

SEQ ID NO: 2889896 - protein, 11 aa, Entamoeba invadens
NSDDKKEDVEE

SEQ ID NO: 2889897 - protein, 12 aa, Entamoeba invadens
NSDDWNKSGSVF

SEQ ID NO: 2889898 - protein, 7 aa, Entamoeba invadens
NSDESFK

SEQ ID NO: 2889899 - protein, 7 aa, Entamoeba invadens
NSDFSER

SEQ ID NO: 2889900 - protein, 11 aa, Entamoeba invadens
NSDFSLKSSAL

SEQ ID NO: 2889901 - protein, 5 aa, Entamoeba invadens
NSDFV

SEQ ID NO: 2889902 - protein, 6 aa, Entamoeba invadens
NSDGTF

SEQ ID NO: 2889903 - protein, 7 aa, Entamoeba invadens
NSDGVWS

SEQ ID NO: 2889904 - protein, 4 aa, Entamoeba invadens
NSDI

SEQ ID NO: 2889905 - protein, 5 aa, Entamoeba invadens
NSDID

SEQ ID NO: 2889906 - protein, 5 aa, Entamoeba invadens
NSDKI

SEQ ID NO: 2889907 - protein, 10 aa, Entamoeba invadens
NSDKKKFQAE

SEQ ID NO: 2889908 - protein, 29 aa, Entamoeba invadens
NSDKNYQPTKQQQQQEQEQEQEQESIGQS

SEQ ID NO: 2889909 - protein, 4 aa, Entamoeba invadens
NSDN

SEQ ID NO: 2889910 - protein, 12 aa, Entamoeba invadens
NSDNIGKLSSPA

SEQ ID NO: 2889911 - protein, 7 aa, Entamoeba invadens
NSDNQKT

SEQ ID NO: 2889912 - protein, 23 aa, Entamoeba invadens
NSDNSDTNDSTPETSGLSLSPPE

SEQ ID NO: 2889913 - protein, 7 aa, Entamoeba invadens
NSDNSQH

SEQ ID NO: 2889914 - protein, 10 aa, Entamoeba invadens
NSDPFQRPTA

SEQ ID NO: 2889915 - protein, 8 aa, Entamoeba invadens
NSDPITIT

SEQ ID NO: 2889916 - protein, 9 aa, Entamoeba invadens
NSDPPTNVK

SEQ ID NO: 2889917 - protein, 4 aa, Entamoeba invadens
NSDQ

SEQ ID NO: 2889918 - protein, 5 aa, Entamoeba invadens
NSDQI

SEQ ID NO: 2889919 - protein, 9 aa, Entamoeba invadens
NSDQNDGAL

SEQ ID NO: 2889920 - protein, 6 aa, Entamoeba invadens
NSDQQN

SEQ ID NO: 2889921 - protein, 6 aa, Entamoeba invadens
NSDRID

SEQ ID NO: 2889922 - protein, 22 aa, Entamoeba invadens
NSDSESAEKVPVDRPETPTIDK

SEQ ID NO: 2889923 - protein, 7 aa, Entamoeba invadens
NSDSTVN

SEQ ID NO: 2889924 - protein, 8 aa, Entamoeba invadens
NSDSYTSK

SEQ ID NO: 2889925 - protein, 5 aa, Entamoeba invadens
NSDTD

SEQ ID NO: 2889926 - protein, 15 aa, Entamoeba invadens
NSDTREKVDDRKRVS

SEQ ID NO: 2889927 - protein, 6 aa, Entamoeba invadens
NSDTSF

SEQ ID NO: 2889928 - protein, 6 aa, Entamoeba invadens
NSDTTV

SEQ ID NO: 2889929 - protein, 13 aa, Entamoeba invadens
NSDVNKMDAQNTA

SEQ ID NO: 2889930 - protein, 32 aa, Entamoeba invadens
NSDVSSESHTPTLEHSSDVEFTKSTPMSPMPT

SEQ ID NO: 2889931 - protein, 5 aa, Entamoeba invadens
NSDWA

SEQ ID NO: 2889932 - protein, 6 aa, Entamoeba invadens
NSDYKD

SEQ ID NO: 2889933 - protein, 17 aa, Entamoeba invadens
NSEAERDKFYDSVTPFL

SEQ ID NO: 2889934 - protein, 8 aa, Entamoeba invadens
NSEAHKTL

SEQ ID NO: 2889935 - protein, 9 aa, Entamoeba invadens
NSEANGRDV

SEQ ID NO: 2889936 - protein, 7 aa, Entamoeba invadens
NSEAQEV

SEQ ID NO: 2889937 - protein, 9 aa, Entamoeba invadens
NSECPETMN

SEQ ID NO: 2889938 - protein, 4 aa, Entamoeba invadens
NSED

SEQ ID NO: 2889939 - protein, 14 aa, Entamoeba invadens
NSEDEDVDSNNSEC

SEQ ID NO: 2889940 - protein, 7 aa, Entamoeba invadens
NSEDESV

SEQ ID NO: 2889941 - protein, 4 aa, Entamoeba invadens
NSEE

SEQ ID NO: 2889942 - protein, 6 aa, Entamoeba invadens
NSEEDY

SEQ ID NO: 2889943 - protein, 6 aa, Entamoeba invadens
NSEEEL

SEQ ID NO: 2889944 - protein, 8 aa, Entamoeba invadens
NSEEETQH

SEQ ID NO: 2889945 - protein, 7 aa, Entamoeba invadens
NSEEGSV

SEQ ID NO: 2889946 - protein, 8 aa, Entamoeba invadens
NSEESRFR

SEQ ID NO: 2889947 - protein, 15 aa, Entamoeba invadens
NSEEYKQLSDEENSC

SEQ ID NO: 2889948 - protein, 5 aa, Entamoeba invadens
NSEGM

SEQ ID NO: 2889949 - protein, 6 aa, Entamoeba invadens
NSEGYY

SEQ ID NO: 2889950 - protein, 4 aa, Entamoeba invadens
NSEI

SEQ ID NO: 2889951 - protein, 20 aa, Entamoeba invadens
NSEIQKGGKLAAIKTKNPCP

SEQ ID NO: 2889952 - protein, 13 aa, Entamoeba invadens
NSEKADKKAKEIG

SEQ ID NO: 2889953 - protein, 12 aa, Entamoeba invadens
NSEKDELEDKNR

SEQ ID NO: 2889954 - protein, 16 aa, Entamoeba invadens
NSEKDELEDKNRKIAE

SEQ ID NO: 2889955 - protein, 15 aa, Entamoeba invadens
NSEKDELEDKNRKLD

SEQ ID NO: 2889956 - protein, 15 aa, Entamoeba invadens
NSEKDGSAAPTTPHS

SEQ ID NO: 2889957 - protein, 6 aa, Entamoeba invadens
NSEKEV

SEQ ID NO: 2889958 - protein, 25 aa, Entamoeba invadens
NSEKIKDQVEKSNRKLYGFKKSTMT

SEQ ID NO: 2889959 - protein, 14 aa, Entamoeba invadens
NSENGVNAIKEASD

SEQ ID NO: 2889960 - protein, 7 aa, Entamoeba invadens
NSENNQA

SEQ ID NO: 2889961 - protein, 12 aa, Entamoeba invadens
NSENVKDNELER

SEQ ID NO: 2889962 - protein, 9 aa, Entamoeba invadens
NSEPKGMPG

SEQ ID NO: 2889963 - protein, 6 aa, Entamoeba invadens
NSEPLP

SEQ ID NO: 2889964 - protein, 15 aa, Entamoeba invadens
NSEQEDLTNYKPTSM

SEQ ID NO: 2889965 - protein, 7 aa, Entamoeba invadens
NSEQESS

SEQ ID NO: 2889966 - protein, 10 aa, Entamoeba invadens
NSERDQKDLE

SEQ ID NO: 2889967 - protein, 18 aa, Entamoeba invadens
NSERITKEEQETREKGEQ

SEQ ID NO: 2889968 - protein, 7 aa, Entamoeba invadens
NSERNET

SEQ ID NO: 2889969 - protein, 14 aa, Entamoeba invadens
NSERQEVHAEPHQP

SEQ ID NO: 2889970 - protein, 14 aa, Entamoeba invadens
NSESCVRNGDLQGT

SEQ ID NO: 2889971 - protein, 5 aa, Entamoeba invadens
NSESD

SEQ ID NO: 2889972 - protein, 19 aa, Entamoeba invadens
NSESEKDQFKTETKAKSYQ

SEQ ID NO: 2889973 - protein, 13 aa, Entamoeba invadens
NSESFDIKPNENL

SEQ ID NO: 2889974 - protein, 10 aa, Entamoeba invadens
NSESMTPSEI

SEQ ID NO: 2889975 - protein, 9 aa, Entamoeba invadens
NSESSEFSG

SEQ ID NO: 2889976 - protein, 22 aa, Entamoeba invadens
NSESTQEVSELPTEENNGNDGW

SEQ ID NO: 2889977 - protein, 6 aa, Entamoeba invadens
NSESVA

SEQ ID NO: 2889978 - protein, 12 aa, Entamoeba invadens
NSESVEKKSELK

SEQ ID NO: 2889979 - protein, 6 aa, Entamoeba invadens
NSESYE

SEQ ID NO: 2889980 - protein, 6 aa, Entamoeba invadens
NSETAR

SEQ ID NO: 2889981 - protein, 18 aa, Entamoeba invadens
NSETDKEQYEKIQSSKRK

SEQ ID NO: 2889982 - protein, 6 aa, Entamoeba invadens
NSETKN

SEQ ID NO: 2889983 - protein, 10 aa, Entamoeba invadens
NSETNSPRMS

SEQ ID NO: 2889984 - protein, 8 aa, Entamoeba invadens
NSETSPLK

SEQ ID NO: 2889985 - protein, 14 aa, Entamoeba invadens
NSETTENINKNKID

SEQ ID NO: 2889986 - protein, 14 aa, Entamoeba invadens
NSETVCSKSATINN

SEQ ID NO: 2889987 - protein, 5 aa, Entamoeba invadens
NSEVF

SEQ ID NO: 2889988 - protein, 9 aa, Entamoeba invadens
NSEWEDTPV

SEQ ID NO: 2889989 - protein, 8 aa, Entamoeba invadens
NSEYETVR

SEQ ID NO: 2889990 - protein, 7 aa, Entamoeba invadens
NSFDSSC

SEQ ID NO: 2889991 - protein, 13 aa, Entamoeba invadens
NSFDTQHDATIGS

SEQ ID NO: 2889992 - protein, 11 aa, Entamoeba invadens
NSFEGRSRSCR

SEQ ID NO: 2889993 - protein, 5 aa, Entamoeba invadens
NSFEK

SEQ ID NO: 2889994 - protein, 6 aa, Entamoeba invadens
NSFENT

SEQ ID NO: 2889995 - protein, 7 aa, Entamoeba invadens
NSFEYEG

SEQ ID NO: 2889996 - protein, 6 aa, Entamoeba invadens
NSFGAT

SEQ ID NO: 2889997 - protein, 13 aa, Entamoeba invadens
NSFGQVGESQIHY

SEQ ID NO: 2889998 - protein, 8 aa, Entamoeba invadens
NSFKPSHP

SEQ ID NO: 2889999 - protein, 5 aa, Entamoeba invadens
NSFLN

SEQ ID NO: 2890000 - protein, 8 aa, Entamoeba invadens
NSFLPPSA

SEQ ID NO: 2890001 - protein, 5 aa, Entamoeba invadens
NSFNN

SEQ ID NO: 2890002 - protein, 9 aa, Entamoeba invadens
NSFPQTPHQ

SEQ ID NO: 2890003 - protein, 6 aa, Entamoeba invadens
NSFPTE

SEQ ID NO: 2890004 - protein, 14 aa, Entamoeba invadens
NSFQPVTSARYSTT

SEQ ID NO: 2890005 - protein, 8 aa, Entamoeba invadens
NSFQSLNS

SEQ ID NO: 2890006 - protein, 21 aa, Entamoeba invadens
NSFRKRPHGNEDFEARRDCKN

SEQ ID NO: 2890007 - protein, 7 aa, Entamoeba invadens
NSFRPEI

SEQ ID NO: 2890008 - protein, 4 aa, Entamoeba invadens
NSFS

SEQ ID NO: 2890009 - protein, 16 aa, Entamoeba invadens
NSFSKGSNKLECTIIA

SEQ ID NO: 2890010 - protein, 17 aa, Entamoeba invadens
NSFSNSSQRKRVYSPRR

SEQ ID NO: 2890011 - protein, 5 aa, Entamoeba invadens
NSFSS

SEQ ID NO: 2890012 - protein, 4 aa, Entamoeba invadens
NSFT

SEQ ID NO: 2890013 - protein, 7 aa, Entamoeba invadens
NSFTDEE

SEQ ID NO: 2890014 - protein, 7 aa, Entamoeba invadens
NSFTFST

SEQ ID NO: 2890015 - protein, 6 aa, Entamoeba invadens
NSFTGE

SEQ ID NO: 2890016 - protein, 11 aa, Entamoeba invadens
NSFTQEHPSDL

SEQ ID NO: 2890017 - protein, 7 aa, Entamoeba invadens
NSGAETA

SEQ ID NO: 2890018 - protein, 8 aa, Entamoeba invadens
NSGAKDVV

SEQ ID NO: 2890019 - protein, 6 aa, Entamoeba invadens
NSGATH

SEQ ID NO: 2890020 - protein, 9 aa, Entamoeba invadens
NSGDKAKFE

SEQ ID NO: 2890021 - protein, 16 aa, Entamoeba invadens
NSGEEALGKSYDGLGY

SEQ ID NO: 2890022 - protein, 8 aa, Entamoeba invadens
NSGEERNI

SEQ ID NO: 2890023 - protein, 8 aa, Entamoeba invadens
NSGEIKEG

SEQ ID NO: 2890024 - protein, 7 aa, Entamoeba invadens
NSGETLP

SEQ ID NO: 2890025 - protein, 5 aa, Entamoeba invadens
NSGHY

SEQ ID NO: 2890026 - protein, 5 aa, Entamoeba invadens
NSGIR

SEQ ID NO: 2890027 - protein, 8 aa, Entamoeba invadens
NSGKQKPW

SEQ ID NO: 2890028 - protein, 5 aa, Entamoeba invadens
NSGKR

SEQ ID NO: 2890029 - protein, 14 aa, Entamoeba invadens
NSGKRNISNKIGRE

SEQ ID NO: 2890030 - protein, 14 aa, Entamoeba invadens
NSGKRSGEDPEETK

SEQ ID NO: 2890031 - protein, 11 aa, Entamoeba invadens
NSGKSTKMPVA

SEQ ID NO: 2890032 - protein, 9 aa, Entamoeba invadens
NSGKTYTLE

SEQ ID NO: 2890033 - protein, 4 aa, Entamoeba invadens
NSGL

SEQ ID NO: 2890034 - protein, 5 aa, Entamoeba invadens
NSGLN

SEQ ID NO: 2890035 - protein, 6 aa, Entamoeba invadens
NSGLSV

SEQ ID NO: 2890036 - protein, 6 aa, Entamoeba invadens
NSGLTE

SEQ ID NO: 2890037 - protein, 18 aa, Entamoeba invadens
NSGNGENRNFLMKLLAEE

SEQ ID NO: 2890038 - protein, 11 aa, Entamoeba invadens
NSGNYKKPADV

SEQ ID NO: 2890039 - protein, 4 aa, Entamoeba invadens
NSGP

SEQ ID NO: 2890040 - protein, 9 aa, Entamoeba invadens
NSGPNTNGS

SEQ ID NO: 2890041 - protein, 7 aa, Entamoeba invadens
NSGRFNS

SEQ ID NO: 2890042 - protein, 19 aa, Entamoeba invadens
NSGSGKNYHTGYGEGDTVG

SEQ ID NO: 2890043 - protein, 4 aa, Entamoeba invadens
NSGT

SEQ ID NO: 2890044 - protein, 16 aa, Entamoeba invadens
NSGTPEENTSRSPLPN

SEQ ID NO: 2890045 - protein, 11 aa, Entamoeba invadens
NSGYHTNTTTC

SEQ ID NO: 2890046 - protein, 5 aa, Entamoeba invadens
NSGYY

SEQ ID NO: 2890047 - protein, 15 aa, Entamoeba invadens
NSHAKPEKKKSHCVM

SEQ ID NO: 2890048 - protein, 7 aa, Entamoeba invadens
NSHAQTL

SEQ ID NO: 2890049 - protein, 6 aa, Entamoeba invadens
NSHDVN

SEQ ID NO: 2890050 - protein, 4 aa, Entamoeba invadens
NSHL

SEQ ID NO: 2890051 - protein, 6 aa, Entamoeba invadens
NSIAEQ

SEQ ID NO: 2890052 - protein, 9 aa, Entamoeba invadens
NSIEESETV

SEQ ID NO: 2890053 - protein, 12 aa, Entamoeba invadens
NSIGQDGTMPTL

SEQ ID NO: 2890054 - protein, 6 aa, Entamoeba invadens
NSIGRV

SEQ ID NO: 2890055 - protein, 7 aa, Entamoeba invadens
NSIGYAG

SEQ ID NO: 2890056 - protein, 9 aa, Entamoeba invadens
NSIIEESGI

SEQ ID NO: 2890057 - protein, 4 aa, Entamoeba invadens
NSIN

SEQ ID NO: 2890058 - protein, 5 aa, Entamoeba invadens
NSIND

SEQ ID NO: 2890059 - protein, 5 aa, Entamoeba invadens
NSINE

SEQ ID NO: 2890060 - protein, 14 aa, Entamoeba invadens
NSINNSINTSINTT

SEQ ID NO: 2890061 - protein, 5 aa, Entamoeba invadens
NSIPE

SEQ ID NO: 2890062 - protein, 9 aa, Entamoeba invadens
NSIPTAYAS

SEQ ID NO: 2890063 - protein, 12 aa, Entamoeba invadens
NSIRETQQSNES

SEQ ID NO: 2890064 - protein, 12 aa, Entamoeba invadens
NSIRETRQSNES

SEQ ID NO: 2890065 - protein, 7 aa, Entamoeba invadens
NSIRNIP

SEQ ID NO: 2890066 - protein, 9 aa, Entamoeba invadens
NSISKNENL

SEQ ID NO: 2890067 - protein, 4 aa, Entamoeba invadens
NSIT

SEQ ID NO: 2890068 - protein, 5 aa, Entamoeba invadens
NSKAE

SEQ ID NO: 2890069 - protein, 7 aa, Entamoeba invadens
NSKAYEK

SEQ ID NO: 2890070 - protein, 7 aa, Entamoeba invadens
NSKCESL

SEQ ID NO: 2890071 - protein, 9 aa, Entamoeba invadens
NSKDARKYG

SEQ ID NO: 2890072 - protein, 5 aa, Entamoeba invadens
NSKDK

SEQ ID NO: 2890073 - protein, 15 aa, Entamoeba invadens
NSKDLKDEKSQIEKG

SEQ ID NO: 2890074 - protein, 6 aa, Entamoeba invadens
NSKDLQ

SEQ ID NO: 2890075 - protein, 7 aa, Entamoeba invadens
NSKDPFQ

SEQ ID NO: 2890076 - protein, 11 aa, Entamoeba invadens
NSKDRNTLKKS

SEQ ID NO: 2890077 - protein, 7 aa, Entamoeba invadens
NSKDSCS

SEQ ID NO: 2890078 - protein, 8 aa, Entamoeba invadens
NSKDSECE

SEQ ID NO: 2890079 - protein, 9 aa, Entamoeba invadens
NSKDVTSAR

SEQ ID NO: 2890080 - protein, 21 aa, Entamoeba invadens
NSKEDCKYSRCGRTDKDVSGF

SEQ ID NO: 2890081 - protein, 8 aa, Entamoeba invadens
NSKEITSI

SEQ ID NO: 2890082 - protein, 6 aa, Entamoeba invadens
NSKERA

SEQ ID NO: 2890083 - protein, 8 aa, Entamoeba invadens
NSKESCSV

SEQ ID NO: 2890084 - protein, 10 aa, Entamoeba invadens
NSKGKCEQCA

SEQ ID NO: 2890085 - protein, 7 aa, Entamoeba invadens
NSKGNLG

SEQ ID NO: 2890086 - protein, 6 aa, Entamoeba invadens
NSKGNY

SEQ ID NO: 2890087 - protein, 6 aa, Entamoeba invadens
NSKHRE

SEQ ID NO: 2890088 - protein, 4 aa, Entamoeba invadens
NSKI

SEQ ID NO: 2890089 - protein, 9 aa, Entamoeba invadens
NSKISPRIT

SEQ ID NO: 2890090 - protein, 6 aa, Entamoeba invadens
NSKKAL

SEQ ID NO: 2890091 - protein, 19 aa, Entamoeba invadens
NSKKGEFTSSQYDDFVSPA

SEQ ID NO: 2890092 - protein, 8 aa, Entamoeba invadens
NSKKGQVY

SEQ ID NO: 2890093 - protein, 7 aa, Entamoeba invadens
NSKKICE

SEQ ID NO: 2890094 - protein, 7 aa, Entamoeba invadens
NSKLGTT

SEQ ID NO: 2890095 - protein, 17 aa, Entamoeba invadens
NSKMRKLGSDIKEGKRT

SEQ ID NO: 2890096 - protein, 12 aa, Entamoeba invadens
NSKNESEAIDPI

SEQ ID NO: 2890097 - protein, 7 aa, Entamoeba invadens
NSKNITT

SEQ ID NO: 2890098 - protein, 9 aa, Entamoeba invadens
NSKNKTVKS

SEQ ID NO: 2890099 - protein, 11 aa, Entamoeba invadens
NSKNNEEERQS

SEQ ID NO: 2890100 - protein, 7 aa, Entamoeba invadens
NSKNQDN

SEQ ID NO: 2890101 - protein, 8 aa, Entamoeba invadens
NSKNSEMK

SEQ ID NO: 2890102 - protein, 7 aa, Entamoeba invadens
NSKNVVS

SEQ ID NO: 2890103 - protein, 7 aa, Entamoeba invadens
NSKPESH

SEQ ID NO: 2890104 - protein, 15 aa, Entamoeba invadens
NSKPSEKPKQTSVLS

SEQ ID NO: 2890105 - protein, 7 aa, Entamoeba invadens
NSKQPFE

SEQ ID NO: 2890106 - protein, 6 aa, Entamoeba invadens
NSKQPR

SEQ ID NO: 2890107 - protein, 16 aa, Entamoeba invadens
NSKQRFTIEGDGQDMK

SEQ ID NO: 2890108 - protein, 7 aa, Entamoeba invadens
NSKQSAD

SEQ ID NO: 2890109 - protein, 16 aa, Entamoeba invadens
NSKQTGFYDTSSPVTA

SEQ ID NO: 2890110 - protein, 4 aa, Entamoeba invadens
NSKR

SEQ ID NO: 2890111 - protein, 8 aa, Entamoeba invadens
NSKRALDS

SEQ ID NO: 2890112 - protein, 28 aa, Entamoeba invadens
NSKRDDKKLSDYKHNESDLKKKLTRSSM

SEQ ID NO: 2890113 - protein, 8 aa, Entamoeba invadens
NSKRGTEA

SEQ ID NO: 2890114 - protein, 11 aa, Entamoeba invadens
NSKRKTPSDAT

SEQ ID NO: 2890115 - protein, 5 aa, Entamoeba invadens
NSKRY

SEQ ID NO: 2890116 - protein, 11 aa, Entamoeba invadens
NSKSDEYDEET

SEQ ID NO: 2890117 - protein, 18 aa, Entamoeba invadens
NSKSNNKRTINSGSLEDV

SEQ ID NO: 2890118 - protein, 9 aa, Entamoeba invadens
NSKSRGKEV

SEQ ID NO: 2890119 - protein, 4 aa, Entamoeba invadens
NSKT

SEQ ID NO: 2890120 - protein, 12 aa, Entamoeba invadens
NSKTEENKSDEQ

SEQ ID NO: 2890121 - protein, 55 aa, Entamoeba invadens
NSKTEIQSQESDVKLKTDGIEGHEIERKTQEISDEVKSNVKNVESRQEAHEEQDD

SEQ ID NO: 2890122 - protein, 21 aa, Entamoeba invadens
NSKTGRNDKPVKEVVIADCGQ

SEQ ID NO: 2890123 - protein, 13 aa, Entamoeba invadens
NSKTKEEANKEPL

SEQ ID NO: 2890124 - protein, 6 aa, Entamoeba invadens
NSKTNM

SEQ ID NO: 2890125 - protein, 5 aa, Entamoeba invadens
NSKTR

SEQ ID NO: 2890126 - protein, 5 aa, Entamoeba invadens
NSKTS

SEQ ID NO: 2890127 - protein, 14 aa, Entamoeba invadens
NSKTTINKLVAFTC

SEQ ID NO: 2890128 - protein, 22 aa, Entamoeba invadens
NSKTVTKQHTTNHTAQRGKVNI

SEQ ID NO: 2890129 - protein, 15 aa, Entamoeba invadens
NSKVPQEVKTPTKIE

SEQ ID NO: 2890130 - protein, 8 aa, Entamoeba invadens
NSKYEEKT

SEQ ID NO: 2890131 - protein, 5 aa, Entamoeba invadens
NSKYP

SEQ ID NO: 2890132 - protein, 5 aa, Entamoeba invadens
NSKYR

SEQ ID NO: 2890133 - protein, 4 aa, Entamoeba invadens
NSLA

SEQ ID NO: 2890134 - protein, 12 aa, Entamoeba invadens
NSLANSASNSDA

SEQ ID NO: 2890135 - protein, 6 aa, Entamoeba invadens
NSLETQ

SEQ ID NO: 2890136 - protein, 7 aa, Entamoeba invadens
NSLETST

SEQ ID NO: 2890137 - protein, 4 aa, Entamoeba invadens
NSLG

SEQ ID NO: 2890138 - protein, 13 aa, Entamoeba invadens
NSLGDVEVSNTYS

SEQ ID NO: 2890139 - protein, 5 aa, Entamoeba invadens
NSLGE

SEQ ID NO: 2890140 - protein, 5 aa, Entamoeba invadens
NSLGN

SEQ ID NO: 2890141 - protein, 6 aa, Entamoeba invadens
NSLHDD

SEQ ID NO: 2890142 - protein, 16 aa, Entamoeba invadens
NSLKDNDPLSAADALR

SEQ ID NO: 2890143 - protein, 9 aa, Entamoeba invadens
NSLKNPASL

SEQ ID NO: 2890144 - protein, 14 aa, Entamoeba invadens
NSLNKTKLNDQEIT

SEQ ID NO: 2890145 - protein, 14 aa, Entamoeba invadens
NSLNKTKLNDQKIT

SEQ ID NO: 2890146 - protein, 12 aa, Entamoeba invadens
NSLNSKISSDTD

SEQ ID NO: 2890147 - protein, 12 aa, Entamoeba invadens
NSLNSKISSETD

SEQ ID NO: 2890148 - protein, 11 aa, Entamoeba invadens
NSLNTDDENVG

SEQ ID NO: 2890149 - protein, 16 aa, Entamoeba invadens
NSLPKKETDVESTGLS

SEQ ID NO: 2890150 - protein, 7 aa, Entamoeba invadens
NSLPNFS

SEQ ID NO: 2890151 - protein, 7 aa, Entamoeba invadens
NSLPPGL

SEQ ID NO: 2890152 - protein, 4 aa, Entamoeba invadens
NSLQ

SEQ ID NO: 2890153 - protein, 7 aa, Entamoeba invadens
NSLQDRC

SEQ ID NO: 2890154 - protein, 6 aa, Entamoeba invadens
NSLRNP

SEQ ID NO: 2890155 - protein, 27 aa, Entamoeba invadens
NSLRNSKENRFDKEIERKELRESRDMK

SEQ ID NO: 2890156 - protein, 7 aa, Entamoeba invadens
NSLSARE

SEQ ID NO: 2890157 - protein, 6 aa, Entamoeba invadens
NSLSEF

SEQ ID NO: 2890158 - protein, 5 aa, Entamoeba invadens
NSLSK

SEQ ID NO: 2890159 - protein, 7 aa, Entamoeba invadens
NSLSQDD

SEQ ID NO: 2890160 - protein, 8 aa, Entamoeba invadens
NSLTKTSE

SEQ ID NO: 2890161 - protein, 9 aa, Entamoeba invadens
NSLTQSTAE

SEQ ID NO: 2890162 - protein, 19 aa, Entamoeba invadens
NSMEKGKDIEPSEFSDANV

SEQ ID NO: 2890163 - protein, 18 aa, Entamoeba invadens
NSMENQEKPKPKITTVDK

SEQ ID NO: 2890164 - protein, 43 aa, Entamoeba invadens
NSMESSDSSESPKISKTTNSTGTSQATSTESDSNSTSTTDSIE

SEQ ID NO: 2890165 - protein, 5 aa, Entamoeba invadens
NSMPE

SEQ ID NO: 2890166 - protein, 7 aa, Entamoeba invadens
NSMSDRS

SEQ ID NO: 2890167 - protein, 6 aa, Entamoeba invadens
NSMSPR

SEQ ID NO: 2890168 - protein, 7 aa, Entamoeba invadens
NSNAMNN

SEQ ID NO: 2890169 - protein, 4 aa, Entamoeba invadens
NSND

SEQ ID NO: 2890170 - protein, 11 aa, Entamoeba invadens
NSNDDSSRVVT

SEQ ID NO: 2890171 - protein, 10 aa, Entamoeba invadens
NSNDNGVAGR

SEQ ID NO: 2890172 - protein, 42 aa, Entamoeba invadens
NSNEEVEEDKSSEENDESSDNGDKKKAKKAKKEDKRDKKHHK

SEQ ID NO: 2890173 - protein, 14 aa, Entamoeba invadens
NSNFDTTNITVYQM

SEQ ID NO: 2890174 - protein, 6 aa, Entamoeba invadens
NSNFSR

SEQ ID NO: 2890175 - protein, 6 aa, Entamoeba invadens
NSNGAI

SEQ ID NO: 2890176 - protein, 10 aa, Entamoeba invadens
NSNHDPNKFR

SEQ ID NO: 2890177 - protein, 7 aa, Entamoeba invadens
NSNHPLK

SEQ ID NO: 2890178 - protein, 11 aa, Entamoeba invadens
NSNKESKVANE

SEQ ID NO: 2890179 - protein, 5 aa, Entamoeba invadens
NSNKI

SEQ ID NO: 2890180 - protein, 6 aa, Entamoeba invadens
NSNKLA

SEQ ID NO: 2890181 - protein, 9 aa, Entamoeba invadens
NSNKRNFEI

SEQ ID NO: 2890182 - protein, 8 aa, Entamoeba invadens
NSNKRNYE

SEQ ID NO: 2890183 - protein, 4 aa, Entamoeba invadens
NSNM

SEQ ID NO: 2890184 - protein, 5 aa, Entamoeba invadens
NSNMK

SEQ ID NO: 2890185 - protein, 6 aa, Entamoeba invadens
NSNMTN

SEQ ID NO: 2890186 - protein, 6 aa, Entamoeba invadens
NSNNGD

SEQ ID NO: 2890187 - protein, 8 aa, Entamoeba invadens
NSNNGDVN

SEQ ID NO: 2890188 - protein, 8 aa, Entamoeba invadens
NSNNGLKK

SEQ ID NO: 2890189 - protein, 6 aa, Entamoeba invadens
NSNNIN

SEQ ID NO: 2890190 - protein, 9 aa, Entamoeba invadens
NSNNQNNES

SEQ ID NO: 2890191 - protein, 5 aa, Entamoeba invadens
NSNNT

SEQ ID NO: 2890192 - protein, 13 aa, Entamoeba invadens
NSNPAVFPENSRD

SEQ ID NO: 2890193 - protein, 6 aa, Entamoeba invadens
NSNPIT

SEQ ID NO: 2890194 - protein, 8 aa, Entamoeba invadens
NSNPTSTM

SEQ ID NO: 2890195 - protein, 8 aa, Entamoeba invadens
NSNPTVTN

SEQ ID NO: 2890196 - protein, 10 aa, Entamoeba invadens
NSNQTTDQKK

SEQ ID NO: 2890197 - protein, 8 aa, Entamoeba invadens
NSNSPQNM

SEQ ID NO: 2890198 - protein, 11 aa, Entamoeba invadens
NSNSPSYPTQR

SEQ ID NO: 2890199 - protein, 7 aa, Entamoeba invadens
NSNTELV

SEQ ID NO: 2890200 - protein, 11 aa, Entamoeba invadens
NSNTKNEKTTQ

SEQ ID NO: 2890201 - protein, 23 aa, Entamoeba invadens
NSNTNSESRTPLKTPEKTPEKLS

SEQ ID NO: 2890202 - protein, 11 aa, Entamoeba invadens
NSNTNTKQSAQ

SEQ ID NO: 2890203 - protein, 7 aa, Entamoeba invadens
NSNTSKY

SEQ ID NO: 2890204 - protein, 4 aa, Entamoeba invadens
NSNY

SEQ ID NO: 2890205 - protein, 21 aa, Entamoeba invadens
NSNYERKCTTCNTGYYPNAEG

SEQ ID NO: 2890206 - protein, 27 aa, Entamoeba invadens
NSNYSNASNNSHLSIGQNTSSVESQDV

SEQ ID NO: 2890207 - protein, 4 aa, Entamoeba invadens
NSPC

SEQ ID NO: 2890208 - protein, 5 aa, Entamoeba invadens
NSPDT

SEQ ID NO: 2890209 - protein, 6 aa, Entamoeba invadens
NSPDYV

SEQ ID NO: 2890210 - protein, 4 aa, Entamoeba invadens
NSPE

SEQ ID NO: 2890211 - protein, 23 aa, Entamoeba invadens
NSPEHNDKAGTNISSKSVSADDI

SEQ ID NO: 2890212 - protein, 9 aa, Entamoeba invadens
NSPELKNNP

SEQ ID NO: 2890213 - protein, 7 aa, Entamoeba invadens
NSPENFK

SEQ ID NO: 2890214 - protein, 7 aa, Entamoeba invadens
NSPENRA

SEQ ID NO: 2890215 - protein, 7 aa, Entamoeba invadens
NSPETNA

SEQ ID NO: 2890216 - protein, 4 aa, Entamoeba invadens
NSPF

SEQ ID NO: 2890217 - protein, 11 aa, Entamoeba invadens
NSPFGDEAFTG

SEQ ID NO: 2890218 - protein, 7 aa, Entamoeba invadens
NSPFGKK

SEQ ID NO: 2890219 - protein, 9 aa, Entamoeba invadens
NSPGDDITE

SEQ ID NO: 2890220 - protein, 5 aa, Entamoeba invadens
NSPHP

SEQ ID NO: 2890221 - protein, 6 aa, Entamoeba invadens
NSPIQR

SEQ ID NO: 2890222 - protein, 9 aa, Entamoeba invadens
NSPKDVDSK

SEQ ID NO: 2890223 - protein, 7 aa, Entamoeba invadens
NSPKKID

SEQ ID NO: 2890224 - protein, 10 aa, Entamoeba invadens
NSPKSSKKDV

SEQ ID NO: 2890225 - protein, 4 aa, Entamoeba invadens
NSPL

SEQ ID NO: 2890226 - protein, 5 aa, Entamoeba invadens
NSPLQ

SEQ ID NO: 2890227 - protein, 4 aa, Entamoeba invadens
NSPM

SEQ ID NO: 2890228 - protein, 8 aa, Entamoeba invadens
NSPNAVPK

SEQ ID NO: 2890229 - protein, 8 aa, Entamoeba invadens
NSPNKRED

SEQ ID NO: 2890230 - protein, 5 aa, Entamoeba invadens
NSPPI

SEQ ID NO: 2890231 - protein, 8 aa, Entamoeba invadens
NSPPRSRL

SEQ ID NO: 2890232 - protein, 6 aa, Entamoeba invadens
NSPPTI

SEQ ID NO: 2890233 - protein, 8 aa, Entamoeba invadens
NSPQELSS

SEQ ID NO: 2890234 - protein, 7 aa, Entamoeba invadens
NSPQFDD

SEQ ID NO: 2890235 - protein, 26 aa, Entamoeba invadens
NSPQQQQEETQKSVPAPAELMPPPAD

SEQ ID NO: 2890236 - protein, 10 aa, Entamoeba invadens
NSPRAEEYHD

SEQ ID NO: 2890237 - protein, 6 aa, Entamoeba invadens
NSPREE

SEQ ID NO: 2890238 - protein, 10 aa, Entamoeba invadens
NSPRGRDVSE

SEQ ID NO: 2890239 - protein, 11 aa, Entamoeba invadens
NSPRGRDVSEL

SEQ ID NO: 2890240 - protein, 9 aa, Entamoeba invadens
NSPRQQKVT

SEQ ID NO: 2890241 - protein, 8 aa, Entamoeba invadens
NSPRVPES

SEQ ID NO: 2890242 - protein, 4 aa, Entamoeba invadens
NSPS

SEQ ID NO: 2890243 - protein, 5 aa, Entamoeba invadens
NSPSD

SEQ ID NO: 2890244 - protein, 12 aa, Entamoeba invadens
NSPSKKRHASGV

SEQ ID NO: 2890245 - protein, 8 aa, Entamoeba invadens
NSPSLESV

SEQ ID NO: 2890246 - protein, 5 aa, Entamoeba invadens
NSPSM

SEQ ID NO: 2890247 - protein, 5 aa, Entamoeba invadens
NSPTD

SEQ ID NO: 2890248 - protein, 6 aa, Entamoeba invadens
NSPTNY

SEQ ID NO: 2890249 - protein, 7 aa, Entamoeba invadens
NSPTQEM

SEQ ID NO: 2890250 - protein, 7 aa, Entamoeba invadens
NSPTWPD

SEQ ID NO: 2890251 - protein, 6 aa, Entamoeba invadens
NSPVSI

SEQ ID NO: 2890252 - protein, 5 aa, Entamoeba invadens
NSPYM

SEQ ID NO: 2890253 - protein, 5 aa, Entamoeba invadens
NSQAF

SEQ ID NO: 2890254 - protein, 9 aa, Entamoeba invadens
NSQAGNVFS

SEQ ID NO: 2890255 - protein, 9 aa, Entamoeba invadens
NSQAKTATL

SEQ ID NO: 2890256 - protein, 7 aa, Entamoeba invadens
NSQCQTC

SEQ ID NO: 2890257 - protein, 5 aa, Entamoeba invadens
NSQDL

SEQ ID NO: 2890258 - protein, 8 aa, Entamoeba invadens
NSQDWNIG

SEQ ID NO: 2890259 - protein, 32 aa, Entamoeba invadens
NSQEVSGAPQKGGVAGDAQALQPNTQQRYTTE

SEQ ID NO: 2890260 - protein, 4 aa, Entamoeba invadens
NSQG

SEQ ID NO: 2890261 - protein, 16 aa, Entamoeba invadens
NSQHETPPPQPKKQEA

SEQ ID NO: 2890262 - protein, 5 aa, Entamoeba invadens
NSQID

SEQ ID NO: 2890263 - protein, 5 aa, Entamoeba invadens
NSQIE

SEQ ID NO: 2890264 - protein, 8 aa, Entamoeba invadens
NSQISESA

SEQ ID NO: 2890265 - protein, 5 aa, Entamoeba invadens
NSQIT

SEQ ID NO: 2890266 - protein, 9 aa, Entamoeba invadens
NSQKAFSSG

SEQ ID NO: 2890267 - protein, 9 aa, Entamoeba invadens
NSQKEDDEI

SEQ ID NO: 2890268 - protein, 18 aa, Entamoeba invadens
NSQKERDAKTLSGGEKSF

SEQ ID NO: 2890269 - protein, 5 aa, Entamoeba invadens
NSQKI

SEQ ID NO: 2890270 - protein, 14 aa, Entamoeba invadens
NSQKNTRISSSSRL

SEQ ID NO: 2890271 - protein, 8 aa, Entamoeba invadens
NSQKQSQL

SEQ ID NO: 2890272 - protein, 9 aa, Entamoeba invadens
NSQKSTKVN

SEQ ID NO: 2890273 - protein, 11 aa, Entamoeba invadens
NSQKTVQEMRS

SEQ ID NO: 2890274 - protein, 4 aa, Entamoeba invadens
NSQL

SEQ ID NO: 2890275 - protein, 9 aa, Entamoeba invadens
NSQLEATQT

SEQ ID NO: 2890276 - protein, 7 aa, Entamoeba invadens
NSQLTDY

SEQ ID NO: 2890277 - protein, 10 aa, Entamoeba invadens
NSQNEKPKDV

SEQ ID NO: 2890278 - protein, 14 aa, Entamoeba invadens
NSQNPSKVSEQTPA

SEQ ID NO: 2890279 - protein, 6 aa, Entamoeba invadens
NSQNYV

SEQ ID NO: 2890280 - protein, 4 aa, Entamoeba invadens
NSQP

SEQ ID NO: 2890281 - protein, 5 aa, Entamoeba invadens
NSQPF

SEQ ID NO: 2890282 - protein, 8 aa, Entamoeba invadens
NSQPISPS

SEQ ID NO: 2890283 - protein, 7 aa, Entamoeba invadens
NSQQKYT

SEQ ID NO: 2890284 - protein, 10 aa, Entamoeba invadens
NSQQNGVSAE

SEQ ID NO: 2890285 - protein, 10 aa, Entamoeba invadens
NSQQNPASKH

SEQ ID NO: 2890286 - protein, 9 aa, Entamoeba invadens
NSQQPNTLS

SEQ ID NO: 2890287 - protein, 15 aa, Entamoeba invadens
NSQQQQQCQSNIANS

SEQ ID NO: 2890288 - protein, 9 aa, Entamoeba invadens
NSQQSESLP

SEQ ID NO: 2890289 - protein, 24 aa, Entamoeba invadens
NSQREKDKQMSETPDNTRIRETPK

SEQ ID NO: 2890290 - protein, 6 aa, Entamoeba invadens
NSQRKV

SEQ ID NO: 2890291 - protein, 11 aa, Entamoeba invadens
NSQSAPKEEQK

SEQ ID NO: 2890292 - protein, 17 aa, Entamoeba invadens
NSQSNENTHVTPSTKCQ

SEQ ID NO: 2890293 - protein, 50 aa, Entamoeba invadens
NSQSSSTKIEKSSKIEKTEKPPKASKPKKETSDKKTSKKSSKEQKKVNAQ

SEQ ID NO: 2890294 - protein, 8 aa, Entamoeba invadens
NSQSYQSS

SEQ ID NO: 2890295 - protein, 6 aa, Entamoeba invadens
NSQTDA

SEQ ID NO: 2890296 - protein, 18 aa, Entamoeba invadens
NSQTLARNAERAEEQYKR

SEQ ID NO: 2890297 - protein, 10 aa, Entamoeba invadens
NSQVSSTTSI

SEQ ID NO: 2890298 - protein, 6 aa, Entamoeba invadens
NSQYTP

SEQ ID NO: 2890299 - protein, 6 aa, Entamoeba invadens
NSRDEM

SEQ ID NO: 2890300 - protein, 7 aa, Entamoeba invadens
NSRDTRH

SEQ ID NO: 2890301 - protein, 6 aa, Entamoeba invadens
NSREQN

SEQ ID NO: 2890302 - protein, 5 aa, Entamoeba invadens
NSRGR

SEQ ID NO: 2890303 - protein, 6 aa, Entamoeba invadens
NSRGVD

SEQ ID NO: 2890304 - protein, 4 aa, Entamoeba invadens
NSRI

SEQ ID NO: 2890305 - protein, 8 aa, Entamoeba invadens
NSRIETYD

SEQ ID NO: 2890306 - protein, 5 aa, Entamoeba invadens
NSRIS

SEQ ID NO: 2890307 - protein, 4 aa, Entamoeba invadens
NSRK

SEQ ID NO: 2890308 - protein, 6 aa, Entamoeba invadens
NSRKIR

SEQ ID NO: 2890309 - protein, 10 aa, Entamoeba invadens
NSRLPKSVDT

SEQ ID NO: 2890310 - protein, 21 aa, Entamoeba invadens
NSRLTQTVENTENQREEESKL

SEQ ID NO: 2890311 - protein, 23 aa, Entamoeba invadens
NSRMTPNIQPPEPPTSIETNRQI

SEQ ID NO: 2890312 - protein, 14 aa, Entamoeba invadens
NSRNKKISASGESE

SEQ ID NO: 2890313 - protein, 6 aa, Entamoeba invadens
NSRPCP

SEQ ID NO: 2890314 - protein, 21 aa, Entamoeba invadens
NSRSSGSDPTISPRRSCSPVQ

SEQ ID NO: 2890315 - protein, 20 aa, Entamoeba invadens
NSRSSPTPLSPLSTSLNSPI

SEQ ID NO: 2890316 - protein, 16 aa, Entamoeba invadens
NSRSVPPTKFTKKDVS

SEQ ID NO: 2890317 - protein, 6 aa, Entamoeba invadens
NSRTKS

SEQ ID NO: 2890318 - protein, 9 aa, Entamoeba invadens
NSRTTANTI

SEQ ID NO: 2890319 - protein, 4 aa, Entamoeba invadens
NSRV

SEQ ID NO: 2890320 - protein, 12 aa, Entamoeba invadens
NSRYAESKRYHK

SEQ ID NO: 2890321 - protein, 10 aa, Entamoeba invadens
NSSAQAVTGD

SEQ ID NO: 2890322 - protein, 9 aa, Entamoeba invadens
NSSCKGGKI

SEQ ID NO: 2890323 - protein, 10 aa, Entamoeba invadens
NSSDQDEIYD

SEQ ID NO: 2890324 - protein, 8 aa, Entamoeba invadens
NSSDSSEL

SEQ ID NO: 2890325 - protein, 14 aa, Entamoeba invadens
NSSDTEVVASGKDN

SEQ ID NO: 2890326 - protein, 4 aa, Entamoeba invadens
NSSE

SEQ ID NO: 2890327 - protein, 9 aa, Entamoeba invadens
NSSEASGWN

SEQ ID NO: 2890328 - protein, 5 aa, Entamoeba invadens
NSSEK

SEQ ID NO: 2890329 - protein, 8 aa, Entamoeba invadens
NSSETPKV

SEQ ID NO: 2890330 - protein, 4 aa, Entamoeba invadens
NSSG

SEQ ID NO: 2890331 - protein, 13 aa, Entamoeba invadens
NSSGEEQKGGVDV

SEQ ID NO: 2890332 - protein, 6 aa, Entamoeba invadens
NSSGET

SEQ ID NO: 2890333 - protein, 6 aa, Entamoeba invadens
NSSGQF

SEQ ID NO: 2890334 - protein, 9 aa, Entamoeba invadens
NSSGTPPTI

SEQ ID NO: 2890335 - protein, 5 aa, Entamoeba invadens
NSSHG

SEQ ID NO: 2890336 - protein, 8 aa, Entamoeba invadens
NSSIEFRG

SEQ ID NO: 2890337 - protein, 8 aa, Entamoeba invadens
NSSIGETV

SEQ ID NO: 2890338 - protein, 7 aa, Entamoeba invadens
NSSIIPG

SEQ ID NO: 2890339 - protein, 11 aa, Entamoeba invadens
NSSINNGFSPS

SEQ ID NO: 2890340 - protein, 6 aa, Entamoeba invadens
NSSIPP

SEQ ID NO: 2890341 - protein, 5 aa, Entamoeba invadens
NSSIR

SEQ ID NO: 2890342 - protein, 16 aa, Entamoeba invadens
NSSKANAKITDFGSSR

SEQ ID NO: 2890343 - protein, 7 aa, Entamoeba invadens
NSSKHDY

SEQ ID NO: 2890344 - protein, 15 aa, Entamoeba invadens
NSSKNGENIEISQTS

SEQ ID NO: 2890345 - protein, 27 aa, Entamoeba invadens
NSSKPEKQEKVDEEYEDDVIDSDEEII

SEQ ID NO: 2890346 - protein, 6 aa, Entamoeba invadens
NSSKQH

SEQ ID NO: 2890347 - protein, 4 aa, Entamoeba invadens
NSSL

SEQ ID NO: 2890348 - protein, 8 aa, Entamoeba invadens
NSSLGTTK

SEQ ID NO: 2890349 - protein, 10 aa, Entamoeba invadens
NSSMSTKTRL

SEQ ID NO: 2890350 - protein, 9 aa, Entamoeba invadens
NSSNDTQEV

SEQ ID NO: 2890351 - protein, 7 aa, Entamoeba invadens
NSSNIED

SEQ ID NO: 2890352 - protein, 7 aa, Entamoeba invadens
NSSNIQV

SEQ ID NO: 2890353 - protein, 8 aa, Entamoeba invadens
NSSNIRLT

SEQ ID NO: 2890354 - protein, 13 aa, Entamoeba invadens
NSSNLNGNNKYNE

SEQ ID NO: 2890355 - protein, 9 aa, Entamoeba invadens
NSSNPIKSR

SEQ ID NO: 2890356 - protein, 6 aa, Entamoeba invadens
NSSPDM

SEQ ID NO: 2890357 - protein, 36 aa, Entamoeba invadens
NSSPRGSRKVQAPPLPPKNPALRKEETLEERDFVRV

SEQ ID NO: 2890358 - protein, 11 aa, Entamoeba invadens
NSSQKKVTQDD

SEQ ID NO: 2890359 - protein, 22 aa, Entamoeba invadens
NSSQLETPKTTKQNEEDDDDTY

SEQ ID NO: 2890360 - protein, 9 aa, Entamoeba invadens
NSSQSADLS

SEQ ID NO: 2890361 - protein, 6 aa, Entamoeba invadens
NSSRAI

SEQ ID NO: 2890362 - protein, 11 aa, Entamoeba invadens
NSSRDPISKPY

SEQ ID NO: 2890363 - protein, 6 aa, Entamoeba invadens
NSSREY

SEQ ID NO: 2890364 - protein, 8 aa, Entamoeba invadens
NSSRSGSV

SEQ ID NO: 2890365 - protein, 6 aa, Entamoeba invadens
NSSSFE

SEQ ID NO: 2890366 - protein, 13 aa, Entamoeba invadens
NSSSFKETSLDSF

SEQ ID NO: 2890367 - protein, 6 aa, Entamoeba invadens
NSSSID

SEQ ID NO: 2890368 - protein, 6 aa, Entamoeba invadens
NSSSIK

SEQ ID NO: 2890369 - protein, 6 aa, Entamoeba invadens
NSSSKF

SEQ ID NO: 2890370 - protein, 5 aa, Entamoeba invadens
NSSSL

SEQ ID NO: 2890371 - protein, 5 aa, Entamoeba invadens
NSSSN

SEQ ID NO: 2890372 - protein, 10 aa, Entamoeba invadens
NSSSNRCERC

SEQ ID NO: 2890373 - protein, 14 aa, Entamoeba invadens
NSSSQNTNSPYEMP

SEQ ID NO: 2890374 - protein, 9 aa, Entamoeba invadens
NSSSSDDNQ

SEQ ID NO: 2890375 - protein, 5 aa, Entamoeba invadens
NSSTD

SEQ ID NO: 2890376 - protein, 7 aa, Entamoeba invadens
NSSTEVE

SEQ ID NO: 2890377 - protein, 6 aa, Entamoeba invadens
NSSTGQ

SEQ ID NO: 2890378 - protein, 19 aa, Entamoeba invadens
NSSTKNVKQTQPLQEKATI

SEQ ID NO: 2890379 - protein, 4 aa, Entamoeba invadens
NSTA

SEQ ID NO: 2890380 - protein, 27 aa, Entamoeba invadens
NSTDEQNKQKQKLNDLKTPKKRDTITK

SEQ ID NO: 2890381 - protein, 6 aa, Entamoeba invadens
NSTDHI

SEQ ID NO: 2890382 - protein, 6 aa, Entamoeba invadens
NSTDPF

SEQ ID NO: 2890383 - protein, 4 aa, Entamoeba invadens
NSTE

SEQ ID NO: 2890384 - protein, 11 aa, Entamoeba invadens
NSTEERRTQQI

SEQ ID NO: 2890385 - protein, 26 aa, Entamoeba invadens
NSTEQTTEVTETTQINGTQENKNQMS

SEQ ID NO: 2890386 - protein, 6 aa, Entamoeba invadens
NSTFKF

SEQ ID NO: 2890387 - protein, 5 aa, Entamoeba invadens
NSTGE

SEQ ID NO: 2890388 - protein, 18 aa, Entamoeba invadens
NSTGIVDSNTEQQTSVVS

SEQ ID NO: 2890389 - protein, 13 aa, Entamoeba invadens
NSTGKSENYNSND

SEQ ID NO: 2890390 - protein, 5 aa, Entamoeba invadens
NSTGR

SEQ ID NO: 2890391 - protein, 7 aa, Entamoeba invadens
NSTGSDC

SEQ ID NO: 2890392 - protein, 4 aa, Entamoeba invadens
NSTH

SEQ ID NO: 2890393 - protein, 4 aa, Entamoeba invadens
NSTI

SEQ ID NO: 2890394 - protein, 34 aa, Entamoeba invadens
NSTIEKQRRKDEARAPIYSDGRENEENDNLRRDF

SEQ ID NO: 2890395 - protein, 6 aa, Entamoeba invadens
NSTIKK

SEQ ID NO: 2890396 - protein, 11 aa, Entamoeba invadens
NSTIPAKKSQI

SEQ ID NO: 2890397 - protein, 6 aa, Entamoeba invadens
NSTIQN

SEQ ID NO: 2890398 - protein, 18 aa, Entamoeba invadens
NSTKARETFGVEWVKVFV

SEQ ID NO: 2890399 - protein, 8 aa, Entamoeba invadens
NSTKKRPN

SEQ ID NO: 2890400 - protein, 6 aa, Entamoeba invadens
NSTKKV

SEQ ID NO: 2890401 - protein, 7 aa, Entamoeba invadens
NSTKLNY

SEQ ID NO: 2890402 - protein, 9 aa, Entamoeba invadens
NSTKNKRAI

SEQ ID NO: 2890403 - protein, 12 aa, Entamoeba invadens
NSTKNLEVEKKV

SEQ ID NO: 2890404 - protein, 6 aa, Entamoeba invadens
NSTKQI

SEQ ID NO: 2890405 - protein, 11 aa, Entamoeba invadens
NSTKSNCDKCN

SEQ ID NO: 2890406 - protein, 11 aa, Entamoeba invadens
NSTLGDKDKDI

SEQ ID NO: 2890407 - protein, 17 aa, Entamoeba invadens
NSTLSQDFKTEYENGTD

SEQ ID NO: 2890408 - protein, 5 aa, Entamoeba invadens
NSTLT

SEQ ID NO: 2890409 - protein, 11 aa, Entamoeba invadens
NSTMANDEDMS

SEQ ID NO: 2890410 - protein, 7 aa, Entamoeba invadens
NSTNENQ

SEQ ID NO: 2890411 - protein, 5 aa, Entamoeba invadens
NSTNK

SEQ ID NO: 2890412 - protein, 8 aa, Entamoeba invadens
NSTNNFTP

SEQ ID NO: 2890413 - protein, 5 aa, Entamoeba invadens
NSTNT

SEQ ID NO: 2890414 - protein, 15 aa, Entamoeba invadens
NSTNYKTQDGDCLPQ

SEQ ID NO: 2890415 - protein, 13 aa, Entamoeba invadens
NSTPEILPCKTPR

SEQ ID NO: 2890416 - protein, 8 aa, Entamoeba invadens
NSTPQIVE

SEQ ID NO: 2890417 - protein, 15 aa, Entamoeba invadens
NSTPSTTQKAPENAN

SEQ ID NO: 2890418 - protein, 7 aa, Entamoeba invadens
NSTPVGR

SEQ ID NO: 2890419 - protein, 4 aa, Entamoeba invadens
NSTQ

SEQ ID NO: 2890420 - protein, 13 aa, Entamoeba invadens
NSTQFKHEEKKNS

SEQ ID NO: 2890421 - protein, 13 aa, Entamoeba invadens
NSTQHNTYSNDTV

SEQ ID NO: 2890422 - protein, 10 aa, Entamoeba invadens
NSTQKTAITI

SEQ ID NO: 2890423 - protein, 7 aa, Entamoeba invadens
NSTQQTT

SEQ ID NO: 2890424 - protein, 12 aa, Entamoeba invadens
NSTQSMQNWLSK

SEQ ID NO: 2890425 - protein, 9 aa, Entamoeba invadens
NSTQTSPAY

SEQ ID NO: 2890426 - protein, 7 aa, Entamoeba invadens
NSTRETL

SEQ ID NO: 2890427 - protein, 5 aa, Entamoeba invadens
NSTRH

SEQ ID NO: 2890428 - protein, 6 aa, Entamoeba invadens
NSTSAT

SEQ ID NO: 2890429 - protein, 9 aa, Entamoeba invadens
NSTSHNNKP

SEQ ID NO: 2890430 - protein, 9 aa, Entamoeba invadens
NSTSPHTSY

SEQ ID NO: 2890431 - protein, 7 aa, Entamoeba invadens
NSTSQRN

SEQ ID NO: 2890432 - protein, 10 aa, Entamoeba invadens
NSTSSLAKLA

SEQ ID NO: 2890433 - protein, 8 aa, Entamoeba invadens
NSTSTRII

SEQ ID NO: 2890434 - protein, 8 aa, Entamoeba invadens
NSTTGKLP

SEQ ID NO: 2890435 - protein, 6 aa, Entamoeba invadens
NSTTHL

SEQ ID NO: 2890436 - protein, 6 aa, Entamoeba invadens
NSTTIN

SEQ ID NO: 2890437 - protein, 10 aa, Entamoeba invadens
NSTTKPRKKD

SEQ ID NO: 2890438 - protein, 9 aa, Entamoeba invadens
NSTTPEASL

SEQ ID NO: 2890439 - protein, 7 aa, Entamoeba invadens
NSTTTYD

SEQ ID NO: 2890440 - protein, 8 aa, Entamoeba invadens
NSTVESHS

SEQ ID NO: 2890441 - protein, 7 aa, Entamoeba invadens
NSTVRRE

SEQ ID NO: 2890442 - protein, 11 aa, Entamoeba invadens
NSTVSKQLRTR

SEQ ID NO: 2890443 - protein, 4 aa, Entamoeba invadens
NSTY

SEQ ID NO: 2890444 - protein, 8 aa, Entamoeba invadens
NSTYEQSK

SEQ ID NO: 2890445 - protein, 6 aa, Entamoeba invadens
NSTYGY

SEQ ID NO: 2890446 - protein, 18 aa, Entamoeba invadens
NSVANEKVEKNDTKNMTK

SEQ ID NO: 2890447 - protein, 4 aa, Entamoeba invadens
NSVD

SEQ ID NO: 2890448 - protein, 5 aa, Entamoeba invadens
NSVDG

SEQ ID NO: 2890449 - protein, 7 aa, Entamoeba invadens
NSVDSPK

SEQ ID NO: 2890450 - protein, 4 aa, Entamoeba invadens
NSVE

SEQ ID NO: 2890451 - protein, 13 aa, Entamoeba invadens
NSVEKEVKSNTSG

SEQ ID NO: 2890452 - protein, 18 aa, Entamoeba invadens
NSVEPKSSMSSVDATQRW

SEQ ID NO: 2890453 - protein, 22 aa, Entamoeba invadens
NSVESERKEEKDGQENAPTPLC

SEQ ID NO: 2890454 - protein, 7 aa, Entamoeba invadens
NSVESIG

SEQ ID NO: 2890455 - protein, 4 aa, Entamoeba invadens
NSVG

SEQ ID NO: 2890456 - protein, 7 aa, Entamoeba invadens
NSVGKTS

SEQ ID NO: 2890457 - protein, 13 aa, Entamoeba invadens
NSVGSGVSHTTQL

SEQ ID NO: 2890458 - protein, 7 aa, Entamoeba invadens
NSVGVSG

SEQ ID NO: 2890459 - protein, 10 aa, Entamoeba invadens
NSVIESAKSK

SEQ ID NO: 2890460 - protein, 6 aa, Entamoeba invadens
NSVIPG

SEQ ID NO: 2890461 - protein, 10 aa, Entamoeba invadens
NSVKDPSYKR

SEQ ID NO: 2890462 - protein, 30 aa, Entamoeba invadens
NSVKKNSQRLRDSRGSIASNGSTGTPSVKK

SEQ ID NO: 2890463 - protein, 7 aa, Entamoeba invadens
NSVKNKS

SEQ ID NO: 2890464 - protein, 17 aa, Entamoeba invadens
NSVKSELKKRNHRRSLT

SEQ ID NO: 2890465 - protein, 4 aa, Entamoeba invadens
NSVN

SEQ ID NO: 2890466 - protein, 5 aa, Entamoeba invadens
NSVNA

SEQ ID NO: 2890467 - protein, 13 aa, Entamoeba invadens
NSVNALRDELKDD

SEQ ID NO: 2890468 - protein, 15 aa, Entamoeba invadens
NSVNDSNVNWRTGSV

SEQ ID NO: 2890469 - protein, 6 aa, Entamoeba invadens
NSVNKT

SEQ ID NO: 2890470 - protein, 13 aa, Entamoeba invadens
NSVNLETEKKLSE

SEQ ID NO: 2890471 - protein, 18 aa, Entamoeba invadens
NSVNTSYDSNDNSNVNEI

SEQ ID NO: 2890472 - protein, 12 aa, Entamoeba invadens
NSVQKPHKEYTD

SEQ ID NO: 2890473 - protein, 6 aa, Entamoeba invadens
NSVQRM

SEQ ID NO: 2890474 - protein, 4 aa, Entamoeba invadens
NSVR

SEQ ID NO: 2890475 - protein, 9 aa, Entamoeba invadens
NSVSGGAKV

SEQ ID NO: 2890476 - protein, 5 aa, Entamoeba invadens
NSVSV

SEQ ID NO: 2890477 - protein, 4 aa, Entamoeba invadens
NSVT

SEQ ID NO: 2890478 - protein, 5 aa, Entamoeba invadens
NSVTP

SEQ ID NO: 2890479 - protein, 11 aa, Entamoeba invadens
NSVTPKSTTTL

SEQ ID NO: 2890480 - protein, 7 aa, Entamoeba invadens
NSVTQDE

SEQ ID NO: 2890481 - protein, 8 aa, Entamoeba invadens
NSVTSAAK

SEQ ID NO: 2890482 - protein, 7 aa, Entamoeba invadens
NSVTSIG

SEQ ID NO: 2890483 - protein, 6 aa, Entamoeba invadens
NSVTSL

SEQ ID NO: 2890484 - protein, 13 aa, Entamoeba invadens
NSVTSRSKSGSVS

SEQ ID NO: 2890485 - protein, 6 aa, Entamoeba invadens
NSVTSV

SEQ ID NO: 2890486 - protein, 6 aa, Entamoeba invadens
NSVVEK

SEQ ID NO: 2890487 - protein, 13 aa, Entamoeba invadens
NSWQNGAGIAKST

SEQ ID NO: 2890488 - protein, 8 aa, Entamoeba invadens
NSWTSSQS

SEQ ID NO: 2890489 - protein, 9 aa, Entamoeba invadens
NSYDGNKYG

SEQ ID NO: 2890490 - protein, 5 aa, Entamoeba invadens
NSYDK

SEQ ID NO: 2890491 - protein, 6 aa, Entamoeba invadens
NSYDSS

SEQ ID NO: 2890492 - protein, 23 aa, Entamoeba invadens
NSYEPKKKKEYVPGENENLPGWG

SEQ ID NO: 2890493 - protein, 6 aa, Entamoeba invadens
NSYETG

SEQ ID NO: 2890494 - protein, 7 aa, Entamoeba invadens
NSYETTL

SEQ ID NO: 2890495 - protein, 4 aa, Entamoeba invadens
NSYN

SEQ ID NO: 2890496 - protein, 5 aa, Entamoeba invadens
NSYPK

SEQ ID NO: 2890497 - protein, 6 aa, Entamoeba invadens
NSYPYP

SEQ ID NO: 2890498 - protein, 4 aa, Entamoeba invadens
NSYR

SEQ ID NO: 2890499 - protein, 10 aa, Entamoeba invadens
NSYREKELGG

SEQ ID NO: 2890500 - protein, 7 aa, Entamoeba invadens
NSYRPDP

SEQ ID NO: 2890501 - protein, 9 aa, Entamoeba invadens
NSYRTETER

SEQ ID NO: 2890502 - protein, 6 aa, Entamoeba invadens
NSYSTS

SEQ ID NO: 2890503 - protein, 6 aa, Entamoeba invadens
NSYSVG

SEQ ID NO: 2890504 - protein, 10 aa, Entamoeba invadens
NSYTESKNAF

SEQ ID NO: 2890505 - protein, 12 aa, Entamoeba invadens
NTAASRQDARSC

SEQ ID NO: 2890506 - protein, 7 aa, Entamoeba invadens
NTAERKA

SEQ ID NO: 2890507 - protein, 8 aa, Entamoeba invadens
NTAGFDGR

SEQ ID NO: 2890508 - protein, 13 aa, Entamoeba invadens
NTAGQELKSEQLT

SEQ ID NO: 2890509 - protein, 18 aa, Entamoeba invadens
NTAGQLPQNEITQQNTLT

SEQ ID NO: 2890510 - protein, 7 aa, Entamoeba invadens
NTAGVTA

SEQ ID NO: 2890511 - protein, 5 aa, Entamoeba invadens
NTAHE

SEQ ID NO: 2890512 - protein, 11 aa, Entamoeba invadens
NTAKPVTAGQN

SEQ ID NO: 2890513 - protein, 16 aa, Entamoeba invadens
NTAKPVTAGQNHIATM

SEQ ID NO: 2890514 - protein, 17 aa, Entamoeba invadens
NTAKPVTAGQNHIVTYV

SEQ ID NO: 2890515 - protein, 9 aa, Entamoeba invadens
NTALSSSTM

SEQ ID NO: 2890516 - protein, 9 aa, Entamoeba invadens
NTAMSSSTM

SEQ ID NO: 2890517 - protein, 6 aa, Entamoeba invadens
NTANAE

SEQ ID NO: 2890518 - protein, 13 aa, Entamoeba invadens
NTANLSEENSAFG

SEQ ID NO: 2890519 - protein, 22 aa, Entamoeba invadens
NTANTQSFQTSTQEKTTSPKWT

SEQ ID NO: 2890520 - protein, 12 aa, Entamoeba invadens
NTATEKTLKHTT

SEQ ID NO: 2890521 - protein, 6 aa, Entamoeba invadens
NTATGP

SEQ ID NO: 2890522 - protein, 28 aa, Entamoeba invadens
NTATTGIGSTGDDKGLGAAGTTGSTGSL

SEQ ID NO: 2890523 - protein, 11 aa, Entamoeba invadens
NTATTQPETKE

SEQ ID NO: 2890524 - protein, 6 aa, Entamoeba invadens
NTAVAR

SEQ ID NO: 2890525 - protein, 5 aa, Entamoeba invadens
NTAVD

SEQ ID NO: 2890526 - protein, 7 aa, Entamoeba invadens
NTCDELS

SEQ ID NO: 2890527 - protein, 8 aa, Entamoeba invadens
NTCEGDVD

SEQ ID NO: 2890528 - protein, 7 aa, Entamoeba invadens
NTCGQTG

SEQ ID NO: 2890529 - protein, 14 aa, Entamoeba invadens
NTCGTTNSCNSDQM

SEQ ID NO: 2890530 - protein, 5 aa, Entamoeba invadens
NTCPS

SEQ ID NO: 2890531 - protein, 9 aa, Entamoeba invadens
NTCSSDTKK

SEQ ID NO: 2890532 - protein, 9 aa, Entamoeba invadens
NTCSSDTQK

SEQ ID NO: 2890533 - protein, 13 aa, Entamoeba invadens
NTDDSEELGEDNI

SEQ ID NO: 2890534 - protein, 4 aa, Entamoeba invadens
NTDE

SEQ ID NO: 2890535 - protein, 14 aa, Entamoeba invadens
NTDETARLERPKEL

SEQ ID NO: 2890536 - protein, 4 aa, Entamoeba invadens
NTDF

SEQ ID NO: 2890537 - protein, 6 aa, Entamoeba invadens
NTDHKE

SEQ ID NO: 2890538 - protein, 4 aa, Entamoeba invadens
NTDI

SEQ ID NO: 2890539 - protein, 24 aa, Entamoeba invadens
NTDINTPKSKDDNKCNTNNINKSR

SEQ ID NO: 2890540 - protein, 9 aa, Entamoeba invadens
NTDKKTEII

SEQ ID NO: 2890541 - protein, 13 aa, Entamoeba invadens
NTDKNNYNIPTRS

SEQ ID NO: 2890542 - protein, 10 aa, Entamoeba invadens
NTDKSVKDKM

SEQ ID NO: 2890543 - protein, 14 aa, Entamoeba invadens
NTDLAKAEKQRAYD

SEQ ID NO: 2890544 - protein, 4 aa, Entamoeba invadens
NTDN

SEQ ID NO: 2890545 - protein, 5 aa, Entamoeba invadens
NTDNL

SEQ ID NO: 2890546 - protein, 20 aa, Entamoeba invadens
NTDNNRKGVENSSKNNNLFL

SEQ ID NO: 2890547 - protein, 5 aa, Entamoeba invadens
NTDNT

SEQ ID NO: 2890548 - protein, 8 aa, Entamoeba invadens
NTDNTVTR

SEQ ID NO: 2890549 - protein, 14 aa, Entamoeba invadens
NTDPELARDSESVQ

SEQ ID NO: 2890550 - protein, 7 aa, Entamoeba invadens
NTDPINN

SEQ ID NO: 2890551 - protein, 9 aa, Entamoeba invadens
NTDPKKESV

SEQ ID NO: 2890552 - protein, 6 aa, Entamoeba invadens
NTDQGR

SEQ ID NO: 2890553 - protein, 7 aa, Entamoeba invadens
NTDQIAD

SEQ ID NO: 2890554 - protein, 13 aa, Entamoeba invadens
NTDRVKREIDSGR

SEQ ID NO: 2890555 - protein, 9 aa, Entamoeba invadens
NTDSFTKNS

SEQ ID NO: 2890556 - protein, 8 aa, Entamoeba invadens
NTDSSSFI

SEQ ID NO: 2890557 - protein, 10 aa, Entamoeba invadens
NTDSTGYNEP

SEQ ID NO: 2890558 - protein, 4 aa, Entamoeba invadens
NTDT

SEQ ID NO: 2890559 - protein, 9 aa, Entamoeba invadens
NTDTKTVDS

SEQ ID NO: 2890560 - protein, 8 aa, Entamoeba invadens
NTDTYDSS

SEQ ID NO: 2890561 - protein, 4 aa, Entamoeba invadens
NTDV

SEQ ID NO: 2890562 - protein, 5 aa, Entamoeba invadens
NTDVL

SEQ ID NO: 2890563 - protein, 6 aa, Entamoeba invadens
NTDYAN

SEQ ID NO: 2890564 - protein, 9 aa, Entamoeba invadens
NTEATGKVS

SEQ ID NO: 2890565 - protein, 7 aa, Entamoeba invadens
NTEATIP

SEQ ID NO: 2890566 - protein, 6 aa, Entamoeba invadens
NTEATR

SEQ ID NO: 2890567 - protein, 5 aa, Entamoeba invadens
NTEDA

SEQ ID NO: 2890568 - protein, 8 aa, Entamoeba invadens
NTEDDHNT

SEQ ID NO: 2890569 - protein, 7 aa, Entamoeba invadens
NTEDDKR

SEQ ID NO: 2890570 - protein, 9 aa, Entamoeba invadens
NTEDGKGQI

SEQ ID NO: 2890571 - protein, 6 aa, Entamoeba invadens
NTEDGY

SEQ ID NO: 2890572 - protein, 21 aa, Entamoeba invadens
NTEDLKSIQSDLDEVRSGKLK

SEQ ID NO: 2890573 - protein, 7 aa, Entamoeba invadens
NTEDNVK

SEQ ID NO: 2890574 - protein, 6 aa, Entamoeba invadens
NTEDQI

SEQ ID NO: 2890575 - protein, 4 aa, Entamoeba invadens
NTEE

SEQ ID NO: 2890576 - protein, 6 aa, Entamoeba invadens
NTEEEI

SEQ ID NO: 2890577 - protein, 6 aa, Entamoeba invadens
NTEEEK

SEQ ID NO: 2890578 - protein, 7 aa, Entamoeba invadens
NTEEEKN

SEQ ID NO: 2890579 - protein, 8 aa, Entamoeba invadens
NTEEGSQL

SEQ ID NO: 2890580 - protein, 10 aa, Entamoeba invadens
NTEENKEKVD

SEQ ID NO: 2890581 - protein, 7 aa, Entamoeba invadens
NTEEPYL

SEQ ID NO: 2890582 - protein, 5 aa, Entamoeba invadens
NTEER

SEQ ID NO: 2890583 - protein, 6 aa, Entamoeba invadens
NTEESY

SEQ ID NO: 2890584 - protein, 11 aa, Entamoeba invadens
NTEEYEDSENE

SEQ ID NO: 2890585 - protein, 4 aa, Entamoeba invadens
NTEF

SEQ ID NO: 2890586 - protein, 24 aa, Entamoeba invadens
NTEGFGNEDEKVKELDKQKEGNYK

SEQ ID NO: 2890587 - protein, 6 aa, Entamoeba invadens
NTEHDC

SEQ ID NO: 2890588 - protein, 5 aa, Entamoeba invadens
NTEIG

SEQ ID NO: 2890589 - protein, 5 aa, Entamoeba invadens
NTEKA

SEQ ID NO: 2890590 - protein, 5 aa, Entamoeba invadens
NTEKE

SEQ ID NO: 2890591 - protein, 5 aa, Entamoeba invadens
NTEKK

SEQ ID NO: 2890592 - protein, 13 aa, Entamoeba invadens
NTEKKISDIGVDD

SEQ ID NO: 2890593 - protein, 9 aa, Entamoeba invadens
NTEKPTAMT

SEQ ID NO: 2890594 - protein, 13 aa, Entamoeba invadens
NTEKQSSKKTTLD

SEQ ID NO: 2890595 - protein, 12 aa, Entamoeba invadens
NTEKRDRNRPQT

SEQ ID NO: 2890596 - protein, 6 aa, Entamoeba invadens
NTEKSI

SEQ ID NO: 2890597 - protein, 5 aa, Entamoeba invadens
NTEKV

SEQ ID NO: 2890598 - protein, 25 aa, Entamoeba invadens
NTEKVKSALNAGEDFSQVDKNGYSP

SEQ ID NO: 2890599 - protein, 22 aa, Entamoeba invadens
NTELDEKQDECDKLEDDMSEMK

SEQ ID NO: 2890600 - protein, 21 aa, Entamoeba invadens
NTELDEKQDKFDKIEDNMSEM

SEQ ID NO: 2890601 - protein, 28 aa, Entamoeba invadens
NTELEEERKKTKPKSKNKVKPRKRPNRI

SEQ ID NO: 2890602 - protein, 4 aa, Entamoeba invadens
NTEN

SEQ ID NO: 2890603 - protein, 7 aa, Entamoeba invadens
NTENITK

SEQ ID NO: 2890604 - protein, 8 aa, Entamoeba invadens
NTENNELK

SEQ ID NO: 2890605 - protein, 13 aa, Entamoeba invadens
NTENQINDKQRGI

SEQ ID NO: 2890606 - protein, 8 aa, Entamoeba invadens
NTENTHED

SEQ ID NO: 2890607 - protein, 5 aa, Entamoeba invadens
NTENV

SEQ ID NO: 2890608 - protein, 18 aa, Entamoeba invadens
NTENVKRIQSKYKTIDEA

SEQ ID NO: 2890609 - protein, 10 aa, Entamoeba invadens
NTENYGNDTK

SEQ ID NO: 2890610 - protein, 9 aa, Entamoeba invadens
NTENYPQRG

SEQ ID NO: 2890611 - protein, 4 aa, Entamoeba invadens
NTEP

SEQ ID NO: 2890612 - protein, 6 aa, Entamoeba invadens
NTEPQL

SEQ ID NO: 2890613 - protein, 15 aa, Entamoeba invadens
NTEPTAGEGLTAEEE

SEQ ID NO: 2890614 - protein, 5 aa, Entamoeba invadens
NTEQA

SEQ ID NO: 2890615 - protein, 12 aa, Entamoeba invadens
NTEQAKNSESVL

SEQ ID NO: 2890616 - protein, 5 aa, Entamoeba invadens
NTEQI

SEQ ID NO: 2890617 - protein, 9 aa, Entamoeba invadens
NTERASSCQ

SEQ ID NO: 2890618 - protein, 7 aa, Entamoeba invadens
NTERGTS

SEQ ID NO: 2890619 - protein, 5 aa, Entamoeba invadens
NTERL

SEQ ID NO: 2890620 - protein, 6 aa, Entamoeba invadens
NTERNI

SEQ ID NO: 2890621 - protein, 18 aa, Entamoeba invadens
NTESASMAKANEDGKYWN

SEQ ID NO: 2890622 - protein, 8 aa, Entamoeba invadens
NTESDIST

SEQ ID NO: 2890623 - protein, 6 aa, Entamoeba invadens
NTESTY

SEQ ID NO: 2890624 - protein, 5 aa, Entamoeba invadens
NTETF

SEQ ID NO: 2890625 - protein, 9 aa, Entamoeba invadens
NTETGKKCP

SEQ ID NO: 2890626 - protein, 7 aa, Entamoeba invadens
NTETNNI

SEQ ID NO: 2890627 - protein, 4 aa, Entamoeba invadens
NTEV

SEQ ID NO: 2890628 - protein, 25 aa, Entamoeba invadens
NTEVQQISEKMNKDEDELDDEEAEM

SEQ ID NO: 2890629 - protein, 7 aa, Entamoeba invadens
NTEVQQT

SEQ ID NO: 2890630 - protein, 14 aa, Entamoeba invadens
NTEWRTYPNPMGNV

SEQ ID NO: 2890631 - protein, 9 aa, Entamoeba invadens
NTFEDEYEV

SEQ ID NO: 2890632 - protein, 6 aa, Entamoeba invadens
NTFEPN

SEQ ID NO: 2890633 - protein, 11 aa, Entamoeba invadens
NTFGGKDVTDT

SEQ ID NO: 2890634 - protein, 10 aa, Entamoeba invadens
NTFGGQSNKE

SEQ ID NO: 2890635 - protein, 6 aa, Entamoeba invadens
NTFGRK

SEQ ID NO: 2890636 - protein, 11 aa, Entamoeba invadens
NTFKDQNGNCL

SEQ ID NO: 2890637 - protein, 6 aa, Entamoeba invadens
NTFNND

SEQ ID NO: 2890638 - protein, 6 aa, Entamoeba invadens
NTFPTD

SEQ ID NO: 2890639 - protein, 17 aa, Entamoeba invadens
NTFQQNSLQQSQSQQQV

SEQ ID NO: 2890640 - protein, 7 aa, Entamoeba invadens
NTFSNAS

SEQ ID NO: 2890641 - protein, 6 aa, Entamoeba invadens
NTFSNN

SEQ ID NO: 2890642 - protein, 9 aa, Entamoeba invadens
NTFTKDKPL

SEQ ID NO: 2890643 - protein, 13 aa, Entamoeba invadens
NTFTQSFNANKSD

SEQ ID NO: 2890644 - protein, 7 aa, Entamoeba invadens
NTGAGKT

SEQ ID NO: 2890645 - protein, 7 aa, Entamoeba invadens
NTGDCQS

SEQ ID NO: 2890646 - protein, 5 aa, Entamoeba invadens
NTGEA

SEQ ID NO: 2890647 - protein, 7 aa, Entamoeba invadens
NTGETKS

SEQ ID NO: 2890648 - protein, 16 aa, Entamoeba invadens
NTGFFDPQNGYTRQEL

SEQ ID NO: 2890649 - protein, 12 aa, Entamoeba invadens
NTGFKKKGSRWN

SEQ ID NO: 2890650 - protein, 5 aa, Entamoeba invadens
NTGGI

SEQ ID NO: 2890651 - protein, 10 aa, Entamoeba invadens
NTGHNGRDCP

SEQ ID NO: 2890652 - protein, 4 aa, Entamoeba invadens
NTGK

SEQ ID NO: 2890653 - protein, 5 aa, Entamoeba invadens
NTGKS

SEQ ID NO: 2890654 - protein, 15 aa, Entamoeba invadens
NTGLPRESLDNKMKE

SEQ ID NO: 2890655 - protein, 8 aa, Entamoeba invadens
NTGLPTPD

SEQ ID NO: 2890656 - protein, 6 aa, Entamoeba invadens
NTGLPV

SEQ ID NO: 2890657 - protein, 16 aa, Entamoeba invadens
NTGNKLPRSDSDKEID

SEQ ID NO: 2890658 - protein, 5 aa, Entamoeba invadens
NTGNR

SEQ ID NO: 2890659 - protein, 9 aa, Entamoeba invadens
NTGRSLTRS

SEQ ID NO: 2890660 - protein, 9 aa, Entamoeba invadens
NTGSAQPKG

SEQ ID NO: 2890661 - protein, 5 aa, Entamoeba invadens
NTGSL

SEQ ID NO: 2890662 - protein, 6 aa, Entamoeba invadens
NTGTKH

SEQ ID NO: 2890663 - protein, 7 aa, Entamoeba invadens
NTHEDAP

SEQ ID NO: 2890664 - protein, 5 aa, Entamoeba invadens
NTHFE

SEQ ID NO: 2890665 - protein, 15 aa, Entamoeba invadens
NTHFKSNTTGCIQFT

SEQ ID NO: 2890666 - protein, 25 aa, Entamoeba invadens
NTHFKSNTTGCKQSGSAKRSCYWKK

SEQ ID NO: 2890667 - protein, 4 aa, Entamoeba invadens
NTHM

SEQ ID NO: 2890668 - protein, 32 aa, Entamoeba invadens
NTHNINPDNSIHNSQYNEATQTTYQATEHPQP

SEQ ID NO: 2890669 - protein, 6 aa, Entamoeba invadens
NTHPDD

SEQ ID NO: 2890670 - protein, 14 aa, Entamoeba invadens
NTHSGMDDSEEEEI

SEQ ID NO: 2890671 - protein, 6 aa, Entamoeba invadens
NTHTDE

SEQ ID NO: 2890672 - protein, 6 aa, Entamoeba invadens
NTHTQV

SEQ ID NO: 2890673 - protein, 25 aa, Entamoeba invadens
NTIAPVAQQNGGDEKTMKLETPNQV

SEQ ID NO: 2890674 - protein, 4 aa, Entamoeba invadens
NTID

SEQ ID NO: 2890675 - protein, 13 aa, Entamoeba invadens
NTIDSSLTRPDGM

SEQ ID NO: 2890676 - protein, 10 aa, Entamoeba invadens
NTIEASQPVY

SEQ ID NO: 2890677 - protein, 6 aa, Entamoeba invadens
NTIEDQ

SEQ ID NO: 2890678 - protein, 17 aa, Entamoeba invadens
NTIEEENGIYNDNNRTL

SEQ ID NO: 2890679 - protein, 23 aa, Entamoeba invadens
NTIEEENGIYNDNNRTLGLKTME

SEQ ID NO: 2890680 - protein, 5 aa, Entamoeba invadens
NTIEG

SEQ ID NO: 2890681 - protein, 5 aa, Entamoeba invadens
NTIEQ

SEQ ID NO: 2890682 - protein, 4 aa, Entamoeba invadens
NTIG

SEQ ID NO: 2890683 - protein, 9 aa, Entamoeba invadens
NTIGDKSGK

SEQ ID NO: 2890684 - protein, 7 aa, Entamoeba invadens
NTIGKSF

SEQ ID NO: 2890685 - protein, 7 aa, Entamoeba invadens
NTIGSTA

SEQ ID NO: 2890686 - protein, 4 aa, Entamoeba invadens
NTIH

SEQ ID NO: 2890687 - protein, 4 aa, Entamoeba invadens
NTIK

SEQ ID NO: 2890688 - protein, 14 aa, Entamoeba invadens
NTIKNSPKQNEGIR

SEQ ID NO: 2890689 - protein, 10 aa, Entamoeba invadens
NTINNTIKTE

SEQ ID NO: 2890690 - protein, 6 aa, Entamoeba invadens
NTIQGA

SEQ ID NO: 2890691 - protein, 12 aa, Entamoeba invadens
NTIQQQSYCQPQ

SEQ ID NO: 2890692 - protein, 5 aa, Entamoeba invadens
NTIRA

SEQ ID NO: 2890693 - protein, 14 aa, Entamoeba invadens
NTIRSQDTTLPRFY

SEQ ID NO: 2890694 - protein, 4 aa, Entamoeba invadens
NTIS

SEQ ID NO: 2890695 - protein, 13 aa, Entamoeba invadens
NTISKRESTQREY

SEQ ID NO: 2890696 - protein, 6 aa, Entamoeba invadens
NTISSS

SEQ ID NO: 2890697 - protein, 4 aa, Entamoeba invadens
NTIT

SEQ ID NO: 2890698 - protein, 6 aa, Entamoeba invadens
NTITGR

SEQ ID NO: 2890699 - protein, 5 aa, Entamoeba invadens
NTITP

SEQ ID NO: 2890700 - protein, 9 aa, Entamoeba invadens
NTITSPKRF

SEQ ID NO: 2890701 - protein, 4 aa, Entamoeba invadens
NTKA

SEQ ID NO: 2890702 - protein, 11 aa, Entamoeba invadens
NTKADTEKELT

SEQ ID NO: 2890703 - protein, 7 aa, Entamoeba invadens
NTKAENA

SEQ ID NO: 2890704 - protein, 14 aa, Entamoeba invadens
NTKAPKEKKKPDWE

SEQ ID NO: 2890705 - protein, 7 aa, Entamoeba invadens
NTKASNR

SEQ ID NO: 2890706 - protein, 6 aa, Entamoeba invadens
NTKCSP

SEQ ID NO: 2890707 - protein, 9 aa, Entamoeba invadens
NTKDETITG

SEQ ID NO: 2890708 - protein, 9 aa, Entamoeba invadens
NTKDKTAVH

SEQ ID NO: 2890709 - protein, 5 aa, Entamoeba invadens
NTKDV

SEQ ID NO: 2890710 - protein, 4 aa, Entamoeba invadens
NTKE

SEQ ID NO: 2890711 - protein, 15 aa, Entamoeba invadens
NTKEDTTKQEEAQIK

SEQ ID NO: 2890712 - protein, 9 aa, Entamoeba invadens
NTKEIGQQI

SEQ ID NO: 2890713 - protein, 10 aa, Entamoeba invadens
NTKENENNTI

SEQ ID NO: 2890714 - protein, 7 aa, Entamoeba invadens
NTKESCS

SEQ ID NO: 2890715 - protein, 12 aa, Entamoeba invadens
NTKESPKFVSGT

SEQ ID NO: 2890716 - protein, 5 aa, Entamoeba invadens
NTKET

SEQ ID NO: 2890717 - protein, 11 aa, Entamoeba invadens
NTKEVKEGSVT

SEQ ID NO: 2890718 - protein, 13 aa, Entamoeba invadens
NTKFSTKKTKRVC

SEQ ID NO: 2890719 - protein, 10 aa, Entamoeba invadens
NTKGMKVGST

SEQ ID NO: 2890720 - protein, 8 aa, Entamoeba invadens
NTKGRGPS

SEQ ID NO: 2890721 - protein, 8 aa, Entamoeba invadens
NTKGSTPV

SEQ ID NO: 2890722 - protein, 7 aa, Entamoeba invadens
NTKITNA

SEQ ID NO: 2890723 - protein, 9 aa, Entamoeba invadens
NTKKDDKEF

SEQ ID NO: 2890724 - protein, 10 aa, Entamoeba invadens
NTKKQEKAPI

SEQ ID NO: 2890725 - protein, 9 aa, Entamoeba invadens
NTKKSIEEI

SEQ ID NO: 2890726 - protein, 20 aa, Entamoeba invadens
NTKKVRAMSTNYNEDKCPTT

SEQ ID NO: 2890727 - protein, 18 aa, Entamoeba invadens
NTKLPDDDTQPEKTMKLE

SEQ ID NO: 2890728 - protein, 4 aa, Entamoeba invadens
NTKM

SEQ ID NO: 2890729 - protein, 18 aa, Entamoeba invadens
NTKMPSQVEQTDTNVEVQ

SEQ ID NO: 2890730 - protein, 33 aa, Entamoeba invadens
NTKMQKTEKVEKKVQKSQPKIAKKTSRKNKKKV

SEQ ID NO: 2890731 - protein, 5 aa, Entamoeba invadens
NTKNA

SEQ ID NO: 2890732 - protein, 12 aa, Entamoeba invadens
NTKNEEENELQN

SEQ ID NO: 2890733 - protein, 9 aa, Entamoeba invadens
NTKNGPTKI

SEQ ID NO: 2890734 - protein, 15 aa, Entamoeba invadens
NTKNNTEHQQTYNEA

SEQ ID NO: 2890735 - protein, 19 aa, Entamoeba invadens
NTKPQHEKKHLRKESKYQN

SEQ ID NO: 2890736 - protein, 10 aa, Entamoeba invadens
NTKQSEMEKT

SEQ ID NO: 2890737 - protein, 6 aa, Entamoeba invadens
NTKQSI

SEQ ID NO: 2890738 - protein, 5 aa, Entamoeba invadens
NTKRN

SEQ ID NO: 2890739 - protein, 29 aa, Entamoeba invadens
NTKSDSFSPKDEKKALKQKEKELKKEEKK

SEQ ID NO: 2890740 - protein, 9 aa, Entamoeba invadens
NTKSEEKVK

SEQ ID NO: 2890741 - protein, 7 aa, Entamoeba invadens
NTKSEQA

SEQ ID NO: 2890742 - protein, 5 aa, Entamoeba invadens
NTKSI

SEQ ID NO: 2890743 - protein, 5 aa, Entamoeba invadens
NTKSL

SEQ ID NO: 2890744 - protein, 16 aa, Entamoeba invadens
NTKSNEADQQYEICKL

SEQ ID NO: 2890745 - protein, 14 aa, Entamoeba invadens
NTKSNETEQKYEIC

SEQ ID NO: 2890746 - protein, 12 aa, Entamoeba invadens
NTKSPQKRLTPE

SEQ ID NO: 2890747 - protein, 7 aa, Entamoeba invadens
NTKSTGF

SEQ ID NO: 2890748 - protein, 9 aa, Entamoeba invadens
NTKSTVQKE

SEQ ID NO: 2890749 - protein, 4 aa, Entamoeba invadens
NTKT

SEQ ID NO: 2890750 - protein, 17 aa, Entamoeba invadens
NTKTDNLKVDDENANPI

SEQ ID NO: 2890751 - protein, 5 aa, Entamoeba invadens
NTKTE

SEQ ID NO: 2890752 - protein, 5 aa, Entamoeba invadens
NTKTI

SEQ ID NO: 2890753 - protein, 7 aa, Entamoeba invadens
NTKTISD

SEQ ID NO: 2890754 - protein, 13 aa, Entamoeba invadens
NTKTKNAHSKKTS

SEQ ID NO: 2890755 - protein, 6 aa, Entamoeba invadens
NTKTKR

SEQ ID NO: 2890756 - protein, 5 aa, Entamoeba invadens
NTKTL

SEQ ID NO: 2890757 - protein, 9 aa, Entamoeba invadens
NTKTNETKK

SEQ ID NO: 2890758 - protein, 7 aa, Entamoeba invadens
NTKTPER

SEQ ID NO: 2890759 - protein, 5 aa, Entamoeba invadens
NTKTT

SEQ ID NO: 2890760 - protein, 7 aa, Entamoeba invadens
NTKTTQV

SEQ ID NO: 2890761 - protein, 4 aa, Entamoeba invadens
NTKV

SEQ ID NO: 2890762 - protein, 8 aa, Entamoeba invadens
NTKVPKNV

SEQ ID NO: 2890763 - protein, 8 aa, Entamoeba invadens
NTKVRKSS

SEQ ID NO: 2890764 - protein, 4 aa, Entamoeba invadens
NTKW

SEQ ID NO: 2890765 - protein, 4 aa, Entamoeba invadens
NTKY

SEQ ID NO: 2890766 - protein, 5 aa, Entamoeba invadens
NTKYA

SEQ ID NO: 2890767 - protein, 5 aa, Entamoeba invadens
NTKYE

SEQ ID NO: 2890768 - protein, 10 aa, Entamoeba invadens
NTKYGSAIPD

SEQ ID NO: 2890769 - protein, 10 aa, Entamoeba invadens
NTKYSVNTPE

SEQ ID NO: 2890770 - protein, 8 aa, Entamoeba invadens
NTKYTEKK

SEQ ID NO: 2890771 - protein, 20 aa, Entamoeba invadens
NTLAEGASRLATKAKNLFDD

SEQ ID NO: 2890772 - protein, 16 aa, Entamoeba invadens
NTLAEQQQSIQTIQPS

SEQ ID NO: 2890773 - protein, 7 aa, Entamoeba invadens
NTLDPAY

SEQ ID NO: 2890774 - protein, 14 aa, Entamoeba invadens
NTLDPHKDKSLPIT

SEQ ID NO: 2890775 - protein, 10 aa, Entamoeba invadens
NTLDQKQAQV

SEQ ID NO: 2890776 - protein, 8 aa, Entamoeba invadens
NTLEKDNK

SEQ ID NO: 2890777 - protein, 14 aa, Entamoeba invadens
NTLEKTKEAKKTCS

SEQ ID NO: 2890778 - protein, 17 aa, Entamoeba invadens
NTLENDTNEKEKRITEL

SEQ ID NO: 2890779 - protein, 6 aa, Entamoeba invadens
NTLGVS

SEQ ID NO: 2890780 - protein, 11 aa, Entamoeba invadens
NTLIPEDSKNF

SEQ ID NO: 2890781 - protein, 9 aa, Entamoeba invadens
NTLKSDYDN

SEQ ID NO: 2890782 - protein, 17 aa, Entamoeba invadens
NTLNDKSKQVDELQNEI

SEQ ID NO: 2890783 - protein, 11 aa, Entamoeba invadens
NTLNGETQYTE

SEQ ID NO: 2890784 - protein, 6 aa, Entamoeba invadens
NTLNNS

SEQ ID NO: 2890785 - protein, 9 aa, Entamoeba invadens
NTLNNSENY

SEQ ID NO: 2890786 - protein, 7 aa, Entamoeba invadens
NTLNPEK

SEQ ID NO: 2890787 - protein, 16 aa, Entamoeba invadens
NTLNQPNNTFETPKHP

SEQ ID NO: 2890788 - protein, 6 aa, Entamoeba invadens
NTLNSS

SEQ ID NO: 2890789 - protein, 4 aa, Entamoeba invadens
NTLP

SEQ ID NO: 2890790 - protein, 6 aa, Entamoeba invadens
NTLPDS

SEQ ID NO: 2890791 - protein, 6 aa, Entamoeba invadens
NTLPDY

SEQ ID NO: 2890792 - protein, 11 aa, Entamoeba invadens
NTLPNNTIKTK

SEQ ID NO: 2890793 - protein, 7 aa, Entamoeba invadens
NTLPQNR

SEQ ID NO: 2890794 - protein, 13 aa, Entamoeba invadens
NTLPTPANVNESV

SEQ ID NO: 2890795 - protein, 5 aa, Entamoeba invadens
NTLPV

SEQ ID NO: 2890796 - protein, 12 aa, Entamoeba invadens
NTLQKENEEMKK

SEQ ID NO: 2890797 - protein, 4 aa, Entamoeba invadens
NTLS

SEQ ID NO: 2890798 - protein, 20 aa, Entamoeba invadens
NTLSDEEKRLTDEETAKIAE

SEQ ID NO: 2890799 - protein, 14 aa, Entamoeba invadens
NTLSDKLKERVATD

SEQ ID NO: 2890800 - protein, 7 aa, Entamoeba invadens
NTLSDVS

SEQ ID NO: 2890801 - protein, 12 aa, Entamoeba invadens
NTLSKATPANFK

SEQ ID NO: 2890802 - protein, 19 aa, Entamoeba invadens
NTLSPTDAITAENNSNWDG

SEQ ID NO: 2890803 - protein, 7 aa, Entamoeba invadens
NTLSTEN

SEQ ID NO: 2890804 - protein, 4 aa, Entamoeba invadens
NTLT

SEQ ID NO: 2890805 - protein, 17 aa, Entamoeba invadens
NTLTLTGESSDRNTTTN

SEQ ID NO: 2890806 - protein, 5 aa, Entamoeba invadens
NTLTS

SEQ ID NO: 2890807 - protein, 5 aa, Entamoeba invadens
NTMDS

SEQ ID NO: 2890808 - protein, 6 aa, Entamoeba invadens
NTMNSE

SEQ ID NO: 2890809 - protein, 6 aa, Entamoeba invadens
NTMNTL

SEQ ID NO: 2890810 - protein, 32 aa, Entamoeba invadens
NTMSKDESVSGVEKKTSSVKKANMDIKESPEL

SEQ ID NO: 2890811 - protein, 20 aa, Entamoeba invadens
NTMTTTEDNTLRNPEQVNQY

SEQ ID NO: 2890812 - protein, 4 aa, Entamoeba invadens
NTMY

SEQ ID NO: 2890813 - protein, 6 aa, Entamoeba invadens
NTNAEG

SEQ ID NO: 2890814 - protein, 8 aa, Entamoeba invadens
NTNCSSNI

SEQ ID NO: 2890815 - protein, 8 aa, Entamoeba invadens
NTNDESGD

SEQ ID NO: 2890816 - protein, 6 aa, Entamoeba invadens
NTNDSI

SEQ ID NO: 2890817 - protein, 12 aa, Entamoeba invadens
NTNECVPDTTNY

SEQ ID NO: 2890818 - protein, 8 aa, Entamoeba invadens
NTNEDATV

SEQ ID NO: 2890819 - protein, 7 aa, Entamoeba invadens
NTNEERV

SEQ ID NO: 2890820 - protein, 12 aa, Entamoeba invadens
NTNENAQTFKDE

SEQ ID NO: 2890821 - protein, 5 aa, Entamoeba invadens
NTNEY

SEQ ID NO: 2890822 - protein, 6 aa, Entamoeba invadens
NTNFSR

SEQ ID NO: 2890823 - protein, 9 aa, Entamoeba invadens
NTNGEKKDW

SEQ ID NO: 2890824 - protein, 9 aa, Entamoeba invadens
NTNGTQTPN

SEQ ID NO: 2890825 - protein, 6 aa, Entamoeba invadens
NTNIKT

SEQ ID NO: 2890826 - protein, 5 aa, Entamoeba invadens
NTNIN

SEQ ID NO: 2890827 - protein, 6 aa, Entamoeba invadens
NTNINT

SEQ ID NO: 2890828 - protein, 6 aa, Entamoeba invadens
NTNIYN

SEQ ID NO: 2890829 - protein, 5 aa, Entamoeba invadens
NTNKD

SEQ ID NO: 2890830 - protein, 9 aa, Entamoeba invadens
NTNKENSKP

SEQ ID NO: 2890831 - protein, 5 aa, Entamoeba invadens
NTNKL

SEQ ID NO: 2890832 - protein, 9 aa, Entamoeba invadens
NTNKNTTKL

SEQ ID NO: 2890833 - protein, 5 aa, Entamoeba invadens
NTNKY

SEQ ID NO: 2890834 - protein, 4 aa, Entamoeba invadens
NTNL

SEQ ID NO: 2890835 - protein, 5 aa, Entamoeba invadens
NTNLG

SEQ ID NO: 2890836 - protein, 9 aa, Entamoeba invadens
NTNLKGEVE

SEQ ID NO: 2890837 - protein, 12 aa, Entamoeba invadens
NTNLTTELAPGH

SEQ ID NO: 2890838 - protein, 4 aa, Entamoeba invadens
NTNN

SEQ ID NO: 2890839 - protein, 10 aa, Entamoeba invadens
NTNNKGNDTI

SEQ ID NO: 2890840 - protein, 5 aa, Entamoeba invadens
NTNNS

SEQ ID NO: 2890841 - protein, 7 aa, Entamoeba invadens
NTNPPQQ

SEQ ID NO: 2890842 - protein, 6 aa, Entamoeba invadens
NTNPTY

SEQ ID NO: 2890843 - protein, 9 aa, Entamoeba invadens
NTNQDDDIS

SEQ ID NO: 2890844 - protein, 8 aa, Entamoeba invadens
NTNRNDIN

SEQ ID NO: 2890845 - protein, 17 aa, Entamoeba invadens
NTNRPPPQMTQQQTESL

SEQ ID NO: 2890846 - protein, 4 aa, Entamoeba invadens
NTNS

SEQ ID NO: 2890847 - protein, 5 aa, Entamoeba invadens
NTNSL

SEQ ID NO: 2890848 - protein, 6 aa, Entamoeba invadens
NTNSLQ

SEQ ID NO: 2890849 - protein, 8 aa, Entamoeba invadens
NTNSNKGK

SEQ ID NO: 2890850 - protein, 7 aa, Entamoeba invadens
NTNSNND

SEQ ID NO: 2890851 - protein, 9 aa, Entamoeba invadens
NTNSSQDPM

SEQ ID NO: 2890852 - protein, 10 aa, Entamoeba invadens
NTNSSQQQSF

SEQ ID NO: 2890853 - protein, 12 aa, Entamoeba invadens
NTNSTFSSEARN

SEQ ID NO: 2890854 - protein, 8 aa, Entamoeba invadens
NTNSTQDP

SEQ ID NO: 2890855 - protein, 4 aa, Entamoeba invadens
NTNT

SEQ ID NO: 2890856 - protein, 6 aa, Entamoeba invadens
NTNTEI

SEQ ID NO: 2890857 - protein, 7 aa, Entamoeba invadens
NTNTKSI

SEQ ID NO: 2890858 - protein, 7 aa, Entamoeba invadens
NTNTPVN

SEQ ID NO: 2890859 - protein, 7 aa, Entamoeba invadens
NTNTPYA

SEQ ID NO: 2890860 - protein, 6 aa, Entamoeba invadens
NTNTRE

SEQ ID NO: 2890861 - protein, 12 aa, Entamoeba invadens
NTNTTSVQSKTK

SEQ ID NO: 2890862 - protein, 7 aa, Entamoeba invadens
NTNTWLG

SEQ ID NO: 2890863 - protein, 7 aa, Entamoeba invadens
NTNVNNL

SEQ ID NO: 2890864 - protein, 25 aa, Entamoeba invadens
NTNVSDIHQRGGTILGSSRGNQNPK

SEQ ID NO: 2890865 - protein, 5 aa, Entamoeba invadens
NTNVT

SEQ ID NO: 2890866 - protein, 11 aa, Entamoeba invadens
NTNYTSRSQIT

SEQ ID NO: 2890867 - protein, 5 aa, Entamoeba invadens
NTNYY

SEQ ID NO: 2890868 - protein, 7 aa, Entamoeba invadens
NTPASSL

SEQ ID NO: 2890869 - protein, 5 aa, Entamoeba invadens
NTPAV

SEQ ID NO: 2890870 - protein, 6 aa, Entamoeba invadens
NTPCTS

SEQ ID NO: 2890871 - protein, 5 aa, Entamoeba invadens
NTPED

SEQ ID NO: 2890872 - protein, 6 aa, Entamoeba invadens
NTPEDI

SEQ ID NO: 2890873 - protein, 6 aa, Entamoeba invadens
NTPEEE

SEQ ID NO: 2890874 - protein, 9 aa, Entamoeba invadens
NTPEKAEVA

SEQ ID NO: 2890875 - protein, 8 aa, Entamoeba invadens
NTPEKGET

SEQ ID NO: 2890876 - protein, 5 aa, Entamoeba invadens
NTPEM

SEQ ID NO: 2890877 - protein, 10 aa, Entamoeba invadens
NTPEQISKNT

SEQ ID NO: 2890878 - protein, 33 aa, Entamoeba invadens
NTPERSLRAQQHSQSTLTLKSDQTKIPPERKTY

SEQ ID NO: 2890879 - protein, 15 aa, Entamoeba invadens
NTPFERPQSVPTNSA

SEQ ID NO: 2890880 - protein, 4 aa, Entamoeba invadens
NTPG

SEQ ID NO: 2890881 - protein, 13 aa, Entamoeba invadens
NTPGVSNTSSYVK

SEQ ID NO: 2890882 - protein, 6 aa, Entamoeba invadens
NTPHDH

SEQ ID NO: 2890883 - protein, 12 aa, Entamoeba invadens
NTPIDKEKEKAL

SEQ ID NO: 2890884 - protein, 11 aa, Entamoeba invadens
NTPIEKQQSNV

SEQ ID NO: 2890885 - protein, 4 aa, Entamoeba invadens
NTPK

SEQ ID NO: 2890886 - protein, 12 aa, Entamoeba invadens
NTPKDHEDYPSI

SEQ ID NO: 2890887 - protein, 31 aa, Entamoeba invadens
NTPKTTTDTPRSKSKSPTPKKGDKHKLERER

SEQ ID NO: 2890888 - protein, 4 aa, Entamoeba invadens
NTPL

SEQ ID NO: 2890889 - protein, 6 aa, Entamoeba invadens
NTPLPK

SEQ ID NO: 2890890 - protein, 4 aa, Entamoeba invadens
NTPM

SEQ ID NO: 2890891 - protein, 9 aa, Entamoeba invadens
NTPMGEYPY

SEQ ID NO: 2890892 - protein, 6 aa, Entamoeba invadens
NTPNIN

SEQ ID NO: 2890893 - protein, 6 aa, Entamoeba invadens
NTPNTL

SEQ ID NO: 2890894 - protein, 9 aa, Entamoeba invadens
NTPNTQKQA

SEQ ID NO: 2890895 - protein, 8 aa, Entamoeba invadens
NTPNVTKM

SEQ ID NO: 2890896 - protein, 9 aa, Entamoeba invadens
NTPPEHPDY

SEQ ID NO: 2890897 - protein, 6 aa, Entamoeba invadens
NTPPKF

SEQ ID NO: 2890898 - protein, 48 aa, Entamoeba invadens
NTPPKPSKSPPRPENLGSKPEQIQKLTPNGEDAPPLPPPRRTKRTTPS

SEQ ID NO: 2890899 - protein, 9 aa, Entamoeba invadens
NTPPLQNQT

SEQ ID NO: 2890900 - protein, 9 aa, Entamoeba invadens
NTPPMTQSL

SEQ ID NO: 2890901 - protein, 5 aa, Entamoeba invadens
NTPPN

SEQ ID NO: 2890902 - protein, 7 aa, Entamoeba invadens
NTPPSDF

SEQ ID NO: 2890903 - protein, 18 aa, Entamoeba invadens
NTPPSFQKKNVKGKPHNF

SEQ ID NO: 2890904 - protein, 7 aa, Entamoeba invadens
NTPQEKK

SEQ ID NO: 2890905 - protein, 5 aa, Entamoeba invadens
NTPQN

SEQ ID NO: 2890906 - protein, 7 aa, Entamoeba invadens
NTPQPNV

SEQ ID NO: 2890907 - protein, 16 aa, Entamoeba invadens
NTPQPSSYDHHEPRKV

SEQ ID NO: 2890908 - protein, 17 aa, Entamoeba invadens
NTPQQYPQTSQYPTYQQ

SEQ ID NO: 2890909 - protein, 73 aa, Entamoeba invadens
NTPQSKSDSIRVEAPNSPRTPGRSIPIKSKGGRSSLSKGETIDNDKKDKKDGSSSPQSETPKEKKRGMFSFMK

SEQ ID NO: 2890910 - protein, 8 aa, Entamoeba invadens
NTPQTHTD

SEQ ID NO: 2890911 - protein, 10 aa, Entamoeba invadens
NTPQTSTNDF

SEQ ID NO: 2890912 - protein, 13 aa, Entamoeba invadens
NTPSNSSGVEQQQ

SEQ ID NO: 2890913 - protein, 7 aa, Entamoeba invadens
NTPSQTR

SEQ ID NO: 2890914 - protein, 7 aa, Entamoeba invadens
NTPSSMA

SEQ ID NO: 2890915 - protein, 23 aa, Entamoeba invadens
NTPSTQGRYDESNDITFENQTPL

SEQ ID NO: 2890916 - protein, 5 aa, Entamoeba invadens
NTPTA

SEQ ID NO: 2890917 - protein, 6 aa, Entamoeba invadens
NTPTEI

SEQ ID NO: 2890918 - protein, 7 aa, Entamoeba invadens
NTPTHRP

SEQ ID NO: 2890919 - protein, 5 aa, Entamoeba invadens
NTPTK

SEQ ID NO: 2890920 - protein, 8 aa, Entamoeba invadens
NTPTKEEI

SEQ ID NO: 2890921 - protein, 6 aa, Entamoeba invadens
NTPTKF

SEQ ID NO: 2890922 - protein, 5 aa, Entamoeba invadens
NTPTP

SEQ ID NO: 2890923 - protein, 58 aa, Entamoeba invadens
NTPTPSNSSQLKPKTYTYQTKTPLKKENTVTPPQSTTGFKKPSPPSSQKTPPQTTVKT

SEQ ID NO: 2890924 - protein, 8 aa, Entamoeba invadens
NTPTTQTI

SEQ ID NO: 2890925 - protein, 4 aa, Entamoeba invadens
NTPV

SEQ ID NO: 2890926 - protein, 14 aa, Entamoeba invadens
NTPVEAPAAAPETK

SEQ ID NO: 2890927 - protein, 5 aa, Entamoeba invadens
NTPYD

SEQ ID NO: 2890928 - protein, 7 aa, Entamoeba invadens
NTPYSIS

SEQ ID NO: 2890929 - protein, 6 aa, Entamoeba invadens
NTPYYK

SEQ ID NO: 2890930 - protein, 38 aa, Entamoeba invadens
NTQCTEPIATQQDFDSDSFTESSEDNESDQNDEEHQTM

SEQ ID NO: 2890931 - protein, 10 aa, Entamoeba invadens
NTQDFTDSTR

SEQ ID NO: 2890932 - protein, 9 aa, Entamoeba invadens
NTQDNAQSV

SEQ ID NO: 2890933 - protein, 8 aa, Entamoeba invadens
NTQDPERA

SEQ ID NO: 2890934 - protein, 9 aa, Entamoeba invadens
NTQDPERAY

SEQ ID NO: 2890935 - protein, 16 aa, Entamoeba invadens
NTQDPNKVAVANENSV

SEQ ID NO: 2890936 - protein, 4 aa, Entamoeba invadens
NTQE

SEQ ID NO: 2890937 - protein, 9 aa, Entamoeba invadens
NTQEAQETL

SEQ ID NO: 2890938 - protein, 8 aa, Entamoeba invadens
NTQEESDE

SEQ ID NO: 2890939 - protein, 10 aa, Entamoeba invadens
NTQEKPLISS

SEQ ID NO: 2890940 - protein, 12 aa, Entamoeba invadens
NTQEYSEKRRPA

SEQ ID NO: 2890941 - protein, 15 aa, Entamoeba invadens
NTQFTTDNSDSSITT

SEQ ID NO: 2890942 - protein, 11 aa, Entamoeba invadens
NTQGEKMAKEL

SEQ ID NO: 2890943 - protein, 10 aa, Entamoeba invadens
NTQGQPQQQF

SEQ ID NO: 2890944 - protein, 7 aa, Entamoeba invadens
NTQHGNC

SEQ ID NO: 2890945 - protein, 26 aa, Entamoeba invadens
NTQIPQPASAPQNTNIPPPQQEPIQR

SEQ ID NO: 2890946 - protein, 5 aa, Entamoeba invadens
NTQIQ

SEQ ID NO: 2890947 - protein, 5 aa, Entamoeba invadens
NTQIS

SEQ ID NO: 2890948 - protein, 22 aa, Entamoeba invadens
NTQKENQVKGRHKFGAQNVKPK

SEQ ID NO: 2890949 - protein, 10 aa, Entamoeba invadens
NTQKKQDVSY

SEQ ID NO: 2890950 - protein, 5 aa, Entamoeba invadens
NTQKM

SEQ ID NO: 2890951 - protein, 12 aa, Entamoeba invadens
NTQKSMAEATQK

SEQ ID NO: 2890952 - protein, 5 aa, Entamoeba invadens
NTQKY

SEQ ID NO: 2890953 - protein, 9 aa, Entamoeba invadens
NTQKYEKAL

SEQ ID NO: 2890954 - protein, 4 aa, Entamoeba invadens
NTQN

SEQ ID NO: 2890955 - protein, 13 aa, Entamoeba invadens
NTQNLRKSTGSKY

SEQ ID NO: 2890956 - protein, 6 aa, Entamoeba invadens
NTQNLS

SEQ ID NO: 2890957 - protein, 16 aa, Entamoeba invadens
NTQNLSESSDDFGDDG

SEQ ID NO: 2890958 - protein, 6 aa, Entamoeba invadens
NTQNNC

SEQ ID NO: 2890959 - protein, 9 aa, Entamoeba invadens
NTQNNTKGE

SEQ ID NO: 2890960 - protein, 11 aa, Entamoeba invadens
NTQNNTKGKIV

SEQ ID NO: 2890961 - protein, 11 aa, Entamoeba invadens
NTQNQKNFTEL

SEQ ID NO: 2890962 - protein, 13 aa, Entamoeba invadens
NTQNQSDLTQPYT

SEQ ID NO: 2890963 - protein, 10 aa, Entamoeba invadens
NTQNRRETQL

SEQ ID NO: 2890964 - protein, 14 aa, Entamoeba invadens
NTQNSQPQQKMMNC

SEQ ID NO: 2890965 - protein, 18 aa, Entamoeba invadens
NTQNSTSFISEKQTTKSL

SEQ ID NO: 2890966 - protein, 11 aa, Entamoeba invadens
NTQNTNKNTNL

SEQ ID NO: 2890967 - protein, 6 aa, Entamoeba invadens
NTQPEH

SEQ ID NO: 2890968 - protein, 9 aa, Entamoeba invadens
NTQPKDYQY

SEQ ID NO: 2890969 - protein, 5 aa, Entamoeba invadens
NTQPL

SEQ ID NO: 2890970 - protein, 6 aa, Entamoeba invadens
NTQPSV

SEQ ID NO: 2890971 - protein, 6 aa, Entamoeba invadens
NTQPVD

SEQ ID NO: 2890972 - protein, 8 aa, Entamoeba invadens
NTQQGTQS

SEQ ID NO: 2890973 - protein, 15 aa, Entamoeba invadens
NTQQKAINSYGLYYH

SEQ ID NO: 2890974 - protein, 5 aa, Entamoeba invadens
NTQQP

SEQ ID NO: 2890975 - protein, 18 aa, Entamoeba invadens
NTQQSTQTNRSVTVTPNK

SEQ ID NO: 2890976 - protein, 8 aa, Entamoeba invadens
NTQQTDLD

SEQ ID NO: 2890977 - protein, 18 aa, Entamoeba invadens
NTQRISNNQTLNTVQPKV

SEQ ID NO: 2890978 - protein, 11 aa, Entamoeba invadens
NTQSQNDTTPL

SEQ ID NO: 2890979 - protein, 12 aa, Entamoeba invadens
NTQSTFQYNSTN

SEQ ID NO: 2890980 - protein, 6 aa, Entamoeba invadens
NTQSTL

SEQ ID NO: 2890981 - protein, 9 aa, Entamoeba invadens
NTQTGTRSD

SEQ ID NO: 2890982 - protein, 5 aa, Entamoeba invadens
NTQTI

SEQ ID NO: 2890983 - protein, 12 aa, Entamoeba invadens
NTQTTEDDPVKG

SEQ ID NO: 2890984 - protein, 6 aa, Entamoeba invadens
NTQTTR

SEQ ID NO: 2890985 - protein, 7 aa, Entamoeba invadens
NTQVSDE

SEQ ID NO: 2890986 - protein, 6 aa, Entamoeba invadens
NTQYPK

SEQ ID NO: 2890987 - protein, 4 aa, Entamoeba invadens
NTRA

SEQ ID NO: 2890988 - protein, 7 aa, Entamoeba invadens
NTRCTSC

SEQ ID NO: 2890989 - protein, 5 aa, Entamoeba invadens
NTRDQ

SEQ ID NO: 2890990 - protein, 4 aa, Entamoeba invadens
NTRI

SEQ ID NO: 2890991 - protein, 4 aa, Entamoeba invadens
NTRK

SEQ ID NO: 2890992 - protein, 7 aa, Entamoeba invadens
NTRKDLS

SEQ ID NO: 2890993 - protein, 16 aa, Entamoeba invadens
NTRKREPTDPVTTSNF

SEQ ID NO: 2890994 - protein, 18 aa, Entamoeba invadens
NTRKTQGTNERDNNPISK

SEQ ID NO: 2890995 - protein, 10 aa, Entamoeba invadens
NTRKYSTSSI

SEQ ID NO: 2890996 - protein, 5 aa, Entamoeba invadens
NTRPF

SEQ ID NO: 2890997 - protein, 4 aa, Entamoeba invadens
NTRQ

SEQ ID NO: 2890998 - protein, 7 aa, Entamoeba invadens
NTRQTMT

SEQ ID NO: 2890999 - protein, 9 aa, Entamoeba invadens
NTRQTTGLI

SEQ ID NO: 2891000 - protein, 9 aa, Entamoeba invadens
NTRRRGPEI

SEQ ID NO: 2891001 - protein, 13 aa, Entamoeba invadens
NTRRSKEVRSKRY

SEQ ID NO: 2891002 - protein, 9 aa, Entamoeba invadens
NTRSEMERT

SEQ ID NO: 2891003 - protein, 16 aa, Entamoeba invadens
NTSAFKNTKLTTTKGW

SEQ ID NO: 2891004 - protein, 7 aa, Entamoeba invadens
NTSCEPK

SEQ ID NO: 2891005 - protein, 6 aa, Entamoeba invadens
NTSDAD

SEQ ID NO: 2891006 - protein, 8 aa, Entamoeba invadens
NTSDKQDP

SEQ ID NO: 2891007 - protein, 9 aa, Entamoeba invadens
NTSDPLERA

SEQ ID NO: 2891008 - protein, 9 aa, Entamoeba invadens
NTSEDVEPR

SEQ ID NO: 2891009 - protein, 6 aa, Entamoeba invadens
NTSENL

SEQ ID NO: 2891010 - protein, 17 aa, Entamoeba invadens
NTSEQKEEKQKEEAETE

SEQ ID NO: 2891011 - protein, 12 aa, Entamoeba invadens
NTSESPKKDQVK

SEQ ID NO: 2891012 - protein, 6 aa, Entamoeba invadens
NTSETI

SEQ ID NO: 2891013 - protein, 7 aa, Entamoeba invadens
NTSFTSQ

SEQ ID NO: 2891014 - protein, 6 aa, Entamoeba invadens
NTSGTM

SEQ ID NO: 2891015 - protein, 5 aa, Entamoeba invadens
NTSGV

SEQ ID NO: 2891016 - protein, 9 aa, Entamoeba invadens
NTSHKCSEI

SEQ ID NO: 2891017 - protein, 4 aa, Entamoeba invadens
NTSI

SEQ ID NO: 2891018 - protein, 17 aa, Entamoeba invadens
NTSIKEKTKLETPPQNI

SEQ ID NO: 2891019 - protein, 6 aa, Entamoeba invadens
NTSIKN

SEQ ID NO: 2891020 - protein, 8 aa, Entamoeba invadens
NTSINSKA

SEQ ID NO: 2891021 - protein, 6 aa, Entamoeba invadens
NTSIRE

SEQ ID NO: 2891022 - protein, 5 aa, Entamoeba invadens
NTSKE

SEQ ID NO: 2891023 - protein, 6 aa, Entamoeba invadens
NTSKEF

SEQ ID NO: 2891024 - protein, 5 aa, Entamoeba invadens
NTSKI

SEQ ID NO: 2891025 - protein, 10 aa, Entamoeba invadens
NTSKKSKRQI

SEQ ID NO: 2891026 - protein, 7 aa, Entamoeba invadens
NTSKNGK

SEQ ID NO: 2891027 - protein, 7 aa, Entamoeba invadens
NTSKNTM

SEQ ID NO: 2891028 - protein, 9 aa, Entamoeba invadens
NTSKNTTKI

SEQ ID NO: 2891029 - protein, 16 aa, Entamoeba invadens
NTSKQNETRDAETSNE

SEQ ID NO: 2891030 - protein, 8 aa, Entamoeba invadens
NTSKSDKI

SEQ ID NO: 2891031 - protein, 7 aa, Entamoeba invadens
NTSKTGV

SEQ ID NO: 2891032 - protein, 11 aa, Entamoeba invadens
NTSLSTTTENL

SEQ ID NO: 2891033 - protein, 11 aa, Entamoeba invadens
NTSLTDEQKSE

SEQ ID NO: 2891034 - protein, 4 aa, Entamoeba invadens
NTSM

SEQ ID NO: 2891035 - protein, 8 aa, Entamoeba invadens
NTSNCPTK

SEQ ID NO: 2891036 - protein, 30 aa, Entamoeba invadens
NTSNDTLNNVNAERMAQQSFNGRINTTEIS

SEQ ID NO: 2891037 - protein, 7 aa, Entamoeba invadens
NTSNEAC

SEQ ID NO: 2891038 - protein, 9 aa, Entamoeba invadens
NTSNEENEI

SEQ ID NO: 2891039 - protein, 7 aa, Entamoeba invadens
NTSNLSP

SEQ ID NO: 2891040 - protein, 18 aa, Entamoeba invadens
NTSNNKLNPKDAEKYNYD

SEQ ID NO: 2891041 - protein, 11 aa, Entamoeba invadens
NTSNNSETNCE

SEQ ID NO: 2891042 - protein, 11 aa, Entamoeba invadens
NTSNYQPQITQ

SEQ ID NO: 2891043 - protein, 6 aa, Entamoeba invadens
NTSPNM

SEQ ID NO: 2891044 - protein, 19 aa, Entamoeba invadens
NTSPSLTPRKEEKESTKTV

SEQ ID NO: 2891045 - protein, 7 aa, Entamoeba invadens
NTSPTLS

SEQ ID NO: 2891046 - protein, 4 aa, Entamoeba invadens
NTSQ

SEQ ID NO: 2891047 - protein, 5 aa, Entamoeba invadens
NTSQA

SEQ ID NO: 2891048 - protein, 22 aa, Entamoeba invadens
NTSQHLSSVSSGPSHQNDMNNT

SEQ ID NO: 2891049 - protein, 4 aa, Entamoeba invadens
NTSR

SEQ ID NO: 2891050 - protein, 5 aa, Entamoeba invadens
NTSRN

SEQ ID NO: 2891051 - protein, 6 aa, Entamoeba invadens
NTSRSD

SEQ ID NO: 2891052 - protein, 4 aa, Entamoeba invadens
NTSS

SEQ ID NO: 2891053 - protein, 6 aa, Entamoeba invadens
NTSSEV

SEQ ID NO: 2891054 - protein, 5 aa, Entamoeba invadens
NTSSI

SEQ ID NO: 2891055 - protein, 8 aa, Entamoeba invadens
NTSSTGCY

SEQ ID NO: 2891056 - protein, 7 aa, Entamoeba invadens
NTSSYGD

SEQ ID NO: 2891057 - protein, 6 aa, Entamoeba invadens
NTSTGI

SEQ ID NO: 2891058 - protein, 9 aa, Entamoeba invadens
NTSTKPDQN

SEQ ID NO: 2891059 - protein, 7 aa, Entamoeba invadens
NTSTPNF

SEQ ID NO: 2891060 - protein, 18 aa, Entamoeba invadens
NTSTSMSSPRRKRYDDPK

SEQ ID NO: 2891061 - protein, 8 aa, Entamoeba invadens
NTSTTPVA

SEQ ID NO: 2891062 - protein, 8 aa, Entamoeba invadens
NTSTVSKG

SEQ ID NO: 2891063 - protein, 6 aa, Entamoeba invadens
NTSVGK

SEQ ID NO: 2891064 - protein, 18 aa, Entamoeba invadens
NTSVPQRGQIRQRPQQRI

SEQ ID NO: 2891065 - protein, 7 aa, Entamoeba invadens
NTSVTSV

SEQ ID NO: 2891066 - protein, 4 aa, Entamoeba invadens
NTTA

SEQ ID NO: 2891067 - protein, 8 aa, Entamoeba invadens
NTTAQQDI

SEQ ID NO: 2891068 - protein, 5 aa, Entamoeba invadens
NTTCA

SEQ ID NO: 2891069 - protein, 13 aa, Entamoeba invadens
NTTCESSSGYTTF

SEQ ID NO: 2891070 - protein, 6 aa, Entamoeba invadens
NTTDCK

SEQ ID NO: 2891071 - protein, 7 aa, Entamoeba invadens
NTTDEEI

SEQ ID NO: 2891072 - protein, 42 aa, Entamoeba invadens
NTTDEVNEIEKSIQEDKIRDKSLRDQTEKAKIQTAKVQNQTK

SEQ ID NO: 2891073 - protein, 10 aa, Entamoeba invadens
NTTDNFPETR

SEQ ID NO: 2891074 - protein, 6 aa, Entamoeba invadens
NTTDPQ

SEQ ID NO: 2891075 - protein, 18 aa, Entamoeba invadens
NTTDSFQQRESSSTSDIK

SEQ ID NO: 2891076 - protein, 15 aa, Entamoeba invadens
NTTEDKRDSQTKQVD

SEQ ID NO: 2891077 - protein, 19 aa, Entamoeba invadens
NTTEEAKKAVDELNGKEVD

SEQ ID NO: 2891078 - protein, 5 aa, Entamoeba invadens
NTTEI

SEQ ID NO: 2891079 - protein, 7 aa, Entamoeba invadens
NTTEKEL

SEQ ID NO: 2891080 - protein, 23 aa, Entamoeba invadens
NTTGATMSGFASEGGVSAEQEEL

SEQ ID NO: 2891081 - protein, 6 aa, Entamoeba invadens
NTTGLQ

SEQ ID NO: 2891082 - protein, 6 aa, Entamoeba invadens
NTTGNL

SEQ ID NO: 2891083 - protein, 19 aa, Entamoeba invadens
NTTHETNKGETTSTGNNTF

SEQ ID NO: 2891084 - protein, 17 aa, Entamoeba invadens
NTTHFNSETLKSDVNNV

SEQ ID NO: 2891085 - protein, 5 aa, Entamoeba invadens
NTTHN

SEQ ID NO: 2891086 - protein, 4 aa, Entamoeba invadens
NTTI

SEQ ID NO: 2891087 - protein, 16 aa, Entamoeba invadens
NTTIDPNDIQLNELIN

SEQ ID NO: 2891088 - protein, 5 aa, Entamoeba invadens
NTTIE

SEQ ID NO: 2891089 - protein, 5 aa, Entamoeba invadens
NTTIN

SEQ ID NO: 2891090 - protein, 6 aa, Entamoeba invadens
NTTKAK

SEQ ID NO: 2891091 - protein, 9 aa, Entamoeba invadens
NTTKDGINS

SEQ ID NO: 2891092 - protein, 6 aa, Entamoeba invadens
NTTKDI

SEQ ID NO: 2891093 - protein, 6 aa, Entamoeba invadens
NTTKEI

SEQ ID NO: 2891094 - protein, 8 aa, Entamoeba invadens
NTTKEQMK

SEQ ID NO: 2891095 - protein, 6 aa, Entamoeba invadens
NTTKKY

SEQ ID NO: 2891096 - protein, 5 aa, Entamoeba invadens
NTTKN

SEQ ID NO: 2891097 - protein, 5 aa, Entamoeba invadens
NTTKV

SEQ ID NO: 2891098 - protein, 12 aa, Entamoeba invadens
NTTLASPVRSVS

SEQ ID NO: 2891099 - protein, 6 aa, Entamoeba invadens
NTTLKG

SEQ ID NO: 2891100 - protein, 9 aa, Entamoeba invadens
NTTLNENNP

SEQ ID NO: 2891101 - protein, 5 aa, Entamoeba invadens
NTTLS

SEQ ID NO: 2891102 - protein, 8 aa, Entamoeba invadens
NTTLTKEE

SEQ ID NO: 2891103 - protein, 14 aa, Entamoeba invadens
NTTMDEEARKRGTT

SEQ ID NO: 2891104 - protein, 18 aa, Entamoeba invadens
NTTNDDNINIQNKSESVD

SEQ ID NO: 2891105 - protein, 5 aa, Entamoeba invadens
NTTNK

SEQ ID NO: 2891106 - protein, 30 aa, Entamoeba invadens
NTTNKPTAQPSITPKTTAVQPTEKQTTANI

SEQ ID NO: 2891107 - protein, 7 aa, Entamoeba invadens
NTTNPAC

SEQ ID NO: 2891108 - protein, 7 aa, Entamoeba invadens
NTTNPEK

SEQ ID NO: 2891109 - protein, 33 aa, Entamoeba invadens
NTTNPLSHSTPSSTNGSINNTNGHSTAQRPSPS

SEQ ID NO: 2891110 - protein, 9 aa, Entamoeba invadens
NTTNPSCST

SEQ ID NO: 2891111 - protein, 21 aa, Entamoeba invadens
NTTPPEVHKQTQSTAKTVSME

SEQ ID NO: 2891112 - protein, 5 aa, Entamoeba invadens
NTTPQ

SEQ ID NO: 2891113 - protein, 9 aa, Entamoeba invadens
NTTPQNAKS

SEQ ID NO: 2891114 - protein, 7 aa, Entamoeba invadens
NTTPSPL

SEQ ID NO: 2891115 - protein, 8 aa, Entamoeba invadens
NTTPYDKN

SEQ ID NO: 2891116 - protein, 5 aa, Entamoeba invadens
NTTQL

SEQ ID NO: 2891117 - protein, 9 aa, Entamoeba invadens
NTTQNKDFK

SEQ ID NO: 2891118 - protein, 25 aa, Entamoeba invadens
NTTQPQTNTQNPLYTQPATTTNPLG

SEQ ID NO: 2891119 - protein, 51 aa, Entamoeba invadens
NTTRDEAKKKRALQPKEKKPKREKSTTPDLSEEKKGKAKRGRKKGETVEGS

SEQ ID NO: 2891120 - protein, 4 aa, Entamoeba invadens
NTTS

SEQ ID NO: 2891121 - protein, 10 aa, Entamoeba invadens
NTTSEEMTES

SEQ ID NO: 2891122 - protein, 7 aa, Entamoeba invadens
NTTSGKN

SEQ ID NO: 2891123 - protein, 9 aa, Entamoeba invadens
NTTSPPEDI

SEQ ID NO: 2891124 - protein, 8 aa, Entamoeba invadens
NTTSSPQF

SEQ ID NO: 2891125 - protein, 5 aa, Entamoeba invadens
NTTTD

SEQ ID NO: 2891126 - protein, 17 aa, Entamoeba invadens
NTTTITDIENQQDTHQP

SEQ ID NO: 2891127 - protein, 5 aa, Entamoeba invadens
NTTTK

SEQ ID NO: 2891128 - protein, 7 aa, Entamoeba invadens
NTTTKIK

SEQ ID NO: 2891129 - protein, 7 aa, Entamoeba invadens
NTTTKVK

SEQ ID NO: 2891130 - protein, 11 aa, Entamoeba invadens
NTTTPPQVPPM

SEQ ID NO: 2891131 - protein, 5 aa, Entamoeba invadens
NTTTQ

SEQ ID NO: 2891132 - protein, 128 aa, Entamoeba invadens
NTTTQPYHEPSQTTNYQNTNLRGQTTKQEYPSNYPTSQTTSTTNTNMEYPTQYPTSCTQNDYPTQYPSSNTTSYGNTQYPTQYPMSNSTQSNNPFNQPYGMPTNTNANYSQPYGGQGFQQYGATPGTF

SEQ ID NO: 2891133 - protein, 7 aa, Entamoeba invadens
NTTTSQS

SEQ ID NO: 2891134 - protein, 8 aa, Entamoeba invadens
NTTTSSVT

SEQ ID NO: 2891135 - protein, 8 aa, Entamoeba invadens
NTTTTEQD

SEQ ID NO: 2891136 - protein, 11 aa, Entamoeba invadens
NTTTTNENEKF

SEQ ID NO: 2891137 - protein, 5 aa, Entamoeba invadens
NTTTV

SEQ ID NO: 2891138 - protein, 15 aa, Entamoeba invadens
NTTVKATSKNGKVDG

SEQ ID NO: 2891139 - protein, 10 aa, Entamoeba invadens
NTTVPSNGKL

SEQ ID NO: 2891140 - protein, 7 aa, Entamoeba invadens
NTTYAPT

SEQ ID NO: 2891141 - protein, 7 aa, Entamoeba invadens
NTTYNGN

SEQ ID NO: 2891142 - protein, 5 aa, Entamoeba invadens
NTTYT

SEQ ID NO: 2891143 - protein, 6 aa, Entamoeba invadens
NTVADK

SEQ ID NO: 2891144 - protein, 7 aa, Entamoeba invadens
NTVAQED

SEQ ID NO: 2891145 - protein, 12 aa, Entamoeba invadens
NTVDDSESGSDS

SEQ ID NO: 2891146 - protein, 25 aa, Entamoeba invadens
NTVDLPTSPNLDQKVEKEEPKNTKQ

SEQ ID NO: 2891147 - protein, 31 aa, Entamoeba invadens
NTVDTTTFTDSEQNTPRYTNNDSEETSEDVY

SEQ ID NO: 2891148 - protein, 123 aa, Entamoeba invadens
NTVEDKEKHEAEPMQTEKSELEELKTEESKPAVLTQTEEVEKHKTEPIQSEELKPVESKPILTQTKDVEQTEAKLDEKVETNSNKKKQEKQEKQDKKLSKKSKKEDKLSSWGEYGHSKTTQTP

SEQ ID NO: 2891149 - protein, 6 aa, Entamoeba invadens
NTVEED

SEQ ID NO: 2891150 - protein, 5 aa, Entamoeba invadens
NTVEG

SEQ ID NO: 2891151 - protein, 13 aa, Entamoeba invadens
NTVENGDCENKGV

SEQ ID NO: 2891152 - protein, 6 aa, Entamoeba invadens
NTVETH

SEQ ID NO: 2891153 - protein, 18 aa, Entamoeba invadens
NTVGADKAVAAASPKKEL

SEQ ID NO: 2891154 - protein, 5 aa, Entamoeba invadens
NTVGD

SEQ ID NO: 2891155 - protein, 7 aa, Entamoeba invadens
NTVGQGD

SEQ ID NO: 2891156 - protein, 10 aa, Entamoeba invadens
NTVKYSNNQK

SEQ ID NO: 2891157 - protein, 12 aa, Entamoeba invadens
NTVNSVGNKSFD

SEQ ID NO: 2891158 - protein, 6 aa, Entamoeba invadens
NTVQSD

SEQ ID NO: 2891159 - protein, 17 aa, Entamoeba invadens
NTVRQNNDAKKSTIKKL

SEQ ID NO: 2891160 - protein, 7 aa, Entamoeba invadens
NTVRSGM

SEQ ID NO: 2891161 - protein, 44 aa, Entamoeba invadens
NTVSDFSQTLQNTNENKTIEEPTTEKTEIAQPDQKVTPDNHTIE

SEQ ID NO: 2891162 - protein, 8 aa, Entamoeba invadens
NTVSGSEN

SEQ ID NO: 2891163 - protein, 11 aa, Entamoeba invadens
NTVSVGGGAAD

SEQ ID NO: 2891164 - protein, 12 aa, Entamoeba invadens
NTVSVKNEGVES

SEQ ID NO: 2891165 - protein, 4 aa, Entamoeba invadens
NTVT

SEQ ID NO: 2891166 - protein, 13 aa, Entamoeba invadens
NTVTGSPKSIKSV

SEQ ID NO: 2891167 - protein, 5 aa, Entamoeba invadens
NTVTK

SEQ ID NO: 2891168 - protein, 6 aa, Entamoeba invadens
NTVTSI

SEQ ID NO: 2891169 - protein, 4 aa, Entamoeba invadens
NTVV

SEQ ID NO: 2891170 - protein, 5 aa, Entamoeba invadens
NTWGS

SEQ ID NO: 2891171 - protein, 4 aa, Entamoeba invadens
NTWQ

SEQ ID NO: 2891172 - protein, 10 aa, Entamoeba invadens
NTWSEGPDFG

SEQ ID NO: 2891173 - protein, 24 aa, Entamoeba invadens
NTYAGNPVETAADGRSTTNEPDCS

SEQ ID NO: 2891174 - protein, 7 aa, Entamoeba invadens
NTYAPTP

SEQ ID NO: 2891175 - protein, 6 aa, Entamoeba invadens
NTYEGN

SEQ ID NO: 2891176 - protein, 9 aa, Entamoeba invadens
NTYGTGVIP

SEQ ID NO: 2891177 - protein, 14 aa, Entamoeba invadens
NTYNSLAKKGNQAI

SEQ ID NO: 2891178 - protein, 5 aa, Entamoeba invadens
NTYQE

SEQ ID NO: 2891179 - protein, 8 aa, Entamoeba invadens
NTYQTDRQ

SEQ ID NO: 2891180 - protein, 8 aa, Entamoeba invadens
NTYQVQTE

SEQ ID NO: 2891181 - protein, 6 aa, Entamoeba invadens
NTYSDS

SEQ ID NO: 2891182 - protein, 6 aa, Entamoeba invadens
NTYTDG

SEQ ID NO: 2891183 - protein, 6 aa, Entamoeba invadens
NTYYTN

SEQ ID NO: 2891184 - protein, 6 aa, Entamoeba invadens
NTYYTQ

SEQ ID NO: 2891185 - protein, 14 aa, Entamoeba invadens
NVAERKEEKIKLLK

SEQ ID NO: 2891186 - protein, 12 aa, Entamoeba invadens
NVAESLSSREVM

SEQ ID NO: 2891187 - protein, 10 aa, Entamoeba invadens
NVAGGKLADD

SEQ ID NO: 2891188 - protein, 9 aa, Entamoeba invadens
NVAGTSKEA

SEQ ID NO: 2891189 - protein, 4 aa, Entamoeba invadens
NVAN

SEQ ID NO: 2891190 - protein, 4 aa, Entamoeba invadens
NVAP

SEQ ID NO: 2891191 - protein, 12 aa, Entamoeba invadens
NVAQGSKKDKLV

SEQ ID NO: 2891192 - protein, 12 aa, Entamoeba invadens
NVAQPYEKEDYE

SEQ ID NO: 2891193 - protein, 9 aa, Entamoeba invadens
NVATSISGK

SEQ ID NO: 2891194 - protein, 17 aa, Entamoeba invadens
NVDAGNTKQQTVTPTPV

SEQ ID NO: 2891195 - protein, 9 aa, Entamoeba invadens
NVDDENEWE

SEQ ID NO: 2891196 - protein, 5 aa, Entamoeba invadens
NVDDS

SEQ ID NO: 2891197 - protein, 24 aa, Entamoeba invadens
NVDEIKTKGEEEDEKEKKQNDEIE

SEQ ID NO: 2891198 - protein, 7 aa, Entamoeba invadens
NVDEWSS

SEQ ID NO: 2891199 - protein, 9 aa, Entamoeba invadens
NVDGKSAEY

SEQ ID NO: 2891200 - protein, 6 aa, Entamoeba invadens
NVDGRD

SEQ ID NO: 2891201 - protein, 12 aa, Entamoeba invadens
NVDNYKTRQRAE

SEQ ID NO: 2891202 - protein, 6 aa, Entamoeba invadens
NVDPKY

SEQ ID NO: 2891203 - protein, 5 aa, Entamoeba invadens
NVDPN

SEQ ID NO: 2891204 - protein, 5 aa, Entamoeba invadens
NVDQY

SEQ ID NO: 2891205 - protein, 12 aa, Entamoeba invadens
NVDSPRKSPVKE

SEQ ID NO: 2891206 - protein, 9 aa, Entamoeba invadens
NVDTAANSI

SEQ ID NO: 2891207 - protein, 12 aa, Entamoeba invadens
NVDTLAEDADYE

SEQ ID NO: 2891208 - protein, 8 aa, Entamoeba invadens
NVEDKEKK

SEQ ID NO: 2891209 - protein, 10 aa, Entamoeba invadens
NVEDKRADKV

SEQ ID NO: 2891210 - protein, 7 aa, Entamoeba invadens
NVEEESL

SEQ ID NO: 2891211 - protein, 5 aa, Entamoeba invadens
NVEEN

SEQ ID NO: 2891212 - protein, 12 aa, Entamoeba invadens
NVEEPQTPKDAV

SEQ ID NO: 2891213 - protein, 13 aa, Entamoeba invadens
NVEESTEKKITTE

SEQ ID NO: 2891214 - protein, 11 aa, Entamoeba invadens
NVEGDETDESF

SEQ ID NO: 2891215 - protein, 17 aa, Entamoeba invadens
NVEGQAELKKLVKKVKD

SEQ ID NO: 2891216 - protein, 11 aa, Entamoeba invadens
NVEGSESSFAD

SEQ ID NO: 2891217 - protein, 10 aa, Entamoeba invadens
NVEKKENELD

SEQ ID NO: 2891218 - protein, 8 aa, Entamoeba invadens
NVEKNSSI

SEQ ID NO: 2891219 - protein, 5 aa, Entamoeba invadens
NVENP

SEQ ID NO: 2891220 - protein, 7 aa, Entamoeba invadens
NVENTTD

SEQ ID NO: 2891221 - protein, 4 aa, Entamoeba invadens
NVEP

SEQ ID NO: 2891222 - protein, 29 aa, Entamoeba invadens
NVEPPPPTLYTKSDKDEKLRDETKPRKVL

SEQ ID NO: 2891223 - protein, 9 aa, Entamoeba invadens
NVEQDASTG

SEQ ID NO: 2891224 - protein, 7 aa, Entamoeba invadens
NVERKSR

SEQ ID NO: 2891225 - protein, 4 aa, Entamoeba invadens
NVET

SEQ ID NO: 2891226 - protein, 18 aa, Entamoeba invadens
NVETHKKVSEATKENSGI

SEQ ID NO: 2891227 - protein, 12 aa, Entamoeba invadens
NVETPKESKKDI

SEQ ID NO: 2891228 - protein, 8 aa, Entamoeba invadens
NVFEDPPS

SEQ ID NO: 2891229 - protein, 5 aa, Entamoeba invadens
NVFGG

SEQ ID NO: 2891230 - protein, 29 aa, Entamoeba invadens
NVFGRSDRDSWSKTTEMKLPESDADMATS

SEQ ID NO: 2891231 - protein, 13 aa, Entamoeba invadens
NVFTPGNLSTQPT

SEQ ID NO: 2891232 - protein, 4 aa, Entamoeba invadens
NVGD

SEQ ID NO: 2891233 - protein, 11 aa, Entamoeba invadens
NVGDRASETEA

SEQ ID NO: 2891234 - protein, 29 aa, Entamoeba invadens
NVGEDSKVLTDTKDMKETPKSGIKRTDIT

SEQ ID NO: 2891235 - protein, 6 aa, Entamoeba invadens
NVGEEV

SEQ ID NO: 2891236 - protein, 10 aa, Entamoeba invadens
NVGEKDYDTY

SEQ ID NO: 2891237 - protein, 13 aa, Entamoeba invadens
NVGEKKSSTFNVP

SEQ ID NO: 2891238 - protein, 9 aa, Entamoeba invadens
NVGGPKGDI

SEQ ID NO: 2891239 - protein, 6 aa, Entamoeba invadens
NVGGSI

SEQ ID NO: 2891240 - protein, 10 aa, Entamoeba invadens
NVGHDKNGQL

SEQ ID NO: 2891241 - protein, 10 aa, Entamoeba invadens
NVGKGDKEKW

SEQ ID NO: 2891242 - protein, 5 aa, Entamoeba invadens
NVGKH

SEQ ID NO: 2891243 - protein, 5 aa, Entamoeba invadens
NVGLT

SEQ ID NO: 2891244 - protein, 8 aa, Entamoeba invadens
NVGMEGKS

SEQ ID NO: 2891245 - protein, 8 aa, Entamoeba invadens
NVGPGNNI

SEQ ID NO: 2891246 - protein, 5 aa, Entamoeba invadens
NVGSG

SEQ ID NO: 2891247 - protein, 11 aa, Entamoeba invadens
NVGTSADAQES

SEQ ID NO: 2891248 - protein, 11 aa, Entamoeba invadens
NVGYTEQDTEL

SEQ ID NO: 2891249 - protein, 8 aa, Entamoeba invadens
NVHAPKDM

SEQ ID NO: 2891250 - protein, 10 aa, Entamoeba invadens
NVHQEDGREC

SEQ ID NO: 2891251 - protein, 5 aa, Entamoeba invadens
NVIEN

SEQ ID NO: 2891252 - protein, 13 aa, Entamoeba invadens
NVIQPNSPKVPTV

SEQ ID NO: 2891253 - protein, 13 aa, Entamoeba invadens
NVKDDGKGTKALS

SEQ ID NO: 2891254 - protein, 14 aa, Entamoeba invadens
NVKDKHKQSESTTT

SEQ ID NO: 2891255 - protein, 5 aa, Entamoeba invadens
NVKDT

SEQ ID NO: 2891256 - protein, 15 aa, Entamoeba invadens
NVKEESDLNEDGSAS

SEQ ID NO: 2891257 - protein, 6 aa, Entamoeba invadens
NVKETI

SEQ ID NO: 2891258 - protein, 6 aa, Entamoeba invadens
NVKGEE

SEQ ID NO: 2891259 - protein, 33 aa, Entamoeba invadens
NVKHNDGEISTQQGTTPSGQSTLEEKKINQNAN

SEQ ID NO: 2891260 - protein, 24 aa, Entamoeba invadens
NVKKDEKKNDDIKNETKKINDEIE

SEQ ID NO: 2891261 - protein, 9 aa, Entamoeba invadens
NVKKTKDHY

SEQ ID NO: 2891262 - protein, 5 aa, Entamoeba invadens
NVKNG

SEQ ID NO: 2891263 - protein, 23 aa, Entamoeba invadens
NVKNNNTTSQKKMSKINKNRCII

SEQ ID NO: 2891264 - protein, 13 aa, Entamoeba invadens
NVKPKSSEDLKEI

SEQ ID NO: 2891265 - protein, 6 aa, Entamoeba invadens
NVKPSV

SEQ ID NO: 2891266 - protein, 20 aa, Entamoeba invadens
NVKRQTKYTNIKTKTIKCVL

SEQ ID NO: 2891267 - protein, 4 aa, Entamoeba invadens
NVKS

SEQ ID NO: 2891268 - protein, 35 aa, Entamoeba invadens
NVKSEAQTLKSSTPPISKQPNDSLKRQNSLNNDDI

SEQ ID NO: 2891269 - protein, 5 aa, Entamoeba invadens
NVKSG

SEQ ID NO: 2891270 - protein, 11 aa, Entamoeba invadens
NVKSKKREDTL

SEQ ID NO: 2891271 - protein, 8 aa, Entamoeba invadens
NVKSNSVQ

SEQ ID NO: 2891272 - protein, 9 aa, Entamoeba invadens
NVKTSAYNA

SEQ ID NO: 2891273 - protein, 4 aa, Entamoeba invadens
NVLE

SEQ ID NO: 2891274 - protein, 4 aa, Entamoeba invadens
NVLN

SEQ ID NO: 2891275 - protein, 5 aa, Entamoeba invadens
NVLNQ

SEQ ID NO: 2891276 - protein, 11 aa, Entamoeba invadens
NVLRKGTKRVK

SEQ ID NO: 2891277 - protein, 12 aa, Entamoeba invadens
NVLSGSSEIPLN

SEQ ID NO: 2891278 - protein, 6 aa, Entamoeba invadens
NVLSGT

SEQ ID NO: 2891279 - protein, 6 aa, Entamoeba invadens
NVNAAD

SEQ ID NO: 2891280 - protein, 8 aa, Entamoeba invadens
NVNANKQK

SEQ ID NO: 2891281 - protein, 25 aa, Entamoeba invadens
NVNANNEISSSSISENFKDKSESLL

SEQ ID NO: 2891282 - protein, 5 aa, Entamoeba invadens
NVNDK

SEQ ID NO: 2891283 - protein, 17 aa, Entamoeba invadens
NVNDKVNAKPTDFESSR

SEQ ID NO: 2891284 - protein, 7 aa, Entamoeba invadens
NVNDPKF

SEQ ID NO: 2891285 - protein, 7 aa, Entamoeba invadens
NVNEEEK

SEQ ID NO: 2891286 - protein, 7 aa, Entamoeba invadens
NVNEKGE

SEQ ID NO: 2891287 - protein, 8 aa, Entamoeba invadens
NVNETKEK

SEQ ID NO: 2891288 - protein, 5 aa, Entamoeba invadens
NVNGI

SEQ ID NO: 2891289 - protein, 5 aa, Entamoeba invadens
NVNIN

SEQ ID NO: 2891290 - protein, 14 aa, Entamoeba invadens
NVNKGNSLKELDDK

SEQ ID NO: 2891291 - protein, 19 aa, Entamoeba invadens
NVNKNSSDTQEEKCKEEQL

SEQ ID NO: 2891292 - protein, 11 aa, Entamoeba invadens
NVNNETDQEID

SEQ ID NO: 2891293 - protein, 8 aa, Entamoeba invadens
NVNSPQIK

SEQ ID NO: 2891294 - protein, 18 aa, Entamoeba invadens
NVNTQQVDKLGKKPENYA

SEQ ID NO: 2891295 - protein, 8 aa, Entamoeba invadens
NVNTQSKN

SEQ ID NO: 2891296 - protein, 4 aa, Entamoeba invadens
NVNV

SEQ ID NO: 2891297 - protein, 5 aa, Entamoeba invadens
NVPDQ

SEQ ID NO: 2891298 - protein, 8 aa, Entamoeba invadens
NVPEEPQI

SEQ ID NO: 2891299 - protein, 11 aa, Entamoeba invadens
NVPESTPKTHT

SEQ ID NO: 2891300 - protein, 6 aa, Entamoeba invadens
NVPETE

SEQ ID NO: 2891301 - protein, 12 aa, Entamoeba invadens
NVPGAGFAGDTN

SEQ ID NO: 2891302 - protein, 6 aa, Entamoeba invadens
NVPKEN

SEQ ID NO: 2891303 - protein, 6 aa, Entamoeba invadens
NVPKND

SEQ ID NO: 2891304 - protein, 8 aa, Entamoeba invadens
NVPKPFDN

SEQ ID NO: 2891305 - protein, 18 aa, Entamoeba invadens
NVPKSDESSGKQAAAPVD

SEQ ID NO: 2891306 - protein, 5 aa, Entamoeba invadens
NVPLE

SEQ ID NO: 2891307 - protein, 6 aa, Entamoeba invadens
NVPLPQ

SEQ ID NO: 2891308 - protein, 7 aa, Entamoeba invadens
NVPLPQQ

SEQ ID NO: 2891309 - protein, 10 aa, Entamoeba invadens
NVPPKKKSFS

SEQ ID NO: 2891310 - protein, 22 aa, Entamoeba invadens
NVPPLDDERDVQLNNEQTKKGC

SEQ ID NO: 2891311 - protein, 24 aa, Entamoeba invadens
NVPPPSSTSMEENQYSDTSSPIPI

SEQ ID NO: 2891312 - protein, 4 aa, Entamoeba invadens
NVPQ

SEQ ID NO: 2891313 - protein, 9 aa, Entamoeba invadens
NVPQTIQPN

SEQ ID NO: 2891314 - protein, 8 aa, Entamoeba invadens
NVPQTKMP

SEQ ID NO: 2891315 - protein, 6 aa, Entamoeba invadens
NVPSDL

SEQ ID NO: 2891316 - protein, 8 aa, Entamoeba invadens
NVPSGKNV

SEQ ID NO: 2891317 - protein, 9 aa, Entamoeba invadens
NVPSGVEPI

SEQ ID NO: 2891318 - protein, 5 aa, Entamoeba invadens
NVQER

SEQ ID NO: 2891319 - protein, 8 aa, Entamoeba invadens
NVQESGTH

SEQ ID NO: 2891320 - protein, 5 aa, Entamoeba invadens
NVQGL

SEQ ID NO: 2891321 - protein, 11 aa, Entamoeba invadens
NVQKGESCNEG

SEQ ID NO: 2891322 - protein, 16 aa, Entamoeba invadens
NVQNSLQQQAAEKARM

SEQ ID NO: 2891323 - protein, 16 aa, Entamoeba invadens
NVQPAHQSTVAQQPIL

SEQ ID NO: 2891324 - protein, 6 aa, Entamoeba invadens
NVQPIS

SEQ ID NO: 2891325 - protein, 21 aa, Entamoeba invadens
NVQPNANEQVSKNSPLRQTSD

SEQ ID NO: 2891326 - protein, 6 aa, Entamoeba invadens
NVQQQH

SEQ ID NO: 2891327 - protein, 13 aa, Entamoeba invadens
NVQSQPNQKCNSN

SEQ ID NO: 2891328 - protein, 7 aa, Entamoeba invadens
NVRDDGD

SEQ ID NO: 2891329 - protein, 5 aa, Entamoeba invadens
NVRDT

SEQ ID NO: 2891330 - protein, 8 aa, Entamoeba invadens
NVREGNSA

SEQ ID NO: 2891331 - protein, 6 aa, Entamoeba invadens
NVRELP

SEQ ID NO: 2891332 - protein, 8 aa, Entamoeba invadens
NVRETKEP

SEQ ID NO: 2891333 - protein, 7 aa, Entamoeba invadens
NVRRSAD

SEQ ID NO: 2891334 - protein, 8 aa, Entamoeba invadens
NVRTDGRS

SEQ ID NO: 2891335 - protein, 13 aa, Entamoeba invadens
NVSAQSVQKQTQL

SEQ ID NO: 2891336 - protein, 7 aa, Entamoeba invadens
NVSDKLG

SEQ ID NO: 2891337 - protein, 7 aa, Entamoeba invadens
NVSDNPL

SEQ ID NO: 2891338 - protein, 7 aa, Entamoeba invadens
NVSDSEV

SEQ ID NO: 2891339 - protein, 8 aa, Entamoeba invadens
NVSDTERE

SEQ ID NO: 2891340 - protein, 4 aa, Entamoeba invadens
NVSE

SEQ ID NO: 2891341 - protein, 4 aa, Entamoeba invadens
NVSG

SEQ ID NO: 2891342 - protein, 16 aa, Entamoeba invadens
NVSGASSSLFSKLITM

SEQ ID NO: 2891343 - protein, 10 aa, Entamoeba invadens
NVSGASTNKI

SEQ ID NO: 2891344 - protein, 9 aa, Entamoeba invadens
NVSGDEEEK

SEQ ID NO: 2891345 - protein, 6 aa, Entamoeba invadens
NVSGDT

SEQ ID NO: 2891346 - protein, 5 aa, Entamoeba invadens
NVSGN

SEQ ID NO: 2891347 - protein, 10 aa, Entamoeba invadens
NVSGNSPLSL

SEQ ID NO: 2891348 - protein, 10 aa, Entamoeba invadens
NVSKEITPDM

SEQ ID NO: 2891349 - protein, 20 aa, Entamoeba invadens
NVSKPEKKSTKSQLPETQEK

SEQ ID NO: 2891350 - protein, 8 aa, Entamoeba invadens
NVSKRKAK

SEQ ID NO: 2891351 - protein, 15 aa, Entamoeba invadens
NVSLGTNDESDSFGL

SEQ ID NO: 2891352 - protein, 6 aa, Entamoeba invadens
NVSNDG

SEQ ID NO: 2891353 - protein, 8 aa, Entamoeba invadens
NVSNTFGK

SEQ ID NO: 2891354 - protein, 7 aa, Entamoeba invadens
NVSNTFR

SEQ ID NO: 2891355 - protein, 6 aa, Entamoeba invadens
NVSNTV

SEQ ID NO: 2891356 - protein, 13 aa, Entamoeba invadens
NVSPEPQKDEAVE

SEQ ID NO: 2891357 - protein, 5 aa, Entamoeba invadens
NVSPK

SEQ ID NO: 2891358 - protein, 6 aa, Entamoeba invadens
NVSPSG

SEQ ID NO: 2891359 - protein, 24 aa, Entamoeba invadens
NVSQLEREKSTYEGIRAERDDALR

SEQ ID NO: 2891360 - protein, 17 aa, Entamoeba invadens
NVSQPNCPSDQKVSGKL

SEQ ID NO: 2891361 - protein, 8 aa, Entamoeba invadens
NVSQTPKD

SEQ ID NO: 2891362 - protein, 9 aa, Entamoeba invadens
NVSQTTRLS

SEQ ID NO: 2891363 - protein, 7 aa, Entamoeba invadens
NVSSESL

SEQ ID NO: 2891364 - protein, 4 aa, Entamoeba invadens
NVST

SEQ ID NO: 2891365 - protein, 24 aa, Entamoeba invadens
NVSTQQQQLPQKTYEIPPGQVNPY

SEQ ID NO: 2891366 - protein, 12 aa, Entamoeba invadens
NVTAPGVKSEDY

SEQ ID NO: 2891367 - protein, 8 aa, Entamoeba invadens
NVTAPGVT

SEQ ID NO: 2891368 - protein, 7 aa, Entamoeba invadens
NVTAPKV

SEQ ID NO: 2891369 - protein, 6 aa, Entamoeba invadens
NVTAPN

SEQ ID NO: 2891370 - protein, 22 aa, Entamoeba invadens
NVTDDSKSGKDGYKKTNLNANN

SEQ ID NO: 2891371 - protein, 17 aa, Entamoeba invadens
NVTDSNEGISNAEMTRE

SEQ ID NO: 2891372 - protein, 22 aa, Entamoeba invadens
NVTEEKQKTCGIESEPITSDDC

SEQ ID NO: 2891373 - protein, 7 aa, Entamoeba invadens
NVTENDE

SEQ ID NO: 2891374 - protein, 14 aa, Entamoeba invadens
NVTESRKSRPTGLN

SEQ ID NO: 2891375 - protein, 13 aa, Entamoeba invadens
NVTGKDSFRDGRA

SEQ ID NO: 2891376 - protein, 10 aa, Entamoeba invadens
NVTIPSSVTS

SEQ ID NO: 2891377 - protein, 4 aa, Entamoeba invadens
NVTK

SEQ ID NO: 2891378 - protein, 26 aa, Entamoeba invadens
NVTKQKDDEKDVKDIKDTKEKKPVHI

SEQ ID NO: 2891379 - protein, 7 aa, Entamoeba invadens
NVTNNKD

SEQ ID NO: 2891380 - protein, 6 aa, Entamoeba invadens
NVTNSE

SEQ ID NO: 2891381 - protein, 32 aa, Entamoeba invadens
NVTPPVSQNESIKQSDQIKSETPNLASTNPFA

SEQ ID NO: 2891382 - protein, 7 aa, Entamoeba invadens
NVTQKAS

SEQ ID NO: 2891383 - protein, 22 aa, Entamoeba invadens
NVTQQLGDTENQKREIEDKNQT

SEQ ID NO: 2891384 - protein, 5 aa, Entamoeba invadens
NVTRL

SEQ ID NO: 2891385 - protein, 13 aa, Entamoeba invadens
NVTRRSKRLSESF

SEQ ID NO: 2891386 - protein, 11 aa, Entamoeba invadens
NVTSENEIQKY

SEQ ID NO: 2891387 - protein, 11 aa, Entamoeba invadens
NVTSENEIQNY

SEQ ID NO: 2891388 - protein, 12 aa, Entamoeba invadens
NVTSIGDEAFSG

SEQ ID NO: 2891389 - protein, 6 aa, Entamoeba invadens
NVTSKF

SEQ ID NO: 2891390 - protein, 6 aa, Entamoeba invadens
NVTSLG

SEQ ID NO: 2891391 - protein, 12 aa, Entamoeba invadens
NVTSTSNVTTKT

SEQ ID NO: 2891392 - protein, 7 aa, Entamoeba invadens
NVTSTSS

SEQ ID NO: 2891393 - protein, 12 aa, Entamoeba invadens
NVTTIGSDAFSG

SEQ ID NO: 2891394 - protein, 7 aa, Entamoeba invadens
NVTTNGL

SEQ ID NO: 2891395 - protein, 11 aa, Entamoeba invadens
NVTTPKEPYIA

SEQ ID NO: 2891396 - protein, 18 aa, Entamoeba invadens
NVTTQQPPVQQPVQRQQF

SEQ ID NO: 2891397 - protein, 49 aa, Entamoeba invadens
NVTTQQVGQNSQGGQPTQNQNNSVGSQYPSSSTPQPTFQTNTTPYSPQV

SEQ ID NO: 2891398 - protein, 4 aa, Entamoeba invadens
NVTV

SEQ ID NO: 2891399 - protein, 5 aa, Entamoeba invadens
NVVES

SEQ ID NO: 2891400 - protein, 31 aa, Entamoeba invadens
NVVGSTSKGQESPQQAKQQTPQTATSLQQID

SEQ ID NO: 2891401 - protein, 8 aa, Entamoeba invadens
NVVTGEEK

SEQ ID NO: 2891402 - protein, 7 aa, Entamoeba invadens
NVYCPSE

SEQ ID NO: 2891403 - protein, 12 aa, Entamoeba invadens
NVYDNSQIGELE

SEQ ID NO: 2891404 - protein, 8 aa, Entamoeba invadens
NVYTRKGN

SEQ ID NO: 2891405 - protein, 6 aa, Entamoeba invadens
NWDRNT

SEQ ID NO: 2891406 - protein, 16 aa, Entamoeba invadens
NWERTDEALVPHPRFG

SEQ ID NO: 2891407 - protein, 10 aa, Entamoeba invadens
NWETSEEKMG

SEQ ID NO: 2891408 - protein, 17 aa, Entamoeba invadens
NWGDYDNQRKIDSYRKS

SEQ ID NO: 2891409 - protein, 13 aa, Entamoeba invadens
NWGNSGLTPQQIA

SEQ ID NO: 2891410 - protein, 8 aa, Entamoeba invadens
NWKPPKNW

SEQ ID NO: 2891411 - protein, 21 aa, Entamoeba invadens
NWLEEGESPAIQAKKKGKALK

SEQ ID NO: 2891412 - protein, 9 aa, Entamoeba invadens
NWNGTDGNC

SEQ ID NO: 2891413 - protein, 5 aa, Entamoeba invadens
NWNSI

SEQ ID NO: 2891414 - protein, 5 aa, Entamoeba invadens
NWRRS

SEQ ID NO: 2891415 - protein, 4 aa, Entamoeba invadens
NWSE

SEQ ID NO: 2891416 - protein, 18 aa, Entamoeba invadens
NYAEQGVAGNDSGKTSIP

SEQ ID NO: 2891417 - protein, 7 aa, Entamoeba invadens
NYAKDDT

SEQ ID NO: 2891418 - protein, 5 aa, Entamoeba invadens
NYANC

SEQ ID NO: 2891419 - protein, 6 aa, Entamoeba invadens
NYAPSL

SEQ ID NO: 2891420 - protein, 6 aa, Entamoeba invadens
NYASPD

SEQ ID NO: 2891421 - protein, 7 aa, Entamoeba invadens
NYASRTS

SEQ ID NO: 2891422 - protein, 5 aa, Entamoeba invadens
NYAST

SEQ ID NO: 2891423 - protein, 7 aa, Entamoeba invadens
NYATGIS

SEQ ID NO: 2891424 - protein, 4 aa, Entamoeba invadens
NYDD

SEQ ID NO: 2891425 - protein, 9 aa, Entamoeba invadens
NYDDSETGF

SEQ ID NO: 2891426 - protein, 4 aa, Entamoeba invadens
NYDE

SEQ ID NO: 2891427 - protein, 6 aa, Entamoeba invadens
NYDEND

SEQ ID NO: 2891428 - protein, 14 aa, Entamoeba invadens
NYDETGPSIINRVC

SEQ ID NO: 2891429 - protein, 6 aa, Entamoeba invadens
NYDKAS

SEQ ID NO: 2891430 - protein, 12 aa, Entamoeba invadens
NYDNDNTFKLFK

SEQ ID NO: 2891431 - protein, 5 aa, Entamoeba invadens
NYDNF

SEQ ID NO: 2891432 - protein, 13 aa, Entamoeba invadens
NYDNGSYFNSPKN

SEQ ID NO: 2891433 - protein, 12 aa, Entamoeba invadens
NYDPDKDKRFAG

SEQ ID NO: 2891434 - protein, 10 aa, Entamoeba invadens
NYDPTIQDSY

SEQ ID NO: 2891435 - protein, 20 aa, Entamoeba invadens
NYDQSGVANTANQNRTERKE

SEQ ID NO: 2891436 - protein, 9 aa, Entamoeba invadens
NYDRAKEDI

SEQ ID NO: 2891437 - protein, 7 aa, Entamoeba invadens
NYDSESI

SEQ ID NO: 2891438 - protein, 4 aa, Entamoeba invadens
NYDT

SEQ ID NO: 2891439 - protein, 4 aa, Entamoeba invadens
NYDV

SEQ ID NO: 2891440 - protein, 9 aa, Entamoeba invadens
NYEDHTSKG

SEQ ID NO: 2891441 - protein, 6 aa, Entamoeba invadens
NYEDKN

SEQ ID NO: 2891442 - protein, 14 aa, Entamoeba invadens
NYEEEKKKDANELE

SEQ ID NO: 2891443 - protein, 14 aa, Entamoeba invadens
NYEEEKKKDANKLD

SEQ ID NO: 2891444 - protein, 14 aa, Entamoeba invadens
NYEEEKKKETKELE

SEQ ID NO: 2891445 - protein, 10 aa, Entamoeba invadens
NYEGNKTDLG

SEQ ID NO: 2891446 - protein, 8 aa, Entamoeba invadens
NYEKENHP

SEQ ID NO: 2891447 - protein, 7 aa, Entamoeba invadens
NYEKKRY

SEQ ID NO: 2891448 - protein, 5 aa, Entamoeba invadens
NYEKS

SEQ ID NO: 2891449 - protein, 6 aa, Entamoeba invadens
NYENND

SEQ ID NO: 2891450 - protein, 35 aa, Entamoeba invadens
NYERMNTERVSSSPKVLTKSATKALSEIKPTRIDG

SEQ ID NO: 2891451 - protein, 5 aa, Entamoeba invadens
NYERV

SEQ ID NO: 2891452 - protein, 8 aa, Entamoeba invadens
NYESPLGS

SEQ ID NO: 2891453 - protein, 5 aa, Entamoeba invadens
NYEVG

SEQ ID NO: 2891454 - protein, 11 aa, Entamoeba invadens
NYEYDTQCGSG

SEQ ID NO: 2891455 - protein, 21 aa, Entamoeba invadens
NYFPGTGDVDEVGVDEGKNYS

SEQ ID NO: 2891456 - protein, 21 aa, Entamoeba invadens
NYFPGTGDVDEVGVEEGKNYS

SEQ ID NO: 2891457 - protein, 10 aa, Entamoeba invadens
NYGDKTGSAV

SEQ ID NO: 2891458 - protein, 7 aa, Entamoeba invadens
NYGEQER

SEQ ID NO: 2891459 - protein, 4 aa, Entamoeba invadens
NYGG

SEQ ID NO: 2891460 - protein, 6 aa, Entamoeba invadens
NYGKCG

SEQ ID NO: 2891461 - protein, 9 aa, Entamoeba invadens
NYGKEKNVN

SEQ ID NO: 2891462 - protein, 18 aa, Entamoeba invadens
NYGNKAKELNRVGDRENA

SEQ ID NO: 2891463 - protein, 14 aa, Entamoeba invadens
NYGNKEIRSQVIYY

SEQ ID NO: 2891464 - protein, 11 aa, Entamoeba invadens
NYGNKTKENGL

SEQ ID NO: 2891465 - protein, 6 aa, Entamoeba invadens
NYGSRP

SEQ ID NO: 2891466 - protein, 26 aa, Entamoeba invadens
NYGSSVIEDSEEFQDYSTSSTPSISP

SEQ ID NO: 2891467 - protein, 8 aa, Entamoeba invadens
NYGSTYKG

SEQ ID NO: 2891468 - protein, 8 aa, Entamoeba invadens
NYGTTYKG

SEQ ID NO: 2891469 - protein, 4 aa, Entamoeba invadens
NYHR

SEQ ID NO: 2891470 - protein, 4 aa, Entamoeba invadens
NYHT

SEQ ID NO: 2891471 - protein, 7 aa, Entamoeba invadens
NYHTASG

SEQ ID NO: 2891472 - protein, 8 aa, Entamoeba invadens
NYKAKEAE

SEQ ID NO: 2891473 - protein, 6 aa, Entamoeba invadens
NYKATI

SEQ ID NO: 2891474 - protein, 9 aa, Entamoeba invadens
NYKDPTEKG

SEQ ID NO: 2891475 - protein, 5 aa, Entamoeba invadens
NYKDT

SEQ ID NO: 2891476 - protein, 16 aa, Entamoeba invadens
NYKENKQHITKNNEIK

SEQ ID NO: 2891477 - protein, 9 aa, Entamoeba invadens
NYKENKYEK

SEQ ID NO: 2891478 - protein, 7 aa, Entamoeba invadens
NYKKAEE

SEQ ID NO: 2891479 - protein, 7 aa, Entamoeba invadens
NYKKDKK

SEQ ID NO: 2891480 - protein, 10 aa, Entamoeba invadens
NYKKPAEVTD

SEQ ID NO: 2891481 - protein, 8 aa, Entamoeba invadens
NYKQKDGI

SEQ ID NO: 2891482 - protein, 11 aa, Entamoeba invadens
NYKQKSDERIS

SEQ ID NO: 2891483 - protein, 5 aa, Entamoeba invadens
NYKQL

SEQ ID NO: 2891484 - protein, 8 aa, Entamoeba invadens
NYKSANEG

SEQ ID NO: 2891485 - protein, 6 aa, Entamoeba invadens
NYKTIQ

SEQ ID NO: 2891486 - protein, 10 aa, Entamoeba invadens
NYKTPTEKVE

SEQ ID NO: 2891487 - protein, 16 aa, Entamoeba invadens
NYKTQKSQGPSKSVTS

SEQ ID NO: 2891488 - protein, 12 aa, Entamoeba invadens
NYKTQSGKCLPQ

SEQ ID NO: 2891489 - protein, 6 aa, Entamoeba invadens
NYLPPA

SEQ ID NO: 2891490 - protein, 10 aa, Entamoeba invadens
NYMGEGDNTA

SEQ ID NO: 2891491 - protein, 5 aa, Entamoeba invadens
NYMKQ

SEQ ID NO: 2891492 - protein, 4 aa, Entamoeba invadens
NYMT

SEQ ID NO: 2891493 - protein, 5 aa, Entamoeba invadens
NYNEG

SEQ ID NO: 2891494 - protein, 4 aa, Entamoeba invadens
NYNG

SEQ ID NO: 2891495 - protein, 6 aa, Entamoeba invadens
NYNGKV

SEQ ID NO: 2891496 - protein, 5 aa, Entamoeba invadens
NYNKA

SEQ ID NO: 2891497 - protein, 14 aa, Entamoeba invadens
NYNNEIEKQNEQFN

SEQ ID NO: 2891498 - protein, 9 aa, Entamoeba invadens
NYNPEDTNY

SEQ ID NO: 2891499 - protein, 5 aa, Entamoeba invadens
NYNQN

SEQ ID NO: 2891500 - protein, 11 aa, Entamoeba invadens
NYNSDKTTEYN

SEQ ID NO: 2891501 - protein, 5 aa, Entamoeba invadens
NYNST

SEQ ID NO: 2891502 - protein, 9 aa, Entamoeba invadens
NYNTDTAPL

SEQ ID NO: 2891503 - protein, 20 aa, Entamoeba invadens
NYNTSAANVNNTLSNTIQPS

SEQ ID NO: 2891504 - protein, 30 aa, Entamoeba invadens
NYPDFKNGYSSDPRQDSNASEWQEKNMKED

SEQ ID NO: 2891505 - protein, 11 aa, Entamoeba invadens
NYPDGETHQVE

SEQ ID NO: 2891506 - protein, 5 aa, Entamoeba invadens
NYPEA

SEQ ID NO: 2891507 - protein, 11 aa, Entamoeba invadens
NYPESDSPRFQ

SEQ ID NO: 2891508 - protein, 4 aa, Entamoeba invadens
NYPG

SEQ ID NO: 2891509 - protein, 6 aa, Entamoeba invadens
NYPGYT

SEQ ID NO: 2891510 - protein, 11 aa, Entamoeba invadens
NYPIGEDGKPI

SEQ ID NO: 2891511 - protein, 6 aa, Entamoeba invadens
NYPKSA

SEQ ID NO: 2891512 - protein, 4 aa, Entamoeba invadens
NYPL

SEQ ID NO: 2891513 - protein, 10 aa, Entamoeba invadens
NYPNKSETQH

SEQ ID NO: 2891514 - protein, 6 aa, Entamoeba invadens
NYPPTS

SEQ ID NO: 2891515 - protein, 5 aa, Entamoeba invadens
NYPQA

SEQ ID NO: 2891516 - protein, 6 aa, Entamoeba invadens
NYPQYK

SEQ ID NO: 2891517 - protein, 6 aa, Entamoeba invadens
NYPTEM

SEQ ID NO: 2891518 - protein, 11 aa, Entamoeba invadens
NYPTKWNEANK

SEQ ID NO: 2891519 - protein, 6 aa, Entamoeba invadens
NYQAEQ

SEQ ID NO: 2891520 - protein, 5 aa, Entamoeba invadens
NYQGL

SEQ ID NO: 2891521 - protein, 28 aa, Entamoeba invadens
NYQKTTSNQCEVKPTTCPSGQYGTPPNC

SEQ ID NO: 2891522 - protein, 12 aa, Entamoeba invadens
NYQNDVGKDKSY

SEQ ID NO: 2891523 - protein, 6 aa, Entamoeba invadens
NYQNEQ

SEQ ID NO: 2891524 - protein, 10 aa, Entamoeba invadens
NYQNKENVRE

SEQ ID NO: 2891525 - protein, 6 aa, Entamoeba invadens
NYQNQT

SEQ ID NO: 2891526 - protein, 6 aa, Entamoeba invadens
NYQPGS

SEQ ID NO: 2891527 - protein, 4 aa, Entamoeba invadens
NYQQ

SEQ ID NO: 2891528 - protein, 7 aa, Entamoeba invadens
NYQSEQE

SEQ ID NO: 2891529 - protein, 50 aa, Entamoeba invadens
NYQSNVPGMPKRDVTKKEDSNLKEKEKNETNSKVKKAYVEKKPKKHQSFL

SEQ ID NO: 2891530 - protein, 12 aa, Entamoeba invadens
NYQTPCNTTECE

SEQ ID NO: 2891531 - protein, 8 aa, Entamoeba invadens
NYQTPQFQ

SEQ ID NO: 2891532 - protein, 7 aa, Entamoeba invadens
NYRDPEI

SEQ ID NO: 2891533 - protein, 6 aa, Entamoeba invadens
NYRGGL

SEQ ID NO: 2891534 - protein, 8 aa, Entamoeba invadens
NYRGHTKK

SEQ ID NO: 2891535 - protein, 8 aa, Entamoeba invadens
NYRNHPDV

SEQ ID NO: 2891536 - protein, 8 aa, Entamoeba invadens
NYRNNSEK

SEQ ID NO: 2891537 - protein, 18 aa, Entamoeba invadens
NYRNRKRALSQRAEAASI

SEQ ID NO: 2891538 - protein, 6 aa, Entamoeba invadens
NYRPKA

SEQ ID NO: 2891539 - protein, 5 aa, Entamoeba invadens
NYRQQ

SEQ ID NO: 2891540 - protein, 7 aa, Entamoeba invadens
NYRSKGR

SEQ ID NO: 2891541 - protein, 8 aa, Entamoeba invadens
NYRTEKDD

SEQ ID NO: 2891542 - protein, 11 aa, Entamoeba invadens
NYSALSSAHER

SEQ ID NO: 2891543 - protein, 4 aa, Entamoeba invadens
NYSD

SEQ ID NO: 2891544 - protein, 10 aa, Entamoeba invadens
NYSENGGRTF

SEQ ID NO: 2891545 - protein, 11 aa, Entamoeba invadens
NYSENGQTEFE

SEQ ID NO: 2891546 - protein, 10 aa, Entamoeba invadens
NYSEPTPVQA

SEQ ID NO: 2891547 - protein, 5 aa, Entamoeba invadens
NYSEQ

SEQ ID NO: 2891548 - protein, 13 aa, Entamoeba invadens
NYSESDSLSMSDD

SEQ ID NO: 2891549 - protein, 12 aa, Entamoeba invadens
NYSKDDISDDEK

SEQ ID NO: 2891550 - protein, 5 aa, Entamoeba invadens
NYSKP

SEQ ID NO: 2891551 - protein, 24 aa, Entamoeba invadens
NYSKPSTKGSEEESKSGLTPKTGT

SEQ ID NO: 2891552 - protein, 6 aa, Entamoeba invadens
NYSKQE

SEQ ID NO: 2891553 - protein, 8 aa, Entamoeba invadens
NYSKSSSL

SEQ ID NO: 2891554 - protein, 8 aa, Entamoeba invadens
NYSKYNNT

SEQ ID NO: 2891555 - protein, 5 aa, Entamoeba invadens
NYSND

SEQ ID NO: 2891556 - protein, 16 aa, Entamoeba invadens
NYSNLDESSKARSRDV

SEQ ID NO: 2891557 - protein, 7 aa, Entamoeba invadens
NYSNTPS

SEQ ID NO: 2891558 - protein, 6 aa, Entamoeba invadens
NYSPAN

SEQ ID NO: 2891559 - protein, 9 aa, Entamoeba invadens
NYSSNPSRF

SEQ ID NO: 2891560 - protein, 19 aa, Entamoeba invadens
NYSTDEEDSTLRKKVNEST

SEQ ID NO: 2891561 - protein, 17 aa, Entamoeba invadens
NYSTESDDCFLFDESEI

SEQ ID NO: 2891562 - protein, 17 aa, Entamoeba invadens
NYSTESDDCFLFDESKI

SEQ ID NO: 2891563 - protein, 8 aa, Entamoeba invadens
NYSTSPDT

SEQ ID NO: 2891564 - protein, 10 aa, Entamoeba invadens
NYTASIDKTD

SEQ ID NO: 2891565 - protein, 7 aa, Entamoeba invadens
NYTEEEI

SEQ ID NO: 2891566 - protein, 7 aa, Entamoeba invadens
NYTEKYP

SEQ ID NO: 2891567 - protein, 5 aa, Entamoeba invadens
NYTEN

SEQ ID NO: 2891568 - protein, 14 aa, Entamoeba invadens
NYTENDRNKYGNNI

SEQ ID NO: 2891569 - protein, 13 aa, Entamoeba invadens
NYTESKQSEYTTY

SEQ ID NO: 2891570 - protein, 5 aa, Entamoeba invadens
NYTGQ

SEQ ID NO: 2891571 - protein, 10 aa, Entamoeba invadens
NYTITPNNGI

SEQ ID NO: 2891572 - protein, 6 aa, Entamoeba invadens
NYTKEK

SEQ ID NO: 2891573 - protein, 9 aa, Entamoeba invadens
NYTKNSPYY

SEQ ID NO: 2891574 - protein, 6 aa, Entamoeba invadens
NYTLPD

SEQ ID NO: 2891575 - protein, 9 aa, Entamoeba invadens
NYTNDGKEM

SEQ ID NO: 2891576 - protein, 8 aa, Entamoeba invadens
NYTNEEVQ

SEQ ID NO: 2891577 - protein, 6 aa, Entamoeba invadens
NYTPAT

SEQ ID NO: 2891578 - protein, 6 aa, Entamoeba invadens
NYTPSH

SEQ ID NO: 2891579 - protein, 8 aa, Entamoeba invadens
NYTQDNKD

SEQ ID NO: 2891580 - protein, 6 aa, Entamoeba invadens
NYTQEI

SEQ ID NO: 2891581 - protein, 9 aa, Entamoeba invadens
NYTQKITPK

SEQ ID NO: 2891582 - protein, 7 aa, Entamoeba invadens
NYTQPSE

SEQ ID NO: 2891583 - protein, 12 aa, Entamoeba invadens
NYTRETEKSEIS

SEQ ID NO: 2891584 - protein, 11 aa, Entamoeba invadens
NYTRTKRPGIA

SEQ ID NO: 2891585 - protein, 16 aa, Entamoeba invadens
NYTSPSKITPVPQVSN

SEQ ID NO: 2891586 - protein, 5 aa, Entamoeba invadens
NYTTK

SEQ ID NO: 2891587 - protein, 48 aa, Entamoeba invadens
NYTTKKHHKHHHKAGNKTQNVQEKPSKETKNEIKQEKNEKKEKQPQEV

SEQ ID NO: 2891588 - protein, 7 aa, Entamoeba invadens
NYVDNES

SEQ ID NO: 2891589 - protein, 6 aa, Entamoeba invadens
NYVNDK

SEQ ID NO: 2891590 - protein, 9 aa, Entamoeba invadens
NYVPGKKDD

SEQ ID NO: 2891591 - protein, 6 aa, Entamoeba invadens
NYYGTE

SEQ ID NO: 2891592 - protein, 5 aa, Entamoeba invadens
NYYKD

SEQ ID NO: 2891593 - protein, 5 aa, Entamoeba invadens
NYYKE

SEQ ID NO: 2891594 - protein, 7 aa, Entamoeba invadens
NYYPNDG

SEQ ID NO: 2891595 - protein, 12 aa, Entamoeba invadens
NYYPNTSNDTDV

SEQ ID NO: 2891596 - protein, 4 aa, Entamoeba invadens
NYYR

SEQ ID NO: 2891597 - protein, 4 aa, Entamoeba invadens
NYYS

SEQ ID NO: 2891598 - protein, 10 aa, Entamoeba invadens
PAAKEKINSG

SEQ ID NO: 2891599 - protein, 8 aa, Entamoeba invadens
PAAPRENS

SEQ ID NO: 2891600 - protein, 31 aa, Entamoeba invadens
PAAPYEKVTEEIQKEVQERQKRLAAGKPRQS

SEQ ID NO: 2891601 - protein, 4 aa, Entamoeba invadens
PAAS

SEQ ID NO: 2891602 - protein, 8 aa, Entamoeba invadens
PAATPPEI

SEQ ID NO: 2891603 - protein, 19 aa, Entamoeba invadens
PADAGSTNALLPSSNPQIP

SEQ ID NO: 2891604 - protein, 21 aa, Entamoeba invadens
PADAQSVSNQENQESEKSVSK

SEQ ID NO: 2891605 - protein, 12 aa, Entamoeba invadens
PADCAKRPSDEM

SEQ ID NO: 2891606 - protein, 9 aa, Entamoeba invadens
PADDGKQTP

SEQ ID NO: 2891607 - protein, 14 aa, Entamoeba invadens
PADEKYADLSDKVR

SEQ ID NO: 2891608 - protein, 10 aa, Entamoeba invadens
PADESAHEKL

SEQ ID NO: 2891609 - protein, 21 aa, Entamoeba invadens
PADGVKRQCDARNIEKFLLKF

SEQ ID NO: 2891610 - protein, 4 aa, Entamoeba invadens
PADI

SEQ ID NO: 2891611 - protein, 7 aa, Entamoeba invadens
PADKLPN

SEQ ID NO: 2891612 - protein, 4 aa, Entamoeba invadens
PADL

SEQ ID NO: 2891613 - protein, 19 aa, Entamoeba invadens
PADPDMSCEESVNTPMDIE

SEQ ID NO: 2891614 - protein, 30 aa, Entamoeba invadens
PADPKNQTHIGSPLSGNVGNVTVKEGDEVL

SEQ ID NO: 2891615 - protein, 15 aa, Entamoeba invadens
PADSRTSTSASEEMK

SEQ ID NO: 2891616 - protein, 7 aa, Entamoeba invadens
PADSYSE

SEQ ID NO: 2891617 - protein, 7 aa, Entamoeba invadens
PADTEPL

SEQ ID NO: 2891618 - protein, 7 aa, Entamoeba invadens
PADYGTS

SEQ ID NO: 2891619 - protein, 23 aa, Entamoeba invadens
PAEGEFTKTHAQYTPANVGERTV

SEQ ID NO: 2891620 - protein, 7 aa, Entamoeba invadens
PAEGTVS

SEQ ID NO: 2891621 - protein, 12 aa, Entamoeba invadens
PAEMNEDGVDYT

SEQ ID NO: 2891622 - protein, 4 aa, Entamoeba invadens
PAES

SEQ ID NO: 2891623 - protein, 7 aa, Entamoeba invadens
PAESDEE

SEQ ID NO: 2891624 - protein, 8 aa, Entamoeba invadens
PAESIGGT

SEQ ID NO: 2891625 - protein, 7 aa, Entamoeba invadens
PAESYTE

SEQ ID NO: 2891626 - protein, 8 aa, Entamoeba invadens
PAETRQWN

SEQ ID NO: 2891627 - protein, 9 aa, Entamoeba invadens
PAFKAGDYK

SEQ ID NO: 2891628 - protein, 8 aa, Entamoeba invadens
PAFPAPPQ

SEQ ID NO: 2891629 - protein, 5 aa, Entamoeba invadens
PAFPD

SEQ ID NO: 2891630 - protein, 7 aa, Entamoeba invadens
PAGELPW

SEQ ID NO: 2891631 - protein, 9 aa, Entamoeba invadens
PAGESDSNK

SEQ ID NO: 2891632 - protein, 5 aa, Entamoeba invadens
PAGIQ

SEQ ID NO: 2891633 - protein, 4 aa, Entamoeba invadens
PAGL

SEQ ID NO: 2891634 - protein, 8 aa, Entamoeba invadens
PAGQALNS

SEQ ID NO: 2891635 - protein, 20 aa, Entamoeba invadens
PAGVVRKQKGLRDDKQEPRA

SEQ ID NO: 2891636 - protein, 11 aa, Entamoeba invadens
PAHEQKRPERF

SEQ ID NO: 2891637 - protein, 8 aa, Entamoeba invadens
PAHPPGPV

SEQ ID NO: 2891638 - protein, 7 aa, Entamoeba invadens
PAHTEPK

SEQ ID NO: 2891639 - protein, 7 aa, Entamoeba invadens
PAIDETG

SEQ ID NO: 2891640 - protein, 4 aa, Entamoeba invadens
PAIK

SEQ ID NO: 2891641 - protein, 7 aa, Entamoeba invadens
PAINDKG

SEQ ID NO: 2891642 - protein, 26 aa, Entamoeba invadens
PAINDSNQFIKDSKDEKKKEQAGKSV

SEQ ID NO: 2891643 - protein, 5 aa, Entamoeba invadens
PAIPD

SEQ ID NO: 2891644 - protein, 11 aa, Entamoeba invadens
PAITPNAHDSF

SEQ ID NO: 2891645 - protein, 25 aa, Entamoeba invadens
PAKADPTYTYADGAGVQECNAGTGP

SEQ ID NO: 2891646 - protein, 18 aa, Entamoeba invadens
PAKAKDVEKRSSDTTTFF

SEQ ID NO: 2891647 - protein, 5 aa, Entamoeba invadens
PAKGA

SEQ ID NO: 2891648 - protein, 10 aa, Entamoeba invadens
PAKGIAKTKI

SEQ ID NO: 2891649 - protein, 9 aa, Entamoeba invadens
PAKKHGEDA

SEQ ID NO: 2891650 - protein, 12 aa, Entamoeba invadens
PAKKSESEKNIT

SEQ ID NO: 2891651 - protein, 7 aa, Entamoeba invadens
PAKNYTN

SEQ ID NO: 2891652 - protein, 10 aa, Entamoeba invadens
PAKRYTKDGA

SEQ ID NO: 2891653 - protein, 12 aa, Entamoeba invadens
PAKTSAADMEPD

SEQ ID NO: 2891654 - protein, 14 aa, Entamoeba invadens
PAKVDAEVAKHNRD

SEQ ID NO: 2891655 - protein, 7 aa, Entamoeba invadens
PALAGQT

SEQ ID NO: 2891656 - protein, 8 aa, Entamoeba invadens
PALAQDAR

SEQ ID NO: 2891657 - protein, 14 aa, Entamoeba invadens
PALEDYSNKLNAAN

SEQ ID NO: 2891658 - protein, 9 aa, Entamoeba invadens
PALESKETV

SEQ ID NO: 2891659 - protein, 62 aa, Entamoeba invadens
PALNDKNVKEQSDVPQMKKPEEKVEEKPINTKVPPPQAPRLKDKIQEPQITTPTDAPLLPPS

SEQ ID NO: 2891660 - protein, 11 aa, Entamoeba invadens
PALNPKHIREK

SEQ ID NO: 2891661 - protein, 9 aa, Entamoeba invadens
PALPQPQND

SEQ ID NO: 2891662 - protein, 4 aa, Entamoeba invadens
PALS

SEQ ID NO: 2891663 - protein, 4 aa, Entamoeba invadens
PAMT

SEQ ID NO: 2891664 - protein, 9 aa, Entamoeba invadens
PANEPSEYT

SEQ ID NO: 2891665 - protein, 7 aa, Entamoeba invadens
PANKAYY

SEQ ID NO: 2891666 - protein, 11 aa, Entamoeba invadens
PANLGQGQSKE

SEQ ID NO: 2891667 - protein, 15 aa, Entamoeba invadens
PANSCEPDIKRGELK

SEQ ID NO: 2891668 - protein, 10 aa, Entamoeba invadens
PANSKQITPE

SEQ ID NO: 2891669 - protein, 9 aa, Entamoeba invadens
PANSRNAEE

SEQ ID NO: 2891670 - protein, 10 aa, Entamoeba invadens
PAPAPNESDR

SEQ ID NO: 2891671 - protein, 7 aa, Entamoeba invadens
PAPAPRT

SEQ ID NO: 2891672 - protein, 6 aa, Entamoeba invadens
PAPDEV

SEQ ID NO: 2891673 - protein, 12 aa, Entamoeba invadens
PAPEETWENDEK

SEQ ID NO: 2891674 - protein, 9 aa, Entamoeba invadens
PAPEGSNRS

SEQ ID NO: 2891675 - protein, 7 aa, Entamoeba invadens
PAPEYSN

SEQ ID NO: 2891676 - protein, 7 aa, Entamoeba invadens
PAPGKFQ

SEQ ID NO: 2891677 - protein, 7 aa, Entamoeba invadens
PAPIKKY

SEQ ID NO: 2891678 - protein, 4 aa, Entamoeba invadens
PAPK

SEQ ID NO: 2891679 - protein, 7 aa, Entamoeba invadens
PAPNGFK

SEQ ID NO: 2891680 - protein, 8 aa, Entamoeba invadens
PAPNKAEM

SEQ ID NO: 2891681 - protein, 18 aa, Entamoeba invadens
PAPQGNRGGNTYDFSSQK

SEQ ID NO: 2891682 - protein, 5 aa, Entamoeba invadens
PAPQI

SEQ ID NO: 2891683 - protein, 15 aa, Entamoeba invadens
PAPSRDDTIEGQKEL

SEQ ID NO: 2891684 - protein, 7 aa, Entamoeba invadens
PAPTQDH

SEQ ID NO: 2891685 - protein, 11 aa, Entamoeba invadens
PAQKSRKSPHL

SEQ ID NO: 2891686 - protein, 8 aa, Entamoeba invadens
PAQRKRRM

SEQ ID NO: 2891687 - protein, 6 aa, Entamoeba invadens
PAQTQQ

SEQ ID NO: 2891688 - protein, 7 aa, Entamoeba invadens
PARLQEQ

SEQ ID NO: 2891689 - protein, 8 aa, Entamoeba invadens
PARSESID

SEQ ID NO: 2891690 - protein, 7 aa, Entamoeba invadens
PASAEAK

SEQ ID NO: 2891691 - protein, 5 aa, Entamoeba invadens
PASAK

SEQ ID NO: 2891692 - protein, 6 aa, Entamoeba invadens
PASATK

SEQ ID NO: 2891693 - protein, 5 aa, Entamoeba invadens
PASDT

SEQ ID NO: 2891694 - protein, 19 aa, Entamoeba invadens
PASEQTPTTKPLHDDEDKM

SEQ ID NO: 2891695 - protein, 38 aa, Entamoeba invadens
PASETTGEISGEEDEDYGYGYDDEDEDDGEDEEDDMTA

SEQ ID NO: 2891696 - protein, 9 aa, Entamoeba invadens
PASGYTQGM

SEQ ID NO: 2891697 - protein, 7 aa, Entamoeba invadens
PASKTFK

SEQ ID NO: 2891698 - protein, 5 aa, Entamoeba invadens
PASLD

SEQ ID NO: 2891699 - protein, 7 aa, Entamoeba invadens
PASNKFN

SEQ ID NO: 2891700 - protein, 12 aa, Entamoeba invadens
PASNLKKTNGMD

SEQ ID NO: 2891701 - protein, 7 aa, Entamoeba invadens
PASPTKL

SEQ ID NO: 2891702 - protein, 4 aa, Entamoeba invadens
PASQ

SEQ ID NO: 2891703 - protein, 14 aa, Entamoeba invadens
PASSDEIEEAEAEG

SEQ ID NO: 2891704 - protein, 7 aa, Entamoeba invadens
PASSELT

SEQ ID NO: 2891705 - protein, 6 aa, Entamoeba invadens
PASSSL

SEQ ID NO: 2891706 - protein, 10 aa, Entamoeba invadens
PASTFDAKQN

SEQ ID NO: 2891707 - protein, 10 aa, Entamoeba invadens
PASTGAAKAV

SEQ ID NO: 2891708 - protein, 8 aa, Entamoeba invadens
PASYAPPQ

SEQ ID NO: 2891709 - protein, 8 aa, Entamoeba invadens
PASYDNAQ

SEQ ID NO: 2891710 - protein, 6 aa, Entamoeba invadens
PASYYS

SEQ ID NO: 2891711 - protein, 4 aa, Entamoeba invadens
PATA

SEQ ID NO: 2891712 - protein, 4 aa, Entamoeba invadens
PATF

SEQ ID NO: 2891713 - protein, 17 aa, Entamoeba invadens
PATGITSQWRNSKEEVA

SEQ ID NO: 2891714 - protein, 7 aa, Entamoeba invadens
PATGSEM

SEQ ID NO: 2891715 - protein, 8 aa, Entamoeba invadens
PATGSEMN

SEQ ID NO: 2891716 - protein, 4 aa, Entamoeba invadens
PATI

SEQ ID NO: 2891717 - protein, 14 aa, Entamoeba invadens
PATKIQDPERQDAL

SEQ ID NO: 2891718 - protein, 6 aa, Entamoeba invadens
PATKRA

SEQ ID NO: 2891719 - protein, 11 aa, Entamoeba invadens
PATLSDAEAAM

SEQ ID NO: 2891720 - protein, 31 aa, Entamoeba invadens
PATLTTTTNPLGVQNQANTSNPLGAQTQPLI

SEQ ID NO: 2891721 - protein, 15 aa, Entamoeba invadens
PATPAGFPARRRTGW

SEQ ID NO: 2891722 - protein, 6 aa, Entamoeba invadens
PATPYD

SEQ ID NO: 2891723 - protein, 6 aa, Entamoeba invadens
PATQRI

SEQ ID NO: 2891724 - protein, 4 aa, Entamoeba invadens
PATR

SEQ ID NO: 2891725 - protein, 4 aa, Entamoeba invadens
PATS

SEQ ID NO: 2891726 - protein, 13 aa, Entamoeba invadens
PATSIGDTCEEMS

SEQ ID NO: 2891727 - protein, 6 aa, Entamoeba invadens
PAVGKT

SEQ ID NO: 2891728 - protein, 4 aa, Entamoeba invadens
PAVP

SEQ ID NO: 2891729 - protein, 9 aa, Entamoeba invadens
PAVPPRRQR

SEQ ID NO: 2891730 - protein, 8 aa, Entamoeba invadens
PAVTDGSI

SEQ ID NO: 2891731 - protein, 5 aa, Entamoeba invadens
PAWES

SEQ ID NO: 2891732 - protein, 16 aa, Entamoeba invadens
PAYCSESTQSLAPQFS

SEQ ID NO: 2891733 - protein, 5 aa, Entamoeba invadens
PAYGV

SEQ ID NO: 2891734 - protein, 9 aa, Entamoeba invadens
PAYNPYTEP

SEQ ID NO: 2891735 - protein, 12 aa, Entamoeba invadens
PCDEGNNVGRSS

SEQ ID NO: 2891736 - protein, 13 aa, Entamoeba invadens
PCDEKEEEKMDDD

SEQ ID NO: 2891737 - protein, 16 aa, Entamoeba invadens
PCDIPTTPKADKEEVL

SEQ ID NO: 2891738 - protein, 5 aa, Entamoeba invadens
PCGAG

SEQ ID NO: 2891739 - protein, 9 aa, Entamoeba invadens
PCGHKSENH

SEQ ID NO: 2891740 - protein, 15 aa, Entamoeba invadens
PCKDVDPDKAVATGA

SEQ ID NO: 2891741 - protein, 6 aa, Entamoeba invadens
PCLSPS

SEQ ID NO: 2891742 - protein, 5 aa, Entamoeba invadens
PCNAS

SEQ ID NO: 2891743 - protein, 10 aa, Entamoeba invadens
PCNPQAPLSF

SEQ ID NO: 2891744 - protein, 6 aa, Entamoeba invadens
PCPLDA

SEQ ID NO: 2891745 - protein, 8 aa, Entamoeba invadens
PCPPPPGC

SEQ ID NO: 2891746 - protein, 19 aa, Entamoeba invadens
PCPQSPRSPESPSPESECS

SEQ ID NO: 2891747 - protein, 5 aa, Entamoeba invadens
PCQTP

SEQ ID NO: 2891748 - protein, 7 aa, Entamoeba invadens
PCSPGDF

SEQ ID NO: 2891749 - protein, 12 aa, Entamoeba invadens
PCSRSDDSIKRS

SEQ ID NO: 2891750 - protein, 8 aa, Entamoeba invadens
PCTEGPGK

SEQ ID NO: 2891751 - protein, 5 aa, Entamoeba invadens
PCTKC

SEQ ID NO: 2891752 - protein, 7 aa, Entamoeba invadens
PCTSDTH

SEQ ID NO: 2891753 - protein, 4 aa, Entamoeba invadens
PDAV

SEQ ID NO: 2891754 - protein, 5 aa, Entamoeba invadens
PDCCA

SEQ ID NO: 2891755 - protein, 4 aa, Entamoeba invadens
PDCG

SEQ ID NO: 2891756 - protein, 4 aa, Entamoeba invadens
PDCS

SEQ ID NO: 2891757 - protein, 14 aa, Entamoeba invadens
PDCTLSEKGFTQAE

SEQ ID NO: 2891758 - protein, 4 aa, Entamoeba invadens
PDDA

SEQ ID NO: 2891759 - protein, 17 aa, Entamoeba invadens
PDDAMEEEYAKEKPVEK

SEQ ID NO: 2891760 - protein, 9 aa, Entamoeba invadens
PDDCSTLGD

SEQ ID NO: 2891761 - protein, 10 aa, Entamoeba invadens
PDDDGKSLEL

SEQ ID NO: 2891762 - protein, 11 aa, Entamoeba invadens
PDDEDGTTVPQ

SEQ ID NO: 2891763 - protein, 8 aa, Entamoeba invadens
PDDEISKE

SEQ ID NO: 2891764 - protein, 9 aa, Entamoeba invadens
PDDEKFENT

SEQ ID NO: 2891765 - protein, 8 aa, Entamoeba invadens
PDDENQAV

SEQ ID NO: 2891766 - protein, 4 aa, Entamoeba invadens
PDDF

SEQ ID NO: 2891767 - protein, 11 aa, Entamoeba invadens
PDDGEIPTTKM

SEQ ID NO: 2891768 - protein, 7 aa, Entamoeba invadens
PDDHSSV

SEQ ID NO: 2891769 - protein, 14 aa, Entamoeba invadens
PDDIKQVNDELFPK

SEQ ID NO: 2891770 - protein, 7 aa, Entamoeba invadens
PDDISNT

SEQ ID NO: 2891771 - protein, 5 aa, Entamoeba invadens
PDDKL

SEQ ID NO: 2891772 - protein, 4 aa, Entamoeba invadens
PDDL

SEQ ID NO: 2891773 - protein, 12 aa, Entamoeba invadens
PDDLSTKEVGAV

SEQ ID NO: 2891774 - protein, 32 aa, Entamoeba invadens
PDDNGEESEEEEEDNIRYTENTETFENREDEQ

SEQ ID NO: 2891775 - protein, 5 aa, Entamoeba invadens
PDDPD

SEQ ID NO: 2891776 - protein, 7 aa, Entamoeba invadens
PDDPNLP

SEQ ID NO: 2891777 - protein, 7 aa, Entamoeba invadens
PDDQAKE

SEQ ID NO: 2891778 - protein, 4 aa, Entamoeba invadens
PDDR

SEQ ID NO: 2891779 - protein, 17 aa, Entamoeba invadens
PDDSDPYSVSKRQGEAD

SEQ ID NO: 2891780 - protein, 4 aa, Entamoeba invadens
PDDT

SEQ ID NO: 2891781 - protein, 4 aa, Entamoeba invadens
PDDV

SEQ ID NO: 2891782 - protein, 4 aa, Entamoeba invadens
PDDY

SEQ ID NO: 2891783 - protein, 9 aa, Entamoeba invadens
PDEAINGNY

SEQ ID NO: 2891784 - protein, 12 aa, Entamoeba invadens
PDEDSSDDRKVP

SEQ ID NO: 2891785 - protein, 5 aa, Entamoeba invadens
PDEEE

SEQ ID NO: 2891786 - protein, 53 aa, Entamoeba invadens
PDEEKEKYVTAAKQNKCKEKQIKTEFEGQNDFSGVSPAGTNPVGNPQGTHSPI

SEQ ID NO: 2891787 - protein, 5 aa, Entamoeba invadens
PDEHG

SEQ ID NO: 2891788 - protein, 5 aa, Entamoeba invadens
PDEKA

SEQ ID NO: 2891789 - protein, 5 aa, Entamoeba invadens
PDEKI

SEQ ID NO: 2891790 - protein, 9 aa, Entamoeba invadens
PDEKRSLPQ

SEQ ID NO: 2891791 - protein, 26 aa, Entamoeba invadens
PDELENVEKVESRKEEKESQNKIEKC

SEQ ID NO: 2891792 - protein, 8 aa, Entamoeba invadens
PDELKPET

SEQ ID NO: 2891793 - protein, 8 aa, Entamoeba invadens
PDELKPQT

SEQ ID NO: 2891794 - protein, 7 aa, Entamoeba invadens
PDEMPDE

SEQ ID NO: 2891795 - protein, 9 aa, Entamoeba invadens
PDEPEDFPI

SEQ ID NO: 2891796 - protein, 10 aa, Entamoeba invadens
PDEPEDIPIP

SEQ ID NO: 2891797 - protein, 9 aa, Entamoeba invadens
PDEPPIPSP

SEQ ID NO: 2891798 - protein, 8 aa, Entamoeba invadens
PDEPVTPG

SEQ ID NO: 2891799 - protein, 4 aa, Entamoeba invadens
PDER

SEQ ID NO: 2891800 - protein, 6 aa, Entamoeba invadens
PDERAR

SEQ ID NO: 2891801 - protein, 5 aa, Entamoeba invadens
PDERE

SEQ ID NO: 2891802 - protein, 19 aa, Entamoeba invadens
PDERISAKDALEDPMFMSF

SEQ ID NO: 2891803 - protein, 9 aa, Entamoeba invadens
PDERMTPEE

SEQ ID NO: 2891804 - protein, 21 aa, Entamoeba invadens
PDERPTTPNPKRTPKKPKEKV

SEQ ID NO: 2891805 - protein, 14 aa, Entamoeba invadens
PDERSKSKSYLSAT

SEQ ID NO: 2891806 - protein, 15 aa, Entamoeba invadens
PDESAEKTQAPKAGD

SEQ ID NO: 2891807 - protein, 14 aa, Entamoeba invadens
PDESGNVSITSGGV

SEQ ID NO: 2891808 - protein, 4 aa, Entamoeba invadens
PDET

SEQ ID NO: 2891809 - protein, 7 aa, Entamoeba invadens
PDETAHK

SEQ ID NO: 2891810 - protein, 8 aa, Entamoeba invadens
PDETGDIG

SEQ ID NO: 2891811 - protein, 7 aa, Entamoeba invadens
PDETSGK

SEQ ID NO: 2891812 - protein, 11 aa, Entamoeba invadens
PDEVDGKNSDQ

SEQ ID NO: 2891813 - protein, 10 aa, Entamoeba invadens
PDEVLSEKSR

SEQ ID NO: 2891814 - protein, 8 aa, Entamoeba invadens
PDEVTQDS

SEQ ID NO: 2891815 - protein, 11 aa, Entamoeba invadens
PDFEPDSEREA

SEQ ID NO: 2891816 - protein, 26 aa, Entamoeba invadens
PDFETKNEKEEEMEQPVKATTADKYT

SEQ ID NO: 2891817 - protein, 5 aa, Entamoeba invadens
PDGPF

SEQ ID NO: 2891818 - protein, 6 aa, Entamoeba invadens
PDGPTE

SEQ ID NO: 2891819 - protein, 17 aa, Entamoeba invadens
PDGQKLSKQNPKTPRLE

SEQ ID NO: 2891820 - protein, 8 aa, Entamoeba invadens
PDGQPNRY

SEQ ID NO: 2891821 - protein, 5 aa, Entamoeba invadens
PDGSF

SEQ ID NO: 2891822 - protein, 7 aa, Entamoeba invadens
PDGSQKK

SEQ ID NO: 2891823 - protein, 4 aa, Entamoeba invadens
PDGT

SEQ ID NO: 2891824 - protein, 6 aa, Entamoeba invadens
PDGTCP

SEQ ID NO: 2891825 - protein, 23 aa, Entamoeba invadens
PDGTPAKEGLAKNLSNGQNVDNA

SEQ ID NO: 2891826 - protein, 5 aa, Entamoeba invadens
PDGTQ

SEQ ID NO: 2891827 - protein, 5 aa, Entamoeba invadens
PDHNT

SEQ ID NO: 2891828 - protein, 12 aa, Entamoeba invadens
PDIAQEEERRNQ

SEQ ID NO: 2891829 - protein, 23 aa, Entamoeba invadens
PDIDDSTGLIDDSDHIKDDYKEG

SEQ ID NO: 2891830 - protein, 15 aa, Entamoeba invadens
PDINSKKDDGCLEDS

SEQ ID NO: 2891831 - protein, 7 aa, Entamoeba invadens
PDIRPTV

SEQ ID NO: 2891832 - protein, 9 aa, Entamoeba invadens
PDITSYDVT

SEQ ID NO: 2891833 - protein, 19 aa, Entamoeba invadens
PDKAEFDKKYTKENEIGQG

SEQ ID NO: 2891834 - protein, 10 aa, Entamoeba invadens
PDKCEQKVEQ

SEQ ID NO: 2891835 - protein, 8 aa, Entamoeba invadens
PDKDAMKK

SEQ ID NO: 2891836 - protein, 9 aa, Entamoeba invadens
PDKDKRGIL

SEQ ID NO: 2891837 - protein, 14 aa, Entamoeba invadens
PDKEFDKPKRSWTN

SEQ ID NO: 2891838 - protein, 8 aa, Entamoeba invadens
PDKGEDIY

SEQ ID NO: 2891839 - protein, 6 aa, Entamoeba invadens
PDKGLA

SEQ ID NO: 2891840 - protein, 8 aa, Entamoeba invadens
PDKHAKVE

SEQ ID NO: 2891841 - protein, 4 aa, Entamoeba invadens
PDKK

SEQ ID NO: 2891842 - protein, 7 aa, Entamoeba invadens
PDKKDKK

SEQ ID NO: 2891843 - protein, 10 aa, Entamoeba invadens
PDKKEFSNGG

SEQ ID NO: 2891844 - protein, 6 aa, Entamoeba invadens
PDKKSD

SEQ ID NO: 2891845 - protein, 8 aa, Entamoeba invadens
PDKNASKV

SEQ ID NO: 2891846 - protein, 9 aa, Entamoeba invadens
PDKNGGDDT

SEQ ID NO: 2891847 - protein, 9 aa, Entamoeba invadens
PDKPSNPCP

SEQ ID NO: 2891848 - protein, 8 aa, Entamoeba invadens
PDKQTAFG

SEQ ID NO: 2891849 - protein, 9 aa, Entamoeba invadens
PDKRITAEA

SEQ ID NO: 2891850 - protein, 10 aa, Entamoeba invadens
PDKRVSADSM

SEQ ID NO: 2891851 - protein, 9 aa, Entamoeba invadens
PDKSESDFE

SEQ ID NO: 2891852 - protein, 8 aa, Entamoeba invadens
PDKSETSM

SEQ ID NO: 2891853 - protein, 10 aa, Entamoeba invadens
PDKSHNNPNP

SEQ ID NO: 2891854 - protein, 18 aa, Entamoeba invadens
PDKSLAKVSSKQKQTTAQ

SEQ ID NO: 2891855 - protein, 7 aa, Entamoeba invadens
PDKTCHE

SEQ ID NO: 2891856 - protein, 5 aa, Entamoeba invadens
PDKTQ

SEQ ID NO: 2891857 - protein, 4 aa, Entamoeba invadens
PDKV

SEQ ID NO: 2891858 - protein, 13 aa, Entamoeba invadens
PDKVEENPIEPTN

SEQ ID NO: 2891859 - protein, 8 aa, Entamoeba invadens
PDKVTSLG

SEQ ID NO: 2891860 - protein, 8 aa, Entamoeba invadens
PDKYEQDW

SEQ ID NO: 2891861 - protein, 6 aa, Entamoeba invadens
PDLDNS

SEQ ID NO: 2891862 - protein, 8 aa, Entamoeba invadens
PDLENRRK

SEQ ID NO: 2891863 - protein, 7 aa, Entamoeba invadens
PDLERDK

SEQ ID NO: 2891864 - protein, 7 aa, Entamoeba invadens
PDLGDKP

SEQ ID NO: 2891865 - protein, 11 aa, Entamoeba invadens
PDLIESDHKPV

SEQ ID NO: 2891866 - protein, 14 aa, Entamoeba invadens
PDLKPNVSHTPTPM

SEQ ID NO: 2891867 - protein, 5 aa, Entamoeba invadens
PDLPN

SEQ ID NO: 2891868 - protein, 4 aa, Entamoeba invadens
PDLS

SEQ ID NO: 2891869 - protein, 8 aa, Entamoeba invadens
PDLSPAES

SEQ ID NO: 2891870 - protein, 11 aa, Entamoeba invadens
PDMTESDIPQA

SEQ ID NO: 2891871 - protein, 7 aa, Entamoeba invadens
PDNANLP

SEQ ID NO: 2891872 - protein, 14 aa, Entamoeba invadens
PDNCANVANDSMYS

SEQ ID NO: 2891873 - protein, 15 aa, Entamoeba invadens
PDNDYPRKIKRNKQS

SEQ ID NO: 2891874 - protein, 11 aa, Entamoeba invadens
PDNEDVSESVS

SEQ ID NO: 2891875 - protein, 19 aa, Entamoeba invadens
PDNETKNDKKEDPAIPSTS

SEQ ID NO: 2891876 - protein, 5 aa, Entamoeba invadens
PDNHN

SEQ ID NO: 2891877 - protein, 8 aa, Entamoeba invadens
PDNHPELQ

SEQ ID NO: 2891878 - protein, 16 aa, Entamoeba invadens
PDNKTTQKLERKRHVG

SEQ ID NO: 2891879 - protein, 4 aa, Entamoeba invadens
PDNL

SEQ ID NO: 2891880 - protein, 5 aa, Entamoeba invadens
PDNLH

SEQ ID NO: 2891881 - protein, 7 aa, Entamoeba invadens
PDNNGPN

SEQ ID NO: 2891882 - protein, 10 aa, Entamoeba invadens
PDNNTKRITF

SEQ ID NO: 2891883 - protein, 8 aa, Entamoeba invadens
PDNQEMPE

SEQ ID NO: 2891884 - protein, 6 aa, Entamoeba invadens
PDNQNI

SEQ ID NO: 2891885 - protein, 6 aa, Entamoeba invadens
PDNQRS

SEQ ID NO: 2891886 - protein, 6 aa, Entamoeba invadens
PDNSDI

SEQ ID NO: 2891887 - protein, 7 aa, Entamoeba invadens
PDNSTRK

SEQ ID NO: 2891888 - protein, 9 aa, Entamoeba invadens
PDNTAAAPC

SEQ ID NO: 2891889 - protein, 9 aa, Entamoeba invadens
PDNTLRNQA

SEQ ID NO: 2891890 - protein, 11 aa, Entamoeba invadens
PDNTPPSNDNK

SEQ ID NO: 2891891 - protein, 9 aa, Entamoeba invadens
PDNTTNTKN

SEQ ID NO: 2891892 - protein, 5 aa, Entamoeba invadens
PDNVE

SEQ ID NO: 2891893 - protein, 21 aa, Entamoeba invadens
PDNYENEVNEIKNKRRKESNI

SEQ ID NO: 2891894 - protein, 5 aa, Entamoeba invadens
PDNYL

SEQ ID NO: 2891895 - protein, 7 aa, Entamoeba invadens
PDNYYED

SEQ ID NO: 2891896 - protein, 15 aa, Entamoeba invadens
PDPDEPKKYGTQNVK

SEQ ID NO: 2891897 - protein, 8 aa, Entamoeba invadens
PDPDEWPE

SEQ ID NO: 2891898 - protein, 20 aa, Entamoeba invadens
PDPETLKNTGINPNTTKEIG

SEQ ID NO: 2891899 - protein, 6 aa, Entamoeba invadens
PDPGDF

SEQ ID NO: 2891900 - protein, 4 aa, Entamoeba invadens
PDPP

SEQ ID NO: 2891901 - protein, 4 aa, Entamoeba invadens
PDPQ

SEQ ID NO: 2891902 - protein, 6 aa, Entamoeba invadens
PDPSLK

SEQ ID NO: 2891903 - protein, 4 aa, Entamoeba invadens
PDQA

SEQ ID NO: 2891904 - protein, 4 aa, Entamoeba invadens
PDQR

SEQ ID NO: 2891905 - protein, 5 aa, Entamoeba invadens
PDQRY

SEQ ID NO: 2891906 - protein, 6 aa, Entamoeba invadens
PDQSGV

SEQ ID NO: 2891907 - protein, 4 aa, Entamoeba invadens
PDRD

SEQ ID NO: 2891908 - protein, 4 aa, Entamoeba invadens
PDRI

SEQ ID NO: 2891909 - protein, 15 aa, Entamoeba invadens
PDRNPNNKEEATEKF

SEQ ID NO: 2891910 - protein, 15 aa, Entamoeba invadens
PDRNTKRFSRLSLSS

SEQ ID NO: 2891911 - protein, 6 aa, Entamoeba invadens
PDRPEL

SEQ ID NO: 2891912 - protein, 4 aa, Entamoeba invadens
PDRS

SEQ ID NO: 2891913 - protein, 7 aa, Entamoeba invadens
PDRVERR

SEQ ID NO: 2891914 - protein, 9 aa, Entamoeba invadens
PDSATEQTI

SEQ ID NO: 2891915 - protein, 10 aa, Entamoeba invadens
PDSDDDELEG

SEQ ID NO: 2891916 - protein, 5 aa, Entamoeba invadens
PDSDL

SEQ ID NO: 2891917 - protein, 5 aa, Entamoeba invadens
PDSDN

SEQ ID NO: 2891918 - protein, 12 aa, Entamoeba invadens
PDSEESQNDGMC

SEQ ID NO: 2891919 - protein, 7 aa, Entamoeba invadens
PDSEITK

SEQ ID NO: 2891920 - protein, 5 aa, Entamoeba invadens
PDSEN

SEQ ID NO: 2891921 - protein, 8 aa, Entamoeba invadens
PDSESPEC

SEQ ID NO: 2891922 - protein, 4 aa, Entamoeba invadens
PDSG

SEQ ID NO: 2891923 - protein, 10 aa, Entamoeba invadens
PDSGEKIKEE

SEQ ID NO: 2891924 - protein, 9 aa, Entamoeba invadens
PDSGTSIGK

SEQ ID NO: 2891925 - protein, 8 aa, Entamoeba invadens
PDSGVSTQ

SEQ ID NO: 2891926 - protein, 11 aa, Entamoeba invadens
PDSKESDDHQM

SEQ ID NO: 2891927 - protein, 7 aa, Entamoeba invadens
PDSKTRY

SEQ ID NO: 2891928 - protein, 4 aa, Entamoeba invadens
PDSL

SEQ ID NO: 2891929 - protein, 8 aa, Entamoeba invadens
PDSREEYL

SEQ ID NO: 2891930 - protein, 5 aa, Entamoeba invadens
PDSSA

SEQ ID NO: 2891931 - protein, 13 aa, Entamoeba invadens
PDSSASTEEVEDT

SEQ ID NO: 2891932 - protein, 5 aa, Entamoeba invadens
PDSSP

SEQ ID NO: 2891933 - protein, 8 aa, Entamoeba invadens
PDSTIDET

SEQ ID NO: 2891934 - protein, 15 aa, Entamoeba invadens
PDSTSKHDDEKSPTV

SEQ ID NO: 2891935 - protein, 11 aa, Entamoeba invadens
PDSTTEERSNV

SEQ ID NO: 2891936 - protein, 14 aa, Entamoeba invadens
PDSVSTERKTKEFH

SEQ ID NO: 2891937 - protein, 7 aa, Entamoeba invadens
PDSVTSI

SEQ ID NO: 2891938 - protein, 6 aa, Entamoeba invadens
PDTDIG

SEQ ID NO: 2891939 - protein, 7 aa, Entamoeba invadens
PDTEAPA

SEQ ID NO: 2891940 - protein, 8 aa, Entamoeba invadens
PDTEAPAN

SEQ ID NO: 2891941 - protein, 8 aa, Entamoeba invadens
PDTEKDEL

SEQ ID NO: 2891942 - protein, 6 aa, Entamoeba invadens
PDTEKT

SEQ ID NO: 2891943 - protein, 5 aa, Entamoeba invadens
PDTFP

SEQ ID NO: 2891944 - protein, 5 aa, Entamoeba invadens
PDTKL

SEQ ID NO: 2891945 - protein, 4 aa, Entamoeba invadens
PDTL

SEQ ID NO: 2891946 - protein, 11 aa, Entamoeba invadens
PDTLQKKSTKT

SEQ ID NO: 2891947 - protein, 10 aa, Entamoeba invadens
PDTNNKRGCN

SEQ ID NO: 2891948 - protein, 10 aa, Entamoeba invadens
PDTNPLPVGR

SEQ ID NO: 2891949 - protein, 12 aa, Entamoeba invadens
PDTNTEDNEGYT

SEQ ID NO: 2891950 - protein, 12 aa, Entamoeba invadens
PDTNYNRNERGY

SEQ ID NO: 2891951 - protein, 8 aa, Entamoeba invadens
PDTPLRTT

SEQ ID NO: 2891952 - protein, 6 aa, Entamoeba invadens
PDTPQT

SEQ ID NO: 2891953 - protein, 10 aa, Entamoeba invadens
PDTPTSIGSS

SEQ ID NO: 2891954 - protein, 13 aa, Entamoeba invadens
PDTRRKVPTYTPE

SEQ ID NO: 2891955 - protein, 4 aa, Entamoeba invadens
PDTS

SEQ ID NO: 2891956 - protein, 5 aa, Entamoeba invadens
PDTSF

SEQ ID NO: 2891957 - protein, 8 aa, Entamoeba invadens
PDTSKMSQ

SEQ ID NO: 2891958 - protein, 13 aa, Entamoeba invadens
PDTSTPPNPQFSA

SEQ ID NO: 2891959 - protein, 5 aa, Entamoeba invadens
PDTTE

SEQ ID NO: 2891960 - protein, 9 aa, Entamoeba invadens
PDTTESTQT

SEQ ID NO: 2891961 - protein, 6 aa, Entamoeba invadens
PDTVTN

SEQ ID NO: 2891962 - protein, 6 aa, Entamoeba invadens
PDVAPN

SEQ ID NO: 2891963 - protein, 10 aa, Entamoeba invadens
PDVKESEYQH

SEQ ID NO: 2891964 - protein, 21 aa, Entamoeba invadens
PDVNNIETKDLNDKDKGKQQL

SEQ ID NO: 2891965 - protein, 5 aa, Entamoeba invadens
PDVPI

SEQ ID NO: 2891966 - protein, 6 aa, Entamoeba invadens
PDVPTN

SEQ ID NO: 2891967 - protein, 9 aa, Entamoeba invadens
PDVSSSTFA

SEQ ID NO: 2891968 - protein, 19 aa, Entamoeba invadens
PDWGSSEAQRGYAQHSGGM

SEQ ID NO: 2891969 - protein, 12 aa, Entamoeba invadens
PDYATQPLDKTA

SEQ ID NO: 2891970 - protein, 5 aa, Entamoeba invadens
PDYEN

SEQ ID NO: 2891971 - protein, 16 aa, Entamoeba invadens
PDYKQEMENDDPTSPY

SEQ ID NO: 2891972 - protein, 6 aa, Entamoeba invadens
PDYNHS

SEQ ID NO: 2891973 - protein, 4 aa, Entamoeba invadens
PDYS

SEQ ID NO: 2891974 - protein, 6 aa, Entamoeba invadens
PDYYNE

SEQ ID NO: 2891975 - protein, 19 aa, Entamoeba invadens
PEADDDKEVDEKTGKTKHD

SEQ ID NO: 2891976 - protein, 27 aa, Entamoeba invadens
PEADLPPVKDTPLGDAVTPEMQDDTED

SEQ ID NO: 2891977 - protein, 6 aa, Entamoeba invadens
PEAETV

SEQ ID NO: 2891978 - protein, 6 aa, Entamoeba invadens
PEAKGN

SEQ ID NO: 2891979 - protein, 25 aa, Entamoeba invadens
PEAKPNEENVSNNQIQPHTETQKEI

SEQ ID NO: 2891980 - protein, 6 aa, Entamoeba invadens
PEALAS

SEQ ID NO: 2891981 - protein, 11 aa, Entamoeba invadens
PEALHGEPADY

SEQ ID NO: 2891982 - protein, 15 aa, Entamoeba invadens
PEANKYGSNSINNDP

SEQ ID NO: 2891983 - protein, 6 aa, Entamoeba invadens
PEAQDL

SEQ ID NO: 2891984 - protein, 17 aa, Entamoeba invadens
PEAQTEFQKVTQNKNLG

SEQ ID NO: 2891985 - protein, 7 aa, Entamoeba invadens
PEATDES

SEQ ID NO: 2891986 - protein, 8 aa, Entamoeba invadens
PEATERGG

SEQ ID NO: 2891987 - protein, 7 aa, Entamoeba invadens
PEAVSEK

SEQ ID NO: 2891988 - protein, 16 aa, Entamoeba invadens
PEAVTEMEKSKPMETE

SEQ ID NO: 2891989 - protein, 7 aa, Entamoeba invadens
PECQQEE

SEQ ID NO: 2891990 - protein, 4 aa, Entamoeba invadens
PEDD

SEQ ID NO: 2891991 - protein, 5 aa, Entamoeba invadens
PEDGE

SEQ ID NO: 2891992 - protein, 4 aa, Entamoeba invadens
PEDH

SEQ ID NO: 2891993 - protein, 15 aa, Entamoeba invadens
PEDHHKEVQVDQNTK

SEQ ID NO: 2891994 - protein, 7 aa, Entamoeba invadens
PEDIARN

SEQ ID NO: 2891995 - protein, 9 aa, Entamoeba invadens
PEDKGFPTL

SEQ ID NO: 2891996 - protein, 18 aa, Entamoeba invadens
PEDKKVKREEGARRPYGY

SEQ ID NO: 2891997 - protein, 7 aa, Entamoeba invadens
PEDKLAA

SEQ ID NO: 2891998 - protein, 9 aa, Entamoeba invadens
PEDKTEDDV

SEQ ID NO: 2891999 - protein, 10 aa, Entamoeba invadens
PEDNGEDKEK

SEQ ID NO: 2892000 - protein, 17 aa, Entamoeba invadens
PEDPDKVKEEHNENNEI

SEQ ID NO: 2892001 - protein, 11 aa, Entamoeba invadens
PEDQVQKVADS

SEQ ID NO: 2892002 - protein, 4 aa, Entamoeba invadens
PEDR

SEQ ID NO: 2892003 - protein, 5 aa, Entamoeba invadens
PEDRD

SEQ ID NO: 2892004 - protein, 26 aa, Entamoeba invadens
PEDRPKEEAQQDDKKTDDQQSQNENL

SEQ ID NO: 2892005 - protein, 6 aa, Entamoeba invadens
PEDSAN

SEQ ID NO: 2892006 - protein, 10 aa, Entamoeba invadens
PEDSKHSRET

SEQ ID NO: 2892007 - protein, 5 aa, Entamoeba invadens
PEDTA

SEQ ID NO: 2892008 - protein, 8 aa, Entamoeba invadens
PEDTTPVQ

SEQ ID NO: 2892009 - protein, 9 aa, Entamoeba invadens
PEEAENYSE

SEQ ID NO: 2892010 - protein, 8 aa, Entamoeba invadens
PEEAKKII

SEQ ID NO: 2892011 - protein, 12 aa, Entamoeba invadens
PEEDAGDEKGYE

SEQ ID NO: 2892012 - protein, 11 aa, Entamoeba invadens
PEEDNQDTSDD

SEQ ID NO: 2892013 - protein, 11 aa, Entamoeba invadens
PEEEKRKDELV

SEQ ID NO: 2892014 - protein, 26 aa, Entamoeba invadens
PEEEKTDKPKVAAKPKTTKKSKRPLT

SEQ ID NO: 2892015 - protein, 11 aa, Entamoeba invadens
PEEENADDPVF

SEQ ID NO: 2892016 - protein, 5 aa, Entamoeba invadens
PEEET

SEQ ID NO: 2892017 - protein, 8 aa, Entamoeba invadens
PEEETDQP

SEQ ID NO: 2892018 - protein, 10 aa, Entamoeba invadens
PEEETPEKIV

SEQ ID NO: 2892019 - protein, 8 aa, Entamoeba invadens
PEEETWES

SEQ ID NO: 2892020 - protein, 9 aa, Entamoeba invadens
PEEGKFSTK

SEQ ID NO: 2892021 - protein, 8 aa, Entamoeba invadens
PEEIEKNS

SEQ ID NO: 2892022 - protein, 8 aa, Entamoeba invadens
PEEKKVGT

SEQ ID NO: 2892023 - protein, 9 aa, Entamoeba invadens
PEEKPTDAI

SEQ ID NO: 2892024 - protein, 5 aa, Entamoeba invadens
PEELS

SEQ ID NO: 2892025 - protein, 4 aa, Entamoeba invadens
PEEM

SEQ ID NO: 2892026 - protein, 5 aa, Entamoeba invadens
PEENA

SEQ ID NO: 2892027 - protein, 10 aa, Entamoeba invadens
PEENKMNEEY

SEQ ID NO: 2892028 - protein, 9 aa, Entamoeba invadens
PEENPASEM

SEQ ID NO: 2892029 - protein, 5 aa, Entamoeba invadens
PEENQ

SEQ ID NO: 2892030 - protein, 7 aa, Entamoeba invadens
PEENSEC

SEQ ID NO: 2892031 - protein, 5 aa, Entamoeba invadens
PEEPH

SEQ ID NO: 2892032 - protein, 42 aa, Entamoeba invadens
PEEPKKVPQKTDRKDQKSRPRERNVKNNFGRDQKSYGTNGKR

SEQ ID NO: 2892033 - protein, 16 aa, Entamoeba invadens
PEEPQESPDFSEQSSC

SEQ ID NO: 2892034 - protein, 5 aa, Entamoeba invadens
PEEQL

SEQ ID NO: 2892035 - protein, 6 aa, Entamoeba invadens
PEEQNR

SEQ ID NO: 2892036 - protein, 17 aa, Entamoeba invadens
PEESEDEIENDGTVGTQ

SEQ ID NO: 2892037 - protein, 11 aa, Entamoeba invadens
PEESNQEIRKK

SEQ ID NO: 2892038 - protein, 5 aa, Entamoeba invadens
PEESR

SEQ ID NO: 2892039 - protein, 5 aa, Entamoeba invadens
PEETD

SEQ ID NO: 2892040 - protein, 7 aa, Entamoeba invadens
PEEVGAE

SEQ ID NO: 2892041 - protein, 6 aa, Entamoeba invadens
PEEVTE

SEQ ID NO: 2892042 - protein, 4 aa, Entamoeba invadens
PEFD

SEQ ID NO: 2892043 - protein, 6 aa, Entamoeba invadens
PEFGSE

SEQ ID NO: 2892044 - protein, 12 aa, Entamoeba invadens
PEFGSTKNTPDV

SEQ ID NO: 2892045 - protein, 6 aa, Entamoeba invadens
PEFPGD

SEQ ID NO: 2892046 - protein, 7 aa, Entamoeba invadens
PEFQSES

SEQ ID NO: 2892047 - protein, 6 aa, Entamoeba invadens
PEFTKD

SEQ ID NO: 2892048 - protein, 7 aa, Entamoeba invadens
PEFTSKV

SEQ ID NO: 2892049 - protein, 6 aa, Entamoeba invadens
PEGATG

SEQ ID NO: 2892050 - protein, 11 aa, Entamoeba invadens
PEGATITAYKN

SEQ ID NO: 2892051 - protein, 9 aa, Entamoeba invadens
PEGDDPTNA

SEQ ID NO: 2892052 - protein, 6 aa, Entamoeba invadens
PEGEGV

SEQ ID NO: 2892053 - protein, 9 aa, Entamoeba invadens
PEGEVPQEN

SEQ ID NO: 2892054 - protein, 5 aa, Entamoeba invadens
PEGGK

SEQ ID NO: 2892055 - protein, 4 aa, Entamoeba invadens
PEGL

SEQ ID NO: 2892056 - protein, 7 aa, Entamoeba invadens
PEGMNLS

SEQ ID NO: 2892057 - protein, 12 aa, Entamoeba invadens
PEGNRDLSEAIS

SEQ ID NO: 2892058 - protein, 6 aa, Entamoeba invadens
PEGQNF

SEQ ID NO: 2892059 - protein, 9 aa, Entamoeba invadens
PEGREKYPR

SEQ ID NO: 2892060 - protein, 8 aa, Entamoeba invadens
PEGSGRYT

SEQ ID NO: 2892061 - protein, 11 aa, Entamoeba invadens
PEGSIDPKFSK

SEQ ID NO: 2892062 - protein, 12 aa, Entamoeba invadens
PEGSIDPKFSKE

SEQ ID NO: 2892063 - protein, 7 aa, Entamoeba invadens
PEGSKEI

SEQ ID NO: 2892064 - protein, 9 aa, Entamoeba invadens
PEGTEYEGG

SEQ ID NO: 2892065 - protein, 7 aa, Entamoeba invadens
PEGTNNQ

SEQ ID NO: 2892066 - protein, 4 aa, Entamoeba invadens
PEGV

SEQ ID NO: 2892067 - protein, 5 aa, Entamoeba invadens
PEGVT

SEQ ID NO: 2892068 - protein, 5 aa, Entamoeba invadens
PEGYN

SEQ ID NO: 2892069 - protein, 21 aa, Entamoeba invadens
PEHKKESSTLDTPLLKFFKGF

SEQ ID NO: 2892070 - protein, 11 aa, Entamoeba invadens
PEHKTSDRHEQ

SEQ ID NO: 2892071 - protein, 13 aa, Entamoeba invadens
PEHKTSDRKEQIR

SEQ ID NO: 2892072 - protein, 4 aa, Entamoeba invadens
PEHL

SEQ ID NO: 2892073 - protein, 14 aa, Entamoeba invadens
PEHPKSTPKSIPKI

SEQ ID NO: 2892074 - protein, 5 aa, Entamoeba invadens
PEHQG

SEQ ID NO: 2892075 - protein, 7 aa, Entamoeba invadens
PEHQRTE

SEQ ID NO: 2892076 - protein, 19 aa, Entamoeba invadens
PEIEVPDPTTNQRKGMGLN

SEQ ID NO: 2892077 - protein, 4 aa, Entamoeba invadens
PEII

SEQ ID NO: 2892078 - protein, 12 aa, Entamoeba invadens
PEIKTDSDNLQP

SEQ ID NO: 2892079 - protein, 11 aa, Entamoeba invadens
PEIKTTQEKLG

SEQ ID NO: 2892080 - protein, 6 aa, Entamoeba invadens
PEIPDD

SEQ ID NO: 2892081 - protein, 6 aa, Entamoeba invadens
PEIPND

SEQ ID NO: 2892082 - protein, 5 aa, Entamoeba invadens
PEISR

SEQ ID NO: 2892083 - protein, 6 aa, Entamoeba invadens
PEITQD

SEQ ID NO: 2892084 - protein, 17 aa, Entamoeba invadens
PEIVEPTSVEGKDDQIE

SEQ ID NO: 2892085 - protein, 5 aa, Entamoeba invadens
PEKAK

SEQ ID NO: 2892086 - protein, 14 aa, Entamoeba invadens
PEKAKNLVVKFSEL

SEQ ID NO: 2892087 - protein, 12 aa, Entamoeba invadens
PEKASGTIPPEM

SEQ ID NO: 2892088 - protein, 7 aa, Entamoeba invadens
PEKDLTD

SEQ ID NO: 2892089 - protein, 14 aa, Entamoeba invadens
PEKETFGEQQFSNS

SEQ ID NO: 2892090 - protein, 7 aa, Entamoeba invadens
PEKETPI

SEQ ID NO: 2892091 - protein, 8 aa, Entamoeba invadens
PEKGKEGQ

SEQ ID NO: 2892092 - protein, 10 aa, Entamoeba invadens
PEKKEKKGDF

SEQ ID NO: 2892093 - protein, 10 aa, Entamoeba invadens
PEKKGDYNPY

SEQ ID NO: 2892094 - protein, 20 aa, Entamoeba invadens
PEKKVKSNIDDNAKCTKEFE

SEQ ID NO: 2892095 - protein, 8 aa, Entamoeba invadens
PEKLNEDV

SEQ ID NO: 2892096 - protein, 11 aa, Entamoeba invadens
PEKNDATNERY

SEQ ID NO: 2892097 - protein, 8 aa, Entamoeba invadens
PEKNDEPI

SEQ ID NO: 2892098 - protein, 6 aa, Entamoeba invadens
PEKNRR

SEQ ID NO: 2892099 - protein, 9 aa, Entamoeba invadens
PEKNSGRVK

SEQ ID NO: 2892100 - protein, 4 aa, Entamoeba invadens
PEKP

SEQ ID NO: 2892101 - protein, 7 aa, Entamoeba invadens
PEKPVDG

SEQ ID NO: 2892102 - protein, 10 aa, Entamoeba invadens
PEKQGAWVRE

SEQ ID NO: 2892103 - protein, 7 aa, Entamoeba invadens
PEKQPPV

SEQ ID NO: 2892104 - protein, 6 aa, Entamoeba invadens
PEKQSN

SEQ ID NO: 2892105 - protein, 10 aa, Entamoeba invadens
PEKRKSNGSL

SEQ ID NO: 2892106 - protein, 18 aa, Entamoeba invadens
PEKRQADEVEEDKQIDEY

SEQ ID NO: 2892107 - protein, 7 aa, Entamoeba invadens
PEKSNTI

SEQ ID NO: 2892108 - protein, 10 aa, Entamoeba invadens
PEKSVIEPSG

SEQ ID NO: 2892109 - protein, 4 aa, Entamoeba invadens
PEKT

SEQ ID NO: 2892110 - protein, 11 aa, Entamoeba invadens
PEKTENAGKYK

SEQ ID NO: 2892111 - protein, 7 aa, Entamoeba invadens
PEKTPPI

SEQ ID NO: 2892112 - protein, 7 aa, Entamoeba invadens
PEKVGDM

SEQ ID NO: 2892113 - protein, 9 aa, Entamoeba invadens
PEKVGKTSL

SEQ ID NO: 2892114 - protein, 4 aa, Entamoeba invadens
PEKY

SEQ ID NO: 2892115 - protein, 10 aa, Entamoeba invadens
PEKYNKPELV

SEQ ID NO: 2892116 - protein, 7 aa, Entamoeba invadens
PEKYSNK

SEQ ID NO: 2892117 - protein, 7 aa, Entamoeba invadens
PELETGA

SEQ ID NO: 2892118 - protein, 13 aa, Entamoeba invadens
PELGSEEEKERKV

SEQ ID NO: 2892119 - protein, 5 aa, Entamoeba invadens
PELGT

SEQ ID NO: 2892120 - protein, 17 aa, Entamoeba invadens
PELLGKKDGKGEMSGRV

SEQ ID NO: 2892121 - protein, 5 aa, Entamoeba invadens
PELLS

SEQ ID NO: 2892122 - protein, 5 aa, Entamoeba invadens
PELNE

SEQ ID NO: 2892123 - protein, 12 aa, Entamoeba invadens
PELPISTRKDFD

SEQ ID NO: 2892124 - protein, 12 aa, Entamoeba invadens
PELQKDTSLTQN

SEQ ID NO: 2892125 - protein, 10 aa, Entamoeba invadens
PELQKEKDIE

SEQ ID NO: 2892126 - protein, 9 aa, Entamoeba invadens
PELQSEKDI

SEQ ID NO: 2892127 - protein, 6 aa, Entamoeba invadens
PELRGD

SEQ ID NO: 2892128 - protein, 7 aa, Entamoeba invadens
PELRRTD

SEQ ID NO: 2892129 - protein, 10 aa, Entamoeba invadens
PELRSEDDIE

SEQ ID NO: 2892130 - protein, 12 aa, Entamoeba invadens
PELSDGFKKNEF

SEQ ID NO: 2892131 - protein, 4 aa, Entamoeba invadens
PELT

SEQ ID NO: 2892132 - protein, 11 aa, Entamoeba invadens
PELTSKTQIDK

SEQ ID NO: 2892133 - protein, 15 aa, Entamoeba invadens
PEMESSTIVNEQKSA

SEQ ID NO: 2892134 - protein, 4 aa, Entamoeba invadens
PEMK

SEQ ID NO: 2892135 - protein, 5 aa, Entamoeba invadens
PEMNQ

SEQ ID NO: 2892136 - protein, 6 aa, Entamoeba invadens
PEMTPG

SEQ ID NO: 2892137 - protein, 8 aa, Entamoeba invadens
PENAVTNE

SEQ ID NO: 2892138 - protein, 17 aa, Entamoeba invadens
PENDNELSTTTDTIKSN

SEQ ID NO: 2892139 - protein, 4 aa, Entamoeba invadens
PENE

SEQ ID NO: 2892140 - protein, 15 aa, Entamoeba invadens
PENEEESASESDDKI

SEQ ID NO: 2892141 - protein, 10 aa, Entamoeba invadens
PENEVKNRYS

SEQ ID NO: 2892142 - protein, 5 aa, Entamoeba invadens
PENEY

SEQ ID NO: 2892143 - protein, 15 aa, Entamoeba invadens
PENHQRPSPPQHSHL

SEQ ID NO: 2892144 - protein, 17 aa, Entamoeba invadens
PENIQESGETFQKPEYI

SEQ ID NO: 2892145 - protein, 5 aa, Entamoeba invadens
PENIR

SEQ ID NO: 2892146 - protein, 6 aa, Entamoeba invadens
PENKNI

SEQ ID NO: 2892147 - protein, 8 aa, Entamoeba invadens
PENLNTKN

SEQ ID NO: 2892148 - protein, 18 aa, Entamoeba invadens
PENNNPVYDRKETAGLPR

SEQ ID NO: 2892149 - protein, 6 aa, Entamoeba invadens
PENPET

SEQ ID NO: 2892150 - protein, 15 aa, Entamoeba invadens
PENPKDVLTSPGKFA

SEQ ID NO: 2892151 - protein, 10 aa, Entamoeba invadens
PENPKGIYSK

SEQ ID NO: 2892152 - protein, 4 aa, Entamoeba invadens
PENQ

SEQ ID NO: 2892153 - protein, 5 aa, Entamoeba invadens
PENQS

SEQ ID NO: 2892154 - protein, 4 aa, Entamoeba invadens
PENR

SEQ ID NO: 2892155 - protein, 10 aa, Entamoeba invadens
PENSPLLKRS

SEQ ID NO: 2892156 - protein, 5 aa, Entamoeba invadens
PENST

SEQ ID NO: 2892157 - protein, 4 aa, Entamoeba invadens
PENT

SEQ ID NO: 2892158 - protein, 7 aa, Entamoeba invadens
PENTKNQ

SEQ ID NO: 2892159 - protein, 5 aa, Entamoeba invadens
PENTN

SEQ ID NO: 2892160 - protein, 10 aa, Entamoeba invadens
PENTTEQSIT

SEQ ID NO: 2892161 - protein, 7 aa, Entamoeba invadens
PENTTYT

SEQ ID NO: 2892162 - protein, 5 aa, Entamoeba invadens
PENVG

SEQ ID NO: 2892163 - protein, 7 aa, Entamoeba invadens
PENVKAE

SEQ ID NO: 2892164 - protein, 8 aa, Entamoeba invadens
PENYNEKD

SEQ ID NO: 2892165 - protein, 20 aa, Entamoeba invadens
PEPATPPIPKSESENETEIS

SEQ ID NO: 2892166 - protein, 6 aa, Entamoeba invadens
PEPCYP

SEQ ID NO: 2892167 - protein, 9 aa, Entamoeba invadens
PEPGKCSSE

SEQ ID NO: 2892168 - protein, 8 aa, Entamoeba invadens
PEPHNPMN

SEQ ID NO: 2892169 - protein, 9 aa, Entamoeba invadens
PEPKTEDIR

SEQ ID NO: 2892170 - protein, 10 aa, Entamoeba invadens
PEPNTKNFSK

SEQ ID NO: 2892171 - protein, 12 aa, Entamoeba invadens
PEPPKFENAPTN

SEQ ID NO: 2892172 - protein, 6 aa, Entamoeba invadens
PEPPNG

SEQ ID NO: 2892173 - protein, 5 aa, Entamoeba invadens
PEPQP

SEQ ID NO: 2892174 - protein, 8 aa, Entamoeba invadens
PEPQTASR

SEQ ID NO: 2892175 - protein, 4 aa, Entamoeba invadens
PEPS

SEQ ID NO: 2892176 - protein, 13 aa, Entamoeba invadens
PEPTINPISPVSH

SEQ ID NO: 2892177 - protein, 7 aa, Entamoeba invadens
PEPVAQS

SEQ ID NO: 2892178 - protein, 4 aa, Entamoeba invadens
PEQC

SEQ ID NO: 2892179 - protein, 4 aa, Entamoeba invadens
PEQD

SEQ ID NO: 2892180 - protein, 10 aa, Entamoeba invadens
PEQEDIKKEQ

SEQ ID NO: 2892181 - protein, 20 aa, Entamoeba invadens
PEQERAEKKAIKALGPKKAR

SEQ ID NO: 2892182 - protein, 6 aa, Entamoeba invadens
PEQKEN

SEQ ID NO: 2892183 - protein, 5 aa, Entamoeba invadens
PEQNK

SEQ ID NO: 2892184 - protein, 8 aa, Entamoeba invadens
PEQNKDVN

SEQ ID NO: 2892185 - protein, 8 aa, Entamoeba invadens
PEQNPKRK

SEQ ID NO: 2892186 - protein, 10 aa, Entamoeba invadens
PEQPAEPGDL

SEQ ID NO: 2892187 - protein, 10 aa, Entamoeba invadens
PEQPGDLQRV

SEQ ID NO: 2892188 - protein, 10 aa, Entamoeba invadens
PEQPNDLQRV

SEQ ID NO: 2892189 - protein, 5 aa, Entamoeba invadens
PEQPT

SEQ ID NO: 2892190 - protein, 8 aa, Entamoeba invadens
PEQRPTFN

SEQ ID NO: 2892191 - protein, 4 aa, Entamoeba invadens
PEQT

SEQ ID NO: 2892192 - protein, 7 aa, Entamoeba invadens
PEQTINS

SEQ ID NO: 2892193 - protein, 7 aa, Entamoeba invadens
PEQTKEL

SEQ ID NO: 2892194 - protein, 32 aa, Entamoeba invadens
PEQTQRTEESEEATFNNPINTQPKEGNVTDLL

SEQ ID NO: 2892195 - protein, 7 aa, Entamoeba invadens
PEQYDGR

SEQ ID NO: 2892196 - protein, 11 aa, Entamoeba invadens
PERDENEYSPV

SEQ ID NO: 2892197 - protein, 7 aa, Entamoeba invadens
PERFTDS

SEQ ID NO: 2892198 - protein, 4 aa, Entamoeba invadens
PERI

SEQ ID NO: 2892199 - protein, 10 aa, Entamoeba invadens
PERKKQDDGK

SEQ ID NO: 2892200 - protein, 4 aa, Entamoeba invadens
PERL

SEQ ID NO: 2892201 - protein, 18 aa, Entamoeba invadens
PERLGTGTIGGVDRYKGN

SEQ ID NO: 2892202 - protein, 24 aa, Entamoeba invadens
PERNGVKEKTEQNLKKEDIPSDVK

SEQ ID NO: 2892203 - protein, 8 aa, Entamoeba invadens
PERPVLPT

SEQ ID NO: 2892204 - protein, 6 aa, Entamoeba invadens
PERREQ

SEQ ID NO: 2892205 - protein, 5 aa, Entamoeba invadens
PERSE

SEQ ID NO: 2892206 - protein, 11 aa, Entamoeba invadens
PERSQINNPKI

SEQ ID NO: 2892207 - protein, 10 aa, Entamoeba invadens
PERSQSSAAW

SEQ ID NO: 2892208 - protein, 14 aa, Entamoeba invadens
PERTMKEDSWNRAD

SEQ ID NO: 2892209 - protein, 5 aa, Entamoeba invadens
PERTQ

SEQ ID NO: 2892210 - protein, 7 aa, Entamoeba invadens
PERVETK

SEQ ID NO: 2892211 - protein, 4 aa, Entamoeba invadens
PESA

SEQ ID NO: 2892212 - protein, 11 aa, Entamoeba invadens
PESDGIVTGRG

SEQ ID NO: 2892213 - protein, 7 aa, Entamoeba invadens
PESDGRR

SEQ ID NO: 2892214 - protein, 9 aa, Entamoeba invadens
PESDTPNDY

SEQ ID NO: 2892215 - protein, 10 aa, Entamoeba invadens
PESEEKGTVV

SEQ ID NO: 2892216 - protein, 16 aa, Entamoeba invadens
PESEKPVPPRTTPAFF

SEQ ID NO: 2892217 - protein, 7 aa, Entamoeba invadens
PESERYR

SEQ ID NO: 2892218 - protein, 23 aa, Entamoeba invadens
PESISDNPASKKVFPRKSNTTFQ

SEQ ID NO: 2892219 - protein, 7 aa, Entamoeba invadens
PESKESF

SEQ ID NO: 2892220 - protein, 20 aa, Entamoeba invadens
PESKQNAEQRKGRAGRTQSG

SEQ ID NO: 2892221 - protein, 5 aa, Entamoeba invadens
PESKT

SEQ ID NO: 2892222 - protein, 9 aa, Entamoeba invadens
PESKTQRGM

SEQ ID NO: 2892223 - protein, 12 aa, Entamoeba invadens
PESKTQRGMCYG

SEQ ID NO: 2892224 - protein, 11 aa, Entamoeba invadens
PESMTQEQADA

SEQ ID NO: 2892225 - protein, 4 aa, Entamoeba invadens
PESN

SEQ ID NO: 2892226 - protein, 20 aa, Entamoeba invadens
PESQTTRNNSDLPPSVPAST

SEQ ID NO: 2892227 - protein, 10 aa, Entamoeba invadens
PESRQKTDVS

SEQ ID NO: 2892228 - protein, 4 aa, Entamoeba invadens
PESS

SEQ ID NO: 2892229 - protein, 5 aa, Entamoeba invadens
PESSF

SEQ ID NO: 2892230 - protein, 8 aa, Entamoeba invadens
PESSHLQD

SEQ ID NO: 2892231 - protein, 34 aa, Entamoeba invadens
PESTPTQTQTLQPPTTTPLKDEKSEQQETKSKEH

SEQ ID NO: 2892232 - protein, 15 aa, Entamoeba invadens
PESTTKLSIDEQQNK

SEQ ID NO: 2892233 - protein, 10 aa, Entamoeba invadens
PESVGGGLAR

SEQ ID NO: 2892234 - protein, 10 aa, Entamoeba invadens
PESVGGGLDR

SEQ ID NO: 2892235 - protein, 13 aa, Entamoeba invadens
PESVGGGSARKFK

SEQ ID NO: 2892236 - protein, 11 aa, Entamoeba invadens
PESVTKIEGSA

SEQ ID NO: 2892237 - protein, 6 aa, Entamoeba invadens
PESVTS

SEQ ID NO: 2892238 - protein, 4 aa, Entamoeba invadens
PESY

SEQ ID NO: 2892239 - protein, 8 aa, Entamoeba invadens
PETAVTDE

SEQ ID NO: 2892240 - protein, 7 aa, Entamoeba invadens
PETCGKE

SEQ ID NO: 2892241 - protein, 8 aa, Entamoeba invadens
PETCGKEI

SEQ ID NO: 2892242 - protein, 4 aa, Entamoeba invadens
PETF

SEQ ID NO: 2892243 - protein, 5 aa, Entamoeba invadens
PETFD

SEQ ID NO: 2892244 - protein, 5 aa, Entamoeba invadens
PETFR

SEQ ID NO: 2892245 - protein, 8 aa, Entamoeba invadens
PETGKEDG

SEQ ID NO: 2892246 - protein, 9 aa, Entamoeba invadens
PETHAETEV

SEQ ID NO: 2892247 - protein, 11 aa, Entamoeba invadens
PETHKDINKNK

SEQ ID NO: 2892248 - protein, 5 aa, Entamoeba invadens
PETHP

SEQ ID NO: 2892249 - protein, 8 aa, Entamoeba invadens
PETKEEDL

SEQ ID NO: 2892250 - protein, 7 aa, Entamoeba invadens
PETKEEI

SEQ ID NO: 2892251 - protein, 10 aa, Entamoeba invadens
PETKEKISTV

SEQ ID NO: 2892252 - protein, 7 aa, Entamoeba invadens
PETKKFN

SEQ ID NO: 2892253 - protein, 36 aa, Entamoeba invadens
PETLATPIKPTETEMNNPQNIETENTKRCLQPKKTS

SEQ ID NO: 2892254 - protein, 6 aa, Entamoeba invadens
PETLPN

SEQ ID NO: 2892255 - protein, 7 aa, Entamoeba invadens
PETLSSL

SEQ ID NO: 2892256 - protein, 10 aa, Entamoeba invadens
PETNDDELSQ

SEQ ID NO: 2892257 - protein, 8 aa, Entamoeba invadens
PETNPREC

SEQ ID NO: 2892258 - protein, 17 aa, Entamoeba invadens
PETPENLPKSEKQEKLE

SEQ ID NO: 2892259 - protein, 5 aa, Entamoeba invadens
PETPN

SEQ ID NO: 2892260 - protein, 5 aa, Entamoeba invadens
PETPY

SEQ ID NO: 2892261 - protein, 10 aa, Entamoeba invadens
PETQPALKDR

SEQ ID NO: 2892262 - protein, 7 aa, Entamoeba invadens
PETQQIT

SEQ ID NO: 2892263 - protein, 8 aa, Entamoeba invadens
PETRLGQL

SEQ ID NO: 2892264 - protein, 13 aa, Entamoeba invadens
PETRSLKETYKVG

SEQ ID NO: 2892265 - protein, 7 aa, Entamoeba invadens
PETRWTA

SEQ ID NO: 2892266 - protein, 6 aa, Entamoeba invadens
PETSDI

SEQ ID NO: 2892267 - protein, 5 aa, Entamoeba invadens
PETVN

SEQ ID NO: 2892268 - protein, 4 aa, Entamoeba invadens
PETY

SEQ ID NO: 2892269 - protein, 8 aa, Entamoeba invadens
PETYDTPI

SEQ ID NO: 2892270 - protein, 31 aa, Entamoeba invadens
PEVATEEVTEEVQTPKEPRVSLSAKKPSRRL

SEQ ID NO: 2892271 - protein, 15 aa, Entamoeba invadens
PEVENDINGKPAENS

SEQ ID NO: 2892272 - protein, 9 aa, Entamoeba invadens
PEVEPAKAR

SEQ ID NO: 2892273 - protein, 16 aa, Entamoeba invadens
PEVGDKEIEILTDSED

SEQ ID NO: 2892274 - protein, 20 aa, Entamoeba invadens
PEVGSASVKLSKTGTPSGGC

SEQ ID NO: 2892275 - protein, 4 aa, Entamoeba invadens
PEVP

SEQ ID NO: 2892276 - protein, 7 aa, Entamoeba invadens
PEVPDNY

SEQ ID NO: 2892277 - protein, 5 aa, Entamoeba invadens
PEVPQ

SEQ ID NO: 2892278 - protein, 6 aa, Entamoeba invadens
PEVPSN

SEQ ID NO: 2892279 - protein, 12 aa, Entamoeba invadens
PEVSEDEYTSEA

SEQ ID NO: 2892280 - protein, 6 aa, Entamoeba invadens
PEVTDR

SEQ ID NO: 2892281 - protein, 18 aa, Entamoeba invadens
PEWAGSTCTPSSLDESYK

SEQ ID NO: 2892282 - protein, 11 aa, Entamoeba invadens
PEWKEGEEPPH

SEQ ID NO: 2892283 - protein, 12 aa, Entamoeba invadens
PEWVKGKDPRYK

SEQ ID NO: 2892284 - protein, 8 aa, Entamoeba invadens
PEYDDKEK

SEQ ID NO: 2892285 - protein, 14 aa, Entamoeba invadens
PEYDKKKTSEWSKS

SEQ ID NO: 2892286 - protein, 4 aa, Entamoeba invadens
PEYL

SEQ ID NO: 2892287 - protein, 6 aa, Entamoeba invadens
PEYTTE

SEQ ID NO: 2892288 - protein, 97 aa, Entamoeba invadens
PFADGSEQQNTSEARSSQTTKSVKSAQNINPFSDEAPQVNTTSYNPFGESTQPKPPQVFQETQKSKTPESINPFADAPPALGEGTTPLQTNSTNPFL

SEQ ID NO: 2892289 - protein, 8 aa, Entamoeba invadens
PFAKGGER

SEQ ID NO: 2892290 - protein, 7 aa, Entamoeba invadens
PFAQQKK

SEQ ID NO: 2892291 - protein, 5 aa, Entamoeba invadens
PFDED

SEQ ID NO: 2892292 - protein, 6 aa, Entamoeba invadens
PFDEKD

SEQ ID NO: 2892293 - protein, 5 aa, Entamoeba invadens
PFDET

SEQ ID NO: 2892294 - protein, 10 aa, Entamoeba invadens
PFDGDNLEEN

SEQ ID NO: 2892295 - protein, 11 aa, Entamoeba invadens
PFDKKNEKKKY

SEQ ID NO: 2892296 - protein, 7 aa, Entamoeba invadens
PFDNNGI

SEQ ID NO: 2892297 - protein, 10 aa, Entamoeba invadens
PFDSSNEVNQ

SEQ ID NO: 2892298 - protein, 5 aa, Entamoeba invadens
PFDST

SEQ ID NO: 2892299 - protein, 7 aa, Entamoeba invadens
PFDTKKF

SEQ ID NO: 2892300 - protein, 7 aa, Entamoeba invadens
PFEEDST

SEQ ID NO: 2892301 - protein, 7 aa, Entamoeba invadens
PFEKTNA

SEQ ID NO: 2892302 - protein, 8 aa, Entamoeba invadens
PFEQEREN

SEQ ID NO: 2892303 - protein, 4 aa, Entamoeba invadens
PFES

SEQ ID NO: 2892304 - protein, 7 aa, Entamoeba invadens
PFESNDN

SEQ ID NO: 2892305 - protein, 26 aa, Entamoeba invadens
PFETENNDEEEEMPKPSSAQPQVEID

SEQ ID NO: 2892306 - protein, 4 aa, Entamoeba invadens
PFGE

SEQ ID NO: 2892307 - protein, 5 aa, Entamoeba invadens
PFGGN

SEQ ID NO: 2892308 - protein, 8 aa, Entamoeba invadens
PFGPGPNY

SEQ ID NO: 2892309 - protein, 4 aa, Entamoeba invadens
PFGS

SEQ ID NO: 2892310 - protein, 10 aa, Entamoeba invadens
PFGSTSRDHV

SEQ ID NO: 2892311 - protein, 5 aa, Entamoeba invadens
PFGTV

SEQ ID NO: 2892312 - protein, 8 aa, Entamoeba invadens
PFKENEEN

SEQ ID NO: 2892313 - protein, 4 aa, Entamoeba invadens
PFKK

SEQ ID NO: 2892314 - protein, 6 aa, Entamoeba invadens
PFKPTT

SEQ ID NO: 2892315 - protein, 8 aa, Entamoeba invadens
PFNAPTPD

SEQ ID NO: 2892316 - protein, 8 aa, Entamoeba invadens
PFNASTPE

SEQ ID NO: 2892317 - protein, 5 aa, Entamoeba invadens
PFNDK

SEQ ID NO: 2892318 - protein, 5 aa, Entamoeba invadens
PFNEE

SEQ ID NO: 2892319 - protein, 5 aa, Entamoeba invadens
PFNEY

SEQ ID NO: 2892320 - protein, 4 aa, Entamoeba invadens
PFNG

SEQ ID NO: 2892321 - protein, 15 aa, Entamoeba invadens
PFNGGVNASQKFTPI

SEQ ID NO: 2892322 - protein, 4 aa, Entamoeba invadens
PFNQ

SEQ ID NO: 2892323 - protein, 16 aa, Entamoeba invadens
PFNTEPTALKRKEKKG

SEQ ID NO: 2892324 - protein, 13 aa, Entamoeba invadens
PFPADDKVSEDPM

SEQ ID NO: 2892325 - protein, 13 aa, Entamoeba invadens
PFPEGNKPSAELR

SEQ ID NO: 2892326 - protein, 4 aa, Entamoeba invadens
PFPN

SEQ ID NO: 2892327 - protein, 8 aa, Entamoeba invadens
PFPNPNRE

SEQ ID NO: 2892328 - protein, 4 aa, Entamoeba invadens
PFPP

SEQ ID NO: 2892329 - protein, 10 aa, Entamoeba invadens
PFPPSNYKYD

SEQ ID NO: 2892330 - protein, 5 aa, Entamoeba invadens
PFPQH

SEQ ID NO: 2892331 - protein, 10 aa, Entamoeba invadens
PFPQNNEETQ

SEQ ID NO: 2892332 - protein, 4 aa, Entamoeba invadens
PFPR

SEQ ID NO: 2892333 - protein, 10 aa, Entamoeba invadens
PFPSTSPYNY

SEQ ID NO: 2892334 - protein, 12 aa, Entamoeba invadens
PFQPLTDTQRNE

SEQ ID NO: 2892335 - protein, 13 aa, Entamoeba invadens
PFQQDPLKKEVKL

SEQ ID NO: 2892336 - protein, 10 aa, Entamoeba invadens
PFRGKSDKLT

SEQ ID NO: 2892337 - protein, 6 aa, Entamoeba invadens
PFRPPE

SEQ ID NO: 2892338 - protein, 5 aa, Entamoeba invadens
PFRTP

SEQ ID NO: 2892339 - protein, 6 aa, Entamoeba invadens
PFSAED

SEQ ID NO: 2892340 - protein, 8 aa, Entamoeba invadens
PFSAQEED

SEQ ID NO: 2892341 - protein, 11 aa, Entamoeba invadens
PFSDYDDEEIS

SEQ ID NO: 2892342 - protein, 10 aa, Entamoeba invadens
PFSEDNDLLT

SEQ ID NO: 2892343 - protein, 12 aa, Entamoeba invadens
PFSEDYDPTIED

SEQ ID NO: 2892344 - protein, 7 aa, Entamoeba invadens
PFSEERT

SEQ ID NO: 2892345 - protein, 7 aa, Entamoeba invadens
PFSGDTL

SEQ ID NO: 2892346 - protein, 7 aa, Entamoeba invadens
PFSLNED

SEQ ID NO: 2892347 - protein, 12 aa, Entamoeba invadens
PFSNGPVQSPEY

SEQ ID NO: 2892348 - protein, 14 aa, Entamoeba invadens
PFSPEKGADRVDTM

SEQ ID NO: 2892349 - protein, 4 aa, Entamoeba invadens
PFSR

SEQ ID NO: 2892350 - protein, 6 aa, Entamoeba invadens
PFSRPT

SEQ ID NO: 2892351 - protein, 21 aa, Entamoeba invadens
PFSRSTSSRVITNSKGSTEEL

SEQ ID NO: 2892352 - protein, 10 aa, Entamoeba invadens
PFSTKVSKKR

SEQ ID NO: 2892353 - protein, 5 aa, Entamoeba invadens
PFTAE

SEQ ID NO: 2892354 - protein, 7 aa, Entamoeba invadens
PFTEKSD

SEQ ID NO: 2892355 - protein, 5 aa, Entamoeba invadens
PFTGK

SEQ ID NO: 2892356 - protein, 4 aa, Entamoeba invadens
PFTH

SEQ ID NO: 2892357 - protein, 5 aa, Entamoeba invadens
PFTPD

SEQ ID NO: 2892358 - protein, 7 aa, Entamoeba invadens
PFTPGTV

SEQ ID NO: 2892359 - protein, 4 aa, Entamoeba invadens
PFTQ

SEQ ID NO: 2892360 - protein, 5 aa, Entamoeba invadens
PFTRS

SEQ ID NO: 2892361 - protein, 17 aa, Entamoeba invadens
PFTSTISSNLKTKAEQS

SEQ ID NO: 2892362 - protein, 10 aa, Entamoeba invadens
PFYPKNVSSQ

SEQ ID NO: 2892363 - protein, 14 aa, Entamoeba invadens
PFYTDDDNQNQTYQ

SEQ ID NO: 2892364 - protein, 7 aa, Entamoeba invadens
PGADSRE

SEQ ID NO: 2892365 - protein, 4 aa, Entamoeba invadens
PGAK

SEQ ID NO: 2892366 - protein, 13 aa, Entamoeba invadens
PGAKYEHKCIYSF

SEQ ID NO: 2892367 - protein, 4 aa, Entamoeba invadens
PGAM

SEQ ID NO: 2892368 - protein, 13 aa, Entamoeba invadens
PGAMSGWKPNTVR

SEQ ID NO: 2892369 - protein, 7 aa, Entamoeba invadens
PGAPQYP

SEQ ID NO: 2892370 - protein, 4 aa, Entamoeba invadens
PGAQ

SEQ ID NO: 2892371 - protein, 7 aa, Entamoeba invadens
PGASNEL

SEQ ID NO: 2892372 - protein, 4 aa, Entamoeba invadens
PGAY

SEQ ID NO: 2892373 - protein, 5 aa, Entamoeba invadens
PGCGK

SEQ ID NO: 2892374 - protein, 20 aa, Entamoeba invadens
PGCGKSFTARKEAEDKWGND

SEQ ID NO: 2892375 - protein, 4 aa, Entamoeba invadens
PGCK

SEQ ID NO: 2892376 - protein, 28 aa, Entamoeba invadens
PGDCGAYNDNAARSDGHISGFNSQQQDL

SEQ ID NO: 2892377 - protein, 9 aa, Entamoeba invadens
PGDEEDTLE

SEQ ID NO: 2892378 - protein, 6 aa, Entamoeba invadens
PGDELP

SEQ ID NO: 2892379 - protein, 6 aa, Entamoeba invadens
PGDETV

SEQ ID NO: 2892380 - protein, 7 aa, Entamoeba invadens
PGDFANK

SEQ ID NO: 2892381 - protein, 9 aa, Entamoeba invadens
PGDLEGENI

SEQ ID NO: 2892382 - protein, 7 aa, Entamoeba invadens
PGDPVED

SEQ ID NO: 2892383 - protein, 8 aa, Entamoeba invadens
PGDQVQQQ

SEQ ID NO: 2892384 - protein, 11 aa, Entamoeba invadens
PGDTGRNDNEG

SEQ ID NO: 2892385 - protein, 6 aa, Entamoeba invadens
PGDVPK

SEQ ID NO: 2892386 - protein, 9 aa, Entamoeba invadens
PGDYEPDDK

SEQ ID NO: 2892387 - protein, 4 aa, Entamoeba invadens
PGEE

SEQ ID NO: 2892388 - protein, 6 aa, Entamoeba invadens
PGEETS

SEQ ID NO: 2892389 - protein, 4 aa, Entamoeba invadens
PGEF

SEQ ID NO: 2892390 - protein, 6 aa, Entamoeba invadens
PGEFPD

SEQ ID NO: 2892391 - protein, 5 aa, Entamoeba invadens
PGEIG

SEQ ID NO: 2892392 - protein, 4 aa, Entamoeba invadens
PGEK

SEQ ID NO: 2892393 - protein, 5 aa, Entamoeba invadens
PGEYE

SEQ ID NO: 2892394 - protein, 12 aa, Entamoeba invadens
PGEYQSKGEPKC

SEQ ID NO: 2892395 - protein, 6 aa, Entamoeba invadens
PGFGGQ

SEQ ID NO: 2892396 - protein, 7 aa, Entamoeba invadens
PGFNDGK

SEQ ID NO: 2892397 - protein, 12 aa, Entamoeba invadens
PGFRKDGPKLGS

SEQ ID NO: 2892398 - protein, 4 aa, Entamoeba invadens
PGFS

SEQ ID NO: 2892399 - protein, 4 aa, Entamoeba invadens
PGFT

SEQ ID NO: 2892400 - protein, 4 aa, Entamoeba invadens
PGGC

SEQ ID NO: 2892401 - protein, 4 aa, Entamoeba invadens
PGGE

SEQ ID NO: 2892402 - protein, 4 aa, Entamoeba invadens
PGGG

SEQ ID NO: 2892403 - protein, 4 aa, Entamoeba invadens
PGGL

SEQ ID NO: 2892404 - protein, 11 aa, Entamoeba invadens
PGGQTTSLDGR

SEQ ID NO: 2892405 - protein, 10 aa, Entamoeba invadens
PGHAKGNSYN

SEQ ID NO: 2892406 - protein, 6 aa, Entamoeba invadens
PGHESF

SEQ ID NO: 2892407 - protein, 17 aa, Entamoeba invadens
PGHGKSSCMKEGGPTYI

SEQ ID NO: 2892408 - protein, 7 aa, Entamoeba invadens
PGHTDLT

SEQ ID NO: 2892409 - protein, 4 aa, Entamoeba invadens
PGHV

SEQ ID NO: 2892410 - protein, 7 aa, Entamoeba invadens
PGIGKTT

SEQ ID NO: 2892411 - protein, 4 aa, Entamoeba invadens
PGIP

SEQ ID NO: 2892412 - protein, 4 aa, Entamoeba invadens
PGIR

SEQ ID NO: 2892413 - protein, 24 aa, Entamoeba invadens
PGKDPRVSRPSKKRKGNMPAPKPH

SEQ ID NO: 2892414 - protein, 7 aa, Entamoeba invadens
PGKGAKT

SEQ ID NO: 2892415 - protein, 5 aa, Entamoeba invadens
PGKIG

SEQ ID NO: 2892416 - protein, 21 aa, Entamoeba invadens
PGKLDASKSELEEPKPSKHYV

SEQ ID NO: 2892417 - protein, 8 aa, Entamoeba invadens
PGKPMTEK

SEQ ID NO: 2892418 - protein, 9 aa, Entamoeba invadens
PGKSAPNRA

SEQ ID NO: 2892419 - protein, 6 aa, Entamoeba invadens
PGKTPH

SEQ ID NO: 2892420 - protein, 38 aa, Entamoeba invadens
PGKVNTPQEKEKGTLNNESKEKTPRGVKTPRSVENGDV

SEQ ID NO: 2892421 - protein, 12 aa, Entamoeba invadens
PGKYPNDSNKVC

SEQ ID NO: 2892422 - protein, 21 aa, Entamoeba invadens
PGKYTIDTYDSQPIGDVSQTG

SEQ ID NO: 2892423 - protein, 4 aa, Entamoeba invadens
PGLA

SEQ ID NO: 2892424 - protein, 5 aa, Entamoeba invadens
PGLES

SEQ ID NO: 2892425 - protein, 8 aa, Entamoeba invadens
PGLESFPG

SEQ ID NO: 2892426 - protein, 7 aa, Entamoeba invadens
PGLGSEE

SEQ ID NO: 2892427 - protein, 13 aa, Entamoeba invadens
PGLHDDNHTSVGS

SEQ ID NO: 2892428 - protein, 13 aa, Entamoeba invadens
PGLHDDNQTSVGS

SEQ ID NO: 2892429 - protein, 8 aa, Entamoeba invadens
PGLKTASM

SEQ ID NO: 2892430 - protein, 7 aa, Entamoeba invadens
PGLNAET

SEQ ID NO: 2892431 - protein, 7 aa, Entamoeba invadens
PGLNNSR

SEQ ID NO: 2892432 - protein, 4 aa, Entamoeba invadens
PGLP

SEQ ID NO: 2892433 - protein, 11 aa, Entamoeba invadens
PGLPEQEPSYP

SEQ ID NO: 2892434 - protein, 7 aa, Entamoeba invadens
PGLPPNT

SEQ ID NO: 2892435 - protein, 7 aa, Entamoeba invadens
PGLPSRL

SEQ ID NO: 2892436 - protein, 4 aa, Entamoeba invadens
PGLS

SEQ ID NO: 2892437 - protein, 5 aa, Entamoeba invadens
PGMAP

SEQ ID NO: 2892438 - protein, 4 aa, Entamoeba invadens
PGMD

SEQ ID NO: 2892439 - protein, 10 aa, Entamoeba invadens
PGMSQYSRQV

SEQ ID NO: 2892440 - protein, 4 aa, Entamoeba invadens
PGND

SEQ ID NO: 2892441 - protein, 9 aa, Entamoeba invadens
PGNDQLEAT

SEQ ID NO: 2892442 - protein, 4 aa, Entamoeba invadens
PGNE

SEQ ID NO: 2892443 - protein, 11 aa, Entamoeba invadens
PGNELQGGHPT

SEQ ID NO: 2892444 - protein, 8 aa, Entamoeba invadens
PGNEQASK

SEQ ID NO: 2892445 - protein, 8 aa, Entamoeba invadens
PGNETEKV

SEQ ID NO: 2892446 - protein, 6 aa, Entamoeba invadens
PGNFGD

SEQ ID NO: 2892447 - protein, 9 aa, Entamoeba invadens
PGNGETSHR

SEQ ID NO: 2892448 - protein, 4 aa, Entamoeba invadens
PGNI

SEQ ID NO: 2892449 - protein, 5 aa, Entamoeba invadens
PGNNV

SEQ ID NO: 2892450 - protein, 7 aa, Entamoeba invadens
PGNPTGQ

SEQ ID NO: 2892451 - protein, 7 aa, Entamoeba invadens
PGNPVKV

SEQ ID NO: 2892452 - protein, 8 aa, Entamoeba invadens
PGNRPTNS

SEQ ID NO: 2892453 - protein, 7 aa, Entamoeba invadens
PGNSAET

SEQ ID NO: 2892454 - protein, 7 aa, Entamoeba invadens
PGNSEYD

SEQ ID NO: 2892455 - protein, 7 aa, Entamoeba invadens
PGNSEYN

SEQ ID NO: 2892456 - protein, 6 aa, Entamoeba invadens
PGNTQF

SEQ ID NO: 2892457 - protein, 12 aa, Entamoeba invadens
PGNWGTTSSDSD

SEQ ID NO: 2892458 - protein, 9 aa, Entamoeba invadens
PGPARFSPG

SEQ ID NO: 2892459 - protein, 14 aa, Entamoeba invadens
PGPDQTYGEIEGNW

SEQ ID NO: 2892460 - protein, 11 aa, Entamoeba invadens
PGPRDKKRGFI

SEQ ID NO: 2892461 - protein, 9 aa, Entamoeba invadens
PGPTEEDAE

SEQ ID NO: 2892462 - protein, 9 aa, Entamoeba invadens
PGPTPMQQE

SEQ ID NO: 2892463 - protein, 12 aa, Entamoeba invadens
PGPYANNISESS

SEQ ID NO: 2892464 - protein, 5 aa, Entamoeba invadens
PGQLD

SEQ ID NO: 2892465 - protein, 5 aa, Entamoeba invadens
PGQMT

SEQ ID NO: 2892466 - protein, 11 aa, Entamoeba invadens
PGQNDSEKELK

SEQ ID NO: 2892467 - protein, 6 aa, Entamoeba invadens
PGQPYC

SEQ ID NO: 2892468 - protein, 4 aa, Entamoeba invadens
PGQQ

SEQ ID NO: 2892469 - protein, 4 aa, Entamoeba invadens
PGQT

SEQ ID NO: 2892470 - protein, 8 aa, Entamoeba invadens
PGQTTEDQ

SEQ ID NO: 2892471 - protein, 7 aa, Entamoeba invadens
PGQYQEN

SEQ ID NO: 2892472 - protein, 9 aa, Entamoeba invadens
PGRAANTVK

SEQ ID NO: 2892473 - protein, 11 aa, Entamoeba invadens
PGRDGQRVVNK

SEQ ID NO: 2892474 - protein, 4 aa, Entamoeba invadens
PGRG

SEQ ID NO: 2892475 - protein, 4 aa, Entamoeba invadens
PGRI

SEQ ID NO: 2892476 - protein, 4 aa, Entamoeba invadens
PGRL

SEQ ID NO: 2892477 - protein, 12 aa, Entamoeba invadens
PGRPSEIRSNRE

SEQ ID NO: 2892478 - protein, 13 aa, Entamoeba invadens
PGRPSEIRSNRES

SEQ ID NO: 2892479 - protein, 7 aa, Entamoeba invadens
PGRSANH

SEQ ID NO: 2892480 - protein, 9 aa, Entamoeba invadens
PGRSPNSIK

SEQ ID NO: 2892481 - protein, 9 aa, Entamoeba invadens
PGRSRKQCR

SEQ ID NO: 2892482 - protein, 10 aa, Entamoeba invadens
PGRTARAIRN

SEQ ID NO: 2892483 - protein, 12 aa, Entamoeba invadens
PGSADNEKRTEM

SEQ ID NO: 2892484 - protein, 7 aa, Entamoeba invadens
PGSAFDA

SEQ ID NO: 2892485 - protein, 10 aa, Entamoeba invadens
PGSATGAYSP

SEQ ID NO: 2892486 - protein, 7 aa, Entamoeba invadens
PGSFRNS

SEQ ID NO: 2892487 - protein, 15 aa, Entamoeba invadens
PGSGDDVASLERTIT

SEQ ID NO: 2892488 - protein, 8 aa, Entamoeba invadens
PGSHTMDH

SEQ ID NO: 2892489 - protein, 5 aa, Entamoeba invadens
PGSIP

SEQ ID NO: 2892490 - protein, 10 aa, Entamoeba invadens
PGSLNLPQKV

SEQ ID NO: 2892491 - protein, 9 aa, Entamoeba invadens
PGSNPPTHQ

SEQ ID NO: 2892492 - protein, 5 aa, Entamoeba invadens
PGSPN

SEQ ID NO: 2892493 - protein, 15 aa, Entamoeba invadens
PGSRQDSYKSPAQSW

SEQ ID NO: 2892494 - protein, 8 aa, Entamoeba invadens
PGSSEYNQ

SEQ ID NO: 2892495 - protein, 12 aa, Entamoeba invadens
PGSSPSTQSFSP

SEQ ID NO: 2892496 - protein, 37 aa, Entamoeba invadens
PGSTTPEVNTKDKGKKDKDVKKKGKDAKEDVEPQIAP

SEQ ID NO: 2892497 - protein, 7 aa, Entamoeba invadens
PGTEEEV

SEQ ID NO: 2892498 - protein, 4 aa, Entamoeba invadens
PGTG

SEQ ID NO: 2892499 - protein, 6 aa, Entamoeba invadens
PGTGIE

SEQ ID NO: 2892500 - protein, 6 aa, Entamoeba invadens
PGTITE

SEQ ID NO: 2892501 - protein, 9 aa, Entamoeba invadens
PGTKSLDSK

SEQ ID NO: 2892502 - protein, 12 aa, Entamoeba invadens
PGTLPNYETTQQ

SEQ ID NO: 2892503 - protein, 6 aa, Entamoeba invadens
PGTLQN

SEQ ID NO: 2892504 - protein, 21 aa, Entamoeba invadens
PGTMSNKELPGQNEKGLPPKG

SEQ ID NO: 2892505 - protein, 6 aa, Entamoeba invadens
PGTNSC

SEQ ID NO: 2892506 - protein, 24 aa, Entamoeba invadens
PGTPAAQMKPVNSKVKKQRSREVT

SEQ ID NO: 2892507 - protein, 11 aa, Entamoeba invadens
PGTPSYQPTAR

SEQ ID NO: 2892508 - protein, 7 aa, Entamoeba invadens
PGTQEDI

SEQ ID NO: 2892509 - protein, 7 aa, Entamoeba invadens
PGTRERE

SEQ ID NO: 2892510 - protein, 8 aa, Entamoeba invadens
PGTREREA

SEQ ID NO: 2892511 - protein, 15 aa, Entamoeba invadens
PGTSEGIGSSANTNK

SEQ ID NO: 2892512 - protein, 6 aa, Entamoeba invadens
PGTSFG

SEQ ID NO: 2892513 - protein, 7 aa, Entamoeba invadens
PGTVTSI

SEQ ID NO: 2892514 - protein, 9 aa, Entamoeba invadens
PGTYKTNQS

SEQ ID NO: 2892515 - protein, 11 aa, Entamoeba invadens
PGVDKKSLSVK

SEQ ID NO: 2892516 - protein, 8 aa, Entamoeba invadens
PGVDKRKM

SEQ ID NO: 2892517 - protein, 9 aa, Entamoeba invadens
PGVDQGGVS

SEQ ID NO: 2892518 - protein, 5 aa, Entamoeba invadens
PGVDS

SEQ ID NO: 2892519 - protein, 7 aa, Entamoeba invadens
PGVEATE

SEQ ID NO: 2892520 - protein, 4 aa, Entamoeba invadens
PGVG

SEQ ID NO: 2892521 - protein, 7 aa, Entamoeba invadens
PGVGGDR

SEQ ID NO: 2892522 - protein, 5 aa, Entamoeba invadens
PGVGI

SEQ ID NO: 2892523 - protein, 14 aa, Entamoeba invadens
PGVLSGEKQRIGRS

SEQ ID NO: 2892524 - protein, 7 aa, Entamoeba invadens
PGVQRSY

SEQ ID NO: 2892525 - protein, 11 aa, Entamoeba invadens
PGVSKKAVKKI

SEQ ID NO: 2892526 - protein, 5 aa, Entamoeba invadens
PGVSR

SEQ ID NO: 2892527 - protein, 4 aa, Entamoeba invadens
PGVT

SEQ ID NO: 2892528 - protein, 4 aa, Entamoeba invadens
PGVV

SEQ ID NO: 2892529 - protein, 8 aa, Entamoeba invadens
PGWKDGTK

SEQ ID NO: 2892530 - protein, 17 aa, Entamoeba invadens
PGYAGGLDTKENGDGRY

SEQ ID NO: 2892531 - protein, 4 aa, Entamoeba invadens
PGYK

SEQ ID NO: 2892532 - protein, 5 aa, Entamoeba invadens
PGYPN

SEQ ID NO: 2892533 - protein, 11 aa, Entamoeba invadens
PGYQPYAQQQP

SEQ ID NO: 2892534 - protein, 10 aa, Entamoeba invadens
PGYSRRNKGA

SEQ ID NO: 2892535 - protein, 8 aa, Entamoeba invadens
PGYSTNSV

SEQ ID NO: 2892536 - protein, 8 aa, Entamoeba invadens
PGYTPFKE

SEQ ID NO: 2892537 - protein, 7 aa, Entamoeba invadens
PGYYDDN

SEQ ID NO: 2892538 - protein, 8 aa, Entamoeba invadens
PHAQTEAR

SEQ ID NO: 2892539 - protein, 5 aa, Entamoeba invadens
PHASD

SEQ ID NO: 2892540 - protein, 7 aa, Entamoeba invadens
PHATRES

SEQ ID NO: 2892541 - protein, 6 aa, Entamoeba invadens
PHCDSC

SEQ ID NO: 2892542 - protein, 24 aa, Entamoeba invadens
PHCEEESFSQDDCSSQQSEPIAQR

SEQ ID NO: 2892543 - protein, 4 aa, Entamoeba invadens
PHDE

SEQ ID NO: 2892544 - protein, 8 aa, Entamoeba invadens
PHDPKSFE

SEQ ID NO: 2892545 - protein, 9 aa, Entamoeba invadens
PHDTATPFY

SEQ ID NO: 2892546 - protein, 15 aa, Entamoeba invadens
PHDYSRETAAEKRKR

SEQ ID NO: 2892547 - protein, 7 aa, Entamoeba invadens
PHEDVAK

SEQ ID NO: 2892548 - protein, 4 aa, Entamoeba invadens
PHEE

SEQ ID NO: 2892549 - protein, 13 aa, Entamoeba invadens
PHEKVTQMCVLGQ

SEQ ID NO: 2892550 - protein, 14 aa, Entamoeba invadens
PHENGSKKSSKVQK

SEQ ID NO: 2892551 - protein, 6 aa, Entamoeba invadens
PHENPN

SEQ ID NO: 2892552 - protein, 4 aa, Entamoeba invadens
PHEP

SEQ ID NO: 2892553 - protein, 7 aa, Entamoeba invadens
PHESPLN

SEQ ID NO: 2892554 - protein, 8 aa, Entamoeba invadens
PHFSTNTD

SEQ ID NO: 2892555 - protein, 6 aa, Entamoeba invadens
PHGNPI

SEQ ID NO: 2892556 - protein, 4 aa, Entamoeba invadens
PHGQ

SEQ ID NO: 2892557 - protein, 8 aa, Entamoeba invadens
PHGSKNDI

SEQ ID NO: 2892558 - protein, 4 aa, Entamoeba invadens
PHGW

SEQ ID NO: 2892559 - protein, 15 aa, Entamoeba invadens
PHHATSTSDQKSMKS

SEQ ID NO: 2892560 - protein, 11 aa, Entamoeba invadens
PHIDSEPQQTF

SEQ ID NO: 2892561 - protein, 25 aa, Entamoeba invadens
PHKDPRIVTTNPRRIGAESVSERVS

SEQ ID NO: 2892562 - protein, 12 aa, Entamoeba invadens
PHKKESKKVPPK

SEQ ID NO: 2892563 - protein, 5 aa, Entamoeba invadens
PHKKQ

SEQ ID NO: 2892564 - protein, 9 aa, Entamoeba invadens
PHKNTENNP

SEQ ID NO: 2892565 - protein, 6 aa, Entamoeba invadens
PHKPED

SEQ ID NO: 2892566 - protein, 4 aa, Entamoeba invadens
PHKS

SEQ ID NO: 2892567 - protein, 9 aa, Entamoeba invadens
PHKTENPST

SEQ ID NO: 2892568 - protein, 10 aa, Entamoeba invadens
PHLGDTTKMA

SEQ ID NO: 2892569 - protein, 9 aa, Entamoeba invadens
PHNETTKNF

SEQ ID NO: 2892570 - protein, 14 aa, Entamoeba invadens
PHNEVQEGIRSNGM

SEQ ID NO: 2892571 - protein, 17 aa, Entamoeba invadens
PHNIPPTKFPVKDTNGD

SEQ ID NO: 2892572 - protein, 17 aa, Entamoeba invadens
PHNIQPTKFGRKKISTT

SEQ ID NO: 2892573 - protein, 5 aa, Entamoeba invadens
PHNKS

SEQ ID NO: 2892574 - protein, 7 aa, Entamoeba invadens
PHNQETR

SEQ ID NO: 2892575 - protein, 6 aa, Entamoeba invadens
PHNRTK

SEQ ID NO: 2892576 - protein, 8 aa, Entamoeba invadens
PHPENTPI

SEQ ID NO: 2892577 - protein, 14 aa, Entamoeba invadens
PHPKFDKKDGTPIF

SEQ ID NO: 2892578 - protein, 9 aa, Entamoeba invadens
PHPKGSSYA

SEQ ID NO: 2892579 - protein, 11 aa, Entamoeba invadens
PHPKRTVPKTG

SEQ ID NO: 2892580 - protein, 6 aa, Entamoeba invadens
PHPLQS

SEQ ID NO: 2892581 - protein, 6 aa, Entamoeba invadens
PHPSPI

SEQ ID NO: 2892582 - protein, 6 aa, Entamoeba invadens
PHPTQD

SEQ ID NO: 2892583 - protein, 6 aa, Entamoeba invadens
PHQDLP

SEQ ID NO: 2892584 - protein, 5 aa, Entamoeba invadens
PHQKA

SEQ ID NO: 2892585 - protein, 10 aa, Entamoeba invadens
PHQNQEAGMQ

SEQ ID NO: 2892586 - protein, 5 aa, Entamoeba invadens
PHQRT

SEQ ID NO: 2892587 - protein, 24 aa, Entamoeba invadens
PHQSPLSATRCQNVNTPNLQGTQK

SEQ ID NO: 2892588 - protein, 8 aa, Entamoeba invadens
PHQSPSNL

SEQ ID NO: 2892589 - protein, 5 aa, Entamoeba invadens
PHRID

SEQ ID NO: 2892590 - protein, 10 aa, Entamoeba invadens
PHRSSEHPSH

SEQ ID NO: 2892591 - protein, 13 aa, Entamoeba invadens
PHRVSDKSLYQKR

SEQ ID NO: 2892592 - protein, 5 aa, Entamoeba invadens
PHSAF

SEQ ID NO: 2892593 - protein, 6 aa, Entamoeba invadens
PHSEAC

SEQ ID NO: 2892594 - protein, 12 aa, Entamoeba invadens
PHSPPGNRDYLN

SEQ ID NO: 2892595 - protein, 6 aa, Entamoeba invadens
PHTDQN

SEQ ID NO: 2892596 - protein, 4 aa, Entamoeba invadens
PHTE

SEQ ID NO: 2892597 - protein, 12 aa, Entamoeba invadens
PHTEKSSYDEVT

SEQ ID NO: 2892598 - protein, 7 aa, Entamoeba invadens
PHTKKPI

SEQ ID NO: 2892599 - protein, 6 aa, Entamoeba invadens
PHTNGN

SEQ ID NO: 2892600 - protein, 8 aa, Entamoeba invadens
PHTQPTTF

SEQ ID NO: 2892601 - protein, 7 aa, Entamoeba invadens
PHYETNG

SEQ ID NO: 2892602 - protein, 4 aa, Entamoeba invadens
PHYP

SEQ ID NO: 2892603 - protein, 9 aa, Entamoeba invadens
PIADTKQRY

SEQ ID NO: 2892604 - protein, 13 aa, Entamoeba invadens
PIAGQTMGTSGLR

SEQ ID NO: 2892605 - protein, 13 aa, Entamoeba invadens
PIAKSRAKTISRN

SEQ ID NO: 2892606 - protein, 10 aa, Entamoeba invadens
PIASPNSVPF

SEQ ID NO: 2892607 - protein, 14 aa, Entamoeba invadens
PIDDDNRDKATNEV

SEQ ID NO: 2892608 - protein, 5 aa, Entamoeba invadens
PIDDK

SEQ ID NO: 2892609 - protein, 15 aa, Entamoeba invadens
PIDDSSDHGAKLQER

SEQ ID NO: 2892610 - protein, 4 aa, Entamoeba invadens
PIDE

SEQ ID NO: 2892611 - protein, 17 aa, Entamoeba invadens
PIDEPTEDELDSESAEN

SEQ ID NO: 2892612 - protein, 10 aa, Entamoeba invadens
PIDETNASYQ

SEQ ID NO: 2892613 - protein, 15 aa, Entamoeba invadens
PIDFEKKEQPKEQFA

SEQ ID NO: 2892614 - protein, 13 aa, Entamoeba invadens
PIDPAKSRYTLSS

SEQ ID NO: 2892615 - protein, 16 aa, Entamoeba invadens
PIDPPPASHLVLHFLG

SEQ ID NO: 2892616 - protein, 7 aa, Entamoeba invadens
PIDQNSP

SEQ ID NO: 2892617 - protein, 8 aa, Entamoeba invadens
PIDSGKTS

SEQ ID NO: 2892618 - protein, 7 aa, Entamoeba invadens
PIDSRKS

SEQ ID NO: 2892619 - protein, 12 aa, Entamoeba invadens
PIDSYSSSNATI

SEQ ID NO: 2892620 - protein, 5 aa, Entamoeba invadens
PIDTE

SEQ ID NO: 2892621 - protein, 14 aa, Entamoeba invadens
PIDTRQNEVNGAMK

SEQ ID NO: 2892622 - protein, 4 aa, Entamoeba invadens
PIED

SEQ ID NO: 2892623 - protein, 8 aa, Entamoeba invadens
PIEDEKKM

SEQ ID NO: 2892624 - protein, 4 aa, Entamoeba invadens
PIEE

SEQ ID NO: 2892625 - protein, 9 aa, Entamoeba invadens
PIEKNGGCN

SEQ ID NO: 2892626 - protein, 5 aa, Entamoeba invadens
PIEKV

SEQ ID NO: 2892627 - protein, 46 aa, Entamoeba invadens
PIENNKEDKESDDESSSSSESSEDSDDIPVKPAKIEKVEKTDNMES

SEQ ID NO: 2892628 - protein, 10 aa, Entamoeba invadens
PIENVKTQEK

SEQ ID NO: 2892629 - protein, 8 aa, Entamoeba invadens
PIEPPSRM

SEQ ID NO: 2892630 - protein, 8 aa, Entamoeba invadens
PIEPSEHV

SEQ ID NO: 2892631 - protein, 6 aa, Entamoeba invadens
PIEQKD

SEQ ID NO: 2892632 - protein, 4 aa, Entamoeba invadens
PIER

SEQ ID NO: 2892633 - protein, 4 aa, Entamoeba invadens
PIES

SEQ ID NO: 2892634 - protein, 15 aa, Entamoeba invadens
PIETPQEQEKKLEPV

SEQ ID NO: 2892635 - protein, 14 aa, Entamoeba invadens
PIETPSNKTSQEVL

SEQ ID NO: 2892636 - protein, 5 aa, Entamoeba invadens
PIETT

SEQ ID NO: 2892637 - protein, 5 aa, Entamoeba invadens
PIEYP

SEQ ID NO: 2892638 - protein, 6 aa, Entamoeba invadens
PIFSEP

SEQ ID NO: 2892639 - protein, 15 aa, Entamoeba invadens
PIGDKSEWKHPPLTT

SEQ ID NO: 2892640 - protein, 10 aa, Entamoeba invadens
PIGDPKDVPT

SEQ ID NO: 2892641 - protein, 5 aa, Entamoeba invadens
PIGDV

SEQ ID NO: 2892642 - protein, 4 aa, Entamoeba invadens
PIGE

SEQ ID NO: 2892643 - protein, 8 aa, Entamoeba invadens
PIGEPGKC

SEQ ID NO: 2892644 - protein, 6 aa, Entamoeba invadens
PIGEST

SEQ ID NO: 2892645 - protein, 13 aa, Entamoeba invadens
PIGGMSKDGVKSC

SEQ ID NO: 2892646 - protein, 5 aa, Entamoeba invadens
PIGKN

SEQ ID NO: 2892647 - protein, 8 aa, Entamoeba invadens
PIGNGGED

SEQ ID NO: 2892648 - protein, 9 aa, Entamoeba invadens
PIGPSGSAY

SEQ ID NO: 2892649 - protein, 5 aa, Entamoeba invadens
PIGRK

SEQ ID NO: 2892650 - protein, 7 aa, Entamoeba invadens
PIGTRDS

SEQ ID NO: 2892651 - protein, 4 aa, Entamoeba invadens
PIHP

SEQ ID NO: 2892652 - protein, 12 aa, Entamoeba invadens
PIHQEKNPSSLK

SEQ ID NO: 2892653 - protein, 25 aa, Entamoeba invadens
PIIERKDEKKPRHRRAKAINDGNGL

SEQ ID NO: 2892654 - protein, 5 aa, Entamoeba invadens
PIIGN

SEQ ID NO: 2892655 - protein, 12 aa, Entamoeba invadens
PIIKDDSEELDQ

SEQ ID NO: 2892656 - protein, 6 aa, Entamoeba invadens
PIIQPN

SEQ ID NO: 2892657 - protein, 59 aa, Entamoeba invadens
PIKDDYNTYRTKINATEKEFDKLKESATIAPQSAKNEVKKEENVVQKTPAEIEDENRLE

SEQ ID NO: 2892658 - protein, 8 aa, Entamoeba invadens
PIKDKKKY

SEQ ID NO: 2892659 - protein, 8 aa, Entamoeba invadens
PIKERDNN

SEQ ID NO: 2892660 - protein, 10 aa, Entamoeba invadens
PIKESEEYLK

SEQ ID NO: 2892661 - protein, 9 aa, Entamoeba invadens
PIKGGNQTL

SEQ ID NO: 2892662 - protein, 10 aa, Entamoeba invadens
PIKGSCKSSC

SEQ ID NO: 2892663 - protein, 7 aa, Entamoeba invadens
PIKGSKG

SEQ ID NO: 2892664 - protein, 9 aa, Entamoeba invadens
PIKGYEEGD

SEQ ID NO: 2892665 - protein, 132 aa, Entamoeba invadens
PIKKGTKLAEPPKPETTTEEPKKEEPKVVEPKKEEKKPEPKKEEKKVEPKKEEPKPEAKKVETKKEEPKKVEPKKEELKKEEPKKEEPKNEKKVEEEKKEEAPADGKKGPVTKTGDLDNCGKCGKPVAGGYK

SEQ ID NO: 2892666 - protein, 12 aa, Entamoeba invadens
PIKKKSEKGKCI

SEQ ID NO: 2892667 - protein, 9 aa, Entamoeba invadens
PIKNQTTKR

SEQ ID NO: 2892668 - protein, 4 aa, Entamoeba invadens
PIKQ

SEQ ID NO: 2892669 - protein, 21 aa, Entamoeba invadens
PIKQESPFKAVQEDTKMSNGE

SEQ ID NO: 2892670 - protein, 21 aa, Entamoeba invadens
PIKQKEEKTKSKKKEKQKSIK

SEQ ID NO: 2892671 - protein, 21 aa, Entamoeba invadens
PIKREPQNDPGLIPKDKRLSP

SEQ ID NO: 2892672 - protein, 27 aa, Entamoeba invadens
PIKRKPESIAPPLEKKRGNESLDTNAI

SEQ ID NO: 2892673 - protein, 13 aa, Entamoeba invadens
PIKSPRKPQRKER

SEQ ID NO: 2892674 - protein, 75 aa, Entamoeba invadens
PIKTERRVRKETNKKRKRYGRNKATRKNMRNKNNKKVRGKREKTKKRKMSRQQNKKKGRKIKGKSATKRKQHKKL

SEQ ID NO: 2892675 - protein, 12 aa, Entamoeba invadens
PIKTQEQTAPTI

SEQ ID NO: 2892676 - protein, 9 aa, Entamoeba invadens
PILSNSNRT

SEQ ID NO: 2892677 - protein, 4 aa, Entamoeba invadens
PIMT

SEQ ID NO: 2892678 - protein, 4 aa, Entamoeba invadens
PINA

SEQ ID NO: 2892679 - protein, 5 aa, Entamoeba invadens
PINAV

SEQ ID NO: 2892680 - protein, 4 aa, Entamoeba invadens
PINE

SEQ ID NO: 2892681 - protein, 17 aa, Entamoeba invadens
PINNSLRQPQVRRTSVY

SEQ ID NO: 2892682 - protein, 6 aa, Entamoeba invadens
PINPLK

SEQ ID NO: 2892683 - protein, 6 aa, Entamoeba invadens
PINPTI

SEQ ID NO: 2892684 - protein, 4 aa, Entamoeba invadens
PINR

SEQ ID NO: 2892685 - protein, 5 aa, Entamoeba invadens
PINSG

SEQ ID NO: 2892686 - protein, 6 aa, Entamoeba invadens
PINSGS

SEQ ID NO: 2892687 - protein, 18 aa, Entamoeba invadens
PIPEEEGAATEKSATNGN

SEQ ID NO: 2892688 - protein, 9 aa, Entamoeba invadens
PIPEGDQDS

SEQ ID NO: 2892689 - protein, 11 aa, Entamoeba invadens
PIPENSTGQFV

SEQ ID NO: 2892690 - protein, 11 aa, Entamoeba invadens
PIPESGNERRI

SEQ ID NO: 2892691 - protein, 5 aa, Entamoeba invadens
PIPFK

SEQ ID NO: 2892692 - protein, 4 aa, Entamoeba invadens
PIPI

SEQ ID NO: 2892693 - protein, 5 aa, Entamoeba invadens
PIPIN

SEQ ID NO: 2892694 - protein, 10 aa, Entamoeba invadens
PIPKDDPTVL

SEQ ID NO: 2892695 - protein, 9 aa, Entamoeba invadens
PIPKEDSTV

SEQ ID NO: 2892696 - protein, 12 aa, Entamoeba invadens
PIPKQPSAGPAF

SEQ ID NO: 2892697 - protein, 12 aa, Entamoeba invadens
PIPKSKSADTNV

SEQ ID NO: 2892698 - protein, 22 aa, Entamoeba invadens
PIPPIPQRSSSKELHSDKEEPN

SEQ ID NO: 2892699 - protein, 6 aa, Entamoeba invadens
PIPPQD

SEQ ID NO: 2892700 - protein, 7 aa, Entamoeba invadens
PIPPQET

SEQ ID NO: 2892701 - protein, 9 aa, Entamoeba invadens
PIPPSEPNH

SEQ ID NO: 2892702 - protein, 4 aa, Entamoeba invadens
PIPQ

SEQ ID NO: 2892703 - protein, 6 aa, Entamoeba invadens
PIPQQE

SEQ ID NO: 2892704 - protein, 53 aa, Entamoeba invadens
PIPQQQQEQQRGQPRPDYAPPPQYSDRRDYQQIDQRKQKDKKEQFRGAQQDGF

SEQ ID NO: 2892705 - protein, 22 aa, Entamoeba invadens
PIPRVQKQKKVNESPTLEKGND

SEQ ID NO: 2892706 - protein, 29 aa, Entamoeba invadens
PIPSAGTMQPQKATADEDEDLLARMSALR

SEQ ID NO: 2892707 - protein, 8 aa, Entamoeba invadens
PIPSNSKT

SEQ ID NO: 2892708 - protein, 10 aa, Entamoeba invadens
PIPTGNETGK

SEQ ID NO: 2892709 - protein, 13 aa, Entamoeba invadens
PIPTPLKGSSANN

SEQ ID NO: 2892710 - protein, 14 aa, Entamoeba invadens
PIPTSQKQDEWVKD

SEQ ID NO: 2892711 - protein, 5 aa, Entamoeba invadens
PIPTT

SEQ ID NO: 2892712 - protein, 6 aa, Entamoeba invadens
PIPTTL

SEQ ID NO: 2892713 - protein, 5 aa, Entamoeba invadens
PIPVT

SEQ ID NO: 2892714 - protein, 4 aa, Entamoeba invadens
PIQG

SEQ ID NO: 2892715 - protein, 5 aa, Entamoeba invadens
PIQKN

SEQ ID NO: 2892716 - protein, 7 aa, Entamoeba invadens
PIQNGQV

SEQ ID NO: 2892717 - protein, 9 aa, Entamoeba invadens
PIQPDKNYT

SEQ ID NO: 2892718 - protein, 16 aa, Entamoeba invadens
PIQPEVPEDKNQSGLK

SEQ ID NO: 2892719 - protein, 29 aa, Entamoeba invadens
PIQPNELQKEVKKSENIEKKETKKSGSIT

SEQ ID NO: 2892720 - protein, 6 aa, Entamoeba invadens
PIQQEN

SEQ ID NO: 2892721 - protein, 47 aa, Entamoeba invadens
PIQQQPTPQQKPPQPPQPQHHTNEDVDGDALSDDDDDDELSEEPEDH

SEQ ID NO: 2892722 - protein, 14 aa, Entamoeba invadens
PIQRPPMERDPRIP

SEQ ID NO: 2892723 - protein, 11 aa, Entamoeba invadens
PIQTPDQQTEM

SEQ ID NO: 2892724 - protein, 8 aa, Entamoeba invadens
PIQTTQEK

SEQ ID NO: 2892725 - protein, 4 aa, Entamoeba invadens
PIQV

SEQ ID NO: 2892726 - protein, 10 aa, Entamoeba invadens
PIRDEKRTFK

SEQ ID NO: 2892727 - protein, 4 aa, Entamoeba invadens
PIRP

SEQ ID NO: 2892728 - protein, 4 aa, Entamoeba invadens
PIRS

SEQ ID NO: 2892729 - protein, 4 aa, Entamoeba invadens
PISA

SEQ ID NO: 2892730 - protein, 32 aa, Entamoeba invadens
PISDDKDTSAPSIATASTSMVTKPKSKKQRSC

SEQ ID NO: 2892731 - protein, 7 aa, Entamoeba invadens
PISEDPH

SEQ ID NO: 2892732 - protein, 24 aa, Entamoeba invadens
PISEDSVETVSITESNSVNTKFKC

SEQ ID NO: 2892733 - protein, 9 aa, Entamoeba invadens
PISGDCKQE

SEQ ID NO: 2892734 - protein, 5 aa, Entamoeba invadens
PISGE

SEQ ID NO: 2892735 - protein, 8 aa, Entamoeba invadens
PISHGNVS

SEQ ID NO: 2892736 - protein, 15 aa, Entamoeba invadens
PISIEGNTQITEIEN

SEQ ID NO: 2892737 - protein, 6 aa, Entamoeba invadens
PISKKG

SEQ ID NO: 2892738 - protein, 7 aa, Entamoeba invadens
PISNDIG

SEQ ID NO: 2892739 - protein, 10 aa, Entamoeba invadens
PISPEKTIKK

SEQ ID NO: 2892740 - protein, 25 aa, Entamoeba invadens
PISPGSDSSKTPNASSTSSTPSLPT

SEQ ID NO: 2892741 - protein, 10 aa, Entamoeba invadens
PISPQDKITP

SEQ ID NO: 2892742 - protein, 8 aa, Entamoeba invadens
PISPQPNL

SEQ ID NO: 2892743 - protein, 20 aa, Entamoeba invadens
PISQAAAQQRAGRAGRTRPG

SEQ ID NO: 2892744 - protein, 6 aa, Entamoeba invadens
PISQPR

SEQ ID NO: 2892745 - protein, 7 aa, Entamoeba invadens
PISTNAK

SEQ ID NO: 2892746 - protein, 6 aa, Entamoeba invadens
PISTNC

SEQ ID NO: 2892747 - protein, 7 aa, Entamoeba invadens
PISTSLS

SEQ ID NO: 2892748 - protein, 5 aa, Entamoeba invadens
PISTT

SEQ ID NO: 2892749 - protein, 7 aa, Entamoeba invadens
PITDSSK

SEQ ID NO: 2892750 - protein, 13 aa, Entamoeba invadens
PITENPEKYRAEQ

SEQ ID NO: 2892751 - protein, 4 aa, Entamoeba invadens
PITG

SEQ ID NO: 2892752 - protein, 4 aa, Entamoeba invadens
PITL

SEQ ID NO: 2892753 - protein, 6 aa, Entamoeba invadens
PITNES

SEQ ID NO: 2892754 - protein, 4 aa, Entamoeba invadens
PITP

SEQ ID NO: 2892755 - protein, 13 aa, Entamoeba invadens
PITPEARTTGPNE

SEQ ID NO: 2892756 - protein, 13 aa, Entamoeba invadens
PITPKKDSRDNYY

SEQ ID NO: 2892757 - protein, 11 aa, Entamoeba invadens
PITPRKSEAMK

SEQ ID NO: 2892758 - protein, 7 aa, Entamoeba invadens
PITPRVS

SEQ ID NO: 2892759 - protein, 13 aa, Entamoeba invadens
PITQPTELDVEKD

SEQ ID NO: 2892760 - protein, 17 aa, Entamoeba invadens
PITSENEVKKNSIPYSK

SEQ ID NO: 2892761 - protein, 5 aa, Entamoeba invadens
PITSS

SEQ ID NO: 2892762 - protein, 10 aa, Entamoeba invadens
PITTDEPIKG

SEQ ID NO: 2892763 - protein, 28 aa, Entamoeba invadens
PITTDKERFDKSRSLEKPSSKEIERTEN

SEQ ID NO: 2892764 - protein, 7 aa, Entamoeba invadens
PITTPAQ

SEQ ID NO: 2892765 - protein, 5 aa, Entamoeba invadens
PITVN

SEQ ID NO: 2892766 - protein, 15 aa, Entamoeba invadens
PIYDPNDYSAARQFG

SEQ ID NO: 2892767 - protein, 4 aa, Entamoeba invadens
PKAE

SEQ ID NO: 2892768 - protein, 9 aa, Entamoeba invadens
PKAELPDDS

SEQ ID NO: 2892769 - protein, 11 aa, Entamoeba invadens
PKAELSQRQTT

SEQ ID NO: 2892770 - protein, 10 aa, Entamoeba invadens
PKAERSIGTS

SEQ ID NO: 2892771 - protein, 9 aa, Entamoeba invadens
PKAKELKQE

SEQ ID NO: 2892772 - protein, 17 aa, Entamoeba invadens
PKAKKGTKAVNNEHPKH

SEQ ID NO: 2892773 - protein, 8 aa, Entamoeba invadens
PKAKSNHE

SEQ ID NO: 2892774 - protein, 7 aa, Entamoeba invadens
PKANTFT

SEQ ID NO: 2892775 - protein, 8 aa, Entamoeba invadens
PKAPKELQ

SEQ ID NO: 2892776 - protein, 10 aa, Entamoeba invadens
PKAPRNSNGA

SEQ ID NO: 2892777 - protein, 17 aa, Entamoeba invadens
PKAQQEQQTVQTPQNVQ

SEQ ID NO: 2892778 - protein, 6 aa, Entamoeba invadens
PKASDD

SEQ ID NO: 2892779 - protein, 9 aa, Entamoeba invadens
PKASFSTYA

SEQ ID NO: 2892780 - protein, 12 aa, Entamoeba invadens
PKASISATINRE

SEQ ID NO: 2892781 - protein, 5 aa, Entamoeba invadens
PKATN

SEQ ID NO: 2892782 - protein, 18 aa, Entamoeba invadens
PKAYPSLKCSSAYLLQLN

SEQ ID NO: 2892783 - protein, 12 aa, Entamoeba invadens
PKCPKCGASGVK

SEQ ID NO: 2892784 - protein, 8 aa, Entamoeba invadens
PKCSEGYE

SEQ ID NO: 2892785 - protein, 5 aa, Entamoeba invadens
PKDAN

SEQ ID NO: 2892786 - protein, 9 aa, Entamoeba invadens
PKDANGSVL

SEQ ID NO: 2892787 - protein, 32 aa, Entamoeba invadens
PKDARSCEDIKNTRSEHATPELDNSPKFSSSF

SEQ ID NO: 2892788 - protein, 8 aa, Entamoeba invadens
PKDCGDNN

SEQ ID NO: 2892789 - protein, 4 aa, Entamoeba invadens
PKDD

SEQ ID NO: 2892790 - protein, 5 aa, Entamoeba invadens
PKDDN

SEQ ID NO: 2892791 - protein, 4 aa, Entamoeba invadens
PKDE

SEQ ID NO: 2892792 - protein, 19 aa, Entamoeba invadens
PKDEGKLSIRKSGSPKLGL

SEQ ID NO: 2892793 - protein, 6 aa, Entamoeba invadens
PKDEIP

SEQ ID NO: 2892794 - protein, 7 aa, Entamoeba invadens
PKDEISR

SEQ ID NO: 2892795 - protein, 5 aa, Entamoeba invadens
PKDEK

SEQ ID NO: 2892796 - protein, 8 aa, Entamoeba invadens
PKDEKKSF

SEQ ID NO: 2892797 - protein, 8 aa, Entamoeba invadens
PKDEQESR

SEQ ID NO: 2892798 - protein, 7 aa, Entamoeba invadens
PKDETFA

SEQ ID NO: 2892799 - protein, 7 aa, Entamoeba invadens
PKDFSNR

SEQ ID NO: 2892800 - protein, 10 aa, Entamoeba invadens
PKDGDSKAEE

SEQ ID NO: 2892801 - protein, 6 aa, Entamoeba invadens
PKDITQ

SEQ ID NO: 2892802 - protein, 20 aa, Entamoeba invadens
PKDKKVDQEIKQATKPTLRV

SEQ ID NO: 2892803 - protein, 7 aa, Entamoeba invadens
PKDKMQT

SEQ ID NO: 2892804 - protein, 9 aa, Entamoeba invadens
PKDLPSPRY

SEQ ID NO: 2892805 - protein, 10 aa, Entamoeba invadens
PKDLSQNDKR

SEQ ID NO: 2892806 - protein, 6 aa, Entamoeba invadens
PKDNNC

SEQ ID NO: 2892807 - protein, 7 aa, Entamoeba invadens
PKDNNPN

SEQ ID NO: 2892808 - protein, 8 aa, Entamoeba invadens
PKDNPKEQ

SEQ ID NO: 2892809 - protein, 9 aa, Entamoeba invadens
PKDPTDNPR

SEQ ID NO: 2892810 - protein, 13 aa, Entamoeba invadens
PKDQKEKEKADAM

SEQ ID NO: 2892811 - protein, 7 aa, Entamoeba invadens
PKDQQKR

SEQ ID NO: 2892812 - protein, 8 aa, Entamoeba invadens
PKDQQKVE

SEQ ID NO: 2892813 - protein, 10 aa, Entamoeba invadens
PKDRMTPDQA

SEQ ID NO: 2892814 - protein, 19 aa, Entamoeba invadens
PKDRSDRREERRDDSYRTF

SEQ ID NO: 2892815 - protein, 4 aa, Entamoeba invadens
PKDS

SEQ ID NO: 2892816 - protein, 11 aa, Entamoeba invadens
PKDSDEAKTPV

SEQ ID NO: 2892817 - protein, 9 aa, Entamoeba invadens
PKDTTDETL

SEQ ID NO: 2892818 - protein, 8 aa, Entamoeba invadens
PKDTTTDE

SEQ ID NO: 2892819 - protein, 7 aa, Entamoeba invadens
PKDVSVS

SEQ ID NO: 2892820 - protein, 4 aa, Entamoeba invadens
PKDY

SEQ ID NO: 2892821 - protein, 8 aa, Entamoeba invadens
PKEAPRPT

SEQ ID NO: 2892822 - protein, 13 aa, Entamoeba invadens
PKEEGDDETTKTT

SEQ ID NO: 2892823 - protein, 7 aa, Entamoeba invadens
PKEEKSK

SEQ ID NO: 2892824 - protein, 48 aa, Entamoeba invadens
PKEEPIKEQEPQACEGETQKDDNKENETEKKPEKKKRDSSKPKERTQC

SEQ ID NO: 2892825 - protein, 5 aa, Entamoeba invadens
PKEEQ

SEQ ID NO: 2892826 - protein, 6 aa, Entamoeba invadens
PKEETF

SEQ ID NO: 2892827 - protein, 11 aa, Entamoeba invadens
PKEETKEFKDG

SEQ ID NO: 2892828 - protein, 4 aa, Entamoeba invadens
PKEF

SEQ ID NO: 2892829 - protein, 8 aa, Entamoeba invadens
PKEHKNGI

SEQ ID NO: 2892830 - protein, 7 aa, Entamoeba invadens
PKEIEGK

SEQ ID NO: 2892831 - protein, 12 aa, Entamoeba invadens
PKEIKKSKELEE

SEQ ID NO: 2892832 - protein, 8 aa, Entamoeba invadens
PKEITKNN

SEQ ID NO: 2892833 - protein, 4 aa, Entamoeba invadens
PKEK

SEQ ID NO: 2892834 - protein, 21 aa, Entamoeba invadens
PKEKAQLADTAKKSFVRGEGD

SEQ ID NO: 2892835 - protein, 7 aa, Entamoeba invadens
PKEKEFV

SEQ ID NO: 2892836 - protein, 8 aa, Entamoeba invadens
PKEKIEEF

SEQ ID NO: 2892837 - protein, 9 aa, Entamoeba invadens
PKEKKAALR

SEQ ID NO: 2892838 - protein, 17 aa, Entamoeba invadens
PKEKKEDKKSKRRHFKK

SEQ ID NO: 2892839 - protein, 8 aa, Entamoeba invadens
PKEKQYEM

SEQ ID NO: 2892840 - protein, 36 aa, Entamoeba invadens
PKEKVEAPVTPPAPVKSVEADEPKEKCKPEEPHTEK

SEQ ID NO: 2892841 - protein, 5 aa, Entamoeba invadens
PKEKY

SEQ ID NO: 2892842 - protein, 5 aa, Entamoeba invadens
PKEMA

SEQ ID NO: 2892843 - protein, 7 aa, Entamoeba invadens
PKENGAA

SEQ ID NO: 2892844 - protein, 10 aa, Entamoeba invadens
PKEPINKKQQ

SEQ ID NO: 2892845 - protein, 10 aa, Entamoeba invadens
PKEQDKRAEE

SEQ ID NO: 2892846 - protein, 21 aa, Entamoeba invadens
PKEREEEADAAREKFYQPDSD

SEQ ID NO: 2892847 - protein, 7 aa, Entamoeba invadens
PKERGEE

SEQ ID NO: 2892848 - protein, 10 aa, Entamoeba invadens
PKERKEDIKM

SEQ ID NO: 2892849 - protein, 10 aa, Entamoeba invadens
PKERLTPDQA

SEQ ID NO: 2892850 - protein, 6 aa, Entamoeba invadens
PKESEE

SEQ ID NO: 2892851 - protein, 12 aa, Entamoeba invadens
PKESERKNRDSK

SEQ ID NO: 2892852 - protein, 26 aa, Entamoeba invadens
PKESKETKQSELKITKEKETLNKCSI

SEQ ID NO: 2892853 - protein, 8 aa, Entamoeba invadens
PKESNANK

SEQ ID NO: 2892854 - protein, 8 aa, Entamoeba invadens
PKESQKHI

SEQ ID NO: 2892855 - protein, 13 aa, Entamoeba invadens
PKESSMKYASDNE

SEQ ID NO: 2892856 - protein, 9 aa, Entamoeba invadens
PKETETDRT

SEQ ID NO: 2892857 - protein, 7 aa, Entamoeba invadens
PKETFAD

SEQ ID NO: 2892858 - protein, 6 aa, Entamoeba invadens
PKETIT

SEQ ID NO: 2892859 - protein, 7 aa, Entamoeba invadens
PKETPKT

SEQ ID NO: 2892860 - protein, 6 aa, Entamoeba invadens
PKETPL

SEQ ID NO: 2892861 - protein, 7 aa, Entamoeba invadens
PKETQTH

SEQ ID NO: 2892862 - protein, 9 aa, Entamoeba invadens
PKETSTLKP

SEQ ID NO: 2892863 - protein, 22 aa, Entamoeba invadens
PKEVKALTPEEEEKKKRREELK

SEQ ID NO: 2892864 - protein, 40 aa, Entamoeba invadens
PKEWGDQQKIDSTGDEEEVLEESEEEKEVENKCEEEVKTQ

SEQ ID NO: 2892865 - protein, 13 aa, Entamoeba invadens
PKEYDGKLERTKN

SEQ ID NO: 2892866 - protein, 7 aa, Entamoeba invadens
PKEYSYN

SEQ ID NO: 2892867 - protein, 9 aa, Entamoeba invadens
PKEYSYNDL

SEQ ID NO: 2892868 - protein, 6 aa, Entamoeba invadens
PKFDTS

SEQ ID NO: 2892869 - protein, 7 aa, Entamoeba invadens
PKFPRTH

SEQ ID NO: 2892870 - protein, 4 aa, Entamoeba invadens
PKFS

SEQ ID NO: 2892871 - protein, 23 aa, Entamoeba invadens
PKFSESSSDNLQPSRTSELAVDV

SEQ ID NO: 2892872 - protein, 10 aa, Entamoeba invadens
PKFSPTSNPL

SEQ ID NO: 2892873 - protein, 23 aa, Entamoeba invadens
PKGAGQTKNLGEGLRAKEEQIST

SEQ ID NO: 2892874 - protein, 5 aa, Entamoeba invadens
PKGDE

SEQ ID NO: 2892875 - protein, 4 aa, Entamoeba invadens
PKGE

SEQ ID NO: 2892876 - protein, 16 aa, Entamoeba invadens
PKGEEDVLPNGITRDV

SEQ ID NO: 2892877 - protein, 8 aa, Entamoeba invadens
PKGEIIEN

SEQ ID NO: 2892878 - protein, 9 aa, Entamoeba invadens
PKGETPLSE

SEQ ID NO: 2892879 - protein, 9 aa, Entamoeba invadens
PKGKDEKQL

SEQ ID NO: 2892880 - protein, 11 aa, Entamoeba invadens
PKGKDKAEYRL

SEQ ID NO: 2892881 - protein, 25 aa, Entamoeba invadens
PKGKNKKKENTESEKKEDKGEEKSK

SEQ ID NO: 2892882 - protein, 13 aa, Entamoeba invadens
PKGKSKDELDEAF

SEQ ID NO: 2892883 - protein, 7 aa, Entamoeba invadens
PKGRNAK

SEQ ID NO: 2892884 - protein, 25 aa, Entamoeba invadens
PKGSLSPRMSRSRTPRSSRLLPLNT

SEQ ID NO: 2892885 - protein, 7 aa, Entamoeba invadens
PKGTPLP

SEQ ID NO: 2892886 - protein, 17 aa, Entamoeba invadens
PKGTYTSGTNCKKCTTT

SEQ ID NO: 2892887 - protein, 4 aa, Entamoeba invadens
PKGV

SEQ ID NO: 2892888 - protein, 9 aa, Entamoeba invadens
PKGVQTGEE

SEQ ID NO: 2892889 - protein, 20 aa, Entamoeba invadens
PKHEEQKEEEPQTKEQLANA

SEQ ID NO: 2892890 - protein, 6 aa, Entamoeba invadens
PKHNQN

SEQ ID NO: 2892891 - protein, 5 aa, Entamoeba invadens
PKHPE

SEQ ID NO: 2892892 - protein, 11 aa, Entamoeba invadens
PKHPESPKNSK

SEQ ID NO: 2892893 - protein, 6 aa, Entamoeba invadens
PKHSVP

SEQ ID NO: 2892894 - protein, 5 aa, Entamoeba invadens
PKHVD

SEQ ID NO: 2892895 - protein, 9 aa, Entamoeba invadens
PKIAPQAIP

SEQ ID NO: 2892896 - protein, 30 aa, Entamoeba invadens
PKIDAGTFESEHKSDNVEISQQPAQQQKRC

SEQ ID NO: 2892897 - protein, 5 aa, Entamoeba invadens
PKIDD

SEQ ID NO: 2892898 - protein, 12 aa, Entamoeba invadens
PKIDKTSWKPHE

SEQ ID NO: 2892899 - protein, 16 aa, Entamoeba invadens
PKIDNYGTKKGYDNQD

SEQ ID NO: 2892900 - protein, 10 aa, Entamoeba invadens
PKIDPDDFSQ

SEQ ID NO: 2892901 - protein, 7 aa, Entamoeba invadens
PKIEGGM

SEQ ID NO: 2892902 - protein, 18 aa, Entamoeba invadens
PKIEPTVPNDDEVATTDD

SEQ ID NO: 2892903 - protein, 12 aa, Entamoeba invadens
PKIGVGSVAPTV

SEQ ID NO: 2892904 - protein, 5 aa, Entamoeba invadens
PKIIT

SEQ ID NO: 2892905 - protein, 8 aa, Entamoeba invadens
PKIPRTKK

SEQ ID NO: 2892906 - protein, 6 aa, Entamoeba invadens
PKIQNS

SEQ ID NO: 2892907 - protein, 41 aa, Entamoeba invadens
PKIQSTAISEVSQPQSLQIDNKSEGKSVEETIGSATTSLVN

SEQ ID NO: 2892908 - protein, 6 aa, Entamoeba invadens
PKITEQ

SEQ ID NO: 2892909 - protein, 8 aa, Entamoeba invadens
PKKADQKE

SEQ ID NO: 2892910 - protein, 6 aa, Entamoeba invadens
PKKCNT

SEQ ID NO: 2892911 - protein, 8 aa, Entamoeba invadens
PKKCSGRK

SEQ ID NO: 2892912 - protein, 4 aa, Entamoeba invadens
PKKD

SEQ ID NO: 2892913 - protein, 21 aa, Entamoeba invadens
PKKDDFTHAKRKKAEDVTAST

SEQ ID NO: 2892914 - protein, 18 aa, Entamoeba invadens
PKKDENSEIEKHDKKPSG

SEQ ID NO: 2892915 - protein, 11 aa, Entamoeba invadens
PKKEDTKEVQR

SEQ ID NO: 2892916 - protein, 8 aa, Entamoeba invadens
PKKEELQK

SEQ ID NO: 2892917 - protein, 27 aa, Entamoeba invadens
PKKEEPKTMKSESEFTLTQSTRERIQR

SEQ ID NO: 2892918 - protein, 9 aa, Entamoeba invadens
PKKEQQQIP

SEQ ID NO: 2892919 - protein, 6 aa, Entamoeba invadens
PKKESV

SEQ ID NO: 2892920 - protein, 9 aa, Entamoeba invadens
PKKETEDHI

SEQ ID NO: 2892921 - protein, 4 aa, Entamoeba invadens
PKKH

SEQ ID NO: 2892922 - protein, 11 aa, Entamoeba invadens
PKKIDFSRENV

SEQ ID NO: 2892923 - protein, 7 aa, Entamoeba invadens
PKKKDYD

SEQ ID NO: 2892924 - protein, 5 aa, Entamoeba invadens
PKKKE

SEQ ID NO: 2892925 - protein, 35 aa, Entamoeba invadens
PKKKKDSAKLKDDEKLESLEEKSKEEDKKRNYNIT

SEQ ID NO: 2892926 - protein, 10 aa, Entamoeba invadens
PKKKNNSVDL

SEQ ID NO: 2892927 - protein, 20 aa, Entamoeba invadens
PKKKQKKDIIDQPPQSEEEV

SEQ ID NO: 2892928 - protein, 8 aa, Entamoeba invadens
PKKKSKVS

SEQ ID NO: 2892929 - protein, 9 aa, Entamoeba invadens
PKKKSSEIS

SEQ ID NO: 2892930 - protein, 15 aa, Entamoeba invadens
PKKLSAAQPTNLRTK

SEQ ID NO: 2892931 - protein, 23 aa, Entamoeba invadens
PKKMRGATSTVDGDGIKTGEVNI

SEQ ID NO: 2892932 - protein, 5 aa, Entamoeba invadens
PKKPT

SEQ ID NO: 2892933 - protein, 5 aa, Entamoeba invadens
PKKQC

SEQ ID NO: 2892934 - protein, 6 aa, Entamoeba invadens
PKKREV

SEQ ID NO: 2892935 - protein, 7 aa, Entamoeba invadens
PKKRITA

SEQ ID NO: 2892936 - protein, 8 aa, Entamoeba invadens
PKKRPDIN

SEQ ID NO: 2892937 - protein, 6 aa, Entamoeba invadens
PKKRRS

SEQ ID NO: 2892938 - protein, 6 aa, Entamoeba invadens
PKKRRT

SEQ ID NO: 2892939 - protein, 6 aa, Entamoeba invadens
PKKRSV

SEQ ID NO: 2892940 - protein, 11 aa, Entamoeba invadens
PKKRTNKTADL

SEQ ID NO: 2892941 - protein, 4 aa, Entamoeba invadens
PKKS

SEQ ID NO: 2892942 - protein, 26 aa, Entamoeba invadens
PKKSKDDEKVQVQPLQKKQDKIPNPL

SEQ ID NO: 2892943 - protein, 8 aa, Entamoeba invadens
PKKSLSPL

SEQ ID NO: 2892944 - protein, 9 aa, Entamoeba invadens
PKKSQNVDT

SEQ ID NO: 2892945 - protein, 4 aa, Entamoeba invadens
PKKT

SEQ ID NO: 2892946 - protein, 9 aa, Entamoeba invadens
PKKTFTQVT

SEQ ID NO: 2892947 - protein, 5 aa, Entamoeba invadens
PKKTV

SEQ ID NO: 2892948 - protein, 26 aa, Entamoeba invadens
PKKVETSPKRKYTRDPEKKQESSRKR

SEQ ID NO: 2892949 - protein, 18 aa, Entamoeba invadens
PKKWEQERNAISGGSSPV

SEQ ID NO: 2892950 - protein, 15 aa, Entamoeba invadens
PKLAAEEADEAYKDV

SEQ ID NO: 2892951 - protein, 6 aa, Entamoeba invadens
PKLAEK

SEQ ID NO: 2892952 - protein, 21 aa, Entamoeba invadens
PKLATTSAAQTVKSLDGGKKF

SEQ ID NO: 2892953 - protein, 15 aa, Entamoeba invadens
PKLDDANKAGTKDGK

SEQ ID NO: 2892954 - protein, 7 aa, Entamoeba invadens
PKLDDKT

SEQ ID NO: 2892955 - protein, 7 aa, Entamoeba invadens
PKLEELE

SEQ ID NO: 2892956 - protein, 10 aa, Entamoeba invadens
PKLEKSGGFP

SEQ ID NO: 2892957 - protein, 7 aa, Entamoeba invadens
PKLETTE

SEQ ID NO: 2892958 - protein, 5 aa, Entamoeba invadens
PKLGE

SEQ ID NO: 2892959 - protein, 4 aa, Entamoeba invadens
PKLK

SEQ ID NO: 2892960 - protein, 7 aa, Entamoeba invadens
PKLKKGK

SEQ ID NO: 2892961 - protein, 8 aa, Entamoeba invadens
PKLKNQDT

SEQ ID NO: 2892962 - protein, 7 aa, Entamoeba invadens
PKLNANV

SEQ ID NO: 2892963 - protein, 4 aa, Entamoeba invadens
PKLP

SEQ ID NO: 2892964 - protein, 44 aa, Entamoeba invadens
PKLPEEDNEKQISPREHESSLSPSETTPRKMQWGGSKRKNRATV

SEQ ID NO: 2892965 - protein, 13 aa, Entamoeba invadens
PKLPNGDDLKIEQ

SEQ ID NO: 2892966 - protein, 6 aa, Entamoeba invadens
PKLQNE

SEQ ID NO: 2892967 - protein, 17 aa, Entamoeba invadens
PKLQNEGVDVSDGKNGI

SEQ ID NO: 2892968 - protein, 18 aa, Entamoeba invadens
PKLSAKATRIQGGGMETQ

SEQ ID NO: 2892969 - protein, 8 aa, Entamoeba invadens
PKLSASAN

SEQ ID NO: 2892970 - protein, 9 aa, Entamoeba invadens
PKLSPETLQ

SEQ ID NO: 2892971 - protein, 5 aa, Entamoeba invadens
PKLTK

SEQ ID NO: 2892972 - protein, 5 aa, Entamoeba invadens
PKLTT

SEQ ID NO: 2892973 - protein, 9 aa, Entamoeba invadens
PKMEEESDL

SEQ ID NO: 2892974 - protein, 14 aa, Entamoeba invadens
PKMGKGDNDKKRYE

SEQ ID NO: 2892975 - protein, 6 aa, Entamoeba invadens
PKMKTT

SEQ ID NO: 2892976 - protein, 14 aa, Entamoeba invadens
PKMSDEDVDRLSDK

SEQ ID NO: 2892977 - protein, 8 aa, Entamoeba invadens
PKMSNENT

SEQ ID NO: 2892978 - protein, 4 aa, Entamoeba invadens
PKNA

SEQ ID NO: 2892979 - protein, 12 aa, Entamoeba invadens
PKNAIRDETQAK

SEQ ID NO: 2892980 - protein, 9 aa, Entamoeba invadens
PKNANQQQI

SEQ ID NO: 2892981 - protein, 11 aa, Entamoeba invadens
PKNDNEKGQAL

SEQ ID NO: 2892982 - protein, 5 aa, Entamoeba invadens
PKNEF

SEQ ID NO: 2892983 - protein, 5 aa, Entamoeba invadens
PKNEL

SEQ ID NO: 2892984 - protein, 4 aa, Entamoeba invadens
PKNF

SEQ ID NO: 2892985 - protein, 7 aa, Entamoeba invadens
PKNFPKT

SEQ ID NO: 2892986 - protein, 8 aa, Entamoeba invadens
PKNGQPLR

SEQ ID NO: 2892987 - protein, 10 aa, Entamoeba invadens
PKNGRKNPYG

SEQ ID NO: 2892988 - protein, 10 aa, Entamoeba invadens
PKNIKAKKTL

SEQ ID NO: 2892989 - protein, 6 aa, Entamoeba invadens
PKNINT

SEQ ID NO: 2892990 - protein, 4 aa, Entamoeba invadens
PKNK

SEQ ID NO: 2892991 - protein, 12 aa, Entamoeba invadens
PKNKDAGDSWAE

SEQ ID NO: 2892992 - protein, 9 aa, Entamoeba invadens
PKNKKGYSP

SEQ ID NO: 2892993 - protein, 6 aa, Entamoeba invadens
PKNLEA

SEQ ID NO: 2892994 - protein, 12 aa, Entamoeba invadens
PKNLTKEIKESD

SEQ ID NO: 2892995 - protein, 6 aa, Entamoeba invadens
PKNNET

SEQ ID NO: 2892996 - protein, 10 aa, Entamoeba invadens
PKNPLDDNQV

SEQ ID NO: 2892997 - protein, 11 aa, Entamoeba invadens
PKNQDNSDKCE

SEQ ID NO: 2892998 - protein, 5 aa, Entamoeba invadens
PKNQP

SEQ ID NO: 2892999 - protein, 10 aa, Entamoeba invadens
PKNQQTIPTK

SEQ ID NO: 2893000 - protein, 12 aa, Entamoeba invadens
PKNRDGKKITGS

SEQ ID NO: 2893001 - protein, 5 aa, Entamoeba invadens
PKNRQ

SEQ ID NO: 2893002 - protein, 4 aa, Entamoeba invadens
PKNS

SEQ ID NO: 2893003 - protein, 8 aa, Entamoeba invadens
PKNSAEAL

SEQ ID NO: 2893004 - protein, 11 aa, Entamoeba invadens
PKNSEDPLPEH

SEQ ID NO: 2893005 - protein, 8 aa, Entamoeba invadens
PKNSHTND

SEQ ID NO: 2893006 - protein, 6 aa, Entamoeba invadens
PKNSTV

SEQ ID NO: 2893007 - protein, 4 aa, Entamoeba invadens
PKNT

SEQ ID NO: 2893008 - protein, 6 aa, Entamoeba invadens
PKNTEF

SEQ ID NO: 2893009 - protein, 7 aa, Entamoeba invadens
PKNVEAR

SEQ ID NO: 2893010 - protein, 7 aa, Entamoeba invadens
PKNVGDN

SEQ ID NO: 2893011 - protein, 7 aa, Entamoeba invadens
PKNYGKD

SEQ ID NO: 2893012 - protein, 16 aa, Entamoeba invadens
PKNYGNNIAFDDIYND

SEQ ID NO: 2893013 - protein, 64 aa, Entamoeba invadens
PKPAKSYKTSQKSPDIKKEVKPKVLETPKEVQKPVEEKKEKSVSTQQKTQASQKSVHEKKQEAF

SEQ ID NO: 2893014 - protein, 11 aa, Entamoeba invadens
PKPDNKAEDVV

SEQ ID NO: 2893015 - protein, 7 aa, Entamoeba invadens
PKPDNTW

SEQ ID NO: 2893016 - protein, 5 aa, Entamoeba invadens
PKPED

SEQ ID NO: 2893017 - protein, 8 aa, Entamoeba invadens
PKPETDDW

SEQ ID NO: 2893018 - protein, 6 aa, Entamoeba invadens
PKPEYA

SEQ ID NO: 2893019 - protein, 14 aa, Entamoeba invadens
PKPFPTDKRQADKA

SEQ ID NO: 2893020 - protein, 12 aa, Entamoeba invadens
PKPFSDDVSIID

SEQ ID NO: 2893021 - protein, 8 aa, Entamoeba invadens
PKPFSEVA

SEQ ID NO: 2893022 - protein, 7 aa, Entamoeba invadens
PKPIADQ

SEQ ID NO: 2893023 - protein, 9 aa, Entamoeba invadens
PKPKEEDLG

SEQ ID NO: 2893024 - protein, 24 aa, Entamoeba invadens
PKPKRRESSAKQQNKNDNENDNFE

SEQ ID NO: 2893025 - protein, 29 aa, Entamoeba invadens
PKPKRRESSAKQQNKNDNENDNFEDDGID

SEQ ID NO: 2893026 - protein, 9 aa, Entamoeba invadens
PKPKSKVKN

SEQ ID NO: 2893027 - protein, 9 aa, Entamoeba invadens
PKPLKPTPI

SEQ ID NO: 2893028 - protein, 5 aa, Entamoeba invadens
PKPQS

SEQ ID NO: 2893029 - protein, 6 aa, Entamoeba invadens
PKPQSV

SEQ ID NO: 2893030 - protein, 10 aa, Entamoeba invadens
PKPRRKETAL

SEQ ID NO: 2893031 - protein, 31 aa, Entamoeba invadens
PKPSNGTPDVKKDNKDNQLNNTTNSEKNTFE

SEQ ID NO: 2893032 - protein, 4 aa, Entamoeba invadens
PKPT

SEQ ID NO: 2893033 - protein, 13 aa, Entamoeba invadens
PKPTEASTKTEDI

SEQ ID NO: 2893034 - protein, 10 aa, Entamoeba invadens
PKPTEDDQNA

SEQ ID NO: 2893035 - protein, 9 aa, Entamoeba invadens
PKPTPQPEK

SEQ ID NO: 2893036 - protein, 7 aa, Entamoeba invadens
PKPTQCT

SEQ ID NO: 2893037 - protein, 5 aa, Entamoeba invadens
PKPVN

SEQ ID NO: 2893038 - protein, 9 aa, Entamoeba invadens
PKPYTKQDA

SEQ ID NO: 2893039 - protein, 8 aa, Entamoeba invadens
PKQAPLGV

SEQ ID NO: 2893040 - protein, 5 aa, Entamoeba invadens
PKQAR

SEQ ID NO: 2893041 - protein, 4 aa, Entamoeba invadens
PKQD

SEQ ID NO: 2893042 - protein, 4 aa, Entamoeba invadens
PKQF

SEQ ID NO: 2893043 - protein, 7 aa, Entamoeba invadens
PKQFPSK

SEQ ID NO: 2893044 - protein, 6 aa, Entamoeba invadens
PKQGIT

SEQ ID NO: 2893045 - protein, 4 aa, Entamoeba invadens
PKQI

SEQ ID NO: 2893046 - protein, 7 aa, Entamoeba invadens
PKQIEEK

SEQ ID NO: 2893047 - protein, 17 aa, Entamoeba invadens
PKQKKDKPKKKEKKVAK

SEQ ID NO: 2893048 - protein, 9 aa, Entamoeba invadens
PKQKQSIPQ

SEQ ID NO: 2893049 - protein, 6 aa, Entamoeba invadens
PKQNIE

SEQ ID NO: 2893050 - protein, 5 aa, Entamoeba invadens
PKQPR

SEQ ID NO: 2893051 - protein, 6 aa, Entamoeba invadens
PKQQPL

SEQ ID NO: 2893052 - protein, 6 aa, Entamoeba invadens
PKQRTP

SEQ ID NO: 2893053 - protein, 9 aa, Entamoeba invadens
PKQSPSKKE

SEQ ID NO: 2893054 - protein, 7 aa, Entamoeba invadens
PKQTEQI

SEQ ID NO: 2893055 - protein, 17 aa, Entamoeba invadens
PKQTGTSKLNSEIKSRF

SEQ ID NO: 2893056 - protein, 21 aa, Entamoeba invadens
PKQTSEAEMYDNTDKDTTPEY

SEQ ID NO: 2893057 - protein, 4 aa, Entamoeba invadens
PKQV

SEQ ID NO: 2893058 - protein, 19 aa, Entamoeba invadens
PKQVDQGANNNPTVRYKTT

SEQ ID NO: 2893059 - protein, 9 aa, Entamoeba invadens
PKRDDYTLT

SEQ ID NO: 2893060 - protein, 11 aa, Entamoeba invadens
PKRDEYDGFRP

SEQ ID NO: 2893061 - protein, 4 aa, Entamoeba invadens
PKRF

SEQ ID NO: 2893062 - protein, 9 aa, Entamoeba invadens
PKRGGFSSA

SEQ ID NO: 2893063 - protein, 6 aa, Entamoeba invadens
PKRGNI

SEQ ID NO: 2893064 - protein, 9 aa, Entamoeba invadens
PKRGPFPEY

SEQ ID NO: 2893065 - protein, 4 aa, Entamoeba invadens
PKRK

SEQ ID NO: 2893066 - protein, 40 aa, Entamoeba invadens
PKRKKVGKDYESHTFEKKEISKESSKEQSKESSKNPRQRM

SEQ ID NO: 2893067 - protein, 37 aa, Entamoeba invadens
PKRKTKESEEKSSQVAESKEAVEKQDRETKNDKTTKV

SEQ ID NO: 2893068 - protein, 7 aa, Entamoeba invadens
PKRNQNF

SEQ ID NO: 2893069 - protein, 9 aa, Entamoeba invadens
PKRPEFGPS

SEQ ID NO: 2893070 - protein, 10 aa, Entamoeba invadens
PKRQNTPMRP

SEQ ID NO: 2893071 - protein, 64 aa, Entamoeba invadens
PKRREPYYRGARESSYRDRGYQNTTNRHNYYQQPQQQIPPQQIPLPPQQQIPPQQNVPEPSLET

SEQ ID NO: 2893072 - protein, 19 aa, Entamoeba invadens
PKRSCTTPSGFQPLLFTSI

SEQ ID NO: 2893073 - protein, 8 aa, Entamoeba invadens
PKRTHKSI

SEQ ID NO: 2893074 - protein, 10 aa, Entamoeba invadens
PKRTKPGSTL

SEQ ID NO: 2893075 - protein, 10 aa, Entamoeba invadens
PKRTPSSTPL

SEQ ID NO: 2893076 - protein, 6 aa, Entamoeba invadens
PKRTRN

SEQ ID NO: 2893077 - protein, 6 aa, Entamoeba invadens
PKRVTE

SEQ ID NO: 2893078 - protein, 10 aa, Entamoeba invadens
PKSASAIQNE

SEQ ID NO: 2893079 - protein, 9 aa, Entamoeba invadens
PKSDKIASK

SEQ ID NO: 2893080 - protein, 15 aa, Entamoeba invadens
PKSEDKHVTQTSTKN

SEQ ID NO: 2893081 - protein, 22 aa, Entamoeba invadens
PKSEEENPFADSPKLRLDGENE

SEQ ID NO: 2893082 - protein, 9 aa, Entamoeba invadens
PKSEQLSEI

SEQ ID NO: 2893083 - protein, 7 aa, Entamoeba invadens
PKSESIA

SEQ ID NO: 2893084 - protein, 7 aa, Entamoeba invadens
PKSESVF

SEQ ID NO: 2893085 - protein, 24 aa, Entamoeba invadens
PKSFDDNLPPDIDLNDEKKTLGIE

SEQ ID NO: 2893086 - protein, 18 aa, Entamoeba invadens
PKSFQPTLKQSKPLIKSD

SEQ ID NO: 2893087 - protein, 15 aa, Entamoeba invadens
PKSGFDDLPKEETKI

SEQ ID NO: 2893088 - protein, 48 aa, Entamoeba invadens
PKSHQRDKKHEKIEKQANPDHTQSTVSAIDEAKTKVAEQLSAQKRDLR

SEQ ID NO: 2893089 - protein, 7 aa, Entamoeba invadens
PKSIHDD

SEQ ID NO: 2893090 - protein, 10 aa, Entamoeba invadens
PKSIKRKGDL

SEQ ID NO: 2893091 - protein, 7 aa, Entamoeba invadens
PKSKKEY

SEQ ID NO: 2893092 - protein, 4 aa, Entamoeba invadens
PKSL

SEQ ID NO: 2893093 - protein, 10 aa, Entamoeba invadens
PKSLEPNDNS

SEQ ID NO: 2893094 - protein, 5 aa, Entamoeba invadens
PKSLQ

SEQ ID NO: 2893095 - protein, 7 aa, Entamoeba invadens
PKSLTDA

SEQ ID NO: 2893096 - protein, 17 aa, Entamoeba invadens
PKSLTGKKKVTSENGFA

SEQ ID NO: 2893097 - protein, 14 aa, Entamoeba invadens
PKSMKKATNKLTGK

SEQ ID NO: 2893098 - protein, 35 aa, Entamoeba invadens
PKSMRRSKTENTKVEVKTEKLQSDKKMEDTPQALR

SEQ ID NO: 2893099 - protein, 15 aa, Entamoeba invadens
PKSNNALFELVVVLS

SEQ ID NO: 2893100 - protein, 7 aa, Entamoeba invadens
PKSPELV

SEQ ID NO: 2893101 - protein, 6 aa, Entamoeba invadens
PKSPES

SEQ ID NO: 2893102 - protein, 8 aa, Entamoeba invadens
PKSPLQEK

SEQ ID NO: 2893103 - protein, 11 aa, Entamoeba invadens
PKSPRINPPEE

SEQ ID NO: 2893104 - protein, 13 aa, Entamoeba invadens
PKSPRINPPEENA

SEQ ID NO: 2893105 - protein, 20 aa, Entamoeba invadens
PKSPSLSTSSESTNSTDFSK

SEQ ID NO: 2893106 - protein, 17 aa, Entamoeba invadens
PKSPTLSLSTDSYAYSS

SEQ ID NO: 2893107 - protein, 7 aa, Entamoeba invadens
PKSPTMS

SEQ ID NO: 2893108 - protein, 10 aa, Entamoeba invadens
PKSPWTPEED

SEQ ID NO: 2893109 - protein, 66 aa, Entamoeba invadens
PKSQIQKPSQPKRAQPPTPRKVTPINTTNTTQIHQNSYSNTVTQPTQQHKQKTFADVTKPTQKAQT

SEQ ID NO: 2893110 - protein, 7 aa, Entamoeba invadens
PKSQLGS

SEQ ID NO: 2893111 - protein, 10 aa, Entamoeba invadens
PKSQNNYEAL

SEQ ID NO: 2893112 - protein, 20 aa, Entamoeba invadens
PKSQQPTDPNVKYRASAPEC

SEQ ID NO: 2893113 - protein, 10 aa, Entamoeba invadens
PKSQQRNSTS

SEQ ID NO: 2893114 - protein, 12 aa, Entamoeba invadens
PKSRDDPKADIS

SEQ ID NO: 2893115 - protein, 25 aa, Entamoeba invadens
PKSRKQALNNGKKVKKFEKLQKLAG

SEQ ID NO: 2893116 - protein, 5 aa, Entamoeba invadens
PKSRR

SEQ ID NO: 2893117 - protein, 7 aa, Entamoeba invadens
PKSSKPV

SEQ ID NO: 2893118 - protein, 11 aa, Entamoeba invadens
PKSSLSRTNQK

SEQ ID NO: 2893119 - protein, 7 aa, Entamoeba invadens
PKSSQTL

SEQ ID NO: 2893120 - protein, 5 aa, Entamoeba invadens
PKSSR

SEQ ID NO: 2893121 - protein, 14 aa, Entamoeba invadens
PKSSVPEQKEQNLV

SEQ ID NO: 2893122 - protein, 5 aa, Entamoeba invadens
PKSTI

SEQ ID NO: 2893123 - protein, 8 aa, Entamoeba invadens
PKSTIDNW

SEQ ID NO: 2893124 - protein, 8 aa, Entamoeba invadens
PKSVKSIG

SEQ ID NO: 2893125 - protein, 7 aa, Entamoeba invadens
PKSVRKV

SEQ ID NO: 2893126 - protein, 6 aa, Entamoeba invadens
PKSVTK

SEQ ID NO: 2893127 - protein, 4 aa, Entamoeba invadens
PKTA

SEQ ID NO: 2893128 - protein, 8 aa, Entamoeba invadens
PKTAAPTL

SEQ ID NO: 2893129 - protein, 5 aa, Entamoeba invadens
PKTAE

SEQ ID NO: 2893130 - protein, 20 aa, Entamoeba invadens
PKTAKLKKEKCFNENVVITL

SEQ ID NO: 2893131 - protein, 10 aa, Entamoeba invadens
PKTCKKPYNP

SEQ ID NO: 2893132 - protein, 12 aa, Entamoeba invadens
PKTECSKATNIT

SEQ ID NO: 2893133 - protein, 6 aa, Entamoeba invadens
PKTEDI

SEQ ID NO: 2893134 - protein, 51 aa, Entamoeba invadens
PKTEIKNVTEKKPRKEKVEQKLNPKREKMTVRQKHTKRVQTTKEDKKNMTK

SEQ ID NO: 2893135 - protein, 11 aa, Entamoeba invadens
PKTELSQKQRM

SEQ ID NO: 2893136 - protein, 14 aa, Entamoeba invadens
PKTEPFKPKKGKTS

SEQ ID NO: 2893137 - protein, 11 aa, Entamoeba invadens
PKTESIRKQSG

SEQ ID NO: 2893138 - protein, 18 aa, Entamoeba invadens
PKTGAKDVQKEKSQVTQP

SEQ ID NO: 2893139 - protein, 7 aa, Entamoeba invadens
PKTGKTA

SEQ ID NO: 2893140 - protein, 9 aa, Entamoeba invadens
PKTGKTALA

SEQ ID NO: 2893141 - protein, 6 aa, Entamoeba invadens
PKTHFR

SEQ ID NO: 2893142 - protein, 4 aa, Entamoeba invadens
PKTI

SEQ ID NO: 2893143 - protein, 10 aa, Entamoeba invadens
PKTIPDKTSY

SEQ ID NO: 2893144 - protein, 11 aa, Entamoeba invadens
PKTKENTRPLT

SEQ ID NO: 2893145 - protein, 7 aa, Entamoeba invadens
PKTKNVI

SEQ ID NO: 2893146 - protein, 9 aa, Entamoeba invadens
PKTKPDHAL

SEQ ID NO: 2893147 - protein, 26 aa, Entamoeba invadens
PKTLEEDVQTENFNSEKDLKEERKDV

SEQ ID NO: 2893148 - protein, 9 aa, Entamoeba invadens
PKTLSEAPE

SEQ ID NO: 2893149 - protein, 4 aa, Entamoeba invadens
PKTN

SEQ ID NO: 2893150 - protein, 5 aa, Entamoeba invadens
PKTNS

SEQ ID NO: 2893151 - protein, 7 aa, Entamoeba invadens
PKTPNEL

SEQ ID NO: 2893152 - protein, 10 aa, Entamoeba invadens
PKTPSDPRKV

SEQ ID NO: 2893153 - protein, 20 aa, Entamoeba invadens
PKTPVKSDATQMDKTCNTID

SEQ ID NO: 2893154 - protein, 8 aa, Entamoeba invadens
PKTQNSLE

SEQ ID NO: 2893155 - protein, 5 aa, Entamoeba invadens
PKTQP

SEQ ID NO: 2893156 - protein, 7 aa, Entamoeba invadens
PKTQPSL

SEQ ID NO: 2893157 - protein, 5 aa, Entamoeba invadens
PKTRD

SEQ ID NO: 2893158 - protein, 36 aa, Entamoeba invadens
PKTRTKTPKSTTSKTTTPKNSKKQNTQGSDDETPIK

SEQ ID NO: 2893159 - protein, 37 aa, Entamoeba invadens
PKTSASPGITSKIDKPEKTPKGRNSEEEKKDKDEKEF

SEQ ID NO: 2893160 - protein, 48 aa, Entamoeba invadens
PKTSDPSPVPSPQPDDKQKKQQNPPKQQKQKQQKKAPEAQHIEHKEEK

SEQ ID NO: 2893161 - protein, 8 aa, Entamoeba invadens
PKTSPKEA

SEQ ID NO: 2893162 - protein, 18 aa, Entamoeba invadens
PKTSRTGYRGLSNSGSTC

SEQ ID NO: 2893163 - protein, 9 aa, Entamoeba invadens
PKTTPTVIT

SEQ ID NO: 2893164 - protein, 23 aa, Entamoeba invadens
PKTTRGDEKQTQKMSIENGTKGL

SEQ ID NO: 2893165 - protein, 28 aa, Entamoeba invadens
PKTTYTKSIHTTSVGTKRKSNGFSKTIG

SEQ ID NO: 2893166 - protein, 8 aa, Entamoeba invadens
PKTVGKDE

SEQ ID NO: 2893167 - protein, 15 aa, Entamoeba invadens
PKTVPKSLQDRAVRD

SEQ ID NO: 2893168 - protein, 5 aa, Entamoeba invadens
PKTVQ

SEQ ID NO: 2893169 - protein, 5 aa, Entamoeba invadens
PKTVV

SEQ ID NO: 2893170 - protein, 9 aa, Entamoeba invadens
PKTWPSTGS

SEQ ID NO: 2893171 - protein, 4 aa, Entamoeba invadens
PKVE

SEQ ID NO: 2893172 - protein, 14 aa, Entamoeba invadens
PKVEENSTQAQCWC

SEQ ID NO: 2893173 - protein, 5 aa, Entamoeba invadens
PKVIE

SEQ ID NO: 2893174 - protein, 5 aa, Entamoeba invadens
PKVKC

SEQ ID NO: 2893175 - protein, 8 aa, Entamoeba invadens
PKVKEENF

SEQ ID NO: 2893176 - protein, 6 aa, Entamoeba invadens
PKVKTT

SEQ ID NO: 2893177 - protein, 5 aa, Entamoeba invadens
PKVNL

SEQ ID NO: 2893178 - protein, 12 aa, Entamoeba invadens
PKVPSKPPISQE

SEQ ID NO: 2893179 - protein, 16 aa, Entamoeba invadens
PKVQSDTWNGTDGNTH

SEQ ID NO: 2893180 - protein, 10 aa, Entamoeba invadens
PKVRESALGT

SEQ ID NO: 2893181 - protein, 11 aa, Entamoeba invadens
PKVTNSSSRLE

SEQ ID NO: 2893182 - protein, 10 aa, Entamoeba invadens
PKVTNYQKSV

SEQ ID NO: 2893183 - protein, 11 aa, Entamoeba invadens
PKWTSSAGQEQ

SEQ ID NO: 2893184 - protein, 19 aa, Entamoeba invadens
PKYENAKTIKKNSRVEKLQ

SEQ ID NO: 2893185 - protein, 4 aa, Entamoeba invadens
PKYF

SEQ ID NO: 2893186 - protein, 5 aa, Entamoeba invadens
PKYGR

SEQ ID NO: 2893187 - protein, 4 aa, Entamoeba invadens
PKYI

SEQ ID NO: 2893188 - protein, 4 aa, Entamoeba invadens
PKYK

SEQ ID NO: 2893189 - protein, 21 aa, Entamoeba invadens
PKYLPPNTQFQPQAQQPSEIY

SEQ ID NO: 2893190 - protein, 4 aa, Entamoeba invadens
PKYN

SEQ ID NO: 2893191 - protein, 6 aa, Entamoeba invadens
PKYNGL

SEQ ID NO: 2893192 - protein, 6 aa, Entamoeba invadens
PKYPAT

SEQ ID NO: 2893193 - protein, 12 aa, Entamoeba invadens
PKYPENPAKTYP

SEQ ID NO: 2893194 - protein, 5 aa, Entamoeba invadens
PKYPK

SEQ ID NO: 2893195 - protein, 8 aa, Entamoeba invadens
PKYQRDGN

SEQ ID NO: 2893196 - protein, 6 aa, Entamoeba invadens
PKYQRR

SEQ ID NO: 2893197 - protein, 6 aa, Entamoeba invadens
PKYSDY

SEQ ID NO: 2893198 - protein, 5 aa, Entamoeba invadens
PKYSH

SEQ ID NO: 2893199 - protein, 6 aa, Entamoeba invadens
PKYSSA

SEQ ID NO: 2893200 - protein, 12 aa, Entamoeba invadens
PKYSSQWQTTTT

SEQ ID NO: 2893201 - protein, 6 aa, Entamoeba invadens
PKYSTT

SEQ ID NO: 2893202 - protein, 11 aa, Entamoeba invadens
PKYTSKDGDTL

SEQ ID NO: 2893203 - protein, 10 aa, Entamoeba invadens
PLADEKMQQK

SEQ ID NO: 2893204 - protein, 12 aa, Entamoeba invadens
PLAEKGKEFDNN

SEQ ID NO: 2893205 - protein, 11 aa, Entamoeba invadens
PLAETLSSSGF

SEQ ID NO: 2893206 - protein, 4 aa, Entamoeba invadens
PLAG

SEQ ID NO: 2893207 - protein, 5 aa, Entamoeba invadens
PLAKT

SEQ ID NO: 2893208 - protein, 9 aa, Entamoeba invadens
PLAPKTPNV

SEQ ID NO: 2893209 - protein, 10 aa, Entamoeba invadens
PLAPPQTKQP

SEQ ID NO: 2893210 - protein, 11 aa, Entamoeba invadens
PLARASSTSLQ

SEQ ID NO: 2893211 - protein, 5 aa, Entamoeba invadens
PLASP

SEQ ID NO: 2893212 - protein, 5 aa, Entamoeba invadens
PLDDD

SEQ ID NO: 2893213 - protein, 9 aa, Entamoeba invadens
PLDDERKKE

SEQ ID NO: 2893214 - protein, 8 aa, Entamoeba invadens
PLDDGRSD

SEQ ID NO: 2893215 - protein, 9 aa, Entamoeba invadens
PLDDYEEGD

SEQ ID NO: 2893216 - protein, 8 aa, Entamoeba invadens
PLDEANVN

SEQ ID NO: 2893217 - protein, 8 aa, Entamoeba invadens
PLDETKKV

SEQ ID NO: 2893218 - protein, 10 aa, Entamoeba invadens
PLDGRNPSLN

SEQ ID NO: 2893219 - protein, 5 aa, Entamoeba invadens
PLDQK

SEQ ID NO: 2893220 - protein, 11 aa, Entamoeba invadens
PLDQNTKTQRT

SEQ ID NO: 2893221 - protein, 34 aa, Entamoeba invadens
PLDRSRDDRDFYRDSRDSNRNYPDRFSDQRSGTM

SEQ ID NO: 2893222 - protein, 5 aa, Entamoeba invadens
PLDSR

SEQ ID NO: 2893223 - protein, 10 aa, Entamoeba invadens
PLDSTISSSL

SEQ ID NO: 2893224 - protein, 6 aa, Entamoeba invadens
PLDTRT

SEQ ID NO: 2893225 - protein, 11 aa, Entamoeba invadens
PLEDNTLREGI

SEQ ID NO: 2893226 - protein, 5 aa, Entamoeba invadens
PLEGH

SEQ ID NO: 2893227 - protein, 9 aa, Entamoeba invadens
PLEKDEQKK

SEQ ID NO: 2893228 - protein, 28 aa, Entamoeba invadens
PLEKEKTPLPEEEIPPESITDANSDEET

SEQ ID NO: 2893229 - protein, 12 aa, Entamoeba invadens
PLENESKRLRTQ

SEQ ID NO: 2893230 - protein, 6 aa, Entamoeba invadens
PLENGY

SEQ ID NO: 2893231 - protein, 9 aa, Entamoeba invadens
PLENQDATN

SEQ ID NO: 2893232 - protein, 5 aa, Entamoeba invadens
PLENT

SEQ ID NO: 2893233 - protein, 7 aa, Entamoeba invadens
PLEPVPP

SEQ ID NO: 2893234 - protein, 9 aa, Entamoeba invadens
PLEQNAKKI

SEQ ID NO: 2893235 - protein, 7 aa, Entamoeba invadens
PLERTTK

SEQ ID NO: 2893236 - protein, 12 aa, Entamoeba invadens
PLESKGETQPLK

SEQ ID NO: 2893237 - protein, 7 aa, Entamoeba invadens
PLESMTK

SEQ ID NO: 2893238 - protein, 12 aa, Entamoeba invadens
PLGDEAPPIDRN

SEQ ID NO: 2893239 - protein, 15 aa, Entamoeba invadens
PLGFPKTTVPPNQNN

SEQ ID NO: 2893240 - protein, 8 aa, Entamoeba invadens
PLGQSSFR

SEQ ID NO: 2893241 - protein, 10 aa, Entamoeba invadens
PLGTNSHEKL

SEQ ID NO: 2893242 - protein, 17 aa, Entamoeba invadens
PLHKSEFGSPLVNESTD

SEQ ID NO: 2893243 - protein, 15 aa, Entamoeba invadens
PLIPPKHRPTPSFSE

SEQ ID NO: 2893244 - protein, 13 aa, Entamoeba invadens
PLIPQNTNKQIES

SEQ ID NO: 2893245 - protein, 4 aa, Entamoeba invadens
PLIQ

SEQ ID NO: 2893246 - protein, 7 aa, Entamoeba invadens
PLITPSN

SEQ ID NO: 2893247 - protein, 21 aa, Entamoeba invadens
PLITSKPPTWPQTNGQSEINI

SEQ ID NO: 2893248 - protein, 38 aa, Entamoeba invadens
PLKEEQAKGGNDDKKVDTQAEPLKSVTGPGSLISSENT

SEQ ID NO: 2893249 - protein, 7 aa, Entamoeba invadens
PLKENGV

SEQ ID NO: 2893250 - protein, 15 aa, Entamoeba invadens
PLKESKSPQNSNMTN

SEQ ID NO: 2893251 - protein, 4 aa, Entamoeba invadens
PLKG

SEQ ID NO: 2893252 - protein, 11 aa, Entamoeba invadens
PLKGGEKDTVK

SEQ ID NO: 2893253 - protein, 4 aa, Entamoeba invadens
PLKK

SEQ ID NO: 2893254 - protein, 9 aa, Entamoeba invadens
PLKKAKVTQ

SEQ ID NO: 2893255 - protein, 23 aa, Entamoeba invadens
PLKKRKRNCDEYEAAEDKKLTEE

SEQ ID NO: 2893256 - protein, 5 aa, Entamoeba invadens
PLKKS

SEQ ID NO: 2893257 - protein, 21 aa, Entamoeba invadens
PLKNAQKDVESMDKTKSTEIA

SEQ ID NO: 2893258 - protein, 10 aa, Entamoeba invadens
PLKNKKRSLS

SEQ ID NO: 2893259 - protein, 7 aa, Entamoeba invadens
PLKPEEV

SEQ ID NO: 2893260 - protein, 10 aa, Entamoeba invadens
PLKPRTNEEN

SEQ ID NO: 2893261 - protein, 9 aa, Entamoeba invadens
PLKPSENID

SEQ ID NO: 2893262 - protein, 4 aa, Entamoeba invadens
PLKR

SEQ ID NO: 2893263 - protein, 6 aa, Entamoeba invadens
PLKSKN

SEQ ID NO: 2893264 - protein, 22 aa, Entamoeba invadens
PLKSTDPSNTTQKTVQKETKVE

SEQ ID NO: 2893265 - protein, 10 aa, Entamoeba invadens
PLKSTTPIIS

SEQ ID NO: 2893266 - protein, 11 aa, Entamoeba invadens
PLKTETNDSLK

SEQ ID NO: 2893267 - protein, 9 aa, Entamoeba invadens
PLKTYESVS

SEQ ID NO: 2893268 - protein, 9 aa, Entamoeba invadens
PLNDPTDPF

SEQ ID NO: 2893269 - protein, 8 aa, Entamoeba invadens
PLNDQNAT

SEQ ID NO: 2893270 - protein, 5 aa, Entamoeba invadens
PLNGE

SEQ ID NO: 2893271 - protein, 5 aa, Entamoeba invadens
PLNKA

SEQ ID NO: 2893272 - protein, 6 aa, Entamoeba invadens
PLNKEG

SEQ ID NO: 2893273 - protein, 10 aa, Entamoeba invadens
PLNKGKDAEQ

SEQ ID NO: 2893274 - protein, 21 aa, Entamoeba invadens
PLNNQGSQMSQSIPPQPIQQQ

SEQ ID NO: 2893275 - protein, 6 aa, Entamoeba invadens
PLNPSD

SEQ ID NO: 2893276 - protein, 8 aa, Entamoeba invadens
PLNSKAQA

SEQ ID NO: 2893277 - protein, 39 aa, Entamoeba invadens
PLNTKEKVNKAKIRRKEEQEEKRKLQEKEQQRKEKRKQY

SEQ ID NO: 2893278 - protein, 22 aa, Entamoeba invadens
PLNTSPLKRPTKKVSQTTSPVS

SEQ ID NO: 2893279 - protein, 4 aa, Entamoeba invadens
PLPE

SEQ ID NO: 2893280 - protein, 7 aa, Entamoeba invadens
PLPEDVE

SEQ ID NO: 2893281 - protein, 5 aa, Entamoeba invadens
PLPEG

SEQ ID NO: 2893282 - protein, 8 aa, Entamoeba invadens
PLPEMSRA

SEQ ID NO: 2893283 - protein, 7 aa, Entamoeba invadens
PLPESDF

SEQ ID NO: 2893284 - protein, 7 aa, Entamoeba invadens
PLPGESV

SEQ ID NO: 2893285 - protein, 4 aa, Entamoeba invadens
PLPI

SEQ ID NO: 2893286 - protein, 5 aa, Entamoeba invadens
PLPKI

SEQ ID NO: 2893287 - protein, 5 aa, Entamoeba invadens
PLPPK

SEQ ID NO: 2893288 - protein, 17 aa, Entamoeba invadens
PLPPKPNRLSSLSDDSQ

SEQ ID NO: 2893289 - protein, 5 aa, Entamoeba invadens
PLPPN

SEQ ID NO: 2893290 - protein, 29 aa, Entamoeba invadens
PLPPPNDLAPPPDLLPPPPGLAPPPANMP

SEQ ID NO: 2893291 - protein, 8 aa, Entamoeba invadens
PLPPPTRL

SEQ ID NO: 2893292 - protein, 25 aa, Entamoeba invadens
PLPQEQYQQREAENNTYPYTQRSHQ

SEQ ID NO: 2893293 - protein, 12 aa, Entamoeba invadens
PLPQESSKAISF

SEQ ID NO: 2893294 - protein, 74 aa, Entamoeba invadens
PLPQLPEGAVGGRPRTPSPHGDDTYEAVGGGESPYQLAGRPRSGRRRSRSTSPKRSDTYQLAGRPSPKEEGVDP

SEQ ID NO: 2893295 - protein, 10 aa, Entamoeba invadens
PLPQTSDPVD

SEQ ID NO: 2893296 - protein, 7 aa, Entamoeba invadens
PLPSPLT

SEQ ID NO: 2893297 - protein, 18 aa, Entamoeba invadens
PLPSRPVQAPRRAMSGSE

SEQ ID NO: 2893298 - protein, 5 aa, Entamoeba invadens
PLPTD

SEQ ID NO: 2893299 - protein, 10 aa, Entamoeba invadens
PLPTKATRQY

SEQ ID NO: 2893300 - protein, 5 aa, Entamoeba invadens
PLPTN

SEQ ID NO: 2893301 - protein, 7 aa, Entamoeba invadens
PLPTPDS

SEQ ID NO: 2893302 - protein, 5 aa, Entamoeba invadens
PLPTS

SEQ ID NO: 2893303 - protein, 7 aa, Entamoeba invadens
PLQENTR

SEQ ID NO: 2893304 - protein, 5 aa, Entamoeba invadens
PLQEV

SEQ ID NO: 2893305 - protein, 6 aa, Entamoeba invadens
PLQGAQ

SEQ ID NO: 2893306 - protein, 14 aa, Entamoeba invadens
PLQPTLQGPMPGNI

SEQ ID NO: 2893307 - protein, 15 aa, Entamoeba invadens
PLQPTQIQNPPPVPL

SEQ ID NO: 2893308 - protein, 4 aa, Entamoeba invadens
PLQQ

SEQ ID NO: 2893309 - protein, 10 aa, Entamoeba invadens
PLQQNSPADF

SEQ ID NO: 2893310 - protein, 11 aa, Entamoeba invadens
PLQQNSSSSFR

SEQ ID NO: 2893311 - protein, 11 aa, Entamoeba invadens
PLQTANPPIFP

SEQ ID NO: 2893312 - protein, 11 aa, Entamoeba invadens
PLQTPKETSKY

SEQ ID NO: 2893313 - protein, 5 aa, Entamoeba invadens
PLRKD

SEQ ID NO: 2893314 - protein, 10 aa, Entamoeba invadens
PLRSKETYDN

SEQ ID NO: 2893315 - protein, 7 aa, Entamoeba invadens
PLRSQKG

SEQ ID NO: 2893316 - protein, 15 aa, Entamoeba invadens
PLSARTSSKLVISHE

SEQ ID NO: 2893317 - protein, 12 aa, Entamoeba invadens
PLSASGASKKDL

SEQ ID NO: 2893318 - protein, 11 aa, Entamoeba invadens
PLSEKGRQQAF

SEQ ID NO: 2893319 - protein, 8 aa, Entamoeba invadens
PLSEQEGQ

SEQ ID NO: 2893320 - protein, 4 aa, Entamoeba invadens
PLSF

SEQ ID NO: 2893321 - protein, 13 aa, Entamoeba invadens
PLSHKEEEKMTAD

SEQ ID NO: 2893322 - protein, 10 aa, Entamoeba invadens
PLSKETQDKM

SEQ ID NO: 2893323 - protein, 6 aa, Entamoeba invadens
PLSKKK

SEQ ID NO: 2893324 - protein, 5 aa, Entamoeba invadens
PLSLP

SEQ ID NO: 2893325 - protein, 30 aa, Entamoeba invadens
PLSNPLKETVQQQNDSTEVKGTTPLSTPII

SEQ ID NO: 2893326 - protein, 8 aa, Entamoeba invadens
PLSNTTED

SEQ ID NO: 2893327 - protein, 7 aa, Entamoeba invadens
PLSPEAL

SEQ ID NO: 2893328 - protein, 6 aa, Entamoeba invadens
PLSPFG

SEQ ID NO: 2893329 - protein, 27 aa, Entamoeba invadens
PLSPRSSPKNSPRSTKCSPRKNAPNVS

SEQ ID NO: 2893330 - protein, 6 aa, Entamoeba invadens
PLSQTM

SEQ ID NO: 2893331 - protein, 8 aa, Entamoeba invadens
PLSRPEKL

SEQ ID NO: 2893332 - protein, 11 aa, Entamoeba invadens
PLSSGITPSPL

SEQ ID NO: 2893333 - protein, 14 aa, Entamoeba invadens
PLSSPEFAEDPETK

SEQ ID NO: 2893334 - protein, 5 aa, Entamoeba invadens
PLTEK

SEQ ID NO: 2893335 - protein, 8 aa, Entamoeba invadens
PLTGPTAP

SEQ ID NO: 2893336 - protein, 8 aa, Entamoeba invadens
PLTKENRY

SEQ ID NO: 2893337 - protein, 7 aa, Entamoeba invadens
PLTKTLT

SEQ ID NO: 2893338 - protein, 4 aa, Entamoeba invadens
PLTL

SEQ ID NO: 2893339 - protein, 12 aa, Entamoeba invadens
PLTNTQQPNITN

SEQ ID NO: 2893340 - protein, 16 aa, Entamoeba invadens
PLTPQNTHKTGSAWDD

SEQ ID NO: 2893341 - protein, 11 aa, Entamoeba invadens
PLTQGATEYNK

SEQ ID NO: 2893342 - protein, 7 aa, Entamoeba invadens
PLTQPEL

SEQ ID NO: 2893343 - protein, 11 aa, Entamoeba invadens
PLTQQDREKNM

SEQ ID NO: 2893344 - protein, 20 aa, Entamoeba invadens
PLTQQTQQIGSNGSTQNMNE

SEQ ID NO: 2893345 - protein, 9 aa, Entamoeba invadens
PLTQRTPKD

SEQ ID NO: 2893346 - protein, 16 aa, Entamoeba invadens
PLTSEYSNSLPSTPKE

SEQ ID NO: 2893347 - protein, 6 aa, Entamoeba invadens
PLTSTT

SEQ ID NO: 2893348 - protein, 12 aa, Entamoeba invadens
PLTTKSAGLPNM

SEQ ID NO: 2893349 - protein, 17 aa, Entamoeba invadens
PLTTPSLPETSKSPTPA

SEQ ID NO: 2893350 - protein, 28 aa, Entamoeba invadens
PLVNKNQSKEIKGVEETTSTKEKNTLVE

SEQ ID NO: 2893351 - protein, 9 aa, Entamoeba invadens
PLVSSERVT

SEQ ID NO: 2893352 - protein, 4 aa, Entamoeba invadens
PLWT

SEQ ID NO: 2893353 - protein, 11 aa, Entamoeba invadens
PLYENSDKRPI

SEQ ID NO: 2893354 - protein, 6 aa, Entamoeba invadens
PLYGKD

SEQ ID NO: 2893355 - protein, 13 aa, Entamoeba invadens
PLYNTKNVNKSYR

SEQ ID NO: 2893356 - protein, 7 aa, Entamoeba invadens
PLYPTTN

SEQ ID NO: 2893357 - protein, 7 aa, Entamoeba invadens
PLYSPPE

SEQ ID NO: 2893358 - protein, 8 aa, Entamoeba invadens
PLYTGEKE

SEQ ID NO: 2893359 - protein, 15 aa, Entamoeba invadens
PLYTSEEYHQTDKKN

SEQ ID NO: 2893360 - protein, 6 aa, Entamoeba invadens
PMADTG

SEQ ID NO: 2893361 - protein, 7 aa, Entamoeba invadens
PMCGPNG

SEQ ID NO: 2893362 - protein, 11 aa, Entamoeba invadens
PMDGESNPNLM

SEQ ID NO: 2893363 - protein, 26 aa, Entamoeba invadens
PMEEPNNEKETLNNEVQESQIPPQVD

SEQ ID NO: 2893364 - protein, 6 aa, Entamoeba invadens
PMEKPN

SEQ ID NO: 2893365 - protein, 12 aa, Entamoeba invadens
PMETESDSVEKP

SEQ ID NO: 2893366 - protein, 10 aa, Entamoeba invadens
PMFSKSTEQL

SEQ ID NO: 2893367 - protein, 5 aa, Entamoeba invadens
PMGPQ

SEQ ID NO: 2893368 - protein, 17 aa, Entamoeba invadens
PMGYPGSMGMGGYPNGA

SEQ ID NO: 2893369 - protein, 20 aa, Entamoeba invadens
PMIEEKTEEKEISEKVEKPI

SEQ ID NO: 2893370 - protein, 5 aa, Entamoeba invadens
PMKEP

SEQ ID NO: 2893371 - protein, 10 aa, Entamoeba invadens
PMKMSGYNTT

SEQ ID NO: 2893372 - protein, 9 aa, Entamoeba invadens
PMKRDGTAV

SEQ ID NO: 2893373 - protein, 5 aa, Entamoeba invadens
PMKRE

SEQ ID NO: 2893374 - protein, 5 aa, Entamoeba invadens
PMLPN

SEQ ID NO: 2893375 - protein, 5 aa, Entamoeba invadens
PMNGK

SEQ ID NO: 2893376 - protein, 32 aa, Entamoeba invadens
PMNNETPRPNHTPSLQKEEQLYPGSKSELESF

SEQ ID NO: 2893377 - protein, 6 aa, Entamoeba invadens
PMNPPK

SEQ ID NO: 2893378 - protein, 5 aa, Entamoeba invadens
PMPGI

SEQ ID NO: 2893379 - protein, 5 aa, Entamoeba invadens
PMPKS

SEQ ID NO: 2893380 - protein, 5 aa, Entamoeba invadens
PMPPH

SEQ ID NO: 2893381 - protein, 9 aa, Entamoeba invadens
PMPPKDESV

SEQ ID NO: 2893382 - protein, 8 aa, Entamoeba invadens
PMQPPLND

SEQ ID NO: 2893383 - protein, 14 aa, Entamoeba invadens
PMRSRSTNNTMTSA

SEQ ID NO: 2893384 - protein, 6 aa, Entamoeba invadens
PMSDDE

SEQ ID NO: 2893385 - protein, 13 aa, Entamoeba invadens
PMSPLPTNESVRL

SEQ ID NO: 2893386 - protein, 4 aa, Entamoeba invadens
PMSS

SEQ ID NO: 2893387 - protein, 11 aa, Entamoeba invadens
PMTDDQEKEFK

SEQ ID NO: 2893388 - protein, 5 aa, Entamoeba invadens
PMTPP

SEQ ID NO: 2893389 - protein, 6 aa, Entamoeba invadens
PMTPSS

SEQ ID NO: 2893390 - protein, 17 aa, Entamoeba invadens
PMTQEEINKKYEQALQG

SEQ ID NO: 2893391 - protein, 11 aa, Entamoeba invadens
PMTREEAADFT

SEQ ID NO: 2893392 - protein, 11 aa, Entamoeba invadens
PMTREEAANFT

SEQ ID NO: 2893393 - protein, 39 aa, Entamoeba invadens
PMTSSESLEDDARVKSASKSEDVSKKVSDKKKQVKQDKE

SEQ ID NO: 2893394 - protein, 13 aa, Entamoeba invadens
PMTTKSAGIPNTQ

SEQ ID NO: 2893395 - protein, 8 aa, Entamoeba invadens
PMTTQTSY

SEQ ID NO: 2893396 - protein, 4 aa, Entamoeba invadens
PMVG

SEQ ID NO: 2893397 - protein, 15 aa, Entamoeba invadens
PMYPPPGPGGYPMGY

SEQ ID NO: 2893398 - protein, 10 aa, Entamoeba invadens
PNADGEDKTC

SEQ ID NO: 2893399 - protein, 6 aa, Entamoeba invadens
PNADLT

SEQ ID NO: 2893400 - protein, 18 aa, Entamoeba invadens
PNADNQDSYTETSTTGAA

SEQ ID NO: 2893401 - protein, 4 aa, Entamoeba invadens
PNAF

SEQ ID NO: 2893402 - protein, 10 aa, Entamoeba invadens
PNAFSGEDQM

SEQ ID NO: 2893403 - protein, 5 aa, Entamoeba invadens
PNAKY

SEQ ID NO: 2893404 - protein, 7 aa, Entamoeba invadens
PNALPEP

SEQ ID NO: 2893405 - protein, 10 aa, Entamoeba invadens
PNALPEPVTS

SEQ ID NO: 2893406 - protein, 7 aa, Entamoeba invadens
PNANFSE

SEQ ID NO: 2893407 - protein, 5 aa, Entamoeba invadens
PNAPE

SEQ ID NO: 2893408 - protein, 5 aa, Entamoeba invadens
PNAPK

SEQ ID NO: 2893409 - protein, 7 aa, Entamoeba invadens
PNAPPTL

SEQ ID NO: 2893410 - protein, 10 aa, Entamoeba invadens
PNARPTATQI

SEQ ID NO: 2893411 - protein, 12 aa, Entamoeba invadens
PNATDNSANTSF

SEQ ID NO: 2893412 - protein, 6 aa, Entamoeba invadens
PNCKNY

SEQ ID NO: 2893413 - protein, 5 aa, Entamoeba invadens
PNCKT

SEQ ID NO: 2893414 - protein, 12 aa, Entamoeba invadens
PNCNTCSSTERK

SEQ ID NO: 2893415 - protein, 4 aa, Entamoeba invadens
PNCP

SEQ ID NO: 2893416 - protein, 7 aa, Entamoeba invadens
PNCPEIS

SEQ ID NO: 2893417 - protein, 4 aa, Entamoeba invadens
PNDD

SEQ ID NO: 2893418 - protein, 4 aa, Entamoeba invadens
PNDG

SEQ ID NO: 2893419 - protein, 12 aa, Entamoeba invadens
PNDHNKKKSQIG

SEQ ID NO: 2893420 - protein, 4 aa, Entamoeba invadens
PNDI

SEQ ID NO: 2893421 - protein, 4 aa, Entamoeba invadens
PNDK

SEQ ID NO: 2893422 - protein, 5 aa, Entamoeba invadens
PNDKI

SEQ ID NO: 2893423 - protein, 11 aa, Entamoeba invadens
PNDKYPPNTGK

SEQ ID NO: 2893424 - protein, 5 aa, Entamoeba invadens
PNDLE

SEQ ID NO: 2893425 - protein, 9 aa, Entamoeba invadens
PNDNLRSGI

SEQ ID NO: 2893426 - protein, 7 aa, Entamoeba invadens
PNDPPQS

SEQ ID NO: 2893427 - protein, 11 aa, Entamoeba invadens
PNDRETQNFES

SEQ ID NO: 2893428 - protein, 19 aa, Entamoeba invadens
PNDRNSLSKVKNRKSELIK

SEQ ID NO: 2893429 - protein, 8 aa, Entamoeba invadens
PNDSQSFE

SEQ ID NO: 2893430 - protein, 5 aa, Entamoeba invadens
PNDSY

SEQ ID NO: 2893431 - protein, 12 aa, Entamoeba invadens
PNDVLDKTNTSI

SEQ ID NO: 2893432 - protein, 8 aa, Entamoeba invadens
PNEDEQKM

SEQ ID NO: 2893433 - protein, 5 aa, Entamoeba invadens
PNEDG

SEQ ID NO: 2893434 - protein, 9 aa, Entamoeba invadens
PNEDQQLQE

SEQ ID NO: 2893435 - protein, 4 aa, Entamoeba invadens
PNEE

SEQ ID NO: 2893436 - protein, 5 aa, Entamoeba invadens
PNEEG

SEQ ID NO: 2893437 - protein, 5 aa, Entamoeba invadens
PNEER

SEQ ID NO: 2893438 - protein, 10 aa, Entamoeba invadens
PNEFNNKYSN

SEQ ID NO: 2893439 - protein, 10 aa, Entamoeba invadens
PNEKEQDLYS

SEQ ID NO: 2893440 - protein, 5 aa, Entamoeba invadens
PNEKG

SEQ ID NO: 2893441 - protein, 8 aa, Entamoeba invadens
PNEKPLAD

SEQ ID NO: 2893442 - protein, 6 aa, Entamoeba invadens
PNEKQF

SEQ ID NO: 2893443 - protein, 5 aa, Entamoeba invadens
PNEKV

SEQ ID NO: 2893444 - protein, 7 aa, Entamoeba invadens
PNEKVNA

SEQ ID NO: 2893445 - protein, 6 aa, Entamoeba invadens
PNENAR

SEQ ID NO: 2893446 - protein, 10 aa, Entamoeba invadens
PNENDLPLDP

SEQ ID NO: 2893447 - protein, 6 aa, Entamoeba invadens
PNEQNR

SEQ ID NO: 2893448 - protein, 9 aa, Entamoeba invadens
PNESNTYTS

SEQ ID NO: 2893449 - protein, 7 aa, Entamoeba invadens
PNESREC

SEQ ID NO: 2893450 - protein, 6 aa, Entamoeba invadens
PNETEQ

SEQ ID NO: 2893451 - protein, 13 aa, Entamoeba invadens
PNETKKSQDWDAD

SEQ ID NO: 2893452 - protein, 9 aa, Entamoeba invadens
PNETPEISL

SEQ ID NO: 2893453 - protein, 5 aa, Entamoeba invadens
PNETT

SEQ ID NO: 2893454 - protein, 28 aa, Entamoeba invadens
PNETTQQTKQQQSVSKDSKQQEKTQQQS

SEQ ID NO: 2893455 - protein, 4 aa, Entamoeba invadens
PNEY

SEQ ID NO: 2893456 - protein, 6 aa, Entamoeba invadens
PNFENP

SEQ ID NO: 2893457 - protein, 6 aa, Entamoeba invadens
PNFREP

SEQ ID NO: 2893458 - protein, 6 aa, Entamoeba invadens
PNFSRE

SEQ ID NO: 2893459 - protein, 43 aa, Entamoeba invadens
PNFSSQDNGEIVDNQEERTNDESNEDGIEQTTNQNEDENINVE

SEQ ID NO: 2893460 - protein, 41 aa, Entamoeba invadens
PNFSSQENGEIVDNQEERTNDESNEDVIEQTTNQNEEENVE

SEQ ID NO: 2893461 - protein, 22 aa, Entamoeba invadens
PNFTNNPEDPYWTDEESEGSFV

SEQ ID NO: 2893462 - protein, 7 aa, Entamoeba invadens
PNFTSKI

SEQ ID NO: 2893463 - protein, 4 aa, Entamoeba invadens
PNGD

SEQ ID NO: 2893464 - protein, 6 aa, Entamoeba invadens
PNGDEL

SEQ ID NO: 2893465 - protein, 7 aa, Entamoeba invadens
PNGEGGV

SEQ ID NO: 2893466 - protein, 20 aa, Entamoeba invadens
PNGIGQDGPRTPPQQQPQPN

SEQ ID NO: 2893467 - protein, 8 aa, Entamoeba invadens
PNGISEIN

SEQ ID NO: 2893468 - protein, 7 aa, Entamoeba invadens
PNGITDK

SEQ ID NO: 2893469 - protein, 4 aa, Entamoeba invadens
PNGK

SEQ ID NO: 2893470 - protein, 10 aa, Entamoeba invadens
PNGKKGRYPI

SEQ ID NO: 2893471 - protein, 5 aa, Entamoeba invadens
PNGKT

SEQ ID NO: 2893472 - protein, 4 aa, Entamoeba invadens
PNGN

SEQ ID NO: 2893473 - protein, 5 aa, Entamoeba invadens
PNGNI

SEQ ID NO: 2893474 - protein, 6 aa, Entamoeba invadens
PNGPHV

SEQ ID NO: 2893475 - protein, 7 aa, Entamoeba invadens
PNGPNET

SEQ ID NO: 2893476 - protein, 5 aa, Entamoeba invadens
PNGPS

SEQ ID NO: 2893477 - protein, 5 aa, Entamoeba invadens
PNGSK

SEQ ID NO: 2893478 - protein, 6 aa, Entamoeba invadens
PNGSKH

SEQ ID NO: 2893479 - protein, 4 aa, Entamoeba invadens
PNGT

SEQ ID NO: 2893480 - protein, 5 aa, Entamoeba invadens
PNGTK

SEQ ID NO: 2893481 - protein, 7 aa, Entamoeba invadens
PNGTKTE

SEQ ID NO: 2893482 - protein, 7 aa, Entamoeba invadens
PNGTTVS

SEQ ID NO: 2893483 - protein, 4 aa, Entamoeba invadens
PNGV

SEQ ID NO: 2893484 - protein, 7 aa, Entamoeba invadens
PNGVSKI

SEQ ID NO: 2893485 - protein, 4 aa, Entamoeba invadens
PNGY

SEQ ID NO: 2893486 - protein, 9 aa, Entamoeba invadens
PNHDEKEDN

SEQ ID NO: 2893487 - protein, 5 aa, Entamoeba invadens
PNHDQ

SEQ ID NO: 2893488 - protein, 40 aa, Entamoeba invadens
PNHNEESDLGGMKENLGDEKEENEQVIEEKSKEEKNTTVL

SEQ ID NO: 2893489 - protein, 5 aa, Entamoeba invadens
PNHPI

SEQ ID NO: 2893490 - protein, 4 aa, Entamoeba invadens
PNID

SEQ ID NO: 2893491 - protein, 10 aa, Entamoeba invadens
PNIDSKSDFS

SEQ ID NO: 2893492 - protein, 10 aa, Entamoeba invadens
PNIGSTITST

SEQ ID NO: 2893493 - protein, 7 aa, Entamoeba invadens
PNINDPK

SEQ ID NO: 2893494 - protein, 7 aa, Entamoeba invadens
PNINKNG

SEQ ID NO: 2893495 - protein, 17 aa, Entamoeba invadens
PNINPKPNNYNSPNQMG

SEQ ID NO: 2893496 - protein, 4 aa, Entamoeba invadens
PNIR

SEQ ID NO: 2893497 - protein, 5 aa, Entamoeba invadens
PNISS

SEQ ID NO: 2893498 - protein, 5 aa, Entamoeba invadens
PNITS

SEQ ID NO: 2893499 - protein, 5 aa, Entamoeba invadens
PNKAC

SEQ ID NO: 2893500 - protein, 10 aa, Entamoeba invadens
PNKADSNPNY

SEQ ID NO: 2893501 - protein, 4 aa, Entamoeba invadens
PNKE

SEQ ID NO: 2893502 - protein, 17 aa, Entamoeba invadens
PNKEIQNKLDALVKSAK

SEQ ID NO: 2893503 - protein, 6 aa, Entamoeba invadens
PNKEKP

SEQ ID NO: 2893504 - protein, 8 aa, Entamoeba invadens
PNKENDSR

SEQ ID NO: 2893505 - protein, 9 aa, Entamoeba invadens
PNKENEKEM

SEQ ID NO: 2893506 - protein, 6 aa, Entamoeba invadens
PNKETI

SEQ ID NO: 2893507 - protein, 5 aa, Entamoeba invadens
PNKFR

SEQ ID NO: 2893508 - protein, 5 aa, Entamoeba invadens
PNKKA

SEQ ID NO: 2893509 - protein, 13 aa, Entamoeba invadens
PNKKFEGGYCIEI

SEQ ID NO: 2893510 - protein, 4 aa, Entamoeba invadens
PNKL

SEQ ID NO: 2893511 - protein, 9 aa, Entamoeba invadens
PNKLKEVSD

SEQ ID NO: 2893512 - protein, 15 aa, Entamoeba invadens
PNKLKPEFKKNDEDR

SEQ ID NO: 2893513 - protein, 19 aa, Entamoeba invadens
PNKLPQSLQTHDPKDISGI

SEQ ID NO: 2893514 - protein, 4 aa, Entamoeba invadens
PNKN

SEQ ID NO: 2893515 - protein, 5 aa, Entamoeba invadens
PNKRE

SEQ ID NO: 2893516 - protein, 5 aa, Entamoeba invadens
PNKRI

SEQ ID NO: 2893517 - protein, 8 aa, Entamoeba invadens
PNKRTESP

SEQ ID NO: 2893518 - protein, 8 aa, Entamoeba invadens
PNKSFTDY

SEQ ID NO: 2893519 - protein, 16 aa, Entamoeba invadens
PNKSGFCQEKPSEEIT

SEQ ID NO: 2893520 - protein, 9 aa, Entamoeba invadens
PNKSKYDLS

SEQ ID NO: 2893521 - protein, 11 aa, Entamoeba invadens
PNKSLATASTN

SEQ ID NO: 2893522 - protein, 10 aa, Entamoeba invadens
PNKSNANSIR

SEQ ID NO: 2893523 - protein, 5 aa, Entamoeba invadens
PNKSQ

SEQ ID NO: 2893524 - protein, 6 aa, Entamoeba invadens
PNKSRE

SEQ ID NO: 2893525 - protein, 4 aa, Entamoeba invadens
PNKT

SEQ ID NO: 2893526 - protein, 18 aa, Entamoeba invadens
PNKTAEIKPEHTPEAYKD

SEQ ID NO: 2893527 - protein, 10 aa, Entamoeba invadens
PNKTTKQTQY

SEQ ID NO: 2893528 - protein, 18 aa, Entamoeba invadens
PNLETTTQIVENEKKNPI

SEQ ID NO: 2893529 - protein, 4 aa, Entamoeba invadens
PNLK

SEQ ID NO: 2893530 - protein, 17 aa, Entamoeba invadens
PNLKDSKDDDVTAKAKN

SEQ ID NO: 2893531 - protein, 4 aa, Entamoeba invadens
PNLN

SEQ ID NO: 2893532 - protein, 13 aa, Entamoeba invadens
PNLPNTSNSKGFV

SEQ ID NO: 2893533 - protein, 8 aa, Entamoeba invadens
PNLQERTE

SEQ ID NO: 2893534 - protein, 11 aa, Entamoeba invadens
PNLQQRHSSTM

SEQ ID NO: 2893535 - protein, 7 aa, Entamoeba invadens
PNLQSGA

SEQ ID NO: 2893536 - protein, 9 aa, Entamoeba invadens
PNLRPTSEQ

SEQ ID NO: 2893537 - protein, 13 aa, Entamoeba invadens
PNLSGSSQNFSPA

SEQ ID NO: 2893538 - protein, 6 aa, Entamoeba invadens
PNLSPD

SEQ ID NO: 2893539 - protein, 8 aa, Entamoeba invadens
PNLTPNER

SEQ ID NO: 2893540 - protein, 5 aa, Entamoeba invadens
PNLTS

SEQ ID NO: 2893541 - protein, 7 aa, Entamoeba invadens
PNLTSEN

SEQ ID NO: 2893542 - protein, 4 aa, Entamoeba invadens
PNME

SEQ ID NO: 2893543 - protein, 4 aa, Entamoeba invadens
PNMG

SEQ ID NO: 2893544 - protein, 9 aa, Entamoeba invadens
PNMGGKSTY

SEQ ID NO: 2893545 - protein, 6 aa, Entamoeba invadens
PNMNPF

SEQ ID NO: 2893546 - protein, 6 aa, Entamoeba invadens
PNNAQV

SEQ ID NO: 2893547 - protein, 4 aa, Entamoeba invadens
PNNC

SEQ ID NO: 2893548 - protein, 11 aa, Entamoeba invadens
PNNENGKCTTT

SEQ ID NO: 2893549 - protein, 18 aa, Entamoeba invadens
PNNEQQNTQNNQTQQTTT

SEQ ID NO: 2893550 - protein, 7 aa, Entamoeba invadens
PNNKGNT

SEQ ID NO: 2893551 - protein, 8 aa, Entamoeba invadens
PNNKNSTV

SEQ ID NO: 2893552 - protein, 4 aa, Entamoeba invadens
PNNL

SEQ ID NO: 2893553 - protein, 5 aa, Entamoeba invadens
PNNPK

SEQ ID NO: 2893554 - protein, 18 aa, Entamoeba invadens
PNNRVTAANALTHQFLQV

SEQ ID NO: 2893555 - protein, 8 aa, Entamoeba invadens
PNNSNVKE

SEQ ID NO: 2893556 - protein, 8 aa, Entamoeba invadens
PNNSQSFE

SEQ ID NO: 2893557 - protein, 4 aa, Entamoeba invadens
PNNT

SEQ ID NO: 2893558 - protein, 14 aa, Entamoeba invadens
PNNTVTVTRPTETL

SEQ ID NO: 2893559 - protein, 7 aa, Entamoeba invadens
PNNVEKM

SEQ ID NO: 2893560 - protein, 7 aa, Entamoeba invadens
PNNVTSI

SEQ ID NO: 2893561 - protein, 8 aa, Entamoeba invadens
PNNVTSVG

SEQ ID NO: 2893562 - protein, 9 aa, Entamoeba invadens
PNPAAAAKL

SEQ ID NO: 2893563 - protein, 7 aa, Entamoeba invadens
PNPDDDE

SEQ ID NO: 2893564 - protein, 8 aa, Entamoeba invadens
PNPEDPLN

SEQ ID NO: 2893565 - protein, 6 aa, Entamoeba invadens
PNPENC

SEQ ID NO: 2893566 - protein, 7 aa, Entamoeba invadens
PNPESIS

SEQ ID NO: 2893567 - protein, 7 aa, Entamoeba invadens
PNPFASP

SEQ ID NO: 2893568 - protein, 7 aa, Entamoeba invadens
PNPFKNK

SEQ ID NO: 2893569 - protein, 6 aa, Entamoeba invadens
PNPFPE

SEQ ID NO: 2893570 - protein, 4 aa, Entamoeba invadens
PNPG

SEQ ID NO: 2893571 - protein, 5 aa, Entamoeba invadens
PNPIR

SEQ ID NO: 2893572 - protein, 5 aa, Entamoeba invadens
PNPLK

SEQ ID NO: 2893573 - protein, 5 aa, Entamoeba invadens
PNPLP

SEQ ID NO: 2893574 - protein, 13 aa, Entamoeba invadens
PNPLQPLSRNRPF

SEQ ID NO: 2893575 - protein, 13 aa, Entamoeba invadens
PNPNDPLNEQAGE

SEQ ID NO: 2893576 - protein, 5 aa, Entamoeba invadens
PNPNF

SEQ ID NO: 2893577 - protein, 7 aa, Entamoeba invadens
PNPPAVS

SEQ ID NO: 2893578 - protein, 6 aa, Entamoeba invadens
PNPPIA

SEQ ID NO: 2893579 - protein, 6 aa, Entamoeba invadens
PNPSKF

SEQ ID NO: 2893580 - protein, 9 aa, Entamoeba invadens
PNPSLGPSV

SEQ ID NO: 2893581 - protein, 17 aa, Entamoeba invadens
PNPSPIETTCEKTKKKY

SEQ ID NO: 2893582 - protein, 9 aa, Entamoeba invadens
PNPTLEDNS

SEQ ID NO: 2893583 - protein, 4 aa, Entamoeba invadens
PNPV

SEQ ID NO: 2893584 - protein, 5 aa, Entamoeba invadens
PNPWD

SEQ ID NO: 2893585 - protein, 5 aa, Entamoeba invadens
PNPYM

SEQ ID NO: 2893586 - protein, 17 aa, Entamoeba invadens
PNQEDDPQKLERKRHVG

SEQ ID NO: 2893587 - protein, 11 aa, Entamoeba invadens
PNQIPQKEDMG

SEQ ID NO: 2893588 - protein, 7 aa, Entamoeba invadens
PNQKGDF

SEQ ID NO: 2893589 - protein, 13 aa, Entamoeba invadens
PNQKGELKAASEL

SEQ ID NO: 2893590 - protein, 9 aa, Entamoeba invadens
PNQLDEDSV

SEQ ID NO: 2893591 - protein, 5 aa, Entamoeba invadens
PNQNT

SEQ ID NO: 2893592 - protein, 17 aa, Entamoeba invadens
PNQPDETQKLERKRHIG

SEQ ID NO: 2893593 - protein, 6 aa, Entamoeba invadens
PNQPHT

SEQ ID NO: 2893594 - protein, 5 aa, Entamoeba invadens
PNQQV

SEQ ID NO: 2893595 - protein, 7 aa, Entamoeba invadens
PNQRGKF

SEQ ID NO: 2893596 - protein, 4 aa, Entamoeba invadens
PNQS

SEQ ID NO: 2893597 - protein, 22 aa, Entamoeba invadens
PNQSDGETSNPSVLKNESERWE

SEQ ID NO: 2893598 - protein, 11 aa, Entamoeba invadens
PNQTDDESHPA

SEQ ID NO: 2893599 - protein, 6 aa, Entamoeba invadens
PNRESP

SEQ ID NO: 2893600 - protein, 31 aa, Entamoeba invadens
PNRFDDDEEEDDANAMEEEEDDEEVFEDEDD

SEQ ID NO: 2893601 - protein, 6 aa, Entamoeba invadens
PNRGEA

SEQ ID NO: 2893602 - protein, 4 aa, Entamoeba invadens
PNRK

SEQ ID NO: 2893603 - protein, 14 aa, Entamoeba invadens
PNRKDVTVDNTDTT

SEQ ID NO: 2893604 - protein, 10 aa, Entamoeba invadens
PNRKQFSNGG

SEQ ID NO: 2893605 - protein, 6 aa, Entamoeba invadens
PNRKTG

SEQ ID NO: 2893606 - protein, 8 aa, Entamoeba invadens
PNRNTTSR

SEQ ID NO: 2893607 - protein, 8 aa, Entamoeba invadens
PNRQSSLQ

SEQ ID NO: 2893608 - protein, 7 aa, Entamoeba invadens
PNRRVND

SEQ ID NO: 2893609 - protein, 22 aa, Entamoeba invadens
PNRSPSTTIDRSTMTNEPFHPN

SEQ ID NO: 2893610 - protein, 9 aa, Entamoeba invadens
PNRTKKQCK

SEQ ID NO: 2893611 - protein, 10 aa, Entamoeba invadens
PNRTKKQCRE

SEQ ID NO: 2893612 - protein, 8 aa, Entamoeba invadens
PNRTKYNL

SEQ ID NO: 2893613 - protein, 9 aa, Entamoeba invadens
PNRVNHNGE

SEQ ID NO: 2893614 - protein, 6 aa, Entamoeba invadens
PNRYRD

SEQ ID NO: 2893615 - protein, 6 aa, Entamoeba invadens
PNSAIQ

SEQ ID NO: 2893616 - protein, 19 aa, Entamoeba invadens
PNSDYCEKTHKPKNKGAIK

SEQ ID NO: 2893617 - protein, 13 aa, Entamoeba invadens
PNSDYCENTHKPN

SEQ ID NO: 2893618 - protein, 7 aa, Entamoeba invadens
PNSEAPT

SEQ ID NO: 2893619 - protein, 11 aa, Entamoeba invadens
PNSEKNIEKGQ

SEQ ID NO: 2893620 - protein, 11 aa, Entamoeba invadens
PNSEMYETEKG

SEQ ID NO: 2893621 - protein, 4 aa, Entamoeba invadens
PNSI

SEQ ID NO: 2893622 - protein, 8 aa, Entamoeba invadens
PNSIENPR

SEQ ID NO: 2893623 - protein, 18 aa, Entamoeba invadens
PNSIPSTDYQMQQQQYGV

SEQ ID NO: 2893624 - protein, 7 aa, Entamoeba invadens
PNSKFTR

SEQ ID NO: 2893625 - protein, 8 aa, Entamoeba invadens
PNSKKAKK

SEQ ID NO: 2893626 - protein, 10 aa, Entamoeba invadens
PNSKRTKKLG

SEQ ID NO: 2893627 - protein, 13 aa, Entamoeba invadens
PNSKYLATQNNSY

SEQ ID NO: 2893628 - protein, 4 aa, Entamoeba invadens
PNSL

SEQ ID NO: 2893629 - protein, 6 aa, Entamoeba invadens
PNSLTT

SEQ ID NO: 2893630 - protein, 8 aa, Entamoeba invadens
PNSNDQIV

SEQ ID NO: 2893631 - protein, 18 aa, Entamoeba invadens
PNSNEVECRTRSNTVGTI

SEQ ID NO: 2893632 - protein, 7 aa, Entamoeba invadens
PNSNPFN

SEQ ID NO: 2893633 - protein, 7 aa, Entamoeba invadens
PNSPPTL

SEQ ID NO: 2893634 - protein, 9 aa, Entamoeba invadens
PNSPYETNR

SEQ ID NO: 2893635 - protein, 9 aa, Entamoeba invadens
PNSQSNNTK

SEQ ID NO: 2893636 - protein, 9 aa, Entamoeba invadens
PNSRPTQVA

SEQ ID NO: 2893637 - protein, 6 aa, Entamoeba invadens
PNSSDY

SEQ ID NO: 2893638 - protein, 6 aa, Entamoeba invadens
PNSSIT

SEQ ID NO: 2893639 - protein, 11 aa, Entamoeba invadens
PNSSNAKGQEL

SEQ ID NO: 2893640 - protein, 9 aa, Entamoeba invadens
PNSSQNVSF

SEQ ID NO: 2893641 - protein, 4 aa, Entamoeba invadens
PNST

SEQ ID NO: 2893642 - protein, 7 aa, Entamoeba invadens
PNSTESE

SEQ ID NO: 2893643 - protein, 5 aa, Entamoeba invadens
PNSTG

SEQ ID NO: 2893644 - protein, 6 aa, Entamoeba invadens
PNSTKI

SEQ ID NO: 2893645 - protein, 8 aa, Entamoeba invadens
PNSTTIPG

SEQ ID NO: 2893646 - protein, 5 aa, Entamoeba invadens
PNSVK

SEQ ID NO: 2893647 - protein, 6 aa, Entamoeba invadens
PNSVTS

SEQ ID NO: 2893648 - protein, 7 aa, Entamoeba invadens
PNSVTSI

SEQ ID NO: 2893649 - protein, 6 aa, Entamoeba invadens
PNTDAT

SEQ ID NO: 2893650 - protein, 16 aa, Entamoeba invadens
PNTDTGSRKRKPQTIR

SEQ ID NO: 2893651 - protein, 8 aa, Entamoeba invadens
PNTEKSAL

SEQ ID NO: 2893652 - protein, 9 aa, Entamoeba invadens
PNTEPEDPI

SEQ ID NO: 2893653 - protein, 9 aa, Entamoeba invadens
PNTEQTVSN

SEQ ID NO: 2893654 - protein, 6 aa, Entamoeba invadens
PNTGKK

SEQ ID NO: 2893655 - protein, 5 aa, Entamoeba invadens
PNTHK

SEQ ID NO: 2893656 - protein, 4 aa, Entamoeba invadens
PNTI

SEQ ID NO: 2893657 - protein, 4 aa, Entamoeba invadens
PNTK

SEQ ID NO: 2893658 - protein, 11 aa, Entamoeba invadens
PNTKEKKNTHI

SEQ ID NO: 2893659 - protein, 12 aa, Entamoeba invadens
PNTKNKTNEYGF

SEQ ID NO: 2893660 - protein, 6 aa, Entamoeba invadens
PNTLEK

SEQ ID NO: 2893661 - protein, 6 aa, Entamoeba invadens
PNTNEQ

SEQ ID NO: 2893662 - protein, 12 aa, Entamoeba invadens
PNTNGEDNDGYT

SEQ ID NO: 2893663 - protein, 6 aa, Entamoeba invadens
PNTNKN

SEQ ID NO: 2893664 - protein, 19 aa, Entamoeba invadens
PNTNYEKRSVGRINPSTEK

SEQ ID NO: 2893665 - protein, 18 aa, Entamoeba invadens
PNTPTDLTQQTQQNNKME

SEQ ID NO: 2893666 - protein, 8 aa, Entamoeba invadens
PNTQSDQM

SEQ ID NO: 2893667 - protein, 11 aa, Entamoeba invadens
PNTQSSVTEKI

SEQ ID NO: 2893668 - protein, 6 aa, Entamoeba invadens
PNTRHY

SEQ ID NO: 2893669 - protein, 11 aa, Entamoeba invadens
PNTSLSQGDKV

SEQ ID NO: 2893670 - protein, 6 aa, Entamoeba invadens
PNTTFS

SEQ ID NO: 2893671 - protein, 6 aa, Entamoeba invadens
PNTTKY

SEQ ID NO: 2893672 - protein, 7 aa, Entamoeba invadens
PNTTSAK

SEQ ID NO: 2893673 - protein, 7 aa, Entamoeba invadens
PNTTTDT

SEQ ID NO: 2893674 - protein, 9 aa, Entamoeba invadens
PNTTTNEGK

SEQ ID NO: 2893675 - protein, 21 aa, Entamoeba invadens
PNTVTKEFKGTGVEDKLKKTQ

SEQ ID NO: 2893676 - protein, 6 aa, Entamoeba invadens
PNTYQT

SEQ ID NO: 2893677 - protein, 9 aa, Entamoeba invadens
PNVANYTQK

SEQ ID NO: 2893678 - protein, 4 aa, Entamoeba invadens
PNVC

SEQ ID NO: 2893679 - protein, 9 aa, Entamoeba invadens
PNVGKTSTI

SEQ ID NO: 2893680 - protein, 5 aa, Entamoeba invadens
PNVKD

SEQ ID NO: 2893681 - protein, 16 aa, Entamoeba invadens
PNVKESSIYCGFFIVP

SEQ ID NO: 2893682 - protein, 5 aa, Entamoeba invadens
PNVKS

SEQ ID NO: 2893683 - protein, 7 aa, Entamoeba invadens
PNVQGQT

SEQ ID NO: 2893684 - protein, 7 aa, Entamoeba invadens
PNVREPK

SEQ ID NO: 2893685 - protein, 7 aa, Entamoeba invadens
PNVTYGE

SEQ ID NO: 2893686 - protein, 5 aa, Entamoeba invadens
PNVYE

SEQ ID NO: 2893687 - protein, 5 aa, Entamoeba invadens
PNWNA

SEQ ID NO: 2893688 - protein, 4 aa, Entamoeba invadens
PNWR

SEQ ID NO: 2893689 - protein, 12 aa, Entamoeba invadens
PNYEQSCEGFER

SEQ ID NO: 2893690 - protein, 7 aa, Entamoeba invadens
PNYGGRC

SEQ ID NO: 2893691 - protein, 5 aa, Entamoeba invadens
PNYGK

SEQ ID NO: 2893692 - protein, 8 aa, Entamoeba invadens
PNYIDKNK

SEQ ID NO: 2893693 - protein, 4 aa, Entamoeba invadens
PNYK

SEQ ID NO: 2893694 - protein, 5 aa, Entamoeba invadens
PNYKA

SEQ ID NO: 2893695 - protein, 8 aa, Entamoeba invadens
PNYQPERS

SEQ ID NO: 2893696 - protein, 23 aa, Entamoeba invadens
PNYRSEEDISNKTGLRESRASDK

SEQ ID NO: 2893697 - protein, 7 aa, Entamoeba invadens
PNYSAPQ

SEQ ID NO: 2893698 - protein, 11 aa, Entamoeba invadens
PNYSDKDADKI

SEQ ID NO: 2893699 - protein, 13 aa, Entamoeba invadens
PNYSFNEKEEEEI

SEQ ID NO: 2893700 - protein, 9 aa, Entamoeba invadens
PNYSKGNLG

SEQ ID NO: 2893701 - protein, 7 aa, Entamoeba invadens
PNYSNKE

SEQ ID NO: 2893702 - protein, 6 aa, Entamoeba invadens
PNYYGY

SEQ ID NO: 2893703 - protein, 22 aa, Entamoeba invadens
PNYYNEDSDDYSTANGLNYHNG

SEQ ID NO: 2893704 - protein, 5 aa, Entamoeba invadens
PNYYS

SEQ ID NO: 2893705 - protein, 4 aa, Entamoeba invadens
PPAE

SEQ ID NO: 2893706 - protein, 11 aa, Entamoeba invadens
PPALPPPRKST

SEQ ID NO: 2893707 - protein, 5 aa, Entamoeba invadens
PPALS

SEQ ID NO: 2893708 - protein, 10 aa, Entamoeba invadens
PPANKDQIKA

SEQ ID NO: 2893709 - protein, 5 aa, Entamoeba invadens
PPANS

SEQ ID NO: 2893710 - protein, 7 aa, Entamoeba invadens
PPAPRNV

SEQ ID NO: 2893711 - protein, 30 aa, Entamoeba invadens
PPAQVSTATKTKKEDTTVVDTPTQNTTSER

SEQ ID NO: 2893712 - protein, 10 aa, Entamoeba invadens
PPASNKEGFV

SEQ ID NO: 2893713 - protein, 21 aa, Entamoeba invadens
PPAVRPQAVSDKGSRNNKDDL

SEQ ID NO: 2893714 - protein, 8 aa, Entamoeba invadens
PPCADTKT

SEQ ID NO: 2893715 - protein, 18 aa, Entamoeba invadens
PPDEGSLGDKISKNGITG

SEQ ID NO: 2893716 - protein, 10 aa, Entamoeba invadens
PPDELTSEDL

SEQ ID NO: 2893717 - protein, 9 aa, Entamoeba invadens
PPDETTKGI

SEQ ID NO: 2893718 - protein, 4 aa, Entamoeba invadens
PPDG

SEQ ID NO: 2893719 - protein, 5 aa, Entamoeba invadens
PPDGI

SEQ ID NO: 2893720 - protein, 15 aa, Entamoeba invadens
PPDPEEQKKKAPPRI

SEQ ID NO: 2893721 - protein, 15 aa, Entamoeba invadens
PPDPIPIPDPASKQS

SEQ ID NO: 2893722 - protein, 7 aa, Entamoeba invadens
PPDQSTQ

SEQ ID NO: 2893723 - protein, 7 aa, Entamoeba invadens
PPDTVTT

SEQ ID NO: 2893724 - protein, 7 aa, Entamoeba invadens
PPDTYYD

SEQ ID NO: 2893725 - protein, 13 aa, Entamoeba invadens
PPDVNDGTQQFAQ

SEQ ID NO: 2893726 - protein, 5 aa, Entamoeba invadens
PPDVS

SEQ ID NO: 2893727 - protein, 4 aa, Entamoeba invadens
PPDY

SEQ ID NO: 2893728 - protein, 6 aa, Entamoeba invadens
PPDYIT

SEQ ID NO: 2893729 - protein, 9 aa, Entamoeba invadens
PPEDDSKRM

SEQ ID NO: 2893730 - protein, 9 aa, Entamoeba invadens
PPEEKDWKV

SEQ ID NO: 2893731 - protein, 8 aa, Entamoeba invadens
PPEENYEQ

SEQ ID NO: 2893732 - protein, 19 aa, Entamoeba invadens
PPEETDDGSGLDNKAVSTK

SEQ ID NO: 2893733 - protein, 4 aa, Entamoeba invadens
PPEG

SEQ ID NO: 2893734 - protein, 7 aa, Entamoeba invadens
PPEGCTT

SEQ ID NO: 2893735 - protein, 13 aa, Entamoeba invadens
PPEGMNEGIEETT

SEQ ID NO: 2893736 - protein, 5 aa, Entamoeba invadens
PPEIK

SEQ ID NO: 2893737 - protein, 6 aa, Entamoeba invadens
PPEIPR

SEQ ID NO: 2893738 - protein, 4 aa, Entamoeba invadens
PPEK

SEQ ID NO: 2893739 - protein, 7 aa, Entamoeba invadens
PPEKDSL

SEQ ID NO: 2893740 - protein, 7 aa, Entamoeba invadens
PPEKSVN

SEQ ID NO: 2893741 - protein, 16 aa, Entamoeba invadens
PPELSEDSTAHPPKRY

SEQ ID NO: 2893742 - protein, 19 aa, Entamoeba invadens
PPENAKNPVETPEADPIKK

SEQ ID NO: 2893743 - protein, 18 aa, Entamoeba invadens
PPENMPSSQQPPKVPETI

SEQ ID NO: 2893744 - protein, 14 aa, Entamoeba invadens
PPENPPLASEATQK

SEQ ID NO: 2893745 - protein, 7 aa, Entamoeba invadens
PPENSEN

SEQ ID NO: 2893746 - protein, 6 aa, Entamoeba invadens
PPEPNG

SEQ ID NO: 2893747 - protein, 69 aa, Entamoeba invadens
PPEPVTQEEEQQLSEEPEQNIEEENNPPLPPVNPRRGLSHQNESQESQDQSAEQPQDDAPPPPPVNSRR

SEQ ID NO: 2893748 - protein, 4 aa, Entamoeba invadens
PPEQ

SEQ ID NO: 2893749 - protein, 5 aa, Entamoeba invadens
PPERK

SEQ ID NO: 2893750 - protein, 7 aa, Entamoeba invadens
PPESEKV

SEQ ID NO: 2893751 - protein, 7 aa, Entamoeba invadens
PPESFPQ

SEQ ID NO: 2893752 - protein, 5 aa, Entamoeba invadens
PPETV

SEQ ID NO: 2893753 - protein, 8 aa, Entamoeba invadens
PPEVTSPN

SEQ ID NO: 2893754 - protein, 8 aa, Entamoeba invadens
PPFENETG

SEQ ID NO: 2893755 - protein, 11 aa, Entamoeba invadens
PPFHADDDSAY

SEQ ID NO: 2893756 - protein, 6 aa, Entamoeba invadens
PPFIPS

SEQ ID NO: 2893757 - protein, 11 aa, Entamoeba invadens
PPFKGHSLSSI

SEQ ID NO: 2893758 - protein, 4 aa, Entamoeba invadens
PPFQ

SEQ ID NO: 2893759 - protein, 5 aa, Entamoeba invadens
PPFQN

SEQ ID NO: 2893760 - protein, 13 aa, Entamoeba invadens
PPFSDGDDGGNRQ

SEQ ID NO: 2893761 - protein, 8 aa, Entamoeba invadens
PPFTGSSE

SEQ ID NO: 2893762 - protein, 4 aa, Entamoeba invadens
PPFV

SEQ ID NO: 2893763 - protein, 4 aa, Entamoeba invadens
PPFY

SEQ ID NO: 2893764 - protein, 16 aa, Entamoeba invadens
PPGDDEFGYESAAERW

SEQ ID NO: 2893765 - protein, 7 aa, Entamoeba invadens
PPGDSVT

SEQ ID NO: 2893766 - protein, 11 aa, Entamoeba invadens
PPGEDEMSGEL

SEQ ID NO: 2893767 - protein, 6 aa, Entamoeba invadens
PPGEDL

SEQ ID NO: 2893768 - protein, 15 aa, Entamoeba invadens
PPGEREEKSDEPPLL

SEQ ID NO: 2893769 - protein, 6 aa, Entamoeba invadens
PPGGLS

SEQ ID NO: 2893770 - protein, 5 aa, Entamoeba invadens
PPGIP

SEQ ID NO: 2893771 - protein, 11 aa, Entamoeba invadens
PPGLKNPVELN

SEQ ID NO: 2893772 - protein, 6 aa, Entamoeba invadens
PPGQKC

SEQ ID NO: 2893773 - protein, 6 aa, Entamoeba invadens
PPGQTG

SEQ ID NO: 2893774 - protein, 9 aa, Entamoeba invadens
PPGSGKTTS

SEQ ID NO: 2893775 - protein, 7 aa, Entamoeba invadens
PPGTGKT

SEQ ID NO: 2893776 - protein, 7 aa, Entamoeba invadens
PPGVPTM

SEQ ID NO: 2893777 - protein, 16 aa, Entamoeba invadens
PPHDPRKDKLRPQSTF

SEQ ID NO: 2893778 - protein, 4 aa, Entamoeba invadens
PPHG

SEQ ID NO: 2893779 - protein, 7 aa, Entamoeba invadens
PPHGSSR

SEQ ID NO: 2893780 - protein, 4 aa, Entamoeba invadens
PPHK

SEQ ID NO: 2893781 - protein, 6 aa, Entamoeba invadens
PPHLPK

SEQ ID NO: 2893782 - protein, 4 aa, Entamoeba invadens
PPHN

SEQ ID NO: 2893783 - protein, 23 aa, Entamoeba invadens
PPHRPPLPAIPPPLPPKTYAEKH

SEQ ID NO: 2893784 - protein, 30 aa, Entamoeba invadens
PPHSATEPKRTSSTKPRSPSFRQPQPPQYA

SEQ ID NO: 2893785 - protein, 11 aa, Entamoeba invadens
PPHTQTPSQIV

SEQ ID NO: 2893786 - protein, 7 aa, Entamoeba invadens
PPIADPR

SEQ ID NO: 2893787 - protein, 11 aa, Entamoeba invadens
PPIERTKQKTM

SEQ ID NO: 2893788 - protein, 13 aa, Entamoeba invadens
PPIGQNGEESDVS

SEQ ID NO: 2893789 - protein, 9 aa, Entamoeba invadens
PPIKTKSDL

SEQ ID NO: 2893790 - protein, 6 aa, Entamoeba invadens
PPIPDT

SEQ ID NO: 2893791 - protein, 9 aa, Entamoeba invadens
PPIREKRNK

SEQ ID NO: 2893792 - protein, 12 aa, Entamoeba invadens
PPISENEPKPIQ

SEQ ID NO: 2893793 - protein, 12 aa, Entamoeba invadens
PPISQPSNNPIT

SEQ ID NO: 2893794 - protein, 4 aa, Entamoeba invadens
PPIT

SEQ ID NO: 2893795 - protein, 8 aa, Entamoeba invadens
PPITQDTD

SEQ ID NO: 2893796 - protein, 6 aa, Entamoeba invadens
PPITQI

SEQ ID NO: 2893797 - protein, 4 aa, Entamoeba invadens
PPKD

SEQ ID NO: 2893798 - protein, 10 aa, Entamoeba invadens
PPKEGDESFP

SEQ ID NO: 2893799 - protein, 7 aa, Entamoeba invadens
PPKIDPS

SEQ ID NO: 2893800 - protein, 8 aa, Entamoeba invadens
PPKKINQK

SEQ ID NO: 2893801 - protein, 11 aa, Entamoeba invadens
PPKKKERSKTC

SEQ ID NO: 2893802 - protein, 7 aa, Entamoeba invadens
PPKKLKV

SEQ ID NO: 2893803 - protein, 8 aa, Entamoeba invadens
PPKKRSTV

SEQ ID NO: 2893804 - protein, 4 aa, Entamoeba invadens
PPKL

SEQ ID NO: 2893805 - protein, 8 aa, Entamoeba invadens
PPKLPDSL

SEQ ID NO: 2893806 - protein, 6 aa, Entamoeba invadens
PPKLTT

SEQ ID NO: 2893807 - protein, 5 aa, Entamoeba invadens
PPKNI

SEQ ID NO: 2893808 - protein, 8 aa, Entamoeba invadens
PPKPINTS

SEQ ID NO: 2893809 - protein, 36 aa, Entamoeba invadens
PPKPRRLSQNKGKTIPKMEEEVSKVEKQDEEKHDPI

SEQ ID NO: 2893810 - protein, 7 aa, Entamoeba invadens
PPKPSYN

SEQ ID NO: 2893811 - protein, 14 aa, Entamoeba invadens
PPKPTDGSEEIGHI

SEQ ID NO: 2893812 - protein, 5 aa, Entamoeba invadens
PPKPV

SEQ ID NO: 2893813 - protein, 11 aa, Entamoeba invadens
PPKPVDTNQQI

SEQ ID NO: 2893814 - protein, 32 aa, Entamoeba invadens
PPKQSAKSSTSGEILKSPNENDEQLRNSTEEI

SEQ ID NO: 2893815 - protein, 7 aa, Entamoeba invadens
PPKQSLK

SEQ ID NO: 2893816 - protein, 11 aa, Entamoeba invadens
PPKRGEKTSVF

SEQ ID NO: 2893817 - protein, 8 aa, Entamoeba invadens
PPKRPEAE

SEQ ID NO: 2893818 - protein, 8 aa, Entamoeba invadens
PPKSVGTF

SEQ ID NO: 2893819 - protein, 7 aa, Entamoeba invadens
PPKTNME

SEQ ID NO: 2893820 - protein, 8 aa, Entamoeba invadens
PPKTQKVQ

SEQ ID NO: 2893821 - protein, 9 aa, Entamoeba invadens
PPKVENPEQ

SEQ ID NO: 2893822 - protein, 8 aa, Entamoeba invadens
PPKVNTPQ

SEQ ID NO: 2893823 - protein, 8 aa, Entamoeba invadens
PPKYGRNS

SEQ ID NO: 2893824 - protein, 6 aa, Entamoeba invadens
PPKYGY

SEQ ID NO: 2893825 - protein, 4 aa, Entamoeba invadens
PPLA

SEQ ID NO: 2893826 - protein, 25 aa, Entamoeba invadens
PPLAPPPLTTTTQTLPSSNAGRGDL

SEQ ID NO: 2893827 - protein, 5 aa, Entamoeba invadens
PPLDA

SEQ ID NO: 2893828 - protein, 13 aa, Entamoeba invadens
PPLEDNTPEVNQK

SEQ ID NO: 2893829 - protein, 5 aa, Entamoeba invadens
PPLEE

SEQ ID NO: 2893830 - protein, 12 aa, Entamoeba invadens
PPLEKAGTDQIT

SEQ ID NO: 2893831 - protein, 15 aa, Entamoeba invadens
PPLEKRKKRSTGKRV

SEQ ID NO: 2893832 - protein, 12 aa, Entamoeba invadens
PPLKPEQQEKMN

SEQ ID NO: 2893833 - protein, 28 aa, Entamoeba invadens
PPLKSGSDEEMKRDELNSLNGKPEKRTT

SEQ ID NO: 2893834 - protein, 4 aa, Entamoeba invadens
PPLL

SEQ ID NO: 2893835 - protein, 5 aa, Entamoeba invadens
PPLNE

SEQ ID NO: 2893836 - protein, 10 aa, Entamoeba invadens
PPLNGDCSES

SEQ ID NO: 2893837 - protein, 4 aa, Entamoeba invadens
PPLP

SEQ ID NO: 2893838 - protein, 6 aa, Entamoeba invadens
PPLPAR

SEQ ID NO: 2893839 - protein, 11 aa, Entamoeba invadens
PPLPDKQSPQR

SEQ ID NO: 2893840 - protein, 11 aa, Entamoeba invadens
PPLPKDKQSLE

SEQ ID NO: 2893841 - protein, 5 aa, Entamoeba invadens
PPLPL

SEQ ID NO: 2893842 - protein, 7 aa, Entamoeba invadens
PPLPLSG

SEQ ID NO: 2893843 - protein, 13 aa, Entamoeba invadens
PPLPPPRKRGKIQ

SEQ ID NO: 2893844 - protein, 13 aa, Entamoeba invadens
PPLPVQKKENEKF

SEQ ID NO: 2893845 - protein, 10 aa, Entamoeba invadens
PPLQNDSEVH

SEQ ID NO: 2893846 - protein, 10 aa, Entamoeba invadens
PPLSQNGKNM

SEQ ID NO: 2893847 - protein, 19 aa, Entamoeba invadens
PPLSRSPPSRKTRKTLTPH

SEQ ID NO: 2893848 - protein, 4 aa, Entamoeba invadens
PPLV

SEQ ID NO: 2893849 - protein, 7 aa, Entamoeba invadens
PPMGAPG

SEQ ID NO: 2893850 - protein, 11 aa, Entamoeba invadens
PPMKGKESQAA

SEQ ID NO: 2893851 - protein, 6 aa, Entamoeba invadens
PPMKKT

SEQ ID NO: 2893852 - protein, 14 aa, Entamoeba invadens
PPMKQNTSYQAKSE

SEQ ID NO: 2893853 - protein, 10 aa, Entamoeba invadens
PPMNPPENRE

SEQ ID NO: 2893854 - protein, 22 aa, Entamoeba invadens
PPMSPPFSDDEMSTSPDVTISL

SEQ ID NO: 2893855 - protein, 59 aa, Entamoeba invadens
PPMTAEQKEFAKQQSIQASKTAYSGAKKAVKTEEFKQASHQTASAAKAVATSKQAKGLC

SEQ ID NO: 2893856 - protein, 52 aa, Entamoeba invadens
PPMTDEQKEKAKTHAAQASKTAYSGAKKAVKTEEFQSAKKQTASAASSAVHS

SEQ ID NO: 2893857 - protein, 14 aa, Entamoeba invadens
PPMTKKDSKIEKPV

SEQ ID NO: 2893858 - protein, 20 aa, Entamoeba invadens
PPMTPGVGRMSDQPPMTPGV

SEQ ID NO: 2893859 - protein, 12 aa, Entamoeba invadens
PPNAKKKTSTTL

SEQ ID NO: 2893860 - protein, 11 aa, Entamoeba invadens
PPNAPDILPTS

SEQ ID NO: 2893861 - protein, 6 aa, Entamoeba invadens
PPNAPF

SEQ ID NO: 2893862 - protein, 10 aa, Entamoeba invadens
PPNAYNKSDY

SEQ ID NO: 2893863 - protein, 5 aa, Entamoeba invadens
PPNEK

SEQ ID NO: 2893864 - protein, 6 aa, Entamoeba invadens
PPNGDM

SEQ ID NO: 2893865 - protein, 10 aa, Entamoeba invadens
PPNGSQDDYE

SEQ ID NO: 2893866 - protein, 4 aa, Entamoeba invadens
PPNK

SEQ ID NO: 2893867 - protein, 4 aa, Entamoeba invadens
PPNN

SEQ ID NO: 2893868 - protein, 11 aa, Entamoeba invadens
PPNSERTRKVA

SEQ ID NO: 2893869 - protein, 7 aa, Entamoeba invadens
PPNSRPV

SEQ ID NO: 2893870 - protein, 17 aa, Entamoeba invadens
PPNSVTPTPGAKGEVNV

SEQ ID NO: 2893871 - protein, 5 aa, Entamoeba invadens
PPNTP

SEQ ID NO: 2893872 - protein, 5 aa, Entamoeba invadens
PPNVG

SEQ ID NO: 2893873 - protein, 12 aa, Entamoeba invadens
PPNVSEKNSKIN

SEQ ID NO: 2893874 - protein, 5 aa, Entamoeba invadens
PPNVT

SEQ ID NO: 2893875 - protein, 6 aa, Entamoeba invadens
PPPDVD

SEQ ID NO: 2893876 - protein, 6 aa, Entamoeba invadens
PPPEWN

SEQ ID NO: 2893877 - protein, 4 aa, Entamoeba invadens
PPPF

SEQ ID NO: 2893878 - protein, 5 aa, Entamoeba invadens
PPPFH

SEQ ID NO: 2893879 - protein, 5 aa, Entamoeba invadens
PPPFV

SEQ ID NO: 2893880 - protein, 6 aa, Entamoeba invadens
PPPGFS

SEQ ID NO: 2893881 - protein, 6 aa, Entamoeba invadens
PPPGMG

SEQ ID NO: 2893882 - protein, 4 aa, Entamoeba invadens
PPPI

SEQ ID NO: 2893883 - protein, 5 aa, Entamoeba invadens
PPPKS

SEQ ID NO: 2893884 - protein, 15 aa, Entamoeba invadens
PPPLPQSISEPPEHI

SEQ ID NO: 2893885 - protein, 4 aa, Entamoeba invadens
PPPP

SEQ ID NO: 2893886 - protein, 6 aa, Entamoeba invadens
PPPPFG

SEQ ID NO: 2893887 - protein, 38 aa, Entamoeba invadens
PPPPKRKPKKVLSKDTIGNPLTEKQKKLSKPHYERRAT

SEQ ID NO: 2893888 - protein, 26 aa, Entamoeba invadens
PPPPMPTDADSYHPPPEFKKDDQEDF

SEQ ID NO: 2893889 - protein, 5 aa, Entamoeba invadens
PPPPP

SEQ ID NO: 2893890 - protein, 7 aa, Entamoeba invadens
PPPPPPF

SEQ ID NO: 2893891 - protein, 4 aa, Entamoeba invadens
PPPR

SEQ ID NO: 2893892 - protein, 19 aa, Entamoeba invadens
PPPRDRERRYEKRFPPREQ

SEQ ID NO: 2893893 - protein, 11 aa, Entamoeba invadens
PPPSPSPKARN

SEQ ID NO: 2893894 - protein, 4 aa, Entamoeba invadens
PPPT

SEQ ID NO: 2893895 - protein, 6 aa, Entamoeba invadens
PPPTFD

SEQ ID NO: 2893896 - protein, 22 aa, Entamoeba invadens
PPPTGKGMRSSKEKTVEERPTS

SEQ ID NO: 2893897 - protein, 22 aa, Entamoeba invadens
PPPTGKGVRSSKEKTVEERPTS

SEQ ID NO: 2893898 - protein, 4 aa, Entamoeba invadens
PPPV

SEQ ID NO: 2893899 - protein, 27 aa, Entamoeba invadens
PPPVPPKRPYKEQRVVTPDRQLSKSVD

SEQ ID NO: 2893900 - protein, 7 aa, Entamoeba invadens
PPPYPDT

SEQ ID NO: 2893901 - protein, 5 aa, Entamoeba invadens
PPQIP

SEQ ID NO: 2893902 - protein, 8 aa, Entamoeba invadens
PPQIPKTK

SEQ ID NO: 2893903 - protein, 5 aa, Entamoeba invadens
PPQKK

SEQ ID NO: 2893904 - protein, 7 aa, Entamoeba invadens
PPQKVED

SEQ ID NO: 2893905 - protein, 16 aa, Entamoeba invadens
PPQLAKPKKKKNVTKD

SEQ ID NO: 2893906 - protein, 7 aa, Entamoeba invadens
PPQNPKI

SEQ ID NO: 2893907 - protein, 13 aa, Entamoeba invadens
PPQPDIQNMQDTS

SEQ ID NO: 2893908 - protein, 66 aa, Entamoeba invadens
PPQPRSPQDFQRPEYPPRLPQEYRQQQPDYNQQRNQQYQIPPVPQYGQDQRQQYQQPPYPPYQQQD

SEQ ID NO: 2893909 - protein, 25 aa, Entamoeba invadens
PPQQLERRDQGVDNLTTKDVIDPSS

SEQ ID NO: 2893910 - protein, 12 aa, Entamoeba invadens
PPQQNTSRSQYQ

SEQ ID NO: 2893911 - protein, 14 aa, Entamoeba invadens
PPQQRENELPDLKT

SEQ ID NO: 2893912 - protein, 7 aa, Entamoeba invadens
PPQSLQQ

SEQ ID NO: 2893913 - protein, 4 aa, Entamoeba invadens
PPQT

SEQ ID NO: 2893914 - protein, 4 aa, Entamoeba invadens
PPQV

SEQ ID NO: 2893915 - protein, 5 aa, Entamoeba invadens
PPQYG

SEQ ID NO: 2893916 - protein, 7 aa, Entamoeba invadens
PPRAAGK

SEQ ID NO: 2893917 - protein, 9 aa, Entamoeba invadens
PPRDSNPIK

SEQ ID NO: 2893918 - protein, 4 aa, Entamoeba invadens
PPRG

SEQ ID NO: 2893919 - protein, 10 aa, Entamoeba invadens
PPRGGINPKA

SEQ ID NO: 2893920 - protein, 8 aa, Entamoeba invadens
PPRGTNPI

SEQ ID NO: 2893921 - protein, 4 aa, Entamoeba invadens
PPRP

SEQ ID NO: 2893922 - protein, 49 aa, Entamoeba invadens
PPRPNSMMTGKSVKKARIRREEDEEPMRKPLNRDAKNASKAKTLKECKT

SEQ ID NO: 2893923 - protein, 98 aa, Entamoeba invadens
PPRPPMKQRASPQIQKSEEVKEAVSAANVQQSKPDLTKQKTAPQLPPQRRTQPALPKQQTTPINKTLKPTPQTVKNEQPLQKSEPEKAEDKGDKTDFR

SEQ ID NO: 2893924 - protein, 8 aa, Entamoeba invadens
PPRRDEHT

SEQ ID NO: 2893925 - protein, 6 aa, Entamoeba invadens
PPRSKE

SEQ ID NO: 2893926 - protein, 5 aa, Entamoeba invadens
PPRSV

SEQ ID NO: 2893927 - protein, 4 aa, Entamoeba invadens
PPRY

SEQ ID NO: 2893928 - protein, 13 aa, Entamoeba invadens
PPRYKATGKEPKV

SEQ ID NO: 2893929 - protein, 16 aa, Entamoeba invadens
PPSAEPLRSFPPGTQL

SEQ ID NO: 2893930 - protein, 5 aa, Entamoeba invadens
PPSAL

SEQ ID NO: 2893931 - protein, 28 aa, Entamoeba invadens
PPSAPPPKAPKYKPQQRDDLNSGFLLED

SEQ ID NO: 2893932 - protein, 5 aa, Entamoeba invadens
PPSCP

SEQ ID NO: 2893933 - protein, 4 aa, Entamoeba invadens
PPSE

SEQ ID NO: 2893934 - protein, 6 aa, Entamoeba invadens
PPSFDN

SEQ ID NO: 2893935 - protein, 56 aa, Entamoeba invadens
PPSFNTPQNSKTQEDTLPPKSEIIESDPVSPLKSPKISQLADSTNATDTKQEQKKS

SEQ ID NO: 2893936 - protein, 5 aa, Entamoeba invadens
PPSFV

SEQ ID NO: 2893937 - protein, 8 aa, Entamoeba invadens
PPSGPDAW

SEQ ID NO: 2893938 - protein, 7 aa, Entamoeba invadens
PPSGPEA

SEQ ID NO: 2893939 - protein, 13 aa, Entamoeba invadens
PPSHETTYTPNNK

SEQ ID NO: 2893940 - protein, 4 aa, Entamoeba invadens
PPSI

SEQ ID NO: 2893941 - protein, 12 aa, Entamoeba invadens
PPSINSSCSDFS

SEQ ID NO: 2893942 - protein, 14 aa, Entamoeba invadens
PPSKGKRTENGREF

SEQ ID NO: 2893943 - protein, 8 aa, Entamoeba invadens
PPSKPSNL

SEQ ID NO: 2893944 - protein, 26 aa, Entamoeba invadens
PPSKYSQTPQKQHLTTGSPVNTTQPQ

SEQ ID NO: 2893945 - protein, 6 aa, Entamoeba invadens
PPSLPS

SEQ ID NO: 2893946 - protein, 11 aa, Entamoeba invadens
PPSLPTSSSRI

SEQ ID NO: 2893947 - protein, 5 aa, Entamoeba invadens
PPSLQ

SEQ ID NO: 2893948 - protein, 7 aa, Entamoeba invadens
PPSPESM

SEQ ID NO: 2893949 - protein, 19 aa, Entamoeba invadens
PPSPNRVSTENKHTRHDTD

SEQ ID NO: 2893950 - protein, 6 aa, Entamoeba invadens
PPSPPM

SEQ ID NO: 2893951 - protein, 17 aa, Entamoeba invadens
PPSPQSNDSKTNYSTTS

SEQ ID NO: 2893952 - protein, 8 aa, Entamoeba invadens
PPSPRDGI

SEQ ID NO: 2893953 - protein, 8 aa, Entamoeba invadens
PPSPSPLI

SEQ ID NO: 2893954 - protein, 12 aa, Entamoeba invadens
PPSQEEELFKEL

SEQ ID NO: 2893955 - protein, 13 aa, Entamoeba invadens
PPSQVDGWIVKYN

SEQ ID NO: 2893956 - protein, 4 aa, Entamoeba invadens
PPSR

SEQ ID NO: 2893957 - protein, 10 aa, Entamoeba invadens
PPSSLSPRGG

SEQ ID NO: 2893958 - protein, 4 aa, Entamoeba invadens
PPST

SEQ ID NO: 2893959 - protein, 5 aa, Entamoeba invadens
PPSTL

SEQ ID NO: 2893960 - protein, 6 aa, Entamoeba invadens
PPSTRL

SEQ ID NO: 2893961 - protein, 5 aa, Entamoeba invadens
PPSVA

SEQ ID NO: 2893962 - protein, 7 aa, Entamoeba invadens
PPSVSVQ

SEQ ID NO: 2893963 - protein, 5 aa, Entamoeba invadens
PPSVT

SEQ ID NO: 2893964 - protein, 5 aa, Entamoeba invadens
PPSYQ

SEQ ID NO: 2893965 - protein, 7 aa, Entamoeba invadens
PPSYTPE

SEQ ID NO: 2893966 - protein, 6 aa, Entamoeba invadens
PPSYYT

SEQ ID NO: 2893967 - protein, 6 aa, Entamoeba invadens
PPTDPS

SEQ ID NO: 2893968 - protein, 5 aa, Entamoeba invadens
PPTDR

SEQ ID NO: 2893969 - protein, 10 aa, Entamoeba invadens
PPTEDPTHYE

SEQ ID NO: 2893970 - protein, 5 aa, Entamoeba invadens
PPTEN

SEQ ID NO: 2893971 - protein, 8 aa, Entamoeba invadens
PPTETTEW

SEQ ID NO: 2893972 - protein, 16 aa, Entamoeba invadens
PPTIGEQQLERKRHVG

SEQ ID NO: 2893973 - protein, 4 aa, Entamoeba invadens
PPTL

SEQ ID NO: 2893974 - protein, 4 aa, Entamoeba invadens
PPTM

SEQ ID NO: 2893975 - protein, 5 aa, Entamoeba invadens
PPTNL

SEQ ID NO: 2893976 - protein, 6 aa, Entamoeba invadens
PPTNNV

SEQ ID NO: 2893977 - protein, 14 aa, Entamoeba invadens
PPTPEDPRITTSPY

SEQ ID NO: 2893978 - protein, 15 aa, Entamoeba invadens
PPTPKLNDTVDTDYN

SEQ ID NO: 2893979 - protein, 20 aa, Entamoeba invadens
PPTPPKPQRLGRVNDKQTMP

SEQ ID NO: 2893980 - protein, 5 aa, Entamoeba invadens
PPTPV

SEQ ID NO: 2893981 - protein, 6 aa, Entamoeba invadens
PPTQTV

SEQ ID NO: 2893982 - protein, 5 aa, Entamoeba invadens
PPTST

SEQ ID NO: 2893983 - protein, 4 aa, Entamoeba invadens
PPTT

SEQ ID NO: 2893984 - protein, 5 aa, Entamoeba invadens
PPTTP

SEQ ID NO: 2893985 - protein, 5 aa, Entamoeba invadens
PPTTR

SEQ ID NO: 2893986 - protein, 8 aa, Entamoeba invadens
PPTTYKET

SEQ ID NO: 2893987 - protein, 5 aa, Entamoeba invadens
PPTVE

SEQ ID NO: 2893988 - protein, 7 aa, Entamoeba invadens
PPTYTNN

SEQ ID NO: 2893989 - protein, 16 aa, Entamoeba invadens
PPVDSTSTSQATTPSK

SEQ ID NO: 2893990 - protein, 6 aa, Entamoeba invadens
PPVEPH

SEQ ID NO: 2893991 - protein, 8 aa, Entamoeba invadens
PPVGSSQI

SEQ ID NO: 2893992 - protein, 7 aa, Entamoeba invadens
PPVGTTH

SEQ ID NO: 2893993 - protein, 4 aa, Entamoeba invadens
PPVI

SEQ ID NO: 2893994 - protein, 11 aa, Entamoeba invadens
PPVKTTQKDIN

SEQ ID NO: 2893995 - protein, 4 aa, Entamoeba invadens
PPVP

SEQ ID NO: 2893996 - protein, 5 aa, Entamoeba invadens
PPVPD

SEQ ID NO: 2893997 - protein, 39 aa, Entamoeba invadens
PPVPPKRKGPEKTNQNTDEKSENEKKIDEEKERLRKENE

SEQ ID NO: 2893998 - protein, 9 aa, Entamoeba invadens
PPVTSEGNL

SEQ ID NO: 2893999 - protein, 27 aa, Entamoeba invadens
PPVTTGNDGDNSDDNSSSNSDDEFNEN

SEQ ID NO: 2894000 - protein, 4 aa, Entamoeba invadens
PPYD

SEQ ID NO: 2894001 - protein, 5 aa, Entamoeba invadens
PPYKG

SEQ ID NO: 2894002 - protein, 5 aa, Entamoeba invadens
PPYKN

SEQ ID NO: 2894003 - protein, 7 aa, Entamoeba invadens
PPYMEDP

SEQ ID NO: 2894004 - protein, 4 aa, Entamoeba invadens
PPYP

SEQ ID NO: 2894005 - protein, 8 aa, Entamoeba invadens
PPYPSKDI

SEQ ID NO: 2894006 - protein, 6 aa, Entamoeba invadens
PPYPTV

SEQ ID NO: 2894007 - protein, 5 aa, Entamoeba invadens
PPYQR

SEQ ID NO: 2894008 - protein, 5 aa, Entamoeba invadens
PPYSL

SEQ ID NO: 2894009 - protein, 5 aa, Entamoeba invadens
PPYYP

SEQ ID NO: 2894010 - protein, 11 aa, Entamoeba invadens
PQADANREGHL

SEQ ID NO: 2894011 - protein, 5 aa, Entamoeba invadens
PQAGD

SEQ ID NO: 2894012 - protein, 10 aa, Entamoeba invadens
PQALKKSPFP

SEQ ID NO: 2894013 - protein, 7 aa, Entamoeba invadens
PQALQST

SEQ ID NO: 2894014 - protein, 5 aa, Entamoeba invadens
PQAMN

SEQ ID NO: 2894015 - protein, 6 aa, Entamoeba invadens
PQAMSD

SEQ ID NO: 2894016 - protein, 7 aa, Entamoeba invadens
PQASTTL

SEQ ID NO: 2894017 - protein, 9 aa, Entamoeba invadens
PQATPDQKE

SEQ ID NO: 2894018 - protein, 5 aa, Entamoeba invadens
PQDAF

SEQ ID NO: 2894019 - protein, 26 aa, Entamoeba invadens
PQDFEPNRPPPQPPQYTEKKSDHPEA

SEQ ID NO: 2894020 - protein, 7 aa, Entamoeba invadens
PQDKGDK

SEQ ID NO: 2894021 - protein, 13 aa, Entamoeba invadens
PQDKNTVPSNKKA

SEQ ID NO: 2894022 - protein, 6 aa, Entamoeba invadens
PQDKSL

SEQ ID NO: 2894023 - protein, 28 aa, Entamoeba invadens
PQDLKDAYKKAADEIENDKSVIEFTKNK

SEQ ID NO: 2894024 - protein, 6 aa, Entamoeba invadens
PQDPIK

SEQ ID NO: 2894025 - protein, 9 aa, Entamoeba invadens
PQDRATADS

SEQ ID NO: 2894026 - protein, 7 aa, Entamoeba invadens
PQDRPFI

SEQ ID NO: 2894027 - protein, 15 aa, Entamoeba invadens
PQDSMSEESANDDTQ

SEQ ID NO: 2894028 - protein, 4 aa, Entamoeba invadens
PQDT

SEQ ID NO: 2894029 - protein, 6 aa, Entamoeba invadens
PQDTPK

SEQ ID NO: 2894030 - protein, 6 aa, Entamoeba invadens
PQDVES

SEQ ID NO: 2894031 - protein, 18 aa, Entamoeba invadens
PQEAVSPQLGDDNEYSRM

SEQ ID NO: 2894032 - protein, 13 aa, Entamoeba invadens
PQEDCKKNMERRL

SEQ ID NO: 2894033 - protein, 22 aa, Entamoeba invadens
PQEEDEEEYEPAIPTKEDELEK

SEQ ID NO: 2894034 - protein, 8 aa, Entamoeba invadens
PQEETTTL

SEQ ID NO: 2894035 - protein, 26 aa, Entamoeba invadens
PQEEVDNKEVSIEVKDKDNSLLSTRV

SEQ ID NO: 2894036 - protein, 4 aa, Entamoeba invadens
PQEI

SEQ ID NO: 2894037 - protein, 7 aa, Entamoeba invadens
PQEKCDG

SEQ ID NO: 2894038 - protein, 7 aa, Entamoeba invadens
PQEKPMK

SEQ ID NO: 2894039 - protein, 12 aa, Entamoeba invadens
PQEKTKLCPPNR

SEQ ID NO: 2894040 - protein, 4 aa, Entamoeba invadens
PQEL

SEQ ID NO: 2894041 - protein, 9 aa, Entamoeba invadens
PQELNKYKA

SEQ ID NO: 2894042 - protein, 11 aa, Entamoeba invadens
PQENKESELPV

SEQ ID NO: 2894043 - protein, 18 aa, Entamoeba invadens
PQEPKKLETFQDKSQQIR

SEQ ID NO: 2894044 - protein, 12 aa, Entamoeba invadens
PQEQTQDVQTFF

SEQ ID NO: 2894045 - protein, 4 aa, Entamoeba invadens
PQET

SEQ ID NO: 2894046 - protein, 4 aa, Entamoeba invadens
PQEV

SEQ ID NO: 2894047 - protein, 7 aa, Entamoeba invadens
PQEVNSV

SEQ ID NO: 2894048 - protein, 4 aa, Entamoeba invadens
PQEY

SEQ ID NO: 2894049 - protein, 9 aa, Entamoeba invadens
PQEYSSSED

SEQ ID NO: 2894050 - protein, 5 aa, Entamoeba invadens
PQFPG

SEQ ID NO: 2894051 - protein, 5 aa, Entamoeba invadens
PQFPQ

SEQ ID NO: 2894052 - protein, 17 aa, Entamoeba invadens
PQFPQQNPITRSGPMSF

SEQ ID NO: 2894053 - protein, 10 aa, Entamoeba invadens
PQFRRKSSHK

SEQ ID NO: 2894054 - protein, 5 aa, Entamoeba invadens
PQFSQ

SEQ ID NO: 2894055 - protein, 8 aa, Entamoeba invadens
PQGDEELL

SEQ ID NO: 2894056 - protein, 12 aa, Entamoeba invadens
PQGDQETTFQKD

SEQ ID NO: 2894057 - protein, 5 aa, Entamoeba invadens
PQGDV

SEQ ID NO: 2894058 - protein, 4 aa, Entamoeba invadens
PQGE

SEQ ID NO: 2894059 - protein, 8 aa, Entamoeba invadens
PQGEIPEE

SEQ ID NO: 2894060 - protein, 4 aa, Entamoeba invadens
PQGI

SEQ ID NO: 2894061 - protein, 5 aa, Entamoeba invadens
PQGLN

SEQ ID NO: 2894062 - protein, 4 aa, Entamoeba invadens
PQGS

SEQ ID NO: 2894063 - protein, 7 aa, Entamoeba invadens
PQGTVRS

SEQ ID NO: 2894064 - protein, 4 aa, Entamoeba invadens
PQHA

SEQ ID NO: 2894065 - protein, 21 aa, Entamoeba invadens
PQHAKRQPDADELLQHVAWII

SEQ ID NO: 2894066 - protein, 36 aa, Entamoeba invadens
PQHKAQKSRVKNQLKKKEKSGSTVRHKQSNQQKKNI

SEQ ID NO: 2894067 - protein, 10 aa, Entamoeba invadens
PQHSTESDGK

SEQ ID NO: 2894068 - protein, 5 aa, Entamoeba invadens
PQHVD

SEQ ID NO: 2894069 - protein, 4 aa, Entamoeba invadens
PQIG

SEQ ID NO: 2894070 - protein, 6 aa, Entamoeba invadens
PQIHGT

SEQ ID NO: 2894071 - protein, 9 aa, Entamoeba invadens
PQIKQNQEL

SEQ ID NO: 2894072 - protein, 38 aa, Entamoeba invadens
PQINPDHKDKKDKDKKDKKDKDHKDKDHKDKDKKDKKK

SEQ ID NO: 2894073 - protein, 14 aa, Entamoeba invadens
PQINTNEIKEEHIG

SEQ ID NO: 2894074 - protein, 6 aa, Entamoeba invadens
PQIPDS

SEQ ID NO: 2894075 - protein, 6 aa, Entamoeba invadens
PQIPTV

SEQ ID NO: 2894076 - protein, 5 aa, Entamoeba invadens
PQIRA

SEQ ID NO: 2894077 - protein, 5 aa, Entamoeba invadens
PQITE

SEQ ID NO: 2894078 - protein, 4 aa, Entamoeba invadens
PQKD

SEQ ID NO: 2894079 - protein, 12 aa, Entamoeba invadens
PQKDEDLRSEGS

SEQ ID NO: 2894080 - protein, 12 aa, Entamoeba invadens
PQKEAPKPNFAS

SEQ ID NO: 2894081 - protein, 9 aa, Entamoeba invadens
PQKEEEQQT

SEQ ID NO: 2894082 - protein, 17 aa, Entamoeba invadens
PQKEERSAVDESVDQVS

SEQ ID NO: 2894083 - protein, 7 aa, Entamoeba invadens
PQKEHGN

SEQ ID NO: 2894084 - protein, 5 aa, Entamoeba invadens
PQKEI

SEQ ID NO: 2894085 - protein, 11 aa, Entamoeba invadens
PQKEKSKEDVK

SEQ ID NO: 2894086 - protein, 7 aa, Entamoeba invadens
PQKGCPQ

SEQ ID NO: 2894087 - protein, 5 aa, Entamoeba invadens
PQKIQ

SEQ ID NO: 2894088 - protein, 8 aa, Entamoeba invadens
PQKKKSNV

SEQ ID NO: 2894089 - protein, 8 aa, Entamoeba invadens
PQKLIDDN

SEQ ID NO: 2894090 - protein, 10 aa, Entamoeba invadens
PQKMPSNQFK

SEQ ID NO: 2894091 - protein, 9 aa, Entamoeba invadens
PQKNDMKNE

SEQ ID NO: 2894092 - protein, 13 aa, Entamoeba invadens
PQKPMKEKKTTEM

SEQ ID NO: 2894093 - protein, 17 aa, Entamoeba invadens
PQKPMKKLKTESERCEG

SEQ ID NO: 2894094 - protein, 11 aa, Entamoeba invadens
PQKPTAVVQEP

SEQ ID NO: 2894095 - protein, 19 aa, Entamoeba invadens
PQKQRRPRLPEKGSLKSKS

SEQ ID NO: 2894096 - protein, 4 aa, Entamoeba invadens
PQKR

SEQ ID NO: 2894097 - protein, 5 aa, Entamoeba invadens
PQKRE

SEQ ID NO: 2894098 - protein, 4 aa, Entamoeba invadens
PQKS

SEQ ID NO: 2894099 - protein, 7 aa, Entamoeba invadens
PQKSDMT

SEQ ID NO: 2894100 - protein, 15 aa, Entamoeba invadens
PQKSFKNSKTSKIKG

SEQ ID NO: 2894101 - protein, 25 aa, Entamoeba invadens
PQKSQLAEWTSQAKVNAEGKVVRST

SEQ ID NO: 2894102 - protein, 5 aa, Entamoeba invadens
PQKSV

SEQ ID NO: 2894103 - protein, 5 aa, Entamoeba invadens
PQKTE

SEQ ID NO: 2894104 - protein, 5 aa, Entamoeba invadens
PQKTM

SEQ ID NO: 2894105 - protein, 8 aa, Entamoeba invadens
PQKTPNDL

SEQ ID NO: 2894106 - protein, 14 aa, Entamoeba invadens
PQKTVTVEGSPTVK

SEQ ID NO: 2894107 - protein, 4 aa, Entamoeba invadens
PQKV

SEQ ID NO: 2894108 - protein, 8 aa, Entamoeba invadens
PQKVQSSS

SEQ ID NO: 2894109 - protein, 5 aa, Entamoeba invadens
PQLDP

SEQ ID NO: 2894110 - protein, 8 aa, Entamoeba invadens
PQLKSSQY

SEQ ID NO: 2894111 - protein, 27 aa, Entamoeba invadens
PQLPPPPMDKIEPNELEESGVTVEKDE

SEQ ID NO: 2894112 - protein, 6 aa, Entamoeba invadens
PQLPTN

SEQ ID NO: 2894113 - protein, 10 aa, Entamoeba invadens
PQLRKKKSFV

SEQ ID NO: 2894114 - protein, 16 aa, Entamoeba invadens
PQLVTRKGDKKGESKV

SEQ ID NO: 2894115 - protein, 4 aa, Entamoeba invadens
PQLY

SEQ ID NO: 2894116 - protein, 4 aa, Entamoeba invadens
PQMG

SEQ ID NO: 2894117 - protein, 11 aa, Entamoeba invadens
PQMKKESAGVK

SEQ ID NO: 2894118 - protein, 7 aa, Entamoeba invadens
PQMPPDV

SEQ ID NO: 2894119 - protein, 9 aa, Entamoeba invadens
PQMTKNEAK

SEQ ID NO: 2894120 - protein, 7 aa, Entamoeba invadens
PQNDPEI

SEQ ID NO: 2894121 - protein, 10 aa, Entamoeba invadens
PQNDSEINDS

SEQ ID NO: 2894122 - protein, 4 aa, Entamoeba invadens
PQNG

SEQ ID NO: 2894123 - protein, 6 aa, Entamoeba invadens
PQNGEA

SEQ ID NO: 2894124 - protein, 6 aa, Entamoeba invadens
PQNGRY

SEQ ID NO: 2894125 - protein, 9 aa, Entamoeba invadens
PQNGTGVSV

SEQ ID NO: 2894126 - protein, 7 aa, Entamoeba invadens
PQNGVYN

SEQ ID NO: 2894127 - protein, 4 aa, Entamoeba invadens
PQNM

SEQ ID NO: 2894128 - protein, 10 aa, Entamoeba invadens
PQNNPSQTYA

SEQ ID NO: 2894129 - protein, 5 aa, Entamoeba invadens
PQNNQ

SEQ ID NO: 2894130 - protein, 13 aa, Entamoeba invadens
PQNNSTEPSATEY

SEQ ID NO: 2894131 - protein, 4 aa, Entamoeba invadens
PQNP

SEQ ID NO: 2894132 - protein, 45 aa, Entamoeba invadens
PQNPKLSKSENPSKNVKHKKRYSQKFKEDRQCEKTGKKISLRKSS

SEQ ID NO: 2894133 - protein, 10 aa, Entamoeba invadens
PQNPLDDRVQ

SEQ ID NO: 2894134 - protein, 7 aa, Entamoeba invadens
PQNQTTY

SEQ ID NO: 2894135 - protein, 4 aa, Entamoeba invadens
PQNR

SEQ ID NO: 2894136 - protein, 9 aa, Entamoeba invadens
PQNRPKVTS

SEQ ID NO: 2894137 - protein, 9 aa, Entamoeba invadens
PQNSPIPNR

SEQ ID NO: 2894138 - protein, 19 aa, Entamoeba invadens
PQNTHKNMNDTIQRNTQHE

SEQ ID NO: 2894139 - protein, 4 aa, Entamoeba invadens
PQNV

SEQ ID NO: 2894140 - protein, 13 aa, Entamoeba invadens
PQNVGQPQMNPQM

SEQ ID NO: 2894141 - protein, 5 aa, Entamoeba invadens
PQNVT

SEQ ID NO: 2894142 - protein, 8 aa, Entamoeba invadens
PQNYTSPV

SEQ ID NO: 2894143 - protein, 4 aa, Entamoeba invadens
PQPD

SEQ ID NO: 2894144 - protein, 12 aa, Entamoeba invadens
PQPEPEYQNENT

SEQ ID NO: 2894145 - protein, 5 aa, Entamoeba invadens
PQPGS

SEQ ID NO: 2894146 - protein, 4 aa, Entamoeba invadens
PQPI

SEQ ID NO: 2894147 - protein, 5 aa, Entamoeba invadens
PQPNL

SEQ ID NO: 2894148 - protein, 5 aa, Entamoeba invadens
PQPNP

SEQ ID NO: 2894149 - protein, 7 aa, Entamoeba invadens
PQPNTRI

SEQ ID NO: 2894150 - protein, 16 aa, Entamoeba invadens
PQPPVVSTAPVASPVV

SEQ ID NO: 2894151 - protein, 5 aa, Entamoeba invadens
PQPQV

SEQ ID NO: 2894152 - protein, 6 aa, Entamoeba invadens
PQPTLP

SEQ ID NO: 2894153 - protein, 5 aa, Entamoeba invadens
PQPVK

SEQ ID NO: 2894154 - protein, 9 aa, Entamoeba invadens
PQQADSNAK

SEQ ID NO: 2894155 - protein, 4 aa, Entamoeba invadens
PQQF

SEQ ID NO: 2894156 - protein, 5 aa, Entamoeba invadens
PQQGA

SEQ ID NO: 2894157 - protein, 10 aa, Entamoeba invadens
PQQGPTSQFS

SEQ ID NO: 2894158 - protein, 5 aa, Entamoeba invadens
PQQIQ

SEQ ID NO: 2894159 - protein, 4 aa, Entamoeba invadens
PQQL

SEQ ID NO: 2894160 - protein, 22 aa, Entamoeba invadens
PQQNDVENKTEKPAMNEDTESI

SEQ ID NO: 2894161 - protein, 7 aa, Entamoeba invadens
PQQNNAP

SEQ ID NO: 2894162 - protein, 4 aa, Entamoeba invadens
PQQP

SEQ ID NO: 2894163 - protein, 7 aa, Entamoeba invadens
PQQPEQE

SEQ ID NO: 2894164 - protein, 7 aa, Entamoeba invadens
PQQPPEP

SEQ ID NO: 2894165 - protein, 27 aa, Entamoeba invadens
PQQPTGFTANSNSYPKTSSTGNGITLP

SEQ ID NO: 2894166 - protein, 13 aa, Entamoeba invadens
PQQPVQQRTPQEI

SEQ ID NO: 2894167 - protein, 17 aa, Entamoeba invadens
PQQQAASSAVPKEQAGC

SEQ ID NO: 2894168 - protein, 20 aa, Entamoeba invadens
PQQQNQYGQFPQQQNPSPMQ

SEQ ID NO: 2894169 - protein, 35 aa, Entamoeba invadens
PQQQPIQQQQDRQQTKYSPYAQMPPMQKPQQYQSM

SEQ ID NO: 2894170 - protein, 19 aa, Entamoeba invadens
PQQQQGQQQGQQPQQQCQT

SEQ ID NO: 2894171 - protein, 106 aa, Entamoeba invadens
PQQQQQQQYKQYPQQQYQQQSQQQYNPNPYGQQQTQFKTNPYTVDTQQRQNSYAQAPQQNYQQQQPTYGQAPQPYGQQQPQQQYGQYQQPGYQPYQPYGQQGNFPH

SEQ ID NO: 2894172 - protein, 29 aa, Entamoeba invadens
PQQQQTQQQSTSVPQQKFPIPQKQTAQQQ

SEQ ID NO: 2894173 - protein, 7 aa, Entamoeba invadens
PQQRKTS

SEQ ID NO: 2894174 - protein, 10 aa, Entamoeba invadens
PQQTQPTQQY

SEQ ID NO: 2894175 - protein, 5 aa, Entamoeba invadens
PQQYY

SEQ ID NO: 2894176 - protein, 12 aa, Entamoeba invadens
PQRETPQPLKHS

SEQ ID NO: 2894177 - protein, 21 aa, Entamoeba invadens
PQRGGAVPSQSRLNDFSKSEV

SEQ ID NO: 2894178 - protein, 7 aa, Entamoeba invadens
PQRIPSD

SEQ ID NO: 2894179 - protein, 22 aa, Entamoeba invadens
PQRKQETKKQSEDKENKDDDLS

SEQ ID NO: 2894180 - protein, 5 aa, Entamoeba invadens
PQRLD

SEQ ID NO: 2894181 - protein, 7 aa, Entamoeba invadens
PQRPSDK

SEQ ID NO: 2894182 - protein, 6 aa, Entamoeba invadens
PQRTPL

SEQ ID NO: 2894183 - protein, 6 aa, Entamoeba invadens
PQRTSF

SEQ ID NO: 2894184 - protein, 4 aa, Entamoeba invadens
PQRY

SEQ ID NO: 2894185 - protein, 8 aa, Entamoeba invadens
PQSAAPLR

SEQ ID NO: 2894186 - protein, 10 aa, Entamoeba invadens
PQSDGIDDKM

SEQ ID NO: 2894187 - protein, 7 aa, Entamoeba invadens
PQSEDPH

SEQ ID NO: 2894188 - protein, 5 aa, Entamoeba invadens
PQSEY

SEQ ID NO: 2894189 - protein, 4 aa, Entamoeba invadens
PQSF

SEQ ID NO: 2894190 - protein, 11 aa, Entamoeba invadens
PQSFKDKNYDN

SEQ ID NO: 2894191 - protein, 6 aa, Entamoeba invadens
PQSGEV

SEQ ID NO: 2894192 - protein, 6 aa, Entamoeba invadens
PQSNWA

SEQ ID NO: 2894193 - protein, 19 aa, Entamoeba invadens
PQSPLSPQYTEPQSITKSA

SEQ ID NO: 2894194 - protein, 21 aa, Entamoeba invadens
PQSPPKSPKRIHSPILSRVIH

SEQ ID NO: 2894195 - protein, 8 aa, Entamoeba invadens
PQSQSLPD

SEQ ID NO: 2894196 - protein, 4 aa, Entamoeba invadens
PQSR

SEQ ID NO: 2894197 - protein, 11 aa, Entamoeba invadens
PQSRPQSVEEE

SEQ ID NO: 2894198 - protein, 4 aa, Entamoeba invadens
PQSS

SEQ ID NO: 2894199 - protein, 7 aa, Entamoeba invadens
PQSTGNN

SEQ ID NO: 2894200 - protein, 6 aa, Entamoeba invadens
PQSTPI

SEQ ID NO: 2894201 - protein, 4 aa, Entamoeba invadens
PQSV

SEQ ID NO: 2894202 - protein, 10 aa, Entamoeba invadens
PQSVCGSQSP

SEQ ID NO: 2894203 - protein, 10 aa, Entamoeba invadens
PQSVEQSARE

SEQ ID NO: 2894204 - protein, 5 aa, Entamoeba invadens
PQSYQ

SEQ ID NO: 2894205 - protein, 23 aa, Entamoeba invadens
PQTAYEPKPNAQVSQAQIPPNQT

SEQ ID NO: 2894206 - protein, 4 aa, Entamoeba invadens
PQTD

SEQ ID NO: 2894207 - protein, 7 aa, Entamoeba invadens
PQTEEAR

SEQ ID NO: 2894208 - protein, 11 aa, Entamoeba invadens
PQTEQKEVAPI

SEQ ID NO: 2894209 - protein, 4 aa, Entamoeba invadens
PQTH

SEQ ID NO: 2894210 - protein, 9 aa, Entamoeba invadens
PQTHDEKTF

SEQ ID NO: 2894211 - protein, 16 aa, Entamoeba invadens
PQTIPRNQLQQEGMSN

SEQ ID NO: 2894212 - protein, 24 aa, Entamoeba invadens
PQTKKEDNVETPKEKSKSEEEWTS

SEQ ID NO: 2894213 - protein, 7 aa, Entamoeba invadens
PQTKNGT

SEQ ID NO: 2894214 - protein, 14 aa, Entamoeba invadens
PQTKQQQPKAMECV

SEQ ID NO: 2894215 - protein, 4 aa, Entamoeba invadens
PQTL

SEQ ID NO: 2894216 - protein, 6 aa, Entamoeba invadens
PQTLPQ

SEQ ID NO: 2894217 - protein, 5 aa, Entamoeba invadens
PQTPK

SEQ ID NO: 2894218 - protein, 12 aa, Entamoeba invadens
PQTPLSQSVQSQ

SEQ ID NO: 2894219 - protein, 41 aa, Entamoeba invadens
PQTQAEVQQVQTQSKEEIVEKTATEVKQPIPQEAKPKEQEV

SEQ ID NO: 2894220 - protein, 56 aa, Entamoeba invadens
PQTQKIDEKKASLVQESVSSSYSSSCGRKPSPPKYGNVSPNSFSPSPTKSTKADPF

SEQ ID NO: 2894221 - protein, 20 aa, Entamoeba invadens
PQTQNSPVAPIEQPPVITPS

SEQ ID NO: 2894222 - protein, 9 aa, Entamoeba invadens
PQTQQPLAN

SEQ ID NO: 2894223 - protein, 7 aa, Entamoeba invadens
PQTQQPT

SEQ ID NO: 2894224 - protein, 5 aa, Entamoeba invadens
PQTQR

SEQ ID NO: 2894225 - protein, 8 aa, Entamoeba invadens
PQTRPPWD

SEQ ID NO: 2894226 - protein, 4 aa, Entamoeba invadens
PQTS

SEQ ID NO: 2894227 - protein, 7 aa, Entamoeba invadens
PQTTEPT

SEQ ID NO: 2894228 - protein, 9 aa, Entamoeba invadens
PQTTKELGK

SEQ ID NO: 2894229 - protein, 8 aa, Entamoeba invadens
PQTVASDS

SEQ ID NO: 2894230 - protein, 5 aa, Entamoeba invadens
PQVDD

SEQ ID NO: 2894231 - protein, 4 aa, Entamoeba invadens
PQVE

SEQ ID NO: 2894232 - protein, 29 aa, Entamoeba invadens
PQVKHQEKQQQVLPQSTQNNIYTPPTQHQ

SEQ ID NO: 2894233 - protein, 14 aa, Entamoeba invadens
PQVPQEPPKKKFQC

SEQ ID NO: 2894234 - protein, 28 aa, Entamoeba invadens
PQVPRSRTPSPRPRGAEGGTEHVYEELP

SEQ ID NO: 2894235 - protein, 7 aa, Entamoeba invadens
PQVSARK

SEQ ID NO: 2894236 - protein, 22 aa, Entamoeba invadens
PQYDDYDDYDNHDYQNQSRCTL

SEQ ID NO: 2894237 - protein, 10 aa, Entamoeba invadens
PQYDGNASPL

SEQ ID NO: 2894238 - protein, 25 aa, Entamoeba invadens
PQYEKTADLPEKLETTKKKEENVER

SEQ ID NO: 2894239 - protein, 7 aa, Entamoeba invadens
PQYPQGL

SEQ ID NO: 2894240 - protein, 9 aa, Entamoeba invadens
PQYPTGPAE

SEQ ID NO: 2894241 - protein, 4 aa, Entamoeba invadens
PQYQ

SEQ ID NO: 2894242 - protein, 5 aa, Entamoeba invadens
PQYSN

SEQ ID NO: 2894243 - protein, 4 aa, Entamoeba invadens
PQYT

SEQ ID NO: 2894244 - protein, 5 aa, Entamoeba invadens
PQYTS

SEQ ID NO: 2894245 - protein, 12 aa, Entamoeba invadens
PRACKGAPMPRF

SEQ ID NO: 2894246 - protein, 18 aa, Entamoeba invadens
PRAVPGNTQQVNAKKQHF

SEQ ID NO: 2894247 - protein, 10 aa, Entamoeba invadens
PRDDETSECF

SEQ ID NO: 2894248 - protein, 5 aa, Entamoeba invadens
PRDFA

SEQ ID NO: 2894249 - protein, 7 aa, Entamoeba invadens
PRDGVNA

SEQ ID NO: 2894250 - protein, 19 aa, Entamoeba invadens
PRDKLNGNLVGRENSDDNM

SEQ ID NO: 2894251 - protein, 29 aa, Entamoeba invadens
PRDPADIEEADDDDEVNSITKTQLSDDDL

SEQ ID NO: 2894252 - protein, 5 aa, Entamoeba invadens
PRDQF

SEQ ID NO: 2894253 - protein, 5 aa, Entamoeba invadens
PRDSF

SEQ ID NO: 2894254 - protein, 13 aa, Entamoeba invadens
PRDYPMKDNGILP

SEQ ID NO: 2894255 - protein, 4 aa, Entamoeba invadens
PREA

SEQ ID NO: 2894256 - protein, 7 aa, Entamoeba invadens
PREAQRD

SEQ ID NO: 2894257 - protein, 4 aa, Entamoeba invadens
PREE

SEQ ID NO: 2894258 - protein, 6 aa, Entamoeba invadens
PREENK

SEQ ID NO: 2894259 - protein, 42 aa, Entamoeba invadens
PREEPVEVNSTSSEEESPVRPKRTRHKQMKQDEEEEKKRVEE

SEQ ID NO: 2894260 - protein, 6 aa, Entamoeba invadens
PREGAG

SEQ ID NO: 2894261 - protein, 9 aa, Entamoeba invadens
PREGNGDSF

SEQ ID NO: 2894262 - protein, 5 aa, Entamoeba invadens
PREGP

SEQ ID NO: 2894263 - protein, 13 aa, Entamoeba invadens
PREHSHSSSDGIL

SEQ ID NO: 2894264 - protein, 11 aa, Entamoeba invadens
PREIKTKNNTN

SEQ ID NO: 2894265 - protein, 9 aa, Entamoeba invadens
PREKEKKGE

SEQ ID NO: 2894266 - protein, 6 aa, Entamoeba invadens
PREKYV

SEQ ID NO: 2894267 - protein, 9 aa, Entamoeba invadens
PRENPLPEH

SEQ ID NO: 2894268 - protein, 12 aa, Entamoeba invadens
PREPKDEQSLER

SEQ ID NO: 2894269 - protein, 4 aa, Entamoeba invadens
PRES

SEQ ID NO: 2894270 - protein, 10 aa, Entamoeba invadens
PRETEEGTTY

SEQ ID NO: 2894271 - protein, 4 aa, Entamoeba invadens
PREV

SEQ ID NO: 2894272 - protein, 8 aa, Entamoeba invadens
PRFDSNTS

SEQ ID NO: 2894273 - protein, 5 aa, Entamoeba invadens
PRFTP

SEQ ID NO: 2894274 - protein, 6 aa, Entamoeba invadens
PRGATV

SEQ ID NO: 2894275 - protein, 7 aa, Entamoeba invadens
PRGDEEL

SEQ ID NO: 2894276 - protein, 5 aa, Entamoeba invadens
PRGIF

SEQ ID NO: 2894277 - protein, 6 aa, Entamoeba invadens
PRGKQN

SEQ ID NO: 2894278 - protein, 14 aa, Entamoeba invadens
PRGMYTSGRGSSAV

SEQ ID NO: 2894279 - protein, 15 aa, Entamoeba invadens
PRGNNQKELEKQTGA

SEQ ID NO: 2894280 - protein, 11 aa, Entamoeba invadens
PRGNPEEEFTG

SEQ ID NO: 2894281 - protein, 9 aa, Entamoeba invadens
PRGSADDNT

SEQ ID NO: 2894282 - protein, 6 aa, Entamoeba invadens
PRGSIP

SEQ ID NO: 2894283 - protein, 7 aa, Entamoeba invadens
PRGSSIP

SEQ ID NO: 2894284 - protein, 8 aa, Entamoeba invadens
PRGSTSDN

SEQ ID NO: 2894285 - protein, 8 aa, Entamoeba invadens
PRGTNAKM

SEQ ID NO: 2894286 - protein, 8 aa, Entamoeba invadens
PRGTNPIL

SEQ ID NO: 2894287 - protein, 5 aa, Entamoeba invadens
PRGVG

SEQ ID NO: 2894288 - protein, 5 aa, Entamoeba invadens
PRHPM

SEQ ID NO: 2894289 - protein, 4 aa, Entamoeba invadens
PRIE

SEQ ID NO: 2894290 - protein, 14 aa, Entamoeba invadens
PRINESKIIYNIRN

SEQ ID NO: 2894291 - protein, 9 aa, Entamoeba invadens
PRIPRNSRT

SEQ ID NO: 2894292 - protein, 4 aa, Entamoeba invadens
PRIT

SEQ ID NO: 2894293 - protein, 16 aa, Entamoeba invadens
PRKAESPKESPRSGSK

SEQ ID NO: 2894294 - protein, 7 aa, Entamoeba invadens
PRKDGRR

SEQ ID NO: 2894295 - protein, 12 aa, Entamoeba invadens
PRKEERKGDLFV

SEQ ID NO: 2894296 - protein, 11 aa, Entamoeba invadens
PRKENKVKPVD

SEQ ID NO: 2894297 - protein, 7 aa, Entamoeba invadens
PRKETDW

SEQ ID NO: 2894298 - protein, 4 aa, Entamoeba invadens
PRKF

SEQ ID NO: 2894299 - protein, 7 aa, Entamoeba invadens
PRKKEKI

SEQ ID NO: 2894300 - protein, 10 aa, Entamoeba invadens
PRKKSETSQF

SEQ ID NO: 2894301 - protein, 6 aa, Entamoeba invadens
PRKKSI

SEQ ID NO: 2894302 - protein, 9 aa, Entamoeba invadens
PRKNMSNDT

SEQ ID NO: 2894303 - protein, 10 aa, Entamoeba invadens
PRKNTPSTTS

SEQ ID NO: 2894304 - protein, 7 aa, Entamoeba invadens
PRKQSSV

SEQ ID NO: 2894305 - protein, 5 aa, Entamoeba invadens
PRKRG

SEQ ID NO: 2894306 - protein, 13 aa, Entamoeba invadens
PRKRGMKEGEEYS

SEQ ID NO: 2894307 - protein, 5 aa, Entamoeba invadens
PRKSS

SEQ ID NO: 2894308 - protein, 5 aa, Entamoeba invadens
PRKTD

SEQ ID NO: 2894309 - protein, 7 aa, Entamoeba invadens
PRKTPNY

SEQ ID NO: 2894310 - protein, 18 aa, Entamoeba invadens
PRKTPTPNAVKKSPEEAM

SEQ ID NO: 2894311 - protein, 4 aa, Entamoeba invadens
PRKY

SEQ ID NO: 2894312 - protein, 4 aa, Entamoeba invadens
PRLE

SEQ ID NO: 2894313 - protein, 5 aa, Entamoeba invadens
PRLED

SEQ ID NO: 2894314 - protein, 46 aa, Entamoeba invadens
PRLEPRGYDRYDSRGYDRVQDRYSPRPDPRTDPRIPFDPRGERLER

SEQ ID NO: 2894315 - protein, 13 aa, Entamoeba invadens
PRLGEVQKDKNEN

SEQ ID NO: 2894316 - protein, 9 aa, Entamoeba invadens
PRLNSTAEF

SEQ ID NO: 2894317 - protein, 11 aa, Entamoeba invadens
PRLRSSTPSNV

SEQ ID NO: 2894318 - protein, 10 aa, Entamoeba invadens
PRMTHTPASD

SEQ ID NO: 2894319 - protein, 8 aa, Entamoeba invadens
PRNDTDWD

SEQ ID NO: 2894320 - protein, 5 aa, Entamoeba invadens
PRNDY

SEQ ID NO: 2894321 - protein, 20 aa, Entamoeba invadens
PRNEENKSSWYAQADKAGID

SEQ ID NO: 2894322 - protein, 5 aa, Entamoeba invadens
PRNFE

SEQ ID NO: 2894323 - protein, 17 aa, Entamoeba invadens
PRNKDRKCVPEEDHKRG

SEQ ID NO: 2894324 - protein, 7 aa, Entamoeba invadens
PRNKRDQ

SEQ ID NO: 2894325 - protein, 8 aa, Entamoeba invadens
PRNPPIRP

SEQ ID NO: 2894326 - protein, 8 aa, Entamoeba invadens
PRNPQSSQ

SEQ ID NO: 2894327 - protein, 13 aa, Entamoeba invadens
PRNPVPPPGPIQQ

SEQ ID NO: 2894328 - protein, 16 aa, Entamoeba invadens
PRPEYAEHTYTTNEVG

SEQ ID NO: 2894329 - protein, 6 aa, Entamoeba invadens
PRPFEY

SEQ ID NO: 2894330 - protein, 4 aa, Entamoeba invadens
PRPI

SEQ ID NO: 2894331 - protein, 6 aa, Entamoeba invadens
PRPIQQ

SEQ ID NO: 2894332 - protein, 36 aa, Entamoeba invadens
PRPKRTRKGKTEDEPSQKVSEEYNESTQREGEIQTD

SEQ ID NO: 2894333 - protein, 4 aa, Entamoeba invadens
PRPM

SEQ ID NO: 2894334 - protein, 8 aa, Entamoeba invadens
PRPNDFGS

SEQ ID NO: 2894335 - protein, 7 aa, Entamoeba invadens
PRPNNFK

SEQ ID NO: 2894336 - protein, 10 aa, Entamoeba invadens
PRPQHSADPA

SEQ ID NO: 2894337 - protein, 7 aa, Entamoeba invadens
PRPSAKA

SEQ ID NO: 2894338 - protein, 9 aa, Entamoeba invadens
PRPSKKTIQ

SEQ ID NO: 2894339 - protein, 4 aa, Entamoeba invadens
PRPT

SEQ ID NO: 2894340 - protein, 14 aa, Entamoeba invadens
PRPTETNKRPSGIG

SEQ ID NO: 2894341 - protein, 14 aa, Entamoeba invadens
PRPTNLVKPEEKSL

SEQ ID NO: 2894342 - protein, 7 aa, Entamoeba invadens
PRPVSAT

SEQ ID NO: 2894343 - protein, 8 aa, Entamoeba invadens
PRPYKTTY

SEQ ID NO: 2894344 - protein, 12 aa, Entamoeba invadens
PRQDQLSSSSPN

SEQ ID NO: 2894345 - protein, 4 aa, Entamoeba invadens
PRQK

SEQ ID NO: 2894346 - protein, 10 aa, Entamoeba invadens
PRQRSSAKRV

SEQ ID NO: 2894347 - protein, 7 aa, Entamoeba invadens
PRQTDPV

SEQ ID NO: 2894348 - protein, 7 aa, Entamoeba invadens
PRQVPQV

SEQ ID NO: 2894349 - protein, 4 aa, Entamoeba invadens
PRRI

SEQ ID NO: 2894350 - protein, 9 aa, Entamoeba invadens
PRRKTDEYY

SEQ ID NO: 2894351 - protein, 4 aa, Entamoeba invadens
PRRQ

SEQ ID NO: 2894352 - protein, 6 aa, Entamoeba invadens
PRRQTS

SEQ ID NO: 2894353 - protein, 6 aa, Entamoeba invadens
PRRRNT

SEQ ID NO: 2894354 - protein, 27 aa, Entamoeba invadens
PRRSDTVSEKTDKHSRKQSESSETEAH

SEQ ID NO: 2894355 - protein, 31 aa, Entamoeba invadens
PRRSSDKSLYSKRDLEKPTFPTKNNTTKPKV

SEQ ID NO: 2894356 - protein, 6 aa, Entamoeba invadens
PRRSTL

SEQ ID NO: 2894357 - protein, 19 aa, Entamoeba invadens
PRRTLRKSQHSASKSVSDR

SEQ ID NO: 2894358 - protein, 15 aa, Entamoeba invadens
PRRWGRSEDNNEIPK

SEQ ID NO: 2894359 - protein, 7 aa, Entamoeba invadens
PRSAEES

SEQ ID NO: 2894360 - protein, 4 aa, Entamoeba invadens
PRSE

SEQ ID NO: 2894361 - protein, 19 aa, Entamoeba invadens
PRSEGIQTNTQLETSAKGI

SEQ ID NO: 2894362 - protein, 9 aa, Entamoeba invadens
PRSFSDSGI

SEQ ID NO: 2894363 - protein, 8 aa, Entamoeba invadens
PRSFSNDR

SEQ ID NO: 2894364 - protein, 11 aa, Entamoeba invadens
PRSGYMTEKSG

SEQ ID NO: 2894365 - protein, 14 aa, Entamoeba invadens
PRSITGNSTPKEKC

SEQ ID NO: 2894366 - protein, 11 aa, Entamoeba invadens
PRSKSHDLQNE

SEQ ID NO: 2894367 - protein, 13 aa, Entamoeba invadens
PRSPKKGHSYVKN

SEQ ID NO: 2894368 - protein, 5 aa, Entamoeba invadens
PRSRI

SEQ ID NO: 2894369 - protein, 13 aa, Entamoeba invadens
PRSVKDKETGKIN

SEQ ID NO: 2894370 - protein, 4 aa, Entamoeba invadens
PRTA

SEQ ID NO: 2894371 - protein, 12 aa, Entamoeba invadens
PRTCQKCDECKC

SEQ ID NO: 2894372 - protein, 4 aa, Entamoeba invadens
PRTE

SEQ ID NO: 2894373 - protein, 7 aa, Entamoeba invadens
PRTEGGD

SEQ ID NO: 2894374 - protein, 26 aa, Entamoeba invadens
PRTELTEQKDNELKEQKETKVGRRHF

SEQ ID NO: 2894375 - protein, 9 aa, Entamoeba invadens
PRTHKPRDH

SEQ ID NO: 2894376 - protein, 11 aa, Entamoeba invadens
PRTNKENPHPI

SEQ ID NO: 2894377 - protein, 9 aa, Entamoeba invadens
PRTNNGAPN

SEQ ID NO: 2894378 - protein, 6 aa, Entamoeba invadens
PRTPSV

SEQ ID NO: 2894379 - protein, 13 aa, Entamoeba invadens
PRTRMREKRNCEK

SEQ ID NO: 2894380 - protein, 5 aa, Entamoeba invadens
PRTST

SEQ ID NO: 2894381 - protein, 5 aa, Entamoeba invadens
PRTTN

SEQ ID NO: 2894382 - protein, 8 aa, Entamoeba invadens
PRTTNKIQ

SEQ ID NO: 2894383 - protein, 39 aa, Entamoeba invadens
PRVDGKRSDGKKGTDKCEKLEKNEKVDNEKQDDELISTR

SEQ ID NO: 2894384 - protein, 7 aa, Entamoeba invadens
PRVENPD

SEQ ID NO: 2894385 - protein, 7 aa, Entamoeba invadens
PRVENPE

SEQ ID NO: 2894386 - protein, 9 aa, Entamoeba invadens
PRVKQNTPE

SEQ ID NO: 2894387 - protein, 13 aa, Entamoeba invadens
PRVPPKTTEAQER

SEQ ID NO: 2894388 - protein, 15 aa, Entamoeba invadens
PRVPTEPLQQTKQEI

SEQ ID NO: 2894389 - protein, 5 aa, Entamoeba invadens
PRVQE

SEQ ID NO: 2894390 - protein, 6 aa, Entamoeba invadens
PRVSIP

SEQ ID NO: 2894391 - protein, 5 aa, Entamoeba invadens
PRVSS

SEQ ID NO: 2894392 - protein, 8 aa, Entamoeba invadens
PRYEMTDE

SEQ ID NO: 2894393 - protein, 22 aa, Entamoeba invadens
PRYRGERGGCASNTEHSCVTTA

SEQ ID NO: 2894394 - protein, 7 aa, Entamoeba invadens
PRYTDAA

SEQ ID NO: 2894395 - protein, 8 aa, Entamoeba invadens
PSADDIDE

SEQ ID NO: 2894396 - protein, 16 aa, Entamoeba invadens
PSADEYISSKRTLEPQ

SEQ ID NO: 2894397 - protein, 15 aa, Entamoeba invadens
PSAFSPTDKQLYEVL

SEQ ID NO: 2894398 - protein, 4 aa, Entamoeba invadens
PSAK

SEQ ID NO: 2894399 - protein, 16 aa, Entamoeba invadens
PSAKRDLGYSTINGDI

SEQ ID NO: 2894400 - protein, 6 aa, Entamoeba invadens
PSAKSL

SEQ ID NO: 2894401 - protein, 6 aa, Entamoeba invadens
PSAKTI

SEQ ID NO: 2894402 - protein, 5 aa, Entamoeba invadens
PSAKY

SEQ ID NO: 2894403 - protein, 8 aa, Entamoeba invadens
PSANNPIV

SEQ ID NO: 2894404 - protein, 5 aa, Entamoeba invadens
PSAPE

SEQ ID NO: 2894405 - protein, 9 aa, Entamoeba invadens
PSAPFGDGS

SEQ ID NO: 2894406 - protein, 9 aa, Entamoeba invadens
PSAREERAK

SEQ ID NO: 2894407 - protein, 11 aa, Entamoeba invadens
PSASIRGTAGK

SEQ ID NO: 2894408 - protein, 8 aa, Entamoeba invadens
PSATSRGE

SEQ ID NO: 2894409 - protein, 13 aa, Entamoeba invadens
PSAVADELIKLYE

SEQ ID NO: 2894410 - protein, 14 aa, Entamoeba invadens
PSAVKPPPLSESAT

SEQ ID NO: 2894411 - protein, 6 aa, Entamoeba invadens
PSCDSD

SEQ ID NO: 2894412 - protein, 39 aa, Entamoeba invadens
PSCFDENDKVNTPPQHHNERDKNCSLKPSLNDTKGIPKK

SEQ ID NO: 2894413 - protein, 5 aa, Entamoeba invadens
PSCIS

SEQ ID NO: 2894414 - protein, 19 aa, Entamoeba invadens
PSCNGADKVGAGKMPEMEE

SEQ ID NO: 2894415 - protein, 8 aa, Entamoeba invadens
PSCNGSDY

SEQ ID NO: 2894416 - protein, 8 aa, Entamoeba invadens
PSCNNNCD

SEQ ID NO: 2894417 - protein, 4 aa, Entamoeba invadens
PSCS

SEQ ID NO: 2894418 - protein, 5 aa, Entamoeba invadens
PSCSV

SEQ ID NO: 2894419 - protein, 26 aa, Entamoeba invadens
PSCTSAESAWTDSTSTETINEVTEKI

SEQ ID NO: 2894420 - protein, 8 aa, Entamoeba invadens
PSDANETR

SEQ ID NO: 2894421 - protein, 8 aa, Entamoeba invadens
PSDEELKE

SEQ ID NO: 2894422 - protein, 5 aa, Entamoeba invadens
PSDEN

SEQ ID NO: 2894423 - protein, 7 aa, Entamoeba invadens
PSDFDRA

SEQ ID NO: 2894424 - protein, 5 aa, Entamoeba invadens
PSDFS

SEQ ID NO: 2894425 - protein, 6 aa, Entamoeba invadens
PSDFTD

SEQ ID NO: 2894426 - protein, 4 aa, Entamoeba invadens
PSDK

SEQ ID NO: 2894427 - protein, 21 aa, Entamoeba invadens
PSDLQQEIHDKTELKNDPQRI

SEQ ID NO: 2894428 - protein, 8 aa, Entamoeba invadens
PSDRDIDE

SEQ ID NO: 2894429 - protein, 15 aa, Entamoeba invadens
PSDSPAPGVTPGLNP

SEQ ID NO: 2894430 - protein, 6 aa, Entamoeba invadens
PSDTKP

SEQ ID NO: 2894431 - protein, 8 aa, Entamoeba invadens
PSDTPQDI

SEQ ID NO: 2894432 - protein, 16 aa, Entamoeba invadens
PSDTRRNKYAKDELKR

SEQ ID NO: 2894433 - protein, 16 aa, Entamoeba invadens
PSDTRRSSYASDTLKT

SEQ ID NO: 2894434 - protein, 11 aa, Entamoeba invadens
PSDTSVQLTPN

SEQ ID NO: 2894435 - protein, 16 aa, Entamoeba invadens
PSDVDLDTQADDGSDA

SEQ ID NO: 2894436 - protein, 5 aa, Entamoeba invadens
PSDVE

SEQ ID NO: 2894437 - protein, 10 aa, Entamoeba invadens
PSDWGTEPPI

SEQ ID NO: 2894438 - protein, 8 aa, Entamoeba invadens
PSECGLSG

SEQ ID NO: 2894439 - protein, 10 aa, Entamoeba invadens
PSEDSASEEV

SEQ ID NO: 2894440 - protein, 4 aa, Entamoeba invadens
PSEE

SEQ ID NO: 2894441 - protein, 5 aa, Entamoeba invadens
PSEES

SEQ ID NO: 2894442 - protein, 9 aa, Entamoeba invadens
PSEFEGNPY

SEQ ID NO: 2894443 - protein, 5 aa, Entamoeba invadens
PSEGL

SEQ ID NO: 2894444 - protein, 8 aa, Entamoeba invadens
PSEHGSDK

SEQ ID NO: 2894445 - protein, 4 aa, Entamoeba invadens
PSEI

SEQ ID NO: 2894446 - protein, 9 aa, Entamoeba invadens
PSEIKNDDI

SEQ ID NO: 2894447 - protein, 11 aa, Entamoeba invadens
PSEKDSSPTKR

SEQ ID NO: 2894448 - protein, 9 aa, Entamoeba invadens
PSEKGSDKF

SEQ ID NO: 2894449 - protein, 9 aa, Entamoeba invadens
PSEKSRSNC

SEQ ID NO: 2894450 - protein, 6 aa, Entamoeba invadens
PSELHS

SEQ ID NO: 2894451 - protein, 8 aa, Entamoeba invadens
PSEMTANS

SEQ ID NO: 2894452 - protein, 18 aa, Entamoeba invadens
PSENLKQKRRRQDTATNN

SEQ ID NO: 2894453 - protein, 16 aa, Entamoeba invadens
PSENLKQKRRSQDALT

SEQ ID NO: 2894454 - protein, 20 aa, Entamoeba invadens
PSENQSERRTRTAKDPNKLS

SEQ ID NO: 2894455 - protein, 7 aa, Entamoeba invadens
PSENSTI

SEQ ID NO: 2894456 - protein, 16 aa, Entamoeba invadens
PSEPFSDHSSEIKSAD

SEQ ID NO: 2894457 - protein, 14 aa, Entamoeba invadens
PSEPLTRRHYTQLL

SEQ ID NO: 2894458 - protein, 9 aa, Entamoeba invadens
PSERATTEE

SEQ ID NO: 2894459 - protein, 5 aa, Entamoeba invadens
PSESK

SEQ ID NO: 2894460 - protein, 4 aa, Entamoeba invadens
PSET

SEQ ID NO: 2894461 - protein, 23 aa, Entamoeba invadens
PSETGIEKNKAKTKKSSKRGEKI

SEQ ID NO: 2894462 - protein, 7 aa, Entamoeba invadens
PSETKSI

SEQ ID NO: 2894463 - protein, 10 aa, Entamoeba invadens
PSEVKTRRKE

SEQ ID NO: 2894464 - protein, 4 aa, Entamoeba invadens
PSEY

SEQ ID NO: 2894465 - protein, 5 aa, Entamoeba invadens
PSEYA

SEQ ID NO: 2894466 - protein, 12 aa, Entamoeba invadens
PSEYESFWANRF

SEQ ID NO: 2894467 - protein, 10 aa, Entamoeba invadens
PSFAESTLTD

SEQ ID NO: 2894468 - protein, 5 aa, Entamoeba invadens
PSFDN

SEQ ID NO: 2894469 - protein, 22 aa, Entamoeba invadens
PSFETSMAKGRNDQLKMLLREV

SEQ ID NO: 2894470 - protein, 9 aa, Entamoeba invadens
PSFGHTTGY

SEQ ID NO: 2894471 - protein, 14 aa, Entamoeba invadens
PSFNGDEAESGYED

SEQ ID NO: 2894472 - protein, 25 aa, Entamoeba invadens
PSFPNPQEEVHQQEAPKEEHKMPAG

SEQ ID NO: 2894473 - protein, 5 aa, Entamoeba invadens
PSFPP

SEQ ID NO: 2894474 - protein, 4 aa, Entamoeba invadens
PSFQ

SEQ ID NO: 2894475 - protein, 10 aa, Entamoeba invadens
PSFSDTDFNT

SEQ ID NO: 2894476 - protein, 7 aa, Entamoeba invadens
PSFSSDG

SEQ ID NO: 2894477 - protein, 29 aa, Entamoeba invadens
PSFSSKGLKNKFSPSFKEKEQTKHKKQIF

SEQ ID NO: 2894478 - protein, 8 aa, Entamoeba invadens
PSGCAKTS

SEQ ID NO: 2894479 - protein, 13 aa, Entamoeba invadens
PSGDRVSRTATWT

SEQ ID NO: 2894480 - protein, 10 aa, Entamoeba invadens
PSGDVHQKRE

SEQ ID NO: 2894481 - protein, 7 aa, Entamoeba invadens
PSGELKK

SEQ ID NO: 2894482 - protein, 6 aa, Entamoeba invadens
PSGEPI

SEQ ID NO: 2894483 - protein, 16 aa, Entamoeba invadens
PSGESLSFNKSGKDDV

SEQ ID NO: 2894484 - protein, 17 aa, Entamoeba invadens
PSGIAKNPLRDSKQIGK

SEQ ID NO: 2894485 - protein, 7 aa, Entamoeba invadens
PSGLPVP

SEQ ID NO: 2894486 - protein, 8 aa, Entamoeba invadens
PSGNYGGW

SEQ ID NO: 2894487 - protein, 6 aa, Entamoeba invadens
PSGPIT

SEQ ID NO: 2894488 - protein, 4 aa, Entamoeba invadens
PSGQ

SEQ ID NO: 2894489 - protein, 10 aa, Entamoeba invadens
PSGRFTPEIT

SEQ ID NO: 2894490 - protein, 5 aa, Entamoeba invadens
PSGSR

SEQ ID NO: 2894491 - protein, 6 aa, Entamoeba invadens
PSGTER

SEQ ID NO: 2894492 - protein, 9 aa, Entamoeba invadens
PSGTNTADA

SEQ ID NO: 2894493 - protein, 8 aa, Entamoeba invadens
PSGTVGAN

SEQ ID NO: 2894494 - protein, 5 aa, Entamoeba invadens
PSGVE

SEQ ID NO: 2894495 - protein, 8 aa, Entamoeba invadens
PSGVGKST

SEQ ID NO: 2894496 - protein, 7 aa, Entamoeba invadens
PSHKESL

SEQ ID NO: 2894497 - protein, 10 aa, Entamoeba invadens
PSHKTKEAEE

SEQ ID NO: 2894498 - protein, 7 aa, Entamoeba invadens
PSHTEEM

SEQ ID NO: 2894499 - protein, 4 aa, Entamoeba invadens
PSIA

SEQ ID NO: 2894500 - protein, 10 aa, Entamoeba invadens
PSIDNEEDKL

SEQ ID NO: 2894501 - protein, 8 aa, Entamoeba invadens
PSIDPNDS

SEQ ID NO: 2894502 - protein, 6 aa, Entamoeba invadens
PSIEDG

SEQ ID NO: 2894503 - protein, 14 aa, Entamoeba invadens
PSINESKFGKPIAD

SEQ ID NO: 2894504 - protein, 4 aa, Entamoeba invadens
PSIP

SEQ ID NO: 2894505 - protein, 7 aa, Entamoeba invadens
PSIPFEQ

SEQ ID NO: 2894506 - protein, 5 aa, Entamoeba invadens
PSIPM

SEQ ID NO: 2894507 - protein, 9 aa, Entamoeba invadens
PSIPPASLT

SEQ ID NO: 2894508 - protein, 7 aa, Entamoeba invadens
PSIPQNA

SEQ ID NO: 2894509 - protein, 15 aa, Entamoeba invadens
PSIQNTSISQQSLQP

SEQ ID NO: 2894510 - protein, 5 aa, Entamoeba invadens
PSIRS

SEQ ID NO: 2894511 - protein, 6 aa, Entamoeba invadens
PSIRST

SEQ ID NO: 2894512 - protein, 4 aa, Entamoeba invadens
PSIS

SEQ ID NO: 2894513 - protein, 12 aa, Entamoeba invadens
PSISESSKYLSS

SEQ ID NO: 2894514 - protein, 10 aa, Entamoeba invadens
PSISPETYNS

SEQ ID NO: 2894515 - protein, 4 aa, Entamoeba invadens
PSKC

SEQ ID NO: 2894516 - protein, 11 aa, Entamoeba invadens
PSKCGGDDQFD

SEQ ID NO: 2894517 - protein, 8 aa, Entamoeba invadens
PSKDVNEL

SEQ ID NO: 2894518 - protein, 6 aa, Entamoeba invadens
PSKEFS

SEQ ID NO: 2894519 - protein, 7 aa, Entamoeba invadens
PSKENLG

SEQ ID NO: 2894520 - protein, 6 aa, Entamoeba invadens
PSKENM

SEQ ID NO: 2894521 - protein, 7 aa, Entamoeba invadens
PSKERKR

SEQ ID NO: 2894522 - protein, 9 aa, Entamoeba invadens
PSKETQPGY

SEQ ID NO: 2894523 - protein, 5 aa, Entamoeba invadens
PSKEV

SEQ ID NO: 2894524 - protein, 5 aa, Entamoeba invadens
PSKFD

SEQ ID NO: 2894525 - protein, 7 aa, Entamoeba invadens
PSKFDPN

SEQ ID NO: 2894526 - protein, 8 aa, Entamoeba invadens
PSKFQRDD

SEQ ID NO: 2894527 - protein, 13 aa, Entamoeba invadens
PSKHSNPPLYPDT

SEQ ID NO: 2894528 - protein, 4 aa, Entamoeba invadens
PSKI

SEQ ID NO: 2894529 - protein, 5 aa, Entamoeba invadens
PSKID

SEQ ID NO: 2894530 - protein, 15 aa, Entamoeba invadens
PSKIHAPSIKANTQV

SEQ ID NO: 2894531 - protein, 11 aa, Entamoeba invadens
PSKIYNSQTDS

SEQ ID NO: 2894532 - protein, 8 aa, Entamoeba invadens
PSKKHTEQ

SEQ ID NO: 2894533 - protein, 16 aa, Entamoeba invadens
PSKKLPPTPLAKQTEC

SEQ ID NO: 2894534 - protein, 13 aa, Entamoeba invadens
PSKKSPNSPPLPL

SEQ ID NO: 2894535 - protein, 18 aa, Entamoeba invadens
PSKKSSRKTKIVSKEPFN

SEQ ID NO: 2894536 - protein, 18 aa, Entamoeba invadens
PSKKVVEDSKKEVKKWMK

SEQ ID NO: 2894537 - protein, 4 aa, Entamoeba invadens
PSKL

SEQ ID NO: 2894538 - protein, 7 aa, Entamoeba invadens
PSKLPAL

SEQ ID NO: 2894539 - protein, 5 aa, Entamoeba invadens
PSKLT

SEQ ID NO: 2894540 - protein, 9 aa, Entamoeba invadens
PSKNDETTL

SEQ ID NO: 2894541 - protein, 10 aa, Entamoeba invadens
PSKNRDDPPL

SEQ ID NO: 2894542 - protein, 7 aa, Entamoeba invadens
PSKNSIE

SEQ ID NO: 2894543 - protein, 6 aa, Entamoeba invadens
PSKNSP

SEQ ID NO: 2894544 - protein, 7 aa, Entamoeba invadens
PSKPEFP

SEQ ID NO: 2894545 - protein, 53 aa, Entamoeba invadens
PSKPGKMPKEDKKEKKEDVEKDEKVEETKKPRVYKKRAKKYPVAKPKKAKNSY

SEQ ID NO: 2894546 - protein, 8 aa, Entamoeba invadens
PSKPGKYG

SEQ ID NO: 2894547 - protein, 20 aa, Entamoeba invadens
PSKQGDDDSVVKKSEEIPPD

SEQ ID NO: 2894548 - protein, 7 aa, Entamoeba invadens
PSKRMSA

SEQ ID NO: 2894549 - protein, 9 aa, Entamoeba invadens
PSKRTNTVK

SEQ ID NO: 2894550 - protein, 8 aa, Entamoeba invadens
PSKRTTTT

SEQ ID NO: 2894551 - protein, 8 aa, Entamoeba invadens
PSKRYTKN

SEQ ID NO: 2894552 - protein, 11 aa, Entamoeba invadens
PSKSCRKTNRI

SEQ ID NO: 2894553 - protein, 15 aa, Entamoeba invadens
PSKSDPTRDGENEVQ

SEQ ID NO: 2894554 - protein, 4 aa, Entamoeba invadens
PSKT

SEQ ID NO: 2894555 - protein, 11 aa, Entamoeba invadens
PSKTDPNAPFT

SEQ ID NO: 2894556 - protein, 7 aa, Entamoeba invadens
PSKTEPM

SEQ ID NO: 2894557 - protein, 11 aa, Entamoeba invadens
PSKTTKIGDSA

SEQ ID NO: 2894558 - protein, 15 aa, Entamoeba invadens
PSKVDNNSIGEAKVD

SEQ ID NO: 2894559 - protein, 8 aa, Entamoeba invadens
PSKVGGPV

SEQ ID NO: 2894560 - protein, 5 aa, Entamoeba invadens
PSKVN

SEQ ID NO: 2894561 - protein, 5 aa, Entamoeba invadens
PSKVP

SEQ ID NO: 2894562 - protein, 8 aa, Entamoeba invadens
PSLEGHKE

SEQ ID NO: 2894563 - protein, 6 aa, Entamoeba invadens
PSLENS

SEQ ID NO: 2894564 - protein, 4 aa, Entamoeba invadens
PSLG

SEQ ID NO: 2894565 - protein, 8 aa, Entamoeba invadens
PSLGAPQG

SEQ ID NO: 2894566 - protein, 4 aa, Entamoeba invadens
PSLL

SEQ ID NO: 2894567 - protein, 10 aa, Entamoeba invadens
PSLNAQSIQN

SEQ ID NO: 2894568 - protein, 7 aa, Entamoeba invadens
PSLNKYE

SEQ ID NO: 2894569 - protein, 20 aa, Entamoeba invadens
PSLPPGVKPRTQPAPPPPKI

SEQ ID NO: 2894570 - protein, 8 aa, Entamoeba invadens
PSLPSEYA

SEQ ID NO: 2894571 - protein, 7 aa, Entamoeba invadens
PSLSEIN

SEQ ID NO: 2894572 - protein, 8 aa, Entamoeba invadens
PSLSKENA

SEQ ID NO: 2894573 - protein, 8 aa, Entamoeba invadens
PSLSNQTS

SEQ ID NO: 2894574 - protein, 5 aa, Entamoeba invadens
PSLTA

SEQ ID NO: 2894575 - protein, 12 aa, Entamoeba invadens
PSLTNKTPESNF

SEQ ID NO: 2894576 - protein, 5 aa, Entamoeba invadens
PSLTP

SEQ ID NO: 2894577 - protein, 27 aa, Entamoeba invadens
PSLTTNSAPLSSSESRSSLAEENTPTS

SEQ ID NO: 2894578 - protein, 11 aa, Entamoeba invadens
PSMASPDTRAE

SEQ ID NO: 2894579 - protein, 8 aa, Entamoeba invadens
PSMDEGTE

SEQ ID NO: 2894580 - protein, 5 aa, Entamoeba invadens
PSMED

SEQ ID NO: 2894581 - protein, 8 aa, Entamoeba invadens
PSMGQGNG

SEQ ID NO: 2894582 - protein, 4 aa, Entamoeba invadens
PSMK

SEQ ID NO: 2894583 - protein, 6 aa, Entamoeba invadens
PSNAAI

SEQ ID NO: 2894584 - protein, 9 aa, Entamoeba invadens
PSNAPTTFE

SEQ ID NO: 2894585 - protein, 6 aa, Entamoeba invadens
PSNDAT

SEQ ID NO: 2894586 - protein, 7 aa, Entamoeba invadens
PSNESME

SEQ ID NO: 2894587 - protein, 7 aa, Entamoeba invadens
PSNGNKV

SEQ ID NO: 2894588 - protein, 5 aa, Entamoeba invadens
PSNIT

SEQ ID NO: 2894589 - protein, 4 aa, Entamoeba invadens
PSNK

SEQ ID NO: 2894590 - protein, 8 aa, Entamoeba invadens
PSNKRGYV

SEQ ID NO: 2894591 - protein, 4 aa, Entamoeba invadens
PSNL

SEQ ID NO: 2894592 - protein, 12 aa, Entamoeba invadens
PSNNNDDPVFEK

SEQ ID NO: 2894593 - protein, 20 aa, Entamoeba invadens
PSNNQIEQKTQTAKDPNKLS

SEQ ID NO: 2894594 - protein, 25 aa, Entamoeba invadens
PSNNSNTKENVTTSSLNRKNRSDIV

SEQ ID NO: 2894595 - protein, 10 aa, Entamoeba invadens
PSNPNHVTKT

SEQ ID NO: 2894596 - protein, 4 aa, Entamoeba invadens
PSNS

SEQ ID NO: 2894597 - protein, 5 aa, Entamoeba invadens
PSNSL

SEQ ID NO: 2894598 - protein, 8 aa, Entamoeba invadens
PSNSQNNL

SEQ ID NO: 2894599 - protein, 8 aa, Entamoeba invadens
PSNTNQSD

SEQ ID NO: 2894600 - protein, 9 aa, Entamoeba invadens
PSNTPSYQY

SEQ ID NO: 2894601 - protein, 5 aa, Entamoeba invadens
PSNTS

SEQ ID NO: 2894602 - protein, 13 aa, Entamoeba invadens
PSNTTSAPQPDIA

SEQ ID NO: 2894603 - protein, 4 aa, Entamoeba invadens
PSNV

SEQ ID NO: 2894604 - protein, 6 aa, Entamoeba invadens
PSNVKS

SEQ ID NO: 2894605 - protein, 6 aa, Entamoeba invadens
PSNVRG

SEQ ID NO: 2894606 - protein, 5 aa, Entamoeba invadens
PSNVT

SEQ ID NO: 2894607 - protein, 4 aa, Entamoeba invadens
PSNW

SEQ ID NO: 2894608 - protein, 7 aa, Entamoeba invadens
PSPELEK

SEQ ID NO: 2894609 - protein, 4 aa, Entamoeba invadens
PSPF

SEQ ID NO: 2894610 - protein, 5 aa, Entamoeba invadens
PSPFA

SEQ ID NO: 2894611 - protein, 14 aa, Entamoeba invadens
PSPFNERRGTMRRA

SEQ ID NO: 2894612 - protein, 8 aa, Entamoeba invadens
PSPGLGNG

SEQ ID NO: 2894613 - protein, 9 aa, Entamoeba invadens
PSPGVRGEL

SEQ ID NO: 2894614 - protein, 13 aa, Entamoeba invadens
PSPKPHPEYVKDT

SEQ ID NO: 2894615 - protein, 6 aa, Entamoeba invadens
PSPKQD

SEQ ID NO: 2894616 - protein, 8 aa, Entamoeba invadens
PSPNQPIR

SEQ ID NO: 2894617 - protein, 5 aa, Entamoeba invadens
PSPPM

SEQ ID NO: 2894618 - protein, 20 aa, Entamoeba invadens
PSPRIDDDCNRSSGCSPNIG

SEQ ID NO: 2894619 - protein, 5 aa, Entamoeba invadens
PSPRV

SEQ ID NO: 2894620 - protein, 7 aa, Entamoeba invadens
PSPSSVD

SEQ ID NO: 2894621 - protein, 18 aa, Entamoeba invadens
PSPTHQPPKESFFVKFAQ

SEQ ID NO: 2894622 - protein, 7 aa, Entamoeba invadens
PSPTISE

SEQ ID NO: 2894623 - protein, 5 aa, Entamoeba invadens
PSPTL

SEQ ID NO: 2894624 - protein, 12 aa, Entamoeba invadens
PSPTSWKLPPNV

SEQ ID NO: 2894625 - protein, 8 aa, Entamoeba invadens
PSPTVSET

SEQ ID NO: 2894626 - protein, 6 aa, Entamoeba invadens
PSPVPQ

SEQ ID NO: 2894627 - protein, 11 aa, Entamoeba invadens
PSPYSDKGYKN

SEQ ID NO: 2894628 - protein, 5 aa, Entamoeba invadens
PSQAL

SEQ ID NO: 2894629 - protein, 7 aa, Entamoeba invadens
PSQDNLG

SEQ ID NO: 2894630 - protein, 4 aa, Entamoeba invadens
PSQE

SEQ ID NO: 2894631 - protein, 5 aa, Entamoeba invadens
PSQEH

SEQ ID NO: 2894632 - protein, 6 aa, Entamoeba invadens
PSQEHM

SEQ ID NO: 2894633 - protein, 7 aa, Entamoeba invadens
PSQESVD

SEQ ID NO: 2894634 - protein, 6 aa, Entamoeba invadens
PSQETI

SEQ ID NO: 2894635 - protein, 4 aa, Entamoeba invadens
PSQF

SEQ ID NO: 2894636 - protein, 7 aa, Entamoeba invadens
PSQFSGK

SEQ ID NO: 2894637 - protein, 5 aa, Entamoeba invadens
PSQFT

SEQ ID NO: 2894638 - protein, 4 aa, Entamoeba invadens
PSQK

SEQ ID NO: 2894639 - protein, 6 aa, Entamoeba invadens
PSQNKN

SEQ ID NO: 2894640 - protein, 7 aa, Entamoeba invadens
PSQNQKK

SEQ ID NO: 2894641 - protein, 12 aa, Entamoeba invadens
PSQPDKDEPAVD

SEQ ID NO: 2894642 - protein, 9 aa, Entamoeba invadens
PSQQIPPEY

SEQ ID NO: 2894643 - protein, 7 aa, Entamoeba invadens
PSQRPRF

SEQ ID NO: 2894644 - protein, 23 aa, Entamoeba invadens
PSQSQPESDKKSEKTSDTGKGDT

SEQ ID NO: 2894645 - protein, 7 aa, Entamoeba invadens
PSQSSHT

SEQ ID NO: 2894646 - protein, 9 aa, Entamoeba invadens
PSQTNRVSN

SEQ ID NO: 2894647 - protein, 5 aa, Entamoeba invadens
PSQVN

SEQ ID NO: 2894648 - protein, 8 aa, Entamoeba invadens
PSQVQQNS

SEQ ID NO: 2894649 - protein, 11 aa, Entamoeba invadens
PSRGKSPIGFD

SEQ ID NO: 2894650 - protein, 7 aa, Entamoeba invadens
PSRGTDY

SEQ ID NO: 2894651 - protein, 22 aa, Entamoeba invadens
PSRINEEKKKKRQSVPNGTTNT

SEQ ID NO: 2894652 - protein, 8 aa, Entamoeba invadens
PSRLGSNP

SEQ ID NO: 2894653 - protein, 22 aa, Entamoeba invadens
PSRLPKVDGKSGSYPHSQNTTY

SEQ ID NO: 2894654 - protein, 12 aa, Entamoeba invadens
PSRLSTKTKSVE

SEQ ID NO: 2894655 - protein, 6 aa, Entamoeba invadens
PSRNNL

SEQ ID NO: 2894656 - protein, 28 aa, Entamoeba invadens
PSRQTGSVKAKQPTSTTLERLEEIFMQK

SEQ ID NO: 2894657 - protein, 5 aa, Entamoeba invadens
PSRQY

SEQ ID NO: 2894658 - protein, 4 aa, Entamoeba invadens
PSRR

SEQ ID NO: 2894659 - protein, 7 aa, Entamoeba invadens
PSRRISN

SEQ ID NO: 2894660 - protein, 10 aa, Entamoeba invadens
PSRSWSGQDM

SEQ ID NO: 2894661 - protein, 10 aa, Entamoeba invadens
PSRTRKQCRE

SEQ ID NO: 2894662 - protein, 4 aa, Entamoeba invadens
PSRV

SEQ ID NO: 2894663 - protein, 8 aa, Entamoeba invadens
PSSANREE

SEQ ID NO: 2894664 - protein, 18 aa, Entamoeba invadens
PSSDAWKQSKSEKEMSTK

SEQ ID NO: 2894665 - protein, 34 aa, Entamoeba invadens
PSSDFNSPTSSMSPLSEEKQMYPNNNFYMHHIYT

SEQ ID NO: 2894666 - protein, 10 aa, Entamoeba invadens
PSSDGTSCAK

SEQ ID NO: 2894667 - protein, 7 aa, Entamoeba invadens
PSSEESF

SEQ ID NO: 2894668 - protein, 8 aa, Entamoeba invadens
PSSEESFS

SEQ ID NO: 2894669 - protein, 8 aa, Entamoeba invadens
PSSEKISD

SEQ ID NO: 2894670 - protein, 16 aa, Entamoeba invadens
PSSENDPQKLERKRHI

SEQ ID NO: 2894671 - protein, 7 aa, Entamoeba invadens
PSSFPSL

SEQ ID NO: 2894672 - protein, 10 aa, Entamoeba invadens
PSSGEAARAY

SEQ ID NO: 2894673 - protein, 5 aa, Entamoeba invadens
PSSHA

SEQ ID NO: 2894674 - protein, 4 aa, Entamoeba invadens
PSSI

SEQ ID NO: 2894675 - protein, 5 aa, Entamoeba invadens
PSSIS

SEQ ID NO: 2894676 - protein, 5 aa, Entamoeba invadens
PSSKI

SEQ ID NO: 2894677 - protein, 11 aa, Entamoeba invadens
PSSLGTDKLRG

SEQ ID NO: 2894678 - protein, 8 aa, Entamoeba invadens
PSSLNPKQ

SEQ ID NO: 2894679 - protein, 15 aa, Entamoeba invadens
PSSNDIPNPSPSPIC

SEQ ID NO: 2894680 - protein, 8 aa, Entamoeba invadens
PSSNPKLI

SEQ ID NO: 2894681 - protein, 4 aa, Entamoeba invadens
PSSP

SEQ ID NO: 2894682 - protein, 12 aa, Entamoeba invadens
PSSPAKKQPAKN

SEQ ID NO: 2894683 - protein, 13 aa, Entamoeba invadens
PSSPATQENKEKA

SEQ ID NO: 2894684 - protein, 9 aa, Entamoeba invadens
PSSPKEEQA

SEQ ID NO: 2894685 - protein, 8 aa, Entamoeba invadens
PSSPMAEN

SEQ ID NO: 2894686 - protein, 26 aa, Entamoeba invadens
PSSPPIQKKEPVEIKKSSDIKKHTKT

SEQ ID NO: 2894687 - protein, 13 aa, Entamoeba invadens
PSSPTLSNETVST

SEQ ID NO: 2894688 - protein, 11 aa, Entamoeba invadens
PSSQDTIPDQS

SEQ ID NO: 2894689 - protein, 9 aa, Entamoeba invadens
PSSQLKPES

SEQ ID NO: 2894690 - protein, 25 aa, Entamoeba invadens
PSSQPQKPLKQETVPIPETLNTINL

SEQ ID NO: 2894691 - protein, 9 aa, Entamoeba invadens
PSSQSEQCY

SEQ ID NO: 2894692 - protein, 8 aa, Entamoeba invadens
PSSQTRES

SEQ ID NO: 2894693 - protein, 10 aa, Entamoeba invadens
PSSRLTPGQA

SEQ ID NO: 2894694 - protein, 13 aa, Entamoeba invadens
PSSRSSKNSENFE

SEQ ID NO: 2894695 - protein, 44 aa, Entamoeba invadens
PSSSKAPRKYYAPKAASKKAAVSSKKAVAGVSQKKPVARHTHPG

SEQ ID NO: 2894696 - protein, 6 aa, Entamoeba invadens
PSSTAD

SEQ ID NO: 2894697 - protein, 10 aa, Entamoeba invadens
PSSTEVDEKN

SEQ ID NO: 2894698 - protein, 8 aa, Entamoeba invadens
PSSTMAEN

SEQ ID NO: 2894699 - protein, 5 aa, Entamoeba invadens
PSSVE

SEQ ID NO: 2894700 - protein, 7 aa, Entamoeba invadens
PSSVEEL

SEQ ID NO: 2894701 - protein, 6 aa, Entamoeba invadens
PSSVES

SEQ ID NO: 2894702 - protein, 9 aa, Entamoeba invadens
PSSVKEIRP

SEQ ID NO: 2894703 - protein, 6 aa, Entamoeba invadens
PSSVKS

SEQ ID NO: 2894704 - protein, 9 aa, Entamoeba invadens
PSSVKSIGQ

SEQ ID NO: 2894705 - protein, 6 aa, Entamoeba invadens
PSSVNS

SEQ ID NO: 2894706 - protein, 6 aa, Entamoeba invadens
PSSVSK

SEQ ID NO: 2894707 - protein, 7 aa, Entamoeba invadens
PSSVSKI

SEQ ID NO: 2894708 - protein, 7 aa, Entamoeba invadens
PSSVTSI

SEQ ID NO: 2894709 - protein, 4 aa, Entamoeba invadens
PSTA

SEQ ID NO: 2894710 - protein, 10 aa, Entamoeba invadens
PSTAKGGKIS

SEQ ID NO: 2894711 - protein, 11 aa, Entamoeba invadens
PSTAQASSLNT

SEQ ID NO: 2894712 - protein, 4 aa, Entamoeba invadens
PSTD

SEQ ID NO: 2894713 - protein, 6 aa, Entamoeba invadens
PSTDHE

SEQ ID NO: 2894714 - protein, 10 aa, Entamoeba invadens
PSTDVNRYSS

SEQ ID NO: 2894715 - protein, 8 aa, Entamoeba invadens
PSTESVAQ

SEQ ID NO: 2894716 - protein, 31 aa, Entamoeba invadens
PSTETSTEHSGSTGRTYVTTSSYKSEFDRSR

SEQ ID NO: 2894717 - protein, 15 aa, Entamoeba invadens
PSTEYSSQHDSLNTS

SEQ ID NO: 2894718 - protein, 4 aa, Entamoeba invadens
PSTF

SEQ ID NO: 2894719 - protein, 5 aa, Entamoeba invadens
PSTFY

SEQ ID NO: 2894720 - protein, 4 aa, Entamoeba invadens
PSTG

SEQ ID NO: 2894721 - protein, 6 aa, Entamoeba invadens
PSTGKQ

SEQ ID NO: 2894722 - protein, 15 aa, Entamoeba invadens
PSTHIQTPNTFNEEF

SEQ ID NO: 2894723 - protein, 7 aa, Entamoeba invadens
PSTINEI

SEQ ID NO: 2894724 - protein, 9 aa, Entamoeba invadens
PSTKETKGL

SEQ ID NO: 2894725 - protein, 9 aa, Entamoeba invadens
PSTKGDSEK

SEQ ID NO: 2894726 - protein, 10 aa, Entamoeba invadens
PSTKSAKAEE

SEQ ID NO: 2894727 - protein, 4 aa, Entamoeba invadens
PSTL

SEQ ID NO: 2894728 - protein, 5 aa, Entamoeba invadens
PSTPS

SEQ ID NO: 2894729 - protein, 8 aa, Entamoeba invadens
PSTPYNRL

SEQ ID NO: 2894730 - protein, 4 aa, Entamoeba invadens
PSTQ

SEQ ID NO: 2894731 - protein, 8 aa, Entamoeba invadens
PSTQPKHI

SEQ ID NO: 2894732 - protein, 4 aa, Entamoeba invadens
PSTR

SEQ ID NO: 2894733 - protein, 9 aa, Entamoeba invadens
PSTRGVDIR

SEQ ID NO: 2894734 - protein, 16 aa, Entamoeba invadens
PSTSGFVQKDKEGKIL

SEQ ID NO: 2894735 - protein, 5 aa, Entamoeba invadens
PSTSY

SEQ ID NO: 2894736 - protein, 6 aa, Entamoeba invadens
PSTTDK

SEQ ID NO: 2894737 - protein, 10 aa, Entamoeba invadens
PSTTNDEQLE

SEQ ID NO: 2894738 - protein, 14 aa, Entamoeba invadens
PSTTRSEASGYRRR

SEQ ID NO: 2894739 - protein, 5 aa, Entamoeba invadens
PSTTT

SEQ ID NO: 2894740 - protein, 4 aa, Entamoeba invadens
PSTV

SEQ ID NO: 2894741 - protein, 22 aa, Entamoeba invadens
PSTVTSVGKNAFEKEKKGTSKL

SEQ ID NO: 2894742 - protein, 6 aa, Entamoeba invadens
PSVAQS

SEQ ID NO: 2894743 - protein, 12 aa, Entamoeba invadens
PSVDFDQDDFEY

SEQ ID NO: 2894744 - protein, 7 aa, Entamoeba invadens
PSVEDQK

SEQ ID NO: 2894745 - protein, 5 aa, Entamoeba invadens
PSVEG

SEQ ID NO: 2894746 - protein, 9 aa, Entamoeba invadens
PSVEKTTHP

SEQ ID NO: 2894747 - protein, 8 aa, Entamoeba invadens
PSVGGNEK

SEQ ID NO: 2894748 - protein, 4 aa, Entamoeba invadens
PSVN

SEQ ID NO: 2894749 - protein, 6 aa, Entamoeba invadens
PSVPKE

SEQ ID NO: 2894750 - protein, 13 aa, Entamoeba invadens
PSVPKEYTKEKES

SEQ ID NO: 2894751 - protein, 13 aa, Entamoeba invadens
PSVPMEEEDPFEN

SEQ ID NO: 2894752 - protein, 20 aa, Entamoeba invadens
PSVPPPREKKETDVQQPVSI

SEQ ID NO: 2894753 - protein, 20 aa, Entamoeba invadens
PSVPQFPKTVEKEGTGYEKP

SEQ ID NO: 2894754 - protein, 9 aa, Entamoeba invadens
PSVPSPSVT

SEQ ID NO: 2894755 - protein, 13 aa, Entamoeba invadens
PSVQSQDFATEEI

SEQ ID NO: 2894756 - protein, 4 aa, Entamoeba invadens
PSVR

SEQ ID NO: 2894757 - protein, 12 aa, Entamoeba invadens
PSVRPSQPPPLQ

SEQ ID NO: 2894758 - protein, 8 aa, Entamoeba invadens
PSVRSYGD

SEQ ID NO: 2894759 - protein, 4 aa, Entamoeba invadens
PSVS

SEQ ID NO: 2894760 - protein, 15 aa, Entamoeba invadens
PSVSERKKQQHTFSS

SEQ ID NO: 2894761 - protein, 11 aa, Entamoeba invadens
PSVSPSPLSLQ

SEQ ID NO: 2894762 - protein, 6 aa, Entamoeba invadens
PSVSSA

SEQ ID NO: 2894763 - protein, 5 aa, Entamoeba invadens
PSVTR

SEQ ID NO: 2894764 - protein, 5 aa, Entamoeba invadens
PSVTS

SEQ ID NO: 2894765 - protein, 5 aa, Entamoeba invadens
PSVTT

SEQ ID NO: 2894766 - protein, 8 aa, Entamoeba invadens
PSVTTQTD

SEQ ID NO: 2894767 - protein, 18 aa, Entamoeba invadens
PSYCDPQYENPLKTTSKV

SEQ ID NO: 2894768 - protein, 4 aa, Entamoeba invadens
PSYD

SEQ ID NO: 2894769 - protein, 24 aa, Entamoeba invadens
PSYDNSYDSDYSDDYDSDDSDHDS

SEQ ID NO: 2894770 - protein, 5 aa, Entamoeba invadens
PSYEG

SEQ ID NO: 2894771 - protein, 22 aa, Entamoeba invadens
PSYENNPKEKLPVECRDKDKRL

SEQ ID NO: 2894772 - protein, 6 aa, Entamoeba invadens
PSYFPD

SEQ ID NO: 2894773 - protein, 15 aa, Entamoeba invadens
PSYPVNTNTKQQDTF

SEQ ID NO: 2894774 - protein, 8 aa, Entamoeba invadens
PSYTIPPQ

SEQ ID NO: 2894775 - protein, 16 aa, Entamoeba invadens
PSYTQTAVERGVGDTI

SEQ ID NO: 2894776 - protein, 6 aa, Entamoeba invadens
PTAAES

SEQ ID NO: 2894777 - protein, 4 aa, Entamoeba invadens
PTAC

SEQ ID NO: 2894778 - protein, 10 aa, Entamoeba invadens
PTADKESPDF

SEQ ID NO: 2894779 - protein, 9 aa, Entamoeba invadens
PTAHDEPYE

SEQ ID NO: 2894780 - protein, 7 aa, Entamoeba invadens
PTAHTGA

SEQ ID NO: 2894781 - protein, 14 aa, Entamoeba invadens
PTAKAIPKNGPTFT

SEQ ID NO: 2894782 - protein, 5 aa, Entamoeba invadens
PTANT

SEQ ID NO: 2894783 - protein, 6 aa, Entamoeba invadens
PTAPPY

SEQ ID NO: 2894784 - protein, 5 aa, Entamoeba invadens
PTAPS

SEQ ID NO: 2894785 - protein, 12 aa, Entamoeba invadens
PTAQKYPPESFS

SEQ ID NO: 2894786 - protein, 32 aa, Entamoeba invadens
PTASTPQKKDDEKTPEMPKDVAPTSDYPDHLN

SEQ ID NO: 2894787 - protein, 9 aa, Entamoeba invadens
PTAVNKQET

SEQ ID NO: 2894788 - protein, 6 aa, Entamoeba invadens
PTCSDT

SEQ ID NO: 2894789 - protein, 4 aa, Entamoeba invadens
PTDA

SEQ ID NO: 2894790 - protein, 16 aa, Entamoeba invadens
PTDADMGNSEVGHNAL

SEQ ID NO: 2894791 - protein, 4 aa, Entamoeba invadens
PTDD

SEQ ID NO: 2894792 - protein, 11 aa, Entamoeba invadens
PTDDETKLAQP

SEQ ID NO: 2894793 - protein, 4 aa, Entamoeba invadens
PTDE

SEQ ID NO: 2894794 - protein, 8 aa, Entamoeba invadens
PTDEERAM

SEQ ID NO: 2894795 - protein, 15 aa, Entamoeba invadens
PTDEKTSNGKKEEAR

SEQ ID NO: 2894796 - protein, 7 aa, Entamoeba invadens
PTDESKT

SEQ ID NO: 2894797 - protein, 8 aa, Entamoeba invadens
PTDETFGN

SEQ ID NO: 2894798 - protein, 12 aa, Entamoeba invadens
PTDFDKNTTCKP

SEQ ID NO: 2894799 - protein, 12 aa, Entamoeba invadens
PTDIKTPRQQDL

SEQ ID NO: 2894800 - protein, 7 aa, Entamoeba invadens
PTDIREQ

SEQ ID NO: 2894801 - protein, 6 aa, Entamoeba invadens
PTDKED

SEQ ID NO: 2894802 - protein, 18 aa, Entamoeba invadens
PTDKNIEGCSPQDNCSKA

SEQ ID NO: 2894803 - protein, 21 aa, Entamoeba invadens
PTDKNQKKQSKAKERPKGIQS

SEQ ID NO: 2894804 - protein, 8 aa, Entamoeba invadens
PTDKPIRD

SEQ ID NO: 2894805 - protein, 4 aa, Entamoeba invadens
PTDL

SEQ ID NO: 2894806 - protein, 10 aa, Entamoeba invadens
PTDLADTSFS

SEQ ID NO: 2894807 - protein, 5 aa, Entamoeba invadens
PTDLT

SEQ ID NO: 2894808 - protein, 4 aa, Entamoeba invadens
PTDM

SEQ ID NO: 2894809 - protein, 6 aa, Entamoeba invadens
PTDPKN

SEQ ID NO: 2894810 - protein, 6 aa, Entamoeba invadens
PTDPNA

SEQ ID NO: 2894811 - protein, 10 aa, Entamoeba invadens
PTDQQKQIFE

SEQ ID NO: 2894812 - protein, 7 aa, Entamoeba invadens
PTDTSIQ

SEQ ID NO: 2894813 - protein, 5 aa, Entamoeba invadens
PTDVH

SEQ ID NO: 2894814 - protein, 4 aa, Entamoeba invadens
PTDW

SEQ ID NO: 2894815 - protein, 6 aa, Entamoeba invadens
PTEEMR

SEQ ID NO: 2894816 - protein, 8 aa, Entamoeba invadens
PTEENLKE

SEQ ID NO: 2894817 - protein, 5 aa, Entamoeba invadens
PTEEV

SEQ ID NO: 2894818 - protein, 40 aa, Entamoeba invadens
PTEEVKEETLSPIKAEPKATEQKVEDKTEQKTEEKVGEKV

SEQ ID NO: 2894819 - protein, 40 aa, Entamoeba invadens
PTEGDTQREIQKTQEVSPPIPKPQELRRDNEHSFSPITKN

SEQ ID NO: 2894820 - protein, 4 aa, Entamoeba invadens
PTEI

SEQ ID NO: 2894821 - protein, 20 aa, Entamoeba invadens
PTEKAENKTITKVEHKCIDL

SEQ ID NO: 2894822 - protein, 11 aa, Entamoeba invadens
PTEKTSKSTAL

SEQ ID NO: 2894823 - protein, 16 aa, Entamoeba invadens
PTEKVNGKLTDFGSAR

SEQ ID NO: 2894824 - protein, 4 aa, Entamoeba invadens
PTEM

SEQ ID NO: 2894825 - protein, 9 aa, Entamoeba invadens
PTENGAALA

SEQ ID NO: 2894826 - protein, 5 aa, Entamoeba invadens
PTENI

SEQ ID NO: 2894827 - protein, 6 aa, Entamoeba invadens
PTENKE

SEQ ID NO: 2894828 - protein, 15 aa, Entamoeba invadens
PTEQEIPPAASKHQL

SEQ ID NO: 2894829 - protein, 11 aa, Entamoeba invadens
PTEQTQSKQID

SEQ ID NO: 2894830 - protein, 4 aa, Entamoeba invadens
PTER

SEQ ID NO: 2894831 - protein, 6 aa, Entamoeba invadens
PTERTK

SEQ ID NO: 2894832 - protein, 10 aa, Entamoeba invadens
PTESLNQKAM

SEQ ID NO: 2894833 - protein, 6 aa, Entamoeba invadens
PTESPL

SEQ ID NO: 2894834 - protein, 6 aa, Entamoeba invadens
PTESQS

SEQ ID NO: 2894835 - protein, 6 aa, Entamoeba invadens
PTESQT

SEQ ID NO: 2894836 - protein, 9 aa, Entamoeba invadens
PTETDEDHK

SEQ ID NO: 2894837 - protein, 7 aa, Entamoeba invadens
PTETLPN

SEQ ID NO: 2894838 - protein, 5 aa, Entamoeba invadens
PTEYT

SEQ ID NO: 2894839 - protein, 4 aa, Entamoeba invadens
PTFD

SEQ ID NO: 2894840 - protein, 11 aa, Entamoeba invadens
PTFDRSKSPEV

SEQ ID NO: 2894841 - protein, 12 aa, Entamoeba invadens
PTFGGTTASYAM

SEQ ID NO: 2894842 - protein, 22 aa, Entamoeba invadens
PTFKKSTSPRSFHPSPLASPTL

SEQ ID NO: 2894843 - protein, 4 aa, Entamoeba invadens
PTFN

SEQ ID NO: 2894844 - protein, 4 aa, Entamoeba invadens
PTFP

SEQ ID NO: 2894845 - protein, 17 aa, Entamoeba invadens
PTFSPRTKKYRKEGEGA

SEQ ID NO: 2894846 - protein, 7 aa, Entamoeba invadens
PTFTQPQ

SEQ ID NO: 2894847 - protein, 4 aa, Entamoeba invadens
PTFV

SEQ ID NO: 2894848 - protein, 8 aa, Entamoeba invadens
PTGAGKTT

SEQ ID NO: 2894849 - protein, 6 aa, Entamoeba invadens
PTGAVS

SEQ ID NO: 2894850 - protein, 5 aa, Entamoeba invadens
PTGET

SEQ ID NO: 2894851 - protein, 17 aa, Entamoeba invadens
PTGEVKPTSFKDGNVGE

SEQ ID NO: 2894852 - protein, 6 aa, Entamoeba invadens
PTGGGK

SEQ ID NO: 2894853 - protein, 7 aa, Entamoeba invadens
PTGGGKS

SEQ ID NO: 2894854 - protein, 7 aa, Entamoeba invadens
PTGGSDV

SEQ ID NO: 2894855 - protein, 9 aa, Entamoeba invadens
PTGGTTKSR

SEQ ID NO: 2894856 - protein, 8 aa, Entamoeba invadens
PTGINPRE

SEQ ID NO: 2894857 - protein, 23 aa, Entamoeba invadens
PTGKPHHRVRSTDNIKKHSNSFY

SEQ ID NO: 2894858 - protein, 7 aa, Entamoeba invadens
PTGKTYQ

SEQ ID NO: 2894859 - protein, 4 aa, Entamoeba invadens
PTGN

SEQ ID NO: 2894860 - protein, 4 aa, Entamoeba invadens
PTGQ

SEQ ID NO: 2894861 - protein, 13 aa, Entamoeba invadens
PTGSGKTRKAVEL

SEQ ID NO: 2894862 - protein, 7 aa, Entamoeba invadens
PTGTGHW

SEQ ID NO: 2894863 - protein, 18 aa, Entamoeba invadens
PTGTLKQEVGKKLNTEAT

SEQ ID NO: 2894864 - protein, 5 aa, Entamoeba invadens
PTGVG

SEQ ID NO: 2894865 - protein, 5 aa, Entamoeba invadens
PTGVN

SEQ ID NO: 2894866 - protein, 14 aa, Entamoeba invadens
PTHAEEYKTLPQKY

SEQ ID NO: 2894867 - protein, 35 aa, Entamoeba invadens
PTHAPPTVAPPRPNHAAPQPKRKIKPSPPSSYHEG

SEQ ID NO: 2894868 - protein, 5 aa, Entamoeba invadens
PTHPG

SEQ ID NO: 2894869 - protein, 7 aa, Entamoeba invadens
PTHPLPD

SEQ ID NO: 2894870 - protein, 6 aa, Entamoeba invadens
PTHPPL

SEQ ID NO: 2894871 - protein, 13 aa, Entamoeba invadens
PTHTEEYKTLPQR

SEQ ID NO: 2894872 - protein, 6 aa, Entamoeba invadens
PTHTLN

SEQ ID NO: 2894873 - protein, 6 aa, Entamoeba invadens
PTIDGF

SEQ ID NO: 2894874 - protein, 5 aa, Entamoeba invadens
PTIDN

SEQ ID NO: 2894875 - protein, 10 aa, Entamoeba invadens
PTIDNKPFTI

SEQ ID NO: 2894876 - protein, 5 aa, Entamoeba invadens
PTIDR

SEQ ID NO: 2894877 - protein, 4 aa, Entamoeba invadens
PTIE

SEQ ID NO: 2894878 - protein, 13 aa, Entamoeba invadens
PTIEDSFKTSVDL

SEQ ID NO: 2894879 - protein, 7 aa, Entamoeba invadens
PTIEDSY

SEQ ID NO: 2894880 - protein, 14 aa, Entamoeba invadens
PTIEDSYSSEVTVD

SEQ ID NO: 2894881 - protein, 6 aa, Entamoeba invadens
PTIEES

SEQ ID NO: 2894882 - protein, 6 aa, Entamoeba invadens
PTIEET

SEQ ID NO: 2894883 - protein, 12 aa, Entamoeba invadens
PTIEETYPTEVN

SEQ ID NO: 2894884 - protein, 6 aa, Entamoeba invadens
PTIENA

SEQ ID NO: 2894885 - protein, 10 aa, Entamoeba invadens
PTIEPTIKKE

SEQ ID NO: 2894886 - protein, 4 aa, Entamoeba invadens
PTIN

SEQ ID NO: 2894887 - protein, 6 aa, Entamoeba invadens
PTINET

SEQ ID NO: 2894888 - protein, 4 aa, Entamoeba invadens
PTIP

SEQ ID NO: 2894889 - protein, 7 aa, Entamoeba invadens
PTIPPST

SEQ ID NO: 2894890 - protein, 9 aa, Entamoeba invadens
PTIPPTKFE

SEQ ID NO: 2894891 - protein, 31 aa, Entamoeba invadens
PTIPSHTSPLPDQPNAENPPPPEHNSPDKPN

SEQ ID NO: 2894892 - protein, 18 aa, Entamoeba invadens
PTIPTEPTLTEEQPFGST

SEQ ID NO: 2894893 - protein, 9 aa, Entamoeba invadens
PTIPVSNPY

SEQ ID NO: 2894894 - protein, 9 aa, Entamoeba invadens
PTIQEPGNY

SEQ ID NO: 2894895 - protein, 10 aa, Entamoeba invadens
PTIQTGNVTR

SEQ ID NO: 2894896 - protein, 20 aa, Entamoeba invadens
PTIRKEELKRKGVSYEEGVT

SEQ ID NO: 2894897 - protein, 5 aa, Entamoeba invadens
PTIRL

SEQ ID NO: 2894898 - protein, 7 aa, Entamoeba invadens
PTIRPNP

SEQ ID NO: 2894899 - protein, 18 aa, Entamoeba invadens
PTISEGKISVENGANYEE

SEQ ID NO: 2894900 - protein, 9 aa, Entamoeba invadens
PTISKTQET

SEQ ID NO: 2894901 - protein, 4 aa, Entamoeba invadens
PTKA

SEQ ID NO: 2894902 - protein, 8 aa, Entamoeba invadens
PTKCATSS

SEQ ID NO: 2894903 - protein, 7 aa, Entamoeba invadens
PTKCDPH

SEQ ID NO: 2894904 - protein, 11 aa, Entamoeba invadens
PTKDKSKRGIS

SEQ ID NO: 2894905 - protein, 5 aa, Entamoeba invadens
PTKED

SEQ ID NO: 2894906 - protein, 8 aa, Entamoeba invadens
PTKEDREN

SEQ ID NO: 2894907 - protein, 8 aa, Entamoeba invadens
PTKETQSI

SEQ ID NO: 2894908 - protein, 4 aa, Entamoeba invadens
PTKG

SEQ ID NO: 2894909 - protein, 41 aa, Entamoeba invadens
PTKIKSTREDTGQIKSSLKVPKDFNPLPKRVEQAEIKPEQV

SEQ ID NO: 2894910 - protein, 15 aa, Entamoeba invadens
PTKISEDDRANYRRV

SEQ ID NO: 2894911 - protein, 12 aa, Entamoeba invadens
PTKKQPKSPKYA

SEQ ID NO: 2894912 - protein, 16 aa, Entamoeba invadens
PTKKTQAKPNSAQRSN

SEQ ID NO: 2894913 - protein, 20 aa, Entamoeba invadens
PTKKVTKKVVKQEEEDIDAE

SEQ ID NO: 2894914 - protein, 17 aa, Entamoeba invadens
PTKLEQYRDNTDPFKPV

SEQ ID NO: 2894915 - protein, 14 aa, Entamoeba invadens
PTKNEKVEKLENLS

SEQ ID NO: 2894916 - protein, 8 aa, Entamoeba invadens
PTKPGKYN

SEQ ID NO: 2894917 - protein, 21 aa, Entamoeba invadens
PTKQSQKTSTSQKGLKSPEIE

SEQ ID NO: 2894918 - protein, 9 aa, Entamoeba invadens
PTKRSEGAV

SEQ ID NO: 2894919 - protein, 12 aa, Entamoeba invadens
PTKRYDEGKDTP

SEQ ID NO: 2894920 - protein, 5 aa, Entamoeba invadens
PTKSS

SEQ ID NO: 2894921 - protein, 6 aa, Entamoeba invadens
PTKSTE

SEQ ID NO: 2894922 - protein, 7 aa, Entamoeba invadens
PTKSYDG

SEQ ID NO: 2894923 - protein, 4 aa, Entamoeba invadens
PTKT

SEQ ID NO: 2894924 - protein, 5 aa, Entamoeba invadens
PTKTA

SEQ ID NO: 2894925 - protein, 6 aa, Entamoeba invadens
PTKTLA

SEQ ID NO: 2894926 - protein, 8 aa, Entamoeba invadens
PTKTPEKV

SEQ ID NO: 2894927 - protein, 14 aa, Entamoeba invadens
PTLAQRLEKLRAKL

SEQ ID NO: 2894928 - protein, 12 aa, Entamoeba invadens
PTLDASDQQSIH

SEQ ID NO: 2894929 - protein, 4 aa, Entamoeba invadens
PTLE

SEQ ID NO: 2894930 - protein, 8 aa, Entamoeba invadens
PTLENQKK

SEQ ID NO: 2894931 - protein, 10 aa, Entamoeba invadens
PTLKNSGRDL

SEQ ID NO: 2894932 - protein, 5 aa, Entamoeba invadens
PTLKR

SEQ ID NO: 2894933 - protein, 5 aa, Entamoeba invadens
PTLPK

SEQ ID NO: 2894934 - protein, 5 aa, Entamoeba invadens
PTLPP

SEQ ID NO: 2894935 - protein, 8 aa, Entamoeba invadens
PTLPSQDV

SEQ ID NO: 2894936 - protein, 10 aa, Entamoeba invadens
PTLPTTGKTI

SEQ ID NO: 2894937 - protein, 8 aa, Entamoeba invadens
PTLPYPSG

SEQ ID NO: 2894938 - protein, 9 aa, Entamoeba invadens
PTLQEEKIQ

SEQ ID NO: 2894939 - protein, 5 aa, Entamoeba invadens
PTLQN

SEQ ID NO: 2894940 - protein, 5 aa, Entamoeba invadens
PTLQV

SEQ ID NO: 2894941 - protein, 7 aa, Entamoeba invadens
PTLSGKN

SEQ ID NO: 2894942 - protein, 9 aa, Entamoeba invadens
PTLSKTPQK

SEQ ID NO: 2894943 - protein, 13 aa, Entamoeba invadens
PTLSRGTKSKVSY

SEQ ID NO: 2894944 - protein, 7 aa, Entamoeba invadens
PTLSSSL

SEQ ID NO: 2894945 - protein, 7 aa, Entamoeba invadens
PTLSTKQ

SEQ ID NO: 2894946 - protein, 8 aa, Entamoeba invadens
PTLTKYPT

SEQ ID NO: 2894947 - protein, 5 aa, Entamoeba invadens
PTLTP

SEQ ID NO: 2894948 - protein, 9 aa, Entamoeba invadens
PTMSEETQL

SEQ ID NO: 2894949 - protein, 7 aa, Entamoeba invadens
PTMTSED

SEQ ID NO: 2894950 - protein, 5 aa, Entamoeba invadens
PTNDF

SEQ ID NO: 2894951 - protein, 6 aa, Entamoeba invadens
PTNDSY

SEQ ID NO: 2894952 - protein, 8 aa, Entamoeba invadens
PTNDTPGS

SEQ ID NO: 2894953 - protein, 7 aa, Entamoeba invadens
PTNDVTD

SEQ ID NO: 2894954 - protein, 7 aa, Entamoeba invadens
PTNEHGE

SEQ ID NO: 2894955 - protein, 6 aa, Entamoeba invadens
PTNEKG

SEQ ID NO: 2894956 - protein, 5 aa, Entamoeba invadens
PTNES

SEQ ID NO: 2894957 - protein, 14 aa, Entamoeba invadens
PTNEWTDDDMNSTL

SEQ ID NO: 2894958 - protein, 4 aa, Entamoeba invadens
PTNF

SEQ ID NO: 2894959 - protein, 11 aa, Entamoeba invadens
PTNFSQTTTST

SEQ ID NO: 2894960 - protein, 4 aa, Entamoeba invadens
PTNG

SEQ ID NO: 2894961 - protein, 10 aa, Entamoeba invadens
PTNGNEEKKI

SEQ ID NO: 2894962 - protein, 6 aa, Entamoeba invadens
PTNGPK

SEQ ID NO: 2894963 - protein, 7 aa, Entamoeba invadens
PTNGSQI

SEQ ID NO: 2894964 - protein, 7 aa, Entamoeba invadens
PTNGTYD

SEQ ID NO: 2894965 - protein, 4 aa, Entamoeba invadens
PTNH

SEQ ID NO: 2894966 - protein, 9 aa, Entamoeba invadens
PTNHLDADS

SEQ ID NO: 2894967 - protein, 13 aa, Entamoeba invadens
PTNHPDVSKELTN

SEQ ID NO: 2894968 - protein, 5 aa, Entamoeba invadens
PTNIP

SEQ ID NO: 2894969 - protein, 15 aa, Entamoeba invadens
PTNIQGASQVTATTP

SEQ ID NO: 2894970 - protein, 4 aa, Entamoeba invadens
PTNL

SEQ ID NO: 2894971 - protein, 5 aa, Entamoeba invadens
PTNLK

SEQ ID NO: 2894972 - protein, 4 aa, Entamoeba invadens
PTNM

SEQ ID NO: 2894973 - protein, 11 aa, Entamoeba invadens
PTNNGAGNSWA

SEQ ID NO: 2894974 - protein, 22 aa, Entamoeba invadens
PTNNSYGWSPTTAYSLPQPKNV

SEQ ID NO: 2894975 - protein, 6 aa, Entamoeba invadens
PTNPDW

SEQ ID NO: 2894976 - protein, 9 aa, Entamoeba invadens
PTNPEGFQP

SEQ ID NO: 2894977 - protein, 7 aa, Entamoeba invadens
PTNPIST

SEQ ID NO: 2894978 - protein, 8 aa, Entamoeba invadens
PTNQNENS

SEQ ID NO: 2894979 - protein, 5 aa, Entamoeba invadens
PTNTI

SEQ ID NO: 2894980 - protein, 7 aa, Entamoeba invadens
PTNTNYQ

SEQ ID NO: 2894981 - protein, 7 aa, Entamoeba invadens
PTNTRDI

SEQ ID NO: 2894982 - protein, 4 aa, Entamoeba invadens
PTPA

SEQ ID NO: 2894983 - protein, 7 aa, Entamoeba invadens
PTPAIPT

SEQ ID NO: 2894984 - protein, 8 aa, Entamoeba invadens
PTPDIGGW

SEQ ID NO: 2894985 - protein, 9 aa, Entamoeba invadens
PTPDTEAPA

SEQ ID NO: 2894986 - protein, 9 aa, Entamoeba invadens
PTPEKISMD

SEQ ID NO: 2894987 - protein, 5 aa, Entamoeba invadens
PTPEV

SEQ ID NO: 2894988 - protein, 5 aa, Entamoeba invadens
PTPFD

SEQ ID NO: 2894989 - protein, 4 aa, Entamoeba invadens
PTPG

SEQ ID NO: 2894990 - protein, 10 aa, Entamoeba invadens
PTPGAEAPSD

SEQ ID NO: 2894991 - protein, 9 aa, Entamoeba invadens
PTPIQSSSI

SEQ ID NO: 2894992 - protein, 5 aa, Entamoeba invadens
PTPIT

SEQ ID NO: 2894993 - protein, 5 aa, Entamoeba invadens
PTPKI

SEQ ID NO: 2894994 - protein, 6 aa, Entamoeba invadens
PTPKIS

SEQ ID NO: 2894995 - protein, 16 aa, Entamoeba invadens
PTPKKTETDENGKEKL

SEQ ID NO: 2894996 - protein, 4 aa, Entamoeba invadens
PTPL

SEQ ID NO: 2894997 - protein, 10 aa, Entamoeba invadens
PTPLDQKVKP

SEQ ID NO: 2894998 - protein, 10 aa, Entamoeba invadens
PTPLKAPTQQ

SEQ ID NO: 2894999 - protein, 15 aa, Entamoeba invadens
PTPNTVEKNTYGVSQ

SEQ ID NO: 2895000 - protein, 14 aa, Entamoeba invadens
PTPPKPRTWTKDPN

SEQ ID NO: 2895001 - protein, 14 aa, Entamoeba invadens
PTPPTIQTRNATHV

SEQ ID NO: 2895002 - protein, 35 aa, Entamoeba invadens
PTPPTIQTRNATHVDYSQATDNESQNTNDSTKEEI

SEQ ID NO: 2895003 - protein, 34 aa, Entamoeba invadens
PTPPTIQTRNATHVDYSQATENESQNTNDSTKEE

SEQ ID NO: 2895004 - protein, 11 aa, Entamoeba invadens
PTPQNVDENNK

SEQ ID NO: 2895005 - protein, 5 aa, Entamoeba invadens
PTPQQ

SEQ ID NO: 2895006 - protein, 5 aa, Entamoeba invadens
PTPRG

SEQ ID NO: 2895007 - protein, 9 aa, Entamoeba invadens
PTPSDDTTR

SEQ ID NO: 2895008 - protein, 7 aa, Entamoeba invadens
PTPSFSK

SEQ ID NO: 2895009 - protein, 13 aa, Entamoeba invadens
PTPSTRVNTKRSS

SEQ ID NO: 2895010 - protein, 7 aa, Entamoeba invadens
PTPTELK

SEQ ID NO: 2895011 - protein, 29 aa, Entamoeba invadens
PTPYPSGHTDDDEGWEQTKTSKKGKKKAK

SEQ ID NO: 2895012 - protein, 10 aa, Entamoeba invadens
PTQAKTQPLQ

SEQ ID NO: 2895013 - protein, 8 aa, Entamoeba invadens
PTQATGQE

SEQ ID NO: 2895014 - protein, 12 aa, Entamoeba invadens
PTQDPTSASFGE

SEQ ID NO: 2895015 - protein, 7 aa, Entamoeba invadens
PTQDWTD

SEQ ID NO: 2895016 - protein, 7 aa, Entamoeba invadens
PTQDYPT

SEQ ID NO: 2895017 - protein, 4 aa, Entamoeba invadens
PTQE

SEQ ID NO: 2895018 - protein, 18 aa, Entamoeba invadens
PTQEDDSQQLTKKRHVGN

SEQ ID NO: 2895019 - protein, 13 aa, Entamoeba invadens
PTQESENDIPSKG

SEQ ID NO: 2895020 - protein, 4 aa, Entamoeba invadens
PTQI

SEQ ID NO: 2895021 - protein, 6 aa, Entamoeba invadens
PTQKLA

SEQ ID NO: 2895022 - protein, 10 aa, Entamoeba invadens
PTQKNSMATK

SEQ ID NO: 2895023 - protein, 7 aa, Entamoeba invadens
PTQNSFS

SEQ ID NO: 2895024 - protein, 11 aa, Entamoeba invadens
PTQNTEKENYS

SEQ ID NO: 2895025 - protein, 7 aa, Entamoeba invadens
PTQPQQA

SEQ ID NO: 2895026 - protein, 4 aa, Entamoeba invadens
PTQQ

SEQ ID NO: 2895027 - protein, 7 aa, Entamoeba invadens
PTQQELE

SEQ ID NO: 2895028 - protein, 9 aa, Entamoeba invadens
PTQRATATQ

SEQ ID NO: 2895029 - protein, 6 aa, Entamoeba invadens
PTQRDG

SEQ ID NO: 2895030 - protein, 5 aa, Entamoeba invadens
PTQRV

SEQ ID NO: 2895031 - protein, 5 aa, Entamoeba invadens
PTQSE

SEQ ID NO: 2895032 - protein, 13 aa, Entamoeba invadens
PTQSETKTDTRSA

SEQ ID NO: 2895033 - protein, 14 aa, Entamoeba invadens
PTQSETTTQQQTHA

SEQ ID NO: 2895034 - protein, 7 aa, Entamoeba invadens
PTQSGKV

SEQ ID NO: 2895035 - protein, 6 aa, Entamoeba invadens
PTQSTV

SEQ ID NO: 2895036 - protein, 8 aa, Entamoeba invadens
PTQTNSSR

SEQ ID NO: 2895037 - protein, 5 aa, Entamoeba invadens
PTQYD

SEQ ID NO: 2895038 - protein, 5 aa, Entamoeba invadens
PTQYG

SEQ ID NO: 2895039 - protein, 5 aa, Entamoeba invadens
PTRCP

SEQ ID NO: 2895040 - protein, 15 aa, Entamoeba invadens
PTRDDLGYEQEGVEQ

SEQ ID NO: 2895041 - protein, 4 aa, Entamoeba invadens
PTRE

SEQ ID NO: 2895042 - protein, 9 aa, Entamoeba invadens
PTRELAQQT

SEQ ID NO: 2895043 - protein, 10 aa, Entamoeba invadens
PTRETSADAL

SEQ ID NO: 2895044 - protein, 4 aa, Entamoeba invadens
PTRG

SEQ ID NO: 2895045 - protein, 11 aa, Entamoeba invadens
PTRGEKLSSPF

SEQ ID NO: 2895046 - protein, 5 aa, Entamoeba invadens
PTRGL

SEQ ID NO: 2895047 - protein, 5 aa, Entamoeba invadens
PTRHM

SEQ ID NO: 2895048 - protein, 8 aa, Entamoeba invadens
PTRKDGKA

SEQ ID NO: 2895049 - protein, 17 aa, Entamoeba invadens
PTRKESERKKIAKNRIA

SEQ ID NO: 2895050 - protein, 8 aa, Entamoeba invadens
PTRNPREI

SEQ ID NO: 2895051 - protein, 21 aa, Entamoeba invadens
PTRPTRMHSQDLSKSTKHEIE

SEQ ID NO: 2895052 - protein, 4 aa, Entamoeba invadens
PTRR

SEQ ID NO: 2895053 - protein, 14 aa, Entamoeba invadens
PTRRDDGGNPRKMT

SEQ ID NO: 2895054 - protein, 21 aa, Entamoeba invadens
PTRRTVSVSSRDQLSKKSLSD

SEQ ID NO: 2895055 - protein, 21 aa, Entamoeba invadens
PTRSKSNIGEKPNYQAPKPQR

SEQ ID NO: 2895056 - protein, 4 aa, Entamoeba invadens
PTRY

SEQ ID NO: 2895057 - protein, 5 aa, Entamoeba invadens
PTRYV

SEQ ID NO: 2895058 - protein, 13 aa, Entamoeba invadens
PTSAQMKNCNSRN

SEQ ID NO: 2895059 - protein, 8 aa, Entamoeba invadens
PTSDDKTS

SEQ ID NO: 2895060 - protein, 8 aa, Entamoeba invadens
PTSDHPSA

SEQ ID NO: 2895061 - protein, 8 aa, Entamoeba invadens
PTSDPTPC

SEQ ID NO: 2895062 - protein, 11 aa, Entamoeba invadens
PTSEESVVSSS

SEQ ID NO: 2895063 - protein, 10 aa, Entamoeba invadens
PTSERPLEKK

SEQ ID NO: 2895064 - protein, 4 aa, Entamoeba invadens
PTSF

SEQ ID NO: 2895065 - protein, 22 aa, Entamoeba invadens
PTSFKSSEQVQGVGSDIPQHQI

SEQ ID NO: 2895066 - protein, 12 aa, Entamoeba invadens
PTSFRRNEGTRS

SEQ ID NO: 2895067 - protein, 4 aa, Entamoeba invadens
PTSI

SEQ ID NO: 2895068 - protein, 13 aa, Entamoeba invadens
PTSKSIPNSSPVV

SEQ ID NO: 2895069 - protein, 7 aa, Entamoeba invadens
PTSLEDT

SEQ ID NO: 2895070 - protein, 8 aa, Entamoeba invadens
PTSLNSKT

SEQ ID NO: 2895071 - protein, 5 aa, Entamoeba invadens
PTSLT

SEQ ID NO: 2895072 - protein, 5 aa, Entamoeba invadens
PTSND

SEQ ID NO: 2895073 - protein, 11 aa, Entamoeba invadens
PTSPSLPPHQK

SEQ ID NO: 2895074 - protein, 8 aa, Entamoeba invadens
PTSQDHWT

SEQ ID NO: 2895075 - protein, 8 aa, Entamoeba invadens
PTSQTVDS

SEQ ID NO: 2895076 - protein, 4 aa, Entamoeba invadens
PTSS

SEQ ID NO: 2895077 - protein, 6 aa, Entamoeba invadens
PTSSIS

SEQ ID NO: 2895078 - protein, 19 aa, Entamoeba invadens
PTSTDHSSPLKSPTTHKLS

SEQ ID NO: 2895079 - protein, 5 aa, Entamoeba invadens
PTSTG

SEQ ID NO: 2895080 - protein, 5 aa, Entamoeba invadens
PTSTL

SEQ ID NO: 2895081 - protein, 6 aa, Entamoeba invadens
PTSTSH

SEQ ID NO: 2895082 - protein, 7 aa, Entamoeba invadens
PTSTSTC

SEQ ID NO: 2895083 - protein, 6 aa, Entamoeba invadens
PTSTYA

SEQ ID NO: 2895084 - protein, 6 aa, Entamoeba invadens
PTSVEK

SEQ ID NO: 2895085 - protein, 8 aa, Entamoeba invadens
PTSVETIG

SEQ ID NO: 2895086 - protein, 9 aa, Entamoeba invadens
PTTADTTLS

SEQ ID NO: 2895087 - protein, 10 aa, Entamoeba invadens
PTTAKDADSP

SEQ ID NO: 2895088 - protein, 5 aa, Entamoeba invadens
PTTCP

SEQ ID NO: 2895089 - protein, 11 aa, Entamoeba invadens
PTTDATNISPP

SEQ ID NO: 2895090 - protein, 10 aa, Entamoeba invadens
PTTDPSSAEW

SEQ ID NO: 2895091 - protein, 6 aa, Entamoeba invadens
PTTEFE

SEQ ID NO: 2895092 - protein, 19 aa, Entamoeba invadens
PTTETLEKASEIDQPYPPT

SEQ ID NO: 2895093 - protein, 8 aa, Entamoeba invadens
PTTGEANI

SEQ ID NO: 2895094 - protein, 9 aa, Entamoeba invadens
PTTHHPEKY

SEQ ID NO: 2895095 - protein, 4 aa, Entamoeba invadens
PTTI

SEQ ID NO: 2895096 - protein, 8 aa, Entamoeba invadens
PTTITPSG

SEQ ID NO: 2895097 - protein, 8 aa, Entamoeba invadens
PTTKGKVN

SEQ ID NO: 2895098 - protein, 16 aa, Entamoeba invadens
PTTKIKDRSDRATNEQ

SEQ ID NO: 2895099 - protein, 9 aa, Entamoeba invadens
PTTKTQEEV

SEQ ID NO: 2895100 - protein, 4 aa, Entamoeba invadens
PTTL

SEQ ID NO: 2895101 - protein, 14 aa, Entamoeba invadens
PTTLKKVETPKTSF

SEQ ID NO: 2895102 - protein, 4 aa, Entamoeba invadens
PTTM

SEQ ID NO: 2895103 - protein, 5 aa, Entamoeba invadens
PTTNE

SEQ ID NO: 2895104 - protein, 5 aa, Entamoeba invadens
PTTNG

SEQ ID NO: 2895105 - protein, 12 aa, Entamoeba invadens
PTTNPINKRSEY

SEQ ID NO: 2895106 - protein, 15 aa, Entamoeba invadens
PTTPEKSMSPMETEE

SEQ ID NO: 2895107 - protein, 10 aa, Entamoeba invadens
PTTPFSTNAE

SEQ ID NO: 2895108 - protein, 5 aa, Entamoeba invadens
PTTPL

SEQ ID NO: 2895109 - protein, 10 aa, Entamoeba invadens
PTTPRDTIPQ

SEQ ID NO: 2895110 - protein, 7 aa, Entamoeba invadens
PTTPTKV

SEQ ID NO: 2895111 - protein, 6 aa, Entamoeba invadens
PTTQVN

SEQ ID NO: 2895112 - protein, 4 aa, Entamoeba invadens
PTTR

SEQ ID NO: 2895113 - protein, 10 aa, Entamoeba invadens
PTTSGTGSEV

SEQ ID NO: 2895114 - protein, 5 aa, Entamoeba invadens
PTTSL

SEQ ID NO: 2895115 - protein, 7 aa, Entamoeba invadens
PTTSLNE

SEQ ID NO: 2895116 - protein, 5 aa, Entamoeba invadens
PTTSP

SEQ ID NO: 2895117 - protein, 18 aa, Entamoeba invadens
PTTSQTDNTLNSLHYVTT

SEQ ID NO: 2895118 - protein, 11 aa, Entamoeba invadens
PTTSSTSASCL

SEQ ID NO: 2895119 - protein, 5 aa, Entamoeba invadens
PTTTD

SEQ ID NO: 2895120 - protein, 20 aa, Entamoeba invadens
PTTTFKTEKSTEMGKGEKKD

SEQ ID NO: 2895121 - protein, 6 aa, Entamoeba invadens
PTTTPD

SEQ ID NO: 2895122 - protein, 6 aa, Entamoeba invadens
PTTTRR

SEQ ID NO: 2895123 - protein, 4 aa, Entamoeba invadens
PTTV

SEQ ID NO: 2895124 - protein, 8 aa, Entamoeba invadens
PTVDSEEK

SEQ ID NO: 2895125 - protein, 7 aa, Entamoeba invadens
PTVKGEN

SEQ ID NO: 2895126 - protein, 4 aa, Entamoeba invadens
PTVN

SEQ ID NO: 2895127 - protein, 11 aa, Entamoeba invadens
PTVNHLGGGSD

SEQ ID NO: 2895128 - protein, 9 aa, Entamoeba invadens
PTVNPTRQR

SEQ ID NO: 2895129 - protein, 18 aa, Entamoeba invadens
PTVPRDEKYEEVKTFTNK

SEQ ID NO: 2895130 - protein, 5 aa, Entamoeba invadens
PTVSS

SEQ ID NO: 2895131 - protein, 9 aa, Entamoeba invadens
PTVSTEPLW

SEQ ID NO: 2895132 - protein, 12 aa, Entamoeba invadens
PTVSVGNSEDEV

SEQ ID NO: 2895133 - protein, 5 aa, Entamoeba invadens
PTVTP

SEQ ID NO: 2895134 - protein, 23 aa, Entamoeba invadens
PTVTPRLDPPSPHNDKTLPEKVT

SEQ ID NO: 2895135 - protein, 7 aa, Entamoeba invadens
PTVTRGR

SEQ ID NO: 2895136 - protein, 8 aa, Entamoeba invadens
PTYEESAR

SEQ ID NO: 2895137 - protein, 7 aa, Entamoeba invadens
PTYGGGN

SEQ ID NO: 2895138 - protein, 7 aa, Entamoeba invadens
PTYHTTK

SEQ ID NO: 2895139 - protein, 5 aa, Entamoeba invadens
PTYLD

SEQ ID NO: 2895140 - protein, 4 aa, Entamoeba invadens
PTYP

SEQ ID NO: 2895141 - protein, 5 aa, Entamoeba invadens
PTYPD

SEQ ID NO: 2895142 - protein, 11 aa, Entamoeba invadens
PTYPDNEVKGT

SEQ ID NO: 2895143 - protein, 8 aa, Entamoeba invadens
PTYSDTQW

SEQ ID NO: 2895144 - protein, 10 aa, Entamoeba invadens
PTYSGDFKSS

SEQ ID NO: 2895145 - protein, 15 aa, Entamoeba invadens
PTYTRPSSSKPYRQV

SEQ ID NO: 2895146 - protein, 6 aa, Entamoeba invadens
PTYTTN

SEQ ID NO: 2895147 - protein, 5 aa, Entamoeba invadens
PVADD

SEQ ID NO: 2895148 - protein, 6 aa, Entamoeba invadens
PVAGQT

SEQ ID NO: 2895149 - protein, 8 aa, Entamoeba invadens
PVAKRKPK

SEQ ID NO: 2895150 - protein, 102 aa, Entamoeba invadens
PVAPEEDFEDDDDSENASYDDLEGKEGFDDSEEEEEVKKVEEKPKKAEKKVEKAKEVKETKPIQKTKEEEKKTKGKQAEPKKELKKENKPVKVAEKKVEEKV

SEQ ID NO: 2895151 - protein, 4 aa, Entamoeba invadens
PVDA

SEQ ID NO: 2895152 - protein, 12 aa, Entamoeba invadens
PVDASKDGIKAY

SEQ ID NO: 2895153 - protein, 9 aa, Entamoeba invadens
PVDDKYAPD

SEQ ID NO: 2895154 - protein, 9 aa, Entamoeba invadens
PVDIPNEGE

SEQ ID NO: 2895155 - protein, 9 aa, Entamoeba invadens
PVDIPSQPL

SEQ ID NO: 2895156 - protein, 5 aa, Entamoeba invadens
PVDNT

SEQ ID NO: 2895157 - protein, 11 aa, Entamoeba invadens
PVDPSSPAQIT

SEQ ID NO: 2895158 - protein, 12 aa, Entamoeba invadens
PVDQKKYDENEC

SEQ ID NO: 2895159 - protein, 5 aa, Entamoeba invadens
PVDSQ

SEQ ID NO: 2895160 - protein, 11 aa, Entamoeba invadens
PVDSSGAKGKY

SEQ ID NO: 2895161 - protein, 7 aa, Entamoeba invadens
PVDTRRF

SEQ ID NO: 2895162 - protein, 10 aa, Entamoeba invadens
PVEDKQKITF

SEQ ID NO: 2895163 - protein, 7 aa, Entamoeba invadens
PVEEEED

SEQ ID NO: 2895164 - protein, 4 aa, Entamoeba invadens
PVEI

SEQ ID NO: 2895165 - protein, 7 aa, Entamoeba invadens
PVEIPTS

SEQ ID NO: 2895166 - protein, 4 aa, Entamoeba invadens
PVEK

SEQ ID NO: 2895167 - protein, 8 aa, Entamoeba invadens
PVEKNGYV

SEQ ID NO: 2895168 - protein, 16 aa, Entamoeba invadens
PVEPVQPQVDHKDDGD

SEQ ID NO: 2895169 - protein, 17 aa, Entamoeba invadens
PVEQPPPQRKATEKSLE

SEQ ID NO: 2895170 - protein, 9 aa, Entamoeba invadens
PVEQSSVSE

SEQ ID NO: 2895171 - protein, 10 aa, Entamoeba invadens
PVETKSKTAQ

SEQ ID NO: 2895172 - protein, 9 aa, Entamoeba invadens
PVGADTSVS

SEQ ID NO: 2895173 - protein, 5 aa, Entamoeba invadens
PVGAI

SEQ ID NO: 2895174 - protein, 8 aa, Entamoeba invadens
PVGEEREV

SEQ ID NO: 2895175 - protein, 10 aa, Entamoeba invadens
PVGSPRSKKV

SEQ ID NO: 2895176 - protein, 10 aa, Entamoeba invadens
PVHHDTPHKV

SEQ ID NO: 2895177 - protein, 9 aa, Entamoeba invadens
PVIGDPNHP

SEQ ID NO: 2895178 - protein, 51 aa, Entamoeba invadens
PVIQNTQQTVQATQTNVQSINKQSDLSKQSAQQKVIQTTQTTEIKSEDVNK

SEQ ID NO: 2895179 - protein, 4 aa, Entamoeba invadens
PVKD

SEQ ID NO: 2895180 - protein, 6 aa, Entamoeba invadens
PVKDED

SEQ ID NO: 2895181 - protein, 4 aa, Entamoeba invadens
PVKI

SEQ ID NO: 2895182 - protein, 13 aa, Entamoeba invadens
PVKKDDGTTWKQS

SEQ ID NO: 2895183 - protein, 18 aa, Entamoeba invadens
PVKKEKAKKEKKEVEDDL

SEQ ID NO: 2895184 - protein, 7 aa, Entamoeba invadens
PVKKGNV

SEQ ID NO: 2895185 - protein, 5 aa, Entamoeba invadens
PVKPF

SEQ ID NO: 2895186 - protein, 25 aa, Entamoeba invadens
PVKREERTSTFSTNASFNKKPQICT

SEQ ID NO: 2895187 - protein, 10 aa, Entamoeba invadens
PVKTGSSDAL

SEQ ID NO: 2895188 - protein, 11 aa, Entamoeba invadens
PVKTSNIRPNI

SEQ ID NO: 2895189 - protein, 12 aa, Entamoeba invadens
PVKTSQQEADQN

SEQ ID NO: 2895190 - protein, 7 aa, Entamoeba invadens
PVLEDEE

SEQ ID NO: 2895191 - protein, 23 aa, Entamoeba invadens
PVLNKKEEKSQTEKIGKESFEKK

SEQ ID NO: 2895192 - protein, 6 aa, Entamoeba invadens
PVLPPP

SEQ ID NO: 2895193 - protein, 8 aa, Entamoeba invadens
PVNAEEDF

SEQ ID NO: 2895194 - protein, 37 aa, Entamoeba invadens
PVNDQGSRSSSTSTSNSRSGSKSRKGSQSSSTRPHVR

SEQ ID NO: 2895195 - protein, 10 aa, Entamoeba invadens
PVNENEIEVN

SEQ ID NO: 2895196 - protein, 21 aa, Entamoeba invadens
PVNETAQTVSHKRTSHSVRER

SEQ ID NO: 2895197 - protein, 16 aa, Entamoeba invadens
PVNKDKEQNDQTLPSL

SEQ ID NO: 2895198 - protein, 20 aa, Entamoeba invadens
PVNKEEKEKEKKEKKEEKDI

SEQ ID NO: 2895199 - protein, 4 aa, Entamoeba invadens
PVNP

SEQ ID NO: 2895200 - protein, 7 aa, Entamoeba invadens
PVNPEFD

SEQ ID NO: 2895201 - protein, 22 aa, Entamoeba invadens
PVNQNDENKSITVTSDVSGKED

SEQ ID NO: 2895202 - protein, 18 aa, Entamoeba invadens
PVNTKDDMKKSKNITSEE

SEQ ID NO: 2895203 - protein, 7 aa, Entamoeba invadens
PVNTKNL

SEQ ID NO: 2895204 - protein, 22 aa, Entamoeba invadens
PVPADEEKDLSTYTFGDNEERQ

SEQ ID NO: 2895205 - protein, 16 aa, Entamoeba invadens
PVPAQIKSAEPMQSKS

SEQ ID NO: 2895206 - protein, 16 aa, Entamoeba invadens
PVPAQTQDKQKTEKLQ

SEQ ID NO: 2895207 - protein, 171 aa, Entamoeba invadens
PVPARDEQKPFSPKPRQDGDKPRRDGRRGGDRRDDGRSYQERKENQERRDGRREGGRDRNEERTEGGAQREKRDDRREGGDRNGGSYYRRDDRRDGGRDRNEERREGGRYGGYQKRDEYGRDDRKQGSQYEDRKYQSHKYTPKFSEEKEVKAPEAQATTPIEKPEQPIESV

SEQ ID NO: 2895208 - protein, 29 aa, Entamoeba invadens
PVPFDRSTSQGGKTVTPSASPDNATPERV

SEQ ID NO: 2895209 - protein, 6 aa, Entamoeba invadens
PVPINT

SEQ ID NO: 2895210 - protein, 8 aa, Entamoeba invadens
PVPLPEHE

SEQ ID NO: 2895211 - protein, 6 aa, Entamoeba invadens
PVPLTS

SEQ ID NO: 2895212 - protein, 8 aa, Entamoeba invadens
PVPNPPFE

SEQ ID NO: 2895213 - protein, 16 aa, Entamoeba invadens
PVPPEKNSQQLARPEP

SEQ ID NO: 2895214 - protein, 13 aa, Entamoeba invadens
PVPPHTEDDLKSL

SEQ ID NO: 2895215 - protein, 9 aa, Entamoeba invadens
PVPQTGNDS

SEQ ID NO: 2895216 - protein, 6 aa, Entamoeba invadens
PVPRIA

SEQ ID NO: 2895217 - protein, 10 aa, Entamoeba invadens
PVPTRLSTAQ

SEQ ID NO: 2895218 - protein, 18 aa, Entamoeba invadens
PVQEKVEENKVETSPQRI

SEQ ID NO: 2895219 - protein, 7 aa, Entamoeba invadens
PVQRDGS

SEQ ID NO: 2895220 - protein, 9 aa, Entamoeba invadens
PVQSGKSSI

SEQ ID NO: 2895221 - protein, 14 aa, Entamoeba invadens
PVQTEDKSVPVIPK

SEQ ID NO: 2895222 - protein, 4 aa, Entamoeba invadens
PVQV

SEQ ID NO: 2895223 - protein, 16 aa, Entamoeba invadens
PVRAGTRKAPSKNLIN

SEQ ID NO: 2895224 - protein, 8 aa, Entamoeba invadens
PVRGQRCT

SEQ ID NO: 2895225 - protein, 6 aa, Entamoeba invadens
PVRIPT

SEQ ID NO: 2895226 - protein, 5 aa, Entamoeba invadens
PVRLE

SEQ ID NO: 2895227 - protein, 30 aa, Entamoeba invadens
PVRPDYKDSRSFVSNPRKIDKKEKERLQDR

SEQ ID NO: 2895228 - protein, 18 aa, Entamoeba invadens
PVRPQSQIQNSSLKQLST

SEQ ID NO: 2895229 - protein, 4 aa, Entamoeba invadens
PVRT

SEQ ID NO: 2895230 - protein, 5 aa, Entamoeba invadens
PVSAY

SEQ ID NO: 2895231 - protein, 18 aa, Entamoeba invadens
PVSDETISNSKRTITDTI

SEQ ID NO: 2895232 - protein, 11 aa, Entamoeba invadens
PVSEKSECVDD

SEQ ID NO: 2895233 - protein, 12 aa, Entamoeba invadens
PVSISPSPHVEH

SEQ ID NO: 2895234 - protein, 6 aa, Entamoeba invadens
PVSKNQ

SEQ ID NO: 2895235 - protein, 12 aa, Entamoeba invadens
PVSLPSRPSAMD

SEQ ID NO: 2895236 - protein, 5 aa, Entamoeba invadens
PVSNC

SEQ ID NO: 2895237 - protein, 6 aa, Entamoeba invadens
PVSNDE

SEQ ID NO: 2895238 - protein, 7 aa, Entamoeba invadens
PVSQENN

SEQ ID NO: 2895239 - protein, 6 aa, Entamoeba invadens
PVSSDG

SEQ ID NO: 2895240 - protein, 7 aa, Entamoeba invadens
PVSYEND

SEQ ID NO: 2895241 - protein, 5 aa, Entamoeba invadens
PVSYS

SEQ ID NO: 2895242 - protein, 4 aa, Entamoeba invadens
PVTG

SEQ ID NO: 2895243 - protein, 8 aa, Entamoeba invadens
PVTKEDYT

SEQ ID NO: 2895244 - protein, 4 aa, Entamoeba invadens
PVTL

SEQ ID NO: 2895245 - protein, 4 aa, Entamoeba invadens
PVTN

SEQ ID NO: 2895246 - protein, 7 aa, Entamoeba invadens
PVTNNKG

SEQ ID NO: 2895247 - protein, 7 aa, Entamoeba invadens
PVTPNEQ

SEQ ID NO: 2895248 - protein, 22 aa, Entamoeba invadens
PVTPQKREEKIENAKTNTTLEA

SEQ ID NO: 2895249 - protein, 17 aa, Entamoeba invadens
PVTQEEIENSYKKALER

SEQ ID NO: 2895250 - protein, 19 aa, Entamoeba invadens
PVTSKTANPERWRGKNYND

SEQ ID NO: 2895251 - protein, 8 aa, Entamoeba invadens
PVTTDDDK

SEQ ID NO: 2895252 - protein, 16 aa, Entamoeba invadens
PVTTPINQSPTRAGIQ

SEQ ID NO: 2895253 - protein, 5 aa, Entamoeba invadens
PVTTS

SEQ ID NO: 2895254 - protein, 7 aa, Entamoeba invadens
PVTTTEV

SEQ ID NO: 2895255 - protein, 4 aa, Entamoeba invadens
PVTV

SEQ ID NO: 2895256 - protein, 63 aa, Entamoeba invadens
PVVEEKKDDAMSSESEHFHSEGVDNEKTRKIKKEESEANTADVSYESSNTSLQTLNTKGEEPM

SEQ ID NO: 2895257 - protein, 14 aa, Entamoeba invadens
PVYPQTPIKPQAQQ

SEQ ID NO: 2895258 - protein, 16 aa, Entamoeba invadens
PVYSQKEVDDLNSENM

SEQ ID NO: 2895259 - protein, 12 aa, Entamoeba invadens
PWENKDNSCAEE

SEQ ID NO: 2895260 - protein, 7 aa, Entamoeba invadens
PWNPEQK

SEQ ID NO: 2895261 - protein, 8 aa, Entamoeba invadens
PWPKDSSI

SEQ ID NO: 2895262 - protein, 9 aa, Entamoeba invadens
PWPKDSSID

SEQ ID NO: 2895263 - protein, 9 aa, Entamoeba invadens
PWSSSEDDA

SEQ ID NO: 2895264 - protein, 4 aa, Entamoeba invadens
PWTN

SEQ ID NO: 2895265 - protein, 8 aa, Entamoeba invadens
PWTTTEDQ

SEQ ID NO: 2895266 - protein, 25 aa, Entamoeba invadens
PYAEENEGQWECENKEEKQKKNPLK

SEQ ID NO: 2895267 - protein, 10 aa, Entamoeba invadens
PYANTQDKNY

SEQ ID NO: 2895268 - protein, 26 aa, Entamoeba invadens
PYAPKGDTVREIPKDESEEEDKDELR

SEQ ID NO: 2895269 - protein, 14 aa, Entamoeba invadens
PYDGEDEKQIEEEM

SEQ ID NO: 2895270 - protein, 11 aa, Entamoeba invadens
PYDGGYADGGI

SEQ ID NO: 2895271 - protein, 5 aa, Entamoeba invadens
PYDPQ

SEQ ID NO: 2895272 - protein, 5 aa, Entamoeba invadens
PYDQQ

SEQ ID NO: 2895273 - protein, 9 aa, Entamoeba invadens
PYEADSELG

SEQ ID NO: 2895274 - protein, 12 aa, Entamoeba invadens
PYEEHKNANQME

SEQ ID NO: 2895275 - protein, 9 aa, Entamoeba invadens
PYEPTESSQ

SEQ ID NO: 2895276 - protein, 6 aa, Entamoeba invadens
PYERQQ

SEQ ID NO: 2895277 - protein, 6 aa, Entamoeba invadens
PYFGNG

SEQ ID NO: 2895278 - protein, 4 aa, Entamoeba invadens
PYFT

SEQ ID NO: 2895279 - protein, 7 aa, Entamoeba invadens
PYGAPTQ

SEQ ID NO: 2895280 - protein, 16 aa, Entamoeba invadens
PYGENETEIQEAVQKK

SEQ ID NO: 2895281 - protein, 5 aa, Entamoeba invadens
PYGEQ

SEQ ID NO: 2895282 - protein, 11 aa, Entamoeba invadens
PYGKDVDQAMD

SEQ ID NO: 2895283 - protein, 6 aa, Entamoeba invadens
PYGKNN

SEQ ID NO: 2895284 - protein, 13 aa, Entamoeba invadens
PYGPARITKDGVS

SEQ ID NO: 2895285 - protein, 7 aa, Entamoeba invadens
PYGPTKI

SEQ ID NO: 2895286 - protein, 13 aa, Entamoeba invadens
PYHEEYEETTEKV

SEQ ID NO: 2895287 - protein, 12 aa, Entamoeba invadens
PYHRNENQQLEE

SEQ ID NO: 2895288 - protein, 5 aa, Entamoeba invadens
PYHTT

SEQ ID NO: 2895289 - protein, 7 aa, Entamoeba invadens
PYIKEKQ

SEQ ID NO: 2895290 - protein, 20 aa, Entamoeba invadens
PYIPPDLQNKTVTKKDVTKL

SEQ ID NO: 2895291 - protein, 7 aa, Entamoeba invadens
PYKPKKY

SEQ ID NO: 2895292 - protein, 6 aa, Entamoeba invadens
PYKRPA

SEQ ID NO: 2895293 - protein, 9 aa, Entamoeba invadens
PYKTEEEDV

SEQ ID NO: 2895294 - protein, 5 aa, Entamoeba invadens
PYLSN

SEQ ID NO: 2895295 - protein, 4 aa, Entamoeba invadens
PYMP

SEQ ID NO: 2895296 - protein, 7 aa, Entamoeba invadens
PYNDLSG

SEQ ID NO: 2895297 - protein, 5 aa, Entamoeba invadens
PYNFE

SEQ ID NO: 2895298 - protein, 7 aa, Entamoeba invadens
PYNPDDI

SEQ ID NO: 2895299 - protein, 9 aa, Entamoeba invadens
PYNPDINKR

SEQ ID NO: 2895300 - protein, 8 aa, Entamoeba invadens
PYNPETNP

SEQ ID NO: 2895301 - protein, 8 aa, Entamoeba invadens
PYNRDEPI

SEQ ID NO: 2895302 - protein, 11 aa, Entamoeba invadens
PYPEKISSGDL

SEQ ID NO: 2895303 - protein, 15 aa, Entamoeba invadens
PYPETSPRKERHSDN

SEQ ID NO: 2895304 - protein, 10 aa, Entamoeba invadens
PYPGSISKKT

SEQ ID NO: 2895305 - protein, 5 aa, Entamoeba invadens
PYPPE

SEQ ID NO: 2895306 - protein, 7 aa, Entamoeba invadens
PYPPIPQ

SEQ ID NO: 2895307 - protein, 5 aa, Entamoeba invadens
PYPPT

SEQ ID NO: 2895308 - protein, 10 aa, Entamoeba invadens
PYPSDEEKEV

SEQ ID NO: 2895309 - protein, 7 aa, Entamoeba invadens
PYPSQRK

SEQ ID NO: 2895310 - protein, 4 aa, Entamoeba invadens
PYPV

SEQ ID NO: 2895311 - protein, 4 aa, Entamoeba invadens
PYQE

SEQ ID NO: 2895312 - protein, 4 aa, Entamoeba invadens
PYQG

SEQ ID NO: 2895313 - protein, 13 aa, Entamoeba invadens
PYQIEEDKTEVFT

SEQ ID NO: 2895314 - protein, 6 aa, Entamoeba invadens
PYQKTT

SEQ ID NO: 2895315 - protein, 4 aa, Entamoeba invadens
PYQN

SEQ ID NO: 2895316 - protein, 10 aa, Entamoeba invadens
PYQQTSPIPI

SEQ ID NO: 2895317 - protein, 4 aa, Entamoeba invadens
PYQS

SEQ ID NO: 2895318 - protein, 11 aa, Entamoeba invadens
PYQSEKKRPMN

SEQ ID NO: 2895319 - protein, 19 aa, Entamoeba invadens
PYQVDTTESDQHVNNENDV

SEQ ID NO: 2895320 - protein, 10 aa, Entamoeba invadens
PYQYTKDKEL

SEQ ID NO: 2895321 - protein, 11 aa, Entamoeba invadens
PYRNKGAQPKI

SEQ ID NO: 2895322 - protein, 12 aa, Entamoeba invadens
PYRPSSSSTQLQ

SEQ ID NO: 2895323 - protein, 5 aa, Entamoeba invadens
PYRSE

SEQ ID NO: 2895324 - protein, 11 aa, Entamoeba invadens
PYSAKDDMEYD

SEQ ID NO: 2895325 - protein, 8 aa, Entamoeba invadens
PYSAKSDL

SEQ ID NO: 2895326 - protein, 7 aa, Entamoeba invadens
PYSEHSN

SEQ ID NO: 2895327 - protein, 4 aa, Entamoeba invadens
PYSK

SEQ ID NO: 2895328 - protein, 5 aa, Entamoeba invadens
PYSSF

SEQ ID NO: 2895329 - protein, 7 aa, Entamoeba invadens
PYSSTTE

SEQ ID NO: 2895330 - protein, 18 aa, Entamoeba invadens
PYSSYSTSPRSQSPSLKK

SEQ ID NO: 2895331 - protein, 4 aa, Entamoeba invadens
PYST

SEQ ID NO: 2895332 - protein, 6 aa, Entamoeba invadens
PYSTQR

SEQ ID NO: 2895333 - protein, 7 aa, Entamoeba invadens
PYSTQRD

SEQ ID NO: 2895334 - protein, 10 aa, Entamoeba invadens
PYTCSSCSSS

SEQ ID NO: 2895335 - protein, 10 aa, Entamoeba invadens
PYTDEKGAHS

SEQ ID NO: 2895336 - protein, 5 aa, Entamoeba invadens
PYTES

SEQ ID NO: 2895337 - protein, 4 aa, Entamoeba invadens
PYTK

SEQ ID NO: 2895338 - protein, 7 aa, Entamoeba invadens
PYTKSDY

SEQ ID NO: 2895339 - protein, 23 aa, Entamoeba invadens
PYTQPQVTQISPSKGCVSGSPLS

SEQ ID NO: 2895340 - protein, 7 aa, Entamoeba invadens
PYTSDDG

SEQ ID NO: 2895341 - protein, 35 aa, Entamoeba invadens
PYTSPSVPHDSQRESVHTKGKAESRRNSTENVNEE

SEQ ID NO: 2895342 - protein, 4 aa, Entamoeba invadens
PYTT

SEQ ID NO: 2895343 - protein, 29 aa, Entamoeba invadens
PYTTDPQKGPSSKFKEDSKTLPQQKRPSM

SEQ ID NO: 2895344 - protein, 5 aa, Entamoeba invadens
PYVSP

SEQ ID NO: 2895345 - protein, 12 aa, Entamoeba invadens
PYYETSAKTGLR

SEQ ID NO: 2895346 - protein, 5 aa, Entamoeba invadens
QAADA

SEQ ID NO: 2895347 - protein, 17 aa, Entamoeba invadens
QAAKTYKQSKKNTYEKE

SEQ ID NO: 2895348 - protein, 17 aa, Entamoeba invadens
QAAKTYKQSKNTYEKEL

SEQ ID NO: 2895349 - protein, 16 aa, Entamoeba invadens
QAAKTYKQSKNTYEKK

SEQ ID NO: 2895350 - protein, 25 aa, Entamoeba invadens
QAAKTYKQSKNTYEKKLTELNEQLD

SEQ ID NO: 2895351 - protein, 16 aa, Entamoeba invadens
QAAKTYKQSKNTYEKR

SEQ ID NO: 2895352 - protein, 21 aa, Entamoeba invadens
QAAKTYKQSNKMQEKELTELN

SEQ ID NO: 2895353 - protein, 10 aa, Entamoeba invadens
QAANEDDPYK

SEQ ID NO: 2895354 - protein, 17 aa, Entamoeba invadens
QAANTFKQSKNTYEKKL

SEQ ID NO: 2895355 - protein, 8 aa, Entamoeba invadens
QAAQPPIA

SEQ ID NO: 2895356 - protein, 10 aa, Entamoeba invadens
QAASEYNTNV

SEQ ID NO: 2895357 - protein, 7 aa, Entamoeba invadens
QADDETL

SEQ ID NO: 2895358 - protein, 10 aa, Entamoeba invadens
QADDQTKRSI

SEQ ID NO: 2895359 - protein, 10 aa, Entamoeba invadens
QADENDQFDP

SEQ ID NO: 2895360 - protein, 5 aa, Entamoeba invadens
QADGE

SEQ ID NO: 2895361 - protein, 8 aa, Entamoeba invadens
QADGTAFE

SEQ ID NO: 2895362 - protein, 27 aa, Entamoeba invadens
QADINTVSEEDKKKLQGQGMAKYGEQM

SEQ ID NO: 2895363 - protein, 11 aa, Entamoeba invadens
QADKTRKCSPR

SEQ ID NO: 2895364 - protein, 7 aa, Entamoeba invadens
QADNDKI

SEQ ID NO: 2895365 - protein, 7 aa, Entamoeba invadens
QADNPQL

SEQ ID NO: 2895366 - protein, 7 aa, Entamoeba invadens
QAEATKY

SEQ ID NO: 2895367 - protein, 47 aa, Entamoeba invadens
QAEAVETQDGDLSSFDETPEKLQSQTQQSQNPEDQGTQKKTKRRKGV

SEQ ID NO: 2895368 - protein, 9 aa, Entamoeba invadens
QAEKANLEV

SEQ ID NO: 2895369 - protein, 7 aa, Entamoeba invadens
QAENEND

SEQ ID NO: 2895370 - protein, 8 aa, Entamoeba invadens
QAENGGNC

SEQ ID NO: 2895371 - protein, 6 aa, Entamoeba invadens
QAENQL

SEQ ID NO: 2895372 - protein, 9 aa, Entamoeba invadens
QAESEQKDV

SEQ ID NO: 2895373 - protein, 5 aa, Entamoeba invadens
QAESI

SEQ ID NO: 2895374 - protein, 6 aa, Entamoeba invadens
QAEVDK

SEQ ID NO: 2895375 - protein, 7 aa, Entamoeba invadens
QAFGESP

SEQ ID NO: 2895376 - protein, 6 aa, Entamoeba invadens
QAGAKK

SEQ ID NO: 2895377 - protein, 6 aa, Entamoeba invadens
QAGCNT

SEQ ID NO: 2895378 - protein, 23 aa, Entamoeba invadens
QAGDSQKIIETTKAVSQNNTKSN

SEQ ID NO: 2895379 - protein, 7 aa, Entamoeba invadens
QAGGRND

SEQ ID NO: 2895380 - protein, 5 aa, Entamoeba invadens
QAGGS

SEQ ID NO: 2895381 - protein, 7 aa, Entamoeba invadens
QAGNHAQ

SEQ ID NO: 2895382 - protein, 8 aa, Entamoeba invadens
QAGSHEQQ

SEQ ID NO: 2895383 - protein, 5 aa, Entamoeba invadens
QAGTE

SEQ ID NO: 2895384 - protein, 10 aa, Entamoeba invadens
QAHPETMDKR

SEQ ID NO: 2895385 - protein, 9 aa, Entamoeba invadens
QAHTPRRIR

SEQ ID NO: 2895386 - protein, 11 aa, Entamoeba invadens
QAIGARSQSCR

SEQ ID NO: 2895387 - protein, 4 aa, Entamoeba invadens
QAIR

SEQ ID NO: 2895388 - protein, 6 aa, Entamoeba invadens
QAISNT

SEQ ID NO: 2895389 - protein, 11 aa, Entamoeba invadens
QAKEDTEGEFG

SEQ ID NO: 2895390 - protein, 11 aa, Entamoeba invadens
QAKFEKREGQD

SEQ ID NO: 2895391 - protein, 8 aa, Entamoeba invadens
QAKGVLPK

SEQ ID NO: 2895392 - protein, 13 aa, Entamoeba invadens
QAKHNTESRSKDI

SEQ ID NO: 2895393 - protein, 10 aa, Entamoeba invadens
QAKIETNKVN

SEQ ID NO: 2895394 - protein, 5 aa, Entamoeba invadens
QAKKA

SEQ ID NO: 2895395 - protein, 6 aa, Entamoeba invadens
QAKKGV

SEQ ID NO: 2895396 - protein, 98 aa, Entamoeba invadens
QAKKKVELAAKKKTEDDDLKVKESKRLYEEKQKKEKLEFEQKQKEEREKREKEMAERKKREEEHKKALEKEKNERLERKEIKEKEKAELEKKNEQTIA

SEQ ID NO: 2895397 - protein, 14 aa, Entamoeba invadens
QAKKPEDQLDNGET

SEQ ID NO: 2895398 - protein, 10 aa, Entamoeba invadens
QAKKRKTRRL

SEQ ID NO: 2895399 - protein, 5 aa, Entamoeba invadens
QAKNE

SEQ ID NO: 2895400 - protein, 8 aa, Entamoeba invadens
QAKPFKAE

SEQ ID NO: 2895401 - protein, 25 aa, Entamoeba invadens
QAKQAQEEQKTEEKTPRATSQNPRD

SEQ ID NO: 2895402 - protein, 9 aa, Entamoeba invadens
QAKTTKDLE

SEQ ID NO: 2895403 - protein, 8 aa, Entamoeba invadens
QAKTTQSK

SEQ ID NO: 2895404 - protein, 9 aa, Entamoeba invadens
QAKYPKDEL

SEQ ID NO: 2895405 - protein, 4 aa, Entamoeba invadens
QALG

SEQ ID NO: 2895406 - protein, 8 aa, Entamoeba invadens
QALSEGGH

SEQ ID NO: 2895407 - protein, 13 aa, Entamoeba invadens
QALSSEKNEDSVM

SEQ ID NO: 2895408 - protein, 4 aa, Entamoeba invadens
QAND

SEQ ID NO: 2895409 - protein, 9 aa, Entamoeba invadens
QANDTENKA

SEQ ID NO: 2895410 - protein, 12 aa, Entamoeba invadens
QANDVSSKKSMC

SEQ ID NO: 2895411 - protein, 4 aa, Entamoeba invadens
QANE

SEQ ID NO: 2895412 - protein, 6 aa, Entamoeba invadens
QANEHS

SEQ ID NO: 2895413 - protein, 6 aa, Entamoeba invadens
QANGFT

SEQ ID NO: 2895414 - protein, 9 aa, Entamoeba invadens
QANGPPLPE

SEQ ID NO: 2895415 - protein, 5 aa, Entamoeba invadens
QANHP

SEQ ID NO: 2895416 - protein, 6 aa, Entamoeba invadens
QANKEY

SEQ ID NO: 2895417 - protein, 8 aa, Entamoeba invadens
QANKGLYS

SEQ ID NO: 2895418 - protein, 5 aa, Entamoeba invadens
QANLG

SEQ ID NO: 2895419 - protein, 13 aa, Entamoeba invadens
QANLGTTINELPE

SEQ ID NO: 2895420 - protein, 7 aa, Entamoeba invadens
QANPRQI

SEQ ID NO: 2895421 - protein, 16 aa, Entamoeba invadens
QANRREEQKVTTVDAG

SEQ ID NO: 2895422 - protein, 11 aa, Entamoeba invadens
QANSTNALNQK

SEQ ID NO: 2895423 - protein, 11 aa, Entamoeba invadens
QANVSGNELAE

SEQ ID NO: 2895424 - protein, 10 aa, Entamoeba invadens
QANYQDTKCP

SEQ ID NO: 2895425 - protein, 13 aa, Entamoeba invadens
QAPAKSKGKISRV

SEQ ID NO: 2895426 - protein, 19 aa, Entamoeba invadens
QAPATIGGYPCSNPTYPIA

SEQ ID NO: 2895427 - protein, 5 aa, Entamoeba invadens
QAPGK

SEQ ID NO: 2895428 - protein, 5 aa, Entamoeba invadens
QAPMA

SEQ ID NO: 2895429 - protein, 21 aa, Entamoeba invadens
QAPNNTTRPITTDVPTDEDFR

SEQ ID NO: 2895430 - protein, 7 aa, Entamoeba invadens
QAPPAIR

SEQ ID NO: 2895431 - protein, 7 aa, Entamoeba invadens
QAPPDKL

SEQ ID NO: 2895432 - protein, 9 aa, Entamoeba invadens
QAPPQQTPF

SEQ ID NO: 2895433 - protein, 4 aa, Entamoeba invadens
QAPQ

SEQ ID NO: 2895434 - protein, 10 aa, Entamoeba invadens
QAPSEAPTID

SEQ ID NO: 2895435 - protein, 8 aa, Entamoeba invadens
QAPTPDEA

SEQ ID NO: 2895436 - protein, 16 aa, Entamoeba invadens
QAPTRVAPELQAYPFI

SEQ ID NO: 2895437 - protein, 13 aa, Entamoeba invadens
QAPVDEKQIEQEL

SEQ ID NO: 2895438 - protein, 6 aa, Entamoeba invadens
QAQHSN

SEQ ID NO: 2895439 - protein, 4 aa, Entamoeba invadens
QAQI

SEQ ID NO: 2895440 - protein, 8 aa, Entamoeba invadens
QAQKESFL

SEQ ID NO: 2895441 - protein, 10 aa, Entamoeba invadens
QAQKKEINDK

SEQ ID NO: 2895442 - protein, 7 aa, Entamoeba invadens
QAQLEKV

SEQ ID NO: 2895443 - protein, 26 aa, Entamoeba invadens
QAQPDEERQKLDSADAARKAAESKLQ

SEQ ID NO: 2895444 - protein, 17 aa, Entamoeba invadens
QAQPDEERQNADTNDLT

SEQ ID NO: 2895445 - protein, 39 aa, Entamoeba invadens
QAQPNKKEKEEKTETTLLEEKKEKKVKKEALKKEKTVPL

SEQ ID NO: 2895446 - protein, 16 aa, Entamoeba invadens
QAQPQNAGEQQTQQLQ

SEQ ID NO: 2895447 - protein, 4 aa, Entamoeba invadens
QAQS

SEQ ID NO: 2895448 - protein, 11 aa, Entamoeba invadens
QAQSGTGKTAA

SEQ ID NO: 2895449 - protein, 7 aa, Entamoeba invadens
QAQYSKK

SEQ ID NO: 2895450 - protein, 10 aa, Entamoeba invadens
QARDGIQAGY

SEQ ID NO: 2895451 - protein, 9 aa, Entamoeba invadens
QARGCTSDD

SEQ ID NO: 2895452 - protein, 14 aa, Entamoeba invadens
QARKSNGSGGERAN

SEQ ID NO: 2895453 - protein, 7 aa, Entamoeba invadens
QARNQNE

SEQ ID NO: 2895454 - protein, 13 aa, Entamoeba invadens
QARQAKKMTQKEL

SEQ ID NO: 2895455 - protein, 7 aa, Entamoeba invadens
QARSDVS

SEQ ID NO: 2895456 - protein, 9 aa, Entamoeba invadens
QASDPSLRK

SEQ ID NO: 2895457 - protein, 14 aa, Entamoeba invadens
QASEEKELVKQAAG

SEQ ID NO: 2895458 - protein, 8 aa, Entamoeba invadens
QASGEIGP

SEQ ID NO: 2895459 - protein, 10 aa, Entamoeba invadens
QASGQVDGES

SEQ ID NO: 2895460 - protein, 8 aa, Entamoeba invadens
QASKEAVD

SEQ ID NO: 2895461 - protein, 5 aa, Entamoeba invadens
QASNE

SEQ ID NO: 2895462 - protein, 13 aa, Entamoeba invadens
QASNLKTYNSSSI

SEQ ID NO: 2895463 - protein, 7 aa, Entamoeba invadens
QASQGLA

SEQ ID NO: 2895464 - protein, 4 aa, Entamoeba invadens
QASR

SEQ ID NO: 2895465 - protein, 6 aa, Entamoeba invadens
QASRDL

SEQ ID NO: 2895466 - protein, 10 aa, Entamoeba invadens
QASTDPGARG

SEQ ID NO: 2895467 - protein, 4 aa, Entamoeba invadens
QASV

SEQ ID NO: 2895468 - protein, 6 aa, Entamoeba invadens
QASYDP

SEQ ID NO: 2895469 - protein, 5 aa, Entamoeba invadens
QATDA

SEQ ID NO: 2895470 - protein, 10 aa, Entamoeba invadens
QATEEQRRAM

SEQ ID NO: 2895471 - protein, 5 aa, Entamoeba invadens
QATEI

SEQ ID NO: 2895472 - protein, 8 aa, Entamoeba invadens
QATEPIRR

SEQ ID NO: 2895473 - protein, 5 aa, Entamoeba invadens
QATFE

SEQ ID NO: 2895474 - protein, 17 aa, Entamoeba invadens
QATFPENTVRTDTAEYT

SEQ ID NO: 2895475 - protein, 7 aa, Entamoeba invadens
QATGEKE

SEQ ID NO: 2895476 - protein, 12 aa, Entamoeba invadens
QATKQGSWTIRV

SEQ ID NO: 2895477 - protein, 18 aa, Entamoeba invadens
QATLEKTDAPAIKQTAVN

SEQ ID NO: 2895478 - protein, 11 aa, Entamoeba invadens
QATNYTKDQYK

SEQ ID NO: 2895479 - protein, 5 aa, Entamoeba invadens
QATRT

SEQ ID NO: 2895480 - protein, 4 aa, Entamoeba invadens
QATV

SEQ ID NO: 2895481 - protein, 21 aa, Entamoeba invadens
QAVAAKKPTKAEIEKKRHEEI

SEQ ID NO: 2895482 - protein, 21 aa, Entamoeba invadens
QAVAAQKPTKAEIEKKRHEEI

SEQ ID NO: 2895483 - protein, 5 aa, Entamoeba invadens
QAVDS

SEQ ID NO: 2895484 - protein, 11 aa, Entamoeba invadens
QAVEEGKVPQT

SEQ ID NO: 2895485 - protein, 11 aa, Entamoeba invadens
QAVKEGKCDQS

SEQ ID NO: 2895486 - protein, 15 aa, Entamoeba invadens
QAVKGNIDKNNRTVT

SEQ ID NO: 2895487 - protein, 9 aa, Entamoeba invadens
QAVRGYDDE

SEQ ID NO: 2895488 - protein, 13 aa, Entamoeba invadens
QAVTNPKLPPGIE

SEQ ID NO: 2895489 - protein, 11 aa, Entamoeba invadens
QAYARSDEKDK

SEQ ID NO: 2895490 - protein, 10 aa, Entamoeba invadens
QAYGSDPKNL

SEQ ID NO: 2895491 - protein, 7 aa, Entamoeba invadens
QAYPKDT

SEQ ID NO: 2895492 - protein, 8 aa, Entamoeba invadens
QAYRNDPE

SEQ ID NO: 2895493 - protein, 8 aa, Entamoeba invadens
QAYTKDPI

SEQ ID NO: 2895494 - protein, 12 aa, Entamoeba invadens
QCAKDTAATVEN

SEQ ID NO: 2895495 - protein, 10 aa, Entamoeba invadens
QCDKGDERKL

SEQ ID NO: 2895496 - protein, 6 aa, Entamoeba invadens
QCEAPH

SEQ ID NO: 2895497 - protein, 5 aa, Entamoeba invadens
QCEDA

SEQ ID NO: 2895498 - protein, 7 aa, Entamoeba invadens
QCEGGST

SEQ ID NO: 2895499 - protein, 5 aa, Entamoeba invadens
QCEKN

SEQ ID NO: 2895500 - protein, 6 aa, Entamoeba invadens
QCEVKR

SEQ ID NO: 2895501 - protein, 24 aa, Entamoeba invadens
QCGGGQPKIPPAKKNDVVKRTAEL

SEQ ID NO: 2895502 - protein, 10 aa, Entamoeba invadens
QCGKSSASVS

SEQ ID NO: 2895503 - protein, 6 aa, Entamoeba invadens
QCGQTT

SEQ ID NO: 2895504 - protein, 7 aa, Entamoeba invadens
QCKEDKV

SEQ ID NO: 2895505 - protein, 6 aa, Entamoeba invadens
QCKPEE

SEQ ID NO: 2895506 - protein, 23 aa, Entamoeba invadens
QCKRCDSNCDRNKCDTVNGCTSC

SEQ ID NO: 2895507 - protein, 8 aa, Entamoeba invadens
QCNEEANI

SEQ ID NO: 2895508 - protein, 17 aa, Entamoeba invadens
QCNPPHPKYMTDQEVKN

SEQ ID NO: 2895509 - protein, 11 aa, Entamoeba invadens
QCNRPESKVTF

SEQ ID NO: 2895510 - protein, 7 aa, Entamoeba invadens
QCNSDDG

SEQ ID NO: 2895511 - protein, 11 aa, Entamoeba invadens
QCNTGSSFSTI

SEQ ID NO: 2895512 - protein, 9 aa, Entamoeba invadens
QCQNKTYEF

SEQ ID NO: 2895513 - protein, 6 aa, Entamoeba invadens
QCQSSL

SEQ ID NO: 2895514 - protein, 9 aa, Entamoeba invadens
QCRKAPKPR

SEQ ID NO: 2895515 - protein, 6 aa, Entamoeba invadens
QCSQCE

SEQ ID NO: 2895516 - protein, 9 aa, Entamoeba invadens
QCSQKNKMT

SEQ ID NO: 2895517 - protein, 13 aa, Entamoeba invadens
QCSREKRNKEALQ

SEQ ID NO: 2895518 - protein, 11 aa, Entamoeba invadens
QCSREKRNQEA

SEQ ID NO: 2895519 - protein, 11 aa, Entamoeba invadens
QCSRPESKVTF

SEQ ID NO: 2895520 - protein, 9 aa, Entamoeba invadens
QCSSPDSKV

SEQ ID NO: 2895521 - protein, 4 aa, Entamoeba invadens
QCTN

SEQ ID NO: 2895522 - protein, 10 aa, Entamoeba invadens
QCTQQTQTCN

SEQ ID NO: 2895523 - protein, 5 aa, Entamoeba invadens
QCYTD

SEQ ID NO: 2895524 - protein, 47 aa, Entamoeba invadens
QDAIEKEKRDRRRKEIESIREAREAAEKAEYAKIEQEEREQAERRKK

SEQ ID NO: 2895525 - protein, 20 aa, Entamoeba invadens
QDAKFQQKNLSSTTNSDAKV

SEQ ID NO: 2895526 - protein, 6 aa, Entamoeba invadens
QDAKKA

SEQ ID NO: 2895527 - protein, 8 aa, Entamoeba invadens
QDAKNGTK

SEQ ID NO: 2895528 - protein, 6 aa, Entamoeba invadens
QDAKPV

SEQ ID NO: 2895529 - protein, 10 aa, Entamoeba invadens
QDAPKTKTRS

SEQ ID NO: 2895530 - protein, 6 aa, Entamoeba invadens
QDATTA

SEQ ID NO: 2895531 - protein, 4 aa, Entamoeba invadens
QDAV

SEQ ID NO: 2895532 - protein, 6 aa, Entamoeba invadens
QDAWKT

SEQ ID NO: 2895533 - protein, 4 aa, Entamoeba invadens
QDDA

SEQ ID NO: 2895534 - protein, 5 aa, Entamoeba invadens
QDDDA

SEQ ID NO: 2895535 - protein, 8 aa, Entamoeba invadens
QDDDKLNV

SEQ ID NO: 2895536 - protein, 13 aa, Entamoeba invadens
QDDDSTIEEGFYF

SEQ ID NO: 2895537 - protein, 9 aa, Entamoeba invadens
QDDEERKGK

SEQ ID NO: 2895538 - protein, 15 aa, Entamoeba invadens
QDDEIQIQEEEQTNI

SEQ ID NO: 2895539 - protein, 5 aa, Entamoeba invadens
QDDET

SEQ ID NO: 2895540 - protein, 9 aa, Entamoeba invadens
QDDGAQQKV

SEQ ID NO: 2895541 - protein, 8 aa, Entamoeba invadens
QDDGKEFD

SEQ ID NO: 2895542 - protein, 4 aa, Entamoeba invadens
QDDI

SEQ ID NO: 2895543 - protein, 8 aa, Entamoeba invadens
QDDKNSFG

SEQ ID NO: 2895544 - protein, 4 aa, Entamoeba invadens
QDDL

SEQ ID NO: 2895545 - protein, 10 aa, Entamoeba invadens
QDDLKEEEIA

SEQ ID NO: 2895546 - protein, 9 aa, Entamoeba invadens
QDDNDTDVK

SEQ ID NO: 2895547 - protein, 8 aa, Entamoeba invadens
QDDQIKNK

SEQ ID NO: 2895548 - protein, 7 aa, Entamoeba invadens
QDDQSDC

SEQ ID NO: 2895549 - protein, 16 aa, Entamoeba invadens
QDDRENNDLRSKQEFN

SEQ ID NO: 2895550 - protein, 6 aa, Entamoeba invadens
QDDRKY

SEQ ID NO: 2895551 - protein, 9 aa, Entamoeba invadens
QDDSFDSEK

SEQ ID NO: 2895552 - protein, 8 aa, Entamoeba invadens
QDDSPDTE

SEQ ID NO: 2895553 - protein, 8 aa, Entamoeba invadens
QDDSPNKE

SEQ ID NO: 2895554 - protein, 7 aa, Entamoeba invadens
QDDSSYI

SEQ ID NO: 2895555 - protein, 7 aa, Entamoeba invadens
QDDTKGI

SEQ ID NO: 2895556 - protein, 8 aa, Entamoeba invadens
QDDTRGYL

SEQ ID NO: 2895557 - protein, 13 aa, Entamoeba invadens
QDDTTVDSTPSVH

SEQ ID NO: 2895558 - protein, 9 aa, Entamoeba invadens
QDDVDNMTD

SEQ ID NO: 2895559 - protein, 18 aa, Entamoeba invadens
QDEEDDHGKDDESEDEDG

SEQ ID NO: 2895560 - protein, 7 aa, Entamoeba invadens
QDEEEQF

SEQ ID NO: 2895561 - protein, 6 aa, Entamoeba invadens
QDEEIG

SEQ ID NO: 2895562 - protein, 4 aa, Entamoeba invadens
QDEF

SEQ ID NO: 2895563 - protein, 9 aa, Entamoeba invadens
QDEFEKEKE

SEQ ID NO: 2895564 - protein, 4 aa, Entamoeba invadens
QDEK

SEQ ID NO: 2895565 - protein, 5 aa, Entamoeba invadens
QDELD

SEQ ID NO: 2895566 - protein, 5 aa, Entamoeba invadens
QDELK

SEQ ID NO: 2895567 - protein, 7 aa, Entamoeba invadens
QDENGQI

SEQ ID NO: 2895568 - protein, 8 aa, Entamoeba invadens
QDENTTNT

SEQ ID NO: 2895569 - protein, 57 aa, Entamoeba invadens
QDEPEVKRKQLNKRKPLRKAKKAKGGEEKTEQKNKGETLDDHQQNLPKKNEMPEPPF

SEQ ID NO: 2895570 - protein, 9 aa, Entamoeba invadens
QDEPSGKCL

SEQ ID NO: 2895571 - protein, 7 aa, Entamoeba invadens
QDERYKK

SEQ ID NO: 2895572 - protein, 7 aa, Entamoeba invadens
QDESNPF

SEQ ID NO: 2895573 - protein, 10 aa, Entamoeba invadens
QDETETAETA

SEQ ID NO: 2895574 - protein, 6 aa, Entamoeba invadens
QDEVEK

SEQ ID NO: 2895575 - protein, 19 aa, Entamoeba invadens
QDEVTERVEEVKERANKLD

SEQ ID NO: 2895576 - protein, 10 aa, Entamoeba invadens
QDEYDHPEFD

SEQ ID NO: 2895577 - protein, 8 aa, Entamoeba invadens
QDFEENTQ

SEQ ID NO: 2895578 - protein, 12 aa, Entamoeba invadens
QDFEKTQVSAQK

SEQ ID NO: 2895579 - protein, 5 aa, Entamoeba invadens
QDFTT

SEQ ID NO: 2895580 - protein, 7 aa, Entamoeba invadens
QDGCSSK

SEQ ID NO: 2895581 - protein, 12 aa, Entamoeba invadens
QDGDVANKESKF

SEQ ID NO: 2895582 - protein, 13 aa, Entamoeba invadens
QDGDVTVSNDGAT

SEQ ID NO: 2895583 - protein, 12 aa, Entamoeba invadens
QDGDVVNKESTF

SEQ ID NO: 2895584 - protein, 7 aa, Entamoeba invadens
QDGEAYW

SEQ ID NO: 2895585 - protein, 6 aa, Entamoeba invadens
QDGFTK

SEQ ID NO: 2895586 - protein, 10 aa, Entamoeba invadens
QDGGESPLNK

SEQ ID NO: 2895587 - protein, 6 aa, Entamoeba invadens
QDGGMD

SEQ ID NO: 2895588 - protein, 7 aa, Entamoeba invadens
QDGKASF

SEQ ID NO: 2895589 - protein, 10 aa, Entamoeba invadens
QDGKERPTFD

SEQ ID NO: 2895590 - protein, 9 aa, Entamoeba invadens
QDGSENIPE

SEQ ID NO: 2895591 - protein, 6 aa, Entamoeba invadens
QDGSNN

SEQ ID NO: 2895592 - protein, 4 aa, Entamoeba invadens
QDGT

SEQ ID NO: 2895593 - protein, 7 aa, Entamoeba invadens
QDGTKIG

SEQ ID NO: 2895594 - protein, 6 aa, Entamoeba invadens
QDGTLD

SEQ ID NO: 2895595 - protein, 12 aa, Entamoeba invadens
QDHNGSVSKEEL

SEQ ID NO: 2895596 - protein, 9 aa, Entamoeba invadens
QDHTTTVTT

SEQ ID NO: 2895597 - protein, 6 aa, Entamoeba invadens
QDHYSG

SEQ ID NO: 2895598 - protein, 12 aa, Entamoeba invadens
QDIKKERKKISE

SEQ ID NO: 2895599 - protein, 6 aa, Entamoeba invadens
QDINST

SEQ ID NO: 2895600 - protein, 23 aa, Entamoeba invadens
QDIQENQQCELSPNLMTNNLSES

SEQ ID NO: 2895601 - protein, 5 aa, Entamoeba invadens
QDISQ

SEQ ID NO: 2895602 - protein, 5 aa, Entamoeba invadens
QDKAQ

SEQ ID NO: 2895603 - protein, 21 aa, Entamoeba invadens
QDKEDTETQKDQQNGSKLKNI

SEQ ID NO: 2895604 - protein, 10 aa, Entamoeba invadens
QDKEEQKVDY

SEQ ID NO: 2895605 - protein, 5 aa, Entamoeba invadens
QDKEP

SEQ ID NO: 2895606 - protein, 11 aa, Entamoeba invadens
QDKEVGDGTTT

SEQ ID NO: 2895607 - protein, 4 aa, Entamoeba invadens
QDKI

SEQ ID NO: 2895608 - protein, 73 aa, Entamoeba invadens
QDKIKEEPKPKEEPKKVEPKEQQKKEEPKPKADVKKEEPKKTEPKKEEKKEEPKTPAKAQPPQSPEKQSAPKF

SEQ ID NO: 2895609 - protein, 8 aa, Entamoeba invadens
QDKMDTKI

SEQ ID NO: 2895610 - protein, 7 aa, Entamoeba invadens
QDKMERN

SEQ ID NO: 2895611 - protein, 24 aa, Entamoeba invadens
QDKNDIPIENNTNPNQTEEETEFL

SEQ ID NO: 2895612 - protein, 4 aa, Entamoeba invadens
QDKP

SEQ ID NO: 2895613 - protein, 14 aa, Entamoeba invadens
QDKPGKTRLQEQGS

SEQ ID NO: 2895614 - protein, 8 aa, Entamoeba invadens
QDKQHAKS

SEQ ID NO: 2895615 - protein, 7 aa, Entamoeba invadens
QDKSKEF

SEQ ID NO: 2895616 - protein, 6 aa, Entamoeba invadens
QDKSLL

SEQ ID NO: 2895617 - protein, 11 aa, Entamoeba invadens
QDKTTKQISPV

SEQ ID NO: 2895618 - protein, 16 aa, Entamoeba invadens
QDKTVMEKQTKETLEI

SEQ ID NO: 2895619 - protein, 10 aa, Entamoeba invadens
QDKYKKPADV

SEQ ID NO: 2895620 - protein, 7 aa, Entamoeba invadens
QDKYNGS

SEQ ID NO: 2895621 - protein, 4 aa, Entamoeba invadens
QDLA

SEQ ID NO: 2895622 - protein, 11 aa, Entamoeba invadens
QDLEDRPRDNQ

SEQ ID NO: 2895623 - protein, 18 aa, Entamoeba invadens
QDLEDRPVGTSNTDQTEV

SEQ ID NO: 2895624 - protein, 10 aa, Entamoeba invadens
QDLKTDDFSE

SEQ ID NO: 2895625 - protein, 6 aa, Entamoeba invadens
QDLNEE

SEQ ID NO: 2895626 - protein, 8 aa, Entamoeba invadens
QDLNKDGS

SEQ ID NO: 2895627 - protein, 8 aa, Entamoeba invadens
QDLPEQRM

SEQ ID NO: 2895628 - protein, 10 aa, Entamoeba invadens
QDLRRKNHSN

SEQ ID NO: 2895629 - protein, 35 aa, Entamoeba invadens
QDLSGDCKRRNERTEENESLKEKTEQRKERKPLPT

SEQ ID NO: 2895630 - protein, 7 aa, Entamoeba invadens
QDLYGTS

SEQ ID NO: 2895631 - protein, 6 aa, Entamoeba invadens
QDMAGA

SEQ ID NO: 2895632 - protein, 12 aa, Entamoeba invadens
QDMSEGVTQKTA

SEQ ID NO: 2895633 - protein, 14 aa, Entamoeba invadens
QDNDEFDDWENEED

SEQ ID NO: 2895634 - protein, 9 aa, Entamoeba invadens
QDNGKLTRE

SEQ ID NO: 2895635 - protein, 5 aa, Entamoeba invadens
QDNKE

SEQ ID NO: 2895636 - protein, 18 aa, Entamoeba invadens
QDNKEKNAKLKRESTDSQ

SEQ ID NO: 2895637 - protein, 7 aa, Entamoeba invadens
QDNKPMK

SEQ ID NO: 2895638 - protein, 7 aa, Entamoeba invadens
QDNNTWT

SEQ ID NO: 2895639 - protein, 21 aa, Entamoeba invadens
QDNNYSPNQYGDAYQRQPDRF

SEQ ID NO: 2895640 - protein, 7 aa, Entamoeba invadens
QDNPQGV

SEQ ID NO: 2895641 - protein, 7 aa, Entamoeba invadens
QDNQHSA

SEQ ID NO: 2895642 - protein, 4 aa, Entamoeba invadens
QDNT

SEQ ID NO: 2895643 - protein, 10 aa, Entamoeba invadens
QDNTKQYNKY

SEQ ID NO: 2895644 - protein, 5 aa, Entamoeba invadens
QDNTT

SEQ ID NO: 2895645 - protein, 14 aa, Entamoeba invadens
QDNTVEVEGADPTL

SEQ ID NO: 2895646 - protein, 4 aa, Entamoeba invadens
QDNV

SEQ ID NO: 2895647 - protein, 10 aa, Entamoeba invadens
QDPDQSIQSN

SEQ ID NO: 2895648 - protein, 5 aa, Entamoeba invadens
QDPDV

SEQ ID NO: 2895649 - protein, 6 aa, Entamoeba invadens
QDPEGW

SEQ ID NO: 2895650 - protein, 9 aa, Entamoeba invadens
QDPEKRPDY

SEQ ID NO: 2895651 - protein, 10 aa, Entamoeba invadens
QDPEKRPGSS

SEQ ID NO: 2895652 - protein, 5 aa, Entamoeba invadens
QDPHS

SEQ ID NO: 2895653 - protein, 15 aa, Entamoeba invadens
QDPITKKWIEENTIP

SEQ ID NO: 2895654 - protein, 9 aa, Entamoeba invadens
QDPKIRPTF

SEQ ID NO: 2895655 - protein, 6 aa, Entamoeba invadens
QDPKLK

SEQ ID NO: 2895656 - protein, 11 aa, Entamoeba invadens
QDPMKQKKSEE

SEQ ID NO: 2895657 - protein, 5 aa, Entamoeba invadens
QDPNA

SEQ ID NO: 2895658 - protein, 8 aa, Entamoeba invadens
QDPNTSTF

SEQ ID NO: 2895659 - protein, 6 aa, Entamoeba invadens
QDPQSQ

SEQ ID NO: 2895660 - protein, 8 aa, Entamoeba invadens
QDPRERPD

SEQ ID NO: 2895661 - protein, 9 aa, Entamoeba invadens
QDPRERPDM

SEQ ID NO: 2895662 - protein, 10 aa, Entamoeba invadens
QDPRERPDMD

SEQ ID NO: 2895663 - protein, 6 aa, Entamoeba invadens
QDPSHA

SEQ ID NO: 2895664 - protein, 6 aa, Entamoeba invadens
QDPSKH

SEQ ID NO: 2895665 - protein, 7 aa, Entamoeba invadens
QDPSTAC

SEQ ID NO: 2895666 - protein, 6 aa, Entamoeba invadens
QDPTDC

SEQ ID NO: 2895667 - protein, 8 aa, Entamoeba invadens
QDPTEAHV

SEQ ID NO: 2895668 - protein, 8 aa, Entamoeba invadens
QDPTFSND

SEQ ID NO: 2895669 - protein, 12 aa, Entamoeba invadens
QDPTNDLDDDTD

SEQ ID NO: 2895670 - protein, 6 aa, Entamoeba invadens
QDPTTA

SEQ ID NO: 2895671 - protein, 14 aa, Entamoeba invadens
QDPYDSDQIAAATR

SEQ ID NO: 2895672 - protein, 6 aa, Entamoeba invadens
QDQECA

SEQ ID NO: 2895673 - protein, 14 aa, Entamoeba invadens
QDQKEKVNQNVIRI

SEQ ID NO: 2895674 - protein, 9 aa, Entamoeba invadens
QDQPQKNEP

SEQ ID NO: 2895675 - protein, 8 aa, Entamoeba invadens
QDQRKYDK

SEQ ID NO: 2895676 - protein, 10 aa, Entamoeba invadens
QDQSRSFSNC

SEQ ID NO: 2895677 - protein, 8 aa, Entamoeba invadens
QDQSYQKK

SEQ ID NO: 2895678 - protein, 4 aa, Entamoeba invadens
QDQT

SEQ ID NO: 2895679 - protein, 7 aa, Entamoeba invadens
QDQTEKR

SEQ ID NO: 2895680 - protein, 4 aa, Entamoeba invadens
QDQY

SEQ ID NO: 2895681 - protein, 5 aa, Entamoeba invadens
QDRDF

SEQ ID NO: 2895682 - protein, 5 aa, Entamoeba invadens
QDREN

SEQ ID NO: 2895683 - protein, 17 aa, Entamoeba invadens
QDRGQEKDEQKEKKRSF

SEQ ID NO: 2895684 - protein, 6 aa, Entamoeba invadens
QDRNVN

SEQ ID NO: 2895685 - protein, 6 aa, Entamoeba invadens
QDRQTR

SEQ ID NO: 2895686 - protein, 8 aa, Entamoeba invadens
QDRSGTLE

SEQ ID NO: 2895687 - protein, 9 aa, Entamoeba invadens
QDRSKTFTC

SEQ ID NO: 2895688 - protein, 7 aa, Entamoeba invadens
QDRTRAV

SEQ ID NO: 2895689 - protein, 16 aa, Entamoeba invadens
QDSANHIGKTGFGQSE

SEQ ID NO: 2895690 - protein, 8 aa, Entamoeba invadens
QDSENPKT

SEQ ID NO: 2895691 - protein, 9 aa, Entamoeba invadens
QDSESSKTA

SEQ ID NO: 2895692 - protein, 11 aa, Entamoeba invadens
QDSEVGDGTTT

SEQ ID NO: 2895693 - protein, 7 aa, Entamoeba invadens
QDSGKLR

SEQ ID NO: 2895694 - protein, 9 aa, Entamoeba invadens
QDSLTGDIT

SEQ ID NO: 2895695 - protein, 15 aa, Entamoeba invadens
QDSMKHKTTEEVNNP

SEQ ID NO: 2895696 - protein, 8 aa, Entamoeba invadens
QDSPKVLE

SEQ ID NO: 2895697 - protein, 8 aa, Entamoeba invadens
QDSPYNDD

SEQ ID NO: 2895698 - protein, 5 aa, Entamoeba invadens
QDSQA

SEQ ID NO: 2895699 - protein, 17 aa, Entamoeba invadens
QDSQANQQNPPQHSNNP

SEQ ID NO: 2895700 - protein, 7 aa, Entamoeba invadens
QDSSQGE

SEQ ID NO: 2895701 - protein, 8 aa, Entamoeba invadens
QDSTENAQ

SEQ ID NO: 2895702 - protein, 6 aa, Entamoeba invadens
QDSTPS

SEQ ID NO: 2895703 - protein, 16 aa, Entamoeba invadens
QDSTRKLPNETTQQAI

SEQ ID NO: 2895704 - protein, 17 aa, Entamoeba invadens
QDTDNESQNTNDSTKEE

SEQ ID NO: 2895705 - protein, 23 aa, Entamoeba invadens
QDTDSKKAYCDKLSNEKNEVANH

SEQ ID NO: 2895706 - protein, 12 aa, Entamoeba invadens
QDTENIKRNVER

SEQ ID NO: 2895707 - protein, 18 aa, Entamoeba invadens
QDTGKEQYDQKREDEWDD

SEQ ID NO: 2895708 - protein, 5 aa, Entamoeba invadens
QDTIN

SEQ ID NO: 2895709 - protein, 11 aa, Entamoeba invadens
QDTKNDDGNKN

SEQ ID NO: 2895710 - protein, 6 aa, Entamoeba invadens
QDTKQD

SEQ ID NO: 2895711 - protein, 12 aa, Entamoeba invadens
QDTLRAKSKAHA

SEQ ID NO: 2895712 - protein, 10 aa, Entamoeba invadens
QDTLSQNIQT

SEQ ID NO: 2895713 - protein, 10 aa, Entamoeba invadens
QDTNGLTETQ

SEQ ID NO: 2895714 - protein, 6 aa, Entamoeba invadens
QDTNNR

SEQ ID NO: 2895715 - protein, 9 aa, Entamoeba invadens
QDTQKPKGC

SEQ ID NO: 2895716 - protein, 11 aa, Entamoeba invadens
QDTSGQEEYSA

SEQ ID NO: 2895717 - protein, 9 aa, Entamoeba invadens
QDTSKVGEV

SEQ ID NO: 2895718 - protein, 8 aa, Entamoeba invadens
QDTTSRTK

SEQ ID NO: 2895719 - protein, 11 aa, Entamoeba invadens
QDTVESSTAVT

SEQ ID NO: 2895720 - protein, 7 aa, Entamoeba invadens
QDTVQNI

SEQ ID NO: 2895721 - protein, 7 aa, Entamoeba invadens
QDTVSGM

SEQ ID NO: 2895722 - protein, 11 aa, Entamoeba invadens
QDVDQGELEDD

SEQ ID NO: 2895723 - protein, 8 aa, Entamoeba invadens
QDVESSPD

SEQ ID NO: 2895724 - protein, 5 aa, Entamoeba invadens
QDVFK

SEQ ID NO: 2895725 - protein, 13 aa, Entamoeba invadens
QDVGDESNAEGID

SEQ ID NO: 2895726 - protein, 4 aa, Entamoeba invadens
QDVL

SEQ ID NO: 2895727 - protein, 6 aa, Entamoeba invadens
QDVPDG

SEQ ID NO: 2895728 - protein, 6 aa, Entamoeba invadens
QDVPEN

SEQ ID NO: 2895729 - protein, 14 aa, Entamoeba invadens
QDVPGKYDAEPTNK

SEQ ID NO: 2895730 - protein, 4 aa, Entamoeba invadens
QDVS

SEQ ID NO: 2895731 - protein, 11 aa, Entamoeba invadens
QDVSDKTSSFL

SEQ ID NO: 2895732 - protein, 5 aa, Entamoeba invadens
QDVST

SEQ ID NO: 2895733 - protein, 8 aa, Entamoeba invadens
QDVSTRNK

SEQ ID NO: 2895734 - protein, 7 aa, Entamoeba invadens
QDVTPQN

SEQ ID NO: 2895735 - protein, 17 aa, Entamoeba invadens
QDYDKSQKELQTQYNGL

SEQ ID NO: 2895736 - protein, 6 aa, Entamoeba invadens
QDYEER

SEQ ID NO: 2895737 - protein, 9 aa, Entamoeba invadens
QDYTNGLAS

SEQ ID NO: 2895738 - protein, 69 aa, Entamoeba invadens
QEAERIKREKELQQKAIEEQKQKQIEEQKRAEAERIAEAEKQKKIAEEKAKIEAERKRIEEERRQEELE

SEQ ID NO: 2895739 - protein, 4 aa, Entamoeba invadens
QEAF

SEQ ID NO: 2895740 - protein, 4 aa, Entamoeba invadens
QEAG

SEQ ID NO: 2895741 - protein, 21 aa, Entamoeba invadens
QEAKQSMEETADLAGRERRNS

SEQ ID NO: 2895742 - protein, 6 aa, Entamoeba invadens
QEALDN

SEQ ID NO: 2895743 - protein, 7 aa, Entamoeba invadens
QEANTIS

SEQ ID NO: 2895744 - protein, 8 aa, Entamoeba invadens
QEAPEKLK

SEQ ID NO: 2895745 - protein, 8 aa, Entamoeba invadens
QEAQKYKP

SEQ ID NO: 2895746 - protein, 9 aa, Entamoeba invadens
QEATQSDSY

SEQ ID NO: 2895747 - protein, 4 aa, Entamoeba invadens
QECE

SEQ ID NO: 2895748 - protein, 8 aa, Entamoeba invadens
QECEGGMD

SEQ ID NO: 2895749 - protein, 9 aa, Entamoeba invadens
QECTDKETL

SEQ ID NO: 2895750 - protein, 10 aa, Entamoeba invadens
QECTKSSIEQ

SEQ ID NO: 2895751 - protein, 6 aa, Entamoeba invadens
QEDATE

SEQ ID NO: 2895752 - protein, 10 aa, Entamoeba invadens
QEDEDVGKMA

SEQ ID NO: 2895753 - protein, 8 aa, Entamoeba invadens
QEDEEDTP

SEQ ID NO: 2895754 - protein, 16 aa, Entamoeba invadens
QEDEMRKKKTSEYSGG

SEQ ID NO: 2895755 - protein, 13 aa, Entamoeba invadens
QEDENNQISPANR

SEQ ID NO: 2895756 - protein, 10 aa, Entamoeba invadens
QEDEVDDKRN

SEQ ID NO: 2895757 - protein, 4 aa, Entamoeba invadens
QEDF

SEQ ID NO: 2895758 - protein, 22 aa, Entamoeba invadens
QEDIDDGNDITDNDNDDEEVYS

SEQ ID NO: 2895759 - protein, 8 aa, Entamoeba invadens
QEDIDNPI

SEQ ID NO: 2895760 - protein, 6 aa, Entamoeba invadens
QEDPTV

SEQ ID NO: 2895761 - protein, 18 aa, Entamoeba invadens
QEDSKNRNENREKPLTAK

SEQ ID NO: 2895762 - protein, 9 aa, Entamoeba invadens
QEDSQTEIV

SEQ ID NO: 2895763 - protein, 4 aa, Entamoeba invadens
QEDV

SEQ ID NO: 2895764 - protein, 6 aa, Entamoeba invadens
QEDVDD

SEQ ID NO: 2895765 - protein, 8 aa, Entamoeba invadens
QEDVNKAG

SEQ ID NO: 2895766 - protein, 459 aa, Entamoeba invadens
QEDVPEEENKEIPTEEKKAEEEAKPEEATKVEEAKPEEVKTEEPKAEEEKQQTEDEEKMKQEKEAVEAKAKEEEEQKKKEEEEKLAKEEAEKAEAEKEEKEVAEAKAKEEEERLQKEKEEKEAAEKAEQEKLAKEKSEQEEKERLEKEEAAKAEAERLQKEKEEQEAATKAEEERLQKEKEEKERIEKEEAEKEKAEQEEKERLAKEEAEKAEAERLQKEKAEKEEAERLQKEKEEKEAAEKAEQERIAKEQEEKERLEKEAAAKAEAERLQKEKEEAEAKAEQERIAKEKAEQEEKERLEKEKLEKEAAEKAEAERIAAEKEETERLAKEKAEKEAAEAKAKEEEERLTKEKEAAEKAEQERIAKEKAEQETAEKLQKEKEEQEKLAKEKAEQEEKERLAKEAAEVERVQKEKEAAEKQAQEVSHEKKDSVGELQKIDSRKNIPLPKNRTPRTTNTTL

SEQ ID NO: 2895767 - protein, 4 aa, Entamoeba invadens
QEDY

SEQ ID NO: 2895768 - protein, 7 aa, Entamoeba invadens
QEEAQKR

SEQ ID NO: 2895769 - protein, 5 aa, Entamoeba invadens
QEEDD

SEQ ID NO: 2895770 - protein, 11 aa, Entamoeba invadens
QEEDEKEAKRL

SEQ ID NO: 2895771 - protein, 9 aa, Entamoeba invadens
QEEDGSLRE

SEQ ID NO: 2895772 - protein, 5 aa, Entamoeba invadens
QEEDY

SEQ ID NO: 2895773 - protein, 4 aa, Entamoeba invadens
QEEE

SEQ ID NO: 2895774 - protein, 8 aa, Entamoeba invadens
QEEERRTG

SEQ ID NO: 2895775 - protein, 12 aa, Entamoeba invadens
QEEESLNNENKA

SEQ ID NO: 2895776 - protein, 32 aa, Entamoeba invadens
QEEETDKDKKKQGEKEKEEGVEYDKPFEKPFD

SEQ ID NO: 2895777 - protein, 9 aa, Entamoeba invadens
QEEFSSREL

SEQ ID NO: 2895778 - protein, 5 aa, Entamoeba invadens
QEEGK

SEQ ID NO: 2895779 - protein, 7 aa, Entamoeba invadens
QEEGTEK

SEQ ID NO: 2895780 - protein, 8 aa, Entamoeba invadens
QEEHDKRT

SEQ ID NO: 2895781 - protein, 14 aa, Entamoeba invadens
QEEHQKEKEKPAIE

SEQ ID NO: 2895782 - protein, 5 aa, Entamoeba invadens
QEEKI

SEQ ID NO: 2895783 - protein, 14 aa, Entamoeba invadens
QEEKKENRLRGVEA

SEQ ID NO: 2895784 - protein, 9 aa, Entamoeba invadens
QEEKKKGNR

SEQ ID NO: 2895785 - protein, 6 aa, Entamoeba invadens
QEEKKQ

SEQ ID NO: 2895786 - protein, 17 aa, Entamoeba invadens
QEEKPSLSIVLSRTNCT

SEQ ID NO: 2895787 - protein, 8 aa, Entamoeba invadens
QEEKSLET

SEQ ID NO: 2895788 - protein, 7 aa, Entamoeba invadens
QEELGNR

SEQ ID NO: 2895789 - protein, 6 aa, Entamoeba invadens
QEEMNC

SEQ ID NO: 2895790 - protein, 14 aa, Entamoeba invadens
QEENETNGSVQSIT

SEQ ID NO: 2895791 - protein, 5 aa, Entamoeba invadens
QEENL

SEQ ID NO: 2895792 - protein, 7 aa, Entamoeba invadens
QEENPNN

SEQ ID NO: 2895793 - protein, 5 aa, Entamoeba invadens
QEENT

SEQ ID NO: 2895794 - protein, 22 aa, Entamoeba invadens
QEEQHNQTVSMEEEQNPQLEEN

SEQ ID NO: 2895795 - protein, 7 aa, Entamoeba invadens
QEEQNAK

SEQ ID NO: 2895796 - protein, 12 aa, Entamoeba invadens
QEERQGKSVGDA

SEQ ID NO: 2895797 - protein, 73 aa, Entamoeba invadens
QEESDKKHEKVKKGLKATRDEDEKSDESSEESVDKNMSEEPEKSEETDKSEESEDEKKKPKKKENKTKITKEV

SEQ ID NO: 2895798 - protein, 7 aa, Entamoeba invadens
QEESIEA

SEQ ID NO: 2895799 - protein, 10 aa, Entamoeba invadens
QEESSDNSCK

SEQ ID NO: 2895800 - protein, 6 aa, Entamoeba invadens
QEETDP

SEQ ID NO: 2895801 - protein, 11 aa, Entamoeba invadens
QEETKEEVTGT

SEQ ID NO: 2895802 - protein, 12 aa, Entamoeba invadens
QEETQSCLSNKT

SEQ ID NO: 2895803 - protein, 8 aa, Entamoeba invadens
QEETTTIG

SEQ ID NO: 2895804 - protein, 31 aa, Entamoeba invadens
QEEVKSEDTKIDKEAEEIKSEPKTIPTPTKP

SEQ ID NO: 2895805 - protein, 4 aa, Entamoeba invadens
QEEY

SEQ ID NO: 2895806 - protein, 7 aa, Entamoeba invadens
QEEYGNA

SEQ ID NO: 2895807 - protein, 7 aa, Entamoeba invadens
QEFEESK

SEQ ID NO: 2895808 - protein, 6 aa, Entamoeba invadens
QEFEVP

SEQ ID NO: 2895809 - protein, 14 aa, Entamoeba invadens
QEFKETKEKSKEKM

SEQ ID NO: 2895810 - protein, 8 aa, Entamoeba invadens
QEGAEVTK

SEQ ID NO: 2895811 - protein, 19 aa, Entamoeba invadens
QEGAKQKCSVNDNTLDAVD

SEQ ID NO: 2895812 - protein, 14 aa, Entamoeba invadens
QEGASQRDVYGNTP

SEQ ID NO: 2895813 - protein, 14 aa, Entamoeba invadens
QEGEKITVQFRLGC

SEQ ID NO: 2895814 - protein, 12 aa, Entamoeba invadens
QEGENESQSGCP

SEQ ID NO: 2895815 - protein, 7 aa, Entamoeba invadens
QEGETPL

SEQ ID NO: 2895816 - protein, 8 aa, Entamoeba invadens
QEGGITGL

SEQ ID NO: 2895817 - protein, 5 aa, Entamoeba invadens
QEGIT

SEQ ID NO: 2895818 - protein, 7 aa, Entamoeba invadens
QEGKAGL

SEQ ID NO: 2895819 - protein, 5 aa, Entamoeba invadens
QEGKE

SEQ ID NO: 2895820 - protein, 11 aa, Entamoeba invadens
QEGKEQPTMGE

SEQ ID NO: 2895821 - protein, 8 aa, Entamoeba invadens
QEGKTTSF

SEQ ID NO: 2895822 - protein, 4 aa, Entamoeba invadens
QEGL

SEQ ID NO: 2895823 - protein, 7 aa, Entamoeba invadens
QEGLTDT

SEQ ID NO: 2895824 - protein, 4 aa, Entamoeba invadens
QEGM

SEQ ID NO: 2895825 - protein, 5 aa, Entamoeba invadens
QEGNL

SEQ ID NO: 2895826 - protein, 5 aa, Entamoeba invadens
QEGNP

SEQ ID NO: 2895827 - protein, 8 aa, Entamoeba invadens
QEGNTSQV

SEQ ID NO: 2895828 - protein, 5 aa, Entamoeba invadens
QEGNV

SEQ ID NO: 2895829 - protein, 5 aa, Entamoeba invadens
QEGPQ

SEQ ID NO: 2895830 - protein, 7 aa, Entamoeba invadens
QEGRADA

SEQ ID NO: 2895831 - protein, 11 aa, Entamoeba invadens
QEGRLDKSAVS

SEQ ID NO: 2895832 - protein, 6 aa, Entamoeba invadens
QEGRLH

SEQ ID NO: 2895833 - protein, 11 aa, Entamoeba invadens
QEGRSQKEADI

SEQ ID NO: 2895834 - protein, 13 aa, Entamoeba invadens
QEGTELIDEESGR

SEQ ID NO: 2895835 - protein, 13 aa, Entamoeba invadens
QEGYDKADKIGKE

SEQ ID NO: 2895836 - protein, 4 aa, Entamoeba invadens
QEHG

SEQ ID NO: 2895837 - protein, 5 aa, Entamoeba invadens
QEHKE

SEQ ID NO: 2895838 - protein, 4 aa, Entamoeba invadens
QEHN

SEQ ID NO: 2895839 - protein, 8 aa, Entamoeba invadens
QEHNTTVE

SEQ ID NO: 2895840 - protein, 4 aa, Entamoeba invadens
QEHP

SEQ ID NO: 2895841 - protein, 7 aa, Entamoeba invadens
QEHQQSA

SEQ ID NO: 2895842 - protein, 4 aa, Entamoeba invadens
QEHV

SEQ ID NO: 2895843 - protein, 6 aa, Entamoeba invadens
QEIAQN

SEQ ID NO: 2895844 - protein, 13 aa, Entamoeba invadens
QEIDSQKKDNDTF

SEQ ID NO: 2895845 - protein, 10 aa, Entamoeba invadens
QEIDTSEQIK

SEQ ID NO: 2895846 - protein, 6 aa, Entamoeba invadens
QEIEHT

SEQ ID NO: 2895847 - protein, 14 aa, Entamoeba invadens
QEIEPKERSQKLPD

SEQ ID NO: 2895848 - protein, 33 aa, Entamoeba invadens
QEIKENHKNEEKSETKEIKEDQKKDEKKFETKN

SEQ ID NO: 2895849 - protein, 6 aa, Entamoeba invadens
QEIKNE

SEQ ID NO: 2895850 - protein, 6 aa, Entamoeba invadens
QEINNQ

SEQ ID NO: 2895851 - protein, 19 aa, Entamoeba invadens
QEIQQDQQQHTDPGHTLPP

SEQ ID NO: 2895852 - protein, 11 aa, Entamoeba invadens
QEITSGAQRIH

SEQ ID NO: 2895853 - protein, 4 aa, Entamoeba invadens
QEKA

SEQ ID NO: 2895854 - protein, 6 aa, Entamoeba invadens
QEKADG

SEQ ID NO: 2895855 - protein, 14 aa, Entamoeba invadens
QEKAKSPNLPYTDK

SEQ ID NO: 2895856 - protein, 13 aa, Entamoeba invadens
QEKDATPKSPRTS

SEQ ID NO: 2895857 - protein, 74 aa, Entamoeba invadens
QEKDEDDDKSEDSSDSLDKSNDDSEGAQMKMEDDDSFSEEEVKEELSGEESSSEDEDKAKATKSKKDKDEEEED

SEQ ID NO: 2895858 - protein, 10 aa, Entamoeba invadens
QEKDQLEEKQ

SEQ ID NO: 2895859 - protein, 4 aa, Entamoeba invadens
QEKE

SEQ ID NO: 2895860 - protein, 25 aa, Entamoeba invadens
QEKEAALKKAEEDRIAKEKAEKERL

SEQ ID NO: 2895861 - protein, 8 aa, Entamoeba invadens
QEKEARKD

SEQ ID NO: 2895862 - protein, 6 aa, Entamoeba invadens
QEKEDI

SEQ ID NO: 2895863 - protein, 42 aa, Entamoeba invadens
QEKEEEEKKKEEEEEKKKGKKGKKDKKKDKKSKKGDKEKCCI

SEQ ID NO: 2895864 - protein, 13 aa, Entamoeba invadens
QEKEKAKYTEPDN

SEQ ID NO: 2895865 - protein, 14 aa, Entamoeba invadens
QEKENENKKLSDDL

SEQ ID NO: 2895866 - protein, 24 aa, Entamoeba invadens
QEKENERKMTEEAQERLKKEMDDK

SEQ ID NO: 2895867 - protein, 23 aa, Entamoeba invadens
QEKERIAQEVKEREEARAETEKI

SEQ ID NO: 2895868 - protein, 28 aa, Entamoeba invadens
QEKFSNDVKQGIAEKTAKRRYETNRTTE

SEQ ID NO: 2895869 - protein, 10 aa, Entamoeba invadens
QEKGDKSVQC

SEQ ID NO: 2895870 - protein, 4 aa, Entamoeba invadens
QEKI

SEQ ID NO: 2895871 - protein, 4 aa, Entamoeba invadens
QEKK

SEQ ID NO: 2895872 - protein, 11 aa, Entamoeba invadens
QEKKEELGKRG

SEQ ID NO: 2895873 - protein, 15 aa, Entamoeba invadens
QEKKNTQQNYKSSKY

SEQ ID NO: 2895874 - protein, 6 aa, Entamoeba invadens
QEKKPF

SEQ ID NO: 2895875 - protein, 10 aa, Entamoeba invadens
QEKLESKAFK

SEQ ID NO: 2895876 - protein, 17 aa, Entamoeba invadens
QEKNDAKNVEEKITNLD

SEQ ID NO: 2895877 - protein, 14 aa, Entamoeba invadens
QEKNEKDKQIEFGN

SEQ ID NO: 2895878 - protein, 6 aa, Entamoeba invadens
QEKNFS

SEQ ID NO: 2895879 - protein, 8 aa, Entamoeba invadens
QEKNFSKL

SEQ ID NO: 2895880 - protein, 25 aa, Entamoeba invadens
QEKNHAKGEADSDLLEEAEKTVEEF

SEQ ID NO: 2895881 - protein, 8 aa, Entamoeba invadens
QEKNTISM

SEQ ID NO: 2895882 - protein, 8 aa, Entamoeba invadens
QEKQMAET

SEQ ID NO: 2895883 - protein, 4 aa, Entamoeba invadens
QEKR

SEQ ID NO: 2895884 - protein, 13 aa, Entamoeba invadens
QEKSQDTRKNKMN

SEQ ID NO: 2895885 - protein, 7 aa, Entamoeba invadens
QEKTENA

SEQ ID NO: 2895886 - protein, 7 aa, Entamoeba invadens
QEKTSTE

SEQ ID NO: 2895887 - protein, 7 aa, Entamoeba invadens
QEKTYKK

SEQ ID NO: 2895888 - protein, 14 aa, Entamoeba invadens
QEKVEKDDSDEYSY

SEQ ID NO: 2895889 - protein, 8 aa, Entamoeba invadens
QEKVEKTQ

SEQ ID NO: 2895890 - protein, 101 aa, Entamoeba invadens
QEKVKGKKDAIKSKKDKLKDKREKKKTQRKDKLQKRKQKAQAQKEKRKKERKNKRKDQRKDKREARRKDLKDKKEKKDKKTQDKNNDKNKTTYTYSAQTKH

SEQ ID NO: 2895891 - protein, 4 aa, Entamoeba invadens
QEKY

SEQ ID NO: 2895892 - protein, 13 aa, Entamoeba invadens
QEKYDQNCPKGFQ

SEQ ID NO: 2895893 - protein, 7 aa, Entamoeba invadens
QEKYEED

SEQ ID NO: 2895894 - protein, 9 aa, Entamoeba invadens
QEKYKEPAD

SEQ ID NO: 2895895 - protein, 8 aa, Entamoeba invadens
QEKYKKEA

SEQ ID NO: 2895896 - protein, 10 aa, Entamoeba invadens
QEKYKKPADI

SEQ ID NO: 2895897 - protein, 10 aa, Entamoeba invadens
QEKYKKPADV

SEQ ID NO: 2895898 - protein, 10 aa, Entamoeba invadens
QEKYKKSADI

SEQ ID NO: 2895899 - protein, 19 aa, Entamoeba invadens
QEKYKKSADVYSEAYPKKC

SEQ ID NO: 2895900 - protein, 8 aa, Entamoeba invadens
QEKYKQAA

SEQ ID NO: 2895901 - protein, 9 aa, Entamoeba invadens
QEKYKQAAD

SEQ ID NO: 2895902 - protein, 8 aa, Entamoeba invadens
QEKYPDQF

SEQ ID NO: 2895903 - protein, 9 aa, Entamoeba invadens
QEKYQKSAD

SEQ ID NO: 2895904 - protein, 7 aa, Entamoeba invadens
QEKYTKS

SEQ ID NO: 2895905 - protein, 9 aa, Entamoeba invadens
QEKYTKSAD

SEQ ID NO: 2895906 - protein, 11 aa, Entamoeba invadens
QEKYYEHQRDM

SEQ ID NO: 2895907 - protein, 8 aa, Entamoeba invadens
QEKYYSEY

SEQ ID NO: 2895908 - protein, 6 aa, Entamoeba invadens
QELEGR

SEQ ID NO: 2895909 - protein, 8 aa, Entamoeba invadens
QELEPSEE

SEQ ID NO: 2895910 - protein, 4 aa, Entamoeba invadens
QELF

SEQ ID NO: 2895911 - protein, 4 aa, Entamoeba invadens
QELG

SEQ ID NO: 2895912 - protein, 11 aa, Entamoeba invadens
QELHKRTPSVE

SEQ ID NO: 2895913 - protein, 18 aa, Entamoeba invadens
QELKDGLTKKIEDTQQTV

SEQ ID NO: 2895914 - protein, 10 aa, Entamoeba invadens
QELPKGTLSD

SEQ ID NO: 2895915 - protein, 8 aa, Entamoeba invadens
QELQDGGE

SEQ ID NO: 2895916 - protein, 8 aa, Entamoeba invadens
QELQETQN

SEQ ID NO: 2895917 - protein, 7 aa, Entamoeba invadens
QELQGTI

SEQ ID NO: 2895918 - protein, 9 aa, Entamoeba invadens
QELQNEKEN

SEQ ID NO: 2895919 - protein, 22 aa, Entamoeba invadens
QELQQQPQQTKTEEKTTDPDFK

SEQ ID NO: 2895920 - protein, 6 aa, Entamoeba invadens
QELRQN

SEQ ID NO: 2895921 - protein, 20 aa, Entamoeba invadens
QELSEMKTAHKTTPMPQASS

SEQ ID NO: 2895922 - protein, 6 aa, Entamoeba invadens
QEMEKK

SEQ ID NO: 2895923 - protein, 5 aa, Entamoeba invadens
QEMPN

SEQ ID NO: 2895924 - protein, 7 aa, Entamoeba invadens
QEMPSEL

SEQ ID NO: 2895925 - protein, 18 aa, Entamoeba invadens
QEMRNEEEKLNIKDPKTT

SEQ ID NO: 2895926 - protein, 5 aa, Entamoeba invadens
QEMSK

SEQ ID NO: 2895927 - protein, 7 aa, Entamoeba invadens
QENADIK

SEQ ID NO: 2895928 - protein, 7 aa, Entamoeba invadens
QENAREA

SEQ ID NO: 2895929 - protein, 21 aa, Entamoeba invadens
QENCEYKKNDTERTKNELDEK

SEQ ID NO: 2895930 - protein, 12 aa, Entamoeba invadens
QENDGMNRGSYT

SEQ ID NO: 2895931 - protein, 39 aa, Entamoeba invadens
QENEEKKKGKRLEETEDSKKPKRKDKLKKKSKKEKMDTG

SEQ ID NO: 2895932 - protein, 8 aa, Entamoeba invadens
QENEHGND

SEQ ID NO: 2895933 - protein, 9 aa, Entamoeba invadens
QENENAMTT

SEQ ID NO: 2895934 - protein, 20 aa, Entamoeba invadens
QENETVERSQQKSQDELNEK

SEQ ID NO: 2895935 - protein, 8 aa, Entamoeba invadens
QENEVTQT

SEQ ID NO: 2895936 - protein, 4 aa, Entamoeba invadens
QENI

SEQ ID NO: 2895937 - protein, 5 aa, Entamoeba invadens
QENKQ

SEQ ID NO: 2895938 - protein, 4 aa, Entamoeba invadens
QENL

SEQ ID NO: 2895939 - protein, 5 aa, Entamoeba invadens
QENLK

SEQ ID NO: 2895940 - protein, 11 aa, Entamoeba invadens
QENNGCTPCDS

SEQ ID NO: 2895941 - protein, 6 aa, Entamoeba invadens
QENNPS

SEQ ID NO: 2895942 - protein, 5 aa, Entamoeba invadens
QENPW

SEQ ID NO: 2895943 - protein, 11 aa, Entamoeba invadens
QENPYTKIEKG

SEQ ID NO: 2895944 - protein, 9 aa, Entamoeba invadens
QENQGSNQK

SEQ ID NO: 2895945 - protein, 29 aa, Entamoeba invadens
QENQQTSKQSLSKTTSEATMQFDLSAIEN

SEQ ID NO: 2895946 - protein, 5 aa, Entamoeba invadens
QENRS

SEQ ID NO: 2895947 - protein, 4 aa, Entamoeba invadens
QENS

SEQ ID NO: 2895948 - protein, 11 aa, Entamoeba invadens
QENSDNSNAFG

SEQ ID NO: 2895949 - protein, 5 aa, Entamoeba invadens
QENSF

SEQ ID NO: 2895950 - protein, 8 aa, Entamoeba invadens
QENSFGNS

SEQ ID NO: 2895951 - protein, 8 aa, Entamoeba invadens
QENSSGGF

SEQ ID NO: 2895952 - protein, 8 aa, Entamoeba invadens
QENTIENY

SEQ ID NO: 2895953 - protein, 8 aa, Entamoeba invadens
QENTTHQI

SEQ ID NO: 2895954 - protein, 5 aa, Entamoeba invadens
QENVE

SEQ ID NO: 2895955 - protein, 9 aa, Entamoeba invadens
QENYQQPAD

SEQ ID NO: 2895956 - protein, 16 aa, Entamoeba invadens
QEPDPGFDKDSQTKMK

SEQ ID NO: 2895957 - protein, 8 aa, Entamoeba invadens
QEPFPNTE

SEQ ID NO: 2895958 - protein, 11 aa, Entamoeba invadens
QEPIENPVKST

SEQ ID NO: 2895959 - protein, 21 aa, Entamoeba invadens
QEPKQSQQPRTEKTDYAANTD

SEQ ID NO: 2895960 - protein, 5 aa, Entamoeba invadens
QEPLS

SEQ ID NO: 2895961 - protein, 5 aa, Entamoeba invadens
QEPPH

SEQ ID NO: 2895962 - protein, 5 aa, Entamoeba invadens
QEPPK

SEQ ID NO: 2895963 - protein, 4 aa, Entamoeba invadens
QEPR

SEQ ID NO: 2895964 - protein, 9 aa, Entamoeba invadens
QEPRVDREN

SEQ ID NO: 2895965 - protein, 10 aa, Entamoeba invadens
QEPRYPPIDS

SEQ ID NO: 2895966 - protein, 6 aa, Entamoeba invadens
QEPSAA

SEQ ID NO: 2895967 - protein, 6 aa, Entamoeba invadens
QEPSNV

SEQ ID NO: 2895968 - protein, 5 aa, Entamoeba invadens
QEPTH

SEQ ID NO: 2895969 - protein, 8 aa, Entamoeba invadens
QEPYQNKW

SEQ ID NO: 2895970 - protein, 5 aa, Entamoeba invadens
QEQDA

SEQ ID NO: 2895971 - protein, 10 aa, Entamoeba invadens
QEQDGRTSNI

SEQ ID NO: 2895972 - protein, 11 aa, Entamoeba invadens
QEQENESEEAL

SEQ ID NO: 2895973 - protein, 5 aa, Entamoeba invadens
QEQIN

SEQ ID NO: 2895974 - protein, 10 aa, Entamoeba invadens
QEQKERSTTY

SEQ ID NO: 2895975 - protein, 29 aa, Entamoeba invadens
QEQLNNPMNTVPPVEQEMKERKRKPSMYT

SEQ ID NO: 2895976 - protein, 6 aa, Entamoeba invadens
QEQNDY

SEQ ID NO: 2895977 - protein, 14 aa, Entamoeba invadens
QEQNPTGVEYPNYS

SEQ ID NO: 2895978 - protein, 24 aa, Entamoeba invadens
QEQPQNSSDVSTNEKTKQTTDTFK

SEQ ID NO: 2895979 - protein, 22 aa, Entamoeba invadens
QEQPTTKEISQQSTNETHDTTL

SEQ ID NO: 2895980 - protein, 14 aa, Entamoeba invadens
QEQTHDKPTNPIKR

SEQ ID NO: 2895981 - protein, 4 aa, Entamoeba invadens
QERA

SEQ ID NO: 2895982 - protein, 8 aa, Entamoeba invadens
QERAERLK

SEQ ID NO: 2895983 - protein, 16 aa, Entamoeba invadens
QERDSNKENIKNMGEM

SEQ ID NO: 2895984 - protein, 4 aa, Entamoeba invadens
QERG

SEQ ID NO: 2895985 - protein, 8 aa, Entamoeba invadens
QERGQYKN

SEQ ID NO: 2895986 - protein, 6 aa, Entamoeba invadens
QERHTT

SEQ ID NO: 2895987 - protein, 4 aa, Entamoeba invadens
QERI

SEQ ID NO: 2895988 - protein, 11 aa, Entamoeba invadens
QERKSDDNQSK

SEQ ID NO: 2895989 - protein, 8 aa, Entamoeba invadens
QERLTQSV

SEQ ID NO: 2895990 - protein, 14 aa, Entamoeba invadens
QERQDREKKRVQTA

SEQ ID NO: 2895991 - protein, 17 aa, Entamoeba invadens
QERQFQSSSTSGLQNSS

SEQ ID NO: 2895992 - protein, 8 aa, Entamoeba invadens
QERQNRKE

SEQ ID NO: 2895993 - protein, 18 aa, Entamoeba invadens
QERQRKMNKKDKGLVGGL

SEQ ID NO: 2895994 - protein, 7 aa, Entamoeba invadens
QERSLSP

SEQ ID NO: 2895995 - protein, 7 aa, Entamoeba invadens
QERWDDG

SEQ ID NO: 2895996 - protein, 5 aa, Entamoeba invadens
QERYY

SEQ ID NO: 2895997 - protein, 4 aa, Entamoeba invadens
QESC

SEQ ID NO: 2895998 - protein, 8 aa, Entamoeba invadens
QESDGEGE

SEQ ID NO: 2895999 - protein, 10 aa, Entamoeba invadens
QESDTGLAPV

SEQ ID NO: 2896000 - protein, 8 aa, Entamoeba invadens
QESESLDV

SEQ ID NO: 2896001 - protein, 5 aa, Entamoeba invadens
QESET

SEQ ID NO: 2896002 - protein, 12 aa, Entamoeba invadens
QESGAKGNPVLQ

SEQ ID NO: 2896003 - protein, 17 aa, Entamoeba invadens
QESGVTSGFGDEDDYNV

SEQ ID NO: 2896004 - protein, 7 aa, Entamoeba invadens
QESHQEV

SEQ ID NO: 2896005 - protein, 11 aa, Entamoeba invadens
QESIEKVENEV

SEQ ID NO: 2896006 - protein, 10 aa, Entamoeba invadens
QESIKPAPAL

SEQ ID NO: 2896007 - protein, 11 aa, Entamoeba invadens
QESISKKPEEY

SEQ ID NO: 2896008 - protein, 7 aa, Entamoeba invadens
QESITPK

SEQ ID NO: 2896009 - protein, 21 aa, Entamoeba invadens
QESKEKLKNPVKSLSQSHKPI

SEQ ID NO: 2896010 - protein, 13 aa, Entamoeba invadens
QESKRKTEEIEKM

SEQ ID NO: 2896011 - protein, 5 aa, Entamoeba invadens
QESPI

SEQ ID NO: 2896012 - protein, 9 aa, Entamoeba invadens
QESQYRPNI

SEQ ID NO: 2896013 - protein, 6 aa, Entamoeba invadens
QESSGT

SEQ ID NO: 2896014 - protein, 8 aa, Entamoeba invadens
QESSPIPL

SEQ ID NO: 2896015 - protein, 9 aa, Entamoeba invadens
QESSRVQLN

SEQ ID NO: 2896016 - protein, 23 aa, Entamoeba invadens
QESVDITDSPETVEEGQNEMPKV

SEQ ID NO: 2896017 - protein, 5 aa, Entamoeba invadens
QESVE

SEQ ID NO: 2896018 - protein, 5 aa, Entamoeba invadens
QESVK

SEQ ID NO: 2896019 - protein, 12 aa, Entamoeba invadens
QESYFSGKYTSY

SEQ ID NO: 2896020 - protein, 17 aa, Entamoeba invadens
QETAKKDIEAVKRDPRI

SEQ ID NO: 2896021 - protein, 5 aa, Entamoeba invadens
QETCG

SEQ ID NO: 2896022 - protein, 5 aa, Entamoeba invadens
QETER

SEQ ID NO: 2896023 - protein, 4 aa, Entamoeba invadens
QETF

SEQ ID NO: 2896024 - protein, 7 aa, Entamoeba invadens
QETGKTS

SEQ ID NO: 2896025 - protein, 4 aa, Entamoeba invadens
QETH

SEQ ID NO: 2896026 - protein, 14 aa, Entamoeba invadens
QETISQEKENNTKV

SEQ ID NO: 2896027 - protein, 7 aa, Entamoeba invadens
QETKATG

SEQ ID NO: 2896028 - protein, 17 aa, Entamoeba invadens
QETLKKEQEEKKRIEEM

SEQ ID NO: 2896029 - protein, 11 aa, Entamoeba invadens
QETNSYRKPTS

SEQ ID NO: 2896030 - protein, 6 aa, Entamoeba invadens
QETPNF

SEQ ID NO: 2896031 - protein, 11 aa, Entamoeba invadens
QETSKDVPSKL

SEQ ID NO: 2896032 - protein, 6 aa, Entamoeba invadens
QETTEA

SEQ ID NO: 2896033 - protein, 10 aa, Entamoeba invadens
QETTQTQQQV

SEQ ID NO: 2896034 - protein, 9 aa, Entamoeba invadens
QETVEERNE

SEQ ID NO: 2896035 - protein, 48 aa, Entamoeba invadens
QETVVESKSEEKEKVVEATPVEGSLETKPELVESKKEEIKEEKKNDVV

SEQ ID NO: 2896036 - protein, 9 aa, Entamoeba invadens
QETYKNSEY

SEQ ID NO: 2896037 - protein, 6 aa, Entamoeba invadens
QETYNK

SEQ ID NO: 2896038 - protein, 13 aa, Entamoeba invadens
QEVAEANEELETV

SEQ ID NO: 2896039 - protein, 4 aa, Entamoeba invadens
QEVD

SEQ ID NO: 2896040 - protein, 10 aa, Entamoeba invadens
QEVDKDKKRI

SEQ ID NO: 2896041 - protein, 9 aa, Entamoeba invadens
QEVDSTEDI

SEQ ID NO: 2896042 - protein, 12 aa, Entamoeba invadens
QEVEASTEKKLD

SEQ ID NO: 2896043 - protein, 31 aa, Entamoeba invadens
QEVEEKQRKEEEGRHENERQEKIKRQRSEQF

SEQ ID NO: 2896044 - protein, 6 aa, Entamoeba invadens
QEVEES

SEQ ID NO: 2896045 - protein, 22 aa, Entamoeba invadens
QEVENARQSTQPPTHTKQSPTS

SEQ ID NO: 2896046 - protein, 22 aa, Entamoeba invadens
QEVENARQSTQPPTHTTQSPTS

SEQ ID NO: 2896047 - protein, 5 aa, Entamoeba invadens
QEVEQ

SEQ ID NO: 2896048 - protein, 12 aa, Entamoeba invadens
QEVETETTTGIT

SEQ ID NO: 2896049 - protein, 19 aa, Entamoeba invadens
QEVGREATQGTDTRGIQDD

SEQ ID NO: 2896050 - protein, 33 aa, Entamoeba invadens
QEVKTEVKEVTQKEVQGEEKKEVKATLEGQKDW

SEQ ID NO: 2896051 - protein, 14 aa, Entamoeba invadens
QEVLKRSEAERWNN

SEQ ID NO: 2896052 - protein, 6 aa, Entamoeba invadens
QEVLTE

SEQ ID NO: 2896053 - protein, 15 aa, Entamoeba invadens
QEVPKEAVQEQTSEV

SEQ ID NO: 2896054 - protein, 7 aa, Entamoeba invadens
QEVPQKR

SEQ ID NO: 2896055 - protein, 10 aa, Entamoeba invadens
QEVQDSQKTI

SEQ ID NO: 2896056 - protein, 11 aa, Entamoeba invadens
QEVQKKNASLV

SEQ ID NO: 2896057 - protein, 20 aa, Entamoeba invadens
QEVQKNEVERIKKTEDNTKI

SEQ ID NO: 2896058 - protein, 4 aa, Entamoeba invadens
QEVR

SEQ ID NO: 2896059 - protein, 6 aa, Entamoeba invadens
QEVSTV

SEQ ID NO: 2896060 - protein, 4 aa, Entamoeba invadens
QEVT

SEQ ID NO: 2896061 - protein, 5 aa, Entamoeba invadens
QEYKA

SEQ ID NO: 2896062 - protein, 20 aa, Entamoeba invadens
QEYKYDMSKGSLARVEKDPH

SEQ ID NO: 2896063 - protein, 17 aa, Entamoeba invadens
QEYPEKQQLVKAILSLF

SEQ ID NO: 2896064 - protein, 6 aa, Entamoeba invadens
QEYQSE

SEQ ID NO: 2896065 - protein, 9 aa, Entamoeba invadens
QFAETKNSE

SEQ ID NO: 2896066 - protein, 20 aa, Entamoeba invadens
QFAHPTRRNTASQRTSPHEI

SEQ ID NO: 2896067 - protein, 11 aa, Entamoeba invadens
QFANENEKERA

SEQ ID NO: 2896068 - protein, 5 aa, Entamoeba invadens
QFANG

SEQ ID NO: 2896069 - protein, 11 aa, Entamoeba invadens
QFAPTGRNNQE

SEQ ID NO: 2896070 - protein, 8 aa, Entamoeba invadens
QFASNQDN

SEQ ID NO: 2896071 - protein, 7 aa, Entamoeba invadens
QFATTPT

SEQ ID NO: 2896072 - protein, 16 aa, Entamoeba invadens
QFDADLKKKKQTQQSV

SEQ ID NO: 2896073 - protein, 4 aa, Entamoeba invadens
QFDF

SEQ ID NO: 2896074 - protein, 17 aa, Entamoeba invadens
QFDTTQAQGDPPHPDSI

SEQ ID NO: 2896075 - protein, 6 aa, Entamoeba invadens
QFEEKK

SEQ ID NO: 2896076 - protein, 11 aa, Entamoeba invadens
QFEENTSSSIG

SEQ ID NO: 2896077 - protein, 19 aa, Entamoeba invadens
QFEEREKGQTNTKTTSLAS

SEQ ID NO: 2896078 - protein, 6 aa, Entamoeba invadens
QFEGQK

SEQ ID NO: 2896079 - protein, 6 aa, Entamoeba invadens
QFEKTS

SEQ ID NO: 2896080 - protein, 13 aa, Entamoeba invadens
QFENTQTNYTKTK

SEQ ID NO: 2896081 - protein, 4 aa, Entamoeba invadens
QFEQ

SEQ ID NO: 2896082 - protein, 6 aa, Entamoeba invadens
QFEREK

SEQ ID NO: 2896083 - protein, 10 aa, Entamoeba invadens
QFERKRKKEI

SEQ ID NO: 2896084 - protein, 5 aa, Entamoeba invadens
QFGEK

SEQ ID NO: 2896085 - protein, 5 aa, Entamoeba invadens
QFGEY

SEQ ID NO: 2896086 - protein, 4 aa, Entamoeba invadens
QFKE

SEQ ID NO: 2896087 - protein, 6 aa, Entamoeba invadens
QFKEAF

SEQ ID NO: 2896088 - protein, 13 aa, Entamoeba invadens
QFKGETKTVVIET

SEQ ID NO: 2896089 - protein, 9 aa, Entamoeba invadens
QFKKEPSYI

SEQ ID NO: 2896090 - protein, 9 aa, Entamoeba invadens
QFKKNQQKA

SEQ ID NO: 2896091 - protein, 7 aa, Entamoeba invadens
QFKTGQI

SEQ ID NO: 2896092 - protein, 8 aa, Entamoeba invadens
QFKTPIKS

SEQ ID NO: 2896093 - protein, 8 aa, Entamoeba invadens
QFKTTNNA

SEQ ID NO: 2896094 - protein, 8 aa, Entamoeba invadens
QFNTESNL

SEQ ID NO: 2896095 - protein, 4 aa, Entamoeba invadens
QFPE

SEQ ID NO: 2896096 - protein, 5 aa, Entamoeba invadens
QFPGN

SEQ ID NO: 2896097 - protein, 19 aa, Entamoeba invadens
QFPGPQAQTMPPTQKDKSP

SEQ ID NO: 2896098 - protein, 27 aa, Entamoeba invadens
QFPKKEEGAAKRTIHDDTEVINQLKSI

SEQ ID NO: 2896099 - protein, 6 aa, Entamoeba invadens
QFPNDE

SEQ ID NO: 2896100 - protein, 12 aa, Entamoeba invadens
QFPPNTEDEKDK

SEQ ID NO: 2896101 - protein, 9 aa, Entamoeba invadens
QFPPRLPPQ

SEQ ID NO: 2896102 - protein, 4 aa, Entamoeba invadens
QFPR

SEQ ID NO: 2896103 - protein, 7 aa, Entamoeba invadens
QFPSSKG

SEQ ID NO: 2896104 - protein, 18 aa, Entamoeba invadens
QFQDPKDKVGTSNIDQTE

SEQ ID NO: 2896105 - protein, 9 aa, Entamoeba invadens
QFQGQQQQQ

SEQ ID NO: 2896106 - protein, 4 aa, Entamoeba invadens
QFQP

SEQ ID NO: 2896107 - protein, 16 aa, Entamoeba invadens
QFQPVNNPYPPLPPKD

SEQ ID NO: 2896108 - protein, 17 aa, Entamoeba invadens
QFQQPYSQPYTQPYTQP

SEQ ID NO: 2896109 - protein, 10 aa, Entamoeba invadens
QFQQQKEEAF

SEQ ID NO: 2896110 - protein, 9 aa, Entamoeba invadens
QFQTKNTTV

SEQ ID NO: 2896111 - protein, 7 aa, Entamoeba invadens
QFRSGEA

SEQ ID NO: 2896112 - protein, 7 aa, Entamoeba invadens
QFRSKGR

SEQ ID NO: 2896113 - protein, 15 aa, Entamoeba invadens
QFRSSNGTCTYEPQE

SEQ ID NO: 2896114 - protein, 28 aa, Entamoeba invadens
QFSAPKEYEEEEQDKAVLEDDDDLKTTE

SEQ ID NO: 2896115 - protein, 6 aa, Entamoeba invadens
QFSARN

SEQ ID NO: 2896116 - protein, 7 aa, Entamoeba invadens
QFSDSKS

SEQ ID NO: 2896117 - protein, 6 aa, Entamoeba invadens
QFSEDK

SEQ ID NO: 2896118 - protein, 9 aa, Entamoeba invadens
QFSEDKSVT

SEQ ID NO: 2896119 - protein, 5 aa, Entamoeba invadens
QFSEH

SEQ ID NO: 2896120 - protein, 19 aa, Entamoeba invadens
QFSGADRQKLNDMAMWAYY

SEQ ID NO: 2896121 - protein, 5 aa, Entamoeba invadens
QFSKS

SEQ ID NO: 2896122 - protein, 6 aa, Entamoeba invadens
QFSKTR

SEQ ID NO: 2896123 - protein, 23 aa, Entamoeba invadens
QFSNEGNAVTTLSKSKSDTSLSL

SEQ ID NO: 2896124 - protein, 11 aa, Entamoeba invadens
QFSPDTSVGSR

SEQ ID NO: 2896125 - protein, 10 aa, Entamoeba invadens
QFSPEQSTTK

SEQ ID NO: 2896126 - protein, 9 aa, Entamoeba invadens
QFSSQYKAT

SEQ ID NO: 2896127 - protein, 7 aa, Entamoeba invadens
QFSTPED

SEQ ID NO: 2896128 - protein, 12 aa, Entamoeba invadens
QFTDDQKSLDEF

SEQ ID NO: 2896129 - protein, 12 aa, Entamoeba invadens
QFTDDQKSLEEF

SEQ ID NO: 2896130 - protein, 9 aa, Entamoeba invadens
QFTDDSGKG

SEQ ID NO: 2896131 - protein, 8 aa, Entamoeba invadens
QFTEKPDY

SEQ ID NO: 2896132 - protein, 26 aa, Entamoeba invadens
QFTNRTPRRRRQTSVCEKPTEDTPPV

SEQ ID NO: 2896133 - protein, 5 aa, Entamoeba invadens
QFTPP

SEQ ID NO: 2896134 - protein, 17 aa, Entamoeba invadens
QFTSELSRSENKADEYN

SEQ ID NO: 2896135 - protein, 18 aa, Entamoeba invadens
QFTSRGKRAADVIKTGET

SEQ ID NO: 2896136 - protein, 14 aa, Entamoeba invadens
QFTTHKDTDAASKE

SEQ ID NO: 2896137 - protein, 8 aa, Entamoeba invadens
QGAALGAK

SEQ ID NO: 2896138 - protein, 4 aa, Entamoeba invadens
QGAF

SEQ ID NO: 2896139 - protein, 5 aa, Entamoeba invadens
QGAKI

SEQ ID NO: 2896140 - protein, 12 aa, Entamoeba invadens
QGAQGTQPQCPY

SEQ ID NO: 2896141 - protein, 7 aa, Entamoeba invadens
QGCGLGD

SEQ ID NO: 2896142 - protein, 6 aa, Entamoeba invadens
QGDEEF

SEQ ID NO: 2896143 - protein, 6 aa, Entamoeba invadens
QGDEEY

SEQ ID NO: 2896144 - protein, 9 aa, Entamoeba invadens
QGDGDYRYK

SEQ ID NO: 2896145 - protein, 5 aa, Entamoeba invadens
QGDKQ

SEQ ID NO: 2896146 - protein, 9 aa, Entamoeba invadens
QGDKTSNEF

SEQ ID NO: 2896147 - protein, 24 aa, Entamoeba invadens
QGDLADLDDKEVDQTDVKNWDGKA

SEQ ID NO: 2896148 - protein, 14 aa, Entamoeba invadens
QGDSAGVVGEETGD

SEQ ID NO: 2896149 - protein, 13 aa, Entamoeba invadens
QGDSGSTLLIKKI

SEQ ID NO: 2896150 - protein, 9 aa, Entamoeba invadens
QGEAKLRSS

SEQ ID NO: 2896151 - protein, 24 aa, Entamoeba invadens
QGEAQRTQENYEKDIKKTKINCFI

SEQ ID NO: 2896152 - protein, 6 aa, Entamoeba invadens
QGEAVT

SEQ ID NO: 2896153 - protein, 8 aa, Entamoeba invadens
QGEDDGTL

SEQ ID NO: 2896154 - protein, 15 aa, Entamoeba invadens
QGEDPKSVGTKPTVG

SEQ ID NO: 2896155 - protein, 7 aa, Entamoeba invadens
QGEEFTD

SEQ ID NO: 2896156 - protein, 4 aa, Entamoeba invadens
QGEG

SEQ ID NO: 2896157 - protein, 10 aa, Entamoeba invadens
QGEGNEHTSR

SEQ ID NO: 2896158 - protein, 19 aa, Entamoeba invadens
QGEKEKTTQMEEEKPAEVI

SEQ ID NO: 2896159 - protein, 20 aa, Entamoeba invadens
QGEKGATEVNLSKKGIKKVP

SEQ ID NO: 2896160 - protein, 7 aa, Entamoeba invadens
QGEKYSY

SEQ ID NO: 2896161 - protein, 16 aa, Entamoeba invadens
QGENGPQKVKQEEKPT

SEQ ID NO: 2896162 - protein, 11 aa, Entamoeba invadens
QGENNTVETPR

SEQ ID NO: 2896163 - protein, 5 aa, Entamoeba invadens
QGENT

SEQ ID NO: 2896164 - protein, 4 aa, Entamoeba invadens
QGER

SEQ ID NO: 2896165 - protein, 15 aa, Entamoeba invadens
QGERKLAKNNKKLGE

SEQ ID NO: 2896166 - protein, 9 aa, Entamoeba invadens
QGESASDQI

SEQ ID NO: 2896167 - protein, 8 aa, Entamoeba invadens
QGEYVSTE

SEQ ID NO: 2896168 - protein, 4 aa, Entamoeba invadens
QGFF

SEQ ID NO: 2896169 - protein, 4 aa, Entamoeba invadens
QGFT

SEQ ID NO: 2896170 - protein, 9 aa, Entamoeba invadens
QGGCTSEIP

SEQ ID NO: 2896171 - protein, 8 aa, Entamoeba invadens
QGGEISKE

SEQ ID NO: 2896172 - protein, 7 aa, Entamoeba invadens
QGGGGIV

SEQ ID NO: 2896173 - protein, 15 aa, Entamoeba invadens
QGGKRPEIDDSVPEK

SEQ ID NO: 2896174 - protein, 6 aa, Entamoeba invadens
QGGMPQ

SEQ ID NO: 2896175 - protein, 13 aa, Entamoeba invadens
QGGYMQDQPFQGQ

SEQ ID NO: 2896176 - protein, 17 aa, Entamoeba invadens
QGHAPDRCSHKGEIGAM

SEQ ID NO: 2896177 - protein, 4 aa, Entamoeba invadens
QGHK

SEQ ID NO: 2896178 - protein, 7 aa, Entamoeba invadens
QGHNGGV

SEQ ID NO: 2896179 - protein, 47 aa, Entamoeba invadens
QGHTSQDCPYKDKKIPKKAEKKSNNKKGEKRSGKKGKTAHSDDGESN

SEQ ID NO: 2896180 - protein, 6 aa, Entamoeba invadens
QGIEET

SEQ ID NO: 2896181 - protein, 11 aa, Entamoeba invadens
QGIGSPKVEGK

SEQ ID NO: 2896182 - protein, 4 aa, Entamoeba invadens
QGIP

SEQ ID NO: 2896183 - protein, 4 aa, Entamoeba invadens
QGIS

SEQ ID NO: 2896184 - protein, 12 aa, Entamoeba invadens
QGISNVSTNSSD

SEQ ID NO: 2896185 - protein, 7 aa, Entamoeba invadens
QGISTGR

SEQ ID NO: 2896186 - protein, 4 aa, Entamoeba invadens
QGIT

SEQ ID NO: 2896187 - protein, 8 aa, Entamoeba invadens
QGITEEGE

SEQ ID NO: 2896188 - protein, 12 aa, Entamoeba invadens
QGITEPNDEDDN

SEQ ID NO: 2896189 - protein, 7 aa, Entamoeba invadens
QGITGLK

SEQ ID NO: 2896190 - protein, 9 aa, Entamoeba invadens
QGKAMTSHT

SEQ ID NO: 2896191 - protein, 24 aa, Entamoeba invadens
QGKAPEKKVKAKAKDNKTDEDGLY

SEQ ID NO: 2896192 - protein, 5 aa, Entamoeba invadens
QGKFR

SEQ ID NO: 2896193 - protein, 9 aa, Entamoeba invadens
QGKGIKEVR

SEQ ID NO: 2896194 - protein, 13 aa, Entamoeba invadens
QGKIGKDANGKAF

SEQ ID NO: 2896195 - protein, 4 aa, Entamoeba invadens
QGKK

SEQ ID NO: 2896196 - protein, 8 aa, Entamoeba invadens
QGKKINKA

SEQ ID NO: 2896197 - protein, 14 aa, Entamoeba invadens
QGKLEEAANAMDRA

SEQ ID NO: 2896198 - protein, 6 aa, Entamoeba invadens
QGKLNQ

SEQ ID NO: 2896199 - protein, 5 aa, Entamoeba invadens
QGKPF

SEQ ID NO: 2896200 - protein, 12 aa, Entamoeba invadens
QGKPIGKIQDGD

SEQ ID NO: 2896201 - protein, 15 aa, Entamoeba invadens
QGKQKKGKKGTAGKL

SEQ ID NO: 2896202 - protein, 13 aa, Entamoeba invadens
QGKQKKGKNKLEG

SEQ ID NO: 2896203 - protein, 8 aa, Entamoeba invadens
QGKSEMGS

SEQ ID NO: 2896204 - protein, 5 aa, Entamoeba invadens
QGKVP

SEQ ID NO: 2896205 - protein, 14 aa, Entamoeba invadens
QGKYAESLKAYSAA

SEQ ID NO: 2896206 - protein, 9 aa, Entamoeba invadens
QGLAKETEV

SEQ ID NO: 2896207 - protein, 18 aa, Entamoeba invadens
QGLGPQSVTTSQLGPTSV

SEQ ID NO: 2896208 - protein, 31 aa, Entamoeba invadens
QGLPKSTSNETTSATKVTRCEEKNAKEKRKI

SEQ ID NO: 2896209 - protein, 8 aa, Entamoeba invadens
QGLPPRVT

SEQ ID NO: 2896210 - protein, 7 aa, Entamoeba invadens
QGLPRAT

SEQ ID NO: 2896211 - protein, 6 aa, Entamoeba invadens
QGLPSS

SEQ ID NO: 2896212 - protein, 11 aa, Entamoeba invadens
QGLPTTPKQDL

SEQ ID NO: 2896213 - protein, 11 aa, Entamoeba invadens
QGLRDAGLESS

SEQ ID NO: 2896214 - protein, 10 aa, Entamoeba invadens
QGLSSTPPKS

SEQ ID NO: 2896215 - protein, 6 aa, Entamoeba invadens
QGLTVS

SEQ ID NO: 2896216 - protein, 5 aa, Entamoeba invadens
QGMDP

SEQ ID NO: 2896217 - protein, 10 aa, Entamoeba invadens
QGMGQASSVG

SEQ ID NO: 2896218 - protein, 4 aa, Entamoeba invadens
QGNE

SEQ ID NO: 2896219 - protein, 10 aa, Entamoeba invadens
QGNECRPKSC

SEQ ID NO: 2896220 - protein, 9 aa, Entamoeba invadens
QGNKTSTEI

SEQ ID NO: 2896221 - protein, 5 aa, Entamoeba invadens
QGNNF

SEQ ID NO: 2896222 - protein, 6 aa, Entamoeba invadens
QGNPQN

SEQ ID NO: 2896223 - protein, 7 aa, Entamoeba invadens
QGNPTDL

SEQ ID NO: 2896224 - protein, 11 aa, Entamoeba invadens
QGNTGSNAEEC

SEQ ID NO: 2896225 - protein, 6 aa, Entamoeba invadens
QGNTRS

SEQ ID NO: 2896226 - protein, 8 aa, Entamoeba invadens
QGNVAEEE

SEQ ID NO: 2896227 - protein, 21 aa, Entamoeba invadens
QGPFSLEQTKKLEQMKRQQTF

SEQ ID NO: 2896228 - protein, 5 aa, Entamoeba invadens
QGPIE

SEQ ID NO: 2896229 - protein, 11 aa, Entamoeba invadens
QGPNGAGKTTL

SEQ ID NO: 2896230 - protein, 9 aa, Entamoeba invadens
QGPPGTGKT

SEQ ID NO: 2896231 - protein, 13 aa, Entamoeba invadens
QGPPGTGKTVTSA

SEQ ID NO: 2896232 - protein, 10 aa, Entamoeba invadens
QGPRPESFKE

SEQ ID NO: 2896233 - protein, 12 aa, Entamoeba invadens
QGPRTSEEQIDE

SEQ ID NO: 2896234 - protein, 6 aa, Entamoeba invadens
QGPVPI

SEQ ID NO: 2896235 - protein, 8 aa, Entamoeba invadens
QGQEPLKK

SEQ ID NO: 2896236 - protein, 6 aa, Entamoeba invadens
QGQGTQ

SEQ ID NO: 2896237 - protein, 58 aa, Entamoeba invadens
QGQPKPVDTTKEEQPVPPPRAQSLPSPPVSRPPTPPPPDYDTSTTTVQQRPKSPTTEK

SEQ ID NO: 2896238 - protein, 4 aa, Entamoeba invadens
QGQQ

SEQ ID NO: 2896239 - protein, 6 aa, Entamoeba invadens
QGQRSS

SEQ ID NO: 2896240 - protein, 7 aa, Entamoeba invadens
QGQVNSR

SEQ ID NO: 2896241 - protein, 6 aa, Entamoeba invadens
QGRELV

SEQ ID NO: 2896242 - protein, 5 aa, Entamoeba invadens
QGRER

SEQ ID NO: 2896243 - protein, 4 aa, Entamoeba invadens
QGRK

SEQ ID NO: 2896244 - protein, 5 aa, Entamoeba invadens
QGRNE

SEQ ID NO: 2896245 - protein, 10 aa, Entamoeba invadens
QGRNTQENVF

SEQ ID NO: 2896246 - protein, 15 aa, Entamoeba invadens
QGRPTPVRPLKFLQS

SEQ ID NO: 2896247 - protein, 10 aa, Entamoeba invadens
QGRSANDVKN

SEQ ID NO: 2896248 - protein, 9 aa, Entamoeba invadens
QGSAGSDDY

SEQ ID NO: 2896249 - protein, 5 aa, Entamoeba invadens
QGSDF

SEQ ID NO: 2896250 - protein, 7 aa, Entamoeba invadens
QGSENEY

SEQ ID NO: 2896251 - protein, 5 aa, Entamoeba invadens
QGSGD

SEQ ID NO: 2896252 - protein, 8 aa, Entamoeba invadens
QGSGRSNI

SEQ ID NO: 2896253 - protein, 5 aa, Entamoeba invadens
QGSIP

SEQ ID NO: 2896254 - protein, 9 aa, Entamoeba invadens
QGSKQVRGK

SEQ ID NO: 2896255 - protein, 5 aa, Entamoeba invadens
QGSLS

SEQ ID NO: 2896256 - protein, 17 aa, Entamoeba invadens
QGSNKTDHTDLDSPNLN

SEQ ID NO: 2896257 - protein, 8 aa, Entamoeba invadens
QGSQDKLK

SEQ ID NO: 2896258 - protein, 8 aa, Entamoeba invadens
QGSSKDYV

SEQ ID NO: 2896259 - protein, 7 aa, Entamoeba invadens
QGSSKNI

SEQ ID NO: 2896260 - protein, 6 aa, Entamoeba invadens
QGSTPL

SEQ ID NO: 2896261 - protein, 4 aa, Entamoeba invadens
QGSV

SEQ ID NO: 2896262 - protein, 8 aa, Entamoeba invadens
QGTADSYE

SEQ ID NO: 2896263 - protein, 4 aa, Entamoeba invadens
QGTF

SEQ ID NO: 2896264 - protein, 7 aa, Entamoeba invadens
QGTHMTY

SEQ ID NO: 2896265 - protein, 7 aa, Entamoeba invadens
QGTHTGF

SEQ ID NO: 2896266 - protein, 4 aa, Entamoeba invadens
QGTK

SEQ ID NO: 2896267 - protein, 6 aa, Entamoeba invadens
QGTPLD

SEQ ID NO: 2896268 - protein, 7 aa, Entamoeba invadens
QGTQQAQ

SEQ ID NO: 2896269 - protein, 8 aa, Entamoeba invadens
QGTRDLKN

SEQ ID NO: 2896270 - protein, 8 aa, Entamoeba invadens
QGTRKEFT

SEQ ID NO: 2896271 - protein, 7 aa, Entamoeba invadens
QGTTTLK

SEQ ID NO: 2896272 - protein, 4 aa, Entamoeba invadens
QGTV

SEQ ID NO: 2896273 - protein, 8 aa, Entamoeba invadens
QGVCTSGE

SEQ ID NO: 2896274 - protein, 11 aa, Entamoeba invadens
QGVGKTSTDNR

SEQ ID NO: 2896275 - protein, 5 aa, Entamoeba invadens
QGVPL

SEQ ID NO: 2896276 - protein, 4 aa, Entamoeba invadens
QGVR

SEQ ID NO: 2896277 - protein, 7 aa, Entamoeba invadens
QGVSTSD

SEQ ID NO: 2896278 - protein, 6 aa, Entamoeba invadens
QGVTDN

SEQ ID NO: 2896279 - protein, 19 aa, Entamoeba invadens
QGYDQQNRVEQQRRDSGRL

SEQ ID NO: 2896280 - protein, 8 aa, Entamoeba invadens
QGYPKSKP

SEQ ID NO: 2896281 - protein, 10 aa, Entamoeba invadens
QGYQSSGESY

SEQ ID NO: 2896282 - protein, 8 aa, Entamoeba invadens
QGYRGSAA

SEQ ID NO: 2896283 - protein, 7 aa, Entamoeba invadens
QGYSSQN

SEQ ID NO: 2896284 - protein, 6 aa, Entamoeba invadens
QGYTDT

SEQ ID NO: 2896285 - protein, 15 aa, Entamoeba invadens
QGYTETPQKGEEVTA

SEQ ID NO: 2896286 - protein, 11 aa, Entamoeba invadens
QGYTSGGTRVT

SEQ ID NO: 2896287 - protein, 5 aa, Entamoeba invadens
QHADK

SEQ ID NO: 2896288 - protein, 23 aa, Entamoeba invadens
QHADPSKSAPKSPRKKSTAPNQV

SEQ ID NO: 2896289 - protein, 7 aa, Entamoeba invadens
QHAGRES

SEQ ID NO: 2896290 - protein, 14 aa, Entamoeba invadens
QHDEEEDDDRTEES

SEQ ID NO: 2896291 - protein, 12 aa, Entamoeba invadens
QHDENPKGRQNV

SEQ ID NO: 2896292 - protein, 6 aa, Entamoeba invadens
QHDGDY

SEQ ID NO: 2896293 - protein, 8 aa, Entamoeba invadens
QHEEPRVE

SEQ ID NO: 2896294 - protein, 27 aa, Entamoeba invadens
QHEGSSTSSIYTPTQNVPPNQTNQFPT

SEQ ID NO: 2896295 - protein, 25 aa, Entamoeba invadens
QHEKELAEKKAVNSAKMQKTRDKYG

SEQ ID NO: 2896296 - protein, 19 aa, Entamoeba invadens
QHEKNKKHKAKKKVEEVDT

SEQ ID NO: 2896297 - protein, 20 aa, Entamoeba invadens
QHEKQKSQQSPITQMTKSTP

SEQ ID NO: 2896298 - protein, 19 aa, Entamoeba invadens
QHENIAKPQKEFPTPSREC

SEQ ID NO: 2896299 - protein, 6 aa, Entamoeba invadens
QHEPEL

SEQ ID NO: 2896300 - protein, 15 aa, Entamoeba invadens
QHEQHDQNTNSNCDI

SEQ ID NO: 2896301 - protein, 10 aa, Entamoeba invadens
QHETENTIPL

SEQ ID NO: 2896302 - protein, 9 aa, Entamoeba invadens
QHETPSEHV

SEQ ID NO: 2896303 - protein, 4 aa, Entamoeba invadens
QHEV

SEQ ID NO: 2896304 - protein, 9 aa, Entamoeba invadens
QHFAPNGDS

SEQ ID NO: 2896305 - protein, 6 aa, Entamoeba invadens
QHFEEN

SEQ ID NO: 2896306 - protein, 7 aa, Entamoeba invadens
QHFNEPD

SEQ ID NO: 2896307 - protein, 27 aa, Entamoeba invadens
QHFQQQDTPVTNRNEQKEDQSEDTELE

SEQ ID NO: 2896308 - protein, 11 aa, Entamoeba invadens
QHGGGRDNNIT

SEQ ID NO: 2896309 - protein, 5 aa, Entamoeba invadens
QHGTF

SEQ ID NO: 2896310 - protein, 12 aa, Entamoeba invadens
QHGTQEDSTETI

SEQ ID NO: 2896311 - protein, 12 aa, Entamoeba invadens
QHHPKAESETPY

SEQ ID NO: 2896312 - protein, 6 aa, Entamoeba invadens
QHIPTN

SEQ ID NO: 2896313 - protein, 20 aa, Entamoeba invadens
QHITGEKKEMRTTSEPPSKN

SEQ ID NO: 2896314 - protein, 11 aa, Entamoeba invadens
QHKAEKENREI

SEQ ID NO: 2896315 - protein, 4 aa, Entamoeba invadens
QHKE

SEQ ID NO: 2896316 - protein, 7 aa, Entamoeba invadens
QHKEIQE

SEQ ID NO: 2896317 - protein, 9 aa, Entamoeba invadens
QHKESGLSS

SEQ ID NO: 2896318 - protein, 5 aa, Entamoeba invadens
QHKIG

SEQ ID NO: 2896319 - protein, 16 aa, Entamoeba invadens
QHKKKTEPNPEPPKKE

SEQ ID NO: 2896320 - protein, 9 aa, Entamoeba invadens
QHKNKQLRE

SEQ ID NO: 2896321 - protein, 9 aa, Entamoeba invadens
QHKRSNHSN

SEQ ID NO: 2896322 - protein, 10 aa, Entamoeba invadens
QHLENRDNIP

SEQ ID NO: 2896323 - protein, 10 aa, Entamoeba invadens
QHNEDNQYEE

SEQ ID NO: 2896324 - protein, 24 aa, Entamoeba invadens
QHNEEAPLHKEETESSLVSLDLND

SEQ ID NO: 2896325 - protein, 26 aa, Entamoeba invadens
QHNEEAPLHKEETESSLVSLDLNDDD

SEQ ID NO: 2896326 - protein, 8 aa, Entamoeba invadens
QHNENDVT

SEQ ID NO: 2896327 - protein, 5 aa, Entamoeba invadens
QHNGS

SEQ ID NO: 2896328 - protein, 12 aa, Entamoeba invadens
QHNKKKTQIESQ

SEQ ID NO: 2896329 - protein, 11 aa, Entamoeba invadens
QHPENKNEHKE

SEQ ID NO: 2896330 - protein, 13 aa, Entamoeba invadens
QHPGNEQNSMEEI

SEQ ID NO: 2896331 - protein, 10 aa, Entamoeba invadens
QHPNKNEKGF

SEQ ID NO: 2896332 - protein, 22 aa, Entamoeba invadens
QHPNKTYDLKGTLKKRTLDEDE

SEQ ID NO: 2896333 - protein, 7 aa, Entamoeba invadens
QHPPKLS

SEQ ID NO: 2896334 - protein, 7 aa, Entamoeba invadens
QHPSTVN

SEQ ID NO: 2896335 - protein, 6 aa, Entamoeba invadens
QHPTCG

SEQ ID NO: 2896336 - protein, 9 aa, Entamoeba invadens
QHQERRKSE

SEQ ID NO: 2896337 - protein, 11 aa, Entamoeba invadens
QHQETISEDTM

SEQ ID NO: 2896338 - protein, 5 aa, Entamoeba invadens
QHQNS

SEQ ID NO: 2896339 - protein, 6 aa, Entamoeba invadens
QHQQEG

SEQ ID NO: 2896340 - protein, 6 aa, Entamoeba invadens
QHQQSG

SEQ ID NO: 2896341 - protein, 6 aa, Entamoeba invadens
QHREPL

SEQ ID NO: 2896342 - protein, 23 aa, Entamoeba invadens
QHRNARKDQSGEDETEIEADFRD

SEQ ID NO: 2896343 - protein, 5 aa, Entamoeba invadens
QHRQV

SEQ ID NO: 2896344 - protein, 11 aa, Entamoeba invadens
QHSEHKKSIAT

SEQ ID NO: 2896345 - protein, 5 aa, Entamoeba invadens
QHSNA

SEQ ID NO: 2896346 - protein, 11 aa, Entamoeba invadens
QHSQNVQSDSL

SEQ ID NO: 2896347 - protein, 6 aa, Entamoeba invadens
QHSQYE

SEQ ID NO: 2896348 - protein, 5 aa, Entamoeba invadens
QHSRG

SEQ ID NO: 2896349 - protein, 4 aa, Entamoeba invadens
QHSS

SEQ ID NO: 2896350 - protein, 5 aa, Entamoeba invadens
QHSSL

SEQ ID NO: 2896351 - protein, 8 aa, Entamoeba invadens
QHTKDSVE

SEQ ID NO: 2896352 - protein, 7 aa, Entamoeba invadens
QHTKPIS

SEQ ID NO: 2896353 - protein, 7 aa, Entamoeba invadens
QHTNPKN

SEQ ID NO: 2896354 - protein, 15 aa, Entamoeba invadens
QHTPEVSNETIAQGL

SEQ ID NO: 2896355 - protein, 9 aa, Entamoeba invadens
QHTTKLSKS

SEQ ID NO: 2896356 - protein, 11 aa, Entamoeba invadens
QHTTKSDTPSW

SEQ ID NO: 2896357 - protein, 7 aa, Entamoeba invadens
QHTVGTP

SEQ ID NO: 2896358 - protein, 22 aa, Entamoeba invadens
QHTYPQLPDEGIQNYLNHYTLF

SEQ ID NO: 2896359 - protein, 7 aa, Entamoeba invadens
QHTYTTT

SEQ ID NO: 2896360 - protein, 5 aa, Entamoeba invadens
QHVKD

SEQ ID NO: 2896361 - protein, 5 aa, Entamoeba invadens
QHVNS

SEQ ID NO: 2896362 - protein, 4 aa, Entamoeba invadens
QHVQ

SEQ ID NO: 2896363 - protein, 8 aa, Entamoeba invadens
QHYDNRPT

SEQ ID NO: 2896364 - protein, 7 aa, Entamoeba invadens
QHYKKAA

SEQ ID NO: 2896365 - protein, 7 aa, Entamoeba invadens
QHYNDKS

SEQ ID NO: 2896366 - protein, 4 aa, Entamoeba invadens
QIAA

SEQ ID NO: 2896367 - protein, 15 aa, Entamoeba invadens
QIAAKTKAEVESSDA

SEQ ID NO: 2896368 - protein, 11 aa, Entamoeba invadens
QIAEEKGREQT

SEQ ID NO: 2896369 - protein, 18 aa, Entamoeba invadens
QIAESKGNAKVEKNEHTS

SEQ ID NO: 2896370 - protein, 13 aa, Entamoeba invadens
QIAKGSRISAEKR

SEQ ID NO: 2896371 - protein, 16 aa, Entamoeba invadens
QIAKKKVSKKCTTSFT

SEQ ID NO: 2896372 - protein, 10 aa, Entamoeba invadens
QIAPQPQQQM

SEQ ID NO: 2896373 - protein, 4 aa, Entamoeba invadens
QIAS

SEQ ID NO: 2896374 - protein, 5 aa, Entamoeba invadens
QIASG

SEQ ID NO: 2896375 - protein, 22 aa, Entamoeba invadens
QIASPNTLTNEITDEKKSLQEF

SEQ ID NO: 2896376 - protein, 10 aa, Entamoeba invadens
QIDDPTTKEY

SEQ ID NO: 2896377 - protein, 7 aa, Entamoeba invadens
QIDERAR

SEQ ID NO: 2896378 - protein, 8 aa, Entamoeba invadens
QIDETPKI

SEQ ID NO: 2896379 - protein, 21 aa, Entamoeba invadens
QIDHEKANNETLNKQNAKYEE

SEQ ID NO: 2896380 - protein, 13 aa, Entamoeba invadens
QIDNNGKHDADRY

SEQ ID NO: 2896381 - protein, 4 aa, Entamoeba invadens
QIDQ

SEQ ID NO: 2896382 - protein, 32 aa, Entamoeba invadens
QIDSEKKKIVKKQTLDNYEKSTTNYQPNAGRS

SEQ ID NO: 2896383 - protein, 10 aa, Entamoeba invadens
QIDSKGRKIN

SEQ ID NO: 2896384 - protein, 10 aa, Entamoeba invadens
QIDSTTGKKS

SEQ ID NO: 2896385 - protein, 18 aa, Entamoeba invadens
QIDTEYTENDEETFEQHN

SEQ ID NO: 2896386 - protein, 8 aa, Entamoeba invadens
QIDTSDDE

SEQ ID NO: 2896387 - protein, 13 aa, Entamoeba invadens
QIDVEKNKELDNP

SEQ ID NO: 2896388 - protein, 4 aa, Entamoeba invadens
QIEA

SEQ ID NO: 2896389 - protein, 10 aa, Entamoeba invadens
QIEDDRANDL

SEQ ID NO: 2896390 - protein, 5 aa, Entamoeba invadens
QIEDR

SEQ ID NO: 2896391 - protein, 9 aa, Entamoeba invadens
QIEEKTSPR

SEQ ID NO: 2896392 - protein, 6 aa, Entamoeba invadens
QIEERG

SEQ ID NO: 2896393 - protein, 7 aa, Entamoeba invadens
QIEESGK

SEQ ID NO: 2896394 - protein, 14 aa, Entamoeba invadens
QIEESVNYDPQRQS

SEQ ID NO: 2896395 - protein, 13 aa, Entamoeba invadens
QIEGLEDSTTGDD

SEQ ID NO: 2896396 - protein, 7 aa, Entamoeba invadens
QIEGPNP

SEQ ID NO: 2896397 - protein, 5 aa, Entamoeba invadens
QIEKG

SEQ ID NO: 2896398 - protein, 37 aa, Entamoeba invadens
QIEKSSANDKKSNEKLKLQKEEEKPTESKRVTPPSLS

SEQ ID NO: 2896399 - protein, 21 aa, Entamoeba invadens
QIENKKEQKLAKLTGRQNSLE

SEQ ID NO: 2896400 - protein, 10 aa, Entamoeba invadens
QIENTDKDIW

SEQ ID NO: 2896401 - protein, 5 aa, Entamoeba invadens
QIENV

SEQ ID NO: 2896402 - protein, 36 aa, Entamoeba invadens
QIEPDGDVQDCDDDGQNAKPKTNKTEMAKNIAGDTV

SEQ ID NO: 2896403 - protein, 13 aa, Entamoeba invadens
QIEPTKQPTTKIN

SEQ ID NO: 2896404 - protein, 22 aa, Entamoeba invadens
QIEQPKKSRHFSSKISDSSMQE

SEQ ID NO: 2896405 - protein, 13 aa, Entamoeba invadens
QIEQTKKPFKIPN

SEQ ID NO: 2896406 - protein, 4 aa, Entamoeba invadens
QIER

SEQ ID NO: 2896407 - protein, 7 aa, Entamoeba invadens
QIERPKG

SEQ ID NO: 2896408 - protein, 4 aa, Entamoeba invadens
QIES

SEQ ID NO: 2896409 - protein, 24 aa, Entamoeba invadens
QIESPRKPMEQTKEPTPLPKRTGI

SEQ ID NO: 2896410 - protein, 17 aa, Entamoeba invadens
QIESPTAVYSQERPPLT

SEQ ID NO: 2896411 - protein, 10 aa, Entamoeba invadens
QIESYNSDQK

SEQ ID NO: 2896412 - protein, 5 aa, Entamoeba invadens
QIETA

SEQ ID NO: 2896413 - protein, 6 aa, Entamoeba invadens
QIETES

SEQ ID NO: 2896414 - protein, 6 aa, Entamoeba invadens
QIGDRD

SEQ ID NO: 2896415 - protein, 4 aa, Entamoeba invadens
QIGE

SEQ ID NO: 2896416 - protein, 6 aa, Entamoeba invadens
QIGEGG

SEQ ID NO: 2896417 - protein, 11 aa, Entamoeba invadens
QIGEYDKNVPT

SEQ ID NO: 2896418 - protein, 7 aa, Entamoeba invadens
QIGGKAE

SEQ ID NO: 2896419 - protein, 7 aa, Entamoeba invadens
QIGGKTT

SEQ ID NO: 2896420 - protein, 11 aa, Entamoeba invadens
QIGIDTKTERE

SEQ ID NO: 2896421 - protein, 4 aa, Entamoeba invadens
QIGK

SEQ ID NO: 2896422 - protein, 35 aa, Entamoeba invadens
QIGKENSQCEKLQSTTQFTSEAEKSIEEEELETRE

SEQ ID NO: 2896423 - protein, 14 aa, Entamoeba invadens
QIGKSENDGDEKTW

SEQ ID NO: 2896424 - protein, 5 aa, Entamoeba invadens
QIGNA

SEQ ID NO: 2896425 - protein, 6 aa, Entamoeba invadens
QIGQSG

SEQ ID NO: 2896426 - protein, 7 aa, Entamoeba invadens
QIGTNTS

SEQ ID NO: 2896427 - protein, 12 aa, Entamoeba invadens
QIHESPSKYTTP

SEQ ID NO: 2896428 - protein, 7 aa, Entamoeba invadens
QIKDDET

SEQ ID NO: 2896429 - protein, 10 aa, Entamoeba invadens
QIKDSTSISG

SEQ ID NO: 2896430 - protein, 9 aa, Entamoeba invadens
QIKESGKEV

SEQ ID NO: 2896431 - protein, 4 aa, Entamoeba invadens
QIKK

SEQ ID NO: 2896432 - protein, 9 aa, Entamoeba invadens
QIKKGEKVG

SEQ ID NO: 2896433 - protein, 12 aa, Entamoeba invadens
QIKNDKVENVYS

SEQ ID NO: 2896434 - protein, 18 aa, Entamoeba invadens
QIKNENKNVPKLDTRSGR

SEQ ID NO: 2896435 - protein, 17 aa, Entamoeba invadens
QIKNGTSRSPRGTGYTF

SEQ ID NO: 2896436 - protein, 15 aa, Entamoeba invadens
QIKRKAAATKPKAPQ

SEQ ID NO: 2896437 - protein, 18 aa, Entamoeba invadens
QIKSDEPEEFADQGSFAA

SEQ ID NO: 2896438 - protein, 9 aa, Entamoeba invadens
QIKSNKTPF

SEQ ID NO: 2896439 - protein, 5 aa, Entamoeba invadens
QIKTQ

SEQ ID NO: 2896440 - protein, 8 aa, Entamoeba invadens
QINDSEDD

SEQ ID NO: 2896441 - protein, 9 aa, Entamoeba invadens
QINKQDDGI

SEQ ID NO: 2896442 - protein, 10 aa, Entamoeba invadens
QINNSDEEKL

SEQ ID NO: 2896443 - protein, 9 aa, Entamoeba invadens
QINQTTKKE

SEQ ID NO: 2896444 - protein, 14 aa, Entamoeba invadens
QIPAQQQEAKSPFG

SEQ ID NO: 2896445 - protein, 12 aa, Entamoeba invadens
QIPDNIGIVLAR

SEQ ID NO: 2896446 - protein, 19 aa, Entamoeba invadens
QIPESKRKTSRRKVKAKVT

SEQ ID NO: 2896447 - protein, 4 aa, Entamoeba invadens
QIPK

SEQ ID NO: 2896448 - protein, 7 aa, Entamoeba invadens
QIPKTNR

SEQ ID NO: 2896449 - protein, 6 aa, Entamoeba invadens
QIPPAY

SEQ ID NO: 2896450 - protein, 6 aa, Entamoeba invadens
QIPPEI

SEQ ID NO: 2896451 - protein, 19 aa, Entamoeba invadens
QIPPKKKKDFKLKQNENKE

SEQ ID NO: 2896452 - protein, 7 aa, Entamoeba invadens
QIPPNYR

SEQ ID NO: 2896453 - protein, 6 aa, Entamoeba invadens
QIPQGV

SEQ ID NO: 2896454 - protein, 5 aa, Entamoeba invadens
QIPQY

SEQ ID NO: 2896455 - protein, 5 aa, Entamoeba invadens
QIPRN

SEQ ID NO: 2896456 - protein, 7 aa, Entamoeba invadens
QIPRRGT

SEQ ID NO: 2896457 - protein, 8 aa, Entamoeba invadens
QIPSDADN

SEQ ID NO: 2896458 - protein, 8 aa, Entamoeba invadens
QIPSGVSN

SEQ ID NO: 2896459 - protein, 6 aa, Entamoeba invadens
QIPSKV

SEQ ID NO: 2896460 - protein, 21 aa, Entamoeba invadens
QIPSPNTYSQYNNLPTQQMNT

SEQ ID NO: 2896461 - protein, 12 aa, Entamoeba invadens
QIPTAAKNSDKL

SEQ ID NO: 2896462 - protein, 6 aa, Entamoeba invadens
QIPTTD

SEQ ID NO: 2896463 - protein, 4 aa, Entamoeba invadens
QIPV

SEQ ID NO: 2896464 - protein, 6 aa, Entamoeba invadens
QIQDQS

SEQ ID NO: 2896465 - protein, 7 aa, Entamoeba invadens
QIQEDAL

SEQ ID NO: 2896466 - protein, 11 aa, Entamoeba invadens
QIQEEDTLTKD

SEQ ID NO: 2896467 - protein, 8 aa, Entamoeba invadens
QIQEKSEN

SEQ ID NO: 2896468 - protein, 9 aa, Entamoeba invadens
QIQKTEKEI

SEQ ID NO: 2896469 - protein, 24 aa, Entamoeba invadens
QIQNKEIDELTKGMSDEERRSLRR

SEQ ID NO: 2896470 - protein, 5 aa, Entamoeba invadens
QIQPD

SEQ ID NO: 2896471 - protein, 7 aa, Entamoeba invadens
QIQPEDF

SEQ ID NO: 2896472 - protein, 7 aa, Entamoeba invadens
QIQPPIE

SEQ ID NO: 2896473 - protein, 16 aa, Entamoeba invadens
QIQPQTPQPIQQQSNV

SEQ ID NO: 2896474 - protein, 9 aa, Entamoeba invadens
QIQQLGQSS

SEQ ID NO: 2896475 - protein, 39 aa, Entamoeba invadens
QIQSDTFEKTSDVSIQNKNADKCTDKQTSGASPPVQDQT

SEQ ID NO: 2896476 - protein, 66 aa, Entamoeba invadens
QIQTPPLNEKVTETRSDESENSSQTQSETSDNKEPPQNTLKPEKTLNDKNKPILPSQDVTKTPSPI

SEQ ID NO: 2896477 - protein, 12 aa, Entamoeba invadens
QIQTYNNSGLYE

SEQ ID NO: 2896478 - protein, 39 aa, Entamoeba invadens
QIREENQSKKKGHYSQTVANKQSSVFKNGSQTGPKTPVR

SEQ ID NO: 2896479 - protein, 20 aa, Entamoeba invadens
QIREGEKLDTFSTQTDVSQE

SEQ ID NO: 2896480 - protein, 5 aa, Entamoeba invadens
QIRKG

SEQ ID NO: 2896481 - protein, 12 aa, Entamoeba invadens
QIRQTQKDQSHL

SEQ ID NO: 2896482 - protein, 5 aa, Entamoeba invadens
QIRST

SEQ ID NO: 2896483 - protein, 6 aa, Entamoeba invadens
QISDDD

SEQ ID NO: 2896484 - protein, 15 aa, Entamoeba invadens
QISDETYGVDKEGSV

SEQ ID NO: 2896485 - protein, 27 aa, Entamoeba invadens
QISDPQCDKLSRSENYEKTDTTESFEK

SEQ ID NO: 2896486 - protein, 17 aa, Entamoeba invadens
QISEPQNNSTDTDKEIQ

SEQ ID NO: 2896487 - protein, 8 aa, Entamoeba invadens
QISETEET

SEQ ID NO: 2896488 - protein, 5 aa, Entamoeba invadens
QISGN

SEQ ID NO: 2896489 - protein, 26 aa, Entamoeba invadens
QISKKSAKKQNGLSEAEAKYNTSKES

SEQ ID NO: 2896490 - protein, 9 aa, Entamoeba invadens
QISKNTIEM

SEQ ID NO: 2896491 - protein, 13 aa, Entamoeba invadens
QISQQKDPREKRG

SEQ ID NO: 2896492 - protein, 7 aa, Entamoeba invadens
QISRQKN

SEQ ID NO: 2896493 - protein, 5 aa, Entamoeba invadens
QISRV

SEQ ID NO: 2896494 - protein, 11 aa, Entamoeba invadens
QISSYQNAEMR

SEQ ID NO: 2896495 - protein, 4 aa, Entamoeba invadens
QITE

SEQ ID NO: 2896496 - protein, 7 aa, Entamoeba invadens
QITEVSQ

SEQ ID NO: 2896497 - protein, 12 aa, Entamoeba invadens
QITNETNKLSEF

SEQ ID NO: 2896498 - protein, 11 aa, Entamoeba invadens
QITNKIKTENV

SEQ ID NO: 2896499 - protein, 6 aa, Entamoeba invadens
QITNNK

SEQ ID NO: 2896500 - protein, 6 aa, Entamoeba invadens
QITPYS

SEQ ID NO: 2896501 - protein, 15 aa, Entamoeba invadens
QITSDKTELKVEQKT

SEQ ID NO: 2896502 - protein, 11 aa, Entamoeba invadens
QITSGQKDFRK

SEQ ID NO: 2896503 - protein, 18 aa, Entamoeba invadens
QITSQSIEKSDSSTKRKV

SEQ ID NO: 2896504 - protein, 6 aa, Entamoeba invadens
QITSTQ

SEQ ID NO: 2896505 - protein, 13 aa, Entamoeba invadens
QITTDGPQTVSKT

SEQ ID NO: 2896506 - protein, 26 aa, Entamoeba invadens
QIVPEDKSSSSDTNVFDKKDDNIINF

SEQ ID NO: 2896507 - protein, 5 aa, Entamoeba invadens
QIYNN

SEQ ID NO: 2896508 - protein, 5 aa, Entamoeba invadens
QKAAE

SEQ ID NO: 2896509 - protein, 13 aa, Entamoeba invadens
QKAAEKSKLDAET

SEQ ID NO: 2896510 - protein, 26 aa, Entamoeba invadens
QKADLQKELEKERAMKQEADKETQRL

SEQ ID NO: 2896511 - protein, 10 aa, Entamoeba invadens
QKAGIPDKDC

SEQ ID NO: 2896512 - protein, 11 aa, Entamoeba invadens
QKAHNAEENKQ

SEQ ID NO: 2896513 - protein, 9 aa, Entamoeba invadens
QKAKDLEEK

SEQ ID NO: 2896514 - protein, 6 aa, Entamoeba invadens
QKAKET

SEQ ID NO: 2896515 - protein, 25 aa, Entamoeba invadens
QKAKLHKRELEKQKVAQVQPVDQQV

SEQ ID NO: 2896516 - protein, 13 aa, Entamoeba invadens
QKAKMESKKAPIE

SEQ ID NO: 2896517 - protein, 6 aa, Entamoeba invadens
QKALPK

SEQ ID NO: 2896518 - protein, 6 aa, Entamoeba invadens
QKAMED

SEQ ID NO: 2896519 - protein, 6 aa, Entamoeba invadens
QKAMEQ

SEQ ID NO: 2896520 - protein, 13 aa, Entamoeba invadens
QKAMSSDTTPETI

SEQ ID NO: 2896521 - protein, 5 aa, Entamoeba invadens
QKANT

SEQ ID NO: 2896522 - protein, 17 aa, Entamoeba invadens
QKAPQKSETPPEATPKV

SEQ ID NO: 2896523 - protein, 6 aa, Entamoeba invadens
QKAQDM

SEQ ID NO: 2896524 - protein, 8 aa, Entamoeba invadens
QKAQENVK

SEQ ID NO: 2896525 - protein, 18 aa, Entamoeba invadens
QKAQERKAESCTTKKTPV

SEQ ID NO: 2896526 - protein, 8 aa, Entamoeba invadens
QKAQKKLR

SEQ ID NO: 2896527 - protein, 7 aa, Entamoeba invadens
QKAQQIA

SEQ ID NO: 2896528 - protein, 6 aa, Entamoeba invadens
QKAQRE

SEQ ID NO: 2896529 - protein, 10 aa, Entamoeba invadens
QKAQTAPVDE

SEQ ID NO: 2896530 - protein, 4 aa, Entamoeba invadens
QKAS

SEQ ID NO: 2896531 - protein, 7 aa, Entamoeba invadens
QKASQDQ

SEQ ID NO: 2896532 - protein, 8 aa, Entamoeba invadens
QKASTIKE

SEQ ID NO: 2896533 - protein, 4 aa, Entamoeba invadens
QKAV

SEQ ID NO: 2896534 - protein, 10 aa, Entamoeba invadens
QKAVDNTEEL

SEQ ID NO: 2896535 - protein, 8 aa, Entamoeba invadens
QKAYTAES

SEQ ID NO: 2896536 - protein, 6 aa, Entamoeba invadens
QKCAEG

SEQ ID NO: 2896537 - protein, 18 aa, Entamoeba invadens
QKCDSTQSVTQSVTQNAT

SEQ ID NO: 2896538 - protein, 20 aa, Entamoeba invadens
QKCKKNGGELSDEEDQKKTY

SEQ ID NO: 2896539 - protein, 6 aa, Entamoeba invadens
QKCQES

SEQ ID NO: 2896540 - protein, 10 aa, Entamoeba invadens
QKDAEEIQES

SEQ ID NO: 2896541 - protein, 8 aa, Entamoeba invadens
QKDAEGQL

SEQ ID NO: 2896542 - protein, 31 aa, Entamoeba invadens
QKDAPKTAGGAQTKATDKKKEPSKEKGKCSL

SEQ ID NO: 2896543 - protein, 6 aa, Entamoeba invadens
QKDARI

SEQ ID NO: 2896544 - protein, 13 aa, Entamoeba invadens
QKDDAYKEAENKI

SEQ ID NO: 2896545 - protein, 23 aa, Entamoeba invadens
QKDDDFCDGKKPIKNTPTQSTGE

SEQ ID NO: 2896546 - protein, 11 aa, Entamoeba invadens
QKDDEPQKSTI

SEQ ID NO: 2896547 - protein, 8 aa, Entamoeba invadens
QKDDKISE

SEQ ID NO: 2896548 - protein, 11 aa, Entamoeba invadens
QKDDTKVDTIT

SEQ ID NO: 2896549 - protein, 5 aa, Entamoeba invadens
QKDEE

SEQ ID NO: 2896550 - protein, 8 aa, Entamoeba invadens
QKDEITEI

SEQ ID NO: 2896551 - protein, 14 aa, Entamoeba invadens
QKDEKAQEEIDKGK

SEQ ID NO: 2896552 - protein, 7 aa, Entamoeba invadens
QKDEKFK

SEQ ID NO: 2896553 - protein, 8 aa, Entamoeba invadens
QKDEKTYI

SEQ ID NO: 2896554 - protein, 5 aa, Entamoeba invadens
QKDGK

SEQ ID NO: 2896555 - protein, 29 aa, Entamoeba invadens
QKDHEKRKVSKKQLNRKKEKKEKRETYQE

SEQ ID NO: 2896556 - protein, 32 aa, Entamoeba invadens
QKDIESAEKEDKKKMDRLRRKREEAKRMREDG

SEQ ID NO: 2896557 - protein, 11 aa, Entamoeba invadens
QKDIGKSLSEM

SEQ ID NO: 2896558 - protein, 11 aa, Entamoeba invadens
QKDITDDVGPK

SEQ ID NO: 2896559 - protein, 4 aa, Entamoeba invadens
QKDK

SEQ ID NO: 2896560 - protein, 9 aa, Entamoeba invadens
QKDKKSEKL

SEQ ID NO: 2896561 - protein, 5 aa, Entamoeba invadens
QKDKQ

SEQ ID NO: 2896562 - protein, 4 aa, Entamoeba invadens
QKDL

SEQ ID NO: 2896563 - protein, 8 aa, Entamoeba invadens
QKDLADDE

SEQ ID NO: 2896564 - protein, 13 aa, Entamoeba invadens
QKDLEANNTEFTE

SEQ ID NO: 2896565 - protein, 28 aa, Entamoeba invadens
QKDLEANNTELTELRDRTAKDKNKIADL

SEQ ID NO: 2896566 - protein, 8 aa, Entamoeba invadens
QKDLSEKG

SEQ ID NO: 2896567 - protein, 9 aa, Entamoeba invadens
QKDLSPDDI

SEQ ID NO: 2896568 - protein, 14 aa, Entamoeba invadens
QKDMETQDKTNQFE

SEQ ID NO: 2896569 - protein, 9 aa, Entamoeba invadens
QKDNVTRLS

SEQ ID NO: 2896570 - protein, 7 aa, Entamoeba invadens
QKDPKGR

SEQ ID NO: 2896571 - protein, 4 aa, Entamoeba invadens
QKDQ

SEQ ID NO: 2896572 - protein, 9 aa, Entamoeba invadens
QKDQNNSEK

SEQ ID NO: 2896573 - protein, 18 aa, Entamoeba invadens
QKDRISAENVVNALQTLV

SEQ ID NO: 2896574 - protein, 7 aa, Entamoeba invadens
QKDRKEW

SEQ ID NO: 2896575 - protein, 4 aa, Entamoeba invadens
QKDS

SEQ ID NO: 2896576 - protein, 8 aa, Entamoeba invadens
QKDSEEQV

SEQ ID NO: 2896577 - protein, 7 aa, Entamoeba invadens
QKDSHSY

SEQ ID NO: 2896578 - protein, 11 aa, Entamoeba invadens
QKDSLHTQNDL

SEQ ID NO: 2896579 - protein, 6 aa, Entamoeba invadens
QKDSTI

SEQ ID NO: 2896580 - protein, 8 aa, Entamoeba invadens
QKDTAVTG

SEQ ID NO: 2896581 - protein, 8 aa, Entamoeba invadens
QKDTDTYM

SEQ ID NO: 2896582 - protein, 9 aa, Entamoeba invadens
QKEAEEKKR

SEQ ID NO: 2896583 - protein, 4 aa, Entamoeba invadens
QKEC

SEQ ID NO: 2896584 - protein, 8 aa, Entamoeba invadens
QKEDAISS

SEQ ID NO: 2896585 - protein, 8 aa, Entamoeba invadens
QKEDALSD

SEQ ID NO: 2896586 - protein, 6 aa, Entamoeba invadens
QKEDLE

SEQ ID NO: 2896587 - protein, 11 aa, Entamoeba invadens
QKEDPRSNNGD

SEQ ID NO: 2896588 - protein, 28 aa, Entamoeba invadens
QKEDQKPSHRHTGSCTDRSPDSSPSSKV

SEQ ID NO: 2896589 - protein, 15 aa, Entamoeba invadens
QKEDQQKEKQRKEME

SEQ ID NO: 2896590 - protein, 11 aa, Entamoeba invadens
QKEEEENIQQE

SEQ ID NO: 2896591 - protein, 33 aa, Entamoeba invadens
QKEEEKQLQDDKEIKELQTQKAVADEDEDEKMA

SEQ ID NO: 2896592 - protein, 7 aa, Entamoeba invadens
QKEEEKR

SEQ ID NO: 2896593 - protein, 14 aa, Entamoeba invadens
QKEEEKYQKLSQTF

SEQ ID NO: 2896594 - protein, 18 aa, Entamoeba invadens
QKEEELNKKQKEENIRQS

SEQ ID NO: 2896595 - protein, 28 aa, Entamoeba invadens
QKEEEQKKADESTEEFTSGEEYGGEDEY

SEQ ID NO: 2896596 - protein, 13 aa, Entamoeba invadens
QKEEHEKTQKEYH

SEQ ID NO: 2896597 - protein, 6 aa, Entamoeba invadens
QKEEKR

SEQ ID NO: 2896598 - protein, 11 aa, Entamoeba invadens
QKEERTRNEAR

SEQ ID NO: 2896599 - protein, 7 aa, Entamoeba invadens
QKEETDL

SEQ ID NO: 2896600 - protein, 4 aa, Entamoeba invadens
QKEF

SEQ ID NO: 2896601 - protein, 9 aa, Entamoeba invadens
QKEGEKKNF

SEQ ID NO: 2896602 - protein, 20 aa, Entamoeba invadens
QKEGFPLKTARRKTQSIKRS

SEQ ID NO: 2896603 - protein, 17 aa, Entamoeba invadens
QKEGNESIETQTEVSQN

SEQ ID NO: 2896604 - protein, 12 aa, Entamoeba invadens
QKEHLVGNSQDI

SEQ ID NO: 2896605 - protein, 5 aa, Entamoeba invadens
QKEID

SEQ ID NO: 2896606 - protein, 15 aa, Entamoeba invadens
QKEIEEAKTTQDAMK

SEQ ID NO: 2896607 - protein, 14 aa, Entamoeba invadens
QKEIETDAQNEELI

SEQ ID NO: 2896608 - protein, 10 aa, Entamoeba invadens
QKEKAEQEQI

SEQ ID NO: 2896609 - protein, 7 aa, Entamoeba invadens
QKEKEDF

SEQ ID NO: 2896610 - protein, 9 aa, Entamoeba invadens
QKEKEKTKE

SEQ ID NO: 2896611 - protein, 11 aa, Entamoeba invadens
QKEKERKDKVN

SEQ ID NO: 2896612 - protein, 14 aa, Entamoeba invadens
QKEKMRERKEDELS

SEQ ID NO: 2896613 - protein, 35 aa, Entamoeba invadens
QKEKNVKKEEKEVSVGTPQKETPEADKCSNCGKEL

SEQ ID NO: 2896614 - protein, 7 aa, Entamoeba invadens
QKEKPDE

SEQ ID NO: 2896615 - protein, 7 aa, Entamoeba invadens
QKEKQRI

SEQ ID NO: 2896616 - protein, 11 aa, Entamoeba invadens
QKEKSVQSNEQ

SEQ ID NO: 2896617 - protein, 10 aa, Entamoeba invadens
QKEKTKKELE

SEQ ID NO: 2896618 - protein, 11 aa, Entamoeba invadens
QKEKTRDEEEM

SEQ ID NO: 2896619 - protein, 14 aa, Entamoeba invadens
QKEKVEEIKKEFIE

SEQ ID NO: 2896620 - protein, 5 aa, Entamoeba invadens
QKELF

SEQ ID NO: 2896621 - protein, 62 aa, Entamoeba invadens
QKELPKKSEKKVGRIRTSKFTGKERGDLDDERLKQAKEHIKDTEKNVKQREDVEDEETKTKN

SEQ ID NO: 2896622 - protein, 6 aa, Entamoeba invadens
QKEMKE

SEQ ID NO: 2896623 - protein, 10 aa, Entamoeba invadens
QKEMNNKDYK

SEQ ID NO: 2896624 - protein, 9 aa, Entamoeba invadens
QKENDMNNE

SEQ ID NO: 2896625 - protein, 5 aa, Entamoeba invadens
QKENF

SEQ ID NO: 2896626 - protein, 7 aa, Entamoeba invadens
QKENNQL

SEQ ID NO: 2896627 - protein, 24 aa, Entamoeba invadens
QKENPSVSAGLSGVNLSEKSAELR

SEQ ID NO: 2896628 - protein, 10 aa, Entamoeba invadens
QKENTTQQEM

SEQ ID NO: 2896629 - protein, 13 aa, Entamoeba invadens
QKENVLNGTSVND

SEQ ID NO: 2896630 - protein, 7 aa, Entamoeba invadens
QKEPTLS

SEQ ID NO: 2896631 - protein, 6 aa, Entamoeba invadens
QKEQEI

SEQ ID NO: 2896632 - protein, 11 aa, Entamoeba invadens
QKEQGLPTTDE

SEQ ID NO: 2896633 - protein, 5 aa, Entamoeba invadens
QKEQI

SEQ ID NO: 2896634 - protein, 7 aa, Entamoeba invadens
QKEQLTN

SEQ ID NO: 2896635 - protein, 7 aa, Entamoeba invadens
QKEQQQY

SEQ ID NO: 2896636 - protein, 24 aa, Entamoeba invadens
QKEREEKARRQREEAERKRVEDEQ

SEQ ID NO: 2896637 - protein, 8 aa, Entamoeba invadens
QKERHGST

SEQ ID NO: 2896638 - protein, 5 aa, Entamoeba invadens
QKERL

SEQ ID NO: 2896639 - protein, 10 aa, Entamoeba invadens
QKERQPPHKT

SEQ ID NO: 2896640 - protein, 17 aa, Entamoeba invadens
QKERSVAEEGQKTISDH

SEQ ID NO: 2896641 - protein, 5 aa, Entamoeba invadens
QKERY

SEQ ID NO: 2896642 - protein, 9 aa, Entamoeba invadens
QKESERGTI

SEQ ID NO: 2896643 - protein, 9 aa, Entamoeba invadens
QKESGNFVT

SEQ ID NO: 2896644 - protein, 28 aa, Entamoeba invadens
QKESTFNTQIGKTQSDLKKTQQSVRDGE

SEQ ID NO: 2896645 - protein, 11 aa, Entamoeba invadens
QKESVSTTNQL

SEQ ID NO: 2896646 - protein, 4 aa, Entamoeba invadens
QKET

SEQ ID NO: 2896647 - protein, 17 aa, Entamoeba invadens
QKETAYKLDHSSKRTLT

SEQ ID NO: 2896648 - protein, 26 aa, Entamoeba invadens
QKETCDGSVEKSTERTVLSPRRTPVS

SEQ ID NO: 2896649 - protein, 7 aa, Entamoeba invadens
QKETDER

SEQ ID NO: 2896650 - protein, 6 aa, Entamoeba invadens
QKETDL

SEQ ID NO: 2896651 - protein, 28 aa, Entamoeba invadens
QKETDSSLKTSISKKLTEIKKSKLGKSL

SEQ ID NO: 2896652 - protein, 12 aa, Entamoeba invadens
QKETQNNETKKD

SEQ ID NO: 2896653 - protein, 9 aa, Entamoeba invadens
QKETSDVQM

SEQ ID NO: 2896654 - protein, 12 aa, Entamoeba invadens
QKEVERNAQNFK

SEQ ID NO: 2896655 - protein, 8 aa, Entamoeba invadens
QKEVGNKW

SEQ ID NO: 2896656 - protein, 20 aa, Entamoeba invadens
QKEVSDVPISSSHIKCFKNN

SEQ ID NO: 2896657 - protein, 6 aa, Entamoeba invadens
QKEYGD

SEQ ID NO: 2896658 - protein, 9 aa, Entamoeba invadens
QKEYPNNQT

SEQ ID NO: 2896659 - protein, 18 aa, Entamoeba invadens
QKFEEQISQAKKKYSEDV

SEQ ID NO: 2896660 - protein, 6 aa, Entamoeba invadens
QKFETK

SEQ ID NO: 2896661 - protein, 9 aa, Entamoeba invadens
QKFKNEGEV

SEQ ID NO: 2896662 - protein, 6 aa, Entamoeba invadens
QKFNPN

SEQ ID NO: 2896663 - protein, 14 aa, Entamoeba invadens
QKFSESRSYGPSGP

SEQ ID NO: 2896664 - protein, 20 aa, Entamoeba invadens
QKFSSNYDDYSERRDRREPK

SEQ ID NO: 2896665 - protein, 7 aa, Entamoeba invadens
QKFSSSP

SEQ ID NO: 2896666 - protein, 7 aa, Entamoeba invadens
QKFTGKS

SEQ ID NO: 2896667 - protein, 20 aa, Entamoeba invadens
QKFTKTKTFSAVEKRGCGGS

SEQ ID NO: 2896668 - protein, 16 aa, Entamoeba invadens
QKGCVKEEKQKTTIEG

SEQ ID NO: 2896669 - protein, 8 aa, Entamoeba invadens
QKGDKTEA

SEQ ID NO: 2896670 - protein, 9 aa, Entamoeba invadens
QKGEDRYTK

SEQ ID NO: 2896671 - protein, 5 aa, Entamoeba invadens
QKGGE

SEQ ID NO: 2896672 - protein, 6 aa, Entamoeba invadens
QKGGFK

SEQ ID NO: 2896673 - protein, 7 aa, Entamoeba invadens
QKGGMPM

SEQ ID NO: 2896674 - protein, 11 aa, Entamoeba invadens
QKGHDRPSPSL

SEQ ID NO: 2896675 - protein, 10 aa, Entamoeba invadens
QKGIDEQSLE

SEQ ID NO: 2896676 - protein, 5 aa, Entamoeba invadens
QKGIQ

SEQ ID NO: 2896677 - protein, 11 aa, Entamoeba invadens
QKGKDCCKTTN

SEQ ID NO: 2896678 - protein, 5 aa, Entamoeba invadens
QKGKL

SEQ ID NO: 2896679 - protein, 19 aa, Entamoeba invadens
QKGKQHKQPKPALSPRKAV

SEQ ID NO: 2896680 - protein, 11 aa, Entamoeba invadens
QKGKTDVRSVQ

SEQ ID NO: 2896681 - protein, 4 aa, Entamoeba invadens
QKGL

SEQ ID NO: 2896682 - protein, 13 aa, Entamoeba invadens
QKGLLQTKKSFYK

SEQ ID NO: 2896683 - protein, 16 aa, Entamoeba invadens
QKGLVENVSEKDCETF

SEQ ID NO: 2896684 - protein, 19 aa, Entamoeba invadens
QKGMENSFGSTCHGAGRRM

SEQ ID NO: 2896685 - protein, 13 aa, Entamoeba invadens
QKGMKQQFIDSLK

SEQ ID NO: 2896686 - protein, 20 aa, Entamoeba invadens
QKGNTDDDINNEEEKSTDKK

SEQ ID NO: 2896687 - protein, 7 aa, Entamoeba invadens
QKGPAEI

SEQ ID NO: 2896688 - protein, 16 aa, Entamoeba invadens
QKGPHTEKKANNDSIQ

SEQ ID NO: 2896689 - protein, 8 aa, Entamoeba invadens
QKGPVYGG

SEQ ID NO: 2896690 - protein, 6 aa, Entamoeba invadens
QKGQIT

SEQ ID NO: 2896691 - protein, 34 aa, Entamoeba invadens
QKGQKQLSKDDENIQPKKQLNERNDQIEDEEEDI

SEQ ID NO: 2896692 - protein, 6 aa, Entamoeba invadens
QKGQSI

SEQ ID NO: 2896693 - protein, 9 aa, Entamoeba invadens
QKGRDGIMN

SEQ ID NO: 2896694 - protein, 13 aa, Entamoeba invadens
QKGRDNDGEITTT

SEQ ID NO: 2896695 - protein, 4 aa, Entamoeba invadens
QKGT

SEQ ID NO: 2896696 - protein, 10 aa, Entamoeba invadens
QKGTGKERMG

SEQ ID NO: 2896697 - protein, 5 aa, Entamoeba invadens
QKGTL

SEQ ID NO: 2896698 - protein, 8 aa, Entamoeba invadens
QKGTMNTI

SEQ ID NO: 2896699 - protein, 5 aa, Entamoeba invadens
QKGTQ

SEQ ID NO: 2896700 - protein, 23 aa, Entamoeba invadens
QKGTSVEDVSGKRIAKNKPNALS

SEQ ID NO: 2896701 - protein, 6 aa, Entamoeba invadens
QKGVIT

SEQ ID NO: 2896702 - protein, 5 aa, Entamoeba invadens
QKGVY

SEQ ID NO: 2896703 - protein, 7 aa, Entamoeba invadens
QKHEKTV

SEQ ID NO: 2896704 - protein, 12 aa, Entamoeba invadens
QKHGKEKMNQVT

SEQ ID NO: 2896705 - protein, 4 aa, Entamoeba invadens
QKHN

SEQ ID NO: 2896706 - protein, 7 aa, Entamoeba invadens
QKHQKTV

SEQ ID NO: 2896707 - protein, 5 aa, Entamoeba invadens
QKHRI

SEQ ID NO: 2896708 - protein, 41 aa, Entamoeba invadens
QKHTKTPSQTSETPLQNAETNSKEEEPKQNEELKEEGKPVK

SEQ ID NO: 2896709 - protein, 4 aa, Entamoeba invadens
QKIA

SEQ ID NO: 2896710 - protein, 8 aa, Entamoeba invadens
QKIANEKL

SEQ ID NO: 2896711 - protein, 4 aa, Entamoeba invadens
QKIE

SEQ ID NO: 2896712 - protein, 8 aa, Entamoeba invadens
QKIEENTV

SEQ ID NO: 2896713 - protein, 12 aa, Entamoeba invadens
QKIENEQVVPPQ

SEQ ID NO: 2896714 - protein, 5 aa, Entamoeba invadens
QKIGE

SEQ ID NO: 2896715 - protein, 28 aa, Entamoeba invadens
QKIGKERDILTNTNKNLTQKMRDEEVKK

SEQ ID NO: 2896716 - protein, 14 aa, Entamoeba invadens
QKIKEDKKERKRID

SEQ ID NO: 2896717 - protein, 13 aa, Entamoeba invadens
QKIKSESEQYANE

SEQ ID NO: 2896718 - protein, 7 aa, Entamoeba invadens
QKINGDK

SEQ ID NO: 2896719 - protein, 5 aa, Entamoeba invadens
QKIPN

SEQ ID NO: 2896720 - protein, 7 aa, Entamoeba invadens
QKIPTEK

SEQ ID NO: 2896721 - protein, 10 aa, Entamoeba invadens
QKIQQQQQDL

SEQ ID NO: 2896722 - protein, 13 aa, Entamoeba invadens
QKIRDDSNNYIST

SEQ ID NO: 2896723 - protein, 13 aa, Entamoeba invadens
QKISENDKAIEHN

SEQ ID NO: 2896724 - protein, 6 aa, Entamoeba invadens
QKISQD

SEQ ID NO: 2896725 - protein, 6 aa, Entamoeba invadens
QKISVT

SEQ ID NO: 2896726 - protein, 7 aa, Entamoeba invadens
QKITHND

SEQ ID NO: 2896727 - protein, 5 aa, Entamoeba invadens
QKKAE

SEQ ID NO: 2896728 - protein, 6 aa, Entamoeba invadens
QKKAGD

SEQ ID NO: 2896729 - protein, 9 aa, Entamoeba invadens
QKKANTGNV

SEQ ID NO: 2896730 - protein, 6 aa, Entamoeba invadens
QKKAQQ

SEQ ID NO: 2896731 - protein, 9 aa, Entamoeba invadens
QKKASCVDA

SEQ ID NO: 2896732 - protein, 4 aa, Entamoeba invadens
QKKC

SEQ ID NO: 2896733 - protein, 12 aa, Entamoeba invadens
QKKDKTVEKENL

SEQ ID NO: 2896734 - protein, 19 aa, Entamoeba invadens
QKKDMKYDDLTKESVTTFG

SEQ ID NO: 2896735 - protein, 10 aa, Entamoeba invadens
QKKDNTGETL

SEQ ID NO: 2896736 - protein, 4 aa, Entamoeba invadens
QKKE

SEQ ID NO: 2896737 - protein, 8 aa, Entamoeba invadens
QKKEGRTI

SEQ ID NO: 2896738 - protein, 27 aa, Entamoeba invadens
QKKEPSTPTTASQISNENSTSSSEKQE

SEQ ID NO: 2896739 - protein, 14 aa, Entamoeba invadens
QKKGEFNLDGSRGA

SEQ ID NO: 2896740 - protein, 8 aa, Entamoeba invadens
QKKGVSRT

SEQ ID NO: 2896741 - protein, 16 aa, Entamoeba invadens
QKKHKSTYLQILKPLL

SEQ ID NO: 2896742 - protein, 8 aa, Entamoeba invadens
QKKHPYLA

SEQ ID NO: 2896743 - protein, 8 aa, Entamoeba invadens
QKKKPSLE

SEQ ID NO: 2896744 - protein, 7 aa, Entamoeba invadens
QKKKTNF

SEQ ID NO: 2896745 - protein, 9 aa, Entamoeba invadens
QKKKTQRFE

SEQ ID NO: 2896746 - protein, 22 aa, Entamoeba invadens
QKKLKRKEEKHKREHKKGGEIR

SEQ ID NO: 2896747 - protein, 5 aa, Entamoeba invadens
QKKLN

SEQ ID NO: 2896748 - protein, 42 aa, Entamoeba invadens
QKKLSDLVDEQQKIQDRLREEQEEVKKEFQEKREKWRKERRE

SEQ ID NO: 2896749 - protein, 7 aa, Entamoeba invadens
QKKMRNA

SEQ ID NO: 2896750 - protein, 19 aa, Entamoeba invadens
QKKMRTETTSKDEKNNPTV

SEQ ID NO: 2896751 - protein, 23 aa, Entamoeba invadens
QKKNATNSNSPAAEEKKVKNKKE

SEQ ID NO: 2896752 - protein, 15 aa, Entamoeba invadens
QKKNFKKKKEMDSSV

SEQ ID NO: 2896753 - protein, 11 aa, Entamoeba invadens
QKKNNSDSEHI

SEQ ID NO: 2896754 - protein, 6 aa, Entamoeba invadens
QKKNRK

SEQ ID NO: 2896755 - protein, 7 aa, Entamoeba invadens
QKKNSQI

SEQ ID NO: 2896756 - protein, 20 aa, Entamoeba invadens
QKKPKRKRKLSTTEKIKSFF

SEQ ID NO: 2896757 - protein, 6 aa, Entamoeba invadens
QKKPNY

SEQ ID NO: 2896758 - protein, 9 aa, Entamoeba invadens
QKKPSGTDL

SEQ ID NO: 2896759 - protein, 14 aa, Entamoeba invadens
QKKQEKRVERENRR

SEQ ID NO: 2896760 - protein, 6 aa, Entamoeba invadens
QKKQEY

SEQ ID NO: 2896761 - protein, 8 aa, Entamoeba invadens
QKKQPASL

SEQ ID NO: 2896762 - protein, 10 aa, Entamoeba invadens
QKKQQPPNLK

SEQ ID NO: 2896763 - protein, 21 aa, Entamoeba invadens
QKKRASDKKKVEVKEPSKEVV

SEQ ID NO: 2896764 - protein, 10 aa, Entamoeba invadens
QKKRPNGKKF

SEQ ID NO: 2896765 - protein, 17 aa, Entamoeba invadens
QKKRRQAKSEMDRNRAE

SEQ ID NO: 2896766 - protein, 10 aa, Entamoeba invadens
QKKRSEYQTY

SEQ ID NO: 2896767 - protein, 9 aa, Entamoeba invadens
QKKRVTGRR

SEQ ID NO: 2896768 - protein, 4 aa, Entamoeba invadens
QKKS

SEQ ID NO: 2896769 - protein, 45 aa, Entamoeba invadens
QKKSEEDAKRQEKEANKSANKKTRGQLRKEKKLKKYVEQDEEDRL

SEQ ID NO: 2896770 - protein, 7 aa, Entamoeba invadens
QKKSEPL

SEQ ID NO: 2896771 - protein, 9 aa, Entamoeba invadens
QKKTGKGSL

SEQ ID NO: 2896772 - protein, 7 aa, Entamoeba invadens
QKKTKNE

SEQ ID NO: 2896773 - protein, 8 aa, Entamoeba invadens
QKKTLKES

SEQ ID NO: 2896774 - protein, 18 aa, Entamoeba invadens
QKKTLQKIKDEKKPRTNV

SEQ ID NO: 2896775 - protein, 7 aa, Entamoeba invadens
QKKTNNE

SEQ ID NO: 2896776 - protein, 8 aa, Entamoeba invadens
QKKTPYPI

SEQ ID NO: 2896777 - protein, 8 aa, Entamoeba invadens
QKKYKRSA

SEQ ID NO: 2896778 - protein, 9 aa, Entamoeba invadens
QKKYTKSAD

SEQ ID NO: 2896779 - protein, 6 aa, Entamoeba invadens
QKLAES

SEQ ID NO: 2896780 - protein, 9 aa, Entamoeba invadens
QKLDTADKY

SEQ ID NO: 2896781 - protein, 18 aa, Entamoeba invadens
QKLEDATNNKVDNTIDQL

SEQ ID NO: 2896782 - protein, 31 aa, Entamoeba invadens
QKLENEKKKETHSEKAQTSVKMEEESETDDG

SEQ ID NO: 2896783 - protein, 32 aa, Entamoeba invadens
QKLESQPQPEDNLEKPKNDEKGDNLKTDGQTI

SEQ ID NO: 2896784 - protein, 11 aa, Entamoeba invadens
QKLGEHPSAVK

SEQ ID NO: 2896785 - protein, 21 aa, Entamoeba invadens
QKLGGPGTQYSESKFTSPPTE

SEQ ID NO: 2896786 - protein, 7 aa, Entamoeba invadens
QKLHEQE

SEQ ID NO: 2896787 - protein, 23 aa, Entamoeba invadens
QKLNEEYTKEVQTLQNENEKQRE

SEQ ID NO: 2896788 - protein, 7 aa, Entamoeba invadens
QKLPEKC

SEQ ID NO: 2896789 - protein, 9 aa, Entamoeba invadens
QKLPKTIQQ

SEQ ID NO: 2896790 - protein, 6 aa, Entamoeba invadens
QKLPND

SEQ ID NO: 2896791 - protein, 8 aa, Entamoeba invadens
QKLQNDNT

SEQ ID NO: 2896792 - protein, 4 aa, Entamoeba invadens
QKLR

SEQ ID NO: 2896793 - protein, 9 aa, Entamoeba invadens
QKLSEYKES

SEQ ID NO: 2896794 - protein, 12 aa, Entamoeba invadens
QKLTDENKTITY

SEQ ID NO: 2896795 - protein, 9 aa, Entamoeba invadens
QKLTKHSQP

SEQ ID NO: 2896796 - protein, 6 aa, Entamoeba invadens
QKLYGD

SEQ ID NO: 2896797 - protein, 9 aa, Entamoeba invadens
QKMEQRKNY

SEQ ID NO: 2896798 - protein, 4 aa, Entamoeba invadens
QKMG

SEQ ID NO: 2896799 - protein, 17 aa, Entamoeba invadens
QKMKDAKQETLETCQKS

SEQ ID NO: 2896800 - protein, 14 aa, Entamoeba invadens
QKMLSEAQSENETL

SEQ ID NO: 2896801 - protein, 14 aa, Entamoeba invadens
QKMSERLTARRNEL

SEQ ID NO: 2896802 - protein, 18 aa, Entamoeba invadens
QKNANDKLQKKINEYERE

SEQ ID NO: 2896803 - protein, 9 aa, Entamoeba invadens
QKNAPLSDD

SEQ ID NO: 2896804 - protein, 8 aa, Entamoeba invadens
QKNASKEG

SEQ ID NO: 2896805 - protein, 15 aa, Entamoeba invadens
QKNATKKVENAPSSA

SEQ ID NO: 2896806 - protein, 5 aa, Entamoeba invadens
QKNCD

SEQ ID NO: 2896807 - protein, 6 aa, Entamoeba invadens
QKNDID

SEQ ID NO: 2896808 - protein, 15 aa, Entamoeba invadens
QKNEEIEKIKNEKHE

SEQ ID NO: 2896809 - protein, 6 aa, Entamoeba invadens
QKNEEM

SEQ ID NO: 2896810 - protein, 5 aa, Entamoeba invadens
QKNEK

SEQ ID NO: 2896811 - protein, 6 aa, Entamoeba invadens
QKNEMT

SEQ ID NO: 2896812 - protein, 54 aa, Entamoeba invadens
QKNENKVGGKGGVKGFGISSNTKKGLYKTSEDEYEEDDMEYEEEDLKEEEKKYL

SEQ ID NO: 2896813 - protein, 9 aa, Entamoeba invadens
QKNEPKVDK

SEQ ID NO: 2896814 - protein, 12 aa, Entamoeba invadens
QKNESGQGESKI

SEQ ID NO: 2896815 - protein, 6 aa, Entamoeba invadens
QKNGGS

SEQ ID NO: 2896816 - protein, 7 aa, Entamoeba invadens
QKNGIDD

SEQ ID NO: 2896817 - protein, 7 aa, Entamoeba invadens
QKNGKKI

SEQ ID NO: 2896818 - protein, 7 aa, Entamoeba invadens
QKNGTDL

SEQ ID NO: 2896819 - protein, 14 aa, Entamoeba invadens
QKNGTQHNTTNYHE

SEQ ID NO: 2896820 - protein, 5 aa, Entamoeba invadens
QKNIK

SEQ ID NO: 2896821 - protein, 14 aa, Entamoeba invadens
QKNIPSGVGTTSSL

SEQ ID NO: 2896822 - protein, 7 aa, Entamoeba invadens
QKNKTGL

SEQ ID NO: 2896823 - protein, 4 aa, Entamoeba invadens
QKNL

SEQ ID NO: 2896824 - protein, 10 aa, Entamoeba invadens
QKNLEKAQTI

SEQ ID NO: 2896825 - protein, 10 aa, Entamoeba invadens
QKNNYQNDKR

SEQ ID NO: 2896826 - protein, 7 aa, Entamoeba invadens
QKNPENY

SEQ ID NO: 2896827 - protein, 7 aa, Entamoeba invadens
QKNPGKM

SEQ ID NO: 2896828 - protein, 9 aa, Entamoeba invadens
QKNQVSESV

SEQ ID NO: 2896829 - protein, 6 aa, Entamoeba invadens
QKNRSI

SEQ ID NO: 2896830 - protein, 7 aa, Entamoeba invadens
QKNSEVI

SEQ ID NO: 2896831 - protein, 11 aa, Entamoeba invadens
QKNSPTPGKRR

SEQ ID NO: 2896832 - protein, 10 aa, Entamoeba invadens
QKNSQPEEIA

SEQ ID NO: 2896833 - protein, 9 aa, Entamoeba invadens
QKNTAPRQC

SEQ ID NO: 2896834 - protein, 8 aa, Entamoeba invadens
QKNTDEEL

SEQ ID NO: 2896835 - protein, 19 aa, Entamoeba invadens
QKNTDKLSEIKTEDQAAIA

SEQ ID NO: 2896836 - protein, 6 aa, Entamoeba invadens
QKNTEG

SEQ ID NO: 2896837 - protein, 9 aa, Entamoeba invadens
QKNTNFPEG

SEQ ID NO: 2896838 - protein, 20 aa, Entamoeba invadens
QKNTTSSSEATETDEPSSVL

SEQ ID NO: 2896839 - protein, 17 aa, Entamoeba invadens
QKNVEQLNEKQKEIEDL

SEQ ID NO: 2896840 - protein, 11 aa, Entamoeba invadens
QKPDGKDKNVP

SEQ ID NO: 2896841 - protein, 36 aa, Entamoeba invadens
QKPEETQEEDDDGWEEVGEKSKKISLRTEKSDGKSC

SEQ ID NO: 2896842 - protein, 14 aa, Entamoeba invadens
QKPEKHPKEHRDPV

SEQ ID NO: 2896843 - protein, 10 aa, Entamoeba invadens
QKPESADSDH

SEQ ID NO: 2896844 - protein, 10 aa, Entamoeba invadens
QKPESGDNDH

SEQ ID NO: 2896845 - protein, 6 aa, Entamoeba invadens
QKPFNV

SEQ ID NO: 2896846 - protein, 7 aa, Entamoeba invadens
QKPGQNV

SEQ ID NO: 2896847 - protein, 4 aa, Entamoeba invadens
QKPI

SEQ ID NO: 2896848 - protein, 7 aa, Entamoeba invadens
QKPIQAA

SEQ ID NO: 2896849 - protein, 5 aa, Entamoeba invadens
QKPKK

SEQ ID NO: 2896850 - protein, 10 aa, Entamoeba invadens
QKPKNMEEDL

SEQ ID NO: 2896851 - protein, 4 aa, Entamoeba invadens
QKPL

SEQ ID NO: 2896852 - protein, 29 aa, Entamoeba invadens
QKPLPSTQNQLEQTTQPQLQQKTVETQRI

SEQ ID NO: 2896853 - protein, 13 aa, Entamoeba invadens
QKPNAMEEEPISD

SEQ ID NO: 2896854 - protein, 9 aa, Entamoeba invadens
QKPNDRTDI

SEQ ID NO: 2896855 - protein, 13 aa, Entamoeba invadens
QKPNFGNPYPPIR

SEQ ID NO: 2896856 - protein, 7 aa, Entamoeba invadens
QKPNKSM

SEQ ID NO: 2896857 - protein, 16 aa, Entamoeba invadens
QKPPFTRGFVYLYRTL

SEQ ID NO: 2896858 - protein, 45 aa, Entamoeba invadens
QKPQEKEKEQTTGVSQTPSQTPTESTDERDIQRSPQRSRSPSTER

SEQ ID NO: 2896859 - protein, 20 aa, Entamoeba invadens
QKPQIESEAQKKDKKECDST

SEQ ID NO: 2896860 - protein, 12 aa, Entamoeba invadens
QKPQPKSEKEAI

SEQ ID NO: 2896861 - protein, 10 aa, Entamoeba invadens
QKPSKKTEHI

SEQ ID NO: 2896862 - protein, 6 aa, Entamoeba invadens
QKPSNV

SEQ ID NO: 2896863 - protein, 6 aa, Entamoeba invadens
QKPSVE

SEQ ID NO: 2896864 - protein, 4 aa, Entamoeba invadens
QKPT

SEQ ID NO: 2896865 - protein, 13 aa, Entamoeba invadens
QKPTDQGPSFDIP

SEQ ID NO: 2896866 - protein, 7 aa, Entamoeba invadens
QKPTGTV

SEQ ID NO: 2896867 - protein, 4 aa, Entamoeba invadens
QKPV

SEQ ID NO: 2896868 - protein, 6 aa, Entamoeba invadens
QKPVGF

SEQ ID NO: 2896869 - protein, 24 aa, Entamoeba invadens
QKQDEQKNETINEQISNEGNEIAS

SEQ ID NO: 2896870 - protein, 10 aa, Entamoeba invadens
QKQDGGAGTM

SEQ ID NO: 2896871 - protein, 9 aa, Entamoeba invadens
QKQDNTLQL

SEQ ID NO: 2896872 - protein, 7 aa, Entamoeba invadens
QKQEDPV

SEQ ID NO: 2896873 - protein, 10 aa, Entamoeba invadens
QKQEKLQSAL

SEQ ID NO: 2896874 - protein, 27 aa, Entamoeba invadens
QKQEPEPQKSTQTPPHFSPTHTQPKPF

SEQ ID NO: 2896875 - protein, 12 aa, Entamoeba invadens
QKQERTTNDVTS

SEQ ID NO: 2896876 - protein, 6 aa, Entamoeba invadens
QKQGGI

SEQ ID NO: 2896877 - protein, 17 aa, Entamoeba invadens
QKQHEENIQREKQKKAY

SEQ ID NO: 2896878 - protein, 4 aa, Entamoeba invadens
QKQI

SEQ ID NO: 2896879 - protein, 8 aa, Entamoeba invadens
QKQIPKPK

SEQ ID NO: 2896880 - protein, 13 aa, Entamoeba invadens
QKQKEEKEKERLA

SEQ ID NO: 2896881 - protein, 6 aa, Entamoeba invadens
QKQKER

SEQ ID NO: 2896882 - protein, 7 aa, Entamoeba invadens
QKQKSES

SEQ ID NO: 2896883 - protein, 6 aa, Entamoeba invadens
QKQLQQ

SEQ ID NO: 2896884 - protein, 13 aa, Entamoeba invadens
QKQMSDAKHVPPI

SEQ ID NO: 2896885 - protein, 8 aa, Entamoeba invadens
QKQNKLGS

SEQ ID NO: 2896886 - protein, 5 aa, Entamoeba invadens
QKQNT

SEQ ID NO: 2896887 - protein, 12 aa, Entamoeba invadens
QKQNTETQTQIG

SEQ ID NO: 2896888 - protein, 4 aa, Entamoeba invadens
QKQP

SEQ ID NO: 2896889 - protein, 10 aa, Entamoeba invadens
QKQPNATDKY

SEQ ID NO: 2896890 - protein, 17 aa, Entamoeba invadens
QKQQINSEEISGNAEDL

SEQ ID NO: 2896891 - protein, 7 aa, Entamoeba invadens
QKQRDVM

SEQ ID NO: 2896892 - protein, 44 aa, Entamoeba invadens
QKQRKEITSLHGPETKERPKKQRKRVRMDSKRTEQSATEEEPSL

SEQ ID NO: 2896893 - protein, 5 aa, Entamoeba invadens
QKQRS

SEQ ID NO: 2896894 - protein, 17 aa, Entamoeba invadens
QKQSGRITKSHKSEQFE

SEQ ID NO: 2896895 - protein, 5 aa, Entamoeba invadens
QKQSQ

SEQ ID NO: 2896896 - protein, 11 aa, Entamoeba invadens
QKQTAAGQRTR

SEQ ID NO: 2896897 - protein, 39 aa, Entamoeba invadens
QKQTYQSRDTPIIPGNPMSQQTPQKQQYPQSAQSYQGMS

SEQ ID NO: 2896898 - protein, 7 aa, Entamoeba invadens
QKQYQQA

SEQ ID NO: 2896899 - protein, 5 aa, Entamoeba invadens
QKRAP

SEQ ID NO: 2896900 - protein, 8 aa, Entamoeba invadens
QKRAVNTQ

SEQ ID NO: 2896901 - protein, 4 aa, Entamoeba invadens
QKRD

SEQ ID NO: 2896902 - protein, 11 aa, Entamoeba invadens
QKRDKDTKKPV

SEQ ID NO: 2896903 - protein, 11 aa, Entamoeba invadens
QKRDNSQREME

SEQ ID NO: 2896904 - protein, 9 aa, Entamoeba invadens
QKREDGYAK

SEQ ID NO: 2896905 - protein, 11 aa, Entamoeba invadens
QKREDKIHSDS

SEQ ID NO: 2896906 - protein, 14 aa, Entamoeba invadens
QKREQKERGDTGEK

SEQ ID NO: 2896907 - protein, 94 aa, Entamoeba invadens
QKRGEKKRGGKGRGGFSNSRGEQQERGHEKRRDPFEDPQSEKDSFGEREIRDDGKRRYDRNSRGGRQSTERRYKTQRTTETKENSEGKSQITEN

SEQ ID NO: 2896908 - protein, 10 aa, Entamoeba invadens
QKRGKSRFRD

SEQ ID NO: 2896909 - protein, 8 aa, Entamoeba invadens
QKRGTAKT

SEQ ID NO: 2896910 - protein, 60 aa, Entamoeba invadens
QKRKDDEKKKNEIEADGTNEKSSSLSKSHSSEEKDRQIDTLQNEKIEKVEVQTSQLNDAT

SEQ ID NO: 2896911 - protein, 21 aa, Entamoeba invadens
QKRKDTVQKIQEERHKGRVKQ

SEQ ID NO: 2896912 - protein, 8 aa, Entamoeba invadens
QKRKEEIR

SEQ ID NO: 2896913 - protein, 10 aa, Entamoeba invadens
QKRKEKAGKW

SEQ ID NO: 2896914 - protein, 6 aa, Entamoeba invadens
QKRKHK

SEQ ID NO: 2896915 - protein, 14 aa, Entamoeba invadens
QKRKLDKKFSKSQS

SEQ ID NO: 2896916 - protein, 8 aa, Entamoeba invadens
QKRLRTTQ

SEQ ID NO: 2896917 - protein, 8 aa, Entamoeba invadens
QKRPGETT

SEQ ID NO: 2896918 - protein, 12 aa, Entamoeba invadens
QKRPRNSQPKQM

SEQ ID NO: 2896919 - protein, 6 aa, Entamoeba invadens
QKRQKI

SEQ ID NO: 2896920 - protein, 8 aa, Entamoeba invadens
QKRQNNRK

SEQ ID NO: 2896921 - protein, 23 aa, Entamoeba invadens
QKRREDIADDSDDNDSEESDEWD

SEQ ID NO: 2896922 - protein, 5 aa, Entamoeba invadens
QKRST

SEQ ID NO: 2896923 - protein, 6 aa, Entamoeba invadens
QKRTFD

SEQ ID NO: 2896924 - protein, 8 aa, Entamoeba invadens
QKRTLDPK

SEQ ID NO: 2896925 - protein, 9 aa, Entamoeba invadens
QKRTLDPKC

SEQ ID NO: 2896926 - protein, 8 aa, Entamoeba invadens
QKRTNTFE

SEQ ID NO: 2896927 - protein, 6 aa, Entamoeba invadens
QKRTTF

SEQ ID NO: 2896928 - protein, 11 aa, Entamoeba invadens
QKRYSGDENTL

SEQ ID NO: 2896929 - protein, 6 aa, Entamoeba invadens
QKRYTD

SEQ ID NO: 2896930 - protein, 9 aa, Entamoeba invadens
QKSADKNEE

SEQ ID NO: 2896931 - protein, 24 aa, Entamoeba invadens
QKSAPEEKKEKNVTPEAPQGSPLM

SEQ ID NO: 2896932 - protein, 5 aa, Entamoeba invadens
QKSDD

SEQ ID NO: 2896933 - protein, 9 aa, Entamoeba invadens
QKSDPLSIR

SEQ ID NO: 2896934 - protein, 7 aa, Entamoeba invadens
QKSDQDL

SEQ ID NO: 2896935 - protein, 7 aa, Entamoeba invadens
QKSEAQN

SEQ ID NO: 2896936 - protein, 9 aa, Entamoeba invadens
QKSEGMSGA

SEQ ID NO: 2896937 - protein, 5 aa, Entamoeba invadens
QKSEI

SEQ ID NO: 2896938 - protein, 33 aa, Entamoeba invadens
QKSEIKEQRQTFKTSSYRRTNEERLATSSDHGK

SEQ ID NO: 2896939 - protein, 23 aa, Entamoeba invadens
QKSEITKSTPPQQEKESTSNPPI

SEQ ID NO: 2896940 - protein, 9 aa, Entamoeba invadens
QKSENKRGK

SEQ ID NO: 2896941 - protein, 22 aa, Entamoeba invadens
QKSEPINRKREEPESKEEESPC

SEQ ID NO: 2896942 - protein, 12 aa, Entamoeba invadens
QKSERVKKEVEV

SEQ ID NO: 2896943 - protein, 4 aa, Entamoeba invadens
QKSF

SEQ ID NO: 2896944 - protein, 7 aa, Entamoeba invadens
QKSGESF

SEQ ID NO: 2896945 - protein, 7 aa, Entamoeba invadens
QKSGTPI

SEQ ID NO: 2896946 - protein, 20 aa, Entamoeba invadens
QKSGTRVPKRKTLTKATSIG

SEQ ID NO: 2896947 - protein, 6 aa, Entamoeba invadens
QKSIGS

SEQ ID NO: 2896948 - protein, 9 aa, Entamoeba invadens
QKSITPDVA

SEQ ID NO: 2896949 - protein, 6 aa, Entamoeba invadens
QKSKEV

SEQ ID NO: 2896950 - protein, 12 aa, Entamoeba invadens
QKSKTLTSSEDI

SEQ ID NO: 2896951 - protein, 8 aa, Entamoeba invadens
QKSLKTDI

SEQ ID NO: 2896952 - protein, 8 aa, Entamoeba invadens
QKSLPQSQ

SEQ ID NO: 2896953 - protein, 17 aa, Entamoeba invadens
QKSNEKHRESVVKDEER

SEQ ID NO: 2896954 - protein, 11 aa, Entamoeba invadens
QKSNETTLTRT

SEQ ID NO: 2896955 - protein, 10 aa, Entamoeba invadens
QKSNNDLSEQ

SEQ ID NO: 2896956 - protein, 10 aa, Entamoeba invadens
QKSNPTDYSK

SEQ ID NO: 2896957 - protein, 16 aa, Entamoeba invadens
QKSNQSPPQKVEETVP

SEQ ID NO: 2896958 - protein, 7 aa, Entamoeba invadens
QKSNTRF

SEQ ID NO: 2896959 - protein, 5 aa, Entamoeba invadens
QKSNY

SEQ ID NO: 2896960 - protein, 6 aa, Entamoeba invadens
QKSPLT

SEQ ID NO: 2896961 - protein, 6 aa, Entamoeba invadens
QKSPMK

SEQ ID NO: 2896962 - protein, 7 aa, Entamoeba invadens
QKSPYDQ

SEQ ID NO: 2896963 - protein, 4 aa, Entamoeba invadens
QKSQ

SEQ ID NO: 2896964 - protein, 10 aa, Entamoeba invadens
QKSQENEFEK

SEQ ID NO: 2896965 - protein, 5 aa, Entamoeba invadens
QKSQF

SEQ ID NO: 2896966 - protein, 6 aa, Entamoeba invadens
QKSQTT

SEQ ID NO: 2896967 - protein, 15 aa, Entamoeba invadens
QKSRATTRTSPAEKR

SEQ ID NO: 2896968 - protein, 7 aa, Entamoeba invadens
QKSRLNS

SEQ ID NO: 2896969 - protein, 5 aa, Entamoeba invadens
QKSSD

SEQ ID NO: 2896970 - protein, 8 aa, Entamoeba invadens
QKSSDKYG

SEQ ID NO: 2896971 - protein, 22 aa, Entamoeba invadens
QKSSEKDKSQKRIQRSKEAEVN

SEQ ID NO: 2896972 - protein, 7 aa, Entamoeba invadens
QKSSGSI

SEQ ID NO: 2896973 - protein, 12 aa, Entamoeba invadens
QKSSKNKDPAQY

SEQ ID NO: 2896974 - protein, 20 aa, Entamoeba invadens
QKSSKSQEDDSRQSAVKQQN

SEQ ID NO: 2896975 - protein, 5 aa, Entamoeba invadens
QKSTI

SEQ ID NO: 2896976 - protein, 7 aa, Entamoeba invadens
QKSVKEI

SEQ ID NO: 2896977 - protein, 12 aa, Entamoeba invadens
QKSVPKSVPQQQ

SEQ ID NO: 2896978 - protein, 12 aa, Entamoeba invadens
QKSVYEKANEFA

SEQ ID NO: 2896979 - protein, 5 aa, Entamoeba invadens
QKSYD

SEQ ID NO: 2896980 - protein, 10 aa, Entamoeba invadens
QKTAKVTSQN

SEQ ID NO: 2896981 - protein, 4 aa, Entamoeba invadens
QKTD

SEQ ID NO: 2896982 - protein, 7 aa, Entamoeba invadens
QKTDMSE

SEQ ID NO: 2896983 - protein, 6 aa, Entamoeba invadens
QKTDQY

SEQ ID NO: 2896984 - protein, 22 aa, Entamoeba invadens
QKTEDETNVGHAETKNEHDEKT

SEQ ID NO: 2896985 - protein, 15 aa, Entamoeba invadens
QKTEIKNKTKSQNDI

SEQ ID NO: 2896986 - protein, 9 aa, Entamoeba invadens
QKTENGQLK

SEQ ID NO: 2896987 - protein, 20 aa, Entamoeba invadens
QKTERKDGEIERLEKEARRD

SEQ ID NO: 2896988 - protein, 44 aa, Entamoeba invadens
QKTESAERLENTQKPEKGEKEGRKSEGSCVGQEGKQQSPQHTNV

SEQ ID NO: 2896989 - protein, 8 aa, Entamoeba invadens
QKTGLESS

SEQ ID NO: 2896990 - protein, 6 aa, Entamoeba invadens
QKTGNV

SEQ ID NO: 2896991 - protein, 9 aa, Entamoeba invadens
QKTGYNKDY

SEQ ID NO: 2896992 - protein, 8 aa, Entamoeba invadens
QKTHKERT

SEQ ID NO: 2896993 - protein, 6 aa, Entamoeba invadens
QKTIAS

SEQ ID NO: 2896994 - protein, 8 aa, Entamoeba invadens
QKTIASTS

SEQ ID NO: 2896995 - protein, 8 aa, Entamoeba invadens
QKTISQTL

SEQ ID NO: 2896996 - protein, 13 aa, Entamoeba invadens
QKTKAENDKMTAQ

SEQ ID NO: 2896997 - protein, 10 aa, Entamoeba invadens
QKTKEAGIPQ

SEQ ID NO: 2896998 - protein, 13 aa, Entamoeba invadens
QKTKEEKKMSEEK

SEQ ID NO: 2896999 - protein, 7 aa, Entamoeba invadens
QKTKEYS

SEQ ID NO: 2897000 - protein, 17 aa, Entamoeba invadens
QKTKPVKNENLNETESV

SEQ ID NO: 2897001 - protein, 14 aa, Entamoeba invadens
QKTKRRSKGQSPVS

SEQ ID NO: 2897002 - protein, 6 aa, Entamoeba invadens
QKTLEK

SEQ ID NO: 2897003 - protein, 15 aa, Entamoeba invadens
QKTLKEDKIEEKNIS

SEQ ID NO: 2897004 - protein, 8 aa, Entamoeba invadens
QKTLSSGF

SEQ ID NO: 2897005 - protein, 4 aa, Entamoeba invadens
QKTM

SEQ ID NO: 2897006 - protein, 7 aa, Entamoeba invadens
QKTNAQA

SEQ ID NO: 2897007 - protein, 5 aa, Entamoeba invadens
QKTNG

SEQ ID NO: 2897008 - protein, 14 aa, Entamoeba invadens
QKTPLTSKQEEEYD

SEQ ID NO: 2897009 - protein, 9 aa, Entamoeba invadens
QKTPSMPKS

SEQ ID NO: 2897010 - protein, 7 aa, Entamoeba invadens
QKTPVKG

SEQ ID NO: 2897011 - protein, 13 aa, Entamoeba invadens
QKTQQYKTSTTQV

SEQ ID NO: 2897012 - protein, 10 aa, Entamoeba invadens
QKTQSVPNSL

SEQ ID NO: 2897013 - protein, 46 aa, Entamoeba invadens
QKTRDEENSSIKGMSSDNESIKVETKDANFTSRQHHTQVNGANKKD

SEQ ID NO: 2897014 - protein, 7 aa, Entamoeba invadens
QKTRGSI

SEQ ID NO: 2897015 - protein, 8 aa, Entamoeba invadens
QKTRRGDR

SEQ ID NO: 2897016 - protein, 6 aa, Entamoeba invadens
QKTSFS

SEQ ID NO: 2897017 - protein, 20 aa, Entamoeba invadens
QKTSGRPLSSSPLNKQSREL

SEQ ID NO: 2897018 - protein, 10 aa, Entamoeba invadens
QKTSSVLGTS

SEQ ID NO: 2897019 - protein, 13 aa, Entamoeba invadens
QKTTDNENEGVPH

SEQ ID NO: 2897020 - protein, 12 aa, Entamoeba invadens
QKTTPRGQQPSL

SEQ ID NO: 2897021 - protein, 11 aa, Entamoeba invadens
QKTTSPSLASS

SEQ ID NO: 2897022 - protein, 16 aa, Entamoeba invadens
QKTVSTEDGADFAKSQ

SEQ ID NO: 2897023 - protein, 4 aa, Entamoeba invadens
QKTY

SEQ ID NO: 2897024 - protein, 6 aa, Entamoeba invadens
QKVAER

SEQ ID NO: 2897025 - protein, 11 aa, Entamoeba invadens
QKVDEKTGLEN

SEQ ID NO: 2897026 - protein, 6 aa, Entamoeba invadens
QKVDKE

SEQ ID NO: 2897027 - protein, 11 aa, Entamoeba invadens
QKVDKKKDATG

SEQ ID NO: 2897028 - protein, 12 aa, Entamoeba invadens
QKVEEPSTVGDS

SEQ ID NO: 2897029 - protein, 10 aa, Entamoeba invadens
QKVEERSAHD

SEQ ID NO: 2897030 - protein, 10 aa, Entamoeba invadens
QKVEGTEKRG

SEQ ID NO: 2897031 - protein, 13 aa, Entamoeba invadens
QKVEKVEKSKDEN

SEQ ID NO: 2897032 - protein, 10 aa, Entamoeba invadens
QKVERKTPRI

SEQ ID NO: 2897033 - protein, 14 aa, Entamoeba invadens
QKVESLKQKQVEPV

SEQ ID NO: 2897034 - protein, 5 aa, Entamoeba invadens
QKVET

SEQ ID NO: 2897035 - protein, 5 aa, Entamoeba invadens
QKVFA

SEQ ID NO: 2897036 - protein, 7 aa, Entamoeba invadens
QKVKERK

SEQ ID NO: 2897037 - protein, 7 aa, Entamoeba invadens
QKVKKNI

SEQ ID NO: 2897038 - protein, 11 aa, Entamoeba invadens
QKVNDKETIEK

SEQ ID NO: 2897039 - protein, 8 aa, Entamoeba invadens
QKVNSVND

SEQ ID NO: 2897040 - protein, 5 aa, Entamoeba invadens
QKVPD

SEQ ID NO: 2897041 - protein, 7 aa, Entamoeba invadens
QKVPHEK

SEQ ID NO: 2897042 - protein, 9 aa, Entamoeba invadens
QKVSEESFD

SEQ ID NO: 2897043 - protein, 6 aa, Entamoeba invadens
QKVSEL

SEQ ID NO: 2897044 - protein, 208 aa, Entamoeba invadens
QKVSKHTKLNKKSDLKDEESDDAPLEISSKKDTQKMEEENPFAKSNKRKTKFEESDELSEDEEDQKPIQKEKEMKKEKPIAMKKEKGSAQAASSKSESKTKKITKPLKETEKHNQKKLNSQEVHERPKKTTKPQKMEEETPPPKFTQEKKKDEKNQKEIQVDKTQEKTGLKQHKKDEKNPSHQFQKKKEKIEKTKESDSESDSESDDI

SEQ ID NO: 2897045 - protein, 10 aa, Entamoeba invadens
QKVSTRENSI

SEQ ID NO: 2897046 - protein, 4 aa, Entamoeba invadens
QKVT

SEQ ID NO: 2897047 - protein, 5 aa, Entamoeba invadens
QKVTP

SEQ ID NO: 2897048 - protein, 17 aa, Entamoeba invadens
QKVTREDVCTESKETGK

SEQ ID NO: 2897049 - protein, 15 aa, Entamoeba invadens
QKVVERTQSPPLTGE

SEQ ID NO: 2897050 - protein, 6 aa, Entamoeba invadens
QKWSIT

SEQ ID NO: 2897051 - protein, 4 aa, Entamoeba invadens
QKYD

SEQ ID NO: 2897052 - protein, 9 aa, Entamoeba invadens
QKYDNDNEY

SEQ ID NO: 2897053 - protein, 8 aa, Entamoeba invadens
QKYETPKY

SEQ ID NO: 2897054 - protein, 20 aa, Entamoeba invadens
QKYGNPDTFAEEVREKKQKE

SEQ ID NO: 2897055 - protein, 19 aa, Entamoeba invadens
QKYGQPKDGVEQGPTSLES

SEQ ID NO: 2897056 - protein, 4 aa, Entamoeba invadens
QKYK

SEQ ID NO: 2897057 - protein, 6 aa, Entamoeba invadens
QKYPRQ

SEQ ID NO: 2897058 - protein, 4 aa, Entamoeba invadens
QKYR

SEQ ID NO: 2897059 - protein, 6 aa, Entamoeba invadens
QKYRDT

SEQ ID NO: 2897060 - protein, 7 aa, Entamoeba invadens
QKYSEAI

SEQ ID NO: 2897061 - protein, 4 aa, Entamoeba invadens
QKYT

SEQ ID NO: 2897062 - protein, 6 aa, Entamoeba invadens
QKYTVD

SEQ ID NO: 2897063 - protein, 54 aa, Entamoeba invadens
QLAEEQKEKEELEAKKKKAENDLADLEDAQSNLQSEKDKTEKDRKKLDNDLKEA

SEQ ID NO: 2897064 - protein, 37 aa, Entamoeba invadens
QLAEEQKEKEELEAKKKKAENDLTDLEDAQSNLQSDK

SEQ ID NO: 2897065 - protein, 15 aa, Entamoeba invadens
QLAEGQDTSTFCGTP

SEQ ID NO: 2897066 - protein, 8 aa, Entamoeba invadens
QLAPQDEL

SEQ ID NO: 2897067 - protein, 6 aa, Entamoeba invadens
QLASAE

SEQ ID NO: 2897068 - protein, 5 aa, Entamoeba invadens
QLATT

SEQ ID NO: 2897069 - protein, 29 aa, Entamoeba invadens
QLDEERQKADSADAARKAAESKLQEANDL

SEQ ID NO: 2897070 - protein, 24 aa, Entamoeba invadens
QLDEERQKSDRADAARKDAESKLQ

SEQ ID NO: 2897071 - protein, 28 aa, Entamoeba invadens
QLDEKSRDDSSCDDASAYIQANNSHLST

SEQ ID NO: 2897072 - protein, 5 aa, Entamoeba invadens
QLDEQ

SEQ ID NO: 2897073 - protein, 21 aa, Entamoeba invadens
QLDEQRKKTVEAEGNFKRSEA

SEQ ID NO: 2897074 - protein, 13 aa, Entamoeba invadens
QLDISQKKIEQSE

SEQ ID NO: 2897075 - protein, 7 aa, Entamoeba invadens
QLDKPEK

SEQ ID NO: 2897076 - protein, 9 aa, Entamoeba invadens
QLDKPKQYK

SEQ ID NO: 2897077 - protein, 12 aa, Entamoeba invadens
QLDKQEQKERKL

SEQ ID NO: 2897078 - protein, 12 aa, Entamoeba invadens
QLDNYESGLEEF

SEQ ID NO: 2897079 - protein, 4 aa, Entamoeba invadens
QLDP

SEQ ID NO: 2897080 - protein, 5 aa, Entamoeba invadens
QLDRT

SEQ ID NO: 2897081 - protein, 7 aa, Entamoeba invadens
QLDSGDN

SEQ ID NO: 2897082 - protein, 9 aa, Entamoeba invadens
QLDSSLSNT

SEQ ID NO: 2897083 - protein, 14 aa, Entamoeba invadens
QLDTANDDRDYEKD

SEQ ID NO: 2897084 - protein, 22 aa, Entamoeba invadens
QLEAEKDKVTTELQTTTNEKIE

SEQ ID NO: 2897085 - protein, 14 aa, Entamoeba invadens
QLEDEEQASKQRQL

SEQ ID NO: 2897086 - protein, 29 aa, Entamoeba invadens
QLEDSRNKEETIASLENDNNELEKKHEGV

SEQ ID NO: 2897087 - protein, 29 aa, Entamoeba invadens
QLEDSRNKEKRITSLENDNNELEKKHEGV

SEQ ID NO: 2897088 - protein, 37 aa, Entamoeba invadens
QLEECQKKAEAAKKSAEEADKRQKEAQKAEDEVTKAL

SEQ ID NO: 2897089 - protein, 16 aa, Entamoeba invadens
QLEEIDEKKRAAVLNN

SEQ ID NO: 2897090 - protein, 5 aa, Entamoeba invadens
QLEGK

SEQ ID NO: 2897091 - protein, 5 aa, Entamoeba invadens
QLEKE

SEQ ID NO: 2897092 - protein, 9 aa, Entamoeba invadens
QLEKEGQEW

SEQ ID NO: 2897093 - protein, 12 aa, Entamoeba invadens
QLEKEKDALDEN

SEQ ID NO: 2897094 - protein, 22 aa, Entamoeba invadens
QLEKERNEAKKEPQVSEQGTPF

SEQ ID NO: 2897095 - protein, 13 aa, Entamoeba invadens
QLEKTDEIQPDKI

SEQ ID NO: 2897096 - protein, 16 aa, Entamoeba invadens
QLENGEGTFTKPAEAD

SEQ ID NO: 2897097 - protein, 37 aa, Entamoeba invadens
QLENGSYRLTKSSNAKKRASQTPRDLTKSSAITSDDE

SEQ ID NO: 2897098 - protein, 6 aa, Entamoeba invadens
QLENKE

SEQ ID NO: 2897099 - protein, 7 aa, Entamoeba invadens
QLENSDL

SEQ ID NO: 2897100 - protein, 13 aa, Entamoeba invadens
QLENSGNKESLNE

SEQ ID NO: 2897101 - protein, 9 aa, Entamoeba invadens
QLENTSHVG

SEQ ID NO: 2897102 - protein, 18 aa, Entamoeba invadens
QLEPENTDKDKSVEKNKI

SEQ ID NO: 2897103 - protein, 9 aa, Entamoeba invadens
QLEPQPETR

SEQ ID NO: 2897104 - protein, 19 aa, Entamoeba invadens
QLEQRQKEKEMRKNKKKEM

SEQ ID NO: 2897105 - protein, 11 aa, Entamoeba invadens
QLEQRSSMQRQ

SEQ ID NO: 2897106 - protein, 12 aa, Entamoeba invadens
QLERNNKQLEEK

SEQ ID NO: 2897107 - protein, 6 aa, Entamoeba invadens
QLETKL

SEQ ID NO: 2897108 - protein, 5 aa, Entamoeba invadens
QLETL

SEQ ID NO: 2897109 - protein, 14 aa, Entamoeba invadens
QLETQKKQEEVDTV

SEQ ID NO: 2897110 - protein, 21 aa, Entamoeba invadens
QLETSNSSEEEEEDNLGQFEP

SEQ ID NO: 2897111 - protein, 10 aa, Entamoeba invadens
QLGARAGSIT

SEQ ID NO: 2897112 - protein, 8 aa, Entamoeba invadens
QLGDINGK

SEQ ID NO: 2897113 - protein, 13 aa, Entamoeba invadens
QLGNQTFAQQTNL

SEQ ID NO: 2897114 - protein, 5 aa, Entamoeba invadens
QLGQS

SEQ ID NO: 2897115 - protein, 9 aa, Entamoeba invadens
QLGQSAGSF

SEQ ID NO: 2897116 - protein, 15 aa, Entamoeba invadens
QLGSDKSSAIQLDDA

SEQ ID NO: 2897117 - protein, 5 aa, Entamoeba invadens
QLGSV

SEQ ID NO: 2897118 - protein, 5 aa, Entamoeba invadens
QLHDD

SEQ ID NO: 2897119 - protein, 16 aa, Entamoeba invadens
QLKADNDNISKAKSIV

SEQ ID NO: 2897120 - protein, 15 aa, Entamoeba invadens
QLKADNDNLTKAKSI

SEQ ID NO: 2897121 - protein, 17 aa, Entamoeba invadens
QLKADNDNLTKTKSVVD

SEQ ID NO: 2897122 - protein, 5 aa, Entamoeba invadens
QLKDL

SEQ ID NO: 2897123 - protein, 7 aa, Entamoeba invadens
QLKDQED

SEQ ID NO: 2897124 - protein, 5 aa, Entamoeba invadens
QLKDT

SEQ ID NO: 2897125 - protein, 26 aa, Entamoeba invadens
QLKEDKKESYFAGKQEKKVGIEDLET

SEQ ID NO: 2897126 - protein, 12 aa, Entamoeba invadens
QLKEEKENDMKR

SEQ ID NO: 2897127 - protein, 13 aa, Entamoeba invadens
QLKEKTSAEHTIV

SEQ ID NO: 2897128 - protein, 8 aa, Entamoeba invadens
QLKESVER

SEQ ID NO: 2897129 - protein, 7 aa, Entamoeba invadens
QLKGDVE

SEQ ID NO: 2897130 - protein, 7 aa, Entamoeba invadens
QLKKSVR

SEQ ID NO: 2897131 - protein, 25 aa, Entamoeba invadens
QLKKTNDKNQKCKTTKKSVSSVSRE

SEQ ID NO: 2897132 - protein, 12 aa, Entamoeba invadens
QLKNEKKELKFS

SEQ ID NO: 2897133 - protein, 7 aa, Entamoeba invadens
QLKNQDT

SEQ ID NO: 2897134 - protein, 13 aa, Entamoeba invadens
QLKQSKKTLSTNY

SEQ ID NO: 2897135 - protein, 7 aa, Entamoeba invadens
QLKQSPC

SEQ ID NO: 2897136 - protein, 17 aa, Entamoeba invadens
QLKQTSKPANARLNTHE

SEQ ID NO: 2897137 - protein, 13 aa, Entamoeba invadens
QLKRSMNSKQEMA

SEQ ID NO: 2897138 - protein, 6 aa, Entamoeba invadens
QLKSND

SEQ ID NO: 2897139 - protein, 10 aa, Entamoeba invadens
QLKTDKEEME

SEQ ID NO: 2897140 - protein, 5 aa, Entamoeba invadens
QLKTN

SEQ ID NO: 2897141 - protein, 4 aa, Entamoeba invadens
QLLT

SEQ ID NO: 2897142 - protein, 63 aa, Entamoeba invadens
QLNGTQQKAVDSKQADEKGKQERYDEQQREIARKREAEELKQAETRRQEEDHKKSFEEKVEKE

SEQ ID NO: 2897143 - protein, 5 aa, Entamoeba invadens
QLNKN

SEQ ID NO: 2897144 - protein, 4 aa, Entamoeba invadens
QLNP

SEQ ID NO: 2897145 - protein, 6 aa, Entamoeba invadens
QLNPDQ

SEQ ID NO: 2897146 - protein, 5 aa, Entamoeba invadens
QLNQQ

SEQ ID NO: 2897147 - protein, 5 aa, Entamoeba invadens
QLNQR

SEQ ID NO: 2897148 - protein, 6 aa, Entamoeba invadens
QLNQSS

SEQ ID NO: 2897149 - protein, 10 aa, Entamoeba invadens
QLNQSSCQAA

SEQ ID NO: 2897150 - protein, 9 aa, Entamoeba invadens
QLNSETSRL

SEQ ID NO: 2897151 - protein, 9 aa, Entamoeba invadens
QLNTQKQKK

SEQ ID NO: 2897152 - protein, 18 aa, Entamoeba invadens
QLNTTAVPQTPLPPSSRV

SEQ ID NO: 2897153 - protein, 13 aa, Entamoeba invadens
QLPANLKGANGKV

SEQ ID NO: 2897154 - protein, 8 aa, Entamoeba invadens
QLPDEEPI

SEQ ID NO: 2897155 - protein, 9 aa, Entamoeba invadens
QLPDGQKIK

SEQ ID NO: 2897156 - protein, 7 aa, Entamoeba invadens
QLPDNSP

SEQ ID NO: 2897157 - protein, 6 aa, Entamoeba invadens
QLPEKR

SEQ ID NO: 2897158 - protein, 5 aa, Entamoeba invadens
QLPKD

SEQ ID NO: 2897159 - protein, 13 aa, Entamoeba invadens
QLPKEEKERTNAK

SEQ ID NO: 2897160 - protein, 8 aa, Entamoeba invadens
QLPKEIDS

SEQ ID NO: 2897161 - protein, 10 aa, Entamoeba invadens
QLPKTQHSPR

SEQ ID NO: 2897162 - protein, 5 aa, Entamoeba invadens
QLPNG

SEQ ID NO: 2897163 - protein, 6 aa, Entamoeba invadens
QLPNGD

SEQ ID NO: 2897164 - protein, 9 aa, Entamoeba invadens
QLPNNIGKY

SEQ ID NO: 2897165 - protein, 8 aa, Entamoeba invadens
QLPPGKQL

SEQ ID NO: 2897166 - protein, 5 aa, Entamoeba invadens
QLPPN

SEQ ID NO: 2897167 - protein, 9 aa, Entamoeba invadens
QLPPNVAPE

SEQ ID NO: 2897168 - protein, 20 aa, Entamoeba invadens
QLPPPWKPQIQSADDTSHFD

SEQ ID NO: 2897169 - protein, 18 aa, Entamoeba invadens
QLPPTVLSTEGKKGGLEK

SEQ ID NO: 2897170 - protein, 7 aa, Entamoeba invadens
QLPQNQR

SEQ ID NO: 2897171 - protein, 12 aa, Entamoeba invadens
QLPRRAKMSSST

SEQ ID NO: 2897172 - protein, 20 aa, Entamoeba invadens
QLPRTKNPQTPRPKETPHVT

SEQ ID NO: 2897173 - protein, 7 aa, Entamoeba invadens
QLPSIPQ

SEQ ID NO: 2897174 - protein, 6 aa, Entamoeba invadens
QLPSPE

SEQ ID NO: 2897175 - protein, 12 aa, Entamoeba invadens
QLPSPRAEITQY

SEQ ID NO: 2897176 - protein, 4 aa, Entamoeba invadens
QLPT

SEQ ID NO: 2897177 - protein, 5 aa, Entamoeba invadens
QLPTD

SEQ ID NO: 2897178 - protein, 16 aa, Entamoeba invadens
QLPTDSSSTQKKTTQN

SEQ ID NO: 2897179 - protein, 6 aa, Entamoeba invadens
QLPTEI

SEQ ID NO: 2897180 - protein, 7 aa, Entamoeba invadens
QLPTNKE

SEQ ID NO: 2897181 - protein, 7 aa, Entamoeba invadens
QLPTPQK

SEQ ID NO: 2897182 - protein, 7 aa, Entamoeba invadens
QLPYPPQ

SEQ ID NO: 2897183 - protein, 37 aa, Entamoeba invadens
QLQNTQKAEKTDKEEVAKPQHVENGQVNFSGSQEIEQ

SEQ ID NO: 2897184 - protein, 9 aa, Entamoeba invadens
QLQRKDAAS

SEQ ID NO: 2897185 - protein, 16 aa, Entamoeba invadens
QLQTEGKIYGEGIGKS

SEQ ID NO: 2897186 - protein, 7 aa, Entamoeba invadens
QLQTHPS

SEQ ID NO: 2897187 - protein, 32 aa, Entamoeba invadens
QLQTIPNNKTTIQSTIPTPVTEKKEPTSNQEL

SEQ ID NO: 2897188 - protein, 9 aa, Entamoeba invadens
QLRDEDSKL

SEQ ID NO: 2897189 - protein, 7 aa, Entamoeba invadens
QLRDEND

SEQ ID NO: 2897190 - protein, 8 aa, Entamoeba invadens
QLRDQERE

SEQ ID NO: 2897191 - protein, 7 aa, Entamoeba invadens
QLREESD

SEQ ID NO: 2897192 - protein, 13 aa, Entamoeba invadens
QLREQKEKSEEEI

SEQ ID NO: 2897193 - protein, 9 aa, Entamoeba invadens
QLRGKNGKL

SEQ ID NO: 2897194 - protein, 6 aa, Entamoeba invadens
QLRNYD

SEQ ID NO: 2897195 - protein, 8 aa, Entamoeba invadens
QLRPRGYT

SEQ ID NO: 2897196 - protein, 8 aa, Entamoeba invadens
QLSAASDS

SEQ ID NO: 2897197 - protein, 4 aa, Entamoeba invadens
QLSD

SEQ ID NO: 2897198 - protein, 5 aa, Entamoeba invadens
QLSDF

SEQ ID NO: 2897199 - protein, 6 aa, Entamoeba invadens
QLSDTP

SEQ ID NO: 2897200 - protein, 6 aa, Entamoeba invadens
QLSDVD

SEQ ID NO: 2897201 - protein, 9 aa, Entamoeba invadens
QLSGGEKTI

SEQ ID NO: 2897202 - protein, 13 aa, Entamoeba invadens
QLSGKKGKPQITK

SEQ ID NO: 2897203 - protein, 20 aa, Entamoeba invadens
QLSGRKKYTTKKQTKNEAYV

SEQ ID NO: 2897204 - protein, 10 aa, Entamoeba invadens
QLSKENEAKI

SEQ ID NO: 2897205 - protein, 27 aa, Entamoeba invadens
QLSKKIDKKSFAVPSLKSSEDSTCEDK

SEQ ID NO: 2897206 - protein, 8 aa, Entamoeba invadens
QLSKQGIQ

SEQ ID NO: 2897207 - protein, 10 aa, Entamoeba invadens
QLSKTQEVHQ

SEQ ID NO: 2897208 - protein, 6 aa, Entamoeba invadens
QLSNEV

SEQ ID NO: 2897209 - protein, 9 aa, Entamoeba invadens
QLSPPRQDL

SEQ ID NO: 2897210 - protein, 26 aa, Entamoeba invadens
QLSPRGTIKSPRVSTSRHKSESLVSQ

SEQ ID NO: 2897211 - protein, 7 aa, Entamoeba invadens
QLSPSLE

SEQ ID NO: 2897212 - protein, 18 aa, Entamoeba invadens
QLSSSQILPTQSSQSGNF

SEQ ID NO: 2897213 - protein, 12 aa, Entamoeba invadens
QLSSVGPQAFPK

SEQ ID NO: 2897214 - protein, 10 aa, Entamoeba invadens
QLSVSERNTL

SEQ ID NO: 2897215 - protein, 7 aa, Entamoeba invadens
QLTAEKK

SEQ ID NO: 2897216 - protein, 5 aa, Entamoeba invadens
QLTDE

SEQ ID NO: 2897217 - protein, 15 aa, Entamoeba invadens
QLTDEKKKNEKDLEE

SEQ ID NO: 2897218 - protein, 14 aa, Entamoeba invadens
QLTDEKKKNEQDLE

SEQ ID NO: 2897219 - protein, 14 aa, Entamoeba invadens
QLTDEKKKNKDLEE

SEQ ID NO: 2897220 - protein, 6 aa, Entamoeba invadens
QLTDEQ

SEQ ID NO: 2897221 - protein, 16 aa, Entamoeba invadens
QLTEDKKKNDNDLEEM

SEQ ID NO: 2897222 - protein, 15 aa, Entamoeba invadens
QLTEEKKKNEKDLEE

SEQ ID NO: 2897223 - protein, 5 aa, Entamoeba invadens
QLTET

SEQ ID NO: 2897224 - protein, 4 aa, Entamoeba invadens
QLTF

SEQ ID NO: 2897225 - protein, 16 aa, Entamoeba invadens
QLTGSKDDDFDKTIRN

SEQ ID NO: 2897226 - protein, 4 aa, Entamoeba invadens
QLTK

SEQ ID NO: 2897227 - protein, 6 aa, Entamoeba invadens
QLTKAT

SEQ ID NO: 2897228 - protein, 8 aa, Entamoeba invadens
QLTKEEKE

SEQ ID NO: 2897229 - protein, 11 aa, Entamoeba invadens
QLTKSYSKRHS

SEQ ID NO: 2897230 - protein, 15 aa, Entamoeba invadens
QLTNEKKKNEKDLEE

SEQ ID NO: 2897231 - protein, 4 aa, Entamoeba invadens
QLTP

SEQ ID NO: 2897232 - protein, 8 aa, Entamoeba invadens
QLTPEEVS

SEQ ID NO: 2897233 - protein, 9 aa, Entamoeba invadens
QLTQEKENT

SEQ ID NO: 2897234 - protein, 16 aa, Entamoeba invadens
QLTQNTTTTTKTLEKY

SEQ ID NO: 2897235 - protein, 8 aa, Entamoeba invadens
QLTRPQPV

SEQ ID NO: 2897236 - protein, 7 aa, Entamoeba invadens
QLTTNNT

SEQ ID NO: 2897237 - protein, 7 aa, Entamoeba invadens
QLTTNSN

SEQ ID NO: 2897238 - protein, 6 aa, Entamoeba invadens
QLTTTD

SEQ ID NO: 2897239 - protein, 6 aa, Entamoeba invadens
QLVQET

SEQ ID NO: 2897240 - protein, 9 aa, Entamoeba invadens
QLVSSRPNA

SEQ ID NO: 2897241 - protein, 4 aa, Entamoeba invadens
QLYQ

SEQ ID NO: 2897242 - protein, 5 aa, Entamoeba invadens
QLYTK

SEQ ID NO: 2897243 - protein, 6 aa, Entamoeba invadens
QMAEEY

SEQ ID NO: 2897244 - protein, 6 aa, Entamoeba invadens
QMAEKE

SEQ ID NO: 2897245 - protein, 21 aa, Entamoeba invadens
QMAEQEKVKTLRDNKAASEEL

SEQ ID NO: 2897246 - protein, 5 aa, Entamoeba invadens
QMASQ

SEQ ID NO: 2897247 - protein, 12 aa, Entamoeba invadens
QMDEQKNVENMR

SEQ ID NO: 2897248 - protein, 20 aa, Entamoeba invadens
QMDGTKSNLPSKKCQGYTGN

SEQ ID NO: 2897249 - protein, 4 aa, Entamoeba invadens
QMDN

SEQ ID NO: 2897250 - protein, 5 aa, Entamoeba invadens
QMDPT

SEQ ID NO: 2897251 - protein, 12 aa, Entamoeba invadens
QMDSDLTKYMGS

SEQ ID NO: 2897252 - protein, 15 aa, Entamoeba invadens
QMEDPKTSEQEKEHL

SEQ ID NO: 2897253 - protein, 4 aa, Entamoeba invadens
QMEE

SEQ ID NO: 2897254 - protein, 11 aa, Entamoeba invadens
QMEEDNNVIND

SEQ ID NO: 2897255 - protein, 8 aa, Entamoeba invadens
QMEGGGVP

SEQ ID NO: 2897256 - protein, 12 aa, Entamoeba invadens
QMEPQKTAQRKV

SEQ ID NO: 2897257 - protein, 8 aa, Entamoeba invadens
QMKAEAAG

SEQ ID NO: 2897258 - protein, 5 aa, Entamoeba invadens
QMKDQ

SEQ ID NO: 2897259 - protein, 6 aa, Entamoeba invadens
QMKKEG

SEQ ID NO: 2897260 - protein, 23 aa, Entamoeba invadens
QMKKGMKDKLKDIKDKKQKKQQM

SEQ ID NO: 2897261 - protein, 12 aa, Entamoeba invadens
QMKSNQSSPNMK

SEQ ID NO: 2897262 - protein, 15 aa, Entamoeba invadens
QMNDGNNNKEAKGKR

SEQ ID NO: 2897263 - protein, 4 aa, Entamoeba invadens
QMNE

SEQ ID NO: 2897264 - protein, 9 aa, Entamoeba invadens
QMNKEDVDR

SEQ ID NO: 2897265 - protein, 4 aa, Entamoeba invadens
QMNP

SEQ ID NO: 2897266 - protein, 13 aa, Entamoeba invadens
QMNPTSRPSVQQV

SEQ ID NO: 2897267 - protein, 4 aa, Entamoeba invadens
QMNQ

SEQ ID NO: 2897268 - protein, 6 aa, Entamoeba invadens
QMNQIG

SEQ ID NO: 2897269 - protein, 6 aa, Entamoeba invadens
QMNSSC

SEQ ID NO: 2897270 - protein, 11 aa, Entamoeba invadens
QMPAQPGQNPP

SEQ ID NO: 2897271 - protein, 22 aa, Entamoeba invadens
QMPGQYQQGQMPGQMPNQMPPQ

SEQ ID NO: 2897272 - protein, 7 aa, Entamoeba invadens
QMPMGQP

SEQ ID NO: 2897273 - protein, 7 aa, Entamoeba invadens
QMPPDQL

SEQ ID NO: 2897274 - protein, 9 aa, Entamoeba invadens
QMPPPPPMP

SEQ ID NO: 2897275 - protein, 4 aa, Entamoeba invadens
QMPY

SEQ ID NO: 2897276 - protein, 5 aa, Entamoeba invadens
QMPYT

SEQ ID NO: 2897277 - protein, 9 aa, Entamoeba invadens
QMQKKDAEV

SEQ ID NO: 2897278 - protein, 10 aa, Entamoeba invadens
QMQQKSGMGL

SEQ ID NO: 2897279 - protein, 24 aa, Entamoeba invadens
QMQQPQQAQYNQYQTNQYNSYNPY

SEQ ID NO: 2897280 - protein, 27 aa, Entamoeba invadens
QMQSTQPTTKQQTQQQKSPSEDSSGVP

SEQ ID NO: 2897281 - protein, 5 aa, Entamoeba invadens
QMQTT

SEQ ID NO: 2897282 - protein, 10 aa, Entamoeba invadens
QMRNESEKKF

SEQ ID NO: 2897283 - protein, 11 aa, Entamoeba invadens
QMSSGEAAGGL

SEQ ID NO: 2897284 - protein, 4 aa, Entamoeba invadens
QMTE

SEQ ID NO: 2897285 - protein, 13 aa, Entamoeba invadens
QMTKKKGEMKSNN

SEQ ID NO: 2897286 - protein, 12 aa, Entamoeba invadens
QMTSDTRDECNN

SEQ ID NO: 2897287 - protein, 5 aa, Entamoeba invadens
QMTSP

SEQ ID NO: 2897288 - protein, 6 aa, Entamoeba invadens
QMTTPL

SEQ ID NO: 2897289 - protein, 38 aa, Entamoeba invadens
QNAAAGNMPGGMPQGGMPGAQQQGAKKSDTKGPKIEEV

SEQ ID NO: 2897290 - protein, 9 aa, Entamoeba invadens
QNAAKDATE

SEQ ID NO: 2897291 - protein, 8 aa, Entamoeba invadens
QNAAQKGN

SEQ ID NO: 2897292 - protein, 28 aa, Entamoeba invadens
QNAEETRKKGNASITTRAGSSTKKATVS

SEQ ID NO: 2897293 - protein, 11 aa, Entamoeba invadens
QNAGGNKEQNF

SEQ ID NO: 2897294 - protein, 7 aa, Entamoeba invadens
QNAPADY

SEQ ID NO: 2897295 - protein, 8 aa, Entamoeba invadens
QNAPEGPV

SEQ ID NO: 2897296 - protein, 8 aa, Entamoeba invadens
QNAPPQTT

SEQ ID NO: 2897297 - protein, 6 aa, Entamoeba invadens
QNAPQN

SEQ ID NO: 2897298 - protein, 14 aa, Entamoeba invadens
QNARRQNKIKSKKY

SEQ ID NO: 2897299 - protein, 10 aa, Entamoeba invadens
QNASGSERYT

SEQ ID NO: 2897300 - protein, 10 aa, Entamoeba invadens
QNASLENPPL

SEQ ID NO: 2897301 - protein, 7 aa, Entamoeba invadens
QNASSEI

SEQ ID NO: 2897302 - protein, 4 aa, Entamoeba invadens
QNAT

SEQ ID NO: 2897303 - protein, 8 aa, Entamoeba invadens
QNATNQRN

SEQ ID NO: 2897304 - protein, 8 aa, Entamoeba invadens
QNATSLTS

SEQ ID NO: 2897305 - protein, 9 aa, Entamoeba invadens
QNCDKRGVE

SEQ ID NO: 2897306 - protein, 10 aa, Entamoeba invadens
QNCENTVYSG

SEQ ID NO: 2897307 - protein, 10 aa, Entamoeba invadens
QNCKASGCGL

SEQ ID NO: 2897308 - protein, 11 aa, Entamoeba invadens
QNCKTCSSNYN

SEQ ID NO: 2897309 - protein, 5 aa, Entamoeba invadens
QNDAH

SEQ ID NO: 2897310 - protein, 15 aa, Entamoeba invadens
QNDDSPKTARVARHV

SEQ ID NO: 2897311 - protein, 7 aa, Entamoeba invadens
QNDEAEE

SEQ ID NO: 2897312 - protein, 7 aa, Entamoeba invadens
QNDEERE

SEQ ID NO: 2897313 - protein, 5 aa, Entamoeba invadens
QNDEI

SEQ ID NO: 2897314 - protein, 9 aa, Entamoeba invadens
QNDESSFKS

SEQ ID NO: 2897315 - protein, 8 aa, Entamoeba invadens
QNDESSVS

SEQ ID NO: 2897316 - protein, 5 aa, Entamoeba invadens
QNDFT

SEQ ID NO: 2897317 - protein, 42 aa, Entamoeba invadens
QNDGKSKAQIKRENEKHEKEYQERRKKEREEFNGKKSKKDKA

SEQ ID NO: 2897318 - protein, 29 aa, Entamoeba invadens
QNDGQKKKGRKKSKAEIEKPIPKKMKAGV

SEQ ID NO: 2897319 - protein, 5 aa, Entamoeba invadens
QNDIA

SEQ ID NO: 2897320 - protein, 8 aa, Entamoeba invadens
QNDKGKRT

SEQ ID NO: 2897321 - protein, 35 aa, Entamoeba invadens
QNDLKKNENDLKDLPDEQSNGTKETEKDTDTDEDD

SEQ ID NO: 2897322 - protein, 7 aa, Entamoeba invadens
QNDLKNK

SEQ ID NO: 2897323 - protein, 7 aa, Entamoeba invadens
QNDLSNL

SEQ ID NO: 2897324 - protein, 8 aa, Entamoeba invadens
QNDNGLKT

SEQ ID NO: 2897325 - protein, 8 aa, Entamoeba invadens
QNDNKEVR

SEQ ID NO: 2897326 - protein, 13 aa, Entamoeba invadens
QNDNNGSKVEQPN

SEQ ID NO: 2897327 - protein, 8 aa, Entamoeba invadens
QNDPITLS

SEQ ID NO: 2897328 - protein, 14 aa, Entamoeba invadens
QNDPMYGRRRNETT

SEQ ID NO: 2897329 - protein, 14 aa, Entamoeba invadens
QNDQKAQQPKSNAV

SEQ ID NO: 2897330 - protein, 28 aa, Entamoeba invadens
QNDSQTEEDRDTIQQVETNQRESEAQYA

SEQ ID NO: 2897331 - protein, 7 aa, Entamoeba invadens
QNDSTTS

SEQ ID NO: 2897332 - protein, 5 aa, Entamoeba invadens
QNDTA

SEQ ID NO: 2897333 - protein, 7 aa, Entamoeba invadens
QNEAEEV

SEQ ID NO: 2897334 - protein, 8 aa, Entamoeba invadens
QNEATGNI

SEQ ID NO: 2897335 - protein, 7 aa, Entamoeba invadens
QNEDFDR

SEQ ID NO: 2897336 - protein, 9 aa, Entamoeba invadens
QNEDHPDQV

SEQ ID NO: 2897337 - protein, 8 aa, Entamoeba invadens
QNEDTHEE

SEQ ID NO: 2897338 - protein, 20 aa, Entamoeba invadens
QNEEIERDQKTEEKALFGGK

SEQ ID NO: 2897339 - protein, 9 aa, Entamoeba invadens
QNEEKEIKE

SEQ ID NO: 2897340 - protein, 5 aa, Entamoeba invadens
QNEEL

SEQ ID NO: 2897341 - protein, 22 aa, Entamoeba invadens
QNEELKKNIESLEKEKGETRKQ

SEQ ID NO: 2897342 - protein, 9 aa, Entamoeba invadens
QNEENVSGQ

SEQ ID NO: 2897343 - protein, 5 aa, Entamoeba invadens
QNEEV

SEQ ID NO: 2897344 - protein, 5 aa, Entamoeba invadens
QNEEY

SEQ ID NO: 2897345 - protein, 7 aa, Entamoeba invadens
QNEFERR

SEQ ID NO: 2897346 - protein, 20 aa, Entamoeba invadens
QNEGIEKEKEDSVEKQKELE

SEQ ID NO: 2897347 - protein, 5 aa, Entamoeba invadens
QNEGV

SEQ ID NO: 2897348 - protein, 13 aa, Entamoeba invadens
QNEIASKEEDTEH

SEQ ID NO: 2897349 - protein, 7 aa, Entamoeba invadens
QNEIGKQ

SEQ ID NO: 2897350 - protein, 45 aa, Entamoeba invadens
QNEIIPTESGYDNKTSKDLVPQHKNTDELEKGLPKMDDKSSIDCP

SEQ ID NO: 2897351 - protein, 7 aa, Entamoeba invadens
QNEINNQ

SEQ ID NO: 2897352 - protein, 5 aa, Entamoeba invadens
QNEIT

SEQ ID NO: 2897353 - protein, 11 aa, Entamoeba invadens
QNEITKEEQIE

SEQ ID NO: 2897354 - protein, 7 aa, Entamoeba invadens
QNEKATN

SEQ ID NO: 2897355 - protein, 6 aa, Entamoeba invadens
QNEKCK

SEQ ID NO: 2897356 - protein, 23 aa, Entamoeba invadens
QNEKDENEKLEKQISDEKEEKTK

SEQ ID NO: 2897357 - protein, 17 aa, Entamoeba invadens
QNEKEKSNDKQIVTSKP

SEQ ID NO: 2897358 - protein, 7 aa, Entamoeba invadens
QNEKEYQ

SEQ ID NO: 2897359 - protein, 9 aa, Entamoeba invadens
QNEKIQTEH

SEQ ID NO: 2897360 - protein, 9 aa, Entamoeba invadens
QNEKLNSKI

SEQ ID NO: 2897361 - protein, 46 aa, Entamoeba invadens
QNEKNEEKGKEKSEHKMEISEEKSDQRDEKRLKVEEENKGKERKLQ

SEQ ID NO: 2897362 - protein, 14 aa, Entamoeba invadens
QNEKREAAEKALSE

SEQ ID NO: 2897363 - protein, 11 aa, Entamoeba invadens
QNEKREVAEKA

SEQ ID NO: 2897364 - protein, 14 aa, Entamoeba invadens
QNEKTQNKDLEQKL

SEQ ID NO: 2897365 - protein, 18 aa, Entamoeba invadens
QNELAKKAKVEVSGDDMR

SEQ ID NO: 2897366 - protein, 5 aa, Entamoeba invadens
QNELE

SEQ ID NO: 2897367 - protein, 15 aa, Entamoeba invadens
QNELEAAKEEQNTLK

SEQ ID NO: 2897368 - protein, 5 aa, Entamoeba invadens
QNELP

SEQ ID NO: 2897369 - protein, 6 aa, Entamoeba invadens
QNELTE

SEQ ID NO: 2897370 - protein, 6 aa, Entamoeba invadens
QNELTL

SEQ ID NO: 2897371 - protein, 10 aa, Entamoeba invadens
QNENAGVNPL

SEQ ID NO: 2897372 - protein, 14 aa, Entamoeba invadens
QNENDEKEEREDEK

SEQ ID NO: 2897373 - protein, 6 aa, Entamoeba invadens
QNENDV

SEQ ID NO: 2897374 - protein, 8 aa, Entamoeba invadens
QNENETLR

SEQ ID NO: 2897375 - protein, 6 aa, Entamoeba invadens
QNENKI

SEQ ID NO: 2897376 - protein, 7 aa, Entamoeba invadens
QNENTRL

SEQ ID NO: 2897377 - protein, 7 aa, Entamoeba invadens
QNEPGKQ

SEQ ID NO: 2897378 - protein, 10 aa, Entamoeba invadens
QNEPIGSNKY

SEQ ID NO: 2897379 - protein, 11 aa, Entamoeba invadens
QNEPKQNCERS

SEQ ID NO: 2897380 - protein, 11 aa, Entamoeba invadens
QNEQECEISTK

SEQ ID NO: 2897381 - protein, 57 aa, Entamoeba invadens
QNEQKAAEEPKKEEEKPIAKQEEKPVEKVEESNPAKETEAKEVKKVTKKKVSPAEMA

SEQ ID NO: 2897382 - protein, 12 aa, Entamoeba invadens
QNEQNETAENTN

SEQ ID NO: 2897383 - protein, 25 aa, Entamoeba invadens
QNEQQDPTQYQQQTQFQPQIPQQNI

SEQ ID NO: 2897384 - protein, 6 aa, Entamoeba invadens
QNEQTE

SEQ ID NO: 2897385 - protein, 25 aa, Entamoeba invadens
QNERLRTDNNTVTSTTTSFKNSTSS

SEQ ID NO: 2897386 - protein, 7 aa, Entamoeba invadens
QNERTLR

SEQ ID NO: 2897387 - protein, 4 aa, Entamoeba invadens
QNES

SEQ ID NO: 2897388 - protein, 6 aa, Entamoeba invadens
QNESDA

SEQ ID NO: 2897389 - protein, 17 aa, Entamoeba invadens
QNESEAVEKSRKKKVPL

SEQ ID NO: 2897390 - protein, 7 aa, Entamoeba invadens
QNESFDN

SEQ ID NO: 2897391 - protein, 6 aa, Entamoeba invadens
QNESHV

SEQ ID NO: 2897392 - protein, 12 aa, Entamoeba invadens
QNESRTNRQMPR

SEQ ID NO: 2897393 - protein, 4 aa, Entamoeba invadens
QNET

SEQ ID NO: 2897394 - protein, 6 aa, Entamoeba invadens
QNETAK

SEQ ID NO: 2897395 - protein, 11 aa, Entamoeba invadens
QNETEEENKKL

SEQ ID NO: 2897396 - protein, 8 aa, Entamoeba invadens
QNETKSEK

SEQ ID NO: 2897397 - protein, 7 aa, Entamoeba invadens
QNETLES

SEQ ID NO: 2897398 - protein, 5 aa, Entamoeba invadens
QNETN

SEQ ID NO: 2897399 - protein, 7 aa, Entamoeba invadens
QNETTDE

SEQ ID NO: 2897400 - protein, 10 aa, Entamoeba invadens
QNETTDHSQA

SEQ ID NO: 2897401 - protein, 17 aa, Entamoeba invadens
QNEVDFGNSNGSSIDGN

SEQ ID NO: 2897402 - protein, 10 aa, Entamoeba invadens
QNEVPDLPKS

SEQ ID NO: 2897403 - protein, 7 aa, Entamoeba invadens
QNEYKGN

SEQ ID NO: 2897404 - protein, 7 aa, Entamoeba invadens
QNEYSDV

SEQ ID NO: 2897405 - protein, 4 aa, Entamoeba invadens
QNFE

SEQ ID NO: 2897406 - protein, 8 aa, Entamoeba invadens
QNFPEKRS

SEQ ID NO: 2897407 - protein, 5 aa, Entamoeba invadens
QNFPK

SEQ ID NO: 2897408 - protein, 18 aa, Entamoeba invadens
QNFPKSPLTETTKVKSYT

SEQ ID NO: 2897409 - protein, 9 aa, Entamoeba invadens
QNFPNSTPE

SEQ ID NO: 2897410 - protein, 5 aa, Entamoeba invadens
QNFQQ

SEQ ID NO: 2897411 - protein, 13 aa, Entamoeba invadens
QNGAFQSEQDKHD

SEQ ID NO: 2897412 - protein, 5 aa, Entamoeba invadens
QNGDI

SEQ ID NO: 2897413 - protein, 7 aa, Entamoeba invadens
QNGDKET

SEQ ID NO: 2897414 - protein, 8 aa, Entamoeba invadens
QNGDNEDI

SEQ ID NO: 2897415 - protein, 7 aa, Entamoeba invadens
QNGDRTI

SEQ ID NO: 2897416 - protein, 10 aa, Entamoeba invadens
QNGDSTTIQK

SEQ ID NO: 2897417 - protein, 13 aa, Entamoeba invadens
QNGDSTTIQKKKV

SEQ ID NO: 2897418 - protein, 18 aa, Entamoeba invadens
QNGDSTTIQKKKVSRRQS

SEQ ID NO: 2897419 - protein, 6 aa, Entamoeba invadens
QNGEDF

SEQ ID NO: 2897420 - protein, 5 aa, Entamoeba invadens
QNGEI

SEQ ID NO: 2897421 - protein, 9 aa, Entamoeba invadens
QNGESKNAM

SEQ ID NO: 2897422 - protein, 10 aa, Entamoeba invadens
QNGGVPKFQR

SEQ ID NO: 2897423 - protein, 6 aa, Entamoeba invadens
QNGGVT

SEQ ID NO: 2897424 - protein, 12 aa, Entamoeba invadens
QNGIGGSGDFAR

SEQ ID NO: 2897425 - protein, 5 aa, Entamoeba invadens
QNGIP

SEQ ID NO: 2897426 - protein, 4 aa, Entamoeba invadens
QNGK

SEQ ID NO: 2897427 - protein, 9 aa, Entamoeba invadens
QNGKIDKTT

SEQ ID NO: 2897428 - protein, 13 aa, Entamoeba invadens
QNGKMAKKGLPGV

SEQ ID NO: 2897429 - protein, 10 aa, Entamoeba invadens
QNGKPNDITE

SEQ ID NO: 2897430 - protein, 11 aa, Entamoeba invadens
QNGLSAQDEIR

SEQ ID NO: 2897431 - protein, 37 aa, Entamoeba invadens
QNGMPPNTQTITQSVQGSVQNVPSVPSTPQPKQQSHG

SEQ ID NO: 2897432 - protein, 4 aa, Entamoeba invadens
QNGN

SEQ ID NO: 2897433 - protein, 5 aa, Entamoeba invadens
QNGNH

SEQ ID NO: 2897434 - protein, 8 aa, Entamoeba invadens
QNGPENWG

SEQ ID NO: 2897435 - protein, 7 aa, Entamoeba invadens
QNGPGVK

SEQ ID NO: 2897436 - protein, 9 aa, Entamoeba invadens
QNGQLYATN

SEQ ID NO: 2897437 - protein, 7 aa, Entamoeba invadens
QNGQRIR

SEQ ID NO: 2897438 - protein, 4 aa, Entamoeba invadens
QNGS

SEQ ID NO: 2897439 - protein, 10 aa, Entamoeba invadens
QNGSIPKKLK

SEQ ID NO: 2897440 - protein, 20 aa, Entamoeba invadens
QNGTEKHNENIEKKPIENHK

SEQ ID NO: 2897441 - protein, 6 aa, Entamoeba invadens
QNGTFG

SEQ ID NO: 2897442 - protein, 8 aa, Entamoeba invadens
QNGTGKTT

SEQ ID NO: 2897443 - protein, 18 aa, Entamoeba invadens
QNGTIESYSNDANDTKSA

SEQ ID NO: 2897444 - protein, 5 aa, Entamoeba invadens
QNGTL

SEQ ID NO: 2897445 - protein, 6 aa, Entamoeba invadens
QNGWGG

SEQ ID NO: 2897446 - protein, 12 aa, Entamoeba invadens
QNGYEPLQIIDL

SEQ ID NO: 2897447 - protein, 11 aa, Entamoeba invadens
QNGYSTGDVKE

SEQ ID NO: 2897448 - protein, 9 aa, Entamoeba invadens
QNHEELRKT

SEQ ID NO: 2897449 - protein, 4 aa, Entamoeba invadens
QNHG

SEQ ID NO: 2897450 - protein, 16 aa, Entamoeba invadens
QNHNDFGNDSFRPSQK

SEQ ID NO: 2897451 - protein, 8 aa, Entamoeba invadens
QNHPPTES

SEQ ID NO: 2897452 - protein, 6 aa, Entamoeba invadens
QNHRVS

SEQ ID NO: 2897453 - protein, 6 aa, Entamoeba invadens
QNIDAA

SEQ ID NO: 2897454 - protein, 5 aa, Entamoeba invadens
QNIDT

SEQ ID NO: 2897455 - protein, 4 aa, Entamoeba invadens
QNIE

SEQ ID NO: 2897456 - protein, 4 aa, Entamoeba invadens
QNIN

SEQ ID NO: 2897457 - protein, 6 aa, Entamoeba invadens
QNIPEK

SEQ ID NO: 2897458 - protein, 14 aa, Entamoeba invadens
QNIPKRKRGTPNNV

SEQ ID NO: 2897459 - protein, 8 aa, Entamoeba invadens
QNIPQLES

SEQ ID NO: 2897460 - protein, 5 aa, Entamoeba invadens
QNITD

SEQ ID NO: 2897461 - protein, 27 aa, Entamoeba invadens
QNITDEERKEKHKKMQRRKEQEGQESS

SEQ ID NO: 2897462 - protein, 7 aa, Entamoeba invadens
QNITNTV

SEQ ID NO: 2897463 - protein, 5 aa, Entamoeba invadens
QNITQ

SEQ ID NO: 2897464 - protein, 16 aa, Entamoeba invadens
QNKAKQDYLKGHEGAK

SEQ ID NO: 2897465 - protein, 4 aa, Entamoeba invadens
QNKD

SEQ ID NO: 2897466 - protein, 9 aa, Entamoeba invadens
QNKDPKKRL

SEQ ID NO: 2897467 - protein, 8 aa, Entamoeba invadens
QNKEGSQV

SEQ ID NO: 2897468 - protein, 17 aa, Entamoeba invadens
QNKEIPENKEVKETKKE

SEQ ID NO: 2897469 - protein, 4 aa, Entamoeba invadens
QNKG

SEQ ID NO: 2897470 - protein, 8 aa, Entamoeba invadens
QNKIGGND

SEQ ID NO: 2897471 - protein, 16 aa, Entamoeba invadens
QNKITRKQIEDTHPTN

SEQ ID NO: 2897472 - protein, 4 aa, Entamoeba invadens
QNKK

SEQ ID NO: 2897473 - protein, 21 aa, Entamoeba invadens
QNKKIGKKHKSKDEKDDKCCV

SEQ ID NO: 2897474 - protein, 11 aa, Entamoeba invadens
QNKKRYSPPIG

SEQ ID NO: 2897475 - protein, 9 aa, Entamoeba invadens
QNKKTDDVL

SEQ ID NO: 2897476 - protein, 7 aa, Entamoeba invadens
QNKKVRE

SEQ ID NO: 2897477 - protein, 16 aa, Entamoeba invadens
QNKMQEKLDELVKQTK

SEQ ID NO: 2897478 - protein, 18 aa, Entamoeba invadens
QNKNAELVRKSSDKDDKL

SEQ ID NO: 2897479 - protein, 15 aa, Entamoeba invadens
QNKNDEEKKDMSDGS

SEQ ID NO: 2897480 - protein, 7 aa, Entamoeba invadens
QNKNDGG

SEQ ID NO: 2897481 - protein, 9 aa, Entamoeba invadens
QNKNQSRAS

SEQ ID NO: 2897482 - protein, 14 aa, Entamoeba invadens
QNKNTIKLPKAPVT

SEQ ID NO: 2897483 - protein, 5 aa, Entamoeba invadens
QNKRI

SEQ ID NO: 2897484 - protein, 9 aa, Entamoeba invadens
QNKRVDGTK

SEQ ID NO: 2897485 - protein, 7 aa, Entamoeba invadens
QNKSGVN

SEQ ID NO: 2897486 - protein, 19 aa, Entamoeba invadens
QNKSKEYSSFERESPEYSE

SEQ ID NO: 2897487 - protein, 5 aa, Entamoeba invadens
QNKTE

SEQ ID NO: 2897488 - protein, 10 aa, Entamoeba invadens
QNKTETSPIE

SEQ ID NO: 2897489 - protein, 8 aa, Entamoeba invadens
QNKVVNEK

SEQ ID NO: 2897490 - protein, 28 aa, Entamoeba invadens
QNLENNNKQLEGDIKEQKRELEELNQTN

SEQ ID NO: 2897491 - protein, 14 aa, Entamoeba invadens
QNLENVDRSAQSMD

SEQ ID NO: 2897492 - protein, 14 aa, Entamoeba invadens
QNLNTQNNQNTNNT

SEQ ID NO: 2897493 - protein, 9 aa, Entamoeba invadens
QNLPDTKTV

SEQ ID NO: 2897494 - protein, 8 aa, Entamoeba invadens
QNLQNNQR

SEQ ID NO: 2897495 - protein, 6 aa, Entamoeba invadens
QNLRDE

SEQ ID NO: 2897496 - protein, 5 aa, Entamoeba invadens
QNLRP

SEQ ID NO: 2897497 - protein, 10 aa, Entamoeba invadens
QNLSGGNTSI

SEQ ID NO: 2897498 - protein, 6 aa, Entamoeba invadens
QNLSSE

SEQ ID NO: 2897499 - protein, 18 aa, Entamoeba invadens
QNLSSSINNTAKQNQTLT

SEQ ID NO: 2897500 - protein, 4 aa, Entamoeba invadens
QNLT

SEQ ID NO: 2897501 - protein, 18 aa, Entamoeba invadens
QNMGKTERKLPTDAKYDS

SEQ ID NO: 2897502 - protein, 7 aa, Entamoeba invadens
QNMTSSQ

SEQ ID NO: 2897503 - protein, 8 aa, Entamoeba invadens
QNNAAGNK

SEQ ID NO: 2897504 - protein, 12 aa, Entamoeba invadens
QNNCNSSESQMR

SEQ ID NO: 2897505 - protein, 7 aa, Entamoeba invadens
QNNDKIE

SEQ ID NO: 2897506 - protein, 21 aa, Entamoeba invadens
QNNDKRHYQKDLEKEKNTLKE

SEQ ID NO: 2897507 - protein, 6 aa, Entamoeba invadens
QNNDSS

SEQ ID NO: 2897508 - protein, 16 aa, Entamoeba invadens
QNNEEKIKEEVELTPP

SEQ ID NO: 2897509 - protein, 9 aa, Entamoeba invadens
QNNEENKSD

SEQ ID NO: 2897510 - protein, 11 aa, Entamoeba invadens
QNNEHKNETHT

SEQ ID NO: 2897511 - protein, 8 aa, Entamoeba invadens
QNNENAVT

SEQ ID NO: 2897512 - protein, 5 aa, Entamoeba invadens
QNNEP

SEQ ID NO: 2897513 - protein, 9 aa, Entamoeba invadens
QNNGAFKEL

SEQ ID NO: 2897514 - protein, 5 aa, Entamoeba invadens
QNNGI

SEQ ID NO: 2897515 - protein, 4 aa, Entamoeba invadens
QNNK

SEQ ID NO: 2897516 - protein, 80 aa, Entamoeba invadens
QNNKNEQLEATKKLAEEKTRANEVKEQKTEQKTEKKTENKTEKNVPKTTEKKEEPAKKVSAEKRKTEIAKPPKEVPKKVE

SEQ ID NO: 2897517 - protein, 7 aa, Entamoeba invadens
QNNLTSK

SEQ ID NO: 2897518 - protein, 11 aa, Entamoeba invadens
QNNPDKSGASE

SEQ ID NO: 2897519 - protein, 7 aa, Entamoeba invadens
QNNPEAE

SEQ ID NO: 2897520 - protein, 5 aa, Entamoeba invadens
QNNPG

SEQ ID NO: 2897521 - protein, 8 aa, Entamoeba invadens
QNNPGMKR

SEQ ID NO: 2897522 - protein, 8 aa, Entamoeba invadens
QNNRTYET

SEQ ID NO: 2897523 - protein, 7 aa, Entamoeba invadens
QNNSKPV

SEQ ID NO: 2897524 - protein, 11 aa, Entamoeba invadens
QNNSMKKESAN

SEQ ID NO: 2897525 - protein, 15 aa, Entamoeba invadens
QNNSQNSQSSTTTSK

SEQ ID NO: 2897526 - protein, 14 aa, Entamoeba invadens
QNNSTIEDYSSTGY

SEQ ID NO: 2897527 - protein, 9 aa, Entamoeba invadens
QNNSTKKNM

SEQ ID NO: 2897528 - protein, 7 aa, Entamoeba invadens
QNNSTKY

SEQ ID NO: 2897529 - protein, 8 aa, Entamoeba invadens
QNNTDHPK

SEQ ID NO: 2897530 - protein, 5 aa, Entamoeba invadens
QNNTE

SEQ ID NO: 2897531 - protein, 8 aa, Entamoeba invadens
QNNTMEKK

SEQ ID NO: 2897532 - protein, 16 aa, Entamoeba invadens
QNNTNKINTQKLTDER

SEQ ID NO: 2897533 - protein, 15 aa, Entamoeba invadens
QNNYTKDTFAGLKVK

SEQ ID NO: 2897534 - protein, 5 aa, Entamoeba invadens
QNPDE

SEQ ID NO: 2897535 - protein, 6 aa, Entamoeba invadens
QNPDFR

SEQ ID NO: 2897536 - protein, 7 aa, Entamoeba invadens
QNPENIG

SEQ ID NO: 2897537 - protein, 7 aa, Entamoeba invadens
QNPEQTE

SEQ ID NO: 2897538 - protein, 6 aa, Entamoeba invadens
QNPESD

SEQ ID NO: 2897539 - protein, 4 aa, Entamoeba invadens
QNPI

SEQ ID NO: 2897540 - protein, 8 aa, Entamoeba invadens
QNPIKKKP

SEQ ID NO: 2897541 - protein, 8 aa, Entamoeba invadens
QNPIPLTQ

SEQ ID NO: 2897542 - protein, 9 aa, Entamoeba invadens
QNPKERETI

SEQ ID NO: 2897543 - protein, 9 aa, Entamoeba invadens
QNPKERKTI

SEQ ID NO: 2897544 - protein, 9 aa, Entamoeba invadens
QNPKERNTI

SEQ ID NO: 2897545 - protein, 11 aa, Entamoeba invadens
QNPKERTPIEN

SEQ ID NO: 2897546 - protein, 7 aa, Entamoeba invadens
QNPKEVE

SEQ ID NO: 2897547 - protein, 5 aa, Entamoeba invadens
QNPKP

SEQ ID NO: 2897548 - protein, 9 aa, Entamoeba invadens
QNPLDRPTS

SEQ ID NO: 2897549 - protein, 21 aa, Entamoeba invadens
QNPLEDEEENVSFDEEPFTGF

SEQ ID NO: 2897550 - protein, 18 aa, Entamoeba invadens
QNPLGEGSGRKGLPQSSI

SEQ ID NO: 2897551 - protein, 11 aa, Entamoeba invadens
QNPNDDTEISK

SEQ ID NO: 2897552 - protein, 10 aa, Entamoeba invadens
QNPNLDKNNR

SEQ ID NO: 2897553 - protein, 9 aa, Entamoeba invadens
QNPNRNAEF

SEQ ID NO: 2897554 - protein, 8 aa, Entamoeba invadens
QNPNTNIA

SEQ ID NO: 2897555 - protein, 5 aa, Entamoeba invadens
QNPPL

SEQ ID NO: 2897556 - protein, 10 aa, Entamoeba invadens
QNPPNTYGGR

SEQ ID NO: 2897557 - protein, 11 aa, Entamoeba invadens
QNPPNTYGGRK

SEQ ID NO: 2897558 - protein, 5 aa, Entamoeba invadens
QNPPV

SEQ ID NO: 2897559 - protein, 8 aa, Entamoeba invadens
QNPQLRAQ

SEQ ID NO: 2897560 - protein, 10 aa, Entamoeba invadens
QNPQQLQNPE

SEQ ID NO: 2897561 - protein, 8 aa, Entamoeba invadens
QNPRERPS

SEQ ID NO: 2897562 - protein, 4 aa, Entamoeba invadens
QNPS

SEQ ID NO: 2897563 - protein, 20 aa, Entamoeba invadens
QNPSDKKAIDFTDPSQVYNS

SEQ ID NO: 2897564 - protein, 15 aa, Entamoeba invadens
QNPSENKEDKLPNTE

SEQ ID NO: 2897565 - protein, 9 aa, Entamoeba invadens
QNPSGFEIN

SEQ ID NO: 2897566 - protein, 5 aa, Entamoeba invadens
QNPSK

SEQ ID NO: 2897567 - protein, 5 aa, Entamoeba invadens
QNPSQ

SEQ ID NO: 2897568 - protein, 6 aa, Entamoeba invadens
QNPSQH

SEQ ID NO: 2897569 - protein, 6 aa, Entamoeba invadens
QNPTKS

SEQ ID NO: 2897570 - protein, 6 aa, Entamoeba invadens
QNPTLK

SEQ ID NO: 2897571 - protein, 6 aa, Entamoeba invadens
QNPTLN

SEQ ID NO: 2897572 - protein, 7 aa, Entamoeba invadens
QNPTRKV

SEQ ID NO: 2897573 - protein, 4 aa, Entamoeba invadens
QNQC

SEQ ID NO: 2897574 - protein, 8 aa, Entamoeba invadens
QNQEFTNK

SEQ ID NO: 2897575 - protein, 24 aa, Entamoeba invadens
QNQEKEKKDVKEEKNTIQSDKDVT

SEQ ID NO: 2897576 - protein, 19 aa, Entamoeba invadens
QNQENTNHEISPEVGQRLE

SEQ ID NO: 2897577 - protein, 6 aa, Entamoeba invadens
QNQGSN

SEQ ID NO: 2897578 - protein, 26 aa, Entamoeba invadens
QNQKTPQNQSPKTAPSPKAKIEKTMN

SEQ ID NO: 2897579 - protein, 16 aa, Entamoeba invadens
QNQKVKKELGAQTDNA

SEQ ID NO: 2897580 - protein, 7 aa, Entamoeba invadens
QNQLDTQ

SEQ ID NO: 2897581 - protein, 5 aa, Entamoeba invadens
QNQNI

SEQ ID NO: 2897582 - protein, 8 aa, Entamoeba invadens
QNQNITGQ

SEQ ID NO: 2897583 - protein, 19 aa, Entamoeba invadens
QNQNPSPQGNGYGQIPKFM

SEQ ID NO: 2897584 - protein, 18 aa, Entamoeba invadens
QNQPEKNTKKVDEAKTTN

SEQ ID NO: 2897585 - protein, 7 aa, Entamoeba invadens
QNQPLRQ

SEQ ID NO: 2897586 - protein, 8 aa, Entamoeba invadens
QNQPPVPL

SEQ ID NO: 2897587 - protein, 4 aa, Entamoeba invadens
QNQQ

SEQ ID NO: 2897588 - protein, 13 aa, Entamoeba invadens
QNQQKTPEEAATN

SEQ ID NO: 2897589 - protein, 7 aa, Entamoeba invadens
QNQRVDD

SEQ ID NO: 2897590 - protein, 16 aa, Entamoeba invadens
QNQSVALSSKTSLESS

SEQ ID NO: 2897591 - protein, 9 aa, Entamoeba invadens
QNQTATTVD

SEQ ID NO: 2897592 - protein, 6 aa, Entamoeba invadens
QNQTRN

SEQ ID NO: 2897593 - protein, 6 aa, Entamoeba invadens
QNQVEE

SEQ ID NO: 2897594 - protein, 6 aa, Entamoeba invadens
QNQVQE

SEQ ID NO: 2897595 - protein, 7 aa, Entamoeba invadens
QNQVQPS

SEQ ID NO: 2897596 - protein, 15 aa, Entamoeba invadens
QNRAFSENDYKTGTD

SEQ ID NO: 2897597 - protein, 4 aa, Entamoeba invadens
QNRC

SEQ ID NO: 2897598 - protein, 4 aa, Entamoeba invadens
QNRE

SEQ ID NO: 2897599 - protein, 5 aa, Entamoeba invadens
QNREE

SEQ ID NO: 2897600 - protein, 10 aa, Entamoeba invadens
QNRFTEKYPA

SEQ ID NO: 2897601 - protein, 7 aa, Entamoeba invadens
QNRGGEA

SEQ ID NO: 2897602 - protein, 5 aa, Entamoeba invadens
QNRHS

SEQ ID NO: 2897603 - protein, 9 aa, Entamoeba invadens
QNRLPAPTK

SEQ ID NO: 2897604 - protein, 14 aa, Entamoeba invadens
QNRNKNNNTNTTDL

SEQ ID NO: 2897605 - protein, 5 aa, Entamoeba invadens
QNRPG

SEQ ID NO: 2897606 - protein, 4 aa, Entamoeba invadens
QNRQ

SEQ ID NO: 2897607 - protein, 10 aa, Entamoeba invadens
QNRSSYIQGE

SEQ ID NO: 2897608 - protein, 7 aa, Entamoeba invadens
QNRTSQI

SEQ ID NO: 2897609 - protein, 8 aa, Entamoeba invadens
QNRTTSSI

SEQ ID NO: 2897610 - protein, 6 aa, Entamoeba invadens
QNRVKR

SEQ ID NO: 2897611 - protein, 4 aa, Entamoeba invadens
QNSA

SEQ ID NO: 2897612 - protein, 4 aa, Entamoeba invadens
QNSD

SEQ ID NO: 2897613 - protein, 25 aa, Entamoeba invadens
QNSDTKNEKESQQNASQCDVQKENA

SEQ ID NO: 2897614 - protein, 12 aa, Entamoeba invadens
QNSEIGSKSSFA

SEQ ID NO: 2897615 - protein, 9 aa, Entamoeba invadens
QNSEKHPQL

SEQ ID NO: 2897616 - protein, 10 aa, Entamoeba invadens
QNSEKNLMGE

SEQ ID NO: 2897617 - protein, 7 aa, Entamoeba invadens
QNSELQK

SEQ ID NO: 2897618 - protein, 10 aa, Entamoeba invadens
QNSELSKRIA

SEQ ID NO: 2897619 - protein, 32 aa, Entamoeba invadens
QNSELSKRIAEGLSQQLEREKSTFTNSSTGTT

SEQ ID NO: 2897620 - protein, 6 aa, Entamoeba invadens
QNSEMP

SEQ ID NO: 2897621 - protein, 11 aa, Entamoeba invadens
QNSEQRPTVGT

SEQ ID NO: 2897622 - protein, 7 aa, Entamoeba invadens
QNSERSK

SEQ ID NO: 2897623 - protein, 9 aa, Entamoeba invadens
QNSESMEKT

SEQ ID NO: 2897624 - protein, 20 aa, Entamoeba invadens
QNSESPSRKNVSYGNVTDGS

SEQ ID NO: 2897625 - protein, 8 aa, Entamoeba invadens
QNSETSPL

SEQ ID NO: 2897626 - protein, 5 aa, Entamoeba invadens
QNSFD

SEQ ID NO: 2897627 - protein, 8 aa, Entamoeba invadens
QNSFSESS

SEQ ID NO: 2897628 - protein, 17 aa, Entamoeba invadens
QNSGRKLENLEKRAKEW

SEQ ID NO: 2897629 - protein, 7 aa, Entamoeba invadens
QNSHDNA

SEQ ID NO: 2897630 - protein, 5 aa, Entamoeba invadens
QNSHL

SEQ ID NO: 2897631 - protein, 8 aa, Entamoeba invadens
QNSHSDKM

SEQ ID NO: 2897632 - protein, 12 aa, Entamoeba invadens
QNSHTQIPVQTT

SEQ ID NO: 2897633 - protein, 8 aa, Entamoeba invadens
QNSKERES

SEQ ID NO: 2897634 - protein, 9 aa, Entamoeba invadens
QNSLNAQSE

SEQ ID NO: 2897635 - protein, 8 aa, Entamoeba invadens
QNSLNKKD

SEQ ID NO: 2897636 - protein, 9 aa, Entamoeba invadens
QNSNDEPKI

SEQ ID NO: 2897637 - protein, 6 aa, Entamoeba invadens
QNSNLT

SEQ ID NO: 2897638 - protein, 19 aa, Entamoeba invadens
QNSNTSSTRVESETTPTKL

SEQ ID NO: 2897639 - protein, 29 aa, Entamoeba invadens
QNSNTSSTRVESETTPTKLPRIVYNSDES

SEQ ID NO: 2897640 - protein, 4 aa, Entamoeba invadens
QNSP

SEQ ID NO: 2897641 - protein, 7 aa, Entamoeba invadens
QNSPPSF

SEQ ID NO: 2897642 - protein, 8 aa, Entamoeba invadens
QNSREFEI

SEQ ID NO: 2897643 - protein, 5 aa, Entamoeba invadens
QNSSE

SEQ ID NO: 2897644 - protein, 5 aa, Entamoeba invadens
QNSSF

SEQ ID NO: 2897645 - protein, 7 aa, Entamoeba invadens
QNSSGRV

SEQ ID NO: 2897646 - protein, 6 aa, Entamoeba invadens
QNSSIQ

SEQ ID NO: 2897647 - protein, 8 aa, Entamoeba invadens
QNSSPDVV

SEQ ID NO: 2897648 - protein, 8 aa, Entamoeba invadens
QNSSPSQF

SEQ ID NO: 2897649 - protein, 5 aa, Entamoeba invadens
QNSSV

SEQ ID NO: 2897650 - protein, 4 aa, Entamoeba invadens
QNST

SEQ ID NO: 2897651 - protein, 8 aa, Entamoeba invadens
QNSTAKIE

SEQ ID NO: 2897652 - protein, 6 aa, Entamoeba invadens
QNSTFE

SEQ ID NO: 2897653 - protein, 12 aa, Entamoeba invadens
QNSTKSKLPKVE

SEQ ID NO: 2897654 - protein, 6 aa, Entamoeba invadens
QNSTQR

SEQ ID NO: 2897655 - protein, 8 aa, Entamoeba invadens
QNSTTRQK

SEQ ID NO: 2897656 - protein, 10 aa, Entamoeba invadens
QNSVEKPDVA

SEQ ID NO: 2897657 - protein, 13 aa, Entamoeba invadens
QNSVTSKKLTTIP

SEQ ID NO: 2897658 - protein, 7 aa, Entamoeba invadens
QNSYTPY

SEQ ID NO: 2897659 - protein, 5 aa, Entamoeba invadens
QNTAE

SEQ ID NO: 2897660 - protein, 9 aa, Entamoeba invadens
QNTANKMTT

SEQ ID NO: 2897661 - protein, 11 aa, Entamoeba invadens
QNTDKSQRSQI

SEQ ID NO: 2897662 - protein, 8 aa, Entamoeba invadens
QNTDPMKN

SEQ ID NO: 2897663 - protein, 6 aa, Entamoeba invadens
QNTEGI

SEQ ID NO: 2897664 - protein, 7 aa, Entamoeba invadens
QNTEKIE

SEQ ID NO: 2897665 - protein, 13 aa, Entamoeba invadens
QNTEKKSKKTEQY

SEQ ID NO: 2897666 - protein, 6 aa, Entamoeba invadens
QNTEKY

SEQ ID NO: 2897667 - protein, 11 aa, Entamoeba invadens
QNTFNRMDQGN

SEQ ID NO: 2897668 - protein, 14 aa, Entamoeba invadens
QNTFTDQRSVYGRQ

SEQ ID NO: 2897669 - protein, 5 aa, Entamoeba invadens
QNTGN

SEQ ID NO: 2897670 - protein, 4 aa, Entamoeba invadens
QNTI

SEQ ID NO: 2897671 - protein, 17 aa, Entamoeba invadens
QNTIKNGVPRLQTSTDQ

SEQ ID NO: 2897672 - protein, 8 aa, Entamoeba invadens
QNTIPSRS

SEQ ID NO: 2897673 - protein, 7 aa, Entamoeba invadens
QNTKKIR

SEQ ID NO: 2897674 - protein, 27 aa, Entamoeba invadens
QNTKQRKGEDEREGKHTRAVKKGKFVL

SEQ ID NO: 2897675 - protein, 8 aa, Entamoeba invadens
QNTKTGEV

SEQ ID NO: 2897676 - protein, 5 aa, Entamoeba invadens
QNTKY

SEQ ID NO: 2897677 - protein, 7 aa, Entamoeba invadens
QNTLQKS

SEQ ID NO: 2897678 - protein, 11 aa, Entamoeba invadens
QNTLQNVPANY

SEQ ID NO: 2897679 - protein, 9 aa, Entamoeba invadens
QNTLRSSQK

SEQ ID NO: 2897680 - protein, 20 aa, Entamoeba invadens
QNTNARQSDKKEDEKSTIVN

SEQ ID NO: 2897681 - protein, 6 aa, Entamoeba invadens
QNTNEG

SEQ ID NO: 2897682 - protein, 17 aa, Entamoeba invadens
QNTNGKEEELAKKKKIK

SEQ ID NO: 2897683 - protein, 5 aa, Entamoeba invadens
QNTNH

SEQ ID NO: 2897684 - protein, 10 aa, Entamoeba invadens
QNTNNDTQQE

SEQ ID NO: 2897685 - protein, 36 aa, Entamoeba invadens
QNTNNVDDKTDGLRKRAPTTTRTSNSMQSRNRGLTV

SEQ ID NO: 2897686 - protein, 7 aa, Entamoeba invadens
QNTNSTN

SEQ ID NO: 2897687 - protein, 7 aa, Entamoeba invadens
QNTNVPK

SEQ ID NO: 2897688 - protein, 6 aa, Entamoeba invadens
QNTPKN

SEQ ID NO: 2897689 - protein, 8 aa, Entamoeba invadens
QNTPMKQQ

SEQ ID NO: 2897690 - protein, 7 aa, Entamoeba invadens
QNTPNLS

SEQ ID NO: 2897691 - protein, 8 aa, Entamoeba invadens
QNTPQIPF

SEQ ID NO: 2897692 - protein, 5 aa, Entamoeba invadens
QNTQF

SEQ ID NO: 2897693 - protein, 15 aa, Entamoeba invadens
QNTQIGAQMSQQVSQ

SEQ ID NO: 2897694 - protein, 5 aa, Entamoeba invadens
QNTQN

SEQ ID NO: 2897695 - protein, 9 aa, Entamoeba invadens
QNTQPAQVV

SEQ ID NO: 2897696 - protein, 7 aa, Entamoeba invadens
QNTQQKL

SEQ ID NO: 2897697 - protein, 26 aa, Entamoeba invadens
QNTQQSVMQNTTQSSSQTHQNTSSGL

SEQ ID NO: 2897698 - protein, 9 aa, Entamoeba invadens
QNTQQTEEP

SEQ ID NO: 2897699 - protein, 18 aa, Entamoeba invadens
QNTQSGLSKEFKDSKGPV

SEQ ID NO: 2897700 - protein, 12 aa, Entamoeba invadens
QNTRPNNSTLGT

SEQ ID NO: 2897701 - protein, 4 aa, Entamoeba invadens
QNTS

SEQ ID NO: 2897702 - protein, 8 aa, Entamoeba invadens
QNTSEETV

SEQ ID NO: 2897703 - protein, 10 aa, Entamoeba invadens
QNTSSTCDEC

SEQ ID NO: 2897704 - protein, 7 aa, Entamoeba invadens
QNTSSYV

SEQ ID NO: 2897705 - protein, 23 aa, Entamoeba invadens
QNTSTGKDKNLPPPSTEIKQPKA

SEQ ID NO: 2897706 - protein, 6 aa, Entamoeba invadens
QNTSTM

SEQ ID NO: 2897707 - protein, 5 aa, Entamoeba invadens
QNTTF

SEQ ID NO: 2897708 - protein, 6 aa, Entamoeba invadens
QNTTGT

SEQ ID NO: 2897709 - protein, 6 aa, Entamoeba invadens
QNTTKN

SEQ ID NO: 2897710 - protein, 7 aa, Entamoeba invadens
QNTTSRV

SEQ ID NO: 2897711 - protein, 4 aa, Entamoeba invadens
QNTV

SEQ ID NO: 2897712 - protein, 15 aa, Entamoeba invadens
QNTVKSVQPNRTGNT

SEQ ID NO: 2897713 - protein, 12 aa, Entamoeba invadens
QNTVTPEKKQMR

SEQ ID NO: 2897714 - protein, 10 aa, Entamoeba invadens
QNVDSSQRPI

SEQ ID NO: 2897715 - protein, 4 aa, Entamoeba invadens
QNVE

SEQ ID NO: 2897716 - protein, 11 aa, Entamoeba invadens
QNVEKSIPPKE

SEQ ID NO: 2897717 - protein, 12 aa, Entamoeba invadens
QNVEKSNKTNED

SEQ ID NO: 2897718 - protein, 28 aa, Entamoeba invadens
QNVEKYSLQKKRPKEEKQKEKQKYSEVS

SEQ ID NO: 2897719 - protein, 5 aa, Entamoeba invadens
QNVEN

SEQ ID NO: 2897720 - protein, 5 aa, Entamoeba invadens
QNVEV

SEQ ID NO: 2897721 - protein, 8 aa, Entamoeba invadens
QNVEYGDG

SEQ ID NO: 2897722 - protein, 11 aa, Entamoeba invadens
QNVGKDDEPFN

SEQ ID NO: 2897723 - protein, 5 aa, Entamoeba invadens
QNVGL

SEQ ID NO: 2897724 - protein, 5 aa, Entamoeba invadens
QNVHS

SEQ ID NO: 2897725 - protein, 10 aa, Entamoeba invadens
QNVPPPNEQV

SEQ ID NO: 2897726 - protein, 7 aa, Entamoeba invadens
QNVPQKK

SEQ ID NO: 2897727 - protein, 13 aa, Entamoeba invadens
QNVQAVGKEGIQH

SEQ ID NO: 2897728 - protein, 8 aa, Entamoeba invadens
QNVQENQK

SEQ ID NO: 2897729 - protein, 38 aa, Entamoeba invadens
QNVQNNKTEDLKDQKQDAESVPSTSPPLDTQNKQQQNF

SEQ ID NO: 2897730 - protein, 7 aa, Entamoeba invadens
QNVQTTN

SEQ ID NO: 2897731 - protein, 5 aa, Entamoeba invadens
QNVTA

SEQ ID NO: 2897732 - protein, 7 aa, Entamoeba invadens
QNYAERN

SEQ ID NO: 2897733 - protein, 22 aa, Entamoeba invadens
QNYKEEKDKKDIEYPDVKGPKI

SEQ ID NO: 2897734 - protein, 6 aa, Entamoeba invadens
QNYPTN

SEQ ID NO: 2897735 - protein, 9 aa, Entamoeba invadens
QNYTTTVSE

SEQ ID NO: 2897736 - protein, 4 aa, Entamoeba invadens
QPAE

SEQ ID NO: 2897737 - protein, 11 aa, Entamoeba invadens
QPAKKSTVSPQ

SEQ ID NO: 2897738 - protein, 9 aa, Entamoeba invadens
QPAKKSVTT

SEQ ID NO: 2897739 - protein, 6 aa, Entamoeba invadens
QPAPDG

SEQ ID NO: 2897740 - protein, 18 aa, Entamoeba invadens
QPAPTEYNATTIDTPMDT

SEQ ID NO: 2897741 - protein, 4 aa, Entamoeba invadens
QPAR

SEQ ID NO: 2897742 - protein, 12 aa, Entamoeba invadens
QPARPPASAITP

SEQ ID NO: 2897743 - protein, 5 aa, Entamoeba invadens
QPATM

SEQ ID NO: 2897744 - protein, 17 aa, Entamoeba invadens
QPAVASPRVVRPNTKDV

SEQ ID NO: 2897745 - protein, 5 aa, Entamoeba invadens
QPAVS

SEQ ID NO: 2897746 - protein, 16 aa, Entamoeba invadens
QPCDSSCNKCNGAAAN

SEQ ID NO: 2897747 - protein, 4 aa, Entamoeba invadens
QPCE

SEQ ID NO: 2897748 - protein, 14 aa, Entamoeba invadens
QPCGDGEYGTKPNC

SEQ ID NO: 2897749 - protein, 4 aa, Entamoeba invadens
QPDD

SEQ ID NO: 2897750 - protein, 41 aa, Entamoeba invadens
QPDEERQKADSADAVRKADSPKELEKERAIKQEADKETQRL

SEQ ID NO: 2897751 - protein, 41 aa, Entamoeba invadens
QPDEERQKAESADAVRKADSQKELEKERAMKQKPDKETQKL

SEQ ID NO: 2897752 - protein, 41 aa, Entamoeba invadens
QPDEERQKSGNADAVRKANSQKELEKERAMKQEADKETQKL

SEQ ID NO: 2897753 - protein, 4 aa, Entamoeba invadens
QPDG

SEQ ID NO: 2897754 - protein, 22 aa, Entamoeba invadens
QPDKPKEPEKQSEASGTTFPSL

SEQ ID NO: 2897755 - protein, 6 aa, Entamoeba invadens
QPDSVY

SEQ ID NO: 2897756 - protein, 6 aa, Entamoeba invadens
QPDTSL

SEQ ID NO: 2897757 - protein, 7 aa, Entamoeba invadens
QPDTTKT

SEQ ID NO: 2897758 - protein, 5 aa, Entamoeba invadens
QPEDA

SEQ ID NO: 2897759 - protein, 32 aa, Entamoeba invadens
QPEENIKKPHKMEEKDTQFVKEKEAPKLEGEK

SEQ ID NO: 2897760 - protein, 6 aa, Entamoeba invadens
QPEETT

SEQ ID NO: 2897761 - protein, 9 aa, Entamoeba invadens
QPEFGQSEK

SEQ ID NO: 2897762 - protein, 113 aa, Entamoeba invadens
QPEKKNIQVNNNAGDGKGLPQQKLPVKKRASLKGSNPFDDESKSASGNPFSDHNSQTSCDAKIGEKAQPTNPFVGEASPKIGPNPFDDDLGDNSKDLKDSKSLKSSQEIKKDN

SEQ ID NO: 2897763 - protein, 30 aa, Entamoeba invadens
QPEKKNIQVNNNAGDGKGLPQQKLPVKKRT

SEQ ID NO: 2897764 - protein, 8 aa, Entamoeba invadens
QPEKKTGY

SEQ ID NO: 2897765 - protein, 8 aa, Entamoeba invadens
QPELGPAK

SEQ ID NO: 2897766 - protein, 11 aa, Entamoeba invadens
QPELKNYGQVP

SEQ ID NO: 2897767 - protein, 5 aa, Entamoeba invadens
QPENG

SEQ ID NO: 2897768 - protein, 8 aa, Entamoeba invadens
QPEPDFPS

SEQ ID NO: 2897769 - protein, 12 aa, Entamoeba invadens
QPERIKKRTRKG

SEQ ID NO: 2897770 - protein, 10 aa, Entamoeba invadens
QPERTPEGVE

SEQ ID NO: 2897771 - protein, 8 aa, Entamoeba invadens
QPETCDDL

SEQ ID NO: 2897772 - protein, 8 aa, Entamoeba invadens
QPETTLEV

SEQ ID NO: 2897773 - protein, 8 aa, Entamoeba invadens
QPEVKNSE

SEQ ID NO: 2897774 - protein, 29 aa, Entamoeba invadens
QPEVQQPNETPQNNTIQDIPSAPNAPIVP

SEQ ID NO: 2897775 - protein, 6 aa, Entamoeba invadens
QPEYEQ

SEQ ID NO: 2897776 - protein, 7 aa, Entamoeba invadens
QPEYTQE

SEQ ID NO: 2897777 - protein, 10 aa, Entamoeba invadens
QPFDDETPIE

SEQ ID NO: 2897778 - protein, 6 aa, Entamoeba invadens
QPFDGT

SEQ ID NO: 2897779 - protein, 4 aa, Entamoeba invadens
QPFE

SEQ ID NO: 2897780 - protein, 11 aa, Entamoeba invadens
QPFETKEAEYT

SEQ ID NO: 2897781 - protein, 4 aa, Entamoeba invadens
QPFK

SEQ ID NO: 2897782 - protein, 9 aa, Entamoeba invadens
QPFNTGEDL

SEQ ID NO: 2897783 - protein, 6 aa, Entamoeba invadens
QPFPQK

SEQ ID NO: 2897784 - protein, 7 aa, Entamoeba invadens
QPFPTAP

SEQ ID NO: 2897785 - protein, 21 aa, Entamoeba invadens
QPFQHPEQHPPQTTSDEGTTL

SEQ ID NO: 2897786 - protein, 14 aa, Entamoeba invadens
QPFSDTVNSPQITA

SEQ ID NO: 2897787 - protein, 7 aa, Entamoeba invadens
QPFSPPY

SEQ ID NO: 2897788 - protein, 6 aa, Entamoeba invadens
QPFSSR

SEQ ID NO: 2897789 - protein, 6 aa, Entamoeba invadens
QPFTGP

SEQ ID NO: 2897790 - protein, 5 aa, Entamoeba invadens
QPGAH

SEQ ID NO: 2897791 - protein, 6 aa, Entamoeba invadens
QPGDLT

SEQ ID NO: 2897792 - protein, 9 aa, Entamoeba invadens
QPGEKTADI

SEQ ID NO: 2897793 - protein, 11 aa, Entamoeba invadens
QPGEPTVPSEI

SEQ ID NO: 2897794 - protein, 5 aa, Entamoeba invadens
QPGKC

SEQ ID NO: 2897795 - protein, 8 aa, Entamoeba invadens
QPGQPNMR

SEQ ID NO: 2897796 - protein, 6 aa, Entamoeba invadens
QPGQSI

SEQ ID NO: 2897797 - protein, 10 aa, Entamoeba invadens
QPGSLQSEGG

SEQ ID NO: 2897798 - protein, 4 aa, Entamoeba invadens
QPGV

SEQ ID NO: 2897799 - protein, 9 aa, Entamoeba invadens
QPHASELGK

SEQ ID NO: 2897800 - protein, 6 aa, Entamoeba invadens
QPHIPK

SEQ ID NO: 2897801 - protein, 4 aa, Entamoeba invadens
QPHP

SEQ ID NO: 2897802 - protein, 5 aa, Entamoeba invadens
QPHQH

SEQ ID NO: 2897803 - protein, 5 aa, Entamoeba invadens
QPHTP

SEQ ID NO: 2897804 - protein, 5 aa, Entamoeba invadens
QPIDD

SEQ ID NO: 2897805 - protein, 10 aa, Entamoeba invadens
QPIDENESLP

SEQ ID NO: 2897806 - protein, 10 aa, Entamoeba invadens
QPIETSNEPH

SEQ ID NO: 2897807 - protein, 10 aa, Entamoeba invadens
QPIGPSGSAY

SEQ ID NO: 2897808 - protein, 5 aa, Entamoeba invadens
QPIGS

SEQ ID NO: 2897809 - protein, 11 aa, Entamoeba invadens
QPIHKNKTHYP

SEQ ID NO: 2897810 - protein, 11 aa, Entamoeba invadens
QPIKQSDVEIE

SEQ ID NO: 2897811 - protein, 42 aa, Entamoeba invadens
QPINTSNVYTPSQHPIATPSTYSSNVYTPGQHTTLTQPINSS

SEQ ID NO: 2897812 - protein, 13 aa, Entamoeba invadens
QPIPQKTKTPSVV

SEQ ID NO: 2897813 - protein, 6 aa, Entamoeba invadens
QPIQNT

SEQ ID NO: 2897814 - protein, 11 aa, Entamoeba invadens
QPIQRQPEVEV

SEQ ID NO: 2897815 - protein, 14 aa, Entamoeba invadens
QPIRSTKDWGNKKT

SEQ ID NO: 2897816 - protein, 5 aa, Entamoeba invadens
QPISP

SEQ ID NO: 2897817 - protein, 13 aa, Entamoeba invadens
QPISTGLKRQTSV

SEQ ID NO: 2897818 - protein, 6 aa, Entamoeba invadens
QPKAHS

SEQ ID NO: 2897819 - protein, 9 aa, Entamoeba invadens
QPKCGRCSN

SEQ ID NO: 2897820 - protein, 6 aa, Entamoeba invadens
QPKEET

SEQ ID NO: 2897821 - protein, 26 aa, Entamoeba invadens
QPKEKKKDEDLKIGTREEKTLNDKNN

SEQ ID NO: 2897822 - protein, 9 aa, Entamoeba invadens
QPKETEKIA

SEQ ID NO: 2897823 - protein, 24 aa, Entamoeba invadens
QPKKETKPKEKVEKEERKDKSNGL

SEQ ID NO: 2897824 - protein, 14 aa, Entamoeba invadens
QPKKPQRQKKEISK

SEQ ID NO: 2897825 - protein, 7 aa, Entamoeba invadens
QPKNEVV

SEQ ID NO: 2897826 - protein, 9 aa, Entamoeba invadens
QPKNKERTQ

SEQ ID NO: 2897827 - protein, 5 aa, Entamoeba invadens
QPKNL

SEQ ID NO: 2897828 - protein, 6 aa, Entamoeba invadens
QPKNLQ

SEQ ID NO: 2897829 - protein, 22 aa, Entamoeba invadens
QPKNMTQIPDVSKDEEISDDEW

SEQ ID NO: 2897830 - protein, 11 aa, Entamoeba invadens
QPKNTKDSYIP

SEQ ID NO: 2897831 - protein, 11 aa, Entamoeba invadens
QPKNTKDSYVP

SEQ ID NO: 2897832 - protein, 31 aa, Entamoeba invadens
QPKPLKIDQQDVQPSDQLSESNSMSSFTDEE

SEQ ID NO: 2897833 - protein, 8 aa, Entamoeba invadens
QPKPVGRV

SEQ ID NO: 2897834 - protein, 4 aa, Entamoeba invadens
QPKQ

SEQ ID NO: 2897835 - protein, 12 aa, Entamoeba invadens
QPKSKHEEKIEE

SEQ ID NO: 2897836 - protein, 7 aa, Entamoeba invadens
QPKSQLK

SEQ ID NO: 2897837 - protein, 7 aa, Entamoeba invadens
QPKSQML

SEQ ID NO: 2897838 - protein, 8 aa, Entamoeba invadens
QPKSTKEL

SEQ ID NO: 2897839 - protein, 9 aa, Entamoeba invadens
QPKTAPKGY

SEQ ID NO: 2897840 - protein, 8 aa, Entamoeba invadens
QPKVSIKT

SEQ ID NO: 2897841 - protein, 6 aa, Entamoeba invadens
QPLAGD

SEQ ID NO: 2897842 - protein, 5 aa, Entamoeba invadens
QPLEE

SEQ ID NO: 2897843 - protein, 7 aa, Entamoeba invadens
QPLGEGR

SEQ ID NO: 2897844 - protein, 7 aa, Entamoeba invadens
QPLGKSS

SEQ ID NO: 2897845 - protein, 14 aa, Entamoeba invadens
QPLPNTTLTSDSGW

SEQ ID NO: 2897846 - protein, 8 aa, Entamoeba invadens
QPLPPPPM

SEQ ID NO: 2897847 - protein, 6 aa, Entamoeba invadens
QPLPQQ

SEQ ID NO: 2897848 - protein, 5 aa, Entamoeba invadens
QPLPS

SEQ ID NO: 2897849 - protein, 7 aa, Entamoeba invadens
QPLRELG

SEQ ID NO: 2897850 - protein, 17 aa, Entamoeba invadens
QPLRGEQAEQEPSLSSI

SEQ ID NO: 2897851 - protein, 5 aa, Entamoeba invadens
QPLRS

SEQ ID NO: 2897852 - protein, 6 aa, Entamoeba invadens
QPLTKT

SEQ ID NO: 2897853 - protein, 18 aa, Entamoeba invadens
QPMNTQPMQPQAPQQVPQ

SEQ ID NO: 2897854 - protein, 4 aa, Entamoeba invadens
QPMQ

SEQ ID NO: 2897855 - protein, 9 aa, Entamoeba invadens
QPMQGRRGY

SEQ ID NO: 2897856 - protein, 4 aa, Entamoeba invadens
QPNA

SEQ ID NO: 2897857 - protein, 8 aa, Entamoeba invadens
QPNDAKTA

SEQ ID NO: 2897858 - protein, 5 aa, Entamoeba invadens
QPNDI

SEQ ID NO: 2897859 - protein, 7 aa, Entamoeba invadens
QPNELPG

SEQ ID NO: 2897860 - protein, 12 aa, Entamoeba invadens
QPNEVYDAGKIT

SEQ ID NO: 2897861 - protein, 4 aa, Entamoeba invadens
QPNG

SEQ ID NO: 2897862 - protein, 9 aa, Entamoeba invadens
QPNGEKVPK

SEQ ID NO: 2897863 - protein, 9 aa, Entamoeba invadens
QPNIDTNPP

SEQ ID NO: 2897864 - protein, 5 aa, Entamoeba invadens
QPNKS

SEQ ID NO: 2897865 - protein, 5 aa, Entamoeba invadens
QPNLN

SEQ ID NO: 2897866 - protein, 10 aa, Entamoeba invadens
QPNNKGDNMP

SEQ ID NO: 2897867 - protein, 5 aa, Entamoeba invadens
QPNNM

SEQ ID NO: 2897868 - protein, 12 aa, Entamoeba invadens
QPNPMDANSDKF

SEQ ID NO: 2897869 - protein, 5 aa, Entamoeba invadens
QPNPN

SEQ ID NO: 2897870 - protein, 8 aa, Entamoeba invadens
QPNPNQSD

SEQ ID NO: 2897871 - protein, 9 aa, Entamoeba invadens
QPNPSSGKH

SEQ ID NO: 2897872 - protein, 6 aa, Entamoeba invadens
QPNQQS

SEQ ID NO: 2897873 - protein, 8 aa, Entamoeba invadens
QPNQREKL

SEQ ID NO: 2897874 - protein, 8 aa, Entamoeba invadens
QPNQTEKL

SEQ ID NO: 2897875 - protein, 11 aa, Entamoeba invadens
QPNSNNSNTIG

SEQ ID NO: 2897876 - protein, 8 aa, Entamoeba invadens
QPNSSGSI

SEQ ID NO: 2897877 - protein, 7 aa, Entamoeba invadens
QPNTETI

SEQ ID NO: 2897878 - protein, 6 aa, Entamoeba invadens
QPNTGD

SEQ ID NO: 2897879 - protein, 7 aa, Entamoeba invadens
QPNTINS

SEQ ID NO: 2897880 - protein, 46 aa, Entamoeba invadens
QPNTRPQNVFPQNTPKTESASVVKTQETTPSKLPIPETPKSTEKYM

SEQ ID NO: 2897881 - protein, 70 aa, Entamoeba invadens
QPNTVNFGKTKNVQEKETSPQLEAEENTERNEKMVTTTKEQETEKKQKVVEKTYDRKDAKIDNFSEEERQ

SEQ ID NO: 2897882 - protein, 4 aa, Entamoeba invadens
QPNV

SEQ ID NO: 2897883 - protein, 8 aa, Entamoeba invadens
QPNYRQDN

SEQ ID NO: 2897884 - protein, 9 aa, Entamoeba invadens
QPPAHNPNY

SEQ ID NO: 2897885 - protein, 9 aa, Entamoeba invadens
QPPETYQPS

SEQ ID NO: 2897886 - protein, 6 aa, Entamoeba invadens
QPPFPT

SEQ ID NO: 2897887 - protein, 4 aa, Entamoeba invadens
QPPI

SEQ ID NO: 2897888 - protein, 24 aa, Entamoeba invadens
QPPIQNEKHRQSIKEREEIQEAER

SEQ ID NO: 2897889 - protein, 4 aa, Entamoeba invadens
QPPK

SEQ ID NO: 2897890 - protein, 11 aa, Entamoeba invadens
QPPKEYSDATK

SEQ ID NO: 2897891 - protein, 18 aa, Entamoeba invadens
QPPKKHVEPEKPKEIIDP

SEQ ID NO: 2897892 - protein, 6 aa, Entamoeba invadens
QPPKRQ

SEQ ID NO: 2897893 - protein, 46 aa, Entamoeba invadens
QPPKTFKDNSSDSDDATKERSEHTQNNLKGSDKQQNDNNLTQITPQ

SEQ ID NO: 2897894 - protein, 10 aa, Entamoeba invadens
QPPLDESNRR

SEQ ID NO: 2897895 - protein, 7 aa, Entamoeba invadens
QPPLSQA

SEQ ID NO: 2897896 - protein, 13 aa, Entamoeba invadens
QPPMQYGQPPMPG

SEQ ID NO: 2897897 - protein, 11 aa, Entamoeba invadens
QPPPKDKEREI

SEQ ID NO: 2897898 - protein, 6 aa, Entamoeba invadens
QPPPKF

SEQ ID NO: 2897899 - protein, 33 aa, Entamoeba invadens
QPPPLPTKPKRFNKEEKQSEVQQQETQESQTQD

SEQ ID NO: 2897900 - protein, 33 aa, Entamoeba invadens
QPPPLVPSKPEKVSKLEKSEIEKNEKLEDEEKT

SEQ ID NO: 2897901 - protein, 13 aa, Entamoeba invadens
QPPPMSPQTRSIV

SEQ ID NO: 2897902 - protein, 8 aa, Entamoeba invadens
QPPPSKGI

SEQ ID NO: 2897903 - protein, 5 aa, Entamoeba invadens
QPPQL

SEQ ID NO: 2897904 - protein, 14 aa, Entamoeba invadens
QPPQPVKQQVVPPY

SEQ ID NO: 2897905 - protein, 23 aa, Entamoeba invadens
QPPRAQLSTSNIPIQPQPHAYNR

SEQ ID NO: 2897906 - protein, 14 aa, Entamoeba invadens
QPPSDVETIRDRQN

SEQ ID NO: 2897907 - protein, 20 aa, Entamoeba invadens
QPPSGNTIPALSTDQVTQQL

SEQ ID NO: 2897908 - protein, 10 aa, Entamoeba invadens
QPPSNFSSTT

SEQ ID NO: 2897909 - protein, 9 aa, Entamoeba invadens
QPPSPVPPC

SEQ ID NO: 2897910 - protein, 9 aa, Entamoeba invadens
QPPSSLADT

SEQ ID NO: 2897911 - protein, 13 aa, Entamoeba invadens
QPPTISKLPSVSK

SEQ ID NO: 2897912 - protein, 17 aa, Entamoeba invadens
QPPTLPTPPIQKSDFES

SEQ ID NO: 2897913 - protein, 12 aa, Entamoeba invadens
QPPVQPKKSRVK

SEQ ID NO: 2897914 - protein, 7 aa, Entamoeba invadens
QPPVTPR

SEQ ID NO: 2897915 - protein, 4 aa, Entamoeba invadens
QPQA

SEQ ID NO: 2897916 - protein, 11 aa, Entamoeba invadens
QPQEPKRDDSQ

SEQ ID NO: 2897917 - protein, 7 aa, Entamoeba invadens
QPQEREV

SEQ ID NO: 2897918 - protein, 8 aa, Entamoeba invadens
QPQIPQNP

SEQ ID NO: 2897919 - protein, 13 aa, Entamoeba invadens
QPQLPANGSPMEE

SEQ ID NO: 2897920 - protein, 4 aa, Entamoeba invadens
QPQM

SEQ ID NO: 2897921 - protein, 4 aa, Entamoeba invadens
QPQN

SEQ ID NO: 2897922 - protein, 8 aa, Entamoeba invadens
QPQPAMGP

SEQ ID NO: 2897923 - protein, 13 aa, Entamoeba invadens
QPQQGEVIEEKKD

SEQ ID NO: 2897924 - protein, 12 aa, Entamoeba invadens
QPQQHPARDAQD

SEQ ID NO: 2897925 - protein, 11 aa, Entamoeba invadens
QPQQPQMAPSQ

SEQ ID NO: 2897926 - protein, 6 aa, Entamoeba invadens
QPQQPV

SEQ ID NO: 2897927 - protein, 30 aa, Entamoeba invadens
QPQQQTLQQPAQQYYQQPYQQQYQQQQQPM

SEQ ID NO: 2897928 - protein, 35 aa, Entamoeba invadens
QPQRDISSPQSASPLSPSKLSKDASPKNVPEPQQD

SEQ ID NO: 2897929 - protein, 19 aa, Entamoeba invadens
QPQSPQDDGTAQENASEES

SEQ ID NO: 2897930 - protein, 8 aa, Entamoeba invadens
QPQTEVTE

SEQ ID NO: 2897931 - protein, 14 aa, Entamoeba invadens
QPQTIQPENTLTTV

SEQ ID NO: 2897932 - protein, 7 aa, Entamoeba invadens
QPRHKNT

SEQ ID NO: 2897933 - protein, 4 aa, Entamoeba invadens
QPRL

SEQ ID NO: 2897934 - protein, 4 aa, Entamoeba invadens
QPRR

SEQ ID NO: 2897935 - protein, 5 aa, Entamoeba invadens
QPRRI

SEQ ID NO: 2897936 - protein, 6 aa, Entamoeba invadens
QPRSKI

SEQ ID NO: 2897937 - protein, 6 aa, Entamoeba invadens
QPRTSQ

SEQ ID NO: 2897938 - protein, 4 aa, Entamoeba invadens
QPSA

SEQ ID NO: 2897939 - protein, 13 aa, Entamoeba invadens
QPSAELSDSEYKE

SEQ ID NO: 2897940 - protein, 20 aa, Entamoeba invadens
QPSDQKSKSTNDVPRYTQSE

SEQ ID NO: 2897941 - protein, 9 aa, Entamoeba invadens
QPSDTNNGA

SEQ ID NO: 2897942 - protein, 4 aa, Entamoeba invadens
QPSE

SEQ ID NO: 2897943 - protein, 6 aa, Entamoeba invadens
QPSETV

SEQ ID NO: 2897944 - protein, 7 aa, Entamoeba invadens
QPSFRPQ

SEQ ID NO: 2897945 - protein, 15 aa, Entamoeba invadens
QPSKGSTATAESQLI

SEQ ID NO: 2897946 - protein, 18 aa, Entamoeba invadens
QPSKKKFTETDFQKTDTK

SEQ ID NO: 2897947 - protein, 6 aa, Entamoeba invadens
QPSKRY

SEQ ID NO: 2897948 - protein, 9 aa, Entamoeba invadens
QPSLNSVDE

SEQ ID NO: 2897949 - protein, 7 aa, Entamoeba invadens
QPSNARG

SEQ ID NO: 2897950 - protein, 25 aa, Entamoeba invadens
QPSPNSVDEYSTDDFNNTQNCADVN

SEQ ID NO: 2897951 - protein, 5 aa, Entamoeba invadens
QPSTI

SEQ ID NO: 2897952 - protein, 9 aa, Entamoeba invadens
QPSTIGSEE

SEQ ID NO: 2897953 - protein, 15 aa, Entamoeba invadens
QPSVDDDKKTHDDYH

SEQ ID NO: 2897954 - protein, 9 aa, Entamoeba invadens
QPTAEEQDL

SEQ ID NO: 2897955 - protein, 10 aa, Entamoeba invadens
QPTDALNDSQ

SEQ ID NO: 2897956 - protein, 5 aa, Entamoeba invadens
QPTDD

SEQ ID NO: 2897957 - protein, 14 aa, Entamoeba invadens
QPTDFKEKKELSEF

SEQ ID NO: 2897958 - protein, 5 aa, Entamoeba invadens
QPTDL

SEQ ID NO: 2897959 - protein, 4 aa, Entamoeba invadens
QPTE

SEQ ID NO: 2897960 - protein, 13 aa, Entamoeba invadens
QPTETNEKVKHNK

SEQ ID NO: 2897961 - protein, 18 aa, Entamoeba invadens
QPTGGFQTKREKRKGVKP

SEQ ID NO: 2897962 - protein, 18 aa, Entamoeba invadens
QPTHNRSSFQAPPTRQSI

SEQ ID NO: 2897963 - protein, 10 aa, Entamoeba invadens
QPTKDETVET

SEQ ID NO: 2897964 - protein, 9 aa, Entamoeba invadens
QPTKQKDVQ

SEQ ID NO: 2897965 - protein, 6 aa, Entamoeba invadens
QPTLKR

SEQ ID NO: 2897966 - protein, 6 aa, Entamoeba invadens
QPTLPN

SEQ ID NO: 2897967 - protein, 16 aa, Entamoeba invadens
QPTLQQQPFPTQYPPQ

SEQ ID NO: 2897968 - protein, 13 aa, Entamoeba invadens
QPTLQSTSQTTYP

SEQ ID NO: 2897969 - protein, 28 aa, Entamoeba invadens
QPTPEKIDKREPDDAATKNDSEDEEEKI

SEQ ID NO: 2897970 - protein, 17 aa, Entamoeba invadens
QPTPPTQPNVYPSTTLP

SEQ ID NO: 2897971 - protein, 5 aa, Entamoeba invadens
QPTPT

SEQ ID NO: 2897972 - protein, 35 aa, Entamoeba invadens
QPTQPSKRQTKAKNIRKGKTTNGPISTSKSPKEEF

SEQ ID NO: 2897973 - protein, 8 aa, Entamoeba invadens
QPTSIDSE

SEQ ID NO: 2897974 - protein, 6 aa, Entamoeba invadens
QPTSLP

SEQ ID NO: 2897975 - protein, 7 aa, Entamoeba invadens
QPTSSED

SEQ ID NO: 2897976 - protein, 4 aa, Entamoeba invadens
QPTT

SEQ ID NO: 2897977 - protein, 8 aa, Entamoeba invadens
QPTTETQK

SEQ ID NO: 2897978 - protein, 13 aa, Entamoeba invadens
QPTTLPDPTTPIN

SEQ ID NO: 2897979 - protein, 13 aa, Entamoeba invadens
QPTTPGAGRRPRY

SEQ ID NO: 2897980 - protein, 13 aa, Entamoeba invadens
QPTTQSAIPAQQV

SEQ ID NO: 2897981 - protein, 4 aa, Entamoeba invadens
QPTV

SEQ ID NO: 2897982 - protein, 6 aa, Entamoeba invadens
QPTVES

SEQ ID NO: 2897983 - protein, 5 aa, Entamoeba invadens
QPTVK

SEQ ID NO: 2897984 - protein, 11 aa, Entamoeba invadens
QPTVNAPATIS

SEQ ID NO: 2897985 - protein, 19 aa, Entamoeba invadens
QPTVPQQVTPSEQVTQQQP

SEQ ID NO: 2897986 - protein, 14 aa, Entamoeba invadens
QPTVQQPQQQQTQN

SEQ ID NO: 2897987 - protein, 21 aa, Entamoeba invadens
QPTYPHKKTTIKSKANTSIKT

SEQ ID NO: 2897988 - protein, 19 aa, Entamoeba invadens
QPTYQTQQPEVEEDGNDVE

SEQ ID NO: 2897989 - protein, 5 aa, Entamoeba invadens
QPTYT

SEQ ID NO: 2897990 - protein, 9 aa, Entamoeba invadens
QPVARDPKL

SEQ ID NO: 2897991 - protein, 10 aa, Entamoeba invadens
QPVDKKPRHA

SEQ ID NO: 2897992 - protein, 6 aa, Entamoeba invadens
QPVDRG

SEQ ID NO: 2897993 - protein, 16 aa, Entamoeba invadens
QPVEQIDPNEGKTLEE

SEQ ID NO: 2897994 - protein, 11 aa, Entamoeba invadens
QPVQNEDDKTC

SEQ ID NO: 2897995 - protein, 20 aa, Entamoeba invadens
QPVQQPEETKPAEKPKEGAE

SEQ ID NO: 2897996 - protein, 28 aa, Entamoeba invadens
QPVSPSTSPKPSLSPLNSPKNITKVEGA

SEQ ID NO: 2897997 - protein, 8 aa, Entamoeba invadens
QPVTRSPD

SEQ ID NO: 2897998 - protein, 5 aa, Entamoeba invadens
QPYAG

SEQ ID NO: 2897999 - protein, 9 aa, Entamoeba invadens
QPYENEESI

SEQ ID NO: 2898000 - protein, 14 aa, Entamoeba invadens
QPYENQSVTPRTSL

SEQ ID NO: 2898001 - protein, 4 aa, Entamoeba invadens
QPYF

SEQ ID NO: 2898002 - protein, 7 aa, Entamoeba invadens
QPYPTQQ

SEQ ID NO: 2898003 - protein, 18 aa, Entamoeba invadens
QPYQNQQQPSYQQNYSTP

SEQ ID NO: 2898004 - protein, 5 aa, Entamoeba invadens
QPYQQ

SEQ ID NO: 2898005 - protein, 6 aa, Entamoeba invadens
QPYTHT

SEQ ID NO: 2898006 - protein, 17 aa, Entamoeba invadens
QPYTPLPPPVYTEERCG

SEQ ID NO: 2898007 - protein, 5 aa, Entamoeba invadens
QPYTY

SEQ ID NO: 2898008 - protein, 10 aa, Entamoeba invadens
QQAAAQQAPQ

SEQ ID NO: 2898009 - protein, 7 aa, Entamoeba invadens
QQAAKNE

SEQ ID NO: 2898010 - protein, 46 aa, Entamoeba invadens
QQAANEKLEAAKKLEGDLPEREKRVQELSDQAKREFNTNLKQKKEL

SEQ ID NO: 2898011 - protein, 8 aa, Entamoeba invadens
QQADYQIS

SEQ ID NO: 2898012 - protein, 11 aa, Entamoeba invadens
QQAEDDCVEYS

SEQ ID NO: 2898013 - protein, 8 aa, Entamoeba invadens
QQAERGEK

SEQ ID NO: 2898014 - protein, 18 aa, Entamoeba invadens
QQAGGQQAWKEQVRKSRE

SEQ ID NO: 2898015 - protein, 8 aa, Entamoeba invadens
QQAHDNDV

SEQ ID NO: 2898016 - protein, 6 aa, Entamoeba invadens
QQAKNQ

SEQ ID NO: 2898017 - protein, 11 aa, Entamoeba invadens
QQANEQKAKQH

SEQ ID NO: 2898018 - protein, 7 aa, Entamoeba invadens
QQAPGDA

SEQ ID NO: 2898019 - protein, 15 aa, Entamoeba invadens
QQAPQQQEQKQQPAS

SEQ ID NO: 2898020 - protein, 9 aa, Entamoeba invadens
QQAPVQTRS

SEQ ID NO: 2898021 - protein, 8 aa, Entamoeba invadens
QQAQEEPR

SEQ ID NO: 2898022 - protein, 7 aa, Entamoeba invadens
QQAQPFF

SEQ ID NO: 2898023 - protein, 12 aa, Entamoeba invadens
QQAREYKRALNA

SEQ ID NO: 2898024 - protein, 19 aa, Entamoeba invadens
QQATATKPTPGTPQTPHVA

SEQ ID NO: 2898025 - protein, 8 aa, Entamoeba invadens
QQATVDPK

SEQ ID NO: 2898026 - protein, 11 aa, Entamoeba invadens
QQAVENSGYDP

SEQ ID NO: 2898027 - protein, 7 aa, Entamoeba invadens
QQCYNTE

SEQ ID NO: 2898028 - protein, 5 aa, Entamoeba invadens
QQDAF

SEQ ID NO: 2898029 - protein, 8 aa, Entamoeba invadens
QQDDNQTL

SEQ ID NO: 2898030 - protein, 5 aa, Entamoeba invadens
QQDDR

SEQ ID NO: 2898031 - protein, 12 aa, Entamoeba invadens
QQDDTLSQYTNS

SEQ ID NO: 2898032 - protein, 9 aa, Entamoeba invadens
QQDDTQRTC

SEQ ID NO: 2898033 - protein, 14 aa, Entamoeba invadens
QQDEHKRSSIQQVR

SEQ ID NO: 2898034 - protein, 6 aa, Entamoeba invadens
QQDGFT

SEQ ID NO: 2898035 - protein, 11 aa, Entamoeba invadens
QQDIEGEKAKV

SEQ ID NO: 2898036 - protein, 6 aa, Entamoeba invadens
QQDINK

SEQ ID NO: 2898037 - protein, 11 aa, Entamoeba invadens
QQDLPSSSEQV

SEQ ID NO: 2898038 - protein, 9 aa, Entamoeba invadens
QQDQQDAAI

SEQ ID NO: 2898039 - protein, 6 aa, Entamoeba invadens
QQDSID

SEQ ID NO: 2898040 - protein, 15 aa, Entamoeba invadens
QQDSKNPQRTHSKNK

SEQ ID NO: 2898041 - protein, 19 aa, Entamoeba invadens
QQDSNYRKRISRNAPTGIK

SEQ ID NO: 2898042 - protein, 8 aa, Entamoeba invadens
QQDTESVI

SEQ ID NO: 2898043 - protein, 5 aa, Entamoeba invadens
QQDTF

SEQ ID NO: 2898044 - protein, 9 aa, Entamoeba invadens
QQDVSTRNK

SEQ ID NO: 2898045 - protein, 25 aa, Entamoeba invadens
QQEALSKPRVKKAPLQLKKNGPKII

SEQ ID NO: 2898046 - protein, 11 aa, Entamoeba invadens
QQECYSRPSRL

SEQ ID NO: 2898047 - protein, 12 aa, Entamoeba invadens
QQEEENGTPMEL

SEQ ID NO: 2898048 - protein, 49 aa, Entamoeba invadens
QQEELEKVRQDNLKANEEGKTEKIEKKKSGVVREHPEKTSKTTNTLKNG

SEQ ID NO: 2898049 - protein, 34 aa, Entamoeba invadens
QQEELKAQENEKKRKELEESQKSSEIAKQNEIQS

SEQ ID NO: 2898050 - protein, 14 aa, Entamoeba invadens
QQEESKLSKTLPQF

SEQ ID NO: 2898051 - protein, 13 aa, Entamoeba invadens
QQEIDKKKDELVT

SEQ ID NO: 2898052 - protein, 9 aa, Entamoeba invadens
QQEIQTQKY

SEQ ID NO: 2898053 - protein, 9 aa, Entamoeba invadens
QQEKQLQDI

SEQ ID NO: 2898054 - protein, 8 aa, Entamoeba invadens
QQEKTNRV

SEQ ID NO: 2898055 - protein, 8 aa, Entamoeba invadens
QQEPTIQE

SEQ ID NO: 2898056 - protein, 12 aa, Entamoeba invadens
QQEQGTCTRGGQ

SEQ ID NO: 2898057 - protein, 5 aa, Entamoeba invadens
QQEQI

SEQ ID NO: 2898058 - protein, 4 aa, Entamoeba invadens
QQER

SEQ ID NO: 2898059 - protein, 9 aa, Entamoeba invadens
QQETNRLKT

SEQ ID NO: 2898060 - protein, 10 aa, Entamoeba invadens
QQEVENSRRE

SEQ ID NO: 2898061 - protein, 9 aa, Entamoeba invadens
QQEVKSEVQ

SEQ ID NO: 2898062 - protein, 10 aa, Entamoeba invadens
QQEVVPEKEV

SEQ ID NO: 2898063 - protein, 12 aa, Entamoeba invadens
QQFADGNKDIKE

SEQ ID NO: 2898064 - protein, 7 aa, Entamoeba invadens
QQFGNGD

SEQ ID NO: 2898065 - protein, 5 aa, Entamoeba invadens
QQFNQ

SEQ ID NO: 2898066 - protein, 6 aa, Entamoeba invadens
QQFQAQ

SEQ ID NO: 2898067 - protein, 9 aa, Entamoeba invadens
QQGDDSGMT

SEQ ID NO: 2898068 - protein, 8 aa, Entamoeba invadens
QQGDFTRN

SEQ ID NO: 2898069 - protein, 7 aa, Entamoeba invadens
QQGEAAL

SEQ ID NO: 2898070 - protein, 17 aa, Entamoeba invadens
QQGEEQHESQMESPLQT

SEQ ID NO: 2898071 - protein, 10 aa, Entamoeba invadens
QQGEKSQDYI

SEQ ID NO: 2898072 - protein, 8 aa, Entamoeba invadens
QQGFPQQP

SEQ ID NO: 2898073 - protein, 5 aa, Entamoeba invadens
QQGIT

SEQ ID NO: 2898074 - protein, 8 aa, Entamoeba invadens
QQGKEDEA

SEQ ID NO: 2898075 - protein, 6 aa, Entamoeba invadens
QQGKNR

SEQ ID NO: 2898076 - protein, 7 aa, Entamoeba invadens
QQGNYQT

SEQ ID NO: 2898077 - protein, 4 aa, Entamoeba invadens
QQGQ

SEQ ID NO: 2898078 - protein, 11 aa, Entamoeba invadens
QQGQTQESQSV

SEQ ID NO: 2898079 - protein, 7 aa, Entamoeba invadens
QQGTGKP

SEQ ID NO: 2898080 - protein, 5 aa, Entamoeba invadens
QQGVK

SEQ ID NO: 2898081 - protein, 6 aa, Entamoeba invadens
QQGVQG

SEQ ID NO: 2898082 - protein, 10 aa, Entamoeba invadens
QQGVQQQRGV

SEQ ID NO: 2898083 - protein, 14 aa, Entamoeba invadens
QQGYGGYPNPYTQM

SEQ ID NO: 2898084 - protein, 15 aa, Entamoeba invadens
QQHHVSDEGISAKSG

SEQ ID NO: 2898085 - protein, 8 aa, Entamoeba invadens
QQHQKTED

SEQ ID NO: 2898086 - protein, 5 aa, Entamoeba invadens
QQHTF

SEQ ID NO: 2898087 - protein, 6 aa, Entamoeba invadens
QQIAAH

SEQ ID NO: 2898088 - protein, 18 aa, Entamoeba invadens
QQIEGLKDNESISKIESG

SEQ ID NO: 2898089 - protein, 15 aa, Entamoeba invadens
QQIENQSKNDASQDK

SEQ ID NO: 2898090 - protein, 6 aa, Entamoeba invadens
QQIERA

SEQ ID NO: 2898091 - protein, 5 aa, Entamoeba invadens
QQIGQ

SEQ ID NO: 2898092 - protein, 16 aa, Entamoeba invadens
QQINDKEINNTNESQK

SEQ ID NO: 2898093 - protein, 6 aa, Entamoeba invadens
QQIPPN

SEQ ID NO: 2898094 - protein, 13 aa, Entamoeba invadens
QQIPQQKSNEIHD

SEQ ID NO: 2898095 - protein, 63 aa, Entamoeba invadens
QQIPQQTQVQRGIQTPQSTLQQPPPAPQPPQQLKQKAVQPQIKPQQQWRDQSPQMQQPPRQLQ

SEQ ID NO: 2898096 - protein, 6 aa, Entamoeba invadens
QQISAR

SEQ ID NO: 2898097 - protein, 6 aa, Entamoeba invadens
QQISEK

SEQ ID NO: 2898098 - protein, 6 aa, Entamoeba invadens
QQISKE

SEQ ID NO: 2898099 - protein, 11 aa, Entamoeba invadens
QQISSKKYKEQ

SEQ ID NO: 2898100 - protein, 12 aa, Entamoeba invadens
QQITPQNYYYCI

SEQ ID NO: 2898101 - protein, 16 aa, Entamoeba invadens
QQITSEDAYIPPNKKN

SEQ ID NO: 2898102 - protein, 5 aa, Entamoeba invadens
QQKDD

SEQ ID NO: 2898103 - protein, 14 aa, Entamoeba invadens
QQKDDLDSIYDNFQ

SEQ ID NO: 2898104 - protein, 19 aa, Entamoeba invadens
QQKDEKLRPKSNSLSPSLP

SEQ ID NO: 2898105 - protein, 21 aa, Entamoeba invadens
QQKDIDTQQKKETQKEKTAEF

SEQ ID NO: 2898106 - protein, 19 aa, Entamoeba invadens
QQKEEKEEHKEEKKGDISV

SEQ ID NO: 2898107 - protein, 18 aa, Entamoeba invadens
QQKEEKIRPKSNSLSPSL

SEQ ID NO: 2898108 - protein, 18 aa, Entamoeba invadens
QQKEEKLRPKSNSLSPSL

SEQ ID NO: 2898109 - protein, 6 aa, Entamoeba invadens
QQKEEL

SEQ ID NO: 2898110 - protein, 27 aa, Entamoeba invadens
QQKEFREREKPIDYQRDSEKKRDSFRD

SEQ ID NO: 2898111 - protein, 8 aa, Entamoeba invadens
QQKELLEN

SEQ ID NO: 2898112 - protein, 6 aa, Entamoeba invadens
QQKERY

SEQ ID NO: 2898113 - protein, 6 aa, Entamoeba invadens
QQKETQ

SEQ ID NO: 2898114 - protein, 8 aa, Entamoeba invadens
QQKETRYE

SEQ ID NO: 2898115 - protein, 8 aa, Entamoeba invadens
QQKEYRQA

SEQ ID NO: 2898116 - protein, 8 aa, Entamoeba invadens
QQKGNVKS

SEQ ID NO: 2898117 - protein, 20 aa, Entamoeba invadens
QQKHKSTVKGSKKERKEEEL

SEQ ID NO: 2898118 - protein, 10 aa, Entamoeba invadens
QQKIETRSGL

SEQ ID NO: 2898119 - protein, 5 aa, Entamoeba invadens
QQKLK

SEQ ID NO: 2898120 - protein, 6 aa, Entamoeba invadens
QQKLSS

SEQ ID NO: 2898121 - protein, 13 aa, Entamoeba invadens
QQKPHTTPPQITQ

SEQ ID NO: 2898122 - protein, 8 aa, Entamoeba invadens
QQKPLRSP

SEQ ID NO: 2898123 - protein, 12 aa, Entamoeba invadens
QQKPPRNNKNLK

SEQ ID NO: 2898124 - protein, 18 aa, Entamoeba invadens
QQKPQQQTVQQQKSTASF

SEQ ID NO: 2898125 - protein, 14 aa, Entamoeba invadens
QQKPYERPWKKLIE

SEQ ID NO: 2898126 - protein, 8 aa, Entamoeba invadens
QQKQELQY

SEQ ID NO: 2898127 - protein, 6 aa, Entamoeba invadens
QQKSKI

SEQ ID NO: 2898128 - protein, 8 aa, Entamoeba invadens
QQKTENTF

SEQ ID NO: 2898129 - protein, 8 aa, Entamoeba invadens
QQKTETKI

SEQ ID NO: 2898130 - protein, 34 aa, Entamoeba invadens
QQKTNEKHDENIDNKPNNAKEKKIDSINDPTDPF

SEQ ID NO: 2898131 - protein, 33 aa, Entamoeba invadens
QQKVETITKTDTLTDLQDQNKNTLKQEKKAMAE

SEQ ID NO: 2898132 - protein, 9 aa, Entamoeba invadens
QQKYKKSAD

SEQ ID NO: 2898133 - protein, 9 aa, Entamoeba invadens
QQKYTKSAD

SEQ ID NO: 2898134 - protein, 8 aa, Entamoeba invadens
QQLAESQD

SEQ ID NO: 2898135 - protein, 25 aa, Entamoeba invadens
QQLEKTTPVIDQSPYKSNEVIPDDV

SEQ ID NO: 2898136 - protein, 8 aa, Entamoeba invadens
QQLENRKE

SEQ ID NO: 2898137 - protein, 18 aa, Entamoeba invadens
QQLEQKHKQEYYKTPEVR

SEQ ID NO: 2898138 - protein, 14 aa, Entamoeba invadens
QQLETASKSVVEER

SEQ ID NO: 2898139 - protein, 9 aa, Entamoeba invadens
QQLPQQNPL

SEQ ID NO: 2898140 - protein, 13 aa, Entamoeba invadens
QQLPQSNQQVYEQ

SEQ ID NO: 2898141 - protein, 5 aa, Entamoeba invadens
QQLQP

SEQ ID NO: 2898142 - protein, 23 aa, Entamoeba invadens
QQLTTKKESAIEKAKEADQNYRA

SEQ ID NO: 2898143 - protein, 7 aa, Entamoeba invadens
QQMKESS

SEQ ID NO: 2898144 - protein, 12 aa, Entamoeba invadens
QQMREQEEKRQQ

SEQ ID NO: 2898145 - protein, 13 aa, Entamoeba invadens
QQMRQQQKPFIPN

SEQ ID NO: 2898146 - protein, 10 aa, Entamoeba invadens
QQMTPNENEQ

SEQ ID NO: 2898147 - protein, 5 aa, Entamoeba invadens
QQMVK

SEQ ID NO: 2898148 - protein, 5 aa, Entamoeba invadens
QQNAK

SEQ ID NO: 2898149 - protein, 11 aa, Entamoeba invadens
QQNATNGMYEG

SEQ ID NO: 2898150 - protein, 4 aa, Entamoeba invadens
QQND

SEQ ID NO: 2898151 - protein, 11 aa, Entamoeba invadens
QQNESSDKNQK

SEQ ID NO: 2898152 - protein, 4 aa, Entamoeba invadens
QQNG

SEQ ID NO: 2898153 - protein, 9 aa, Entamoeba invadens
QQNGQLPHQ

SEQ ID NO: 2898154 - protein, 8 aa, Entamoeba invadens
QQNIPQPV

SEQ ID NO: 2898155 - protein, 14 aa, Entamoeba invadens
QQNIQATQSTQQQQ

SEQ ID NO: 2898156 - protein, 11 aa, Entamoeba invadens
QQNITNAPENP

SEQ ID NO: 2898157 - protein, 11 aa, Entamoeba invadens
QQNKAKFGVGV

SEQ ID NO: 2898158 - protein, 9 aa, Entamoeba invadens
QQNNDEEQM

SEQ ID NO: 2898159 - protein, 7 aa, Entamoeba invadens
QQNNGQM

SEQ ID NO: 2898160 - protein, 16 aa, Entamoeba invadens
QQNNTQTQQTNDQNNP

SEQ ID NO: 2898161 - protein, 6 aa, Entamoeba invadens
QQNPLQ

SEQ ID NO: 2898162 - protein, 7 aa, Entamoeba invadens
QQNPQLK

SEQ ID NO: 2898163 - protein, 8 aa, Entamoeba invadens
QQNQDITD

SEQ ID NO: 2898164 - protein, 6 aa, Entamoeba invadens
QQNQNL

SEQ ID NO: 2898165 - protein, 8 aa, Entamoeba invadens
QQNRPQQQ

SEQ ID NO: 2898166 - protein, 4 aa, Entamoeba invadens
QQNS

SEQ ID NO: 2898167 - protein, 8 aa, Entamoeba invadens
QQNSENAT

SEQ ID NO: 2898168 - protein, 6 aa, Entamoeba invadens
QQNTNS

SEQ ID NO: 2898169 - protein, 8 aa, Entamoeba invadens
QQNTPLSA

SEQ ID NO: 2898170 - protein, 6 aa, Entamoeba invadens
QQNTSY

SEQ ID NO: 2898171 - protein, 21 aa, Entamoeba invadens
QQNTTKEQQEVKKAQSPINDE

SEQ ID NO: 2898172 - protein, 6 aa, Entamoeba invadens
QQNYPI

SEQ ID NO: 2898173 - protein, 26 aa, Entamoeba invadens
QQPAPQQKQSPQPSQQPKYQKPQPDV

SEQ ID NO: 2898174 - protein, 8 aa, Entamoeba invadens
QQPDNKKK

SEQ ID NO: 2898175 - protein, 4 aa, Entamoeba invadens
QQPE

SEQ ID NO: 2898176 - protein, 5 aa, Entamoeba invadens
QQPEL

SEQ ID NO: 2898177 - protein, 17 aa, Entamoeba invadens
QQPENRPNINEVVNFLR

SEQ ID NO: 2898178 - protein, 8 aa, Entamoeba invadens
QQPENYPA

SEQ ID NO: 2898179 - protein, 5 aa, Entamoeba invadens
QQPGM

SEQ ID NO: 2898180 - protein, 7 aa, Entamoeba invadens
QQPIDKN

SEQ ID NO: 2898181 - protein, 18 aa, Entamoeba invadens
QQPIQPNHDDFSYNDSDD

SEQ ID NO: 2898182 - protein, 20 aa, Entamoeba invadens
QQPMKQNTQRYSSDMGNTNV

SEQ ID NO: 2898183 - protein, 5 aa, Entamoeba invadens
QQPMN

SEQ ID NO: 2898184 - protein, 7 aa, Entamoeba invadens
QQPNQLQ

SEQ ID NO: 2898185 - protein, 27 aa, Entamoeba invadens
QQPNSIKNESLSSRTATTKQQKSPRIK

SEQ ID NO: 2898186 - protein, 7 aa, Entamoeba invadens
QQPPEVT

SEQ ID NO: 2898187 - protein, 21 aa, Entamoeba invadens
QQPPPPPVALPPEPAPQEDAK

SEQ ID NO: 2898188 - protein, 11 aa, Entamoeba invadens
QQPPTHSDNKP

SEQ ID NO: 2898189 - protein, 8 aa, Entamoeba invadens
QQPPYYNT

SEQ ID NO: 2898190 - protein, 4 aa, Entamoeba invadens
QQPQ

SEQ ID NO: 2898191 - protein, 9 aa, Entamoeba invadens
QQPQGAMGG

SEQ ID NO: 2898192 - protein, 24 aa, Entamoeba invadens
QQPQNDIKNRTTDTEGKSKPTELI

SEQ ID NO: 2898193 - protein, 6 aa, Entamoeba invadens
QQPQNF

SEQ ID NO: 2898194 - protein, 14 aa, Entamoeba invadens
QQPQRDRYQLPDDQ

SEQ ID NO: 2898195 - protein, 7 aa, Entamoeba invadens
QQPQSAQ

SEQ ID NO: 2898196 - protein, 27 aa, Entamoeba invadens
QQPQSNSKPFPQSRQDCDTKERRGYKK

SEQ ID NO: 2898197 - protein, 10 aa, Entamoeba invadens
QQPQTNPNYP

SEQ ID NO: 2898198 - protein, 5 aa, Entamoeba invadens
QQPSA

SEQ ID NO: 2898199 - protein, 15 aa, Entamoeba invadens
QQPSARRSIRSQSIN

SEQ ID NO: 2898200 - protein, 13 aa, Entamoeba invadens
QQPSNNNNFFKNG

SEQ ID NO: 2898201 - protein, 7 aa, Entamoeba invadens
QQPSPLL

SEQ ID NO: 2898202 - protein, 14 aa, Entamoeba invadens
QQPSQQQLPDPQQL

SEQ ID NO: 2898203 - protein, 10 aa, Entamoeba invadens
QQPSSPPYEQ

SEQ ID NO: 2898204 - protein, 5 aa, Entamoeba invadens
QQPTI

SEQ ID NO: 2898205 - protein, 18 aa, Entamoeba invadens
QQPTPDIPQTFEEREDIS

SEQ ID NO: 2898206 - protein, 7 aa, Entamoeba invadens
QQPTSGV

SEQ ID NO: 2898207 - protein, 9 aa, Entamoeba invadens
QQPTSKTLV

SEQ ID NO: 2898208 - protein, 12 aa, Entamoeba invadens
QQPTVDEGVDDN

SEQ ID NO: 2898209 - protein, 6 aa, Entamoeba invadens
QQPTVT

SEQ ID NO: 2898210 - protein, 5 aa, Entamoeba invadens
QQPTY

SEQ ID NO: 2898211 - protein, 22 aa, Entamoeba invadens
QQPVISSSKRRKTRSMNNAPME

SEQ ID NO: 2898212 - protein, 35 aa, Entamoeba invadens
QQPVTQQSQQQQTQQNTEQSAQTQHQCQSTPLFPS

SEQ ID NO: 2898213 - protein, 7 aa, Entamoeba invadens
QQPYDEK

SEQ ID NO: 2898214 - protein, 9 aa, Entamoeba invadens
QQQANEVKE

SEQ ID NO: 2898215 - protein, 16 aa, Entamoeba invadens
QQQAPPPPPVQQRGGA

SEQ ID NO: 2898216 - protein, 4 aa, Entamoeba invadens
QQQD

SEQ ID NO: 2898217 - protein, 6 aa, Entamoeba invadens
QQQDDF

SEQ ID NO: 2898218 - protein, 45 aa, Entamoeba invadens
QQQDKEVSRTIRTSTTPGVAPTPIKETKIETKQQPSVHKKPVAPY

SEQ ID NO: 2898219 - protein, 10 aa, Entamoeba invadens
QQQEEEFQKV

SEQ ID NO: 2898220 - protein, 10 aa, Entamoeba invadens
QQQEKEKETI

SEQ ID NO: 2898221 - protein, 6 aa, Entamoeba invadens
QQQEKQ

SEQ ID NO: 2898222 - protein, 17 aa, Entamoeba invadens
QQQGTNVNGQQTQPTAF

SEQ ID NO: 2898223 - protein, 7 aa, Entamoeba invadens
QQQKALD

SEQ ID NO: 2898224 - protein, 5 aa, Entamoeba invadens
QQQKT

SEQ ID NO: 2898225 - protein, 15 aa, Entamoeba invadens
QQQNAQKQESPQQTV

SEQ ID NO: 2898226 - protein, 9 aa, Entamoeba invadens
QQQNINQQI

SEQ ID NO: 2898227 - protein, 9 aa, Entamoeba invadens
QQQNNTEPL

SEQ ID NO: 2898228 - protein, 9 aa, Entamoeba invadens
QQQNSNPLG

SEQ ID NO: 2898229 - protein, 7 aa, Entamoeba invadens
QQQPASM

SEQ ID NO: 2898230 - protein, 5 aa, Entamoeba invadens
QQQPM

SEQ ID NO: 2898231 - protein, 8 aa, Entamoeba invadens
QQQPPPPM

SEQ ID NO: 2898232 - protein, 5 aa, Entamoeba invadens
QQQPQ

SEQ ID NO: 2898233 - protein, 19 aa, Entamoeba invadens
QQQPQKDTEIPVPGSKAET

SEQ ID NO: 2898234 - protein, 12 aa, Entamoeba invadens
QQQPQMGGAFGF

SEQ ID NO: 2898235 - protein, 25 aa, Entamoeba invadens
QQQPSHPQETKFQQQSFQGTQQSMN

SEQ ID NO: 2898236 - protein, 6 aa, Entamoeba invadens
QQQPVG

SEQ ID NO: 2898237 - protein, 4 aa, Entamoeba invadens
QQQQ

SEQ ID NO: 2898238 - protein, 17 aa, Entamoeba invadens
QQQQAQHIQQPQAPQQM

SEQ ID NO: 2898239 - protein, 6 aa, Entamoeba invadens
QQQQDN

SEQ ID NO: 2898240 - protein, 12 aa, Entamoeba invadens
QQQQESASVSSN

SEQ ID NO: 2898241 - protein, 9 aa, Entamoeba invadens
QQQQISPSL

SEQ ID NO: 2898242 - protein, 5 aa, Entamoeba invadens
QQQQM

SEQ ID NO: 2898243 - protein, 9 aa, Entamoeba invadens
QQQQPQMGG

SEQ ID NO: 2898244 - protein, 7 aa, Entamoeba invadens
QQQQPTF

SEQ ID NO: 2898245 - protein, 101 aa, Entamoeba invadens
QQQQQPKPQCFGPPGGPQGVPQSTTLNPPGSTYTPYGQPQMTQSTYTAPPQMQQSTYAAPQMQQPQQQPMSQSTYARPQQYQQPQQQPQQYQMQPQQQPME

SEQ ID NO: 2898246 - protein, 11 aa, Entamoeba invadens
QQQQQQPFSQQ

SEQ ID NO: 2898247 - protein, 7 aa, Entamoeba invadens
QQQQQQQ

SEQ ID NO: 2898248 - protein, 45 aa, Entamoeba invadens
QQQQQRRPVGPKKPRVERSEKIEKKKYEQKKEEKKPEPKKEIEVT

SEQ ID NO: 2898249 - protein, 9 aa, Entamoeba invadens
QQQSDMKRV

SEQ ID NO: 2898250 - protein, 5 aa, Entamoeba invadens
QQQSV

SEQ ID NO: 2898251 - protein, 22 aa, Entamoeba invadens
QQQSVSLPGSSLSPMSSQNGSL

SEQ ID NO: 2898252 - protein, 65 aa, Entamoeba invadens
QQQTAKTTPLPSNTTEQKKKTPPQLPKRKAPPPLPQRGSKPSGGKVGPSGQKRRPPPKDISMKDF

SEQ ID NO: 2898253 - protein, 11 aa, Entamoeba invadens
QQQTENQMKTI

SEQ ID NO: 2898254 - protein, 30 aa, Entamoeba invadens
QQQTESVEPKRSNSEGIRPIEEQPEKKPIV

SEQ ID NO: 2898255 - protein, 19 aa, Entamoeba invadens
QQQTNTQSQPQTCQPQSNQ

SEQ ID NO: 2898256 - protein, 19 aa, Entamoeba invadens
QQQTTPAVVQQTQPKRTDK

SEQ ID NO: 2898257 - protein, 22 aa, Entamoeba invadens
QQQTTVQHQNTQGFSQQKSQTA

SEQ ID NO: 2898258 - protein, 4 aa, Entamoeba invadens
QQQV

SEQ ID NO: 2898259 - protein, 8 aa, Entamoeba invadens
QQQVANTK

SEQ ID NO: 2898260 - protein, 5 aa, Entamoeba invadens
QQQVD

SEQ ID NO: 2898261 - protein, 6 aa, Entamoeba invadens
QQQVET

SEQ ID NO: 2898262 - protein, 6 aa, Entamoeba invadens
QQQVEV

SEQ ID NO: 2898263 - protein, 6 aa, Entamoeba invadens
QQQVNV

SEQ ID NO: 2898264 - protein, 55 aa, Entamoeba invadens
QQQYEYNPSQIPQQPQQYPPYRDDTNKNSFGYPQISQQPNSSTQSYNSPYGANSY

SEQ ID NO: 2898265 - protein, 31 aa, Entamoeba invadens
QQQYQRSASPQYQREQQYTREQDGPQQPKED

SEQ ID NO: 2898266 - protein, 4 aa, Entamoeba invadens
QQRA

SEQ ID NO: 2898267 - protein, 9 aa, Entamoeba invadens
QQRDKDKRI

SEQ ID NO: 2898268 - protein, 7 aa, Entamoeba invadens
QQREENK

SEQ ID NO: 2898269 - protein, 11 aa, Entamoeba invadens
QQREYDAQQLQ

SEQ ID NO: 2898270 - protein, 7 aa, Entamoeba invadens
QQREYSD

SEQ ID NO: 2898271 - protein, 11 aa, Entamoeba invadens
QQRGSQCSSQE

SEQ ID NO: 2898272 - protein, 11 aa, Entamoeba invadens
QQRHNQDSRVA

SEQ ID NO: 2898273 - protein, 5 aa, Entamoeba invadens
QQRIE

SEQ ID NO: 2898274 - protein, 7 aa, Entamoeba invadens
QQRNEFN

SEQ ID NO: 2898275 - protein, 6 aa, Entamoeba invadens
QQRPNE

SEQ ID NO: 2898276 - protein, 17 aa, Entamoeba invadens
QQRPPERRRQKERKTSC

SEQ ID NO: 2898277 - protein, 9 aa, Entamoeba invadens
QQRQNRSVE

SEQ ID NO: 2898278 - protein, 12 aa, Entamoeba invadens
QQRVQYDQEKFS

SEQ ID NO: 2898279 - protein, 22 aa, Entamoeba invadens
QQSDRIEEGDKGQHESFNYTQN

SEQ ID NO: 2898280 - protein, 24 aa, Entamoeba invadens
QQSEAAYKAAVEKANAYNEEMYGE

SEQ ID NO: 2898281 - protein, 6 aa, Entamoeba invadens
QQSEGK

SEQ ID NO: 2898282 - protein, 23 aa, Entamoeba invadens
QQSEKGEEPAQNEKCERGAVSQK

SEQ ID NO: 2898283 - protein, 6 aa, Entamoeba invadens
QQSERL

SEQ ID NO: 2898284 - protein, 15 aa, Entamoeba invadens
QQSFDKKDKKWEKKE

SEQ ID NO: 2898285 - protein, 58 aa, Entamoeba invadens
QQSFDPTDAQIEENVKTGENEQREISNEVGETPKETTSVNNAIAEGTVKRDEKKTDES

SEQ ID NO: 2898286 - protein, 10 aa, Entamoeba invadens
QQSGEDLNTT

SEQ ID NO: 2898287 - protein, 6 aa, Entamoeba invadens
QQSGVS

SEQ ID NO: 2898288 - protein, 7 aa, Entamoeba invadens
QQSIERQ

SEQ ID NO: 2898289 - protein, 13 aa, Entamoeba invadens
QQSINSVETTPFY

SEQ ID NO: 2898290 - protein, 6 aa, Entamoeba invadens
QQSITS

SEQ ID NO: 2898291 - protein, 13 aa, Entamoeba invadens
QQSKNGQNDPERD

SEQ ID NO: 2898292 - protein, 9 aa, Entamoeba invadens
QQSKNKTSL

SEQ ID NO: 2898293 - protein, 13 aa, Entamoeba invadens
QQSNNAAAEEGQI

SEQ ID NO: 2898294 - protein, 12 aa, Entamoeba invadens
QQSQNNENVGKE

SEQ ID NO: 2898295 - protein, 20 aa, Entamoeba invadens
QQSQNNENVRLQDGQKELQT

SEQ ID NO: 2898296 - protein, 10 aa, Entamoeba invadens
QQSQSQQVTN

SEQ ID NO: 2898297 - protein, 20 aa, Entamoeba invadens
QQSRNYPAELRGSEVEFKEG

SEQ ID NO: 2898298 - protein, 5 aa, Entamoeba invadens
QQSSF

SEQ ID NO: 2898299 - protein, 7 aa, Entamoeba invadens
QQSTEEI

SEQ ID NO: 2898300 - protein, 19 aa, Entamoeba invadens
QQSTLNEDPENTLPPSHRI

SEQ ID NO: 2898301 - protein, 8 aa, Entamoeba invadens
QQSTSNPL

SEQ ID NO: 2898302 - protein, 18 aa, Entamoeba invadens
QQSVQPPQTRSTDQPTRQ

SEQ ID NO: 2898303 - protein, 7 aa, Entamoeba invadens
QQTADLG

SEQ ID NO: 2898304 - protein, 8 aa, Entamoeba invadens
QQTAPQQI

SEQ ID NO: 2898305 - protein, 6 aa, Entamoeba invadens
QQTARI

SEQ ID NO: 2898306 - protein, 20 aa, Entamoeba invadens
QQTATKVPQKIEEDSISDVE

SEQ ID NO: 2898307 - protein, 4 aa, Entamoeba invadens
QQTE

SEQ ID NO: 2898308 - protein, 22 aa, Entamoeba invadens
QQTEEEKEKGKAQVEDSEKKIR

SEQ ID NO: 2898309 - protein, 9 aa, Entamoeba invadens
QQTESGTTA

SEQ ID NO: 2898310 - protein, 5 aa, Entamoeba invadens
QQTFY

SEQ ID NO: 2898311 - protein, 7 aa, Entamoeba invadens
QQTGERN

SEQ ID NO: 2898312 - protein, 8 aa, Entamoeba invadens
QQTIKRPD

SEQ ID NO: 2898313 - protein, 8 aa, Entamoeba invadens
QQTIPQKS

SEQ ID NO: 2898314 - protein, 21 aa, Entamoeba invadens
QQTKAQKQNLGFDPSEIHEAE

SEQ ID NO: 2898315 - protein, 17 aa, Entamoeba invadens
QQTKHNKIKSDGQYDKQ

SEQ ID NO: 2898316 - protein, 18 aa, Entamoeba invadens
QQTKKTKKESEEKPLKEI

SEQ ID NO: 2898317 - protein, 16 aa, Entamoeba invadens
QQTKQPNYKAKETQQQ

SEQ ID NO: 2898318 - protein, 4 aa, Entamoeba invadens
QQTL

SEQ ID NO: 2898319 - protein, 8 aa, Entamoeba invadens
QQTLERES

SEQ ID NO: 2898320 - protein, 5 aa, Entamoeba invadens
QQTLG

SEQ ID NO: 2898321 - protein, 9 aa, Entamoeba invadens
QQTNFEKKT

SEQ ID NO: 2898322 - protein, 11 aa, Entamoeba invadens
QQTPFTPSSNM

SEQ ID NO: 2898323 - protein, 19 aa, Entamoeba invadens
QQTPKERPDIAMVIKQLEL

SEQ ID NO: 2898324 - protein, 28 aa, Entamoeba invadens
QQTPPPVSQISQPSIPIQPTQNDENVLS

SEQ ID NO: 2898325 - protein, 8 aa, Entamoeba invadens
QQTPQGVQ

SEQ ID NO: 2898326 - protein, 4 aa, Entamoeba invadens
QQTQ

SEQ ID NO: 2898327 - protein, 8 aa, Entamoeba invadens
QQTQDISL

SEQ ID NO: 2898328 - protein, 5 aa, Entamoeba invadens
QQTQK

SEQ ID NO: 2898329 - protein, 13 aa, Entamoeba invadens
QQTQLNESCEGQQ

SEQ ID NO: 2898330 - protein, 16 aa, Entamoeba invadens
QQTQTGKSKSGSVDFQ

SEQ ID NO: 2898331 - protein, 10 aa, Entamoeba invadens
QQTQTQAPPT

SEQ ID NO: 2898332 - protein, 11 aa, Entamoeba invadens
QQTQTTGVPNT

SEQ ID NO: 2898333 - protein, 5 aa, Entamoeba invadens
QQTRS

SEQ ID NO: 2898334 - protein, 5 aa, Entamoeba invadens
QQTRY

SEQ ID NO: 2898335 - protein, 6 aa, Entamoeba invadens
QQTSDV

SEQ ID NO: 2898336 - protein, 11 aa, Entamoeba invadens
QQTSPQIQQPQ

SEQ ID NO: 2898337 - protein, 5 aa, Entamoeba invadens
QQTSQ

SEQ ID NO: 2898338 - protein, 6 aa, Entamoeba invadens
QQTSSS

SEQ ID NO: 2898339 - protein, 9 aa, Entamoeba invadens
QQTSTPQMR

SEQ ID NO: 2898340 - protein, 13 aa, Entamoeba invadens
QQTTRCQSPSNTT

SEQ ID NO: 2898341 - protein, 6 aa, Entamoeba invadens
QQTTRI

SEQ ID NO: 2898342 - protein, 6 aa, Entamoeba invadens
QQTTTQ

SEQ ID NO: 2898343 - protein, 36 aa, Entamoeba invadens
QQVEADKSKSAARREQEVNAYNQQQQQRDQAEQQRW

SEQ ID NO: 2898344 - protein, 5 aa, Entamoeba invadens
QQVEE

SEQ ID NO: 2898345 - protein, 17 aa, Entamoeba invadens
QQVEEEEIHRKENRCGS

SEQ ID NO: 2898346 - protein, 13 aa, Entamoeba invadens
QQVGGNRHKPYST

SEQ ID NO: 2898347 - protein, 5 aa, Entamoeba invadens
QQVGN

SEQ ID NO: 2898348 - protein, 4 aa, Entamoeba invadens
QQVI

SEQ ID NO: 2898349 - protein, 12 aa, Entamoeba invadens
QQVKDAEDKLKA

SEQ ID NO: 2898350 - protein, 17 aa, Entamoeba invadens
QQVKTEEFYQSREDELK

SEQ ID NO: 2898351 - protein, 5 aa, Entamoeba invadens
QQVQD

SEQ ID NO: 2898352 - protein, 20 aa, Entamoeba invadens
QQVQDLEDRPVGTSNIDQTE

SEQ ID NO: 2898353 - protein, 11 aa, Entamoeba invadens
QQVQDLEERPV

SEQ ID NO: 2898354 - protein, 16 aa, Entamoeba invadens
QQVQTAPAEIQPKPVS

SEQ ID NO: 2898355 - protein, 13 aa, Entamoeba invadens
QQVQTIEKELANM

SEQ ID NO: 2898356 - protein, 5 aa, Entamoeba invadens
QQVSE

SEQ ID NO: 2898357 - protein, 7 aa, Entamoeba invadens
QQVSPEA

SEQ ID NO: 2898358 - protein, 11 aa, Entamoeba invadens
QQVSQPPLQPP

SEQ ID NO: 2898359 - protein, 4 aa, Entamoeba invadens
QQVT

SEQ ID NO: 2898360 - protein, 6 aa, Entamoeba invadens
QQVTSI

SEQ ID NO: 2898361 - protein, 6 aa, Entamoeba invadens
QQVTSL

SEQ ID NO: 2898362 - protein, 27 aa, Entamoeba invadens
QQYAQQTQVQQPPSQSTQLSSQTNPYY

SEQ ID NO: 2898363 - protein, 6 aa, Entamoeba invadens
QQYASE

SEQ ID NO: 2898364 - protein, 14 aa, Entamoeba invadens
QQYGHNKQTCPMIK

SEQ ID NO: 2898365 - protein, 11 aa, Entamoeba invadens
QQYKQSLTSSA

SEQ ID NO: 2898366 - protein, 15 aa, Entamoeba invadens
QQYNAKKRKERDEEV

SEQ ID NO: 2898367 - protein, 13 aa, Entamoeba invadens
QQYPPYQPQMQQQ

SEQ ID NO: 2898368 - protein, 9 aa, Entamoeba invadens
QQYQQQYSQ

SEQ ID NO: 2898369 - protein, 6 aa, Entamoeba invadens
QQYQTQ

SEQ ID NO: 2898370 - protein, 29 aa, Entamoeba invadens
QQYSQQPQQMQYQQTPQQQTYQQPIPQSQ

SEQ ID NO: 2898371 - protein, 5 aa, Entamoeba invadens
QQYTH

SEQ ID NO: 2898372 - protein, 10 aa, Entamoeba invadens
QRAGAGEYSR

SEQ ID NO: 2898373 - protein, 16 aa, Entamoeba invadens
QRANASQQSDQQTPQN

SEQ ID NO: 2898374 - protein, 11 aa, Entamoeba invadens
QRAQDGDATLE

SEQ ID NO: 2898375 - protein, 12 aa, Entamoeba invadens
QRASEKTKVSKK

SEQ ID NO: 2898376 - protein, 12 aa, Entamoeba invadens
QRASNDRNPDAL

SEQ ID NO: 2898377 - protein, 10 aa, Entamoeba invadens
QRAYNQPLNE

SEQ ID NO: 2898378 - protein, 7 aa, Entamoeba invadens
QRCDGRG

SEQ ID NO: 2898379 - protein, 6 aa, Entamoeba invadens
QRCGGQ

SEQ ID NO: 2898380 - protein, 8 aa, Entamoeba invadens
QRDDHLTK

SEQ ID NO: 2898381 - protein, 6 aa, Entamoeba invadens
QRDEES

SEQ ID NO: 2898382 - protein, 5 aa, Entamoeba invadens
QRDEN

SEQ ID NO: 2898383 - protein, 9 aa, Entamoeba invadens
QRDFGSKDI

SEQ ID NO: 2898384 - protein, 6 aa, Entamoeba invadens
QRDGFS

SEQ ID NO: 2898385 - protein, 6 aa, Entamoeba invadens
QRDGNY

SEQ ID NO: 2898386 - protein, 4 aa, Entamoeba invadens
QRDI

SEQ ID NO: 2898387 - protein, 5 aa, Entamoeba invadens
QRDKD

SEQ ID NO: 2898388 - protein, 29 aa, Entamoeba invadens
QRDLEANNTELTELRDKTTKDKKKIANLE

SEQ ID NO: 2898389 - protein, 27 aa, Entamoeba invadens
QRDLEANNTELTELRDRKDKNKIADLE

SEQ ID NO: 2898390 - protein, 14 aa, Entamoeba invadens
QRDLETNNTELTEL

SEQ ID NO: 2898391 - protein, 8 aa, Entamoeba invadens
QRDPQKVA

SEQ ID NO: 2898392 - protein, 5 aa, Entamoeba invadens
QRDQT

SEQ ID NO: 2898393 - protein, 52 aa, Entamoeba invadens
QRDSKDSKEAHDLKEPRLSKDSQEAKEVKDTLESKDCKDLQDLKEQEEMKDP

SEQ ID NO: 2898394 - protein, 7 aa, Entamoeba invadens
QRDSNTM

SEQ ID NO: 2898395 - protein, 7 aa, Entamoeba invadens
QRDSYAS

SEQ ID NO: 2898396 - protein, 8 aa, Entamoeba invadens
QRDVEANN

SEQ ID NO: 2898397 - protein, 8 aa, Entamoeba invadens
QRDYNQPV

SEQ ID NO: 2898398 - protein, 4 aa, Entamoeba invadens
QREA

SEQ ID NO: 2898399 - protein, 17 aa, Entamoeba invadens
QREATTQQMDESPNDNS

SEQ ID NO: 2898400 - protein, 4 aa, Entamoeba invadens
QRED

SEQ ID NO: 2898401 - protein, 11 aa, Entamoeba invadens
QREEKHSPNDL

SEQ ID NO: 2898402 - protein, 24 aa, Entamoeba invadens
QREEQAEKESLDKEIEAEQSRRAT

SEQ ID NO: 2898403 - protein, 13 aa, Entamoeba invadens
QREGKGKLDSPTS

SEQ ID NO: 2898404 - protein, 8 aa, Entamoeba invadens
QREGKLTT

SEQ ID NO: 2898405 - protein, 4 aa, Entamoeba invadens
QREI

SEQ ID NO: 2898406 - protein, 4 aa, Entamoeba invadens
QREK

SEQ ID NO: 2898407 - protein, 28 aa, Entamoeba invadens
QREKHQQRQYTAPQSKTQDYQQYTATTF

SEQ ID NO: 2898408 - protein, 5 aa, Entamoeba invadens
QRELD

SEQ ID NO: 2898409 - protein, 14 aa, Entamoeba invadens
QREMTAKKAEIKEK

SEQ ID NO: 2898410 - protein, 4 aa, Entamoeba invadens
QREN

SEQ ID NO: 2898411 - protein, 10 aa, Entamoeba invadens
QRENVEQTEC

SEQ ID NO: 2898412 - protein, 4 aa, Entamoeba invadens
QREQ

SEQ ID NO: 2898413 - protein, 8 aa, Entamoeba invadens
QREQKTTE

SEQ ID NO: 2898414 - protein, 5 aa, Entamoeba invadens
QREQQ

SEQ ID NO: 2898415 - protein, 4 aa, Entamoeba invadens
QRER

SEQ ID NO: 2898416 - protein, 16 aa, Entamoeba invadens
QRERDEKSSPKRKDVQ

SEQ ID NO: 2898417 - protein, 5 aa, Entamoeba invadens
QRERY

SEQ ID NO: 2898418 - protein, 6 aa, Entamoeba invadens
QRESIK

SEQ ID NO: 2898419 - protein, 7 aa, Entamoeba invadens
QRESIQN

SEQ ID NO: 2898420 - protein, 4 aa, Entamoeba invadens
QRET

SEQ ID NO: 2898421 - protein, 8 aa, Entamoeba invadens
QRETHKRK

SEQ ID NO: 2898422 - protein, 12 aa, Entamoeba invadens
QREVGDDTETPK

SEQ ID NO: 2898423 - protein, 5 aa, Entamoeba invadens
QRFED

SEQ ID NO: 2898424 - protein, 5 aa, Entamoeba invadens
QRFGG

SEQ ID NO: 2898425 - protein, 4 aa, Entamoeba invadens
QRFP

SEQ ID NO: 2898426 - protein, 17 aa, Entamoeba invadens
QRFSADSTELENVEDKK

SEQ ID NO: 2898427 - protein, 14 aa, Entamoeba invadens
QRGDATNEKQEDKP

SEQ ID NO: 2898428 - protein, 10 aa, Entamoeba invadens
QRGDSSDKDE

SEQ ID NO: 2898429 - protein, 6 aa, Entamoeba invadens
QRGEMA

SEQ ID NO: 2898430 - protein, 7 aa, Entamoeba invadens
QRGERPN

SEQ ID NO: 2898431 - protein, 21 aa, Entamoeba invadens
QRGGAGEGKSTKEKQKGKCFI

SEQ ID NO: 2898432 - protein, 5 aa, Entamoeba invadens
QRGGN

SEQ ID NO: 2898433 - protein, 6 aa, Entamoeba invadens
QRGKRK

SEQ ID NO: 2898434 - protein, 4 aa, Entamoeba invadens
QRGM

SEQ ID NO: 2898435 - protein, 4 aa, Entamoeba invadens
QRGN

SEQ ID NO: 2898436 - protein, 7 aa, Entamoeba invadens
QRGSATK

SEQ ID NO: 2898437 - protein, 6 aa, Entamoeba invadens
QRGSKI

SEQ ID NO: 2898438 - protein, 6 aa, Entamoeba invadens
QRHRER

SEQ ID NO: 2898439 - protein, 6 aa, Entamoeba invadens
QRIGMS

SEQ ID NO: 2898440 - protein, 10 aa, Entamoeba invadens
QRIKENKDVE

SEQ ID NO: 2898441 - protein, 5 aa, Entamoeba invadens
QRISN

SEQ ID NO: 2898442 - protein, 9 aa, Entamoeba invadens
QRKAGTVSR

SEQ ID NO: 2898443 - protein, 5 aa, Entamoeba invadens
QRKAT

SEQ ID NO: 2898444 - protein, 4 aa, Entamoeba invadens
QRKD

SEQ ID NO: 2898445 - protein, 9 aa, Entamoeba invadens
QRKDDAPEV

SEQ ID NO: 2898446 - protein, 7 aa, Entamoeba invadens
QRKDGEE

SEQ ID NO: 2898447 - protein, 14 aa, Entamoeba invadens
QRKEEEQGKGETQY

SEQ ID NO: 2898448 - protein, 9 aa, Entamoeba invadens
QRKEHTKEA

SEQ ID NO: 2898449 - protein, 9 aa, Entamoeba invadens
QRKEITDYN

SEQ ID NO: 2898450 - protein, 5 aa, Entamoeba invadens
QRKET

SEQ ID NO: 2898451 - protein, 11 aa, Entamoeba invadens
QRKETGKNENC

SEQ ID NO: 2898452 - protein, 6 aa, Entamoeba invadens
QRKFKN

SEQ ID NO: 2898453 - protein, 5 aa, Entamoeba invadens
QRKGY

SEQ ID NO: 2898454 - protein, 5 aa, Entamoeba invadens
QRKHG

SEQ ID NO: 2898455 - protein, 4 aa, Entamoeba invadens
QRKI

SEQ ID NO: 2898456 - protein, 6 aa, Entamoeba invadens
QRKKAD

SEQ ID NO: 2898457 - protein, 12 aa, Entamoeba invadens
QRKKKSSPVQEE

SEQ ID NO: 2898458 - protein, 16 aa, Entamoeba invadens
QRKKPASQRKKQNNTT

SEQ ID NO: 2898459 - protein, 10 aa, Entamoeba invadens
QRKNEEQALT

SEQ ID NO: 2898460 - protein, 5 aa, Entamoeba invadens
QRKNQ

SEQ ID NO: 2898461 - protein, 33 aa, Entamoeba invadens
QRKQQLKEEQEKKTKTAEEELKSKEAELLQQTN

SEQ ID NO: 2898462 - protein, 5 aa, Entamoeba invadens
QRKQV

SEQ ID NO: 2898463 - protein, 4 aa, Entamoeba invadens
QRKR

SEQ ID NO: 2898464 - protein, 11 aa, Entamoeba invadens
QRKRDSRNEEG

SEQ ID NO: 2898465 - protein, 15 aa, Entamoeba invadens
QRKRRNKVSLDESFS

SEQ ID NO: 2898466 - protein, 9 aa, Entamoeba invadens
QRKRRPTIS

SEQ ID NO: 2898467 - protein, 7 aa, Entamoeba invadens
QRKSDKK

SEQ ID NO: 2898468 - protein, 15 aa, Entamoeba invadens
QRKSEKGKQPLSKNK

SEQ ID NO: 2898469 - protein, 10 aa, Entamoeba invadens
QRKSGIETRS

SEQ ID NO: 2898470 - protein, 8 aa, Entamoeba invadens
QRKVRNSY

SEQ ID NO: 2898471 - protein, 18 aa, Entamoeba invadens
QRKYKAKDIASVTELTKS

SEQ ID NO: 2898472 - protein, 5 aa, Entamoeba invadens
QRLEE

SEQ ID NO: 2898473 - protein, 12 aa, Entamoeba invadens
QRLENRKEFGTK

SEQ ID NO: 2898474 - protein, 53 aa, Entamoeba invadens
QRLKDEEARLKQEAESLKREKEQVMASKNNALQTPLEPPQGLLPPPPGMAPPI

SEQ ID NO: 2898475 - protein, 10 aa, Entamoeba invadens
QRLKNKDSKL

SEQ ID NO: 2898476 - protein, 13 aa, Entamoeba invadens
QRLKNKQSKLNRT

SEQ ID NO: 2898477 - protein, 6 aa, Entamoeba invadens
QRLNDE

SEQ ID NO: 2898478 - protein, 15 aa, Entamoeba invadens
QRLNQKRVANNPQQH

SEQ ID NO: 2898479 - protein, 18 aa, Entamoeba invadens
QRLQETKAQVTGRQDKLK

SEQ ID NO: 2898480 - protein, 4 aa, Entamoeba invadens
QRLS

SEQ ID NO: 2898481 - protein, 13 aa, Entamoeba invadens
QRMEAQRKKEELI

SEQ ID NO: 2898482 - protein, 5 aa, Entamoeba invadens
QRMEK

SEQ ID NO: 2898483 - protein, 7 aa, Entamoeba invadens
QRMPSAN

SEQ ID NO: 2898484 - protein, 8 aa, Entamoeba invadens
QRMRPPRY

SEQ ID NO: 2898485 - protein, 4 aa, Entamoeba invadens
QRMS

SEQ ID NO: 2898486 - protein, 6 aa, Entamoeba invadens
QRMTPE

SEQ ID NO: 2898487 - protein, 6 aa, Entamoeba invadens
QRNDEE

SEQ ID NO: 2898488 - protein, 8 aa, Entamoeba invadens
QRNEGGCD

SEQ ID NO: 2898489 - protein, 9 aa, Entamoeba invadens
QRNESGFPT

SEQ ID NO: 2898490 - protein, 4 aa, Entamoeba invadens
QRNG

SEQ ID NO: 2898491 - protein, 5 aa, Entamoeba invadens
QRNGF

SEQ ID NO: 2898492 - protein, 8 aa, Entamoeba invadens
QRNGSLKP

SEQ ID NO: 2898493 - protein, 10 aa, Entamoeba invadens
QRNKEEKWSE

SEQ ID NO: 2898494 - protein, 23 aa, Entamoeba invadens
QRNKTKQRNEKQSSNKHTKGCKT

SEQ ID NO: 2898495 - protein, 5 aa, Entamoeba invadens
QRNLE

SEQ ID NO: 2898496 - protein, 6 aa, Entamoeba invadens
QRNNDV

SEQ ID NO: 2898497 - protein, 6 aa, Entamoeba invadens
QRNNTY

SEQ ID NO: 2898498 - protein, 11 aa, Entamoeba invadens
QRNQQTSALPE

SEQ ID NO: 2898499 - protein, 6 aa, Entamoeba invadens
QRNSGY

SEQ ID NO: 2898500 - protein, 4 aa, Entamoeba invadens
QRPL

SEQ ID NO: 2898501 - protein, 5 aa, Entamoeba invadens
QRPLN

SEQ ID NO: 2898502 - protein, 4 aa, Entamoeba invadens
QRPR

SEQ ID NO: 2898503 - protein, 5 aa, Entamoeba invadens
QRPRE

SEQ ID NO: 2898504 - protein, 8 aa, Entamoeba invadens
QRPRGEKV

SEQ ID NO: 2898505 - protein, 15 aa, Entamoeba invadens
QRPRNLDGKVETEKF

SEQ ID NO: 2898506 - protein, 8 aa, Entamoeba invadens
QRPRSASV

SEQ ID NO: 2898507 - protein, 20 aa, Entamoeba invadens
QRPSNGELPIPPSFSRKESV

SEQ ID NO: 2898508 - protein, 8 aa, Entamoeba invadens
QRQAKNTS

SEQ ID NO: 2898509 - protein, 12 aa, Entamoeba invadens
QRQATKDAGTIA

SEQ ID NO: 2898510 - protein, 10 aa, Entamoeba invadens
QRQDKVDNAK

SEQ ID NO: 2898511 - protein, 5 aa, Entamoeba invadens
QRQPF

SEQ ID NO: 2898512 - protein, 8 aa, Entamoeba invadens
QRQPMRRQ

SEQ ID NO: 2898513 - protein, 11 aa, Entamoeba invadens
QRQPPRTFRQR

SEQ ID NO: 2898514 - protein, 22 aa, Entamoeba invadens
QRQQSNTQSTQTTLNNTSLMEV

SEQ ID NO: 2898515 - protein, 4 aa, Entamoeba invadens
QRQT

SEQ ID NO: 2898516 - protein, 5 aa, Entamoeba invadens
QRQTY

SEQ ID NO: 2898517 - protein, 10 aa, Entamoeba invadens
QRQYPPQSQY

SEQ ID NO: 2898518 - protein, 5 aa, Entamoeba invadens
QRRAR

SEQ ID NO: 2898519 - protein, 7 aa, Entamoeba invadens
QRRATTD

SEQ ID NO: 2898520 - protein, 8 aa, Entamoeba invadens
QRRDKIAQ

SEQ ID NO: 2898521 - protein, 7 aa, Entamoeba invadens
QRRDLEK

SEQ ID NO: 2898522 - protein, 16 aa, Entamoeba invadens
QRREEVRNSQQSAPVV

SEQ ID NO: 2898523 - protein, 5 aa, Entamoeba invadens
QRREG

SEQ ID NO: 2898524 - protein, 7 aa, Entamoeba invadens
QRRGPKV

SEQ ID NO: 2898525 - protein, 9 aa, Entamoeba invadens
QRRHPRAQS

SEQ ID NO: 2898526 - protein, 17 aa, Entamoeba invadens
QRRPGKDVRKELKNPNG

SEQ ID NO: 2898527 - protein, 14 aa, Entamoeba invadens
QRRQNHNDTSVKSA

SEQ ID NO: 2898528 - protein, 5 aa, Entamoeba invadens
QRRRK

SEQ ID NO: 2898529 - protein, 4 aa, Entamoeba invadens
QRRS

SEQ ID NO: 2898530 - protein, 17 aa, Entamoeba invadens
QRRTASRPQKIPSSVKP

SEQ ID NO: 2898531 - protein, 14 aa, Entamoeba invadens
QRRTSAHSLKTPAR

SEQ ID NO: 2898532 - protein, 4 aa, Entamoeba invadens
QRRV

SEQ ID NO: 2898533 - protein, 6 aa, Entamoeba invadens
QRRVSE

SEQ ID NO: 2898534 - protein, 9 aa, Entamoeba invadens
QRSEEGMRN

SEQ ID NO: 2898535 - protein, 8 aa, Entamoeba invadens
QRSEETHQ

SEQ ID NO: 2898536 - protein, 8 aa, Entamoeba invadens
QRSERQYE

SEQ ID NO: 2898537 - protein, 7 aa, Entamoeba invadens
QRSGTLP

SEQ ID NO: 2898538 - protein, 5 aa, Entamoeba invadens
QRSHH

SEQ ID NO: 2898539 - protein, 8 aa, Entamoeba invadens
QRSKSSLS

SEQ ID NO: 2898540 - protein, 20 aa, Entamoeba invadens
QRSPDEMASTKARRNIAEKS

SEQ ID NO: 2898541 - protein, 15 aa, Entamoeba invadens
QRSQEEQKYQDREDQ

SEQ ID NO: 2898542 - protein, 18 aa, Entamoeba invadens
QRSQNEVETEYKLPDGES

SEQ ID NO: 2898543 - protein, 9 aa, Entamoeba invadens
QRSQYNSSK

SEQ ID NO: 2898544 - protein, 14 aa, Entamoeba invadens
QRSRQSSMNRGTRI

SEQ ID NO: 2898545 - protein, 40 aa, Entamoeba invadens
QRSSASLGNFSKNLKGEKIRPRKRKLKESDFTEGSDKLRN

SEQ ID NO: 2898546 - protein, 11 aa, Entamoeba invadens
QRSSSINLKNS

SEQ ID NO: 2898547 - protein, 12 aa, Entamoeba invadens
QRSTPGAGLDDP

SEQ ID NO: 2898548 - protein, 14 aa, Entamoeba invadens
QRSTRRDAEEGEGI

SEQ ID NO: 2898549 - protein, 26 aa, Entamoeba invadens
QRSYGQQPQQRFQQGGPWQNSAFAYY

SEQ ID NO: 2898550 - protein, 5 aa, Entamoeba invadens
QRTCQ

SEQ ID NO: 2898551 - protein, 16 aa, Entamoeba invadens
QRTDNDVRHQQPYEKA

SEQ ID NO: 2898552 - protein, 6 aa, Entamoeba invadens
QRTENH

SEQ ID NO: 2898553 - protein, 5 aa, Entamoeba invadens
QRTGH

SEQ ID NO: 2898554 - protein, 4 aa, Entamoeba invadens
QRTI

SEQ ID NO: 2898555 - protein, 4 aa, Entamoeba invadens
QRTL

SEQ ID NO: 2898556 - protein, 11 aa, Entamoeba invadens
QRTMTDKERAH

SEQ ID NO: 2898557 - protein, 27 aa, Entamoeba invadens
QRTPEELPQNFTKTEKFDQLEKPAIEN

SEQ ID NO: 2898558 - protein, 5 aa, Entamoeba invadens
QRTSK

SEQ ID NO: 2898559 - protein, 18 aa, Entamoeba invadens
QRTTQTQTTTRTRTNTQV

SEQ ID NO: 2898560 - protein, 4 aa, Entamoeba invadens
QRTY

SEQ ID NO: 2898561 - protein, 23 aa, Entamoeba invadens
QRVEEKQKLEVQNKELQKSINTI

SEQ ID NO: 2898562 - protein, 6 aa, Entamoeba invadens
QRVEGD

SEQ ID NO: 2898563 - protein, 5 aa, Entamoeba invadens
QRVGT

SEQ ID NO: 2898564 - protein, 4 aa, Entamoeba invadens
QRVL

SEQ ID NO: 2898565 - protein, 6 aa, Entamoeba invadens
QRVPQS

SEQ ID NO: 2898566 - protein, 7 aa, Entamoeba invadens
QRVRPTG

SEQ ID NO: 2898567 - protein, 6 aa, Entamoeba invadens
QRVSEE

SEQ ID NO: 2898568 - protein, 5 aa, Entamoeba invadens
QRVTS

SEQ ID NO: 2898569 - protein, 17 aa, Entamoeba invadens
QRYEENGPNVALYWSSD

SEQ ID NO: 2898570 - protein, 5 aa, Entamoeba invadens
QRYFE

SEQ ID NO: 2898571 - protein, 8 aa, Entamoeba invadens
QRYGEIED

SEQ ID NO: 2898572 - protein, 4 aa, Entamoeba invadens
QRYI

SEQ ID NO: 2898573 - protein, 12 aa, Entamoeba invadens
QRYNKDKQCYQV

SEQ ID NO: 2898574 - protein, 21 aa, Entamoeba invadens
QRYNKNKQCYEVKDKNNSSIK

SEQ ID NO: 2898575 - protein, 11 aa, Entamoeba invadens
QRYNKNKQCYQ

SEQ ID NO: 2898576 - protein, 4 aa, Entamoeba invadens
QRYQ

SEQ ID NO: 2898577 - protein, 11 aa, Entamoeba invadens
QRYSKTNEAME

SEQ ID NO: 2898578 - protein, 9 aa, Entamoeba invadens
QRYTESEAI

SEQ ID NO: 2898579 - protein, 5 aa, Entamoeba invadens
QRYTT

SEQ ID NO: 2898580 - protein, 9 aa, Entamoeba invadens
QSAANTGDV

SEQ ID NO: 2898581 - protein, 10 aa, Entamoeba invadens
QSAEERKKPL

SEQ ID NO: 2898582 - protein, 6 aa, Entamoeba invadens
QSAEEV

SEQ ID NO: 2898583 - protein, 6 aa, Entamoeba invadens
QSAFSE

SEQ ID NO: 2898584 - protein, 8 aa, Entamoeba invadens
QSAGPDKM

SEQ ID NO: 2898585 - protein, 6 aa, Entamoeba invadens
QSAGRR

SEQ ID NO: 2898586 - protein, 16 aa, Entamoeba invadens
QSAIDEEKNQKLGGEE

SEQ ID NO: 2898587 - protein, 10 aa, Entamoeba invadens
QSAISQNPAF

SEQ ID NO: 2898588 - protein, 14 aa, Entamoeba invadens
QSAKATPQTNPEEV

SEQ ID NO: 2898589 - protein, 4 aa, Entamoeba invadens
QSAL

SEQ ID NO: 2898590 - protein, 7 aa, Entamoeba invadens
QSALKTV

SEQ ID NO: 2898591 - protein, 7 aa, Entamoeba invadens
QSALNKE

SEQ ID NO: 2898592 - protein, 5 aa, Entamoeba invadens
QSANN

SEQ ID NO: 2898593 - protein, 93 aa, Entamoeba invadens
QSANVQPQQPNVPTKQLPPLPPKQPAVQPQYQQPQYPPQQYPQYSQPQQRQQQPYQQPMTASSYQQCPQRNYASQPQQQQFTQSQRQYPQQQV

SEQ ID NO: 2898594 - protein, 8 aa, Entamoeba invadens
QSAPNVSG

SEQ ID NO: 2898595 - protein, 7 aa, Entamoeba invadens
QSAPTER

SEQ ID NO: 2898596 - protein, 16 aa, Entamoeba invadens
QSASSKPRKFKYESRH

SEQ ID NO: 2898597 - protein, 5 aa, Entamoeba invadens
QSASV

SEQ ID NO: 2898598 - protein, 4 aa, Entamoeba invadens
QSAT

SEQ ID NO: 2898599 - protein, 7 aa, Entamoeba invadens
QSATIDD

SEQ ID NO: 2898600 - protein, 11 aa, Entamoeba invadens
QSAVVAETNSY

SEQ ID NO: 2898601 - protein, 9 aa, Entamoeba invadens
QSCSGVDAN

SEQ ID NO: 2898602 - protein, 5 aa, Entamoeba invadens
QSDDN

SEQ ID NO: 2898603 - protein, 8 aa, Entamoeba invadens
QSDEDEAA

SEQ ID NO: 2898604 - protein, 8 aa, Entamoeba invadens
QSDEPFPK

SEQ ID NO: 2898605 - protein, 9 aa, Entamoeba invadens
QSDGGNAHT

SEQ ID NO: 2898606 - protein, 8 aa, Entamoeba invadens
QSDGKSSF

SEQ ID NO: 2898607 - protein, 6 aa, Entamoeba invadens
QSDGLN

SEQ ID NO: 2898608 - protein, 23 aa, Entamoeba invadens
QSDGSKKKVDVEKMRGKDKSLDK

SEQ ID NO: 2898609 - protein, 18 aa, Entamoeba invadens
QSDGTYYNTTGPTSCKGC

SEQ ID NO: 2898610 - protein, 6 aa, Entamoeba invadens
QSDHKP

SEQ ID NO: 2898611 - protein, 7 aa, Entamoeba invadens
QSDINEK

SEQ ID NO: 2898612 - protein, 28 aa, Entamoeba invadens
QSDISNDVSVDNKSNEQMSKKQSESEVM

SEQ ID NO: 2898613 - protein, 13 aa, Entamoeba invadens
QSDITKKIAQRFV

SEQ ID NO: 2898614 - protein, 14 aa, Entamoeba invadens
QSDKKYPDFVKSVI

SEQ ID NO: 2898615 - protein, 6 aa, Entamoeba invadens
QSDLDS

SEQ ID NO: 2898616 - protein, 9 aa, Entamoeba invadens
QSDNPDLRD

SEQ ID NO: 2898617 - protein, 4 aa, Entamoeba invadens
QSDP

SEQ ID NO: 2898618 - protein, 10 aa, Entamoeba invadens
QSDPEEGFAE

SEQ ID NO: 2898619 - protein, 6 aa, Entamoeba invadens
QSDPSL

SEQ ID NO: 2898620 - protein, 7 aa, Entamoeba invadens
QSDRKEI

SEQ ID NO: 2898621 - protein, 10 aa, Entamoeba invadens
QSDSASPIPQ

SEQ ID NO: 2898622 - protein, 8 aa, Entamoeba invadens
QSDSDTNL

SEQ ID NO: 2898623 - protein, 7 aa, Entamoeba invadens
QSDSPKC

SEQ ID NO: 2898624 - protein, 14 aa, Entamoeba invadens
QSDTRKTSARKKKN

SEQ ID NO: 2898625 - protein, 4 aa, Entamoeba invadens
QSDV

SEQ ID NO: 2898626 - protein, 40 aa, Entamoeba invadens
QSDYNNFDDNQTFSSDTENMSLEQNSDEESDSEFEDTNND

SEQ ID NO: 2898627 - protein, 8 aa, Entamoeba invadens
QSDYNNFN

SEQ ID NO: 2898628 - protein, 17 aa, Entamoeba invadens
QSDYNNFNDNKTFSSDI

SEQ ID NO: 2898629 - protein, 61 aa, Entamoeba invadens
QSDYNNFNDNQTLSSDTENMSLEQNSDEESDSEFEDTNNDYIDQNENDENEEREDEKTIKN

SEQ ID NO: 2898630 - protein, 15 aa, Entamoeba invadens
QSEAEELKKEVTEIQ

SEQ ID NO: 2898631 - protein, 11 aa, Entamoeba invadens
QSEAGAAGAVH

SEQ ID NO: 2898632 - protein, 13 aa, Entamoeba invadens
QSEAIRSKVPTNL

SEQ ID NO: 2898633 - protein, 4 aa, Entamoeba invadens
QSEC

SEQ ID NO: 2898634 - protein, 6 aa, Entamoeba invadens
QSEDCV

SEQ ID NO: 2898635 - protein, 9 aa, Entamoeba invadens
QSEDWTHEP

SEQ ID NO: 2898636 - protein, 4 aa, Entamoeba invadens
QSEE

SEQ ID NO: 2898637 - protein, 16 aa, Entamoeba invadens
QSEHSKISEIKPHKSG

SEQ ID NO: 2898638 - protein, 5 aa, Entamoeba invadens
QSEIK

SEQ ID NO: 2898639 - protein, 12 aa, Entamoeba invadens
QSEKCKDQKENE

SEQ ID NO: 2898640 - protein, 8 aa, Entamoeba invadens
QSEKSTKP

SEQ ID NO: 2898641 - protein, 9 aa, Entamoeba invadens
QSEKTALES

SEQ ID NO: 2898642 - protein, 9 aa, Entamoeba invadens
QSELSESQL

SEQ ID NO: 2898643 - protein, 6 aa, Entamoeba invadens
QSENSI

SEQ ID NO: 2898644 - protein, 6 aa, Entamoeba invadens
QSESAF

SEQ ID NO: 2898645 - protein, 6 aa, Entamoeba invadens
QSESDI

SEQ ID NO: 2898646 - protein, 7 aa, Entamoeba invadens
QSESDIK

SEQ ID NO: 2898647 - protein, 6 aa, Entamoeba invadens
QSESEM

SEQ ID NO: 2898648 - protein, 8 aa, Entamoeba invadens
QSESTKLR

SEQ ID NO: 2898649 - protein, 37 aa, Entamoeba invadens
QSETEDENVQEKIEQPLQHEKQYNDAPSSQKPVEKIP

SEQ ID NO: 2898650 - protein, 10 aa, Entamoeba invadens
QSETFESQST

SEQ ID NO: 2898651 - protein, 5 aa, Entamoeba invadens
QSETR

SEQ ID NO: 2898652 - protein, 12 aa, Entamoeba invadens
QSETTTTENTEL

SEQ ID NO: 2898653 - protein, 6 aa, Entamoeba invadens
QSEVEA

SEQ ID NO: 2898654 - protein, 12 aa, Entamoeba invadens
QSEVSSKVPKTI

SEQ ID NO: 2898655 - protein, 5 aa, Entamoeba invadens
QSEWR

SEQ ID NO: 2898656 - protein, 4 aa, Entamoeba invadens
QSEY

SEQ ID NO: 2898657 - protein, 6 aa, Entamoeba invadens
QSEYDD

SEQ ID NO: 2898658 - protein, 4 aa, Entamoeba invadens
QSFD

SEQ ID NO: 2898659 - protein, 24 aa, Entamoeba invadens
QSFEEKKQEKSLLESEGQKVNESI

SEQ ID NO: 2898660 - protein, 7 aa, Entamoeba invadens
QSFEGCK

SEQ ID NO: 2898661 - protein, 7 aa, Entamoeba invadens
QSFEKTD

SEQ ID NO: 2898662 - protein, 11 aa, Entamoeba invadens
QSFKKDNQGFQ

SEQ ID NO: 2898663 - protein, 6 aa, Entamoeba invadens
QSFSDD

SEQ ID NO: 2898664 - protein, 9 aa, Entamoeba invadens
QSFSKSSKQ

SEQ ID NO: 2898665 - protein, 9 aa, Entamoeba invadens
QSGASSVKR

SEQ ID NO: 2898666 - protein, 6 aa, Entamoeba invadens
QSGCAE

SEQ ID NO: 2898667 - protein, 6 aa, Entamoeba invadens
QSGCSE

SEQ ID NO: 2898668 - protein, 7 aa, Entamoeba invadens
QSGDQEV

SEQ ID NO: 2898669 - protein, 7 aa, Entamoeba invadens
QSGEEVS

SEQ ID NO: 2898670 - protein, 8 aa, Entamoeba invadens
QSGETKDV

SEQ ID NO: 2898671 - protein, 13 aa, Entamoeba invadens
QSGFTISQTDQNY

SEQ ID NO: 2898672 - protein, 5 aa, Entamoeba invadens
QSGGE

SEQ ID NO: 2898673 - protein, 9 aa, Entamoeba invadens
QSGGKQTSI

SEQ ID NO: 2898674 - protein, 4 aa, Entamoeba invadens
QSGI

SEQ ID NO: 2898675 - protein, 18 aa, Entamoeba invadens
QSGKVSNKNTDDGKLKAD

SEQ ID NO: 2898676 - protein, 5 aa, Entamoeba invadens
QSGNK

SEQ ID NO: 2898677 - protein, 6 aa, Entamoeba invadens
QSGNLT

SEQ ID NO: 2898678 - protein, 55 aa, Entamoeba invadens
QSGNSGYSDDTDEKSKTDSKPAPKQETDDTNTDDDDTSDLATTDTDDSSDGSENK

SEQ ID NO: 2898679 - protein, 20 aa, Entamoeba invadens
QSGNSYTLKRGDTELMSVLF

SEQ ID NO: 2898680 - protein, 6 aa, Entamoeba invadens
QSGQPQ

SEQ ID NO: 2898681 - protein, 9 aa, Entamoeba invadens
QSGQPSDLR

SEQ ID NO: 2898682 - protein, 14 aa, Entamoeba invadens
QSGQSFDDDDTDPL

SEQ ID NO: 2898683 - protein, 5 aa, Entamoeba invadens
QSGRL

SEQ ID NO: 2898684 - protein, 11 aa, Entamoeba invadens
QSGSDIGLPGD

SEQ ID NO: 2898685 - protein, 5 aa, Entamoeba invadens
QSGSL

SEQ ID NO: 2898686 - protein, 5 aa, Entamoeba invadens
QSGSN

SEQ ID NO: 2898687 - protein, 7 aa, Entamoeba invadens
QSGSTQV

SEQ ID NO: 2898688 - protein, 5 aa, Entamoeba invadens
QSGTS

SEQ ID NO: 2898689 - protein, 11 aa, Entamoeba invadens
QSGTTNEDKMG

SEQ ID NO: 2898690 - protein, 6 aa, Entamoeba invadens
QSHHEK

SEQ ID NO: 2898691 - protein, 6 aa, Entamoeba invadens
QSHKSA

SEQ ID NO: 2898692 - protein, 7 aa, Entamoeba invadens
QSHKSGK

SEQ ID NO: 2898693 - protein, 7 aa, Entamoeba invadens
QSHPSLD

SEQ ID NO: 2898694 - protein, 5 aa, Entamoeba invadens
QSHSP

SEQ ID NO: 2898695 - protein, 13 aa, Entamoeba invadens
QSHSQSALNASQQ

SEQ ID NO: 2898696 - protein, 8 aa, Entamoeba invadens
QSHTLSEK

SEQ ID NO: 2898697 - protein, 19 aa, Entamoeba invadens
QSHTSQTSTSKLSKEIKKK

SEQ ID NO: 2898698 - protein, 14 aa, Entamoeba invadens
QSHTTEGKENKEYQ

SEQ ID NO: 2898699 - protein, 14 aa, Entamoeba invadens
QSIAEKDEENTKMN

SEQ ID NO: 2898700 - protein, 7 aa, Entamoeba invadens
QSIAGDK

SEQ ID NO: 2898701 - protein, 35 aa, Entamoeba invadens
QSIDEQNREGQNQGNTTGQNRNQQNQRRQDPPPGY

SEQ ID NO: 2898702 - protein, 4 aa, Entamoeba invadens
QSIE

SEQ ID NO: 2898703 - protein, 4 aa, Entamoeba invadens
QSIG

SEQ ID NO: 2898704 - protein, 9 aa, Entamoeba invadens
QSIGAPATQ

SEQ ID NO: 2898705 - protein, 7 aa, Entamoeba invadens
QSIGDGI

SEQ ID NO: 2898706 - protein, 10 aa, Entamoeba invadens
QSIGEPSTQM

SEQ ID NO: 2898707 - protein, 4 aa, Entamoeba invadens
QSIK

SEQ ID NO: 2898708 - protein, 10 aa, Entamoeba invadens
QSIQGEVSQD

SEQ ID NO: 2898709 - protein, 10 aa, Entamoeba invadens
QSIRREKKAF

SEQ ID NO: 2898710 - protein, 4 aa, Entamoeba invadens
QSIS

SEQ ID NO: 2898711 - protein, 5 aa, Entamoeba invadens
QSISE

SEQ ID NO: 2898712 - protein, 13 aa, Entamoeba invadens
QSIYTEENQQDTF

SEQ ID NO: 2898713 - protein, 9 aa, Entamoeba invadens
QSKDDKLNF

SEQ ID NO: 2898714 - protein, 6 aa, Entamoeba invadens
QSKDIE

SEQ ID NO: 2898715 - protein, 8 aa, Entamoeba invadens
QSKDREMD

SEQ ID NO: 2898716 - protein, 7 aa, Entamoeba invadens
QSKDTIN

SEQ ID NO: 2898717 - protein, 4 aa, Entamoeba invadens
QSKE

SEQ ID NO: 2898718 - protein, 13 aa, Entamoeba invadens
QSKEFQDAKQVGI

SEQ ID NO: 2898719 - protein, 9 aa, Entamoeba invadens
QSKELPAEK

SEQ ID NO: 2898720 - protein, 10 aa, Entamoeba invadens
QSKENEVNEL

SEQ ID NO: 2898721 - protein, 6 aa, Entamoeba invadens
QSKEYL

SEQ ID NO: 2898722 - protein, 8 aa, Entamoeba invadens
QSKGKVLQ

SEQ ID NO: 2898723 - protein, 10 aa, Entamoeba invadens
QSKGLPPERL

SEQ ID NO: 2898724 - protein, 5 aa, Entamoeba invadens
QSKGM

SEQ ID NO: 2898725 - protein, 6 aa, Entamoeba invadens
QSKING

SEQ ID NO: 2898726 - protein, 5 aa, Entamoeba invadens
QSKKI

SEQ ID NO: 2898727 - protein, 10 aa, Entamoeba invadens
QSKKKNEEII

SEQ ID NO: 2898728 - protein, 11 aa, Entamoeba invadens
QSKKKTKEDVK

SEQ ID NO: 2898729 - protein, 9 aa, Entamoeba invadens
QSKKSLSVD

SEQ ID NO: 2898730 - protein, 6 aa, Entamoeba invadens
QSKLNN

SEQ ID NO: 2898731 - protein, 7 aa, Entamoeba invadens
QSKLSQL

SEQ ID NO: 2898732 - protein, 21 aa, Entamoeba invadens
QSKNDDAENKYGIKESGGFGD

SEQ ID NO: 2898733 - protein, 7 aa, Entamoeba invadens
QSKNGGF

SEQ ID NO: 2898734 - protein, 15 aa, Entamoeba invadens
QSKNTSRQDKTTFQQ

SEQ ID NO: 2898735 - protein, 11 aa, Entamoeba invadens
QSKNVNDQKEA

SEQ ID NO: 2898736 - protein, 9 aa, Entamoeba invadens
QSKPITKSE

SEQ ID NO: 2898737 - protein, 50 aa, Entamoeba invadens
QSKPPERYESYTKSSYGGASSYTNTYADNDNYDDHYNDNSNDGGSEEDLG

SEQ ID NO: 2898738 - protein, 5 aa, Entamoeba invadens
QSKPQ

SEQ ID NO: 2898739 - protein, 8 aa, Entamoeba invadens
QSKPRPTV

SEQ ID NO: 2898740 - protein, 8 aa, Entamoeba invadens
QSKQARND

SEQ ID NO: 2898741 - protein, 8 aa, Entamoeba invadens
QSKQFEQR

SEQ ID NO: 2898742 - protein, 9 aa, Entamoeba invadens
QSKQKPECT

SEQ ID NO: 2898743 - protein, 6 aa, Entamoeba invadens
QSKQSL

SEQ ID NO: 2898744 - protein, 7 aa, Entamoeba invadens
QSKQSWD

SEQ ID NO: 2898745 - protein, 4 aa, Entamoeba invadens
QSKR

SEQ ID NO: 2898746 - protein, 10 aa, Entamoeba invadens
QSKRNGKKVE

SEQ ID NO: 2898747 - protein, 8 aa, Entamoeba invadens
QSKRPWTI

SEQ ID NO: 2898748 - protein, 8 aa, Entamoeba invadens
QSKSEGMA

SEQ ID NO: 2898749 - protein, 10 aa, Entamoeba invadens
QSKSEKESRF

SEQ ID NO: 2898750 - protein, 7 aa, Entamoeba invadens
QSKSHQV

SEQ ID NO: 2898751 - protein, 7 aa, Entamoeba invadens
QSKSWEA

SEQ ID NO: 2898752 - protein, 7 aa, Entamoeba invadens
QSKTETT

SEQ ID NO: 2898753 - protein, 10 aa, Entamoeba invadens
QSKTKSSDIK

SEQ ID NO: 2898754 - protein, 6 aa, Entamoeba invadens
QSKTLE

SEQ ID NO: 2898755 - protein, 12 aa, Entamoeba invadens
QSKVSEERNRMN

SEQ ID NO: 2898756 - protein, 4 aa, Entamoeba invadens
QSKY

SEQ ID NO: 2898757 - protein, 8 aa, Entamoeba invadens
QSKYKASV

SEQ ID NO: 2898758 - protein, 5 aa, Entamoeba invadens
QSKYQ

SEQ ID NO: 2898759 - protein, 4 aa, Entamoeba invadens
QSLE

SEQ ID NO: 2898760 - protein, 12 aa, Entamoeba invadens
QSLEISSKNAAK

SEQ ID NO: 2898761 - protein, 5 aa, Entamoeba invadens
QSLEK

SEQ ID NO: 2898762 - protein, 4 aa, Entamoeba invadens
QSLK

SEQ ID NO: 2898763 - protein, 10 aa, Entamoeba invadens
QSLNSSANES

SEQ ID NO: 2898764 - protein, 5 aa, Entamoeba invadens
QSLPE

SEQ ID NO: 2898765 - protein, 6 aa, Entamoeba invadens
QSLPES

SEQ ID NO: 2898766 - protein, 5 aa, Entamoeba invadens
QSLPS

SEQ ID NO: 2898767 - protein, 13 aa, Entamoeba invadens
QSLPSSPLKVPPH

SEQ ID NO: 2898768 - protein, 6 aa, Entamoeba invadens
QSLQGT

SEQ ID NO: 2898769 - protein, 4 aa, Entamoeba invadens
QSLS

SEQ ID NO: 2898770 - protein, 17 aa, Entamoeba invadens
QSLSDEKETKTPKRVTS

SEQ ID NO: 2898771 - protein, 6 aa, Entamoeba invadens
QSLTKQ

SEQ ID NO: 2898772 - protein, 23 aa, Entamoeba invadens
QSLYDRKKKTITESPEFKKEEED

SEQ ID NO: 2898773 - protein, 9 aa, Entamoeba invadens
QSMERTNEY

SEQ ID NO: 2898774 - protein, 48 aa, Entamoeba invadens
QSMNDDQTQQTAQADAQNQNTTSTNQTHDTQPPSFGGWGDQASQLQWK

SEQ ID NO: 2898775 - protein, 6 aa, Entamoeba invadens
QSMNEY

SEQ ID NO: 2898776 - protein, 22 aa, Entamoeba invadens
QSMSPPSDTTSSKCYSAFNVNA

SEQ ID NO: 2898777 - protein, 18 aa, Entamoeba invadens
QSNDDKTCQEKSDIRKEE

SEQ ID NO: 2898778 - protein, 11 aa, Entamoeba invadens
QSNDKQEKENL

SEQ ID NO: 2898779 - protein, 10 aa, Entamoeba invadens
QSNDTLKKKN

SEQ ID NO: 2898780 - protein, 5 aa, Entamoeba invadens
QSNED

SEQ ID NO: 2898781 - protein, 10 aa, Entamoeba invadens
QSNEQTQTQQ

SEQ ID NO: 2898782 - protein, 10 aa, Entamoeba invadens
QSNESKMCEP

SEQ ID NO: 2898783 - protein, 79 aa, Entamoeba invadens
QSNFPTTPKEKVNPSPRKADERQSPSPTPKKKDKKLQKDDETKPKSQGTTEPQTPKKKDKKNESRKETPIEKESKKKVV

SEQ ID NO: 2898784 - protein, 9 aa, Entamoeba invadens
QSNIDTPKY

SEQ ID NO: 2898785 - protein, 10 aa, Entamoeba invadens
QSNKEKITTA

SEQ ID NO: 2898786 - protein, 11 aa, Entamoeba invadens
QSNNKESFETK

SEQ ID NO: 2898787 - protein, 5 aa, Entamoeba invadens
QSNNL

SEQ ID NO: 2898788 - protein, 8 aa, Entamoeba invadens
QSNNTQLE

SEQ ID NO: 2898789 - protein, 12 aa, Entamoeba invadens
QSNNYKQTEDEY

SEQ ID NO: 2898790 - protein, 8 aa, Entamoeba invadens
QSNSKDLR

SEQ ID NO: 2898791 - protein, 4 aa, Entamoeba invadens
QSNT

SEQ ID NO: 2898792 - protein, 9 aa, Entamoeba invadens
QSNTGIQDL

SEQ ID NO: 2898793 - protein, 34 aa, Entamoeba invadens
QSNTISSSNQGNQNIPNPHTNRSNTGSRPTPVDL

SEQ ID NO: 2898794 - protein, 5 aa, Entamoeba invadens
QSNTL

SEQ ID NO: 2898795 - protein, 6 aa, Entamoeba invadens
QSNTSY

SEQ ID NO: 2898796 - protein, 8 aa, Entamoeba invadens
QSNTVEDV

SEQ ID NO: 2898797 - protein, 7 aa, Entamoeba invadens
QSNVGKT

SEQ ID NO: 2898798 - protein, 4 aa, Entamoeba invadens
QSPA

SEQ ID NO: 2898799 - protein, 15 aa, Entamoeba invadens
QSPDKQIESSKPNMR

SEQ ID NO: 2898800 - protein, 16 aa, Entamoeba invadens
QSPDYNGETESEWAKK

SEQ ID NO: 2898801 - protein, 17 aa, Entamoeba invadens
QSPEAPPRKSSFVGTPE

SEQ ID NO: 2898802 - protein, 6 aa, Entamoeba invadens
QSPELS

SEQ ID NO: 2898803 - protein, 9 aa, Entamoeba invadens
QSPHTTQQK

SEQ ID NO: 2898804 - protein, 6 aa, Entamoeba invadens
QSPIPK

SEQ ID NO: 2898805 - protein, 7 aa, Entamoeba invadens
QSPKEAE

SEQ ID NO: 2898806 - protein, 21 aa, Entamoeba invadens
QSPKEDSKNTINNSKNTITDS

SEQ ID NO: 2898807 - protein, 19 aa, Entamoeba invadens
QSPKKKEKREKDSKKIQAN

SEQ ID NO: 2898808 - protein, 10 aa, Entamoeba invadens
QSPKKSNFDE

SEQ ID NO: 2898809 - protein, 9 aa, Entamoeba invadens
QSPKNNFGV

SEQ ID NO: 2898810 - protein, 6 aa, Entamoeba invadens
QSPKTI

SEQ ID NO: 2898811 - protein, 23 aa, Entamoeba invadens
QSPLPLGGEKRRTAPLSADIGGT

SEQ ID NO: 2898812 - protein, 12 aa, Entamoeba invadens
QSPNAEIRKRAA

SEQ ID NO: 2898813 - protein, 8 aa, Entamoeba invadens
QSPNDLQK

SEQ ID NO: 2898814 - protein, 14 aa, Entamoeba invadens
QSPNYANFADSKSK

SEQ ID NO: 2898815 - protein, 15 aa, Entamoeba invadens
QSPPSQVSTPFNKDS

SEQ ID NO: 2898816 - protein, 15 aa, Entamoeba invadens
QSPQGKAKFVTKSET

SEQ ID NO: 2898817 - protein, 4 aa, Entamoeba invadens
QSPR

SEQ ID NO: 2898818 - protein, 9 aa, Entamoeba invadens
QSPRANKTV

SEQ ID NO: 2898819 - protein, 7 aa, Entamoeba invadens
QSPRFSL

SEQ ID NO: 2898820 - protein, 5 aa, Entamoeba invadens
QSPRN

SEQ ID NO: 2898821 - protein, 20 aa, Entamoeba invadens
QSPRTPKTKVESVDKSNEIK

SEQ ID NO: 2898822 - protein, 7 aa, Entamoeba invadens
QSPSQNL

SEQ ID NO: 2898823 - protein, 8 aa, Entamoeba invadens
QSPSRNET

SEQ ID NO: 2898824 - protein, 6 aa, Entamoeba invadens
QSPSYS

SEQ ID NO: 2898825 - protein, 7 aa, Entamoeba invadens
QSPTHIK

SEQ ID NO: 2898826 - protein, 8 aa, Entamoeba invadens
QSPVCGPM

SEQ ID NO: 2898827 - protein, 5 aa, Entamoeba invadens
QSPYE

SEQ ID NO: 2898828 - protein, 6 aa, Entamoeba invadens
QSPYTF

SEQ ID NO: 2898829 - protein, 9 aa, Entamoeba invadens
QSQAETSKR

SEQ ID NO: 2898830 - protein, 11 aa, Entamoeba invadens
QSQAFSREKSR

SEQ ID NO: 2898831 - protein, 17 aa, Entamoeba invadens
QSQCRESEKVEKVENQV

SEQ ID NO: 2898832 - protein, 4 aa, Entamoeba invadens
QSQD

SEQ ID NO: 2898833 - protein, 5 aa, Entamoeba invadens
QSQEA

SEQ ID NO: 2898834 - protein, 4 aa, Entamoeba invadens
QSQF

SEQ ID NO: 2898835 - protein, 6 aa, Entamoeba invadens
QSQGAW

SEQ ID NO: 2898836 - protein, 6 aa, Entamoeba invadens
QSQHER

SEQ ID NO: 2898837 - protein, 4 aa, Entamoeba invadens
QSQI

SEQ ID NO: 2898838 - protein, 8 aa, Entamoeba invadens
QSQISDKS

SEQ ID NO: 2898839 - protein, 4 aa, Entamoeba invadens
QSQK

SEQ ID NO: 2898840 - protein, 11 aa, Entamoeba invadens
QSQLQERNDEI

SEQ ID NO: 2898841 - protein, 4 aa, Entamoeba invadens
QSQN

SEQ ID NO: 2898842 - protein, 10 aa, Entamoeba invadens
QSQPQTYPPV

SEQ ID NO: 2898843 - protein, 9 aa, Entamoeba invadens
QSQSGSGKT

SEQ ID NO: 2898844 - protein, 9 aa, Entamoeba invadens
QSQSQEDQD

SEQ ID NO: 2898845 - protein, 6 aa, Entamoeba invadens
QSQSSC

SEQ ID NO: 2898846 - protein, 7 aa, Entamoeba invadens
QSQSTLE

SEQ ID NO: 2898847 - protein, 9 aa, Entamoeba invadens
QSQTGSGKT

SEQ ID NO: 2898848 - protein, 11 aa, Entamoeba invadens
QSQVAPKSSHV

SEQ ID NO: 2898849 - protein, 10 aa, Entamoeba invadens
QSQYTQSTVE

SEQ ID NO: 2898850 - protein, 18 aa, Entamoeba invadens
QSRDRKYNITEDQVEDMK

SEQ ID NO: 2898851 - protein, 4 aa, Entamoeba invadens
QSRE

SEQ ID NO: 2898852 - protein, 15 aa, Entamoeba invadens
QSRKRKTRKRTKKSV

SEQ ID NO: 2898853 - protein, 5 aa, Entamoeba invadens
QSRLE

SEQ ID NO: 2898854 - protein, 7 aa, Entamoeba invadens
QSRLESS

SEQ ID NO: 2898855 - protein, 8 aa, Entamoeba invadens
QSRNRRMA

SEQ ID NO: 2898856 - protein, 12 aa, Entamoeba invadens
QSRPDTPIPPYS

SEQ ID NO: 2898857 - protein, 22 aa, Entamoeba invadens
QSSAQLNSTSKSFRDSSLSSEC

SEQ ID NO: 2898858 - protein, 9 aa, Entamoeba invadens
QSSDKKKVV

SEQ ID NO: 2898859 - protein, 13 aa, Entamoeba invadens
QSSDVIEGETKEV

SEQ ID NO: 2898860 - protein, 6 aa, Entamoeba invadens
QSSDYA

SEQ ID NO: 2898861 - protein, 17 aa, Entamoeba invadens
QSSEDISKQMSGPFKKK

SEQ ID NO: 2898862 - protein, 20 aa, Entamoeba invadens
QSSEEKKLKEEVSKGGANMK

SEQ ID NO: 2898863 - protein, 12 aa, Entamoeba invadens
QSSEKMKTTKCG

SEQ ID NO: 2898864 - protein, 9 aa, Entamoeba invadens
QSSEKNFDR

SEQ ID NO: 2898865 - protein, 4 aa, Entamoeba invadens
QSSF

SEQ ID NO: 2898866 - protein, 6 aa, Entamoeba invadens
QSSFNR

SEQ ID NO: 2898867 - protein, 13 aa, Entamoeba invadens
QSSFSGVDKSSLD

SEQ ID NO: 2898868 - protein, 6 aa, Entamoeba invadens
QSSFTN

SEQ ID NO: 2898869 - protein, 4 aa, Entamoeba invadens
QSSG

SEQ ID NO: 2898870 - protein, 6 aa, Entamoeba invadens
QSSGKV

SEQ ID NO: 2898871 - protein, 6 aa, Entamoeba invadens
QSSGPI

SEQ ID NO: 2898872 - protein, 4 aa, Entamoeba invadens
QSSH

SEQ ID NO: 2898873 - protein, 17 aa, Entamoeba invadens
QSSMKTKETSKKSVSIS

SEQ ID NO: 2898874 - protein, 9 aa, Entamoeba invadens
QSSMSPDMS

SEQ ID NO: 2898875 - protein, 7 aa, Entamoeba invadens
QSSNEDN

SEQ ID NO: 2898876 - protein, 8 aa, Entamoeba invadens
QSSNKDNV

SEQ ID NO: 2898877 - protein, 7 aa, Entamoeba invadens
QSSNKSV

SEQ ID NO: 2898878 - protein, 6 aa, Entamoeba invadens
QSSNTI

SEQ ID NO: 2898879 - protein, 5 aa, Entamoeba invadens
QSSPA

SEQ ID NO: 2898880 - protein, 7 aa, Entamoeba invadens
QSSPLRN

SEQ ID NO: 2898881 - protein, 4 aa, Entamoeba invadens
QSSQ

SEQ ID NO: 2898882 - protein, 13 aa, Entamoeba invadens
QSSQNKKFSLSDS

SEQ ID NO: 2898883 - protein, 15 aa, Entamoeba invadens
QSSRGSMERHNSYSP

SEQ ID NO: 2898884 - protein, 7 aa, Entamoeba invadens
QSSSFKE

SEQ ID NO: 2898885 - protein, 11 aa, Entamoeba invadens
QSSTEFSSRVP

SEQ ID NO: 2898886 - protein, 13 aa, Entamoeba invadens
QSSTNGLKNEVNG

SEQ ID NO: 2898887 - protein, 19 aa, Entamoeba invadens
QSSVPKRSDSDGEYSPREH

SEQ ID NO: 2898888 - protein, 6 aa, Entamoeba invadens
QSTASV

SEQ ID NO: 2898889 - protein, 9 aa, Entamoeba invadens
QSTDENEKV

SEQ ID NO: 2898890 - protein, 6 aa, Entamoeba invadens
QSTDHP

SEQ ID NO: 2898891 - protein, 20 aa, Entamoeba invadens
QSTDIPEEAMENRKRPSSDL

SEQ ID NO: 2898892 - protein, 16 aa, Entamoeba invadens
QSTDKTLKQTGPSPDL

SEQ ID NO: 2898893 - protein, 10 aa, Entamoeba invadens
QSTDQTTNFK

SEQ ID NO: 2898894 - protein, 10 aa, Entamoeba invadens
QSTETTPEFK

SEQ ID NO: 2898895 - protein, 5 aa, Entamoeba invadens
QSTFG

SEQ ID NO: 2898896 - protein, 4 aa, Entamoeba invadens
QSTG

SEQ ID NO: 2898897 - protein, 11 aa, Entamoeba invadens
QSTGKNNDKYD

SEQ ID NO: 2898898 - protein, 22 aa, Entamoeba invadens
QSTHPEEKKQQTDLPLNNSSRT

SEQ ID NO: 2898899 - protein, 10 aa, Entamoeba invadens
QSTINKDNAT

SEQ ID NO: 2898900 - protein, 11 aa, Entamoeba invadens
QSTIQGDNEQF

SEQ ID NO: 2898901 - protein, 8 aa, Entamoeba invadens
QSTIRGNN

SEQ ID NO: 2898902 - protein, 6 aa, Entamoeba invadens
QSTKAD

SEQ ID NO: 2898903 - protein, 17 aa, Entamoeba invadens
QSTKSTVHRLGGSQGLA

SEQ ID NO: 2898904 - protein, 10 aa, Entamoeba invadens
QSTNSTQIAP

SEQ ID NO: 2898905 - protein, 10 aa, Entamoeba invadens
QSTPDEICTT

SEQ ID NO: 2898906 - protein, 6 aa, Entamoeba invadens
QSTPKV

SEQ ID NO: 2898907 - protein, 7 aa, Entamoeba invadens
QSTPNDT

SEQ ID NO: 2898908 - protein, 10 aa, Entamoeba invadens
QSTPQPSLSL

SEQ ID NO: 2898909 - protein, 5 aa, Entamoeba invadens
QSTRF

SEQ ID NO: 2898910 - protein, 9 aa, Entamoeba invadens
QSTSLQPEL

SEQ ID NO: 2898911 - protein, 15 aa, Entamoeba invadens
QSTSNKRFGTESAEM

SEQ ID NO: 2898912 - protein, 7 aa, Entamoeba invadens
QSTSSIA

SEQ ID NO: 2898913 - protein, 4 aa, Entamoeba invadens
QSTT

SEQ ID NO: 2898914 - protein, 6 aa, Entamoeba invadens
QSTTTS

SEQ ID NO: 2898915 - protein, 8 aa, Entamoeba invadens
QSTTYAET

SEQ ID NO: 2898916 - protein, 21 aa, Entamoeba invadens
QSTVTTGLSRDRKRASRSCES

SEQ ID NO: 2898917 - protein, 4 aa, Entamoeba invadens
QSVD

SEQ ID NO: 2898918 - protein, 9 aa, Entamoeba invadens
QSVGRRAQM

SEQ ID NO: 2898919 - protein, 4 aa, Entamoeba invadens
QSVK

SEQ ID NO: 2898920 - protein, 12 aa, Entamoeba invadens
QSVKRKEKPFAG

SEQ ID NO: 2898921 - protein, 7 aa, Entamoeba invadens
QSVPQSI

SEQ ID NO: 2898922 - protein, 30 aa, Entamoeba invadens
QSVPQTTSDAFKPSNKENTEKMKKSEFSLT

SEQ ID NO: 2898923 - protein, 16 aa, Entamoeba invadens
QSVQDNSFKDSEEKVE

SEQ ID NO: 2898924 - protein, 6 aa, Entamoeba invadens
QSVQNK

SEQ ID NO: 2898925 - protein, 4 aa, Entamoeba invadens
QSVS

SEQ ID NO: 2898926 - protein, 7 aa, Entamoeba invadens
QSVSNDN

SEQ ID NO: 2898927 - protein, 6 aa, Entamoeba invadens
QSVTEE

SEQ ID NO: 2898928 - protein, 13 aa, Entamoeba invadens
QSVTNIPNITSGS

SEQ ID NO: 2898929 - protein, 12 aa, Entamoeba invadens
QSVVENANTSCQ

SEQ ID NO: 2898930 - protein, 7 aa, Entamoeba invadens
QSVVGEE

SEQ ID NO: 2898931 - protein, 18 aa, Entamoeba invadens
QSVVPSSPEIQSKKYTPL

SEQ ID NO: 2898932 - protein, 4 aa, Entamoeba invadens
QSYD

SEQ ID NO: 2898933 - protein, 9 aa, Entamoeba invadens
QSYLSPQQV

SEQ ID NO: 2898934 - protein, 5 aa, Entamoeba invadens
QSYND

SEQ ID NO: 2898935 - protein, 11 aa, Entamoeba invadens
QSYNDSNTPDQ

SEQ ID NO: 2898936 - protein, 6 aa, Entamoeba invadens
QSYSTD

SEQ ID NO: 2898937 - protein, 10 aa, Entamoeba invadens
QSYTQYGGLR

SEQ ID NO: 2898938 - protein, 9 aa, Entamoeba invadens
QSYYPDPNY

SEQ ID NO: 2898939 - protein, 10 aa, Entamoeba invadens
QTAAKTQVIG

SEQ ID NO: 2898940 - protein, 9 aa, Entamoeba invadens
QTAARTQMV

SEQ ID NO: 2898941 - protein, 8 aa, Entamoeba invadens
QTADPERL

SEQ ID NO: 2898942 - protein, 5 aa, Entamoeba invadens
QTAEK

SEQ ID NO: 2898943 - protein, 9 aa, Entamoeba invadens
QTAFRRYEK

SEQ ID NO: 2898944 - protein, 6 aa, Entamoeba invadens
QTALNS

SEQ ID NO: 2898945 - protein, 7 aa, Entamoeba invadens
QTANDYL

SEQ ID NO: 2898946 - protein, 5 aa, Entamoeba invadens
QTANV

SEQ ID NO: 2898947 - protein, 4 aa, Entamoeba invadens
QTAP

SEQ ID NO: 2898948 - protein, 11 aa, Entamoeba invadens
QTAPATPNISG

SEQ ID NO: 2898949 - protein, 78 aa, Entamoeba invadens
QTAQNNSSPEKSEKDEKKEKHTTPPKPAGVAPPLEKGKKEKSRDSKGKTDDVKAAEKEKEKTEKEKKKEKKKDKKKKI

SEQ ID NO: 2898950 - protein, 5 aa, Entamoeba invadens
QTAQT

SEQ ID NO: 2898951 - protein, 36 aa, Entamoeba invadens
QTARENVTTQLRNEENEKCEHQSPSSSQSNPVDHNQ

SEQ ID NO: 2898952 - protein, 5 aa, Entamoeba invadens
QTART

SEQ ID NO: 2898953 - protein, 8 aa, Entamoeba invadens
QTASDLTE

SEQ ID NO: 2898954 - protein, 11 aa, Entamoeba invadens
QTASEETTNKI

SEQ ID NO: 2898955 - protein, 16 aa, Entamoeba invadens
QTATKWSKKKAKKFIE

SEQ ID NO: 2898956 - protein, 16 aa, Entamoeba invadens
QTATKWSKKKAKKFSE

SEQ ID NO: 2898957 - protein, 8 aa, Entamoeba invadens
QTATSTCP

SEQ ID NO: 2898958 - protein, 9 aa, Entamoeba invadens
QTAYTNGEY

SEQ ID NO: 2898959 - protein, 11 aa, Entamoeba invadens
QTCATDGTRSC

SEQ ID NO: 2898960 - protein, 5 aa, Entamoeba invadens
QTCCG

SEQ ID NO: 2898961 - protein, 9 aa, Entamoeba invadens
QTCDGGLNT

SEQ ID NO: 2898962 - protein, 8 aa, Entamoeba invadens
QTCENNEE

SEQ ID NO: 2898963 - protein, 34 aa, Entamoeba invadens
QTCGKGEKRVAKQRVRNDTGAPALTTPDKTSAAM

SEQ ID NO: 2898964 - protein, 10 aa, Entamoeba invadens
QTCKEPELNA

SEQ ID NO: 2898965 - protein, 7 aa, Entamoeba invadens
QTCSDGP

SEQ ID NO: 2898966 - protein, 15 aa, Entamoeba invadens
QTCTQTSSQPFSQSI

SEQ ID NO: 2898967 - protein, 6 aa, Entamoeba invadens
QTDAAK

SEQ ID NO: 2898968 - protein, 10 aa, Entamoeba invadens
QTDAKNVEDK

SEQ ID NO: 2898969 - protein, 8 aa, Entamoeba invadens
QTDALREK

SEQ ID NO: 2898970 - protein, 6 aa, Entamoeba invadens
QTDDEG

SEQ ID NO: 2898971 - protein, 5 aa, Entamoeba invadens
QTDDV

SEQ ID NO: 2898972 - protein, 7 aa, Entamoeba invadens
QTDEDEL

SEQ ID NO: 2898973 - protein, 7 aa, Entamoeba invadens
QTDEELK

SEQ ID NO: 2898974 - protein, 18 aa, Entamoeba invadens
QTDEQYKAYPSDPSEISQ

SEQ ID NO: 2898975 - protein, 28 aa, Entamoeba invadens
QTDESFGNQIARKSTENNNEENTENKRV

SEQ ID NO: 2898976 - protein, 6 aa, Entamoeba invadens
QTDEST

SEQ ID NO: 2898977 - protein, 4 aa, Entamoeba invadens
QTDG

SEQ ID NO: 2898978 - protein, 12 aa, Entamoeba invadens
QTDGNLCPGEYA

SEQ ID NO: 2898979 - protein, 9 aa, Entamoeba invadens
QTDGTYEKN

SEQ ID NO: 2898980 - protein, 5 aa, Entamoeba invadens
QTDIR

SEQ ID NO: 2898981 - protein, 10 aa, Entamoeba invadens
QTDKGIAGNY

SEQ ID NO: 2898982 - protein, 4 aa, Entamoeba invadens
QTDL

SEQ ID NO: 2898983 - protein, 15 aa, Entamoeba invadens
QTDLRNEKDKEHISK

SEQ ID NO: 2898984 - protein, 7 aa, Entamoeba invadens
QTDPKSG

SEQ ID NO: 2898985 - protein, 5 aa, Entamoeba invadens
QTDPL

SEQ ID NO: 2898986 - protein, 5 aa, Entamoeba invadens
QTDPS

SEQ ID NO: 2898987 - protein, 5 aa, Entamoeba invadens
QTDQY

SEQ ID NO: 2898988 - protein, 9 aa, Entamoeba invadens
QTDSMEEEV

SEQ ID NO: 2898989 - protein, 8 aa, Entamoeba invadens
QTDTEPTL

SEQ ID NO: 2898990 - protein, 15 aa, Entamoeba invadens
QTDTVKYDKPCSEKT

SEQ ID NO: 2898991 - protein, 4 aa, Entamoeba invadens
QTDV

SEQ ID NO: 2898992 - protein, 6 aa, Entamoeba invadens
QTDVEP

SEQ ID NO: 2898993 - protein, 7 aa, Entamoeba invadens
QTDVNKN

SEQ ID NO: 2898994 - protein, 6 aa, Entamoeba invadens
QTDVQS

SEQ ID NO: 2898995 - protein, 8 aa, Entamoeba invadens
QTEASLDQ

SEQ ID NO: 2898996 - protein, 7 aa, Entamoeba invadens
QTEDAGQ

SEQ ID NO: 2898997 - protein, 6 aa, Entamoeba invadens
QTEDIT

SEQ ID NO: 2898998 - protein, 5 aa, Entamoeba invadens
QTEEI

SEQ ID NO: 2898999 - protein, 9 aa, Entamoeba invadens
QTEENDKTA

SEQ ID NO: 2899000 - protein, 9 aa, Entamoeba invadens
QTEENTYEE

SEQ ID NO: 2899001 - protein, 9 aa, Entamoeba invadens
QTEENTYEQ

SEQ ID NO: 2899002 - protein, 6 aa, Entamoeba invadens
QTEETL

SEQ ID NO: 2899003 - protein, 7 aa, Entamoeba invadens
QTEEYQR

SEQ ID NO: 2899004 - protein, 24 aa, Entamoeba invadens
QTEFERKTSEDETLKQEKEQLNAE

SEQ ID NO: 2899005 - protein, 8 aa, Entamoeba invadens
QTEGFSGS

SEQ ID NO: 2899006 - protein, 6 aa, Entamoeba invadens
QTEGSV

SEQ ID NO: 2899007 - protein, 13 aa, Entamoeba invadens
QTEIEEENDKKDM

SEQ ID NO: 2899008 - protein, 4 aa, Entamoeba invadens
QTEK

SEQ ID NO: 2899009 - protein, 9 aa, Entamoeba invadens
QTEKESQTQ

SEQ ID NO: 2899010 - protein, 12 aa, Entamoeba invadens
QTEKGSEKDTTR

SEQ ID NO: 2899011 - protein, 5 aa, Entamoeba invadens
QTEKK

SEQ ID NO: 2899012 - protein, 10 aa, Entamoeba invadens
QTEKLAKGEV

SEQ ID NO: 2899013 - protein, 7 aa, Entamoeba invadens
QTELPTT

SEQ ID NO: 2899014 - protein, 17 aa, Entamoeba invadens
QTELTKTAERILTIVKM

SEQ ID NO: 2899015 - protein, 7 aa, Entamoeba invadens
QTELTNS

SEQ ID NO: 2899016 - protein, 4 aa, Entamoeba invadens
QTEN

SEQ ID NO: 2899017 - protein, 7 aa, Entamoeba invadens
QTENDAL

SEQ ID NO: 2899018 - protein, 10 aa, Entamoeba invadens
QTENDELRKQ

SEQ ID NO: 2899019 - protein, 14 aa, Entamoeba invadens
QTENDKTYDAKKND

SEQ ID NO: 2899020 - protein, 8 aa, Entamoeba invadens
QTENGHTM

SEQ ID NO: 2899021 - protein, 6 aa, Entamoeba invadens
QTENKK

SEQ ID NO: 2899022 - protein, 7 aa, Entamoeba invadens
QTENLEK

SEQ ID NO: 2899023 - protein, 4 aa, Entamoeba invadens
QTEQ

SEQ ID NO: 2899024 - protein, 15 aa, Entamoeba invadens
QTEQQNEKDNATELY

SEQ ID NO: 2899025 - protein, 4 aa, Entamoeba invadens
QTER

SEQ ID NO: 2899026 - protein, 6 aa, Entamoeba invadens
QTERED

SEQ ID NO: 2899027 - protein, 11 aa, Entamoeba invadens
QTESDKSFSTN

SEQ ID NO: 2899028 - protein, 9 aa, Entamoeba invadens
QTESKSAMK

SEQ ID NO: 2899029 - protein, 33 aa, Entamoeba invadens
QTESSQNSQKLTEKVEKSPTKKNSIVEKSEVEK

SEQ ID NO: 2899030 - protein, 21 aa, Entamoeba invadens
QTETFPPVGSQTSNETEDKKT

SEQ ID NO: 2899031 - protein, 5 aa, Entamoeba invadens
QTFEK

SEQ ID NO: 2899032 - protein, 13 aa, Entamoeba invadens
QTFSETVTNGEFS

SEQ ID NO: 2899033 - protein, 8 aa, Entamoeba invadens
QTFTQCTD

SEQ ID NO: 2899034 - protein, 5 aa, Entamoeba invadens
QTFTR

SEQ ID NO: 2899035 - protein, 8 aa, Entamoeba invadens
QTGDNPVS

SEQ ID NO: 2899036 - protein, 15 aa, Entamoeba invadens
QTGEKKEETQPASNL

SEQ ID NO: 2899037 - protein, 15 aa, Entamoeba invadens
QTGKDKIPKSIKRTL

SEQ ID NO: 2899038 - protein, 7 aa, Entamoeba invadens
QTGQQFD

SEQ ID NO: 2899039 - protein, 6 aa, Entamoeba invadens
QTGQYN

SEQ ID NO: 2899040 - protein, 6 aa, Entamoeba invadens
QTGRAI

SEQ ID NO: 2899041 - protein, 6 aa, Entamoeba invadens
QTGSAV

SEQ ID NO: 2899042 - protein, 9 aa, Entamoeba invadens
QTGSCKYGS

SEQ ID NO: 2899043 - protein, 7 aa, Entamoeba invadens
QTGSQEQ

SEQ ID NO: 2899044 - protein, 6 aa, Entamoeba invadens
QTGTAV

SEQ ID NO: 2899045 - protein, 7 aa, Entamoeba invadens
QTGTNLE

SEQ ID NO: 2899046 - protein, 8 aa, Entamoeba invadens
QTHPKDNV

SEQ ID NO: 2899047 - protein, 7 aa, Entamoeba invadens
QTHPSEV

SEQ ID NO: 2899048 - protein, 4 aa, Entamoeba invadens
QTIE

SEQ ID NO: 2899049 - protein, 6 aa, Entamoeba invadens
QTIESS

SEQ ID NO: 2899050 - protein, 12 aa, Entamoeba invadens
QTIESSTFDGCE

SEQ ID NO: 2899051 - protein, 7 aa, Entamoeba invadens
QTIGDSS

SEQ ID NO: 2899052 - protein, 13 aa, Entamoeba invadens
QTIGKESTGDPNL

SEQ ID NO: 2899053 - protein, 12 aa, Entamoeba invadens
QTIGKKSSMEDT

SEQ ID NO: 2899054 - protein, 6 aa, Entamoeba invadens
QTIKDQ

SEQ ID NO: 2899055 - protein, 15 aa, Entamoeba invadens
QTINDDNIPDNKIPA

SEQ ID NO: 2899056 - protein, 24 aa, Entamoeba invadens
QTINPPSVSVTSSQLQTTSLQHEN

SEQ ID NO: 2899057 - protein, 4 aa, Entamoeba invadens
QTIP

SEQ ID NO: 2899058 - protein, 8 aa, Entamoeba invadens
QTIPNSNG

SEQ ID NO: 2899059 - protein, 5 aa, Entamoeba invadens
QTIPP

SEQ ID NO: 2899060 - protein, 26 aa, Entamoeba invadens
QTIPQTENHDIEPVPDVNSSKQNIPF

SEQ ID NO: 2899061 - protein, 13 aa, Entamoeba invadens
QTIQQQQNQIAEL

SEQ ID NO: 2899062 - protein, 9 aa, Entamoeba invadens
QTITESLSD

SEQ ID NO: 2899063 - protein, 5 aa, Entamoeba invadens
QTITN

SEQ ID NO: 2899064 - protein, 5 aa, Entamoeba invadens
QTKDM

SEQ ID NO: 2899065 - protein, 4 aa, Entamoeba invadens
QTKE

SEQ ID NO: 2899066 - protein, 6 aa, Entamoeba invadens
QTKEAM

SEQ ID NO: 2899067 - protein, 6 aa, Entamoeba invadens
QTKEHE

SEQ ID NO: 2899068 - protein, 12 aa, Entamoeba invadens
QTKEKEEYEASK

SEQ ID NO: 2899069 - protein, 8 aa, Entamoeba invadens
QTKERPRW

SEQ ID NO: 2899070 - protein, 8 aa, Entamoeba invadens
QTKETEKL

SEQ ID NO: 2899071 - protein, 9 aa, Entamoeba invadens
QTKEYKESV

SEQ ID NO: 2899072 - protein, 4 aa, Entamoeba invadens
QTKI

SEQ ID NO: 2899073 - protein, 13 aa, Entamoeba invadens
QTKIQSKDNTIHN

SEQ ID NO: 2899074 - protein, 9 aa, Entamoeba invadens
QTKKAKLTE

SEQ ID NO: 2899075 - protein, 60 aa, Entamoeba invadens
QTKKEEDSSEEISDQNKETTSSDKNSESERSSNEESSRSTQSSSETSSKSDETGITPPFT

SEQ ID NO: 2899076 - protein, 9 aa, Entamoeba invadens
QTKKIRRRI

SEQ ID NO: 2899077 - protein, 10 aa, Entamoeba invadens
QTKKSLQPNY

SEQ ID NO: 2899078 - protein, 10 aa, Entamoeba invadens
QTKKTTNMSD

SEQ ID NO: 2899079 - protein, 14 aa, Entamoeba invadens
QTKKVRWTKEEDAA

SEQ ID NO: 2899080 - protein, 12 aa, Entamoeba invadens
QTKLAKHSLRRL

SEQ ID NO: 2899081 - protein, 18 aa, Entamoeba invadens
QTKLDKEIGQNATVEEEN

SEQ ID NO: 2899082 - protein, 7 aa, Entamoeba invadens
QTKLEDY

SEQ ID NO: 2899083 - protein, 14 aa, Entamoeba invadens
QTKLENVESDDKNS

SEQ ID NO: 2899084 - protein, 5 aa, Entamoeba invadens
QTKMT

SEQ ID NO: 2899085 - protein, 7 aa, Entamoeba invadens
QTKPFET

SEQ ID NO: 2899086 - protein, 8 aa, Entamoeba invadens
QTKPLSDD

SEQ ID NO: 2899087 - protein, 8 aa, Entamoeba invadens
QTKPTSEI

SEQ ID NO: 2899088 - protein, 10 aa, Entamoeba invadens
QTKQLQEEVE

SEQ ID NO: 2899089 - protein, 6 aa, Entamoeba invadens
QTKQNA

SEQ ID NO: 2899090 - protein, 20 aa, Entamoeba invadens
QTKQPKEDQLLSRSKSSNEL

SEQ ID NO: 2899091 - protein, 7 aa, Entamoeba invadens
QTKRPNI

SEQ ID NO: 2899092 - protein, 7 aa, Entamoeba invadens
QTKRSSL

SEQ ID NO: 2899093 - protein, 7 aa, Entamoeba invadens
QTKRTEL

SEQ ID NO: 2899094 - protein, 9 aa, Entamoeba invadens
QTKRTKCTE

SEQ ID NO: 2899095 - protein, 10 aa, Entamoeba invadens
QTKSDSEGYV

SEQ ID NO: 2899096 - protein, 5 aa, Entamoeba invadens
QTKSL

SEQ ID NO: 2899097 - protein, 6 aa, Entamoeba invadens
QTKSSL

SEQ ID NO: 2899098 - protein, 7 aa, Entamoeba invadens
QTKSTNA

SEQ ID NO: 2899099 - protein, 4 aa, Entamoeba invadens
QTKT

SEQ ID NO: 2899100 - protein, 10 aa, Entamoeba invadens
QTKTNKGSSV

SEQ ID NO: 2899101 - protein, 21 aa, Entamoeba invadens
QTKTPSKKSTQKKDKQEKERV

SEQ ID NO: 2899102 - protein, 5 aa, Entamoeba invadens
QTKTR

SEQ ID NO: 2899103 - protein, 17 aa, Entamoeba invadens
QTKTSKGVGEGIVSTEQ

SEQ ID NO: 2899104 - protein, 12 aa, Entamoeba invadens
QTKTVQRKRGTT

SEQ ID NO: 2899105 - protein, 4 aa, Entamoeba invadens
QTKV

SEQ ID NO: 2899106 - protein, 8 aa, Entamoeba invadens
QTKVPNYP

SEQ ID NO: 2899107 - protein, 4 aa, Entamoeba invadens
QTKY

SEQ ID NO: 2899108 - protein, 4 aa, Entamoeba invadens
QTLA

SEQ ID NO: 2899109 - protein, 9 aa, Entamoeba invadens
QTLAGTKVS

SEQ ID NO: 2899110 - protein, 16 aa, Entamoeba invadens
QTLARKNGNTQAPVEQ

SEQ ID NO: 2899111 - protein, 5 aa, Entamoeba invadens
QTLAS

SEQ ID NO: 2899112 - protein, 4 aa, Entamoeba invadens
QTLD

SEQ ID NO: 2899113 - protein, 6 aa, Entamoeba invadens
QTLEQN

SEQ ID NO: 2899114 - protein, 24 aa, Entamoeba invadens
QTLESVEKSEFKTTNESSNSEDLP

SEQ ID NO: 2899115 - protein, 6 aa, Entamoeba invadens
QTLETT

SEQ ID NO: 2899116 - protein, 4 aa, Entamoeba invadens
QTLG

SEQ ID NO: 2899117 - protein, 5 aa, Entamoeba invadens
QTLGA

SEQ ID NO: 2899118 - protein, 10 aa, Entamoeba invadens
QTLKNEEPDL

SEQ ID NO: 2899119 - protein, 6 aa, Entamoeba invadens
QTLKSS

SEQ ID NO: 2899120 - protein, 14 aa, Entamoeba invadens
QTLNHPKTPSHRNE

SEQ ID NO: 2899121 - protein, 12 aa, Entamoeba invadens
QTLPNGEEKELT

SEQ ID NO: 2899122 - protein, 16 aa, Entamoeba invadens
QTLPVGVNGNNQQTPT

SEQ ID NO: 2899123 - protein, 5 aa, Entamoeba invadens
QTMDE

SEQ ID NO: 2899124 - protein, 4 aa, Entamoeba invadens
QTMK

SEQ ID NO: 2899125 - protein, 5 aa, Entamoeba invadens
QTMND

SEQ ID NO: 2899126 - protein, 6 aa, Entamoeba invadens
QTMTTQ

SEQ ID NO: 2899127 - protein, 7 aa, Entamoeba invadens
QTNDTDD

SEQ ID NO: 2899128 - protein, 7 aa, Entamoeba invadens
QTNDTDK

SEQ ID NO: 2899129 - protein, 20 aa, Entamoeba invadens
QTNFPADKKERVNATDDVDE

SEQ ID NO: 2899130 - protein, 14 aa, Entamoeba invadens
QTNFSSRSKTEIPK

SEQ ID NO: 2899131 - protein, 6 aa, Entamoeba invadens
QTNGIA

SEQ ID NO: 2899132 - protein, 13 aa, Entamoeba invadens
QTNGVDTKSGSFT

SEQ ID NO: 2899133 - protein, 11 aa, Entamoeba invadens
QTNGYKPHQPS

SEQ ID NO: 2899134 - protein, 9 aa, Entamoeba invadens
QTNINDQTP

SEQ ID NO: 2899135 - protein, 4 aa, Entamoeba invadens
QTNK

SEQ ID NO: 2899136 - protein, 5 aa, Entamoeba invadens
QTNKN

SEQ ID NO: 2899137 - protein, 6 aa, Entamoeba invadens
QTNKNQ

SEQ ID NO: 2899138 - protein, 9 aa, Entamoeba invadens
QTNLNTPSI

SEQ ID NO: 2899139 - protein, 6 aa, Entamoeba invadens
QTNNKG

SEQ ID NO: 2899140 - protein, 7 aa, Entamoeba invadens
QTNPKYE

SEQ ID NO: 2899141 - protein, 6 aa, Entamoeba invadens
QTNRDT

SEQ ID NO: 2899142 - protein, 6 aa, Entamoeba invadens
QTNRPY

SEQ ID NO: 2899143 - protein, 18 aa, Entamoeba invadens
QTNSATFGVGQTQSVSCG

SEQ ID NO: 2899144 - protein, 8 aa, Entamoeba invadens
QTNTAASA

SEQ ID NO: 2899145 - protein, 47 aa, Entamoeba invadens
QTNTQQPTAQTTTLNTTMPTLNTTPLQTQTTTNTQQPQQSTQPTGNT

SEQ ID NO: 2899146 - protein, 6 aa, Entamoeba invadens
QTPAEC

SEQ ID NO: 2899147 - protein, 5 aa, Entamoeba invadens
QTPAK

SEQ ID NO: 2899148 - protein, 58 aa, Entamoeba invadens
QTPATRQTRAKSTPRKKQIKSRSHNSLSRNAYSSSNSLSSSPSNSAFYSPTKQHKGEK

SEQ ID NO: 2899149 - protein, 12 aa, Entamoeba invadens
QTPDYTTSSARD

SEQ ID NO: 2899150 - protein, 7 aa, Entamoeba invadens
QTPEHDH

SEQ ID NO: 2899151 - protein, 10 aa, Entamoeba invadens
QTPEKTNKKV

SEQ ID NO: 2899152 - protein, 7 aa, Entamoeba invadens
QTPEVAQ

SEQ ID NO: 2899153 - protein, 4 aa, Entamoeba invadens
QTPF

SEQ ID NO: 2899154 - protein, 8 aa, Entamoeba invadens
QTPFPNTE

SEQ ID NO: 2899155 - protein, 6 aa, Entamoeba invadens
QTPHKL

SEQ ID NO: 2899156 - protein, 7 aa, Entamoeba invadens
QTPINAK

SEQ ID NO: 2899157 - protein, 6 aa, Entamoeba invadens
QTPKAQ

SEQ ID NO: 2899158 - protein, 12 aa, Entamoeba invadens
QTPKENSEEEIN

SEQ ID NO: 2899159 - protein, 5 aa, Entamoeba invadens
QTPKG

SEQ ID NO: 2899160 - protein, 7 aa, Entamoeba invadens
QTPKGLR

SEQ ID NO: 2899161 - protein, 8 aa, Entamoeba invadens
QTPKHKVY

SEQ ID NO: 2899162 - protein, 5 aa, Entamoeba invadens
QTPLN

SEQ ID NO: 2899163 - protein, 6 aa, Entamoeba invadens
QTPLNI

SEQ ID NO: 2899164 - protein, 10 aa, Entamoeba invadens
QTPLPKENAM

SEQ ID NO: 2899165 - protein, 10 aa, Entamoeba invadens
QTPLSSDANT

SEQ ID NO: 2899166 - protein, 4 aa, Entamoeba invadens
QTPN

SEQ ID NO: 2899167 - protein, 8 aa, Entamoeba invadens
QTPPKVTS

SEQ ID NO: 2899168 - protein, 15 aa, Entamoeba invadens
QTPPLSLNSTKREHQ

SEQ ID NO: 2899169 - protein, 7 aa, Entamoeba invadens
QTPPNAR

SEQ ID NO: 2899170 - protein, 8 aa, Entamoeba invadens
QTPQGVSN

SEQ ID NO: 2899171 - protein, 6 aa, Entamoeba invadens
QTPQPM

SEQ ID NO: 2899172 - protein, 15 aa, Entamoeba invadens
QTPQQKYSSSPPTNE

SEQ ID NO: 2899173 - protein, 4 aa, Entamoeba invadens
QTPR

SEQ ID NO: 2899174 - protein, 5 aa, Entamoeba invadens
QTPRM

SEQ ID NO: 2899175 - protein, 13 aa, Entamoeba invadens
QTPRNNGISPLLD

SEQ ID NO: 2899176 - protein, 19 aa, Entamoeba invadens
QTPRPDRCRKDITGENTRS

SEQ ID NO: 2899177 - protein, 8 aa, Entamoeba invadens
QTPSSLDR

SEQ ID NO: 2899178 - protein, 7 aa, Entamoeba invadens
QTPSTLQ

SEQ ID NO: 2899179 - protein, 5 aa, Entamoeba invadens
QTPSY

SEQ ID NO: 2899180 - protein, 6 aa, Entamoeba invadens
QTPTPD

SEQ ID NO: 2899181 - protein, 6 aa, Entamoeba invadens
QTPTTA

SEQ ID NO: 2899182 - protein, 5 aa, Entamoeba invadens
QTPTV

SEQ ID NO: 2899183 - protein, 4 aa, Entamoeba invadens
QTPV

SEQ ID NO: 2899184 - protein, 10 aa, Entamoeba invadens
QTPYRSDSEN

SEQ ID NO: 2899185 - protein, 11 aa, Entamoeba invadens
QTQDKTNIKNL

SEQ ID NO: 2899186 - protein, 14 aa, Entamoeba invadens
QTQDTMKRSVDSEH

SEQ ID NO: 2899187 - protein, 25 aa, Entamoeba invadens
QTQDTQKKKDQESKPRPVRTQSTQA

SEQ ID NO: 2899188 - protein, 20 aa, Entamoeba invadens
QTQETEPQIEEKKATNSSTS

SEQ ID NO: 2899189 - protein, 7 aa, Entamoeba invadens
QTQGDLD

SEQ ID NO: 2899190 - protein, 5 aa, Entamoeba invadens
QTQKI

SEQ ID NO: 2899191 - protein, 7 aa, Entamoeba invadens
QTQKNSL

SEQ ID NO: 2899192 - protein, 9 aa, Entamoeba invadens
QTQNERQRK

SEQ ID NO: 2899193 - protein, 11 aa, Entamoeba invadens
QTQNGEAASTV

SEQ ID NO: 2899194 - protein, 13 aa, Entamoeba invadens
QTQQAKKTKFCTL

SEQ ID NO: 2899195 - protein, 7 aa, Entamoeba invadens
QTQQATL

SEQ ID NO: 2899196 - protein, 15 aa, Entamoeba invadens
QTQQIEQEQKKTEEV

SEQ ID NO: 2899197 - protein, 20 aa, Entamoeba invadens
QTQQQQPTNAMGMPSNTGLM

SEQ ID NO: 2899198 - protein, 20 aa, Entamoeba invadens
QTQQTGNIFPPGHDYYGQTF

SEQ ID NO: 2899199 - protein, 9 aa, Entamoeba invadens
QTQRERMSE

SEQ ID NO: 2899200 - protein, 5 aa, Entamoeba invadens
QTQSF

SEQ ID NO: 2899201 - protein, 24 aa, Entamoeba invadens
QTQSTQPTPSQPQQSVATQNQPLT

SEQ ID NO: 2899202 - protein, 8 aa, Entamoeba invadens
QTQSTRYT

SEQ ID NO: 2899203 - protein, 5 aa, Entamoeba invadens
QTQTS

SEQ ID NO: 2899204 - protein, 6 aa, Entamoeba invadens
QTQTSS

SEQ ID NO: 2899205 - protein, 8 aa, Entamoeba invadens
QTQVGGRH

SEQ ID NO: 2899206 - protein, 7 aa, Entamoeba invadens
QTQVKNK

SEQ ID NO: 2899207 - protein, 8 aa, Entamoeba invadens
QTRDIDGK

SEQ ID NO: 2899208 - protein, 12 aa, Entamoeba invadens
QTREKNEQFETQ

SEQ ID NO: 2899209 - protein, 9 aa, Entamoeba invadens
QTRKKGIPR

SEQ ID NO: 2899210 - protein, 13 aa, Entamoeba invadens
QTRKWSERGKSVA

SEQ ID NO: 2899211 - protein, 15 aa, Entamoeba invadens
QTRQNFNNVSDEYEK

SEQ ID NO: 2899212 - protein, 4 aa, Entamoeba invadens
QTRS

SEQ ID NO: 2899213 - protein, 9 aa, Entamoeba invadens
QTRVNATNY

SEQ ID NO: 2899214 - protein, 10 aa, Entamoeba invadens
QTSATNGSSV

SEQ ID NO: 2899215 - protein, 9 aa, Entamoeba invadens
QTSCDSPSD

SEQ ID NO: 2899216 - protein, 6 aa, Entamoeba invadens
QTSEGN

SEQ ID NO: 2899217 - protein, 5 aa, Entamoeba invadens
QTSEN

SEQ ID NO: 2899218 - protein, 7 aa, Entamoeba invadens
QTSGCTS

SEQ ID NO: 2899219 - protein, 8 aa, Entamoeba invadens
QTSGIPED

SEQ ID NO: 2899220 - protein, 11 aa, Entamoeba invadens
QTSGPITKVNT

SEQ ID NO: 2899221 - protein, 6 aa, Entamoeba invadens
QTSKDT

SEQ ID NO: 2899222 - protein, 8 aa, Entamoeba invadens
QTSKLRSG

SEQ ID NO: 2899223 - protein, 8 aa, Entamoeba invadens
QTSLKNEK

SEQ ID NO: 2899224 - protein, 10 aa, Entamoeba invadens
QTSLKNERKY

SEQ ID NO: 2899225 - protein, 7 aa, Entamoeba invadens
QTSLQSV

SEQ ID NO: 2899226 - protein, 9 aa, Entamoeba invadens
QTSLSTNDI

SEQ ID NO: 2899227 - protein, 19 aa, Entamoeba invadens
QTSMNRKSVGDNLSPTGTE

SEQ ID NO: 2899228 - protein, 33 aa, Entamoeba invadens
QTSNTPSKTDDKANLSKGNGKAKPEKKKSFCSM

SEQ ID NO: 2899229 - protein, 4 aa, Entamoeba invadens
QTSP

SEQ ID NO: 2899230 - protein, 7 aa, Entamoeba invadens
QTSPIDN

SEQ ID NO: 2899231 - protein, 14 aa, Entamoeba invadens
QTSPKQPANPPVTP

SEQ ID NO: 2899232 - protein, 5 aa, Entamoeba invadens
QTSQL

SEQ ID NO: 2899233 - protein, 6 aa, Entamoeba invadens
QTSQMQ

SEQ ID NO: 2899234 - protein, 9 aa, Entamoeba invadens
QTSQTSIGL

SEQ ID NO: 2899235 - protein, 7 aa, Entamoeba invadens
QTSSGDI

SEQ ID NO: 2899236 - protein, 7 aa, Entamoeba invadens
QTSSSNL

SEQ ID NO: 2899237 - protein, 6 aa, Entamoeba invadens
QTSTKT

SEQ ID NO: 2899238 - protein, 6 aa, Entamoeba invadens
QTSVDS

SEQ ID NO: 2899239 - protein, 14 aa, Entamoeba invadens
QTSVDSSGQSYYGE

SEQ ID NO: 2899240 - protein, 11 aa, Entamoeba invadens
QTSVPSPSERV

SEQ ID NO: 2899241 - protein, 5 aa, Entamoeba invadens
QTTAA

SEQ ID NO: 2899242 - protein, 6 aa, Entamoeba invadens
QTTDHG

SEQ ID NO: 2899243 - protein, 14 aa, Entamoeba invadens
QTTEEKEKTSPRHR

SEQ ID NO: 2899244 - protein, 7 aa, Entamoeba invadens
QTTEESL

SEQ ID NO: 2899245 - protein, 8 aa, Entamoeba invadens
QTTEGKEI

SEQ ID NO: 2899246 - protein, 5 aa, Entamoeba invadens
QTTFN

SEQ ID NO: 2899247 - protein, 12 aa, Entamoeba invadens
QTTGKNGTRKTD

SEQ ID NO: 2899248 - protein, 4 aa, Entamoeba invadens
QTTI

SEQ ID NO: 2899249 - protein, 6 aa, Entamoeba invadens
QTTIKA

SEQ ID NO: 2899250 - protein, 4 aa, Entamoeba invadens
QTTK

SEQ ID NO: 2899251 - protein, 9 aa, Entamoeba invadens
QTTKDDIQK

SEQ ID NO: 2899252 - protein, 9 aa, Entamoeba invadens
QTTKGANIE

SEQ ID NO: 2899253 - protein, 10 aa, Entamoeba invadens
QTTKKDERHP

SEQ ID NO: 2899254 - protein, 20 aa, Entamoeba invadens
QTTLKDTKENISTKMGRTAT

SEQ ID NO: 2899255 - protein, 7 aa, Entamoeba invadens
QTTLPQN

SEQ ID NO: 2899256 - protein, 9 aa, Entamoeba invadens
QTTLSRGEN

SEQ ID NO: 2899257 - protein, 8 aa, Entamoeba invadens
QTTLTTKE

SEQ ID NO: 2899258 - protein, 4 aa, Entamoeba invadens
QTTN

SEQ ID NO: 2899259 - protein, 7 aa, Entamoeba invadens
QTTNEEL

SEQ ID NO: 2899260 - protein, 7 aa, Entamoeba invadens
QTTNETA

SEQ ID NO: 2899261 - protein, 8 aa, Entamoeba invadens
QTTNNSFV

SEQ ID NO: 2899262 - protein, 5 aa, Entamoeba invadens
QTTNQ

SEQ ID NO: 2899263 - protein, 5 aa, Entamoeba invadens
QTTPF

SEQ ID NO: 2899264 - protein, 10 aa, Entamoeba invadens
QTTPHSYTKA

SEQ ID NO: 2899265 - protein, 5 aa, Entamoeba invadens
QTTPI

SEQ ID NO: 2899266 - protein, 10 aa, Entamoeba invadens
QTTPKSALSN

SEQ ID NO: 2899267 - protein, 9 aa, Entamoeba invadens
QTTPQNTFG

SEQ ID NO: 2899268 - protein, 14 aa, Entamoeba invadens
QTTPQTEPKRRTQT

SEQ ID NO: 2899269 - protein, 13 aa, Entamoeba invadens
QTTPQTNIEPTPI

SEQ ID NO: 2899270 - protein, 7 aa, Entamoeba invadens
QTTPRNP

SEQ ID NO: 2899271 - protein, 6 aa, Entamoeba invadens
QTTPVQ

SEQ ID NO: 2899272 - protein, 6 aa, Entamoeba invadens
QTTQPL

SEQ ID NO: 2899273 - protein, 7 aa, Entamoeba invadens
QTTQQLQ

SEQ ID NO: 2899274 - protein, 10 aa, Entamoeba invadens
QTTQQQRWDK

SEQ ID NO: 2899275 - protein, 8 aa, Entamoeba invadens
QTTQSNLK

SEQ ID NO: 2899276 - protein, 13 aa, Entamoeba invadens
QTTQTENKKITEK

SEQ ID NO: 2899277 - protein, 16 aa, Entamoeba invadens
QTTQTTEIKSEDVNKV

SEQ ID NO: 2899278 - protein, 6 aa, Entamoeba invadens
QTTRYA

SEQ ID NO: 2899279 - protein, 7 aa, Entamoeba invadens
QTTSAQI

SEQ ID NO: 2899280 - protein, 8 aa, Entamoeba invadens
QTTSGNSR

SEQ ID NO: 2899281 - protein, 4 aa, Entamoeba invadens
QTTT

SEQ ID NO: 2899282 - protein, 7 aa, Entamoeba invadens
QTTTCES

SEQ ID NO: 2899283 - protein, 11 aa, Entamoeba invadens
QTTTCPNGDSG

SEQ ID NO: 2899284 - protein, 11 aa, Entamoeba invadens
QTTTENNKDIS

SEQ ID NO: 2899285 - protein, 7 aa, Entamoeba invadens
QTTTHQP

SEQ ID NO: 2899286 - protein, 7 aa, Entamoeba invadens
QTTTSKD

SEQ ID NO: 2899287 - protein, 15 aa, Entamoeba invadens
QTTTTTQKITGELKA

SEQ ID NO: 2899288 - protein, 7 aa, Entamoeba invadens
QTTYNDP

SEQ ID NO: 2899289 - protein, 17 aa, Entamoeba invadens
QTTYSEQEKADTQQEKL

SEQ ID NO: 2899290 - protein, 6 aa, Entamoeba invadens
QTTYYN

SEQ ID NO: 2899291 - protein, 20 aa, Entamoeba invadens
QTVACGAKNGRVYVAKSSLS

SEQ ID NO: 2899292 - protein, 5 aa, Entamoeba invadens
QTVAQ

SEQ ID NO: 2899293 - protein, 29 aa, Entamoeba invadens
QTVAQNYQPAQNVQRTPNTQNVQQKKQNV

SEQ ID NO: 2899294 - protein, 40 aa, Entamoeba invadens
QTVATEVDDKGTKSEPVEKSEEKMSKRQQRKLEKKEYKDK

SEQ ID NO: 2899295 - protein, 6 aa, Entamoeba invadens
QTVDPS

SEQ ID NO: 2899296 - protein, 10 aa, Entamoeba invadens
QTVDTQQQIN

SEQ ID NO: 2899297 - protein, 9 aa, Entamoeba invadens
QTVETSNEM

SEQ ID NO: 2899298 - protein, 6 aa, Entamoeba invadens
QTVGKE

SEQ ID NO: 2899299 - protein, 10 aa, Entamoeba invadens
QTVGTAPLEP

SEQ ID NO: 2899300 - protein, 18 aa, Entamoeba invadens
QTVGTSKPEVNVKADGKR

SEQ ID NO: 2899301 - protein, 10 aa, Entamoeba invadens
QTVNGGRVSD

SEQ ID NO: 2899302 - protein, 6 aa, Entamoeba invadens
QTVPQN

SEQ ID NO: 2899303 - protein, 12 aa, Entamoeba invadens
QTVQSNDTPKHS

SEQ ID NO: 2899304 - protein, 29 aa, Entamoeba invadens
QTVQTQKTEIESFKKQKADKQKDAPPLLE

SEQ ID NO: 2899305 - protein, 5 aa, Entamoeba invadens
QTVST

SEQ ID NO: 2899306 - protein, 5 aa, Entamoeba invadens
QTVTI

SEQ ID NO: 2899307 - protein, 8 aa, Entamoeba invadens
QTYPDGRI

SEQ ID NO: 2899308 - protein, 5 aa, Entamoeba invadens
QTYQR

SEQ ID NO: 2899309 - protein, 5 aa, Entamoeba invadens
QTYSS

SEQ ID NO: 2899310 - protein, 18 aa, Entamoeba invadens
QTYTPDKGVQRFFCLCLN

SEQ ID NO: 2899311 - protein, 24 aa, Entamoeba invadens
QVAEESKKLTPFKKREPTGERPKT

SEQ ID NO: 2899312 - protein, 6 aa, Entamoeba invadens
QVAKSS

SEQ ID NO: 2899313 - protein, 8 aa, Entamoeba invadens
QVASSSIS

SEQ ID NO: 2899314 - protein, 19 aa, Entamoeba invadens
QVDAERATKTAIENASNYP

SEQ ID NO: 2899315 - protein, 11 aa, Entamoeba invadens
QVDEAGKSSTM

SEQ ID NO: 2899316 - protein, 10 aa, Entamoeba invadens
QVDNSNDENA

SEQ ID NO: 2899317 - protein, 14 aa, Entamoeba invadens
QVDNSNNENPVDEF

SEQ ID NO: 2899318 - protein, 12 aa, Entamoeba invadens
QVDPSVASLTPY

SEQ ID NO: 2899319 - protein, 9 aa, Entamoeba invadens
QVDRQNTIN

SEQ ID NO: 2899320 - protein, 6 aa, Entamoeba invadens
QVDRRY

SEQ ID NO: 2899321 - protein, 9 aa, Entamoeba invadens
QVDTDGKLS

SEQ ID NO: 2899322 - protein, 10 aa, Entamoeba invadens
QVDTGCSNCE

SEQ ID NO: 2899323 - protein, 5 aa, Entamoeba invadens
QVDTS

SEQ ID NO: 2899324 - protein, 13 aa, Entamoeba invadens
QVEATTNPYEPFS

SEQ ID NO: 2899325 - protein, 26 aa, Entamoeba invadens
QVEDEERKAIDKESISSSLKPQDLKG

SEQ ID NO: 2899326 - protein, 4 aa, Entamoeba invadens
QVEE

SEQ ID NO: 2899327 - protein, 11 aa, Entamoeba invadens
QVEEEAKSSER

SEQ ID NO: 2899328 - protein, 32 aa, Entamoeba invadens
QVEESEESKMEVENKENERMEVEEEDNEDEIT

SEQ ID NO: 2899329 - protein, 70 aa, Entamoeba invadens
QVEETTSSKMEEEPGKKEEKEDKKETNTENNKSEQKDEQKEEDKKEEVKKENKKENEDGTSNEQNEREIE

SEQ ID NO: 2899330 - protein, 4 aa, Entamoeba invadens
QVEK

SEQ ID NO: 2899331 - protein, 7 aa, Entamoeba invadens
QVEKADE

SEQ ID NO: 2899332 - protein, 7 aa, Entamoeba invadens
QVEKERV

SEQ ID NO: 2899333 - protein, 10 aa, Entamoeba invadens
QVEKGVGKSK

SEQ ID NO: 2899334 - protein, 10 aa, Entamoeba invadens
QVEKQKKVEE

SEQ ID NO: 2899335 - protein, 12 aa, Entamoeba invadens
QVEKTQNEYYDP

SEQ ID NO: 2899336 - protein, 4 aa, Entamoeba invadens
QVEN

SEQ ID NO: 2899337 - protein, 7 aa, Entamoeba invadens
QVENKKR

SEQ ID NO: 2899338 - protein, 11 aa, Entamoeba invadens
QVENTSTTTTM

SEQ ID NO: 2899339 - protein, 28 aa, Entamoeba invadens
QVERNSTQSYIQTSTHTNQLQKHESSLI

SEQ ID NO: 2899340 - protein, 14 aa, Entamoeba invadens
QVESEKKEKTKQIE

SEQ ID NO: 2899341 - protein, 8 aa, Entamoeba invadens
QVETGISN

SEQ ID NO: 2899342 - protein, 5 aa, Entamoeba invadens
QVETY

SEQ ID NO: 2899343 - protein, 6 aa, Entamoeba invadens
QVEYEK

SEQ ID NO: 2899344 - protein, 12 aa, Entamoeba invadens
QVFTDDAKKVAD

SEQ ID NO: 2899345 - protein, 6 aa, Entamoeba invadens
QVGADQ

SEQ ID NO: 2899346 - protein, 6 aa, Entamoeba invadens
QVGDTS

SEQ ID NO: 2899347 - protein, 6 aa, Entamoeba invadens
QVGEDG

SEQ ID NO: 2899348 - protein, 7 aa, Entamoeba invadens
QVGEKRT

SEQ ID NO: 2899349 - protein, 10 aa, Entamoeba invadens
QVGERGEHKT

SEQ ID NO: 2899350 - protein, 4 aa, Entamoeba invadens
QVGK

SEQ ID NO: 2899351 - protein, 5 aa, Entamoeba invadens
QVGND

SEQ ID NO: 2899352 - protein, 6 aa, Entamoeba invadens
QVGRKS

SEQ ID NO: 2899353 - protein, 4 aa, Entamoeba invadens
QVGT

SEQ ID NO: 2899354 - protein, 11 aa, Entamoeba invadens
QVHNENNLRQY

SEQ ID NO: 2899355 - protein, 6 aa, Entamoeba invadens
QVHPSG

SEQ ID NO: 2899356 - protein, 12 aa, Entamoeba invadens
QVHTNSSKYTTP

SEQ ID NO: 2899357 - protein, 11 aa, Entamoeba invadens
QVIPGSGGQQL

SEQ ID NO: 2899358 - protein, 9 aa, Entamoeba invadens
QVKAKDGKL

SEQ ID NO: 2899359 - protein, 9 aa, Entamoeba invadens
QVKDAEPEY

SEQ ID NO: 2899360 - protein, 12 aa, Entamoeba invadens
QVKDDKIDSDEL

SEQ ID NO: 2899361 - protein, 17 aa, Entamoeba invadens
QVKDEKKLKTRHPSSGA

SEQ ID NO: 2899362 - protein, 10 aa, Entamoeba invadens
QVKESDRKEM

SEQ ID NO: 2899363 - protein, 9 aa, Entamoeba invadens
QVKGQAHPE

SEQ ID NO: 2899364 - protein, 4 aa, Entamoeba invadens
QVKK

SEQ ID NO: 2899365 - protein, 5 aa, Entamoeba invadens
QVKMK

SEQ ID NO: 2899366 - protein, 9 aa, Entamoeba invadens
QVKNTTHTD

SEQ ID NO: 2899367 - protein, 13 aa, Entamoeba invadens
QVKRHRDANRSAL

SEQ ID NO: 2899368 - protein, 18 aa, Entamoeba invadens
QVKRTNTNGALLSPTTPK

SEQ ID NO: 2899369 - protein, 27 aa, Entamoeba invadens
QVLPKPKKEEEEESSDDSESQGGTSCS

SEQ ID NO: 2899370 - protein, 11 aa, Entamoeba invadens
QVLQTGGSKKV

SEQ ID NO: 2899371 - protein, 19 aa, Entamoeba invadens
QVLRGTSRDYNSAKRTPLT

SEQ ID NO: 2899372 - protein, 16 aa, Entamoeba invadens
QVNESDMVDSKSALRH

SEQ ID NO: 2899373 - protein, 8 aa, Entamoeba invadens
QVNETSRL

SEQ ID NO: 2899374 - protein, 4 aa, Entamoeba invadens
QVNP

SEQ ID NO: 2899375 - protein, 5 aa, Entamoeba invadens
QVNQA

SEQ ID NO: 2899376 - protein, 4 aa, Entamoeba invadens
QVNS

SEQ ID NO: 2899377 - protein, 5 aa, Entamoeba invadens
QVNSS

SEQ ID NO: 2899378 - protein, 15 aa, Entamoeba invadens
QVNTAQEPTSGASET

SEQ ID NO: 2899379 - protein, 25 aa, Entamoeba invadens
QVNTSGDPPTSQASNSSLQSSQGFK

SEQ ID NO: 2899380 - protein, 5 aa, Entamoeba invadens
QVPDG

SEQ ID NO: 2899381 - protein, 10 aa, Entamoeba invadens
QVPEKEPPSL

SEQ ID NO: 2899382 - protein, 5 aa, Entamoeba invadens
QVPGS

SEQ ID NO: 2899383 - protein, 5 aa, Entamoeba invadens
QVPKS

SEQ ID NO: 2899384 - protein, 13 aa, Entamoeba invadens
QVPKTTYTSTSFN

SEQ ID NO: 2899385 - protein, 43 aa, Entamoeba invadens
QVPPPIDDAPDDETNNTFQEDDNNTLEDDDDEDTIKTEEGFEE

SEQ ID NO: 2899386 - protein, 52 aa, Entamoeba invadens
QVPPPQNTQGVQDSTKQTYQTPQVPPQAQNPQQDQMYGSAQPQLATNPQQPF

SEQ ID NO: 2899387 - protein, 4 aa, Entamoeba invadens
QVPQ

SEQ ID NO: 2899388 - protein, 13 aa, Entamoeba invadens
QVPQKQKQPEQKK

SEQ ID NO: 2899389 - protein, 4 aa, Entamoeba invadens
QVPT

SEQ ID NO: 2899390 - protein, 6 aa, Entamoeba invadens
QVPTGI

SEQ ID NO: 2899391 - protein, 11 aa, Entamoeba invadens
QVPTPNSPAHE

SEQ ID NO: 2899392 - protein, 6 aa, Entamoeba invadens
QVPTTS

SEQ ID NO: 2899393 - protein, 6 aa, Entamoeba invadens
QVPYDN

SEQ ID NO: 2899394 - protein, 6 aa, Entamoeba invadens
QVQEEK

SEQ ID NO: 2899395 - protein, 5 aa, Entamoeba invadens
QVQPQ

SEQ ID NO: 2899396 - protein, 13 aa, Entamoeba invadens
QVQQSAQNTQQQN

SEQ ID NO: 2899397 - protein, 11 aa, Entamoeba invadens
QVQRNSDQKEV

SEQ ID NO: 2899398 - protein, 16 aa, Entamoeba invadens
QVQTLSNKTIENNPIT

SEQ ID NO: 2899399 - protein, 9 aa, Entamoeba invadens
QVQTPFNKT

SEQ ID NO: 2899400 - protein, 15 aa, Entamoeba invadens
QVRAKDGKLVSVHKP

SEQ ID NO: 2899401 - protein, 10 aa, Entamoeba invadens
QVRDAGGNYV

SEQ ID NO: 2899402 - protein, 10 aa, Entamoeba invadens
QVRGKDGKLV

SEQ ID NO: 2899403 - protein, 9 aa, Entamoeba invadens
QVRGKDSKL

SEQ ID NO: 2899404 - protein, 13 aa, Entamoeba invadens
QVRTKKNVVQAKT

SEQ ID NO: 2899405 - protein, 4 aa, Entamoeba invadens
QVSA

SEQ ID NO: 2899406 - protein, 4 aa, Entamoeba invadens
QVSE

SEQ ID NO: 2899407 - protein, 5 aa, Entamoeba invadens
QVSET

SEQ ID NO: 2899408 - protein, 5 aa, Entamoeba invadens
QVSGD

SEQ ID NO: 2899409 - protein, 12 aa, Entamoeba invadens
QVSGGGRIKGDW

SEQ ID NO: 2899410 - protein, 10 aa, Entamoeba invadens
QVSKGETHTH

SEQ ID NO: 2899411 - protein, 4 aa, Entamoeba invadens
QVSN

SEQ ID NO: 2899412 - protein, 11 aa, Entamoeba invadens
QVSNADNPQQN

SEQ ID NO: 2899413 - protein, 7 aa, Entamoeba invadens
QVSPRTR

SEQ ID NO: 2899414 - protein, 8 aa, Entamoeba invadens
QVSQAPHV

SEQ ID NO: 2899415 - protein, 9 aa, Entamoeba invadens
QVSQENEEA

SEQ ID NO: 2899416 - protein, 9 aa, Entamoeba invadens
QVSQNAALS

SEQ ID NO: 2899417 - protein, 5 aa, Entamoeba invadens
QVSQR

SEQ ID NO: 2899418 - protein, 37 aa, Entamoeba invadens
QVSSESSDSSMDSLETSEDSEDTEEGKYDKTNSDSEA

SEQ ID NO: 2899419 - protein, 5 aa, Entamoeba invadens
QVSSI

SEQ ID NO: 2899420 - protein, 13 aa, Entamoeba invadens
QVSTLNKGTFSSC

SEQ ID NO: 2899421 - protein, 5 aa, Entamoeba invadens
QVSTR

SEQ ID NO: 2899422 - protein, 10 aa, Entamoeba invadens
QVSTRNQDRN

SEQ ID NO: 2899423 - protein, 21 aa, Entamoeba invadens
QVTATEIYSTPDVVKSSKQDK

SEQ ID NO: 2899424 - protein, 4 aa, Entamoeba invadens
QVTE

SEQ ID NO: 2899425 - protein, 9 aa, Entamoeba invadens
QVTGATCNG

SEQ ID NO: 2899426 - protein, 8 aa, Entamoeba invadens
QVTHNGAE

SEQ ID NO: 2899427 - protein, 6 aa, Entamoeba invadens
QVTIEP

SEQ ID NO: 2899428 - protein, 11 aa, Entamoeba invadens
QVTLKGPDSVV

SEQ ID NO: 2899429 - protein, 8 aa, Entamoeba invadens
QVTNKNKI

SEQ ID NO: 2899430 - protein, 7 aa, Entamoeba invadens
QVTPERE

SEQ ID NO: 2899431 - protein, 23 aa, Entamoeba invadens
QVTPQNNRGFNTFNGQKPLGIFG

SEQ ID NO: 2899432 - protein, 4 aa, Entamoeba invadens
QVTT

SEQ ID NO: 2899433 - protein, 10 aa, Entamoeba invadens
QVVEDERRAT

SEQ ID NO: 2899434 - protein, 12 aa, Entamoeba invadens
QVVPEKKESSTV

SEQ ID NO: 2899435 - protein, 38 aa, Entamoeba invadens
QVVPPKSEEKRNGVIKPQGSKTGVKEEKKEVGPKVTEK

SEQ ID NO: 2899436 - protein, 8 aa, Entamoeba invadens
QVYSPEAG

SEQ ID NO: 2899437 - protein, 7 aa, Entamoeba invadens
QWAPQDN

SEQ ID NO: 2899438 - protein, 5 aa, Entamoeba invadens
QWDSY

SEQ ID NO: 2899439 - protein, 12 aa, Entamoeba invadens
QWGKKEGGSVKS

SEQ ID NO: 2899440 - protein, 101 aa, Entamoeba invadens
QYAEESEQVPQKPVSSGRKWQPPAKAAEPAAPVQQYEEPQQEVQQEEVPVEQEQYQEEPQQQEEYQEQPPQQQYEEPQQEQAPVEQEQYQEEAQQEPAQGD

SEQ ID NO: 2899441 - protein, 8 aa, Entamoeba invadens
QYAERNGK

SEQ ID NO: 2899442 - protein, 23 aa, Entamoeba invadens
QYAGRKENPSQKNVAAKENSTGI

SEQ ID NO: 2899443 - protein, 4 aa, Entamoeba invadens
QYAP

SEQ ID NO: 2899444 - protein, 18 aa, Entamoeba invadens
QYAPGVQVQQNQQDTQMY

SEQ ID NO: 2899445 - protein, 6 aa, Entamoeba invadens
QYDDSK

SEQ ID NO: 2899446 - protein, 4 aa, Entamoeba invadens
QYDG

SEQ ID NO: 2899447 - protein, 4 aa, Entamoeba invadens
QYDN

SEQ ID NO: 2899448 - protein, 11 aa, Entamoeba invadens
QYDNPSKIKSV

SEQ ID NO: 2899449 - protein, 12 aa, Entamoeba invadens
QYDPDEPPAQNY

SEQ ID NO: 2899450 - protein, 6 aa, Entamoeba invadens
QYDQQE

SEQ ID NO: 2899451 - protein, 4 aa, Entamoeba invadens
QYDS

SEQ ID NO: 2899452 - protein, 4 aa, Entamoeba invadens
QYDT

SEQ ID NO: 2899453 - protein, 5 aa, Entamoeba invadens
QYDTE

SEQ ID NO: 2899454 - protein, 7 aa, Entamoeba invadens
QYDTTKI

SEQ ID NO: 2899455 - protein, 11 aa, Entamoeba invadens
QYEAGGISSEI

SEQ ID NO: 2899456 - protein, 5 aa, Entamoeba invadens
QYEDA

SEQ ID NO: 2899457 - protein, 7 aa, Entamoeba invadens
QYEEARQ

SEQ ID NO: 2899458 - protein, 7 aa, Entamoeba invadens
QYEEQKS

SEQ ID NO: 2899459 - protein, 17 aa, Entamoeba invadens
QYEETSIEMKTKDDKSI

SEQ ID NO: 2899460 - protein, 21 aa, Entamoeba invadens
QYEKYSNQHIPQNSTEKDEKV

SEQ ID NO: 2899461 - protein, 10 aa, Entamoeba invadens
QYERRTTSPL

SEQ ID NO: 2899462 - protein, 5 aa, Entamoeba invadens
QYETN

SEQ ID NO: 2899463 - protein, 6 aa, Entamoeba invadens
QYFPPG

SEQ ID NO: 2899464 - protein, 11 aa, Entamoeba invadens
QYGATDNEGSS

SEQ ID NO: 2899465 - protein, 11 aa, Entamoeba invadens
QYGEKAGETNI

SEQ ID NO: 2899466 - protein, 7 aa, Entamoeba invadens
QYGPVKA

SEQ ID NO: 2899467 - protein, 4 aa, Entamoeba invadens
QYGR

SEQ ID NO: 2899468 - protein, 4 aa, Entamoeba invadens
QYGS

SEQ ID NO: 2899469 - protein, 4 aa, Entamoeba invadens
QYGT

SEQ ID NO: 2899470 - protein, 24 aa, Entamoeba invadens
QYHSAEPQIDQTIQDNTSIASQPS

SEQ ID NO: 2899471 - protein, 16 aa, Entamoeba invadens
QYITTTSEVSCQTPTC

SEQ ID NO: 2899472 - protein, 10 aa, Entamoeba invadens
QYKEYESPFD

SEQ ID NO: 2899473 - protein, 7 aa, Entamoeba invadens
QYKNERV

SEQ ID NO: 2899474 - protein, 16 aa, Entamoeba invadens
QYKNYQDKDPVVPKEV

SEQ ID NO: 2899475 - protein, 10 aa, Entamoeba invadens
QYKSGATTDV

SEQ ID NO: 2899476 - protein, 11 aa, Entamoeba invadens
QYKSVAQSTEL

SEQ ID NO: 2899477 - protein, 6 aa, Entamoeba invadens
QYKTTK

SEQ ID NO: 2899478 - protein, 4 aa, Entamoeba invadens
QYMP

SEQ ID NO: 2899479 - protein, 6 aa, Entamoeba invadens
QYMQTG

SEQ ID NO: 2899480 - protein, 5 aa, Entamoeba invadens
QYNGQ

SEQ ID NO: 2899481 - protein, 14 aa, Entamoeba invadens
QYNGSEMYNTQDEI

SEQ ID NO: 2899482 - protein, 11 aa, Entamoeba invadens
QYNKSEVEQAI

SEQ ID NO: 2899483 - protein, 4 aa, Entamoeba invadens
QYNN

SEQ ID NO: 2899484 - protein, 14 aa, Entamoeba invadens
QYNNNNCSGTPRSE

SEQ ID NO: 2899485 - protein, 5 aa, Entamoeba invadens
QYNTN

SEQ ID NO: 2899486 - protein, 11 aa, Entamoeba invadens
QYPDTQKCETK

SEQ ID NO: 2899487 - protein, 6 aa, Entamoeba invadens
QYPDVV

SEQ ID NO: 2899488 - protein, 4 aa, Entamoeba invadens
QYPH

SEQ ID NO: 2899489 - protein, 12 aa, Entamoeba invadens
QYPHSASQALPE

SEQ ID NO: 2899490 - protein, 5 aa, Entamoeba invadens
QYPKL

SEQ ID NO: 2899491 - protein, 6 aa, Entamoeba invadens
QYPPNT

SEQ ID NO: 2899492 - protein, 4 aa, Entamoeba invadens
QYPQ

SEQ ID NO: 2899493 - protein, 18 aa, Entamoeba invadens
QYPQQSLQNTQTQTSQTD

SEQ ID NO: 2899494 - protein, 9 aa, Entamoeba invadens
QYPQTSLPQ

SEQ ID NO: 2899495 - protein, 19 aa, Entamoeba invadens
QYPRINPQRASPTKTRTIE

SEQ ID NO: 2899496 - protein, 33 aa, Entamoeba invadens
QYPTSAAQQFDSNSLQNQQQGNAGQQQQNSEYL

SEQ ID NO: 2899497 - protein, 6 aa, Entamoeba invadens
QYQDVE

SEQ ID NO: 2899498 - protein, 6 aa, Entamoeba invadens
QYQGTT

SEQ ID NO: 2899499 - protein, 9 aa, Entamoeba invadens
QYQQKQNDL

SEQ ID NO: 2899500 - protein, 6 aa, Entamoeba invadens
QYQQMQ

SEQ ID NO: 2899501 - protein, 17 aa, Entamoeba invadens
QYQSDGFTSWQKQTKED

SEQ ID NO: 2899502 - protein, 4 aa, Entamoeba invadens
QYRK

SEQ ID NO: 2899503 - protein, 12 aa, Entamoeba invadens
QYRKNSEKGKVK

SEQ ID NO: 2899504 - protein, 5 aa, Entamoeba invadens
QYSDG

SEQ ID NO: 2899505 - protein, 5 aa, Entamoeba invadens
QYSEE

SEQ ID NO: 2899506 - protein, 8 aa, Entamoeba invadens
QYSEPQKR

SEQ ID NO: 2899507 - protein, 11 aa, Entamoeba invadens
QYSGRKRRAAS

SEQ ID NO: 2899508 - protein, 5 aa, Entamoeba invadens
QYSHR

SEQ ID NO: 2899509 - protein, 12 aa, Entamoeba invadens
QYSKEKLQTYAK

SEQ ID NO: 2899510 - protein, 11 aa, Entamoeba invadens
QYSNKECGEDE

SEQ ID NO: 2899511 - protein, 6 aa, Entamoeba invadens
QYSQTL

SEQ ID NO: 2899512 - protein, 4 aa, Entamoeba invadens
QYSS

SEQ ID NO: 2899513 - protein, 13 aa, Entamoeba invadens
QYSYPNTNGNCTT

SEQ ID NO: 2899514 - protein, 15 aa, Entamoeba invadens
QYTDTQQIAPPQQQV

SEQ ID NO: 2899515 - protein, 8 aa, Entamoeba invadens
QYTEGNQN

SEQ ID NO: 2899516 - protein, 5 aa, Entamoeba invadens
QYTEK

SEQ ID NO: 2899517 - protein, 32 aa, Entamoeba invadens
QYTKQKKAEKGCSDKQKKGKKGENTSKKGNKK

SEQ ID NO: 2899518 - protein, 9 aa, Entamoeba invadens
QYTNTTPLE

SEQ ID NO: 2899519 - protein, 5 aa, Entamoeba invadens
QYTQN

SEQ ID NO: 2899520 - protein, 7 aa, Entamoeba invadens
QYTSEDR

SEQ ID NO: 2899521 - protein, 13 aa, Entamoeba invadens
QYTSKNNRKQSPT

SEQ ID NO: 2899522 - protein, 10 aa, Entamoeba invadens
QYTSSRSISH

SEQ ID NO: 2899523 - protein, 8 aa, Entamoeba invadens
QYTSTITN

SEQ ID NO: 2899524 - protein, 12 aa, Entamoeba invadens
QYTTPSSIPKTS

SEQ ID NO: 2899525 - protein, 8 aa, Entamoeba invadens
QYVPYSSE

SEQ ID NO: 2899526 - protein, 6 aa, Entamoeba invadens
QYYKNA

SEQ ID NO: 2899527 - protein, 7 aa, Entamoeba invadens
QYYKRSN

SEQ ID NO: 2899528 - protein, 12 aa, Entamoeba invadens
RAAAQSDEGSLD

SEQ ID NO: 2899529 - protein, 73 aa, Entamoeba invadens
RAAEKKKAKKVVKNKKNKKDDEENSDDDNSEEKTEEKAKVAKKTTKKTAKKKNKKKNKKEENSSDDDKEKEFD

SEQ ID NO: 2899530 - protein, 14 aa, Entamoeba invadens
RAAESKAAGIAQPQ

SEQ ID NO: 2899531 - protein, 55 aa, Entamoeba invadens
RAAKREKKRVNSERSKALLGKKRKDEERSKAQAKEVKAKNKAKKFRHETKPRKNF

SEQ ID NO: 2899532 - protein, 13 aa, Entamoeba invadens
RAALEKEKNGDQL

SEQ ID NO: 2899533 - protein, 12 aa, Entamoeba invadens
RAANSHNAVQSE

SEQ ID NO: 2899534 - protein, 10 aa, Entamoeba invadens
RAANTDGMEH

SEQ ID NO: 2899535 - protein, 8 aa, Entamoeba invadens
RAANYDPK

SEQ ID NO: 2899536 - protein, 10 aa, Entamoeba invadens
RAAQCDGEPF

SEQ ID NO: 2899537 - protein, 17 aa, Entamoeba invadens
RAAQKALTTLDKTEFNG

SEQ ID NO: 2899538 - protein, 14 aa, Entamoeba invadens
RAARNEDGNQAGLD

SEQ ID NO: 2899539 - protein, 5 aa, Entamoeba invadens
RACED

SEQ ID NO: 2899540 - protein, 5 aa, Entamoeba invadens
RACGD

SEQ ID NO: 2899541 - protein, 4 aa, Entamoeba invadens
RACM

SEQ ID NO: 2899542 - protein, 22 aa, Entamoeba invadens
RADIQSAGKEADVEKVKEDATA

SEQ ID NO: 2899543 - protein, 6 aa, Entamoeba invadens
RADNSL

SEQ ID NO: 2899544 - protein, 17 aa, Entamoeba invadens
RADPESLKKMKKDPKKV

SEQ ID NO: 2899545 - protein, 9 aa, Entamoeba invadens
RADPPQEKV

SEQ ID NO: 2899546 - protein, 6 aa, Entamoeba invadens
RADSGH

SEQ ID NO: 2899547 - protein, 7 aa, Entamoeba invadens
RADSLDP

SEQ ID NO: 2899548 - protein, 5 aa, Entamoeba invadens
RADTL

SEQ ID NO: 2899549 - protein, 7 aa, Entamoeba invadens
RADTRVD

SEQ ID NO: 2899550 - protein, 64 aa, Entamoeba invadens
RAEAERIEKERLEREAAEKLEKERLEQERVAKEKEEEERKAKELAEKLAREEAEKLEKERIEKE

SEQ ID NO: 2899551 - protein, 9 aa, Entamoeba invadens
RAEAESAVQ

SEQ ID NO: 2899552 - protein, 10 aa, Entamoeba invadens
RAEEAEKRDH

SEQ ID NO: 2899553 - protein, 5 aa, Entamoeba invadens
RAEEL

SEQ ID NO: 2899554 - protein, 16 aa, Entamoeba invadens
RAEELNDDIPRTEMGK

SEQ ID NO: 2899555 - protein, 5 aa, Entamoeba invadens
RAEKK

SEQ ID NO: 2899556 - protein, 5 aa, Entamoeba invadens
RAENC

SEQ ID NO: 2899557 - protein, 8 aa, Entamoeba invadens
RAENENDK

SEQ ID NO: 2899558 - protein, 11 aa, Entamoeba invadens
RAENTLTDGKI

SEQ ID NO: 2899559 - protein, 16 aa, Entamoeba invadens
RAEPTDESKEFKEPPL

SEQ ID NO: 2899560 - protein, 8 aa, Entamoeba invadens
RAEQSRTV

SEQ ID NO: 2899561 - protein, 17 aa, Entamoeba invadens
RAERKKLPTKKKPLPDL

SEQ ID NO: 2899562 - protein, 4 aa, Entamoeba invadens
RAES

SEQ ID NO: 2899563 - protein, 7 aa, Entamoeba invadens
RAESKKK

SEQ ID NO: 2899564 - protein, 11 aa, Entamoeba invadens
RAETPGTSYYK

SEQ ID NO: 2899565 - protein, 6 aa, Entamoeba invadens
RAEVTR

SEQ ID NO: 2899566 - protein, 9 aa, Entamoeba invadens
RAFGDDSQL

SEQ ID NO: 2899567 - protein, 6 aa, Entamoeba invadens
RAFSKN

SEQ ID NO: 2899568 - protein, 4 aa, Entamoeba invadens
RAGA

SEQ ID NO: 2899569 - protein, 9 aa, Entamoeba invadens
RAGDKTSGI

SEQ ID NO: 2899570 - protein, 7 aa, Entamoeba invadens
RAGEDVR

SEQ ID NO: 2899571 - protein, 16 aa, Entamoeba invadens
RAGERTGMSIPSSSEK

SEQ ID NO: 2899572 - protein, 19 aa, Entamoeba invadens
RAGGDYDANEDVSSGGEDS

SEQ ID NO: 2899573 - protein, 7 aa, Entamoeba invadens
RAGGEYT

SEQ ID NO: 2899574 - protein, 9 aa, Entamoeba invadens
RAGKDQVKE

SEQ ID NO: 2899575 - protein, 5 aa, Entamoeba invadens
RAGLQ

SEQ ID NO: 2899576 - protein, 10 aa, Entamoeba invadens
RAGPGLKPQD

SEQ ID NO: 2899577 - protein, 32 aa, Entamoeba invadens
RAGRAARAKTAENDNLDDVDDDTITDAQSQGI

SEQ ID NO: 2899578 - protein, 6 aa, Entamoeba invadens
RAGRFD

SEQ ID NO: 2899579 - protein, 5 aa, Entamoeba invadens
RAGRI

SEQ ID NO: 2899580 - protein, 10 aa, Entamoeba invadens
RAGSNHQTQV

SEQ ID NO: 2899581 - protein, 14 aa, Entamoeba invadens
RAGTKTKTKSNRYK

SEQ ID NO: 2899582 - protein, 9 aa, Entamoeba invadens
RAHGGGEVA

SEQ ID NO: 2899583 - protein, 6 aa, Entamoeba invadens
RAIAGQ

SEQ ID NO: 2899584 - protein, 17 aa, Entamoeba invadens
RAIDTNSTVTEDGEVQS

SEQ ID NO: 2899585 - protein, 12 aa, Entamoeba invadens
RAINEDKVTNIT

SEQ ID NO: 2899586 - protein, 4 aa, Entamoeba invadens
RAIQ

SEQ ID NO: 2899587 - protein, 5 aa, Entamoeba invadens
RAITG

SEQ ID NO: 2899588 - protein, 8 aa, Entamoeba invadens
RAKDEAFK

SEQ ID NO: 2899589 - protein, 8 aa, Entamoeba invadens
RAKDTLPS

SEQ ID NO: 2899590 - protein, 5 aa, Entamoeba invadens
RAKGH

SEQ ID NO: 2899591 - protein, 12 aa, Entamoeba invadens
RAKGKRSTYDSL

SEQ ID NO: 2899592 - protein, 11 aa, Entamoeba invadens
RAKKASMRTST

SEQ ID NO: 2899593 - protein, 10 aa, Entamoeba invadens
RAKKDGNEKA

SEQ ID NO: 2899594 - protein, 8 aa, Entamoeba invadens
RAKKGVNI

SEQ ID NO: 2899595 - protein, 13 aa, Entamoeba invadens
RAKKQKTEVDSKK

SEQ ID NO: 2899596 - protein, 4 aa, Entamoeba invadens
RAKL

SEQ ID NO: 2899597 - protein, 5 aa, Entamoeba invadens
RAKLE

SEQ ID NO: 2899598 - protein, 22 aa, Entamoeba invadens
RAKLHGKRSSSLHTLKDDFLDI

SEQ ID NO: 2899599 - protein, 10 aa, Entamoeba invadens
RAKLKKSDFE

SEQ ID NO: 2899600 - protein, 7 aa, Entamoeba invadens
RAKNEHK

SEQ ID NO: 2899601 - protein, 42 aa, Entamoeba invadens
RAKPVERVEKSKTIKTEGAENNTQNNQMEEEWESNGMSDLSG

SEQ ID NO: 2899602 - protein, 8 aa, Entamoeba invadens
RAKQLKEE

SEQ ID NO: 2899603 - protein, 18 aa, Entamoeba invadens
RAKQQKEQIEMENKKTKE

SEQ ID NO: 2899604 - protein, 13 aa, Entamoeba invadens
RAKRRKDYDTAEG

SEQ ID NO: 2899605 - protein, 10 aa, Entamoeba invadens
RAKTSQRKMN

SEQ ID NO: 2899606 - protein, 8 aa, Entamoeba invadens
RAKTTEEA

SEQ ID NO: 2899607 - protein, 25 aa, Entamoeba invadens
RALDSSKEMANHVNSKTKKMTCKTK

SEQ ID NO: 2899608 - protein, 19 aa, Entamoeba invadens
RALEQAAGRSGRQGQPGTV

SEQ ID NO: 2899609 - protein, 18 aa, Entamoeba invadens
RALEQANGRSGRQGQPGT

SEQ ID NO: 2899610 - protein, 10 aa, Entamoeba invadens
RALGDANRST

SEQ ID NO: 2899611 - protein, 6 aa, Entamoeba invadens
RALKRA

SEQ ID NO: 2899612 - protein, 6 aa, Entamoeba invadens
RALRET

SEQ ID NO: 2899613 - protein, 5 aa, Entamoeba invadens
RAMGS

SEQ ID NO: 2899614 - protein, 36 aa, Entamoeba invadens
RANAITKRAQPTSFNDQNKPQINLNAPQKSFEAPQK

SEQ ID NO: 2899615 - protein, 50 aa, Entamoeba invadens
RANEVKKQKTEQKTEKNVPKTTEKKEEPAKKVSAEKRKTEIAKPPKEVEE

SEQ ID NO: 2899616 - protein, 7 aa, Entamoeba invadens
RANEVQR

SEQ ID NO: 2899617 - protein, 7 aa, Entamoeba invadens
RANGEAD

SEQ ID NO: 2899618 - protein, 8 aa, Entamoeba invadens
RANGGELD

SEQ ID NO: 2899619 - protein, 8 aa, Entamoeba invadens
RANGITGY

SEQ ID NO: 2899620 - protein, 7 aa, Entamoeba invadens
RANKPEK

SEQ ID NO: 2899621 - protein, 12 aa, Entamoeba invadens
RANSEENKQENV

SEQ ID NO: 2899622 - protein, 32 aa, Entamoeba invadens
RANSKTKEVKQKEKTRKEVLNSQEAKAIQKSE

SEQ ID NO: 2899623 - protein, 7 aa, Entamoeba invadens
RANSNTW

SEQ ID NO: 2899624 - protein, 5 aa, Entamoeba invadens
RANSR

SEQ ID NO: 2899625 - protein, 11 aa, Entamoeba invadens
RANTRNDNEKF

SEQ ID NO: 2899626 - protein, 12 aa, Entamoeba invadens
RAPKRNAKQKIP

SEQ ID NO: 2899627 - protein, 7 aa, Entamoeba invadens
RAPNSIK

SEQ ID NO: 2899628 - protein, 7 aa, Entamoeba invadens
RAPNTTK

SEQ ID NO: 2899629 - protein, 5 aa, Entamoeba invadens
RAPPK

SEQ ID NO: 2899630 - protein, 13 aa, Entamoeba invadens
RAPPQDAMKEMEN

SEQ ID NO: 2899631 - protein, 14 aa, Entamoeba invadens
RAPPQESAKEIENT

SEQ ID NO: 2899632 - protein, 5 aa, Entamoeba invadens
RAPQE

SEQ ID NO: 2899633 - protein, 8 aa, Entamoeba invadens
RAPTDEIR

SEQ ID NO: 2899634 - protein, 4 aa, Entamoeba invadens
RAPY

SEQ ID NO: 2899635 - protein, 8 aa, Entamoeba invadens
RAQEEVKR

SEQ ID NO: 2899636 - protein, 13 aa, Entamoeba invadens
RAQEKEKTPRQLR

SEQ ID NO: 2899637 - protein, 6 aa, Entamoeba invadens
RAQQKS

SEQ ID NO: 2899638 - protein, 6 aa, Entamoeba invadens
RAQREK

SEQ ID NO: 2899639 - protein, 37 aa, Entamoeba invadens
RAQSTKQQQTPYKEKRTSLHHKKNETNIFKNSKGDYA

SEQ ID NO: 2899640 - protein, 10 aa, Entamoeba invadens
RAREPKKSTL

SEQ ID NO: 2899641 - protein, 8 aa, Entamoeba invadens
RARKNDNL

SEQ ID NO: 2899642 - protein, 6 aa, Entamoeba invadens
RARSAT

SEQ ID NO: 2899643 - protein, 8 aa, Entamoeba invadens
RARTGRGL

SEQ ID NO: 2899644 - protein, 4 aa, Entamoeba invadens
RASA

SEQ ID NO: 2899645 - protein, 5 aa, Entamoeba invadens
RASCE

SEQ ID NO: 2899646 - protein, 9 aa, Entamoeba invadens
RASDEETRR

SEQ ID NO: 2899647 - protein, 47 aa, Entamoeba invadens
RASDEKQRDNRGRSNSRGKLSNHKERDEDYEFKKSQRIDKDIKGHKF

SEQ ID NO: 2899648 - protein, 7 aa, Entamoeba invadens
RASEGID

SEQ ID NO: 2899649 - protein, 4 aa, Entamoeba invadens
RASF

SEQ ID NO: 2899650 - protein, 5 aa, Entamoeba invadens
RASFD

SEQ ID NO: 2899651 - protein, 11 aa, Entamoeba invadens
RASFSKNQTNI

SEQ ID NO: 2899652 - protein, 6 aa, Entamoeba invadens
RASGNP

SEQ ID NO: 2899653 - protein, 7 aa, Entamoeba invadens
RASNKNV

SEQ ID NO: 2899654 - protein, 13 aa, Entamoeba invadens
RASNYGKDEGEVN

SEQ ID NO: 2899655 - protein, 11 aa, Entamoeba invadens
RASPTKPPTEI

SEQ ID NO: 2899656 - protein, 8 aa, Entamoeba invadens
RASQDQTI

SEQ ID NO: 2899657 - protein, 5 aa, Entamoeba invadens
RASSG

SEQ ID NO: 2899658 - protein, 26 aa, Entamoeba invadens
RASSQEQKKVWQGSNRNNTKSTAFGH

SEQ ID NO: 2899659 - protein, 12 aa, Entamoeba invadens
RASTDRDSAQQG

SEQ ID NO: 2899660 - protein, 4 aa, Entamoeba invadens
RASV

SEQ ID NO: 2899661 - protein, 18 aa, Entamoeba invadens
RASVYDDEEKQKRMEECS

SEQ ID NO: 2899662 - protein, 6 aa, Entamoeba invadens
RATAKE

SEQ ID NO: 2899663 - protein, 8 aa, Entamoeba invadens
RATASTNA

SEQ ID NO: 2899664 - protein, 10 aa, Entamoeba invadens
RATDENYDKT

SEQ ID NO: 2899665 - protein, 6 aa, Entamoeba invadens
RATDLT

SEQ ID NO: 2899666 - protein, 7 aa, Entamoeba invadens
RATEDGY

SEQ ID NO: 2899667 - protein, 10 aa, Entamoeba invadens
RATEPSKGTL

SEQ ID NO: 2899668 - protein, 18 aa, Entamoeba invadens
RATGATVVSRTEELNESH

SEQ ID NO: 2899669 - protein, 6 aa, Entamoeba invadens
RATGDL

SEQ ID NO: 2899670 - protein, 12 aa, Entamoeba invadens
RATIAKKDSVIT

SEQ ID NO: 2899671 - protein, 18 aa, Entamoeba invadens
RATKPTKNDDKNEVERRQ

SEQ ID NO: 2899672 - protein, 41 aa, Entamoeba invadens
RATKSPSDESPPPSANTSNPNETNETIESVQTSQQPEEIQS

SEQ ID NO: 2899673 - protein, 9 aa, Entamoeba invadens
RATLDPNSP

SEQ ID NO: 2899674 - protein, 4 aa, Entamoeba invadens
RATN

SEQ ID NO: 2899675 - protein, 10 aa, Entamoeba invadens
RATPKSSQQL

SEQ ID NO: 2899676 - protein, 6 aa, Entamoeba invadens
RATRDV

SEQ ID NO: 2899677 - protein, 14 aa, Entamoeba invadens
RATRPFSQRQDKHT

SEQ ID NO: 2899678 - protein, 9 aa, Entamoeba invadens
RATTKIGSD

SEQ ID NO: 2899679 - protein, 5 aa, Entamoeba invadens
RAVEK

SEQ ID NO: 2899680 - protein, 6 aa, Entamoeba invadens
RAVGAQ

SEQ ID NO: 2899681 - protein, 7 aa, Entamoeba invadens
RAVGKGL

SEQ ID NO: 2899682 - protein, 16 aa, Entamoeba invadens
RAVNENAEKAKAAENH

SEQ ID NO: 2899683 - protein, 5 aa, Entamoeba invadens
RAVQS

SEQ ID NO: 2899684 - protein, 48 aa, Entamoeba invadens
RAVSERKDELRRKKEEEERKIQEDFEKQQQEERDQAERMKRSISERRQ

SEQ ID NO: 2899685 - protein, 9 aa, Entamoeba invadens
RAVTNDELR

SEQ ID NO: 2899686 - protein, 4 aa, Entamoeba invadens
RAVY

SEQ ID NO: 2899687 - protein, 15 aa, Entamoeba invadens
RAWADKEKKYREEIS

SEQ ID NO: 2899688 - protein, 6 aa, Entamoeba invadens
RAYPDT

SEQ ID NO: 2899689 - protein, 5 aa, Entamoeba invadens
RAYQG

SEQ ID NO: 2899690 - protein, 4 aa, Entamoeba invadens
RAYS

SEQ ID NO: 2899691 - protein, 32 aa, Entamoeba invadens
RCASATPRTSEYGEKKSSSDAERSDVEDDNEV

SEQ ID NO: 2899692 - protein, 8 aa, Entamoeba invadens
RCASDYSR

SEQ ID NO: 2899693 - protein, 9 aa, Entamoeba invadens
RCDSHPDDE

SEQ ID NO: 2899694 - protein, 4 aa, Entamoeba invadens
RCEC

SEQ ID NO: 2899695 - protein, 9 aa, Entamoeba invadens
RCEEESEHN

SEQ ID NO: 2899696 - protein, 4 aa, Entamoeba invadens
RCEK

SEQ ID NO: 2899697 - protein, 15 aa, Entamoeba invadens
RCGGDKEKIKEDNLK

SEQ ID NO: 2899698 - protein, 7 aa, Entamoeba invadens
RCGRDNI

SEQ ID NO: 2899699 - protein, 9 aa, Entamoeba invadens
RCGRSQKAG

SEQ ID NO: 2899700 - protein, 10 aa, Entamoeba invadens
RCHDNVNNTE

SEQ ID NO: 2899701 - protein, 5 aa, Entamoeba invadens
RCKGG

SEQ ID NO: 2899702 - protein, 11 aa, Entamoeba invadens
RCKKKKRNTRI

SEQ ID NO: 2899703 - protein, 8 aa, Entamoeba invadens
RCPAGDRE

SEQ ID NO: 2899704 - protein, 7 aa, Entamoeba invadens
RCPKPIQ

SEQ ID NO: 2899705 - protein, 19 aa, Entamoeba invadens
RCPNNQGDRFSKIIKKIVL

SEQ ID NO: 2899706 - protein, 7 aa, Entamoeba invadens
RCRSPEI

SEQ ID NO: 2899707 - protein, 7 aa, Entamoeba invadens
RCSAYPN

SEQ ID NO: 2899708 - protein, 5 aa, Entamoeba invadens
RCSKV

SEQ ID NO: 2899709 - protein, 7 aa, Entamoeba invadens
RCSNEQR

SEQ ID NO: 2899710 - protein, 6 aa, Entamoeba invadens
RCSSTF

SEQ ID NO: 2899711 - protein, 12 aa, Entamoeba invadens
RCTAGSAKYHPE

SEQ ID NO: 2899712 - protein, 6 aa, Entamoeba invadens
RCTKEF

SEQ ID NO: 2899713 - protein, 11 aa, Entamoeba invadens
RCTNNADQCNE

SEQ ID NO: 2899714 - protein, 7 aa, Entamoeba invadens
RCTPCDS

SEQ ID NO: 2899715 - protein, 16 aa, Entamoeba invadens
RCVEEAPKKNKGDPIK

SEQ ID NO: 2899716 - protein, 5 aa, Entamoeba invadens
RDAAA

SEQ ID NO: 2899717 - protein, 8 aa, Entamoeba invadens
RDAANGNY

SEQ ID NO: 2899718 - protein, 5 aa, Entamoeba invadens
RDACS

SEQ ID NO: 2899719 - protein, 11 aa, Entamoeba invadens
RDADDKKMKER

SEQ ID NO: 2899720 - protein, 11 aa, Entamoeba invadens
RDAGQTEADTQ

SEQ ID NO: 2899721 - protein, 6 aa, Entamoeba invadens
RDAIEK

SEQ ID NO: 2899722 - protein, 6 aa, Entamoeba invadens
RDAISS

SEQ ID NO: 2899723 - protein, 10 aa, Entamoeba invadens
RDALGSGTEF

SEQ ID NO: 2899724 - protein, 5 aa, Entamoeba invadens
RDANE

SEQ ID NO: 2899725 - protein, 14 aa, Entamoeba invadens
RDASTTFEKTFTPG

SEQ ID NO: 2899726 - protein, 8 aa, Entamoeba invadens
RDASVSEI

SEQ ID NO: 2899727 - protein, 8 aa, Entamoeba invadens
RDATKDVS

SEQ ID NO: 2899728 - protein, 16 aa, Entamoeba invadens
RDATMSEVPDEEKSFP

SEQ ID NO: 2899729 - protein, 12 aa, Entamoeba invadens
RDCKRNGQSETD

SEQ ID NO: 2899730 - protein, 35 aa, Entamoeba invadens
RDCPKKKEMRSKYEMKDKERSLARGPRAPRRPNPS

SEQ ID NO: 2899731 - protein, 7 aa, Entamoeba invadens
RDDDLPK

SEQ ID NO: 2899732 - protein, 10 aa, Entamoeba invadens
RDDELSNNAE

SEQ ID NO: 2899733 - protein, 5 aa, Entamoeba invadens
RDDEQ

SEQ ID NO: 2899734 - protein, 55 aa, Entamoeba invadens
RDDESVKRTYSKQKIKNEKTIKQDVSDESDEEYIQSEESENESVEEADKCYLWGV

SEQ ID NO: 2899735 - protein, 55 aa, Entamoeba invadens
RDDESVKRTYSKQKIKVEKTIKQDVSDESDEEYIQSEESENESVDEADKCYLWGG

SEQ ID NO: 2899736 - protein, 12 aa, Entamoeba invadens
RDDIEKSGKKIS

SEQ ID NO: 2899737 - protein, 8 aa, Entamoeba invadens
RDDIGNKD

SEQ ID NO: 2899738 - protein, 8 aa, Entamoeba invadens
RDDKPDYQ

SEQ ID NO: 2899739 - protein, 5 aa, Entamoeba invadens
RDDPT

SEQ ID NO: 2899740 - protein, 12 aa, Entamoeba invadens
RDDQDANLFHYI

SEQ ID NO: 2899741 - protein, 5 aa, Entamoeba invadens
RDDQH

SEQ ID NO: 2899742 - protein, 10 aa, Entamoeba invadens
RDDRRTHGSH

SEQ ID NO: 2899743 - protein, 8 aa, Entamoeba invadens
RDDSDFPM

SEQ ID NO: 2899744 - protein, 8 aa, Entamoeba invadens
RDDTQNLK

SEQ ID NO: 2899745 - protein, 23 aa, Entamoeba invadens
RDDTQTDITKRNNEFDDDKNVFL

SEQ ID NO: 2899746 - protein, 9 aa, Entamoeba invadens
RDDTQTLSS

SEQ ID NO: 2899747 - protein, 6 aa, Entamoeba invadens
RDDTST

SEQ ID NO: 2899748 - protein, 16 aa, Entamoeba invadens
RDDYQENGDDAMKAKF

SEQ ID NO: 2899749 - protein, 21 aa, Entamoeba invadens
RDEDEEKERRLREAEEAKKAK

SEQ ID NO: 2899750 - protein, 11 aa, Entamoeba invadens
RDEEQESYEKP

SEQ ID NO: 2899751 - protein, 13 aa, Entamoeba invadens
RDEETDKEKKPIR

SEQ ID NO: 2899752 - protein, 23 aa, Entamoeba invadens
RDEETFAKQKAREEKTTKKTTMK

SEQ ID NO: 2899753 - protein, 9 aa, Entamoeba invadens
RDEETTEKY

SEQ ID NO: 2899754 - protein, 10 aa, Entamoeba invadens
RDEFESKKDR

SEQ ID NO: 2899755 - protein, 17 aa, Entamoeba invadens
RDEGFKKRVEQKTNLEV

SEQ ID NO: 2899756 - protein, 7 aa, Entamoeba invadens
RDEIPGL

SEQ ID NO: 2899757 - protein, 6 aa, Entamoeba invadens
RDEKKL

SEQ ID NO: 2899758 - protein, 8 aa, Entamoeba invadens
RDELKDDQ

SEQ ID NO: 2899759 - protein, 12 aa, Entamoeba invadens
RDELKKQNEKMR

SEQ ID NO: 2899760 - protein, 12 aa, Entamoeba invadens
RDELPRAVPDFF

SEQ ID NO: 2899761 - protein, 12 aa, Entamoeba invadens
RDELSAKYGGKE

SEQ ID NO: 2899762 - protein, 7 aa, Entamoeba invadens
RDEMNEK

SEQ ID NO: 2899763 - protein, 9 aa, Entamoeba invadens
RDENGAKRL

SEQ ID NO: 2899764 - protein, 13 aa, Entamoeba invadens
RDENQFNPYDNNE

SEQ ID NO: 2899765 - protein, 4 aa, Entamoeba invadens
RDEQ

SEQ ID NO: 2899766 - protein, 6 aa, Entamoeba invadens
RDESDV

SEQ ID NO: 2899767 - protein, 8 aa, Entamoeba invadens
RDESEYRM

SEQ ID NO: 2899768 - protein, 10 aa, Entamoeba invadens
RDESRTYEDR

SEQ ID NO: 2899769 - protein, 4 aa, Entamoeba invadens
RDET

SEQ ID NO: 2899770 - protein, 8 aa, Entamoeba invadens
RDETKAPV

SEQ ID NO: 2899771 - protein, 7 aa, Entamoeba invadens
RDETLSS

SEQ ID NO: 2899772 - protein, 9 aa, Entamoeba invadens
RDETVKEAK

SEQ ID NO: 2899773 - protein, 14 aa, Entamoeba invadens
RDEVGDVPSETLEN

SEQ ID NO: 2899774 - protein, 4 aa, Entamoeba invadens
RDFA

SEQ ID NO: 2899775 - protein, 4 aa, Entamoeba invadens
RDFT

SEQ ID NO: 2899776 - protein, 10 aa, Entamoeba invadens
RDFTHSSSKK

SEQ ID NO: 2899777 - protein, 8 aa, Entamoeba invadens
RDGCGRTP

SEQ ID NO: 2899778 - protein, 6 aa, Entamoeba invadens
RDGESL

SEQ ID NO: 2899779 - protein, 6 aa, Entamoeba invadens
RDGETV

SEQ ID NO: 2899780 - protein, 9 aa, Entamoeba invadens
RDGGSIENK

SEQ ID NO: 2899781 - protein, 7 aa, Entamoeba invadens
RDGGSLG

SEQ ID NO: 2899782 - protein, 6 aa, Entamoeba invadens
RDGHVA

SEQ ID NO: 2899783 - protein, 7 aa, Entamoeba invadens
RDGKNAE

SEQ ID NO: 2899784 - protein, 7 aa, Entamoeba invadens
RDGMSKR

SEQ ID NO: 2899785 - protein, 17 aa, Entamoeba invadens
RDGNTTINTSSPQIRQK

SEQ ID NO: 2899786 - protein, 5 aa, Entamoeba invadens
RDGPN

SEQ ID NO: 2899787 - protein, 7 aa, Entamoeba invadens
RDGQERI

SEQ ID NO: 2899788 - protein, 7 aa, Entamoeba invadens
RDGQKKK

SEQ ID NO: 2899789 - protein, 7 aa, Entamoeba invadens
RDGRDYE

SEQ ID NO: 2899790 - protein, 5 aa, Entamoeba invadens
RDGRT

SEQ ID NO: 2899791 - protein, 8 aa, Entamoeba invadens
RDGVGSFP

SEQ ID NO: 2899792 - protein, 9 aa, Entamoeba invadens
RDGVHKESK

SEQ ID NO: 2899793 - protein, 6 aa, Entamoeba invadens
RDGYLN

SEQ ID NO: 2899794 - protein, 6 aa, Entamoeba invadens
RDHKNR

SEQ ID NO: 2899795 - protein, 5 aa, Entamoeba invadens
RDHNV

SEQ ID NO: 2899796 - protein, 4 aa, Entamoeba invadens
RDHT

SEQ ID NO: 2899797 - protein, 12 aa, Entamoeba invadens
RDIGTVEQSTQP

SEQ ID NO: 2899798 - protein, 5 aa, Entamoeba invadens
RDIKK

SEQ ID NO: 2899799 - protein, 5 aa, Entamoeba invadens
RDIKP

SEQ ID NO: 2899800 - protein, 8 aa, Entamoeba invadens
RDIKSDNT

SEQ ID NO: 2899801 - protein, 11 aa, Entamoeba invadens
RDIKSKDPCAT

SEQ ID NO: 2899802 - protein, 8 aa, Entamoeba invadens
RDINSDGV

SEQ ID NO: 2899803 - protein, 6 aa, Entamoeba invadens
RDIPEE

SEQ ID NO: 2899804 - protein, 9 aa, Entamoeba invadens
RDIQDKDAI

SEQ ID NO: 2899805 - protein, 13 aa, Entamoeba invadens
RDIRPYGILVLEC

SEQ ID NO: 2899806 - protein, 9 aa, Entamoeba invadens
RDISEVTKE

SEQ ID NO: 2899807 - protein, 37 aa, Entamoeba invadens
RDISKQTGKEAEKDPPSNTKAEGQSESPHLESDGQVV

SEQ ID NO: 2899808 - protein, 8 aa, Entamoeba invadens
RDITDNNE

SEQ ID NO: 2899809 - protein, 4 aa, Entamoeba invadens
RDKA

SEQ ID NO: 2899810 - protein, 4 aa, Entamoeba invadens
RDKD

SEQ ID NO: 2899811 - protein, 24 aa, Entamoeba invadens
RDKDEMENSSRSENGEGSENETNK

SEQ ID NO: 2899812 - protein, 5 aa, Entamoeba invadens
RDKDI

SEQ ID NO: 2899813 - protein, 9 aa, Entamoeba invadens
RDKDLEPKR

SEQ ID NO: 2899814 - protein, 8 aa, Entamoeba invadens
RDKFEDKE

SEQ ID NO: 2899815 - protein, 10 aa, Entamoeba invadens
RDKKDSQKEV

SEQ ID NO: 2899816 - protein, 6 aa, Entamoeba invadens
RDKKLY

SEQ ID NO: 2899817 - protein, 8 aa, Entamoeba invadens
RDKRGVHS

SEQ ID NO: 2899818 - protein, 6 aa, Entamoeba invadens
RDKRLD

SEQ ID NO: 2899819 - protein, 6 aa, Entamoeba invadens
RDKSNN

SEQ ID NO: 2899820 - protein, 14 aa, Entamoeba invadens
RDKTKLKGDNNKWA

SEQ ID NO: 2899821 - protein, 7 aa, Entamoeba invadens
RDKTQQI

SEQ ID NO: 2899822 - protein, 9 aa, Entamoeba invadens
RDKYKKAAD

SEQ ID NO: 2899823 - protein, 5 aa, Entamoeba invadens
RDLDN

SEQ ID NO: 2899824 - protein, 4 aa, Entamoeba invadens
RDLE

SEQ ID NO: 2899825 - protein, 12 aa, Entamoeba invadens
RDLEANNTELNE

SEQ ID NO: 2899826 - protein, 13 aa, Entamoeba invadens
RDLEANNTELTEL

SEQ ID NO: 2899827 - protein, 13 aa, Entamoeba invadens
RDLEETEQSTTGV

SEQ ID NO: 2899828 - protein, 22 aa, Entamoeba invadens
RDLESEKNEFGDEIENGGTIDE

SEQ ID NO: 2899829 - protein, 10 aa, Entamoeba invadens
RDLGKKVEKP

SEQ ID NO: 2899830 - protein, 7 aa, Entamoeba invadens
RDLNTNK

SEQ ID NO: 2899831 - protein, 8 aa, Entamoeba invadens
RDLPDKDM

SEQ ID NO: 2899832 - protein, 9 aa, Entamoeba invadens
RDLQNGFSY

SEQ ID NO: 2899833 - protein, 19 aa, Entamoeba invadens
RDMGETAETKKESASSSEI

SEQ ID NO: 2899834 - protein, 10 aa, Entamoeba invadens
RDMGKTGHAR

SEQ ID NO: 2899835 - protein, 13 aa, Entamoeba invadens
RDMPKPSGSAYKK

SEQ ID NO: 2899836 - protein, 7 aa, Entamoeba invadens
RDMSNTI

SEQ ID NO: 2899837 - protein, 8 aa, Entamoeba invadens
RDNGAKEE

SEQ ID NO: 2899838 - protein, 6 aa, Entamoeba invadens
RDNGKG

SEQ ID NO: 2899839 - protein, 9 aa, Entamoeba invadens
RDNKQRKYT

SEQ ID NO: 2899840 - protein, 8 aa, Entamoeba invadens
RDNPRFTE

SEQ ID NO: 2899841 - protein, 11 aa, Entamoeba invadens
RDNRDQKSNTI

SEQ ID NO: 2899842 - protein, 10 aa, Entamoeba invadens
RDNRTKYPIP

SEQ ID NO: 2899843 - protein, 5 aa, Entamoeba invadens
RDNSI

SEQ ID NO: 2899844 - protein, 15 aa, Entamoeba invadens
RDNSTTAIKKNGQKY

SEQ ID NO: 2899845 - protein, 8 aa, Entamoeba invadens
RDNTEDLE

SEQ ID NO: 2899846 - protein, 29 aa, Entamoeba invadens
RDNTKAETINKQKIEKNDEDDESIEMPTK

SEQ ID NO: 2899847 - protein, 10 aa, Entamoeba invadens
RDNTKQRVTK

SEQ ID NO: 2899848 - protein, 10 aa, Entamoeba invadens
RDNTNQRVTK

SEQ ID NO: 2899849 - protein, 6 aa, Entamoeba invadens
RDNTNV

SEQ ID NO: 2899850 - protein, 10 aa, Entamoeba invadens
RDNTTNPVDF

SEQ ID NO: 2899851 - protein, 22 aa, Entamoeba invadens
RDNVEYDQPSFQSGATSLNPET

SEQ ID NO: 2899852 - protein, 17 aa, Entamoeba invadens
RDNVREKGSRGKGMTTL

SEQ ID NO: 2899853 - protein, 7 aa, Entamoeba invadens
RDPARLA

SEQ ID NO: 2899854 - protein, 8 aa, Entamoeba invadens
RDPASPFP

SEQ ID NO: 2899855 - protein, 6 aa, Entamoeba invadens
RDPASV

SEQ ID NO: 2899856 - protein, 9 aa, Entamoeba invadens
RDPDNYRPR

SEQ ID NO: 2899857 - protein, 8 aa, Entamoeba invadens
RDPGTGEN

SEQ ID NO: 2899858 - protein, 7 aa, Entamoeba invadens
RDPHGNV

SEQ ID NO: 2899859 - protein, 4 aa, Entamoeba invadens
RDPK

SEQ ID NO: 2899860 - protein, 5 aa, Entamoeba invadens
RDPKG

SEQ ID NO: 2899861 - protein, 7 aa, Entamoeba invadens
RDPKRYI

SEQ ID NO: 2899862 - protein, 13 aa, Entamoeba invadens
RDPMGTRSKHVEE

SEQ ID NO: 2899863 - protein, 5 aa, Entamoeba invadens
RDPQF

SEQ ID NO: 2899864 - protein, 8 aa, Entamoeba invadens
RDPSSPIP

SEQ ID NO: 2899865 - protein, 34 aa, Entamoeba invadens
RDPTKKKEKEEQKQKEKEEKKEKKEKKKEEKDKK

SEQ ID NO: 2899866 - protein, 4 aa, Entamoeba invadens
RDPY

SEQ ID NO: 2899867 - protein, 16 aa, Entamoeba invadens
RDQAINNKRVEHGTTT

SEQ ID NO: 2899868 - protein, 7 aa, Entamoeba invadens
RDQDNEE

SEQ ID NO: 2899869 - protein, 7 aa, Entamoeba invadens
RDQEASM

SEQ ID NO: 2899870 - protein, 8 aa, Entamoeba invadens
RDQEGSTL

SEQ ID NO: 2899871 - protein, 8 aa, Entamoeba invadens
RDQKKTNF

SEQ ID NO: 2899872 - protein, 6 aa, Entamoeba invadens
RDQNNC

SEQ ID NO: 2899873 - protein, 9 aa, Entamoeba invadens
RDQPIPTQR

SEQ ID NO: 2899874 - protein, 7 aa, Entamoeba invadens
RDQPTQH

SEQ ID NO: 2899875 - protein, 13 aa, Entamoeba invadens
RDQPYMTKGRQRE

SEQ ID NO: 2899876 - protein, 5 aa, Entamoeba invadens
RDQTD

SEQ ID NO: 2899877 - protein, 7 aa, Entamoeba invadens
RDQTEAL

SEQ ID NO: 2899878 - protein, 8 aa, Entamoeba invadens
RDRATNYR

SEQ ID NO: 2899879 - protein, 16 aa, Entamoeba invadens
RDRGDVPDIHRKPFFM

SEQ ID NO: 2899880 - protein, 12 aa, Entamoeba invadens
RDRIQDEIGGED

SEQ ID NO: 2899881 - protein, 10 aa, Entamoeba invadens
RDRKTLTPTQ

SEQ ID NO: 2899882 - protein, 11 aa, Entamoeba invadens
RDRKTLTPTQY

SEQ ID NO: 2899883 - protein, 15 aa, Entamoeba invadens
RDRLEKDKTSGIKVG

SEQ ID NO: 2899884 - protein, 7 aa, Entamoeba invadens
RDRLSAK

SEQ ID NO: 2899885 - protein, 43 aa, Entamoeba invadens
RDRSRSRERDRDRSWDRDRRDDRYDTRYSSRDREWADIDLNRK

SEQ ID NO: 2899886 - protein, 11 aa, Entamoeba invadens
RDRTAKDKKKI

SEQ ID NO: 2899887 - protein, 17 aa, Entamoeba invadens
RDRTAKDKKKIADLEQQ

SEQ ID NO: 2899888 - protein, 21 aa, Entamoeba invadens
RDRTAKDKKKITDLEQQRDNQ

SEQ ID NO: 2899889 - protein, 43 aa, Entamoeba invadens
RDRVRRDKDDSPRSERFRDRYESDECYSPRERRNSYSPRDFSP

SEQ ID NO: 2899890 - protein, 10 aa, Entamoeba invadens
RDRVSGQHRG

SEQ ID NO: 2899891 - protein, 4 aa, Entamoeba invadens
RDSC

SEQ ID NO: 2899892 - protein, 6 aa, Entamoeba invadens
RDSDAL

SEQ ID NO: 2899893 - protein, 9 aa, Entamoeba invadens
RDSDVDMST

SEQ ID NO: 2899894 - protein, 23 aa, Entamoeba invadens
RDSEPAGTMSNAPENEAPQRTKN

SEQ ID NO: 2899895 - protein, 12 aa, Entamoeba invadens
RDSERKKRAKHN

SEQ ID NO: 2899896 - protein, 5 aa, Entamoeba invadens
RDSFE

SEQ ID NO: 2899897 - protein, 10 aa, Entamoeba invadens
RDSGNVENDL

SEQ ID NO: 2899898 - protein, 6 aa, Entamoeba invadens
RDSIQK

SEQ ID NO: 2899899 - protein, 12 aa, Entamoeba invadens
RDSISNLETPTD

SEQ ID NO: 2899900 - protein, 7 aa, Entamoeba invadens
RDSKYQE

SEQ ID NO: 2899901 - protein, 7 aa, Entamoeba invadens
RDSLNDG

SEQ ID NO: 2899902 - protein, 4 aa, Entamoeba invadens
RDSN

SEQ ID NO: 2899903 - protein, 8 aa, Entamoeba invadens
RDSNGKKF

SEQ ID NO: 2899904 - protein, 8 aa, Entamoeba invadens
RDSNNRAE

SEQ ID NO: 2899905 - protein, 10 aa, Entamoeba invadens
RDSPDDYDKK

SEQ ID NO: 2899906 - protein, 6 aa, Entamoeba invadens
RDSPHA

SEQ ID NO: 2899907 - protein, 7 aa, Entamoeba invadens
RDSPTKF

SEQ ID NO: 2899908 - protein, 7 aa, Entamoeba invadens
RDSQAIQ

SEQ ID NO: 2899909 - protein, 4 aa, Entamoeba invadens
RDSS

SEQ ID NO: 2899910 - protein, 5 aa, Entamoeba invadens
RDSTK

SEQ ID NO: 2899911 - protein, 6 aa, Entamoeba invadens
RDSTTL

SEQ ID NO: 2899912 - protein, 12 aa, Entamoeba invadens
RDSVDGSVTKKQ

SEQ ID NO: 2899913 - protein, 6 aa, Entamoeba invadens
RDSVQK

SEQ ID NO: 2899914 - protein, 7 aa, Entamoeba invadens
RDTADSL

SEQ ID NO: 2899915 - protein, 8 aa, Entamoeba invadens
RDTDFGQN

SEQ ID NO: 2899916 - protein, 7 aa, Entamoeba invadens
RDTERTQ

SEQ ID NO: 2899917 - protein, 5 aa, Entamoeba invadens
RDTGE

SEQ ID NO: 2899918 - protein, 12 aa, Entamoeba invadens
RDTISYAKPPVN

SEQ ID NO: 2899919 - protein, 15 aa, Entamoeba invadens
RDTKKRRSMSSAKGM

SEQ ID NO: 2899920 - protein, 4 aa, Entamoeba invadens
RDTL

SEQ ID NO: 2899921 - protein, 8 aa, Entamoeba invadens
RDTLDDTD

SEQ ID NO: 2899922 - protein, 6 aa, Entamoeba invadens
RDTLPF

SEQ ID NO: 2899923 - protein, 6 aa, Entamoeba invadens
RDTNGR

SEQ ID NO: 2899924 - protein, 7 aa, Entamoeba invadens
RDTPEGV

SEQ ID NO: 2899925 - protein, 6 aa, Entamoeba invadens
RDTPTN

SEQ ID NO: 2899926 - protein, 7 aa, Entamoeba invadens
RDTQKNR

SEQ ID NO: 2899927 - protein, 4 aa, Entamoeba invadens
RDTT

SEQ ID NO: 2899928 - protein, 6 aa, Entamoeba invadens
RDTTTT

SEQ ID NO: 2899929 - protein, 5 aa, Entamoeba invadens
RDTVS

SEQ ID NO: 2899930 - protein, 16 aa, Entamoeba invadens
RDTVTTQLRNSNTKFK

SEQ ID NO: 2899931 - protein, 4 aa, Entamoeba invadens
RDTY

SEQ ID NO: 2899932 - protein, 7 aa, Entamoeba invadens
RDVAPDS

SEQ ID NO: 2899933 - protein, 8 aa, Entamoeba invadens
RDVAPERS

SEQ ID NO: 2899934 - protein, 4 aa, Entamoeba invadens
RDVD

SEQ ID NO: 2899935 - protein, 8 aa, Entamoeba invadens
RDVDSYPN

SEQ ID NO: 2899936 - protein, 25 aa, Entamoeba invadens
RDVEENEEVEPQEVEENLPERDYDK

SEQ ID NO: 2899937 - protein, 4 aa, Entamoeba invadens
RDVN

SEQ ID NO: 2899938 - protein, 5 aa, Entamoeba invadens
RDVQE

SEQ ID NO: 2899939 - protein, 6 aa, Entamoeba invadens
RDVQTL

SEQ ID NO: 2899940 - protein, 9 aa, Entamoeba invadens
RDVRKATPQ

SEQ ID NO: 2899941 - protein, 10 aa, Entamoeba invadens
RDVSARSKVE

SEQ ID NO: 2899942 - protein, 12 aa, Entamoeba invadens
RDVSESELKKAY

SEQ ID NO: 2899943 - protein, 6 aa, Entamoeba invadens
RDVSSC

SEQ ID NO: 2899944 - protein, 13 aa, Entamoeba invadens
RDVSTGATSANSG

SEQ ID NO: 2899945 - protein, 4 aa, Entamoeba invadens
RDVT

SEQ ID NO: 2899946 - protein, 7 aa, Entamoeba invadens
RDVTENE

SEQ ID NO: 2899947 - protein, 16 aa, Entamoeba invadens
RDVTGNAVNSHKEALA

SEQ ID NO: 2899948 - protein, 13 aa, Entamoeba invadens
RDWGKKGRAKHTT

SEQ ID NO: 2899949 - protein, 6 aa, Entamoeba invadens
RDYHDY

SEQ ID NO: 2899950 - protein, 5 aa, Entamoeba invadens
RDYKE

SEQ ID NO: 2899951 - protein, 4 aa, Entamoeba invadens
RDYQ

SEQ ID NO: 2899952 - protein, 10 aa, Entamoeba invadens
RDYQTSQQGT

SEQ ID NO: 2899953 - protein, 9 aa, Entamoeba invadens
RDYSKGLTP

SEQ ID NO: 2899954 - protein, 20 aa, Entamoeba invadens
RDYVTKDDLTAGKNRIEEDI

SEQ ID NO: 2899955 - protein, 13 aa, Entamoeba invadens
READEDTQKTMTE

SEQ ID NO: 2899956 - protein, 9 aa, Entamoeba invadens
READHSDDL

SEQ ID NO: 2899957 - protein, 54 aa, Entamoeba invadens
REAEDRIAKDKLEKRGNGEMSRQQQKETEADIKAERERKNNERKERKAKKQAEL

SEQ ID NO: 2899958 - protein, 77 aa, Entamoeba invadens
REAEEEKKRVAAEEAENIRKENIRKRRDEEKRKMEEKMRQEEEVKKKKWEEIQKRKQEEKERQEKLETERKEREQQI

SEQ ID NO: 2899959 - protein, 18 aa, Entamoeba invadens
REANIERTNADKATMELN

SEQ ID NO: 2899960 - protein, 5 aa, Entamoeba invadens
REANK

SEQ ID NO: 2899961 - protein, 7 aa, Entamoeba invadens
REAPSPV

SEQ ID NO: 2899962 - protein, 14 aa, Entamoeba invadens
REAQDNKQISYKAP

SEQ ID NO: 2899963 - protein, 11 aa, Entamoeba invadens
REASDGTPPYM

SEQ ID NO: 2899964 - protein, 12 aa, Entamoeba invadens
REASEQKKKLNK

SEQ ID NO: 2899965 - protein, 5 aa, Entamoeba invadens
REATF

SEQ ID NO: 2899966 - protein, 18 aa, Entamoeba invadens
REATNNEQWGPTSKQHQQ

SEQ ID NO: 2899967 - protein, 8 aa, Entamoeba invadens
RECGGKKC

SEQ ID NO: 2899968 - protein, 6 aa, Entamoeba invadens
RECISS

SEQ ID NO: 2899969 - protein, 6 aa, Entamoeba invadens
RECKEK

SEQ ID NO: 2899970 - protein, 8 aa, Entamoeba invadens
RECTQTDQ

SEQ ID NO: 2899971 - protein, 16 aa, Entamoeba invadens
REDAPTQKVKEKPQEY

SEQ ID NO: 2899972 - protein, 9 aa, Entamoeba invadens
REDDKAPTI

SEQ ID NO: 2899973 - protein, 9 aa, Entamoeba invadens
REDDNSLEE

SEQ ID NO: 2899974 - protein, 9 aa, Entamoeba invadens
REDENENME

SEQ ID NO: 2899975 - protein, 10 aa, Entamoeba invadens
REDEQQRQIT

SEQ ID NO: 2899976 - protein, 7 aa, Entamoeba invadens
REDETFG

SEQ ID NO: 2899977 - protein, 20 aa, Entamoeba invadens
REDFSGSDKDEAYKTLESQA

SEQ ID NO: 2899978 - protein, 5 aa, Entamoeba invadens
REDGT

SEQ ID NO: 2899979 - protein, 9 aa, Entamoeba invadens
REDKDHSNV

SEQ ID NO: 2899980 - protein, 10 aa, Entamoeba invadens
REDKDHSTVF

SEQ ID NO: 2899981 - protein, 5 aa, Entamoeba invadens
REDKF

SEQ ID NO: 2899982 - protein, 7 aa, Entamoeba invadens
REDKPKQ

SEQ ID NO: 2899983 - protein, 4 aa, Entamoeba invadens
REDL

SEQ ID NO: 2899984 - protein, 8 aa, Entamoeba invadens
REDLGKVA

SEQ ID NO: 2899985 - protein, 6 aa, Entamoeba invadens
REDPHE

SEQ ID NO: 2899986 - protein, 7 aa, Entamoeba invadens
REDPRYS

SEQ ID NO: 2899987 - protein, 6 aa, Entamoeba invadens
REDQKF

SEQ ID NO: 2899988 - protein, 5 aa, Entamoeba invadens
REDRN

SEQ ID NO: 2899989 - protein, 13 aa, Entamoeba invadens
REDTEASVSYRTK

SEQ ID NO: 2899990 - protein, 8 aa, Entamoeba invadens
REDTTKRL

SEQ ID NO: 2899991 - protein, 4 aa, Entamoeba invadens
REDV

SEQ ID NO: 2899992 - protein, 17 aa, Entamoeba invadens
REDVGDIPSETLKNKSK

SEQ ID NO: 2899993 - protein, 5 aa, Entamoeba invadens
REDWS

SEQ ID NO: 2899994 - protein, 18 aa, Entamoeba invadens
REEAEKEAAKEAGKKKNK

SEQ ID NO: 2899995 - protein, 8 aa, Entamoeba invadens
REEAEKSV

SEQ ID NO: 2899996 - protein, 4 aa, Entamoeba invadens
REED

SEQ ID NO: 2899997 - protein, 14 aa, Entamoeba invadens
REEDNNSETPNYRQ

SEQ ID NO: 2899998 - protein, 6 aa, Entamoeba invadens
REEDVL

SEQ ID NO: 2899999 - protein, 9 aa, Entamoeba invadens
REEEEGLPK

SEQ ID NO: 2900000 - protein, 31 aa, Entamoeba invadens
REEEEVGEVDEGRERRDQAREERRKDREEFY

SEQ ID NO: 2900001 - protein, 23 aa, Entamoeba invadens
REEEFSPLKNANDAKVDCPDSGR

SEQ ID NO: 2900002 - protein, 16 aa, Entamoeba invadens
REEEIVEKKDTSDLNN

SEQ ID NO: 2900003 - protein, 13 aa, Entamoeba invadens
REEEKKEDVDDFE

SEQ ID NO: 2900004 - protein, 27 aa, Entamoeba invadens
REEEKQSEYYRSQNQNVLEPNKHYQDE

SEQ ID NO: 2900005 - protein, 6 aa, Entamoeba invadens
REEERT

SEQ ID NO: 2900006 - protein, 8 aa, Entamoeba invadens
REEESMSK

SEQ ID NO: 2900007 - protein, 5 aa, Entamoeba invadens
REEFP

SEQ ID NO: 2900008 - protein, 4 aa, Entamoeba invadens
REEG

SEQ ID NO: 2900009 - protein, 12 aa, Entamoeba invadens
REEGDHREQTGV

SEQ ID NO: 2900010 - protein, 19 aa, Entamoeba invadens
REEGRRQIEPPNLPNKTDT

SEQ ID NO: 2900011 - protein, 15 aa, Entamoeba invadens
REEIEREKPELQKKL

SEQ ID NO: 2900012 - protein, 11 aa, Entamoeba invadens
REEIKSNKEDA

SEQ ID NO: 2900013 - protein, 5 aa, Entamoeba invadens
REEIS

SEQ ID NO: 2900014 - protein, 4 aa, Entamoeba invadens
REEK

SEQ ID NO: 2900015 - protein, 13 aa, Entamoeba invadens
REEKFNEKKVQEK

SEQ ID NO: 2900016 - protein, 21 aa, Entamoeba invadens
REEKMKERGLETESKECGDIK

SEQ ID NO: 2900017 - protein, 6 aa, Entamoeba invadens
REEKNE

SEQ ID NO: 2900018 - protein, 15 aa, Entamoeba invadens
REEKQKIEEEEKGSL

SEQ ID NO: 2900019 - protein, 37 aa, Entamoeba invadens
REEKRAQKVEENRKRQMEKNERNKQLFEEKKNQGVVR

SEQ ID NO: 2900020 - protein, 4 aa, Entamoeba invadens
REEL

SEQ ID NO: 2900021 - protein, 12 aa, Entamoeba invadens
REELKQEGVSGN

SEQ ID NO: 2900022 - protein, 12 aa, Entamoeba invadens
REELSSKYNGKE

SEQ ID NO: 2900023 - protein, 4 aa, Entamoeba invadens
REEM

SEQ ID NO: 2900024 - protein, 5 aa, Entamoeba invadens
REEMN

SEQ ID NO: 2900025 - protein, 12 aa, Entamoeba invadens
REEQGPIDLQPN

SEQ ID NO: 2900026 - protein, 6 aa, Entamoeba invadens
REESNE

SEQ ID NO: 2900027 - protein, 9 aa, Entamoeba invadens
REESNEGDV

SEQ ID NO: 2900028 - protein, 21 aa, Entamoeba invadens
REESPKRKESERQRKNTDTEF

SEQ ID NO: 2900029 - protein, 5 aa, Entamoeba invadens
REETK

SEQ ID NO: 2900030 - protein, 6 aa, Entamoeba invadens
REETVR

SEQ ID NO: 2900031 - protein, 5 aa, Entamoeba invadens
REEVR

SEQ ID NO: 2900032 - protein, 18 aa, Entamoeba invadens
REEYKKLPAKGKEQENEW

SEQ ID NO: 2900033 - protein, 5 aa, Entamoeba invadens
REEYT

SEQ ID NO: 2900034 - protein, 4 aa, Entamoeba invadens
REFA

SEQ ID NO: 2900035 - protein, 16 aa, Entamoeba invadens
REFEEDNNVYTEPNRE

SEQ ID NO: 2900036 - protein, 15 aa, Entamoeba invadens
REFESDNDVYTEPNR

SEQ ID NO: 2900037 - protein, 8 aa, Entamoeba invadens
REFETNDP

SEQ ID NO: 2900038 - protein, 4 aa, Entamoeba invadens
REFG

SEQ ID NO: 2900039 - protein, 5 aa, Entamoeba invadens
REFPS

SEQ ID NO: 2900040 - protein, 11 aa, Entamoeba invadens
REFTTTNDFQR

SEQ ID NO: 2900041 - protein, 13 aa, Entamoeba invadens
REGCGSPHYAAPE

SEQ ID NO: 2900042 - protein, 7 aa, Entamoeba invadens
REGDASL

SEQ ID NO: 2900043 - protein, 19 aa, Entamoeba invadens
REGDGKFSMNTAENKSFTT

SEQ ID NO: 2900044 - protein, 4 aa, Entamoeba invadens
REGE

SEQ ID NO: 2900045 - protein, 18 aa, Entamoeba invadens
REGEIQKEKKTEVPTKTS

SEQ ID NO: 2900046 - protein, 9 aa, Entamoeba invadens
REGENGWKT

SEQ ID NO: 2900047 - protein, 6 aa, Entamoeba invadens
REGENI

SEQ ID NO: 2900048 - protein, 7 aa, Entamoeba invadens
REGFESE

SEQ ID NO: 2900049 - protein, 5 aa, Entamoeba invadens
REGIG

SEQ ID NO: 2900050 - protein, 6 aa, Entamoeba invadens
REGING

SEQ ID NO: 2900051 - protein, 9 aa, Entamoeba invadens
REGKSDGDL

SEQ ID NO: 2900052 - protein, 8 aa, Entamoeba invadens
REGKYTIK

SEQ ID NO: 2900053 - protein, 13 aa, Entamoeba invadens
REGNGCKFQENHD

SEQ ID NO: 2900054 - protein, 6 aa, Entamoeba invadens
REGNTF

SEQ ID NO: 2900055 - protein, 13 aa, Entamoeba invadens
REGNTKCSECGCK

SEQ ID NO: 2900056 - protein, 9 aa, Entamoeba invadens
REGRITQEG

SEQ ID NO: 2900057 - protein, 6 aa, Entamoeba invadens
REGRMS

SEQ ID NO: 2900058 - protein, 6 aa, Entamoeba invadens
REGSEE

SEQ ID NO: 2900059 - protein, 8 aa, Entamoeba invadens
REGSTEDG

SEQ ID NO: 2900060 - protein, 20 aa, Entamoeba invadens
REGSVGKTISTLNQAKASTD

SEQ ID NO: 2900061 - protein, 4 aa, Entamoeba invadens
REGV

SEQ ID NO: 2900062 - protein, 10 aa, Entamoeba invadens
REGYTLSPSH

SEQ ID NO: 2900063 - protein, 13 aa, Entamoeba invadens
REHAQRQKEVQTL

SEQ ID NO: 2900064 - protein, 10 aa, Entamoeba invadens
REHELDERGD

SEQ ID NO: 2900065 - protein, 4 aa, Entamoeba invadens
REHM

SEQ ID NO: 2900066 - protein, 8 aa, Entamoeba invadens
REHNAQQA

SEQ ID NO: 2900067 - protein, 5 aa, Entamoeba invadens
REHPE

SEQ ID NO: 2900068 - protein, 56 aa, Entamoeba invadens
REHVEENKDQSDESPSTSVGSGKRVKTEESPTTQPKEESEEQEKDVLDKGDIERKQ

SEQ ID NO: 2900069 - protein, 5 aa, Entamoeba invadens
REIAT

SEQ ID NO: 2900070 - protein, 6 aa, Entamoeba invadens
REIDEL

SEQ ID NO: 2900071 - protein, 13 aa, Entamoeba invadens
REIDNLNQKKKKL

SEQ ID NO: 2900072 - protein, 8 aa, Entamoeba invadens
REIDPTNY

SEQ ID NO: 2900073 - protein, 12 aa, Entamoeba invadens
REIDTTKGTQLF

SEQ ID NO: 2900074 - protein, 4 aa, Entamoeba invadens
REIE

SEQ ID NO: 2900075 - protein, 20 aa, Entamoeba invadens
REIEERERLKKEKSDRKKEL

SEQ ID NO: 2900076 - protein, 12 aa, Entamoeba invadens
REIKAGLNTEAL

SEQ ID NO: 2900077 - protein, 4 aa, Entamoeba invadens
REIN

SEQ ID NO: 2900078 - protein, 8 aa, Entamoeba invadens
REINEDKS

SEQ ID NO: 2900079 - protein, 8 aa, Entamoeba invadens
REIQKNET

SEQ ID NO: 2900080 - protein, 7 aa, Entamoeba invadens
REISAGD

SEQ ID NO: 2900081 - protein, 8 aa, Entamoeba invadens
REISEELT

SEQ ID NO: 2900082 - protein, 9 aa, Entamoeba invadens
REITTDRKD

SEQ ID NO: 2900083 - protein, 4 aa, Entamoeba invadens
REIY

SEQ ID NO: 2900084 - protein, 9 aa, Entamoeba invadens
REKADQEYF

SEQ ID NO: 2900085 - protein, 10 aa, Entamoeba invadens
REKANDNNKL

SEQ ID NO: 2900086 - protein, 17 aa, Entamoeba invadens
REKDEEERRKKEEQDRI

SEQ ID NO: 2900087 - protein, 13 aa, Entamoeba invadens
REKDEERVTQEVE

SEQ ID NO: 2900088 - protein, 8 aa, Entamoeba invadens
REKDKNYI

SEQ ID NO: 2900089 - protein, 16 aa, Entamoeba invadens
REKDPEKYRQSVYSRE

SEQ ID NO: 2900090 - protein, 42 aa, Entamoeba invadens
REKEANERKGFSKPLKTTPPNPSTSNTTPVSNPKVNPQTTTF

SEQ ID NO: 2900091 - protein, 12 aa, Entamoeba invadens
REKEKYTENQKL

SEQ ID NO: 2900092 - protein, 12 aa, Entamoeba invadens
REKENGGDAGQF

SEQ ID NO: 2900093 - protein, 11 aa, Entamoeba invadens
REKEVNTYTVD

SEQ ID NO: 2900094 - protein, 4 aa, Entamoeba invadens
REKG

SEQ ID NO: 2900095 - protein, 5 aa, Entamoeba invadens
REKGI

SEQ ID NO: 2900096 - protein, 7 aa, Entamoeba invadens
REKGKLK

SEQ ID NO: 2900097 - protein, 8 aa, Entamoeba invadens
REKGSNMV

SEQ ID NO: 2900098 - protein, 7 aa, Entamoeba invadens
REKHDGG

SEQ ID NO: 2900099 - protein, 10 aa, Entamoeba invadens
REKIGQTIEE

SEQ ID NO: 2900100 - protein, 14 aa, Entamoeba invadens
REKIKEAQYNEYNV

SEQ ID NO: 2900101 - protein, 7 aa, Entamoeba invadens
REKIQTE

SEQ ID NO: 2900102 - protein, 10 aa, Entamoeba invadens
REKKAIKENE

SEQ ID NO: 2900103 - protein, 10 aa, Entamoeba invadens
REKKDGKYQD

SEQ ID NO: 2900104 - protein, 19 aa, Entamoeba invadens
REKKELQTIAAKKKKGCVL

SEQ ID NO: 2900105 - protein, 6 aa, Entamoeba invadens
REKKEY

SEQ ID NO: 2900106 - protein, 10 aa, Entamoeba invadens
REKKKGNNVP

SEQ ID NO: 2900107 - protein, 21 aa, Entamoeba invadens
REKKQIQREKTKKQEETTKRY

SEQ ID NO: 2900108 - protein, 33 aa, Entamoeba invadens
REKLDEKKKLEKQNEDAGLKEKVENITQENEKL

SEQ ID NO: 2900109 - protein, 8 aa, Entamoeba invadens
REKMRPKT

SEQ ID NO: 2900110 - protein, 8 aa, Entamoeba invadens
REKMSEKV

SEQ ID NO: 2900111 - protein, 10 aa, Entamoeba invadens
REKNDLELER

SEQ ID NO: 2900112 - protein, 5 aa, Entamoeba invadens
REKNM

SEQ ID NO: 2900113 - protein, 12 aa, Entamoeba invadens
REKNQKKRMRKR

SEQ ID NO: 2900114 - protein, 7 aa, Entamoeba invadens
REKNTLT

SEQ ID NO: 2900115 - protein, 26 aa, Entamoeba invadens
REKPNIEVENKTTLVKENTQLTTQNA

SEQ ID NO: 2900116 - protein, 8 aa, Entamoeba invadens
REKQKNLR

SEQ ID NO: 2900117 - protein, 4 aa, Entamoeba invadens
REKR

SEQ ID NO: 2900118 - protein, 10 aa, Entamoeba invadens
REKRRSDEEL

SEQ ID NO: 2900119 - protein, 28 aa, Entamoeba invadens
REKRTTKTEGQQDEKDDKEGLSPTPEED

SEQ ID NO: 2900120 - protein, 11 aa, Entamoeba invadens
REKSGQLKPKK

SEQ ID NO: 2900121 - protein, 8 aa, Entamoeba invadens
REKTEKVK

SEQ ID NO: 2900122 - protein, 9 aa, Entamoeba invadens
REKYEKPSD

SEQ ID NO: 2900123 - protein, 5 aa, Entamoeba invadens
REKYG

SEQ ID NO: 2900124 - protein, 23 aa, Entamoeba invadens
REKYKKETHKAGPPPQPPPGNRD

SEQ ID NO: 2900125 - protein, 10 aa, Entamoeba invadens
REKYKKSADV

SEQ ID NO: 2900126 - protein, 8 aa, Entamoeba invadens
REKYPEKI

SEQ ID NO: 2900127 - protein, 8 aa, Entamoeba invadens
REKYTKSA

SEQ ID NO: 2900128 - protein, 10 aa, Entamoeba invadens
RELERSKVRR

SEQ ID NO: 2900129 - protein, 4 aa, Entamoeba invadens
RELG

SEQ ID NO: 2900130 - protein, 8 aa, Entamoeba invadens
RELNKRGI

SEQ ID NO: 2900131 - protein, 7 aa, Entamoeba invadens
RELNPSS

SEQ ID NO: 2900132 - protein, 6 aa, Entamoeba invadens
RELPRD

SEQ ID NO: 2900133 - protein, 9 aa, Entamoeba invadens
RELSEDEVI

SEQ ID NO: 2900134 - protein, 7 aa, Entamoeba invadens
RELSPED

SEQ ID NO: 2900135 - protein, 12 aa, Entamoeba invadens
RELTGKLSAAEK

SEQ ID NO: 2900136 - protein, 6 aa, Entamoeba invadens
RELTQN

SEQ ID NO: 2900137 - protein, 7 aa, Entamoeba invadens
RELTRDL

SEQ ID NO: 2900138 - protein, 4 aa, Entamoeba invadens
REMD

SEQ ID NO: 2900139 - protein, 4 aa, Entamoeba invadens
REME

SEQ ID NO: 2900140 - protein, 5 aa, Entamoeba invadens
REMKK

SEQ ID NO: 2900141 - protein, 6 aa, Entamoeba invadens
REMKTN

SEQ ID NO: 2900142 - protein, 9 aa, Entamoeba invadens
REMQRRDTE

SEQ ID NO: 2900143 - protein, 8 aa, Entamoeba invadens
REMSREDE

SEQ ID NO: 2900144 - protein, 5 aa, Entamoeba invadens
RENAP

SEQ ID NO: 2900145 - protein, 7 aa, Entamoeba invadens
RENAQEV

SEQ ID NO: 2900146 - protein, 6 aa, Entamoeba invadens
RENDGQ

SEQ ID NO: 2900147 - protein, 7 aa, Entamoeba invadens
RENDLTG

SEQ ID NO: 2900148 - protein, 7 aa, Entamoeba invadens
RENDTTK

SEQ ID NO: 2900149 - protein, 4 aa, Entamoeba invadens
RENE

SEQ ID NO: 2900150 - protein, 10 aa, Entamoeba invadens
RENEDCENKS

SEQ ID NO: 2900151 - protein, 10 aa, Entamoeba invadens
RENEDSENEV

SEQ ID NO: 2900152 - protein, 5 aa, Entamoeba invadens
RENEI

SEQ ID NO: 2900153 - protein, 17 aa, Entamoeba invadens
RENEKQRFEPFSTDANR

SEQ ID NO: 2900154 - protein, 7 aa, Entamoeba invadens
RENENEL

SEQ ID NO: 2900155 - protein, 12 aa, Entamoeba invadens
RENESEENENIP

SEQ ID NO: 2900156 - protein, 10 aa, Entamoeba invadens
RENGDMENKN

SEQ ID NO: 2900157 - protein, 11 aa, Entamoeba invadens
RENGENKNKTV

SEQ ID NO: 2900158 - protein, 12 aa, Entamoeba invadens
RENGKGARNCRR

SEQ ID NO: 2900159 - protein, 7 aa, Entamoeba invadens
RENGMSA

SEQ ID NO: 2900160 - protein, 6 aa, Entamoeba invadens
RENKDR

SEQ ID NO: 2900161 - protein, 5 aa, Entamoeba invadens
RENKL

SEQ ID NO: 2900162 - protein, 6 aa, Entamoeba invadens
RENKSL

SEQ ID NO: 2900163 - protein, 12 aa, Entamoeba invadens
RENRKNKNEKEV

SEQ ID NO: 2900164 - protein, 5 aa, Entamoeba invadens
RENRN

SEQ ID NO: 2900165 - protein, 10 aa, Entamoeba invadens
RENRRSEATR

SEQ ID NO: 2900166 - protein, 10 aa, Entamoeba invadens
RENSSLRSTV

SEQ ID NO: 2900167 - protein, 8 aa, Entamoeba invadens
RENTGSVK

SEQ ID NO: 2900168 - protein, 5 aa, Entamoeba invadens
RENTQ

SEQ ID NO: 2900169 - protein, 6 aa, Entamoeba invadens
RENVGN

SEQ ID NO: 2900170 - protein, 12 aa, Entamoeba invadens
RENVKENEDGWY

SEQ ID NO: 2900171 - protein, 16 aa, Entamoeba invadens
RENVREKGSRGKGMST

SEQ ID NO: 2900172 - protein, 16 aa, Entamoeba invadens
RENVREKGSRGKGMTT

SEQ ID NO: 2900173 - protein, 4 aa, Entamoeba invadens
REPA

SEQ ID NO: 2900174 - protein, 7 aa, Entamoeba invadens
REPARSY

SEQ ID NO: 2900175 - protein, 4 aa, Entamoeba invadens
REPF

SEQ ID NO: 2900176 - protein, 6 aa, Entamoeba invadens
REPKRK

SEQ ID NO: 2900177 - protein, 9 aa, Entamoeba invadens
REPNEELYR

SEQ ID NO: 2900178 - protein, 6 aa, Entamoeba invadens
REPPPT

SEQ ID NO: 2900179 - protein, 5 aa, Entamoeba invadens
REPPS

SEQ ID NO: 2900180 - protein, 7 aa, Entamoeba invadens
REPSRDL

SEQ ID NO: 2900181 - protein, 5 aa, Entamoeba invadens
REPTA

SEQ ID NO: 2900182 - protein, 7 aa, Entamoeba invadens
REPYIGG

SEQ ID NO: 2900183 - protein, 8 aa, Entamoeba invadens
REQANENI

SEQ ID NO: 2900184 - protein, 7 aa, Entamoeba invadens
REQAQKP

SEQ ID NO: 2900185 - protein, 6 aa, Entamoeba invadens
REQGEL

SEQ ID NO: 2900186 - protein, 7 aa, Entamoeba invadens
REQGKTE

SEQ ID NO: 2900187 - protein, 12 aa, Entamoeba invadens
REQNGKSSITSS

SEQ ID NO: 2900188 - protein, 7 aa, Entamoeba invadens
REQNPEY

SEQ ID NO: 2900189 - protein, 7 aa, Entamoeba invadens
REQNPNY

SEQ ID NO: 2900190 - protein, 6 aa, Entamoeba invadens
REQQIK

SEQ ID NO: 2900191 - protein, 4 aa, Entamoeba invadens
REQR

SEQ ID NO: 2900192 - protein, 24 aa, Entamoeba invadens
REQRESKERNERQNDVDEHKNEFD

SEQ ID NO: 2900193 - protein, 11 aa, Entamoeba invadens
REQRKSVQLSP

SEQ ID NO: 2900194 - protein, 15 aa, Entamoeba invadens
REQRMKAQLDEIGKD

SEQ ID NO: 2900195 - protein, 4 aa, Entamoeba invadens
REQV

SEQ ID NO: 2900196 - protein, 7 aa, Entamoeba invadens
RERARRE

SEQ ID NO: 2900197 - protein, 16 aa, Entamoeba invadens
RERASSKNSDDRNTGI

SEQ ID NO: 2900198 - protein, 6 aa, Entamoeba invadens
RERAST

SEQ ID NO: 2900199 - protein, 6 aa, Entamoeba invadens
RERDES

SEQ ID NO: 2900200 - protein, 5 aa, Entamoeba invadens
RERDN

SEQ ID NO: 2900201 - protein, 5 aa, Entamoeba invadens
RERDS

SEQ ID NO: 2900202 - protein, 4 aa, Entamoeba invadens
RERE

SEQ ID NO: 2900203 - protein, 5 aa, Entamoeba invadens
REREG

SEQ ID NO: 2900204 - protein, 6 aa, Entamoeba invadens
REREHA

SEQ ID NO: 2900205 - protein, 36 aa, Entamoeba invadens
RERGESWKRRDRFNKEKAEERHEESRDREEQNERNS

SEQ ID NO: 2900206 - protein, 10 aa, Entamoeba invadens
RERGGDSCSD

SEQ ID NO: 2900207 - protein, 22 aa, Entamoeba invadens
RERGSKVIEARKASSAASAAKA

SEQ ID NO: 2900208 - protein, 5 aa, Entamoeba invadens
RERIG

SEQ ID NO: 2900209 - protein, 4 aa, Entamoeba invadens
RERK

SEQ ID NO: 2900210 - protein, 8 aa, Entamoeba invadens
RERKGSVF

SEQ ID NO: 2900211 - protein, 6 aa, Entamoeba invadens
RERKSS

SEQ ID NO: 2900212 - protein, 4 aa, Entamoeba invadens
RERL

SEQ ID NO: 2900213 - protein, 4 aa, Entamoeba invadens
RERQ

SEQ ID NO: 2900214 - protein, 11 aa, Entamoeba invadens
RERQNTTKPIT

SEQ ID NO: 2900215 - protein, 11 aa, Entamoeba invadens
RERSRQKRINE

SEQ ID NO: 2900216 - protein, 13 aa, Entamoeba invadens
RERSRQTEQRLQG

SEQ ID NO: 2900217 - protein, 8 aa, Entamoeba invadens
RERTFNTA

SEQ ID NO: 2900218 - protein, 9 aa, Entamoeba invadens
RERTSTKEG

SEQ ID NO: 2900219 - protein, 11 aa, Entamoeba invadens
RERVESQIENK

SEQ ID NO: 2900220 - protein, 5 aa, Entamoeba invadens
RESCE

SEQ ID NO: 2900221 - protein, 6 aa, Entamoeba invadens
RESCES

SEQ ID NO: 2900222 - protein, 5 aa, Entamoeba invadens
RESCG

SEQ ID NO: 2900223 - protein, 5 aa, Entamoeba invadens
RESDE

SEQ ID NO: 2900224 - protein, 11 aa, Entamoeba invadens
RESDGNVSDES

SEQ ID NO: 2900225 - protein, 4 aa, Entamoeba invadens
RESF

SEQ ID NO: 2900226 - protein, 7 aa, Entamoeba invadens
RESGATA

SEQ ID NO: 2900227 - protein, 22 aa, Entamoeba invadens
RESGGNEIRKTKQQNYSKEAGA

SEQ ID NO: 2900228 - protein, 13 aa, Entamoeba invadens
RESGKALKQEDVA

SEQ ID NO: 2900229 - protein, 19 aa, Entamoeba invadens
RESGRAEIERKKQKDYSEI

SEQ ID NO: 2900230 - protein, 18 aa, Entamoeba invadens
RESGTTGIYNKDGSVNKD

SEQ ID NO: 2900231 - protein, 8 aa, Entamoeba invadens
RESHGGST

SEQ ID NO: 2900232 - protein, 14 aa, Entamoeba invadens
RESIENQNKTKLSH

SEQ ID NO: 2900233 - protein, 5 aa, Entamoeba invadens
RESKN

SEQ ID NO: 2900234 - protein, 11 aa, Entamoeba invadens
RESKNRDAAQQ

SEQ ID NO: 2900235 - protein, 10 aa, Entamoeba invadens
RESKSYEAIQ

SEQ ID NO: 2900236 - protein, 7 aa, Entamoeba invadens
RESMPGE

SEQ ID NO: 2900237 - protein, 4 aa, Entamoeba invadens
RESN

SEQ ID NO: 2900238 - protein, 9 aa, Entamoeba invadens
RESQNASVR

SEQ ID NO: 2900239 - protein, 5 aa, Entamoeba invadens
RESQT

SEQ ID NO: 2900240 - protein, 7 aa, Entamoeba invadens
RESSAKA

SEQ ID NO: 2900241 - protein, 9 aa, Entamoeba invadens
RESSESGNE

SEQ ID NO: 2900242 - protein, 6 aa, Entamoeba invadens
RESSIF

SEQ ID NO: 2900243 - protein, 6 aa, Entamoeba invadens
RESTEQ

SEQ ID NO: 2900244 - protein, 6 aa, Entamoeba invadens
RESTNF

SEQ ID NO: 2900245 - protein, 8 aa, Entamoeba invadens
RESTSKCI

SEQ ID NO: 2900246 - protein, 8 aa, Entamoeba invadens
RESWTKEK

SEQ ID NO: 2900247 - protein, 4 aa, Entamoeba invadens
RESY

SEQ ID NO: 2900248 - protein, 13 aa, Entamoeba invadens
RESYIPKKYTYFK

SEQ ID NO: 2900249 - protein, 10 aa, Entamoeba invadens
RETAKKFESG

SEQ ID NO: 2900250 - protein, 15 aa, Entamoeba invadens
RETALEQENSELKNG

SEQ ID NO: 2900251 - protein, 6 aa, Entamoeba invadens
RETAND

SEQ ID NO: 2900252 - protein, 9 aa, Entamoeba invadens
RETAPNKPY

SEQ ID NO: 2900253 - protein, 6 aa, Entamoeba invadens
RETDEF

SEQ ID NO: 2900254 - protein, 7 aa, Entamoeba invadens
RETDKGF

SEQ ID NO: 2900255 - protein, 15 aa, Entamoeba invadens
RETEDERKTEKEVNE

SEQ ID NO: 2900256 - protein, 8 aa, Entamoeba invadens
RETEKPEI

SEQ ID NO: 2900257 - protein, 4 aa, Entamoeba invadens
RETF

SEQ ID NO: 2900258 - protein, 4 aa, Entamoeba invadens
RETH

SEQ ID NO: 2900259 - protein, 41 aa, Entamoeba invadens
RETHQNVTQEDTKEVKDMKDDINEKHKSSDEVQNLKEKGIE

SEQ ID NO: 2900260 - protein, 6 aa, Entamoeba invadens
RETIGK

SEQ ID NO: 2900261 - protein, 5 aa, Entamoeba invadens
RETIQ

SEQ ID NO: 2900262 - protein, 27 aa, Entamoeba invadens
RETKAKKTLPKKKPTKKETQKVTRPEN

SEQ ID NO: 2900263 - protein, 9 aa, Entamoeba invadens
RETKKNKGC

SEQ ID NO: 2900264 - protein, 7 aa, Entamoeba invadens
RETKRGI

SEQ ID NO: 2900265 - protein, 10 aa, Entamoeba invadens
RETKRSGSEE

SEQ ID NO: 2900266 - protein, 20 aa, Entamoeba invadens
RETLKREEQKQEKPKSGVPP

SEQ ID NO: 2900267 - protein, 6 aa, Entamoeba invadens
RETNEA

SEQ ID NO: 2900268 - protein, 5 aa, Entamoeba invadens
RETPL

SEQ ID NO: 2900269 - protein, 25 aa, Entamoeba invadens
RETPLDEMENNSPPPLPSKNQQPKV

SEQ ID NO: 2900270 - protein, 6 aa, Entamoeba invadens
RETPQL

SEQ ID NO: 2900271 - protein, 10 aa, Entamoeba invadens
RETQQSKGGV

SEQ ID NO: 2900272 - protein, 9 aa, Entamoeba invadens
RETQRNALE

SEQ ID NO: 2900273 - protein, 6 aa, Entamoeba invadens
RETQYV

SEQ ID NO: 2900274 - protein, 8 aa, Entamoeba invadens
RETRDGRM

SEQ ID NO: 2900275 - protein, 8 aa, Entamoeba invadens
RETRIEKA

SEQ ID NO: 2900276 - protein, 16 aa, Entamoeba invadens
RETRNAESRKKEAENI

SEQ ID NO: 2900277 - protein, 34 aa, Entamoeba invadens
RETRSTISNSTDFSNLSGSDKIEEDKYNPDPNYS

SEQ ID NO: 2900278 - protein, 9 aa, Entamoeba invadens
RETSDPSLI

SEQ ID NO: 2900279 - protein, 47 aa, Entamoeba invadens
RETSDSENEEESEGRGTKPIYKAQTKEETQRNKTKKLKKKKKEKAVP

SEQ ID NO: 2900280 - protein, 5 aa, Entamoeba invadens
RETTE

SEQ ID NO: 2900281 - protein, 8 aa, Entamoeba invadens
RETTSTER

SEQ ID NO: 2900282 - protein, 12 aa, Entamoeba invadens
RETVCSKSAKIN

SEQ ID NO: 2900283 - protein, 7 aa, Entamoeba invadens
RETYSGI

SEQ ID NO: 2900284 - protein, 18 aa, Entamoeba invadens
REVAEAEKLAKKAIRSRR

SEQ ID NO: 2900285 - protein, 10 aa, Entamoeba invadens
REVCGGGSAE

SEQ ID NO: 2900286 - protein, 7 aa, Entamoeba invadens
REVDENG

SEQ ID NO: 2900287 - protein, 4 aa, Entamoeba invadens
REVE

SEQ ID NO: 2900288 - protein, 4 aa, Entamoeba invadens
REVG

SEQ ID NO: 2900289 - protein, 11 aa, Entamoeba invadens
REVKPLEKEKI

SEQ ID NO: 2900290 - protein, 53 aa, Entamoeba invadens
REVKPREKKREFSENEEKESKVESEKLKMEETKIDGDESEEDVKEPQKIKTEN

SEQ ID NO: 2900291 - protein, 9 aa, Entamoeba invadens
REVNTKSDG

SEQ ID NO: 2900292 - protein, 8 aa, Entamoeba invadens
REVRGEAE

SEQ ID NO: 2900293 - protein, 9 aa, Entamoeba invadens
REVRNLESY

SEQ ID NO: 2900294 - protein, 9 aa, Entamoeba invadens
REVSGKTVT

SEQ ID NO: 2900295 - protein, 7 aa, Entamoeba invadens
REVTGGV

SEQ ID NO: 2900296 - protein, 8 aa, Entamoeba invadens
REYAENVD

SEQ ID NO: 2900297 - protein, 10 aa, Entamoeba invadens
REYDQQNCDK

SEQ ID NO: 2900298 - protein, 13 aa, Entamoeba invadens
REYEIEDDTRLND

SEQ ID NO: 2900299 - protein, 7 aa, Entamoeba invadens
REYGESK

SEQ ID NO: 2900300 - protein, 4 aa, Entamoeba invadens
REYP

SEQ ID NO: 2900301 - protein, 13 aa, Entamoeba invadens
REYPHKTINTTEK

SEQ ID NO: 2900302 - protein, 4 aa, Entamoeba invadens
REYS

SEQ ID NO: 2900303 - protein, 6 aa, Entamoeba invadens
RFAKTK

SEQ ID NO: 2900304 - protein, 11 aa, Entamoeba invadens
RFDDDGNVIDD

SEQ ID NO: 2900305 - protein, 5 aa, Entamoeba invadens
RFDED

SEQ ID NO: 2900306 - protein, 10 aa, Entamoeba invadens
RFDKKENIPK

SEQ ID NO: 2900307 - protein, 13 aa, Entamoeba invadens
RFDKKTKDLQTAE

SEQ ID NO: 2900308 - protein, 12 aa, Entamoeba invadens
RFDNPKKETIQE

SEQ ID NO: 2900309 - protein, 8 aa, Entamoeba invadens
RFEEAENT

SEQ ID NO: 2900310 - protein, 13 aa, Entamoeba invadens
RFEEELQKNSFRK

SEQ ID NO: 2900311 - protein, 17 aa, Entamoeba invadens
RFEEENTKREKMLETSG

SEQ ID NO: 2900312 - protein, 4 aa, Entamoeba invadens
RFEG

SEQ ID NO: 2900313 - protein, 13 aa, Entamoeba invadens
RFENDKPGMTTSA

SEQ ID NO: 2900314 - protein, 11 aa, Entamoeba invadens
RFEQTKAAPIV

SEQ ID NO: 2900315 - protein, 30 aa, Entamoeba invadens
RFETGGKGVDGEGEETYKSFTDKKPHGPSL

SEQ ID NO: 2900316 - protein, 12 aa, Entamoeba invadens
RFGKNANKQKSF

SEQ ID NO: 2900317 - protein, 5 aa, Entamoeba invadens
RFGKT

SEQ ID NO: 2900318 - protein, 7 aa, Entamoeba invadens
RFGNTDE

SEQ ID NO: 2900319 - protein, 6 aa, Entamoeba invadens
RFKEDQ

SEQ ID NO: 2900320 - protein, 22 aa, Entamoeba invadens
RFKKEGNTDADNLGHGAYGSVT

SEQ ID NO: 2900321 - protein, 5 aa, Entamoeba invadens
RFNEE

SEQ ID NO: 2900322 - protein, 4 aa, Entamoeba invadens
RFNR

SEQ ID NO: 2900323 - protein, 7 aa, Entamoeba invadens
RFPEASE

SEQ ID NO: 2900324 - protein, 6 aa, Entamoeba invadens
RFPEDT

SEQ ID NO: 2900325 - protein, 5 aa, Entamoeba invadens
RFPEE

SEQ ID NO: 2900326 - protein, 9 aa, Entamoeba invadens
RFPKDSKFR

SEQ ID NO: 2900327 - protein, 16 aa, Entamoeba invadens
RFPKQNENIPTGNEMR

SEQ ID NO: 2900328 - protein, 5 aa, Entamoeba invadens
RFPNE

SEQ ID NO: 2900329 - protein, 11 aa, Entamoeba invadens
RFPPKHVPRSE

SEQ ID NO: 2900330 - protein, 5 aa, Entamoeba invadens
RFPSQ

SEQ ID NO: 2900331 - protein, 13 aa, Entamoeba invadens
RFPSRVDATASTI

SEQ ID NO: 2900332 - protein, 5 aa, Entamoeba invadens
RFQST

SEQ ID NO: 2900333 - protein, 6 aa, Entamoeba invadens
RFRAND

SEQ ID NO: 2900334 - protein, 5 aa, Entamoeba invadens
RFRNT

SEQ ID NO: 2900335 - protein, 5 aa, Entamoeba invadens
RFRRS

SEQ ID NO: 2900336 - protein, 8 aa, Entamoeba invadens
RFRTKPGN

SEQ ID NO: 2900337 - protein, 5 aa, Entamoeba invadens
RFSDE

SEQ ID NO: 2900338 - protein, 12 aa, Entamoeba invadens
RFSEEGKKYNVT

SEQ ID NO: 2900339 - protein, 16 aa, Entamoeba invadens
RFSGTNKSILLEMINN

SEQ ID NO: 2900340 - protein, 4 aa, Entamoeba invadens
RFST

SEQ ID NO: 2900341 - protein, 11 aa, Entamoeba invadens
RFTEGTPKENV

SEQ ID NO: 2900342 - protein, 17 aa, Entamoeba invadens
RFVSSSGMESSEIEETS

SEQ ID NO: 2900343 - protein, 9 aa, Entamoeba invadens
RGAAQSDGI

SEQ ID NO: 2900344 - protein, 10 aa, Entamoeba invadens
RGAATNSTDL

SEQ ID NO: 2900345 - protein, 4 aa, Entamoeba invadens
RGAD

SEQ ID NO: 2900346 - protein, 14 aa, Entamoeba invadens
RGADSNGKSIISKS

SEQ ID NO: 2900347 - protein, 7 aa, Entamoeba invadens
RGADTTV

SEQ ID NO: 2900348 - protein, 8 aa, Entamoeba invadens
RGAEGKYT

SEQ ID NO: 2900349 - protein, 10 aa, Entamoeba invadens
RGAGGKGGFG

SEQ ID NO: 2900350 - protein, 4 aa, Entamoeba invadens
RGAQ

SEQ ID NO: 2900351 - protein, 5 aa, Entamoeba invadens
RGASG

SEQ ID NO: 2900352 - protein, 8 aa, Entamoeba invadens
RGASSPAL

SEQ ID NO: 2900353 - protein, 8 aa, Entamoeba invadens
RGATQMRP

SEQ ID NO: 2900354 - protein, 5 aa, Entamoeba invadens
RGCGN

SEQ ID NO: 2900355 - protein, 25 aa, Entamoeba invadens
RGCSTTRYTGKTITDATQKEPLTQH

SEQ ID NO: 2900356 - protein, 4 aa, Entamoeba invadens
RGCY

SEQ ID NO: 2900357 - protein, 6 aa, Entamoeba invadens
RGDDKN

SEQ ID NO: 2900358 - protein, 16 aa, Entamoeba invadens
RGDEREEKSEDDEDEL

SEQ ID NO: 2900359 - protein, 8 aa, Entamoeba invadens
RGDFPNQF

SEQ ID NO: 2900360 - protein, 5 aa, Entamoeba invadens
RGDFS

SEQ ID NO: 2900361 - protein, 5 aa, Entamoeba invadens
RGDGC

SEQ ID NO: 2900362 - protein, 8 aa, Entamoeba invadens
RGDGPGID

SEQ ID NO: 2900363 - protein, 4 aa, Entamoeba invadens
RGDI

SEQ ID NO: 2900364 - protein, 8 aa, Entamoeba invadens
RGDISNPM

SEQ ID NO: 2900365 - protein, 9 aa, Entamoeba invadens
RGDKDINKG

SEQ ID NO: 2900366 - protein, 18 aa, Entamoeba invadens
RGDKKENKGHLDKGQVHG

SEQ ID NO: 2900367 - protein, 13 aa, Entamoeba invadens
RGDKTEKLTGSTA

SEQ ID NO: 2900368 - protein, 5 aa, Entamoeba invadens
RGDNF

SEQ ID NO: 2900369 - protein, 10 aa, Entamoeba invadens
RGDNNGSTKV

SEQ ID NO: 2900370 - protein, 6 aa, Entamoeba invadens
RGDNPP

SEQ ID NO: 2900371 - protein, 8 aa, Entamoeba invadens
RGDNTVDF

SEQ ID NO: 2900372 - protein, 5 aa, Entamoeba invadens
RGDNW

SEQ ID NO: 2900373 - protein, 10 aa, Entamoeba invadens
RGDSNGTTMP

SEQ ID NO: 2900374 - protein, 4 aa, Entamoeba invadens
RGDV

SEQ ID NO: 2900375 - protein, 11 aa, Entamoeba invadens
RGDVAEGRKAY

SEQ ID NO: 2900376 - protein, 10 aa, Entamoeba invadens
RGDVVSPREM

SEQ ID NO: 2900377 - protein, 5 aa, Entamoeba invadens
RGDYE

SEQ ID NO: 2900378 - protein, 6 aa, Entamoeba invadens
RGDYTP

SEQ ID NO: 2900379 - protein, 15 aa, Entamoeba invadens
RGEDGLPIGDTGKSI

SEQ ID NO: 2900380 - protein, 16 aa, Entamoeba invadens
RGEDGLPIGDTGKSVR

SEQ ID NO: 2900381 - protein, 4 aa, Entamoeba invadens
RGEE

SEQ ID NO: 2900382 - protein, 9 aa, Entamoeba invadens
RGEESEGKC

SEQ ID NO: 2900383 - protein, 4 aa, Entamoeba invadens
RGEF

SEQ ID NO: 2900384 - protein, 5 aa, Entamoeba invadens
RGEHK

SEQ ID NO: 2900385 - protein, 12 aa, Entamoeba invadens
RGEITDEKIQEA

SEQ ID NO: 2900386 - protein, 6 aa, Entamoeba invadens
RGEKDF

SEQ ID NO: 2900387 - protein, 9 aa, Entamoeba invadens
RGEKEASTC

SEQ ID NO: 2900388 - protein, 8 aa, Entamoeba invadens
RGEKEKTR

SEQ ID NO: 2900389 - protein, 17 aa, Entamoeba invadens
RGEKKENHGSLEKGKVH

SEQ ID NO: 2900390 - protein, 19 aa, Entamoeba invadens
RGEKNQTISRSAQPLPGTL

SEQ ID NO: 2900391 - protein, 6 aa, Entamoeba invadens
RGEKSY

SEQ ID NO: 2900392 - protein, 9 aa, Entamoeba invadens
RGENETENM

SEQ ID NO: 2900393 - protein, 5 aa, Entamoeba invadens
RGENF

SEQ ID NO: 2900394 - protein, 9 aa, Entamoeba invadens
RGEPTTPPL

SEQ ID NO: 2900395 - protein, 5 aa, Entamoeba invadens
RGERE

SEQ ID NO: 2900396 - protein, 12 aa, Entamoeba invadens
RGERENARNELG

SEQ ID NO: 2900397 - protein, 16 aa, Entamoeba invadens
RGERPTIELGDGEQKA

SEQ ID NO: 2900398 - protein, 4 aa, Entamoeba invadens
RGES

SEQ ID NO: 2900399 - protein, 5 aa, Entamoeba invadens
RGESI

SEQ ID NO: 2900400 - protein, 12 aa, Entamoeba invadens
RGESQTATAVSV

SEQ ID NO: 2900401 - protein, 11 aa, Entamoeba invadens
RGETKYTKEEM

SEQ ID NO: 2900402 - protein, 6 aa, Entamoeba invadens
RGETPI

SEQ ID NO: 2900403 - protein, 7 aa, Entamoeba invadens
RGETRDY

SEQ ID NO: 2900404 - protein, 13 aa, Entamoeba invadens
RGETTKEIKHSSI

SEQ ID NO: 2900405 - protein, 7 aa, Entamoeba invadens
RGETTTI

SEQ ID NO: 2900406 - protein, 15 aa, Entamoeba invadens
RGEYKSNVKFTDDDK

SEQ ID NO: 2900407 - protein, 6 aa, Entamoeba invadens
RGFGDL

SEQ ID NO: 2900408 - protein, 4 aa, Entamoeba invadens
RGFS

SEQ ID NO: 2900409 - protein, 10 aa, Entamoeba invadens
RGFSETWDET

SEQ ID NO: 2900410 - protein, 13 aa, Entamoeba invadens
RGFTEDDYVKGKG

SEQ ID NO: 2900411 - protein, 5 aa, Entamoeba invadens
RGGDL

SEQ ID NO: 2900412 - protein, 5 aa, Entamoeba invadens
RGGEF

SEQ ID NO: 2900413 - protein, 4 aa, Entamoeba invadens
RGGF

SEQ ID NO: 2900414 - protein, 6 aa, Entamoeba invadens
RGGGEI

SEQ ID NO: 2900415 - protein, 7 aa, Entamoeba invadens
RGGHSGV

SEQ ID NO: 2900416 - protein, 10 aa, Entamoeba invadens
RGGKEYKGAR

SEQ ID NO: 2900417 - protein, 9 aa, Entamoeba invadens
RGGKREEKS

SEQ ID NO: 2900418 - protein, 8 aa, Entamoeba invadens
RGGKTSHA

SEQ ID NO: 2900419 - protein, 31 aa, Entamoeba invadens
RGGKYPKDGANCANCDSTCGNQCDGKDGHCT

SEQ ID NO: 2900420 - protein, 11 aa, Entamoeba invadens
RGGKYPKDGVN

SEQ ID NO: 2900421 - protein, 4 aa, Entamoeba invadens
RGGM

SEQ ID NO: 2900422 - protein, 5 aa, Entamoeba invadens
RGGNL

SEQ ID NO: 2900423 - protein, 6 aa, Entamoeba invadens
RGGNTG

SEQ ID NO: 2900424 - protein, 5 aa, Entamoeba invadens
RGGNV

SEQ ID NO: 2900425 - protein, 7 aa, Entamoeba invadens
RGGQLQY

SEQ ID NO: 2900426 - protein, 8 aa, Entamoeba invadens
RGGRDGSL

SEQ ID NO: 2900427 - protein, 5 aa, Entamoeba invadens
RGGSE

SEQ ID NO: 2900428 - protein, 6 aa, Entamoeba invadens
RGGSLE

SEQ ID NO: 2900429 - protein, 6 aa, Entamoeba invadens
RGGSLG

SEQ ID NO: 2900430 - protein, 6 aa, Entamoeba invadens
RGGSSE

SEQ ID NO: 2900431 - protein, 6 aa, Entamoeba invadens
RGGVSL

SEQ ID NO: 2900432 - protein, 4 aa, Entamoeba invadens
RGIA

SEQ ID NO: 2900433 - protein, 12 aa, Entamoeba invadens
RGIAPEGTTLFS

SEQ ID NO: 2900434 - protein, 6 aa, Entamoeba invadens
RGIDAS

SEQ ID NO: 2900435 - protein, 14 aa, Entamoeba invadens
RGIDDDTSLISIEQ

SEQ ID NO: 2900436 - protein, 4 aa, Entamoeba invadens
RGIE

SEQ ID NO: 2900437 - protein, 7 aa, Entamoeba invadens
RGINERS

SEQ ID NO: 2900438 - protein, 5 aa, Entamoeba invadens
RGIPT

SEQ ID NO: 2900439 - protein, 8 aa, Entamoeba invadens
RGIRGRSV

SEQ ID NO: 2900440 - protein, 11 aa, Entamoeba invadens
RGIRQGKTGKC

SEQ ID NO: 2900441 - protein, 5 aa, Entamoeba invadens
RGISE

SEQ ID NO: 2900442 - protein, 14 aa, Entamoeba invadens
RGISHSSGRENNIA

SEQ ID NO: 2900443 - protein, 4 aa, Entamoeba invadens
RGIT

SEQ ID NO: 2900444 - protein, 6 aa, Entamoeba invadens
RGITGE

SEQ ID NO: 2900445 - protein, 5 aa, Entamoeba invadens
RGITS

SEQ ID NO: 2900446 - protein, 9 aa, Entamoeba invadens
RGKDAQQKH

SEQ ID NO: 2900447 - protein, 12 aa, Entamoeba invadens
RGKDGKILASVE

SEQ ID NO: 2900448 - protein, 13 aa, Entamoeba invadens
RGKDSEWKQKNGF

SEQ ID NO: 2900449 - protein, 30 aa, Entamoeba invadens
RGKEDLSKLTTEYKKLEADNQRLQDEITEH

SEQ ID NO: 2900450 - protein, 6 aa, Entamoeba invadens
RGKEGV

SEQ ID NO: 2900451 - protein, 5 aa, Entamoeba invadens
RGKEK

SEQ ID NO: 2900452 - protein, 8 aa, Entamoeba invadens
RGKEKKQL

SEQ ID NO: 2900453 - protein, 8 aa, Entamoeba invadens
RGKFTEGS

SEQ ID NO: 2900454 - protein, 6 aa, Entamoeba invadens
RGKGFG

SEQ ID NO: 2900455 - protein, 14 aa, Entamoeba invadens
RGKIISEEQRPGTP

SEQ ID NO: 2900456 - protein, 4 aa, Entamoeba invadens
RGKK

SEQ ID NO: 2900457 - protein, 8 aa, Entamoeba invadens
RGKKEITL

SEQ ID NO: 2900458 - protein, 9 aa, Entamoeba invadens
RGKKEMEHE

SEQ ID NO: 2900459 - protein, 8 aa, Entamoeba invadens
RGKKINKA

SEQ ID NO: 2900460 - protein, 10 aa, Entamoeba invadens
RGKKQRLTTE

SEQ ID NO: 2900461 - protein, 13 aa, Entamoeba invadens
RGKLSPKTARNSL

SEQ ID NO: 2900462 - protein, 10 aa, Entamoeba invadens
RGKNSGVSDK

SEQ ID NO: 2900463 - protein, 8 aa, Entamoeba invadens
RGKPSHSG

SEQ ID NO: 2900464 - protein, 9 aa, Entamoeba invadens
RGKQQQSLP

SEQ ID NO: 2900465 - protein, 11 aa, Entamoeba invadens
RGKREENDVSC

SEQ ID NO: 2900466 - protein, 17 aa, Entamoeba invadens
RGKSEPNLNKSGKPVEF

SEQ ID NO: 2900467 - protein, 4 aa, Entamoeba invadens
RGKT

SEQ ID NO: 2900468 - protein, 7 aa, Entamoeba invadens
RGKTLED

SEQ ID NO: 2900469 - protein, 8 aa, Entamoeba invadens
RGKTVAEN

SEQ ID NO: 2900470 - protein, 9 aa, Entamoeba invadens
RGKTVTRKP

SEQ ID NO: 2900471 - protein, 17 aa, Entamoeba invadens
RGKVPNTLEKYSENEGV

SEQ ID NO: 2900472 - protein, 6 aa, Entamoeba invadens
RGKYEQ

SEQ ID NO: 2900473 - protein, 15 aa, Entamoeba invadens
RGLKGKKKVNASEQR

SEQ ID NO: 2900474 - protein, 4 aa, Entamoeba invadens
RGLN

SEQ ID NO: 2900475 - protein, 6 aa, Entamoeba invadens
RGLNGE

SEQ ID NO: 2900476 - protein, 8 aa, Entamoeba invadens
RGLSPSDI

SEQ ID NO: 2900477 - protein, 29 aa, Entamoeba invadens
RGMPEKSNSPMKYSPKTSPAPRDQQRPKK

SEQ ID NO: 2900478 - protein, 6 aa, Entamoeba invadens
RGMSAD

SEQ ID NO: 2900479 - protein, 6 aa, Entamoeba invadens
RGNAKY

SEQ ID NO: 2900480 - protein, 8 aa, Entamoeba invadens
RGNDFKDE

SEQ ID NO: 2900481 - protein, 5 aa, Entamoeba invadens
RGNFS

SEQ ID NO: 2900482 - protein, 7 aa, Entamoeba invadens
RGNGIKR

SEQ ID NO: 2900483 - protein, 8 aa, Entamoeba invadens
RGNHEEKD

SEQ ID NO: 2900484 - protein, 13 aa, Entamoeba invadens
RGNKKSQHETTET

SEQ ID NO: 2900485 - protein, 8 aa, Entamoeba invadens
RGNNIGRG

SEQ ID NO: 2900486 - protein, 6 aa, Entamoeba invadens
RGNPAM

SEQ ID NO: 2900487 - protein, 6 aa, Entamoeba invadens
RGNPDT

SEQ ID NO: 2900488 - protein, 5 aa, Entamoeba invadens
RGNPE

SEQ ID NO: 2900489 - protein, 7 aa, Entamoeba invadens
RGNQTRR

SEQ ID NO: 2900490 - protein, 5 aa, Entamoeba invadens
RGNTE

SEQ ID NO: 2900491 - protein, 10 aa, Entamoeba invadens
RGNTEESQTV

SEQ ID NO: 2900492 - protein, 24 aa, Entamoeba invadens
RGPEDTLGEHSESSGEESHNQDGV

SEQ ID NO: 2900493 - protein, 31 aa, Entamoeba invadens
RGPENTLDIDNKPNQDNSNQNNGEQNEENGS

SEQ ID NO: 2900494 - protein, 51 aa, Entamoeba invadens
RGPGAYPPMGNYQQQQQVYKGDSKFKPVDAKRPDSVPDDGQGMGQIKKPPE

SEQ ID NO: 2900495 - protein, 4 aa, Entamoeba invadens
RGPK

SEQ ID NO: 2900496 - protein, 4 aa, Entamoeba invadens
RGPL

SEQ ID NO: 2900497 - protein, 4 aa, Entamoeba invadens
RGPS

SEQ ID NO: 2900498 - protein, 7 aa, Entamoeba invadens
RGPSCAR

SEQ ID NO: 2900499 - protein, 13 aa, Entamoeba invadens
RGPSEDEKSEAEK

SEQ ID NO: 2900500 - protein, 4 aa, Entamoeba invadens
RGPV

SEQ ID NO: 2900501 - protein, 7 aa, Entamoeba invadens
RGQGQAD

SEQ ID NO: 2900502 - protein, 8 aa, Entamoeba invadens
RGQIDDED

SEQ ID NO: 2900503 - protein, 7 aa, Entamoeba invadens
RGQITGM

SEQ ID NO: 2900504 - protein, 11 aa, Entamoeba invadens
RGQNGQCPHDP

SEQ ID NO: 2900505 - protein, 5 aa, Entamoeba invadens
RGQQM

SEQ ID NO: 2900506 - protein, 9 aa, Entamoeba invadens
RGQSTEEEV

SEQ ID NO: 2900507 - protein, 5 aa, Entamoeba invadens
RGQTC

SEQ ID NO: 2900508 - protein, 8 aa, Entamoeba invadens
RGQVQNRP

SEQ ID NO: 2900509 - protein, 6 aa, Entamoeba invadens
RGRDDS

SEQ ID NO: 2900510 - protein, 16 aa, Entamoeba invadens
RGREQNADALFKRNGL

SEQ ID NO: 2900511 - protein, 6 aa, Entamoeba invadens
RGRGIG

SEQ ID NO: 2900512 - protein, 8 aa, Entamoeba invadens
RGRLENQP

SEQ ID NO: 2900513 - protein, 10 aa, Entamoeba invadens
RGRNTETEEQ

SEQ ID NO: 2900514 - protein, 70 aa, Entamoeba invadens
RGRSSERGSFGGRGGRGGFSREGGRGGFGGARGGRGGSSERGSFGGRGGRGGARGGRGGVGMKKGGTTIR

SEQ ID NO: 2900515 - protein, 4 aa, Entamoeba invadens
RGSD

SEQ ID NO: 2900516 - protein, 5 aa, Entamoeba invadens
RGSEA

SEQ ID NO: 2900517 - protein, 5 aa, Entamoeba invadens
RGSEK

SEQ ID NO: 2900518 - protein, 14 aa, Entamoeba invadens
RGSEKKREDGMPEE

SEQ ID NO: 2900519 - protein, 8 aa, Entamoeba invadens
RGSETSCS

SEQ ID NO: 2900520 - protein, 4 aa, Entamoeba invadens
RGSG

SEQ ID NO: 2900521 - protein, 8 aa, Entamoeba invadens
RGSGTEPK

SEQ ID NO: 2900522 - protein, 9 aa, Entamoeba invadens
RGSIGITQS

SEQ ID NO: 2900523 - protein, 5 aa, Entamoeba invadens
RGSKW

SEQ ID NO: 2900524 - protein, 8 aa, Entamoeba invadens
RGSLNGGH

SEQ ID NO: 2900525 - protein, 7 aa, Entamoeba invadens
RGSMDSA

SEQ ID NO: 2900526 - protein, 10 aa, Entamoeba invadens
RGSPDGNETV

SEQ ID NO: 2900527 - protein, 7 aa, Entamoeba invadens
RGSQENV

SEQ ID NO: 2900528 - protein, 6 aa, Entamoeba invadens
RGSSGG

SEQ ID NO: 2900529 - protein, 10 aa, Entamoeba invadens
RGSSKYSGQL

SEQ ID NO: 2900530 - protein, 7 aa, Entamoeba invadens
RGSTDKR

SEQ ID NO: 2900531 - protein, 9 aa, Entamoeba invadens
RGSTNPPTV

SEQ ID NO: 2900532 - protein, 9 aa, Entamoeba invadens
RGSTQPLPI

SEQ ID NO: 2900533 - protein, 10 aa, Entamoeba invadens
RGSTRNSGNL

SEQ ID NO: 2900534 - protein, 9 aa, Entamoeba invadens
RGSVATDNN

SEQ ID NO: 2900535 - protein, 4 aa, Entamoeba invadens
RGSY

SEQ ID NO: 2900536 - protein, 6 aa, Entamoeba invadens
RGTATV

SEQ ID NO: 2900537 - protein, 4 aa, Entamoeba invadens
RGTD

SEQ ID NO: 2900538 - protein, 7 aa, Entamoeba invadens
RGTDNGD

SEQ ID NO: 2900539 - protein, 10 aa, Entamoeba invadens
RGTEEVSPHG

SEQ ID NO: 2900540 - protein, 5 aa, Entamoeba invadens
RGTEI

SEQ ID NO: 2900541 - protein, 4 aa, Entamoeba invadens
RGTF

SEQ ID NO: 2900542 - protein, 5 aa, Entamoeba invadens
RGTGK

SEQ ID NO: 2900543 - protein, 5 aa, Entamoeba invadens
RGTGL

SEQ ID NO: 2900544 - protein, 20 aa, Entamoeba invadens
RGTGTNERSETDERNDPSRV

SEQ ID NO: 2900545 - protein, 6 aa, Entamoeba invadens
RGTKCG

SEQ ID NO: 2900546 - protein, 11 aa, Entamoeba invadens
RGTKKERKTEW

SEQ ID NO: 2900547 - protein, 10 aa, Entamoeba invadens
RGTKVRSGKV

SEQ ID NO: 2900548 - protein, 5 aa, Entamoeba invadens
RGTPL

SEQ ID NO: 2900549 - protein, 9 aa, Entamoeba invadens
RGTPSDLSA

SEQ ID NO: 2900550 - protein, 10 aa, Entamoeba invadens
RGTQQRRACD

SEQ ID NO: 2900551 - protein, 11 aa, Entamoeba invadens
RGTSDMKGGIA

SEQ ID NO: 2900552 - protein, 10 aa, Entamoeba invadens
RGTSKSSNNY

SEQ ID NO: 2900553 - protein, 4 aa, Entamoeba invadens
RGTY

SEQ ID NO: 2900554 - protein, 5 aa, Entamoeba invadens
RGTYK

SEQ ID NO: 2900555 - protein, 13 aa, Entamoeba invadens
RGTYQNPIDIKLK

SEQ ID NO: 2900556 - protein, 4 aa, Entamoeba invadens
RGVD

SEQ ID NO: 2900557 - protein, 11 aa, Entamoeba invadens
RGVDKKEKYNI

SEQ ID NO: 2900558 - protein, 7 aa, Entamoeba invadens
RGVDSNG

SEQ ID NO: 2900559 - protein, 5 aa, Entamoeba invadens
RGVFT

SEQ ID NO: 2900560 - protein, 8 aa, Entamoeba invadens
RGVGDSGK

SEQ ID NO: 2900561 - protein, 8 aa, Entamoeba invadens
RGVGTPSF

SEQ ID NO: 2900562 - protein, 4 aa, Entamoeba invadens
RGVN

SEQ ID NO: 2900563 - protein, 4 aa, Entamoeba invadens
RGVS

SEQ ID NO: 2900564 - protein, 7 aa, Entamoeba invadens
RGVTERP

SEQ ID NO: 2900565 - protein, 5 aa, Entamoeba invadens
RGYDN

SEQ ID NO: 2900566 - protein, 10 aa, Entamoeba invadens
RGYDSAGIAS

SEQ ID NO: 2900567 - protein, 5 aa, Entamoeba invadens
RGYQG

SEQ ID NO: 2900568 - protein, 36 aa, Entamoeba invadens
RGYREQPRDYSPERNYDFSPTSYSPKPRDRETDRDV

SEQ ID NO: 2900569 - protein, 11 aa, Entamoeba invadens
RHAAEDPNTYK

SEQ ID NO: 2900570 - protein, 9 aa, Entamoeba invadens
RHAAGKEMG

SEQ ID NO: 2900571 - protein, 14 aa, Entamoeba invadens
RHDAKTKKTLSQTA

SEQ ID NO: 2900572 - protein, 7 aa, Entamoeba invadens
RHDSESP

SEQ ID NO: 2900573 - protein, 6 aa, Entamoeba invadens
RHEEEG

SEQ ID NO: 2900574 - protein, 6 aa, Entamoeba invadens
RHEFRD

SEQ ID NO: 2900575 - protein, 13 aa, Entamoeba invadens
RHEKSNKKELNTQ

SEQ ID NO: 2900576 - protein, 7 aa, Entamoeba invadens
RHETDIP

SEQ ID NO: 2900577 - protein, 16 aa, Entamoeba invadens
RHGDACSRNHHRPEVS

SEQ ID NO: 2900578 - protein, 17 aa, Entamoeba invadens
RHGDSCKKQHFRPESSQ

SEQ ID NO: 2900579 - protein, 6 aa, Entamoeba invadens
RHGGQD

SEQ ID NO: 2900580 - protein, 11 aa, Entamoeba invadens
RHGSGKTALAV

SEQ ID NO: 2900581 - protein, 4 aa, Entamoeba invadens
RHGV

SEQ ID NO: 2900582 - protein, 13 aa, Entamoeba invadens
RHIASKSEEVFGD

SEQ ID NO: 2900583 - protein, 4 aa, Entamoeba invadens
RHIP

SEQ ID NO: 2900584 - protein, 12 aa, Entamoeba invadens
RHKEAVKSISNT

SEQ ID NO: 2900585 - protein, 6 aa, Entamoeba invadens
RHKEKL

SEQ ID NO: 2900586 - protein, 15 aa, Entamoeba invadens
RHKFGDNIPSDVTSI

SEQ ID NO: 2900587 - protein, 66 aa, Entamoeba invadens
RHKNHEQEDRDDGDDINNDGNENENAIDSKNDEIDDINDDEKEKENDDITDNEEVEDKKENNENGI

SEQ ID NO: 2900588 - protein, 7 aa, Entamoeba invadens
RHKNKTV

SEQ ID NO: 2900589 - protein, 4 aa, Entamoeba invadens
RHLA

SEQ ID NO: 2900590 - protein, 24 aa, Entamoeba invadens
RHMSASETCSPSDRATPSPLSFSP

SEQ ID NO: 2900591 - protein, 8 aa, Entamoeba invadens
RHMTPKQY

SEQ ID NO: 2900592 - protein, 4 aa, Entamoeba invadens
RHNK

SEQ ID NO: 2900593 - protein, 6 aa, Entamoeba invadens
RHNKRT

SEQ ID NO: 2900594 - protein, 41 aa, Entamoeba invadens
RHPASNPRTTKPTLSTSKTKPLNKSQLTMTQKRKTTMGEVP

SEQ ID NO: 2900595 - protein, 6 aa, Entamoeba invadens
RHPASS

SEQ ID NO: 2900596 - protein, 5 aa, Entamoeba invadens
RHPGH

SEQ ID NO: 2900597 - protein, 21 aa, Entamoeba invadens
RHPKQQGESIRHDNSINSYNV

SEQ ID NO: 2900598 - protein, 21 aa, Entamoeba invadens
RHPNPNSSKKSVNPPQPVEKR

SEQ ID NO: 2900599 - protein, 5 aa, Entamoeba invadens
RHPQK

SEQ ID NO: 2900600 - protein, 4 aa, Entamoeba invadens
RHPT

SEQ ID NO: 2900601 - protein, 7 aa, Entamoeba invadens
RHPTDEK

SEQ ID NO: 2900602 - protein, 6 aa, Entamoeba invadens
RHPTLA

SEQ ID NO: 2900603 - protein, 12 aa, Entamoeba invadens
RHPTSNKAVTLN

SEQ ID NO: 2900604 - protein, 9 aa, Entamoeba invadens
RHQAPTKSL

SEQ ID NO: 2900605 - protein, 28 aa, Entamoeba invadens
RHQQSQNQLEHNQRTAELDNTKSQVEEI

SEQ ID NO: 2900606 - protein, 9 aa, Entamoeba invadens
RHQSSTKRG

SEQ ID NO: 2900607 - protein, 15 aa, Entamoeba invadens
RHSAEDELTYKQNDI

SEQ ID NO: 2900608 - protein, 5 aa, Entamoeba invadens
RHSAG

SEQ ID NO: 2900609 - protein, 5 aa, Entamoeba invadens
RHSAP

SEQ ID NO: 2900610 - protein, 12 aa, Entamoeba invadens
RHSDDQNKTKEN

SEQ ID NO: 2900611 - protein, 12 aa, Entamoeba invadens
RHTEDDNKKLQS

SEQ ID NO: 2900612 - protein, 6 aa, Entamoeba invadens
RHTEED

SEQ ID NO: 2900613 - protein, 8 aa, Entamoeba invadens
RHTPNTLD

SEQ ID NO: 2900614 - protein, 4 aa, Entamoeba invadens
RIAE

SEQ ID NO: 2900615 - protein, 8 aa, Entamoeba invadens
RIAESENC

SEQ ID NO: 2900616 - protein, 6 aa, Entamoeba invadens
RIAKEA

SEQ ID NO: 2900617 - protein, 5 aa, Entamoeba invadens
RIANG

SEQ ID NO: 2900618 - protein, 7 aa, Entamoeba invadens
RIANNEE

SEQ ID NO: 2900619 - protein, 12 aa, Entamoeba invadens
RIANNKKRASFG

SEQ ID NO: 2900620 - protein, 14 aa, Entamoeba invadens
RIAPPLETATAAPL

SEQ ID NO: 2900621 - protein, 6 aa, Entamoeba invadens
RIAPST

SEQ ID NO: 2900622 - protein, 7 aa, Entamoeba invadens
RIARSKT

SEQ ID NO: 2900623 - protein, 9 aa, Entamoeba invadens
RIATDQINA

SEQ ID NO: 2900624 - protein, 13 aa, Entamoeba invadens
RIATQRLNKYHPP

SEQ ID NO: 2900625 - protein, 5 aa, Entamoeba invadens
RIDEL

SEQ ID NO: 2900626 - protein, 8 aa, Entamoeba invadens
RIDEYSEK

SEQ ID NO: 2900627 - protein, 12 aa, Entamoeba invadens
RIDKSAQRNALR

SEQ ID NO: 2900628 - protein, 7 aa, Entamoeba invadens
RIDTGTG

SEQ ID NO: 2900629 - protein, 12 aa, Entamoeba invadens
RIDTNDKYCRPQ

SEQ ID NO: 2900630 - protein, 11 aa, Entamoeba invadens
RIEEGKKEFDY

SEQ ID NO: 2900631 - protein, 5 aa, Entamoeba invadens
RIEES

SEQ ID NO: 2900632 - protein, 8 aa, Entamoeba invadens
RIEETEDL

SEQ ID NO: 2900633 - protein, 7 aa, Entamoeba invadens
RIEETLS

SEQ ID NO: 2900634 - protein, 4 aa, Entamoeba invadens
RIEG

SEQ ID NO: 2900635 - protein, 4 aa, Entamoeba invadens
RIEK

SEQ ID NO: 2900636 - protein, 33 aa, Entamoeba invadens
RIEPSNDAPQIDQHDEEQANVHTSQTKDDLHAQ

SEQ ID NO: 2900637 - protein, 14 aa, Entamoeba invadens
RIEREEEEKARKEL

SEQ ID NO: 2900638 - protein, 6 aa, Entamoeba invadens
RIERET

SEQ ID NO: 2900639 - protein, 6 aa, Entamoeba invadens
RIETTK

SEQ ID NO: 2900640 - protein, 5 aa, Entamoeba invadens
RIGAT

SEQ ID NO: 2900641 - protein, 6 aa, Entamoeba invadens
RIGDER

SEQ ID NO: 2900642 - protein, 9 aa, Entamoeba invadens
RIGENTTGV

SEQ ID NO: 2900643 - protein, 12 aa, Entamoeba invadens
RIGKDHKPEDIE

SEQ ID NO: 2900644 - protein, 14 aa, Entamoeba invadens
RIGKDHNPEDPEEY

SEQ ID NO: 2900645 - protein, 9 aa, Entamoeba invadens
RIGKYSRKS

SEQ ID NO: 2900646 - protein, 7 aa, Entamoeba invadens
RIGNGNG

SEQ ID NO: 2900647 - protein, 13 aa, Entamoeba invadens
RIGPDRLKGEKEG

SEQ ID NO: 2900648 - protein, 11 aa, Entamoeba invadens
RIGPSPPAYLS

SEQ ID NO: 2900649 - protein, 13 aa, Entamoeba invadens
RIGQPLKKGGQKF

SEQ ID NO: 2900650 - protein, 8 aa, Entamoeba invadens
RIGQTKPV

SEQ ID NO: 2900651 - protein, 28 aa, Entamoeba invadens
RIGSKDPFAVRQKPNIKKTSSGVTNKDR

SEQ ID NO: 2900652 - protein, 5 aa, Entamoeba invadens
RIGSQ

SEQ ID NO: 2900653 - protein, 5 aa, Entamoeba invadens
RIIPT

SEQ ID NO: 2900654 - protein, 14 aa, Entamoeba invadens
RIKESVTKVNGQNW

SEQ ID NO: 2900655 - protein, 10 aa, Entamoeba invadens
RIKKEETQKK

SEQ ID NO: 2900656 - protein, 22 aa, Entamoeba invadens
RIKNNSKQNDSTKMLKNMDFFG

SEQ ID NO: 2900657 - protein, 4 aa, Entamoeba invadens
RIKS

SEQ ID NO: 2900658 - protein, 16 aa, Entamoeba invadens
RIKTIEKKEEYDRQRM

SEQ ID NO: 2900659 - protein, 9 aa, Entamoeba invadens
RINADGSLS

SEQ ID NO: 2900660 - protein, 8 aa, Entamoeba invadens
RINAETLQ

SEQ ID NO: 2900661 - protein, 4 aa, Entamoeba invadens
RINK

SEQ ID NO: 2900662 - protein, 6 aa, Entamoeba invadens
RINKSK

SEQ ID NO: 2900663 - protein, 8 aa, Entamoeba invadens
RINNTDVK

SEQ ID NO: 2900664 - protein, 4 aa, Entamoeba invadens
RINS

SEQ ID NO: 2900665 - protein, 11 aa, Entamoeba invadens
RINTNELSNDV

SEQ ID NO: 2900666 - protein, 4 aa, Entamoeba invadens
RINY

SEQ ID NO: 2900667 - protein, 17 aa, Entamoeba invadens
RIPDKEISSFGESKREI

SEQ ID NO: 2900668 - protein, 5 aa, Entamoeba invadens
RIPEN

SEQ ID NO: 2900669 - protein, 9 aa, Entamoeba invadens
RIPENWPSA

SEQ ID NO: 2900670 - protein, 17 aa, Entamoeba invadens
RIPNKEISSFGESKREI

SEQ ID NO: 2900671 - protein, 4 aa, Entamoeba invadens
RIPP

SEQ ID NO: 2900672 - protein, 5 aa, Entamoeba invadens
RIPQE

SEQ ID NO: 2900673 - protein, 7 aa, Entamoeba invadens
RIPRNNS

SEQ ID NO: 2900674 - protein, 11 aa, Entamoeba invadens
RIPSRTRKQCR

SEQ ID NO: 2900675 - protein, 4 aa, Entamoeba invadens
RIQA

SEQ ID NO: 2900676 - protein, 5 aa, Entamoeba invadens
RIQDT

SEQ ID NO: 2900677 - protein, 15 aa, Entamoeba invadens
RIQKPFGRKTMASPM

SEQ ID NO: 2900678 - protein, 15 aa, Entamoeba invadens
RIQKPFGRKTMTSPL

SEQ ID NO: 2900679 - protein, 8 aa, Entamoeba invadens
RIQSQKSL

SEQ ID NO: 2900680 - protein, 4 aa, Entamoeba invadens
RIQT

SEQ ID NO: 2900681 - protein, 6 aa, Entamoeba invadens
RIQTCE

SEQ ID NO: 2900682 - protein, 4 aa, Entamoeba invadens
RIRS

SEQ ID NO: 2900683 - protein, 5 aa, Entamoeba invadens
RISDT

SEQ ID NO: 2900684 - protein, 6 aa, Entamoeba invadens
RISEGI

SEQ ID NO: 2900685 - protein, 13 aa, Entamoeba invadens
RISEPSPQEEMSK

SEQ ID NO: 2900686 - protein, 5 aa, Entamoeba invadens
RISEQ

SEQ ID NO: 2900687 - protein, 23 aa, Entamoeba invadens
RISGEQKWKEERGENKKMITPTD

SEQ ID NO: 2900688 - protein, 11 aa, Entamoeba invadens
RISKSSPGSVD

SEQ ID NO: 2900689 - protein, 7 aa, Entamoeba invadens
RISPSQV

SEQ ID NO: 2900690 - protein, 4 aa, Entamoeba invadens
RISQ

SEQ ID NO: 2900691 - protein, 6 aa, Entamoeba invadens
RISQEN

SEQ ID NO: 2900692 - protein, 13 aa, Entamoeba invadens
RISSPKDSYISEE

SEQ ID NO: 2900693 - protein, 13 aa, Entamoeba invadens
RISSTFGNKMIGM

SEQ ID NO: 2900694 - protein, 6 aa, Entamoeba invadens
RISTGK

SEQ ID NO: 2900695 - protein, 4 aa, Entamoeba invadens
RITA

SEQ ID NO: 2900696 - protein, 4 aa, Entamoeba invadens
RITE

SEQ ID NO: 2900697 - protein, 6 aa, Entamoeba invadens
RITENK

SEQ ID NO: 2900698 - protein, 14 aa, Entamoeba invadens
RITPDKTASDLGLQ

SEQ ID NO: 2900699 - protein, 6 aa, Entamoeba invadens
RITPKE

SEQ ID NO: 2900700 - protein, 10 aa, Entamoeba invadens
RITPKGEEVI

SEQ ID NO: 2900701 - protein, 17 aa, Entamoeba invadens
RITQAGGTIDGGRVNGN

SEQ ID NO: 2900702 - protein, 10 aa, Entamoeba invadens
RITQKSQCGN

SEQ ID NO: 2900703 - protein, 5 aa, Entamoeba invadens
RITQL

SEQ ID NO: 2900704 - protein, 5 aa, Entamoeba invadens
RITSE

SEQ ID NO: 2900705 - protein, 9 aa, Entamoeba invadens
RITSGSREL

SEQ ID NO: 2900706 - protein, 8 aa, Entamoeba invadens
RITSVPDS

SEQ ID NO: 2900707 - protein, 4 aa, Entamoeba invadens
RITT

SEQ ID NO: 2900708 - protein, 6 aa, Entamoeba invadens
RITTST

SEQ ID NO: 2900709 - protein, 16 aa, Entamoeba invadens
RIVESDRTAVQNTPKF

SEQ ID NO: 2900710 - protein, 8 aa, Entamoeba invadens
RIYNSATR

SEQ ID NO: 2900711 - protein, 8 aa, Entamoeba invadens
RKAASTIL

SEQ ID NO: 2900712 - protein, 6 aa, Entamoeba invadens
RKADEE

SEQ ID NO: 2900713 - protein, 8 aa, Entamoeba invadens
RKADEMKK

SEQ ID NO: 2900714 - protein, 6 aa, Entamoeba invadens
RKADFE

SEQ ID NO: 2900715 - protein, 16 aa, Entamoeba invadens
RKAEIAAKKEMDEQKR

SEQ ID NO: 2900716 - protein, 12 aa, Entamoeba invadens
RKAELDELDDSH

SEQ ID NO: 2900717 - protein, 6 aa, Entamoeba invadens
RKAETQ

SEQ ID NO: 2900718 - protein, 11 aa, Entamoeba invadens
RKAKKQLTQEE

SEQ ID NO: 2900719 - protein, 9 aa, Entamoeba invadens
RKAKQRNVE

SEQ ID NO: 2900720 - protein, 16 aa, Entamoeba invadens
RKALKDQIDSIGKTFC

SEQ ID NO: 2900721 - protein, 17 aa, Entamoeba invadens
RKALPEGVPGLDRFYDK

SEQ ID NO: 2900722 - protein, 19 aa, Entamoeba invadens
RKAMEIENDGTTTTDEDVE

SEQ ID NO: 2900723 - protein, 6 aa, Entamoeba invadens
RKAPKD

SEQ ID NO: 2900724 - protein, 8 aa, Entamoeba invadens
RKAPQLPK

SEQ ID NO: 2900725 - protein, 16 aa, Entamoeba invadens
RKAPTTERANNYKTNK

SEQ ID NO: 2900726 - protein, 6 aa, Entamoeba invadens
RKAQKE

SEQ ID NO: 2900727 - protein, 9 aa, Entamoeba invadens
RKAQKERML

SEQ ID NO: 2900728 - protein, 9 aa, Entamoeba invadens
RKARATAEQ

SEQ ID NO: 2900729 - protein, 10 aa, Entamoeba invadens
RKASADPFAK

SEQ ID NO: 2900730 - protein, 7 aa, Entamoeba invadens
RKASSVR

SEQ ID NO: 2900731 - protein, 12 aa, Entamoeba invadens
RKASTEGRGTTE

SEQ ID NO: 2900732 - protein, 23 aa, Entamoeba invadens
RKATENEEGATQTIGTAKNPIEV

SEQ ID NO: 2900733 - protein, 43 aa, Entamoeba invadens
RKATFGEKVKQEEPPKVGSPEKRGFGSNTGAPKVTKDTERKNF

SEQ ID NO: 2900734 - protein, 12 aa, Entamoeba invadens
RKATNEGRGTTE

SEQ ID NO: 2900735 - protein, 6 aa, Entamoeba invadens
RKAVGT

SEQ ID NO: 2900736 - protein, 4 aa, Entamoeba invadens
RKAY

SEQ ID NO: 2900737 - protein, 7 aa, Entamoeba invadens
RKCEGKD

SEQ ID NO: 2900738 - protein, 9 aa, Entamoeba invadens
RKCNHPPSM

SEQ ID NO: 2900739 - protein, 11 aa, Entamoeba invadens
RKCSGDDNTPV

SEQ ID NO: 2900740 - protein, 18 aa, Entamoeba invadens
RKCSNDECQLENATIIIV

SEQ ID NO: 2900741 - protein, 8 aa, Entamoeba invadens
RKDDANKV

SEQ ID NO: 2900742 - protein, 9 aa, Entamoeba invadens
RKDDPTSFK

SEQ ID NO: 2900743 - protein, 7 aa, Entamoeba invadens
RKDDRGD

SEQ ID NO: 2900744 - protein, 7 aa, Entamoeba invadens
RKDDSKV

SEQ ID NO: 2900745 - protein, 8 aa, Entamoeba invadens
RKDEDHDC

SEQ ID NO: 2900746 - protein, 7 aa, Entamoeba invadens
RKDEHTT

SEQ ID NO: 2900747 - protein, 8 aa, Entamoeba invadens
RKDEIEEA

SEQ ID NO: 2900748 - protein, 11 aa, Entamoeba invadens
RKDEKKDKFEE

SEQ ID NO: 2900749 - protein, 7 aa, Entamoeba invadens
RKDEKSS

SEQ ID NO: 2900750 - protein, 8 aa, Entamoeba invadens
RKDEPEVS

SEQ ID NO: 2900751 - protein, 7 aa, Entamoeba invadens
RKDESDL

SEQ ID NO: 2900752 - protein, 4 aa, Entamoeba invadens
RKDG

SEQ ID NO: 2900753 - protein, 13 aa, Entamoeba invadens
RKDGERSESRMNE

SEQ ID NO: 2900754 - protein, 8 aa, Entamoeba invadens
RKDGGEIR

SEQ ID NO: 2900755 - protein, 15 aa, Entamoeba invadens
RKDGMRRGDRTAANV

SEQ ID NO: 2900756 - protein, 11 aa, Entamoeba invadens
RKDGPNKGKPF

SEQ ID NO: 2900757 - protein, 8 aa, Entamoeba invadens
RKDHPPGF

SEQ ID NO: 2900758 - protein, 18 aa, Entamoeba invadens
RKDIADDEESDDESEDWD

SEQ ID NO: 2900759 - protein, 8 aa, Entamoeba invadens
RKDISSTL

SEQ ID NO: 2900760 - protein, 39 aa, Entamoeba invadens
RKDKDEKKDDKKDEKGQKKEDKSDKSKDEKKSEKDEKTR

SEQ ID NO: 2900761 - protein, 10 aa, Entamoeba invadens
RKDKETANKL

SEQ ID NO: 2900762 - protein, 5 aa, Entamoeba invadens
RKDLP

SEQ ID NO: 2900763 - protein, 6 aa, Entamoeba invadens
RKDLRD

SEQ ID NO: 2900764 - protein, 5 aa, Entamoeba invadens
RKDNN

SEQ ID NO: 2900765 - protein, 8 aa, Entamoeba invadens
RKDNTLNI

SEQ ID NO: 2900766 - protein, 5 aa, Entamoeba invadens
RKDNV

SEQ ID NO: 2900767 - protein, 11 aa, Entamoeba invadens
RKDPTSCRRPV

SEQ ID NO: 2900768 - protein, 12 aa, Entamoeba invadens
RKDQHEQSEKEF

SEQ ID NO: 2900769 - protein, 31 aa, Entamoeba invadens
RKDQKGEQRETSHLQDPPKELIENNEKIPQT

SEQ ID NO: 2900770 - protein, 4 aa, Entamoeba invadens
RKDR

SEQ ID NO: 2900771 - protein, 9 aa, Entamoeba invadens
RKDRLGSLA

SEQ ID NO: 2900772 - protein, 20 aa, Entamoeba invadens
RKDRNGGSGIPRPASKQAPL

SEQ ID NO: 2900773 - protein, 8 aa, Entamoeba invadens
RKDRTDKK

SEQ ID NO: 2900774 - protein, 6 aa, Entamoeba invadens
RKDSPI

SEQ ID NO: 2900775 - protein, 7 aa, Entamoeba invadens
RKDYEKA

SEQ ID NO: 2900776 - protein, 7 aa, Entamoeba invadens
RKDYQGV

SEQ ID NO: 2900777 - protein, 8 aa, Entamoeba invadens
RKEAERIK

SEQ ID NO: 2900778 - protein, 11 aa, Entamoeba invadens
RKEAGAHGKDT

SEQ ID NO: 2900779 - protein, 11 aa, Entamoeba invadens
RKEALEESTVP

SEQ ID NO: 2900780 - protein, 4 aa, Entamoeba invadens
RKED

SEQ ID NO: 2900781 - protein, 8 aa, Entamoeba invadens
RKEDEGKQ

SEQ ID NO: 2900782 - protein, 11 aa, Entamoeba invadens
RKEDKDTNSCV

SEQ ID NO: 2900783 - protein, 7 aa, Entamoeba invadens
RKEDKTL

SEQ ID NO: 2900784 - protein, 15 aa, Entamoeba invadens
RKEDRAHEKSPIENT

SEQ ID NO: 2900785 - protein, 4 aa, Entamoeba invadens
RKEE

SEQ ID NO: 2900786 - protein, 7 aa, Entamoeba invadens
RKEEAEL

SEQ ID NO: 2900787 - protein, 10 aa, Entamoeba invadens
RKEEDQCKKN

SEQ ID NO: 2900788 - protein, 18 aa, Entamoeba invadens
RKEEEEAKRKEARKESII

SEQ ID NO: 2900789 - protein, 28 aa, Entamoeba invadens
RKEEEMKQKKKEEIRKMKADNDKKMQDI

SEQ ID NO: 2900790 - protein, 28 aa, Entamoeba invadens
RKEELDNKISSKRKEIELTKKRRDERVK

SEQ ID NO: 2900791 - protein, 4 aa, Entamoeba invadens
RKEF

SEQ ID NO: 2900792 - protein, 9 aa, Entamoeba invadens
RKEFSNGGS

SEQ ID NO: 2900793 - protein, 4 aa, Entamoeba invadens
RKEG

SEQ ID NO: 2900794 - protein, 7 aa, Entamoeba invadens
RKEGDEL

SEQ ID NO: 2900795 - protein, 16 aa, Entamoeba invadens
RKEGGVPDIKNPKMEL

SEQ ID NO: 2900796 - protein, 8 aa, Entamoeba invadens
RKEGSLQQ

SEQ ID NO: 2900797 - protein, 6 aa, Entamoeba invadens
RKEIEK

SEQ ID NO: 2900798 - protein, 7 aa, Entamoeba invadens
RKEITKE

SEQ ID NO: 2900799 - protein, 10 aa, Entamoeba invadens
RKEKADNDIL

SEQ ID NO: 2900800 - protein, 8 aa, Entamoeba invadens
RKEKDLDT

SEQ ID NO: 2900801 - protein, 22 aa, Entamoeba invadens
RKEKEAQKQGMSNTQITKTTIQ

SEQ ID NO: 2900802 - protein, 24 aa, Entamoeba invadens
RKEKEIEKVREETEKTAVERSGLN

SEQ ID NO: 2900803 - protein, 8 aa, Entamoeba invadens
RKEKETIE

SEQ ID NO: 2900804 - protein, 23 aa, Entamoeba invadens
RKEKGEKKDKKDATQTMKSQTTQ

SEQ ID NO: 2900805 - protein, 18 aa, Entamoeba invadens
RKEKNKRRTPNPSTGELQ

SEQ ID NO: 2900806 - protein, 6 aa, Entamoeba invadens
RKEKPR

SEQ ID NO: 2900807 - protein, 10 aa, Entamoeba invadens
RKEKRKTILT

SEQ ID NO: 2900808 - protein, 20 aa, Entamoeba invadens
RKEKTKTRKRVEGDNTEALE

SEQ ID NO: 2900809 - protein, 17 aa, Entamoeba invadens
RKELEDEKRRLDEEYTR

SEQ ID NO: 2900810 - protein, 7 aa, Entamoeba invadens
RKELEKD

SEQ ID NO: 2900811 - protein, 16 aa, Entamoeba invadens
RKELESQLRQTSYTTF

SEQ ID NO: 2900812 - protein, 7 aa, Entamoeba invadens
RKELKMS

SEQ ID NO: 2900813 - protein, 18 aa, Entamoeba invadens
RKELPDEAKTIKGRTPDT

SEQ ID NO: 2900814 - protein, 13 aa, Entamoeba invadens
RKEMFGSGGEVGS

SEQ ID NO: 2900815 - protein, 23 aa, Entamoeba invadens
RKEMHEKQLSQQKKKNKFKKCTI

SEQ ID NO: 2900816 - protein, 7 aa, Entamoeba invadens
RKEMKEE

SEQ ID NO: 2900817 - protein, 19 aa, Entamoeba invadens
RKENERADAMKSEQTNFKT

SEQ ID NO: 2900818 - protein, 9 aa, Entamoeba invadens
RKENQQKLK

SEQ ID NO: 2900819 - protein, 6 aa, Entamoeba invadens
RKENYK

SEQ ID NO: 2900820 - protein, 8 aa, Entamoeba invadens
RKEQTYKD

SEQ ID NO: 2900821 - protein, 4 aa, Entamoeba invadens
RKER

SEQ ID NO: 2900822 - protein, 7 aa, Entamoeba invadens
RKEREDL

SEQ ID NO: 2900823 - protein, 11 aa, Entamoeba invadens
RKERENTHYQQ

SEQ ID NO: 2900824 - protein, 26 aa, Entamoeba invadens
RKERETTRDGELPPRMDKADKPVAKV

SEQ ID NO: 2900825 - protein, 6 aa, Entamoeba invadens
RKERIT

SEQ ID NO: 2900826 - protein, 8 aa, Entamoeba invadens
RKERITSE

SEQ ID NO: 2900827 - protein, 20 aa, Entamoeba invadens
RKERLTKDRAIAKAKKEAMI

SEQ ID NO: 2900828 - protein, 8 aa, Entamoeba invadens
RKERTLRR

SEQ ID NO: 2900829 - protein, 8 aa, Entamoeba invadens
RKESEDDW

SEQ ID NO: 2900830 - protein, 6 aa, Entamoeba invadens
RKESFE

SEQ ID NO: 2900831 - protein, 8 aa, Entamoeba invadens
RKESGGII

SEQ ID NO: 2900832 - protein, 9 aa, Entamoeba invadens
RKESPIVPS

SEQ ID NO: 2900833 - protein, 27 aa, Entamoeba invadens
RKESTFNTQIGKTQADLKKHNNQSETA

SEQ ID NO: 2900834 - protein, 10 aa, Entamoeba invadens
RKETDRVNIE

SEQ ID NO: 2900835 - protein, 7 aa, Entamoeba invadens
RKETKRY

SEQ ID NO: 2900836 - protein, 7 aa, Entamoeba invadens
RKETNDP

SEQ ID NO: 2900837 - protein, 12 aa, Entamoeba invadens
RKETPKTRTRVD

SEQ ID NO: 2900838 - protein, 34 aa, Entamoeba invadens
RKETVSVSSSTVYGSDEDKKKRCQTCNTTRDDID

SEQ ID NO: 2900839 - protein, 6 aa, Entamoeba invadens
RKEVGN

SEQ ID NO: 2900840 - protein, 6 aa, Entamoeba invadens
RKFGAQ

SEQ ID NO: 2900841 - protein, 6 aa, Entamoeba invadens
RKFGAT

SEQ ID NO: 2900842 - protein, 7 aa, Entamoeba invadens
RKFGENA

SEQ ID NO: 2900843 - protein, 4 aa, Entamoeba invadens
RKFK

SEQ ID NO: 2900844 - protein, 5 aa, Entamoeba invadens
RKFSE

SEQ ID NO: 2900845 - protein, 6 aa, Entamoeba invadens
RKFTER

SEQ ID NO: 2900846 - protein, 7 aa, Entamoeba invadens
RKGARNS

SEQ ID NO: 2900847 - protein, 4 aa, Entamoeba invadens
RKGD

SEQ ID NO: 2900848 - protein, 7 aa, Entamoeba invadens
RKGEFGG

SEQ ID NO: 2900849 - protein, 9 aa, Entamoeba invadens
RKGENEEDL

SEQ ID NO: 2900850 - protein, 9 aa, Entamoeba invadens
RKGEPVKGL

SEQ ID NO: 2900851 - protein, 9 aa, Entamoeba invadens
RKGERLPSL

SEQ ID NO: 2900852 - protein, 7 aa, Entamoeba invadens
RKGESEY

SEQ ID NO: 2900853 - protein, 10 aa, Entamoeba invadens
RKGGDDISSA

SEQ ID NO: 2900854 - protein, 5 aa, Entamoeba invadens
RKGGN

SEQ ID NO: 2900855 - protein, 4 aa, Entamoeba invadens
RKGI

SEQ ID NO: 2900856 - protein, 6 aa, Entamoeba invadens
RKGIDT

SEQ ID NO: 2900857 - protein, 8 aa, Entamoeba invadens
RKGKAEVS

SEQ ID NO: 2900858 - protein, 9 aa, Entamoeba invadens
RKGKRGGAC

SEQ ID NO: 2900859 - protein, 10 aa, Entamoeba invadens
RKGKRSGACK

SEQ ID NO: 2900860 - protein, 9 aa, Entamoeba invadens
RKGKRSGGY

SEQ ID NO: 2900861 - protein, 17 aa, Entamoeba invadens
RKGKTESHNSKLGTRNV

SEQ ID NO: 2900862 - protein, 11 aa, Entamoeba invadens
RKGKTGKESDI

SEQ ID NO: 2900863 - protein, 22 aa, Entamoeba invadens
RKGMNRVDRERAEKFNNTVEEM

SEQ ID NO: 2900864 - protein, 9 aa, Entamoeba invadens
RKGMSSPAL

SEQ ID NO: 2900865 - protein, 7 aa, Entamoeba invadens
RKGPPHM

SEQ ID NO: 2900866 - protein, 4 aa, Entamoeba invadens
RKGQ

SEQ ID NO: 2900867 - protein, 5 aa, Entamoeba invadens
RKGQE

SEQ ID NO: 2900868 - protein, 5 aa, Entamoeba invadens
RKGRI

SEQ ID NO: 2900869 - protein, 12 aa, Entamoeba invadens
RKGRTKDAEQNP

SEQ ID NO: 2900870 - protein, 13 aa, Entamoeba invadens
RKGSFPKTTAILK

SEQ ID NO: 2900871 - protein, 17 aa, Entamoeba invadens
RKGSGNNKTMRDGSRKK

SEQ ID NO: 2900872 - protein, 8 aa, Entamoeba invadens
RKGSPQEG

SEQ ID NO: 2900873 - protein, 9 aa, Entamoeba invadens
RKGTSSDYE

SEQ ID NO: 2900874 - protein, 23 aa, Entamoeba invadens
RKGTTLKPPTITNDNTVTDDQYD

SEQ ID NO: 2900875 - protein, 10 aa, Entamoeba invadens
RKGVDSTQHT

SEQ ID NO: 2900876 - protein, 5 aa, Entamoeba invadens
RKHDG

SEQ ID NO: 2900877 - protein, 13 aa, Entamoeba invadens
RKHKKDISGNARA

SEQ ID NO: 2900878 - protein, 8 aa, Entamoeba invadens
RKHQRNIK

SEQ ID NO: 2900879 - protein, 55 aa, Entamoeba invadens
RKHSNSISSKTQKRDDLGEKKNEKDDSGTDSDNTVSPIKSPRRDKPDHRKSKLSA

SEQ ID NO: 2900880 - protein, 4 aa, Entamoeba invadens
RKID

SEQ ID NO: 2900881 - protein, 7 aa, Entamoeba invadens
RKIDSQH

SEQ ID NO: 2900882 - protein, 15 aa, Entamoeba invadens
RKIEEDKKRAEEERL

SEQ ID NO: 2900883 - protein, 6 aa, Entamoeba invadens
RKIEPK

SEQ ID NO: 2900884 - protein, 12 aa, Entamoeba invadens
RKIEPKRDEFRP

SEQ ID NO: 2900885 - protein, 7 aa, Entamoeba invadens
RKIETSK

SEQ ID NO: 2900886 - protein, 8 aa, Entamoeba invadens
RKIGDGGI

SEQ ID NO: 2900887 - protein, 7 aa, Entamoeba invadens
RKIGEKA

SEQ ID NO: 2900888 - protein, 34 aa, Entamoeba invadens
RKIGNEKMSEKKIENVRNDNIQGVNQNGEKSQLG

SEQ ID NO: 2900889 - protein, 28 aa, Entamoeba invadens
RKIQEKKNEEKKAKENLKALTKDEKVKE

SEQ ID NO: 2900890 - protein, 7 aa, Entamoeba invadens
RKISEDV

SEQ ID NO: 2900891 - protein, 22 aa, Entamoeba invadens
RKITTIDPLSDDYEKSKDSKNF

SEQ ID NO: 2900892 - protein, 7 aa, Entamoeba invadens
RKKAEDL

SEQ ID NO: 2900893 - protein, 15 aa, Entamoeba invadens
RKKAEQEKEDAKIPF

SEQ ID NO: 2900894 - protein, 11 aa, Entamoeba invadens
RKKAKALEREQ

SEQ ID NO: 2900895 - protein, 9 aa, Entamoeba invadens
RKKAVDMRD

SEQ ID NO: 2900896 - protein, 6 aa, Entamoeba invadens
RKKDDR

SEQ ID NO: 2900897 - protein, 13 aa, Entamoeba invadens
RKKDKPKKKPINK

SEQ ID NO: 2900898 - protein, 54 aa, Entamoeba invadens
RKKDPTVPDPIKPEKVEKQEKNEAEPEKKKRRKKIDKKSVTGVEDGLSQTTKDD

SEQ ID NO: 2900899 - protein, 22 aa, Entamoeba invadens
RKKEASSMEEEPPKEEKKLSEN

SEQ ID NO: 2900900 - protein, 5 aa, Entamoeba invadens
RKKEG

SEQ ID NO: 2900901 - protein, 5 aa, Entamoeba invadens
RKKEK

SEQ ID NO: 2900902 - protein, 8 aa, Entamoeba invadens
RKKEVPHD

SEQ ID NO: 2900903 - protein, 8 aa, Entamoeba invadens
RKKFGNNI

SEQ ID NO: 2900904 - protein, 17 aa, Entamoeba invadens
RKKGEKFDSYRAGSEGI

SEQ ID NO: 2900905 - protein, 6 aa, Entamoeba invadens
RKKGPW

SEQ ID NO: 2900906 - protein, 8 aa, Entamoeba invadens
RKKGTTDL

SEQ ID NO: 2900907 - protein, 5 aa, Entamoeba invadens
RKKGV

SEQ ID NO: 2900908 - protein, 9 aa, Entamoeba invadens
RKKHENDIP

SEQ ID NO: 2900909 - protein, 9 aa, Entamoeba invadens
RKKIDSYGE

SEQ ID NO: 2900910 - protein, 9 aa, Entamoeba invadens
RKKISPNPM

SEQ ID NO: 2900911 - protein, 20 aa, Entamoeba invadens
RKKKAHPKPIPKRPPSPENV

SEQ ID NO: 2900912 - protein, 38 aa, Entamoeba invadens
RKKKEKASQGTTPITEKRKSLQTAEVQPDIKSLNSEDT

SEQ ID NO: 2900913 - protein, 9 aa, Entamoeba invadens
RKKKTKTVN

SEQ ID NO: 2900914 - protein, 19 aa, Entamoeba invadens
RKKNKKNPPVETQPFQSEN

SEQ ID NO: 2900915 - protein, 13 aa, Entamoeba invadens
RKKNSTQMEEEHK

SEQ ID NO: 2900916 - protein, 9 aa, Entamoeba invadens
RKKNTKSDF

SEQ ID NO: 2900917 - protein, 13 aa, Entamoeba invadens
RKKNYTPFPPERD

SEQ ID NO: 2900918 - protein, 22 aa, Entamoeba invadens
RKKPKKGDVDDDSEEEEQCQSV

SEQ ID NO: 2900919 - protein, 9 aa, Entamoeba invadens
RKKPSSIKQ

SEQ ID NO: 2900920 - protein, 24 aa, Entamoeba invadens
RKKPSTQKKKQPQQSQPNEDQSSV

SEQ ID NO: 2900921 - protein, 8 aa, Entamoeba invadens
RKKPTKEE

SEQ ID NO: 2900922 - protein, 19 aa, Entamoeba invadens
RKKPTPHRKKTGGDDTTSL

SEQ ID NO: 2900923 - protein, 11 aa, Entamoeba invadens
RKKQEDANKAL

SEQ ID NO: 2900924 - protein, 29 aa, Entamoeba invadens
  misc_feature (15)..(16): Xaa can be any naturally occurring amino acid
RKKQKMRFVLTQKIXXNINWSGMKEFSEE

SEQ ID NO: 2900925 - protein, 25 aa, Entamoeba invadens
RKKQKTPEPVKETEKVENKEEQERL

SEQ ID NO: 2900926 - protein, 8 aa, Entamoeba invadens
RKKQSDAL

SEQ ID NO: 2900927 - protein, 13 aa, Entamoeba invadens
RKKQSNKVVEDPS

SEQ ID NO: 2900928 - protein, 10 aa, Entamoeba invadens
RKKQTESEIR

SEQ ID NO: 2900929 - protein, 21 aa, Entamoeba invadens
RKKQVEVKESEKDKVPPALEE

SEQ ID NO: 2900930 - protein, 12 aa, Entamoeba invadens
RKKRENESFEEG

SEQ ID NO: 2900931 - protein, 55 aa, Entamoeba invadens
RKKRGGYKGYADQKTKEMPKTAGKPAKTNKAKVEKKPKKEKKTKDPNKPKKPQTA

SEQ ID NO: 2900932 - protein, 6 aa, Entamoeba invadens
RKKRNR

SEQ ID NO: 2900933 - protein, 9 aa, Entamoeba invadens
RKKSGDASF

SEQ ID NO: 2900934 - protein, 7 aa, Entamoeba invadens
RKKSSAY

SEQ ID NO: 2900935 - protein, 15 aa, Entamoeba invadens
RKKSSTFTEKLPKVD

SEQ ID NO: 2900936 - protein, 4 aa, Entamoeba invadens
RKKT

SEQ ID NO: 2900937 - protein, 22 aa, Entamoeba invadens
RKKTAEGENILNTKKEKTEIDV

SEQ ID NO: 2900938 - protein, 8 aa, Entamoeba invadens
RKKTDQKF

SEQ ID NO: 2900939 - protein, 15 aa, Entamoeba invadens
RKKTDQLYKEKEERI

SEQ ID NO: 2900940 - protein, 7 aa, Entamoeba invadens
RKKTEKL

SEQ ID NO: 2900941 - protein, 10 aa, Entamoeba invadens
RKKTLAKTKS

SEQ ID NO: 2900942 - protein, 7 aa, Entamoeba invadens
RKKTPEL

SEQ ID NO: 2900943 - protein, 4 aa, Entamoeba invadens
RKKV

SEQ ID NO: 2900944 - protein, 10 aa, Entamoeba invadens
RKKYKKSSDV

SEQ ID NO: 2900945 - protein, 8 aa, Entamoeba invadens
RKLAAETQ

SEQ ID NO: 2900946 - protein, 16 aa, Entamoeba invadens
RKLAKKASEEAEAFKD

SEQ ID NO: 2900947 - protein, 6 aa, Entamoeba invadens
RKLDSF

SEQ ID NO: 2900948 - protein, 11 aa, Entamoeba invadens
RKLEEEEKEAI

SEQ ID NO: 2900949 - protein, 13 aa, Entamoeba invadens
RKLGDKKYTTKDE

SEQ ID NO: 2900950 - protein, 6 aa, Entamoeba invadens
RKLGGQ

SEQ ID NO: 2900951 - protein, 9 aa, Entamoeba invadens
RKLGPDELE

SEQ ID NO: 2900952 - protein, 11 aa, Entamoeba invadens
RKLKNEKGESA

SEQ ID NO: 2900953 - protein, 19 aa, Entamoeba invadens
RKLKNKESARKSRQKSKEA

SEQ ID NO: 2900954 - protein, 22 aa, Entamoeba invadens
RKLKNKESARKSRQKSKEAFSQ

SEQ ID NO: 2900955 - protein, 9 aa, Entamoeba invadens
RKLKRQKAL

SEQ ID NO: 2900956 - protein, 4 aa, Entamoeba invadens
RKLP

SEQ ID NO: 2900957 - protein, 14 aa, Entamoeba invadens
RKLPKAEPEPQHPR

SEQ ID NO: 2900958 - protein, 5 aa, Entamoeba invadens
RKLQG

SEQ ID NO: 2900959 - protein, 9 aa, Entamoeba invadens
RKLSQDMRE

SEQ ID NO: 2900960 - protein, 15 aa, Entamoeba invadens
RKMAQKRIKGQLERR

SEQ ID NO: 2900961 - protein, 10 aa, Entamoeba invadens
RKMGYGGSGF

SEQ ID NO: 2900962 - protein, 13 aa, Entamoeba invadens
RKMSDKLNTSVED

SEQ ID NO: 2900963 - protein, 7 aa, Entamoeba invadens
RKMSKQE

SEQ ID NO: 2900964 - protein, 7 aa, Entamoeba invadens
RKMSSND

SEQ ID NO: 2900965 - protein, 24 aa, Entamoeba invadens
RKMSTARGTKTKVSSKRKNDLSKS

SEQ ID NO: 2900966 - protein, 6 aa, Entamoeba invadens
RKMTKK

SEQ ID NO: 2900967 - protein, 11 aa, Entamoeba invadens
RKNAPPPAELK

SEQ ID NO: 2900968 - protein, 43 aa, Entamoeba invadens
RKNASKSEQERSESGECTTRDLSPEYQEEKCEDLEKAKNPIAT

SEQ ID NO: 2900969 - protein, 5 aa, Entamoeba invadens
RKNDN

SEQ ID NO: 2900970 - protein, 9 aa, Entamoeba invadens
RKNDTLKNS

SEQ ID NO: 2900971 - protein, 9 aa, Entamoeba invadens
RKNEDGKHI

SEQ ID NO: 2900972 - protein, 9 aa, Entamoeba invadens
RKNEDTTDF

SEQ ID NO: 2900973 - protein, 12 aa, Entamoeba invadens
RKNEELRKELNI

SEQ ID NO: 2900974 - protein, 17 aa, Entamoeba invadens
RKNEENKENKSSKGTTM

SEQ ID NO: 2900975 - protein, 6 aa, Entamoeba invadens
RKNGEI

SEQ ID NO: 2900976 - protein, 8 aa, Entamoeba invadens
RKNGNKSA

SEQ ID NO: 2900977 - protein, 11 aa, Entamoeba invadens
RKNGNSKRVSE

SEQ ID NO: 2900978 - protein, 8 aa, Entamoeba invadens
RKNKEECV

SEQ ID NO: 2900979 - protein, 9 aa, Entamoeba invadens
RKNKTERSF

SEQ ID NO: 2900980 - protein, 7 aa, Entamoeba invadens
RKNNEPI

SEQ ID NO: 2900981 - protein, 14 aa, Entamoeba invadens
RKNNINASSLTQNE

SEQ ID NO: 2900982 - protein, 12 aa, Entamoeba invadens
RKNNKKAIEVAN

SEQ ID NO: 2900983 - protein, 11 aa, Entamoeba invadens
RKNNPKSSAGW

SEQ ID NO: 2900984 - protein, 9 aa, Entamoeba invadens
RKNPEADIN

SEQ ID NO: 2900985 - protein, 5 aa, Entamoeba invadens
RKNPI

SEQ ID NO: 2900986 - protein, 9 aa, Entamoeba invadens
RKNPNARYS

SEQ ID NO: 2900987 - protein, 14 aa, Entamoeba invadens
RKNPVEKDLPNIDD

SEQ ID NO: 2900988 - protein, 21 aa, Entamoeba invadens
RKNQDKIKMSENSVKDRRTSV

SEQ ID NO: 2900989 - protein, 6 aa, Entamoeba invadens
RKNRTM

SEQ ID NO: 2900990 - protein, 9 aa, Entamoeba invadens
RKNSDFDRD

SEQ ID NO: 2900991 - protein, 9 aa, Entamoeba invadens
RKNSERKEE

SEQ ID NO: 2900992 - protein, 5 aa, Entamoeba invadens
RKNSK

SEQ ID NO: 2900993 - protein, 8 aa, Entamoeba invadens
RKNSPRIV

SEQ ID NO: 2900994 - protein, 5 aa, Entamoeba invadens
RKNSY

SEQ ID NO: 2900995 - protein, 19 aa, Entamoeba invadens
RKNTDISDGQITQQSKLST

SEQ ID NO: 2900996 - protein, 7 aa, Entamoeba invadens
RKNTERL

SEQ ID NO: 2900997 - protein, 7 aa, Entamoeba invadens
RKNTTFK

SEQ ID NO: 2900998 - protein, 4 aa, Entamoeba invadens
RKNV

SEQ ID NO: 2900999 - protein, 18 aa, Entamoeba invadens
RKNVESDKMKTADRNTKT

SEQ ID NO: 2901000 - protein, 21 aa, Entamoeba invadens
RKNVPLPKGRKRMTKNNKQIG

SEQ ID NO: 2901001 - protein, 27 aa, Entamoeba invadens
RKNYENEKRKMDAKVNPYSNQGPPTVP

SEQ ID NO: 2901002 - protein, 18 aa, Entamoeba invadens
RKNYQNYKRSSCDDLRSN

SEQ ID NO: 2901003 - protein, 8 aa, Entamoeba invadens
RKPANQGI

SEQ ID NO: 2901004 - protein, 11 aa, Entamoeba invadens
RKPEEITKEEY

SEQ ID NO: 2901005 - protein, 6 aa, Entamoeba invadens
RKPEML

SEQ ID NO: 2901006 - protein, 10 aa, Entamoeba invadens
RKPEQSTTAQ

SEQ ID NO: 2901007 - protein, 7 aa, Entamoeba invadens
RKPITFG

SEQ ID NO: 2901008 - protein, 9 aa, Entamoeba invadens
RKPKKDMKD

SEQ ID NO: 2901009 - protein, 7 aa, Entamoeba invadens
RKPNAAI

SEQ ID NO: 2901010 - protein, 8 aa, Entamoeba invadens
RKPNWSKT

SEQ ID NO: 2901011 - protein, 10 aa, Entamoeba invadens
RKPPDQNQLE

SEQ ID NO: 2901012 - protein, 6 aa, Entamoeba invadens
RKPPVF

SEQ ID NO: 2901013 - protein, 8 aa, Entamoeba invadens
RKPSEEAQ

SEQ ID NO: 2901014 - protein, 5 aa, Entamoeba invadens
RKPSF

SEQ ID NO: 2901015 - protein, 7 aa, Entamoeba invadens
RKPSKMS

SEQ ID NO: 2901016 - protein, 12 aa, Entamoeba invadens
RKPSKQARVTTQ

SEQ ID NO: 2901017 - protein, 7 aa, Entamoeba invadens
RKPTADF

SEQ ID NO: 2901018 - protein, 25 aa, Entamoeba invadens
RKPTATSTSGPITTHSPRRRADNRA

SEQ ID NO: 2901019 - protein, 6 aa, Entamoeba invadens
RKPTGV

SEQ ID NO: 2901020 - protein, 5 aa, Entamoeba invadens
RKPVD

SEQ ID NO: 2901021 - protein, 6 aa, Entamoeba invadens
RKPVDT

SEQ ID NO: 2901022 - protein, 7 aa, Entamoeba invadens
RKPVTGK

SEQ ID NO: 2901023 - protein, 9 aa, Entamoeba invadens
RKPYTAKSD

SEQ ID NO: 2901024 - protein, 18 aa, Entamoeba invadens
RKPYYTRPYKKEEENVEV

SEQ ID NO: 2901025 - protein, 25 aa, Entamoeba invadens
RKQAEEEGIDSSEEYEERDRTFVSP

SEQ ID NO: 2901026 - protein, 8 aa, Entamoeba invadens
RKQAEGKD

SEQ ID NO: 2901027 - protein, 27 aa, Entamoeba invadens
RKQEEEDSEDQPLGNPEDDDEEIDSDD

SEQ ID NO: 2901028 - protein, 9 aa, Entamoeba invadens
RKQEEVGCR

SEQ ID NO: 2901029 - protein, 9 aa, Entamoeba invadens
RKQGGAPTN

SEQ ID NO: 2901030 - protein, 7 aa, Entamoeba invadens
RKQHETE

SEQ ID NO: 2901031 - protein, 5 aa, Entamoeba invadens
RKQHT

SEQ ID NO: 2901032 - protein, 10 aa, Entamoeba invadens
RKQKGKKDDE

SEQ ID NO: 2901033 - protein, 8 aa, Entamoeba invadens
RKQKQSVG

SEQ ID NO: 2901034 - protein, 6 aa, Entamoeba invadens
RKQNST

SEQ ID NO: 2901035 - protein, 7 aa, Entamoeba invadens
RKQPKGI

SEQ ID NO: 2901036 - protein, 24 aa, Entamoeba invadens
RKQQETIRQQHSAPPSLPKRSQQL

SEQ ID NO: 2901037 - protein, 20 aa, Entamoeba invadens
RKQQETLQAPRKKKAPLELN

SEQ ID NO: 2901038 - protein, 15 aa, Entamoeba invadens
RKQRKRTIKTDTGET

SEQ ID NO: 2901039 - protein, 12 aa, Entamoeba invadens
RKQRPTKGKKAY

SEQ ID NO: 2901040 - protein, 16 aa, Entamoeba invadens
RKQSKMERRRMTMALL

SEQ ID NO: 2901041 - protein, 6 aa, Entamoeba invadens
RKQSYH

SEQ ID NO: 2901042 - protein, 4 aa, Entamoeba invadens
RKQV

SEQ ID NO: 2901043 - protein, 6 aa, Entamoeba invadens
RKQVPL

SEQ ID NO: 2901044 - protein, 4 aa, Entamoeba invadens
RKQY

SEQ ID NO: 2901045 - protein, 7 aa, Entamoeba invadens
RKQYSTE

SEQ ID NO: 2901046 - protein, 10 aa, Entamoeba invadens
RKRAKDSGFV

SEQ ID NO: 2901047 - protein, 20 aa, Entamoeba invadens
RKRDEKSTNDKCKKKLLAMF

SEQ ID NO: 2901048 - protein, 8 aa, Entamoeba invadens
RKRDGEEE

SEQ ID NO: 2901049 - protein, 5 aa, Entamoeba invadens
RKRDK

SEQ ID NO: 2901050 - protein, 12 aa, Entamoeba invadens
RKREDMKTKAEQ

SEQ ID NO: 2901051 - protein, 20 aa, Entamoeba invadens
RKREEEKKQLELEKSQNEMR

SEQ ID NO: 2901052 - protein, 16 aa, Entamoeba invadens
RKREEVQRRQEEVRQR

SEQ ID NO: 2901053 - protein, 5 aa, Entamoeba invadens
RKREM

SEQ ID NO: 2901054 - protein, 17 aa, Entamoeba invadens
RKRENPENKEETEEEDY

SEQ ID NO: 2901055 - protein, 10 aa, Entamoeba invadens
RKRGDCPGID

SEQ ID NO: 2901056 - protein, 10 aa, Entamoeba invadens
RKRGEIQAKN

SEQ ID NO: 2901057 - protein, 13 aa, Entamoeba invadens
RKRGKLLKGGEPD

SEQ ID NO: 2901058 - protein, 5 aa, Entamoeba invadens
RKRHR

SEQ ID NO: 2901059 - protein, 4 aa, Entamoeba invadens
RKRI

SEQ ID NO: 2901060 - protein, 17 aa, Entamoeba invadens
RKRITKEAAEAVLSGSA

SEQ ID NO: 2901061 - protein, 7 aa, Entamoeba invadens
RKRKEGN

SEQ ID NO: 2901062 - protein, 24 aa, Entamoeba invadens
RKRKEKSEVDHTKEAYEEKKQTIM

SEQ ID NO: 2901063 - protein, 6 aa, Entamoeba invadens
RKRKRQ

SEQ ID NO: 2901064 - protein, 11 aa, Entamoeba invadens
RKRLDEAKHTP

SEQ ID NO: 2901065 - protein, 6 aa, Entamoeba invadens
RKRLRD

SEQ ID NO: 2901066 - protein, 6 aa, Entamoeba invadens
RKRNPQ

SEQ ID NO: 2901067 - protein, 10 aa, Entamoeba invadens
RKRPAEMKDN

SEQ ID NO: 2901068 - protein, 11 aa, Entamoeba invadens
RKRPAEMKNKD

SEQ ID NO: 2901069 - protein, 5 aa, Entamoeba invadens
RKRPG

SEQ ID NO: 2901070 - protein, 8 aa, Entamoeba invadens
RKRPYDGK

SEQ ID NO: 2901071 - protein, 10 aa, Entamoeba invadens
RKRQGKPSCV

SEQ ID NO: 2901072 - protein, 13 aa, Entamoeba invadens
RKRRATACVVDKD

SEQ ID NO: 2901073 - protein, 6 aa, Entamoeba invadens
RKRRGV

SEQ ID NO: 2901074 - protein, 9 aa, Entamoeba invadens
RKRRKDEVL

SEQ ID NO: 2901075 - protein, 8 aa, Entamoeba invadens
RKRRPSAM

SEQ ID NO: 2901076 - protein, 9 aa, Entamoeba invadens
RKRSEKTEN

SEQ ID NO: 2901077 - protein, 10 aa, Entamoeba invadens
RKRSQNVSRN

SEQ ID NO: 2901078 - protein, 8 aa, Entamoeba invadens
RKRTQHDW

SEQ ID NO: 2901079 - protein, 13 aa, Entamoeba invadens
RKRVSRNEETTIA

SEQ ID NO: 2901080 - protein, 4 aa, Entamoeba invadens
RKRY

SEQ ID NO: 2901081 - protein, 9 aa, Entamoeba invadens
RKRYDHHQR

SEQ ID NO: 2901082 - protein, 35 aa, Entamoeba invadens
RKRYEARSLPSTPAGSPAPSPKGTPKTSPSQMRRR

SEQ ID NO: 2901083 - protein, 11 aa, Entamoeba invadens
RKRYEKEDQKI

SEQ ID NO: 2901084 - protein, 9 aa, Entamoeba invadens
RKSAEACSG

SEQ ID NO: 2901085 - protein, 8 aa, Entamoeba invadens
RKSDALNQ

SEQ ID NO: 2901086 - protein, 10 aa, Entamoeba invadens
RKSDGTLQEH

SEQ ID NO: 2901087 - protein, 14 aa, Entamoeba invadens
RKSDMDRDGHIDEP

SEQ ID NO: 2901088 - protein, 8 aa, Entamoeba invadens
RKSDPREM

SEQ ID NO: 2901089 - protein, 14 aa, Entamoeba invadens
RKSDQLKKMTGDRP

SEQ ID NO: 2901090 - protein, 6 aa, Entamoeba invadens
RKSDYS

SEQ ID NO: 2901091 - protein, 8 aa, Entamoeba invadens
RKSEGERP

SEQ ID NO: 2901092 - protein, 8 aa, Entamoeba invadens
RKSEQIPP

SEQ ID NO: 2901093 - protein, 85 aa, Entamoeba invadens
RKSESDEKKESRSFSSFPQRGISRQEPSKSISRSESKSFKDQRSISRPDTKRPPISNPGVNKRLPEPTQIKSVPTKKSYVLSDSD

SEQ ID NO: 2901094 - protein, 31 aa, Entamoeba invadens
RKSEVEADREKSESEVKKYELKSKGKDVKEV

SEQ ID NO: 2901095 - protein, 12 aa, Entamoeba invadens
RKSEVSPIYFGT

SEQ ID NO: 2901096 - protein, 6 aa, Entamoeba invadens
RKSFED

SEQ ID NO: 2901097 - protein, 7 aa, Entamoeba invadens
RKSFEQI

SEQ ID NO: 2901098 - protein, 6 aa, Entamoeba invadens
RKSFKI

SEQ ID NO: 2901099 - protein, 15 aa, Entamoeba invadens
RKSGEAKNKIKAKRD

SEQ ID NO: 2901100 - protein, 7 aa, Entamoeba invadens
RKSGENI

SEQ ID NO: 2901101 - protein, 11 aa, Entamoeba invadens
RKSGGGCAPVN

SEQ ID NO: 2901102 - protein, 11 aa, Entamoeba invadens
RKSGNSGGYRM

SEQ ID NO: 2901103 - protein, 6 aa, Entamoeba invadens
RKSGNV

SEQ ID NO: 2901104 - protein, 8 aa, Entamoeba invadens
RKSGQCLD

SEQ ID NO: 2901105 - protein, 8 aa, Entamoeba invadens
RKSIPNEL

SEQ ID NO: 2901106 - protein, 14 aa, Entamoeba invadens
RKSISNTDLNSPRV

SEQ ID NO: 2901107 - protein, 17 aa, Entamoeba invadens
RKSKEYADKLKKAQRRN

SEQ ID NO: 2901108 - protein, 66 aa, Entamoeba invadens
RKSKGLPPLERKKHSKHHEHKDKKEKEKAKAEPVSTPRDGFDTAPLPPQIQTTPIAAPPPPPTSQF

SEQ ID NO: 2901109 - protein, 17 aa, Entamoeba invadens
RKSKKIEVKPVKKPEEI

SEQ ID NO: 2901110 - protein, 9 aa, Entamoeba invadens
RKSKKLSGL

SEQ ID NO: 2901111 - protein, 11 aa, Entamoeba invadens
RKSKSKSPTTL

SEQ ID NO: 2901112 - protein, 10 aa, Entamoeba invadens
RKSKSYESQI

SEQ ID NO: 2901113 - protein, 10 aa, Entamoeba invadens
RKSLDPEQDV

SEQ ID NO: 2901114 - protein, 5 aa, Entamoeba invadens
RKSME

SEQ ID NO: 2901115 - protein, 8 aa, Entamoeba invadens
RKSNPDYV

SEQ ID NO: 2901116 - protein, 10 aa, Entamoeba invadens
RKSPNERMTA

SEQ ID NO: 2901117 - protein, 14 aa, Entamoeba invadens
RKSPQVSNTKIENQ

SEQ ID NO: 2901118 - protein, 8 aa, Entamoeba invadens
RKSQESIG

SEQ ID NO: 2901119 - protein, 47 aa, Entamoeba invadens
RKSQKSETPLSEKEKKNAELPKVADDVSGTTVNNDEHTEIKSESHVS

SEQ ID NO: 2901120 - protein, 12 aa, Entamoeba invadens
RKSQSVQNENRR

SEQ ID NO: 2901121 - protein, 11 aa, Entamoeba invadens
RKSRDEEASLA

SEQ ID NO: 2901122 - protein, 13 aa, Entamoeba invadens
RKSRKENKEEIDG

SEQ ID NO: 2901123 - protein, 5 aa, Entamoeba invadens
RKSRL

SEQ ID NO: 2901124 - protein, 8 aa, Entamoeba invadens
RKSRPKRI

SEQ ID NO: 2901125 - protein, 22 aa, Entamoeba invadens
RKSSAKSYSSTTMSSVSEGEEM

SEQ ID NO: 2901126 - protein, 8 aa, Entamoeba invadens
RKSSDYNQ

SEQ ID NO: 2901127 - protein, 9 aa, Entamoeba invadens
RKSSGKSGL

SEQ ID NO: 2901128 - protein, 16 aa, Entamoeba invadens
RKSSPIRPFKDCTFVS

SEQ ID NO: 2901129 - protein, 7 aa, Entamoeba invadens
RKSSTKM

SEQ ID NO: 2901130 - protein, 13 aa, Entamoeba invadens
RKSSTSKSDDLPV

SEQ ID NO: 2901131 - protein, 9 aa, Entamoeba invadens
RKSSVTSTG

SEQ ID NO: 2901132 - protein, 24 aa, Entamoeba invadens
RKSTLKSKINKSEECDEDKTSSVN

SEQ ID NO: 2901133 - protein, 7 aa, Entamoeba invadens
RKSTNDL

SEQ ID NO: 2901134 - protein, 8 aa, Entamoeba invadens
RKSTPKAR

SEQ ID NO: 2901135 - protein, 19 aa, Entamoeba invadens
RKSTQDKQSAPHTPSFESQ

SEQ ID NO: 2901136 - protein, 7 aa, Entamoeba invadens
RKSTSQL

SEQ ID NO: 2901137 - protein, 7 aa, Entamoeba invadens
RKSVGEI

SEQ ID NO: 2901138 - protein, 14 aa, Entamoeba invadens
RKSWNAKPKEPPAS

SEQ ID NO: 2901139 - protein, 4 aa, Entamoeba invadens
RKSY

SEQ ID NO: 2901140 - protein, 7 aa, Entamoeba invadens
RKTAKEL

SEQ ID NO: 2901141 - protein, 7 aa, Entamoeba invadens
RKTAKSA

SEQ ID NO: 2901142 - protein, 19 aa, Entamoeba invadens
RKTAQVQTEEKKKKKACYI

SEQ ID NO: 2901143 - protein, 7 aa, Entamoeba invadens
RKTDNDF

SEQ ID NO: 2901144 - protein, 4 aa, Entamoeba invadens
RKTE

SEQ ID NO: 2901145 - protein, 8 aa, Entamoeba invadens
RKTEIQND

SEQ ID NO: 2901146 - protein, 7 aa, Entamoeba invadens
RKTEKLE

SEQ ID NO: 2901147 - protein, 5 aa, Entamoeba invadens
RKTEM

SEQ ID NO: 2901148 - protein, 7 aa, Entamoeba invadens
RKTERLS

SEQ ID NO: 2901149 - protein, 10 aa, Entamoeba invadens
RKTESTVQTE

SEQ ID NO: 2901150 - protein, 10 aa, Entamoeba invadens
RKTFAEVGES

SEQ ID NO: 2901151 - protein, 14 aa, Entamoeba invadens
RKTFQKTPIQKEKS

SEQ ID NO: 2901152 - protein, 17 aa, Entamoeba invadens
RKTGEQKEDLQGKAKGF

SEQ ID NO: 2901153 - protein, 13 aa, Entamoeba invadens
RKTGGVGSANGHG

SEQ ID NO: 2901154 - protein, 5 aa, Entamoeba invadens
RKTGK

SEQ ID NO: 2901155 - protein, 8 aa, Entamoeba invadens
RKTGKNGN

SEQ ID NO: 2901156 - protein, 5 aa, Entamoeba invadens
RKTHF

SEQ ID NO: 2901157 - protein, 7 aa, Entamoeba invadens
RKTHRGL

SEQ ID NO: 2901158 - protein, 12 aa, Entamoeba invadens
RKTHTNKETSKD

SEQ ID NO: 2901159 - protein, 6 aa, Entamoeba invadens
RKTKDK

SEQ ID NO: 2901160 - protein, 7 aa, Entamoeba invadens
RKTKEEY

SEQ ID NO: 2901161 - protein, 22 aa, Entamoeba invadens
RKTKKGKKEKKSKKGLFGLFHK

SEQ ID NO: 2901162 - protein, 11 aa, Entamoeba invadens
RKTKKNSNKAK

SEQ ID NO: 2901163 - protein, 11 aa, Entamoeba invadens
RKTKPRNKDFG

SEQ ID NO: 2901164 - protein, 7 aa, Entamoeba invadens
RKTKTPI

SEQ ID NO: 2901165 - protein, 14 aa, Entamoeba invadens
RKTLEKASGNFSDK

SEQ ID NO: 2901166 - protein, 12 aa, Entamoeba invadens
RKTLQNQSTPTF

SEQ ID NO: 2901167 - protein, 11 aa, Entamoeba invadens
RKTLSNLKQEN

SEQ ID NO: 2901168 - protein, 8 aa, Entamoeba invadens
RKTLTAEN

SEQ ID NO: 2901169 - protein, 9 aa, Entamoeba invadens
RKTNKEIRN

SEQ ID NO: 2901170 - protein, 11 aa, Entamoeba invadens
RKTNQKKKKLR

SEQ ID NO: 2901171 - protein, 9 aa, Entamoeba invadens
RKTNSSKNI

SEQ ID NO: 2901172 - protein, 21 aa, Entamoeba invadens
RKTPNGKSVIGESEKRIAPDT

SEQ ID NO: 2901173 - protein, 9 aa, Entamoeba invadens
RKTPSPNET

SEQ ID NO: 2901174 - protein, 8 aa, Entamoeba invadens
RKTPVDPD

SEQ ID NO: 2901175 - protein, 5 aa, Entamoeba invadens
RKTQM

SEQ ID NO: 2901176 - protein, 7 aa, Entamoeba invadens
RKTQNKS

SEQ ID NO: 2901177 - protein, 7 aa, Entamoeba invadens
RKTQTPI

SEQ ID NO: 2901178 - protein, 7 aa, Entamoeba invadens
RKTRGTS

SEQ ID NO: 2901179 - protein, 27 aa, Entamoeba invadens
RKTRHDNKVSKKLARPVGAKYSGERKI

SEQ ID NO: 2901180 - protein, 9 aa, Entamoeba invadens
RKTRPKSLL

SEQ ID NO: 2901181 - protein, 23 aa, Entamoeba invadens
RKTRRNVSQNSQTDTINKIVSEL

SEQ ID NO: 2901182 - protein, 7 aa, Entamoeba invadens
RKTRSFQ

SEQ ID NO: 2901183 - protein, 4 aa, Entamoeba invadens
RKTS

SEQ ID NO: 2901184 - protein, 10 aa, Entamoeba invadens
RKTSGLSKDE

SEQ ID NO: 2901185 - protein, 9 aa, Entamoeba invadens
RKTSKTKEV

SEQ ID NO: 2901186 - protein, 20 aa, Entamoeba invadens
RKTSLTPRDLSTRDQTVKSC

SEQ ID NO: 2901187 - protein, 9 aa, Entamoeba invadens
RKTTEKNTF

SEQ ID NO: 2901188 - protein, 6 aa, Entamoeba invadens
RKTTKS

SEQ ID NO: 2901189 - protein, 7 aa, Entamoeba invadens
RKTTQEI

SEQ ID NO: 2901190 - protein, 6 aa, Entamoeba invadens
RKTTQL

SEQ ID NO: 2901191 - protein, 8 aa, Entamoeba invadens
RKTTSIGN

SEQ ID NO: 2901192 - protein, 4 aa, Entamoeba invadens
RKTY

SEQ ID NO: 2901193 - protein, 8 aa, Entamoeba invadens
RKTYTKSD

SEQ ID NO: 2901194 - protein, 13 aa, Entamoeba invadens
RKVAGYTKKNYLA

SEQ ID NO: 2901195 - protein, 10 aa, Entamoeba invadens
RKVDEMPPPI

SEQ ID NO: 2901196 - protein, 16 aa, Entamoeba invadens
RKVDGKKELFKNENSK

SEQ ID NO: 2901197 - protein, 8 aa, Entamoeba invadens
RKVGENTA

SEQ ID NO: 2901198 - protein, 4 aa, Entamoeba invadens
RKVK

SEQ ID NO: 2901199 - protein, 10 aa, Entamoeba invadens
RKVKRENEAY

SEQ ID NO: 2901200 - protein, 8 aa, Entamoeba invadens
RKVNKDES

SEQ ID NO: 2901201 - protein, 6 aa, Entamoeba invadens
RKVPEE

SEQ ID NO: 2901202 - protein, 6 aa, Entamoeba invadens
RKVPYG

SEQ ID NO: 2901203 - protein, 6 aa, Entamoeba invadens
RKVREN

SEQ ID NO: 2901204 - protein, 10 aa, Entamoeba invadens
RKVRGNKRYA

SEQ ID NO: 2901205 - protein, 7 aa, Entamoeba invadens
RKVSSND

SEQ ID NO: 2901206 - protein, 59 aa, Entamoeba invadens
RKVTKSPTPQETPKTPKTNVKGKAQDSTKLQKKSSNEQVDTVEEKKEEKGQVDEKTLKT

SEQ ID NO: 2901207 - protein, 6 aa, Entamoeba invadens
RKVTNK

SEQ ID NO: 2901208 - protein, 14 aa, Entamoeba invadens
RKWENSNKVSKTEA

SEQ ID NO: 2901209 - protein, 16 aa, Entamoeba invadens
RKWSNNNKSVLEGNEK

SEQ ID NO: 2901210 - protein, 8 aa, Entamoeba invadens
RKWSTKSD

SEQ ID NO: 2901211 - protein, 8 aa, Entamoeba invadens
RKYAKTIK

SEQ ID NO: 2901212 - protein, 5 aa, Entamoeba invadens
RKYGR

SEQ ID NO: 2901213 - protein, 8 aa, Entamoeba invadens
RKYGRDEG

SEQ ID NO: 2901214 - protein, 11 aa, Entamoeba invadens
RKYGSCPHGGY

SEQ ID NO: 2901215 - protein, 7 aa, Entamoeba invadens
RKYGTSN

SEQ ID NO: 2901216 - protein, 6 aa, Entamoeba invadens
RKYIEN

SEQ ID NO: 2901217 - protein, 9 aa, Entamoeba invadens
RKYQRPASP

SEQ ID NO: 2901218 - protein, 8 aa, Entamoeba invadens
RKYSNNTE

SEQ ID NO: 2901219 - protein, 9 aa, Entamoeba invadens
RKYSRQLSQ

SEQ ID NO: 2901220 - protein, 10 aa, Entamoeba invadens
RKYSTPSTVP

SEQ ID NO: 2901221 - protein, 12 aa, Entamoeba invadens
RKYSTSSDVPST

SEQ ID NO: 2901222 - protein, 9 aa, Entamoeba invadens
RLAENGQPL

SEQ ID NO: 2901223 - protein, 53 aa, Entamoeba invadens
RLAETEKEKEEIEAKKKKAENELADLEDAQSNLQSEKDRTEKEKKKLDNDLKE

SEQ ID NO: 2901224 - protein, 18 aa, Entamoeba invadens
RLANTLGKKEKRKERQKM

SEQ ID NO: 2901225 - protein, 4 aa, Entamoeba invadens
RLAS

SEQ ID NO: 2901226 - protein, 8 aa, Entamoeba invadens
RLASAESK

SEQ ID NO: 2901227 - protein, 9 aa, Entamoeba invadens
RLDDQEAQI

SEQ ID NO: 2901228 - protein, 55 aa, Entamoeba invadens
RLDGNGTETQKVETDNCNTLQSQKEEPQKHQNNKGSAQPMPTRPSTNKTTPQYGF

SEQ ID NO: 2901229 - protein, 5 aa, Entamoeba invadens
RLDNN

SEQ ID NO: 2901230 - protein, 7 aa, Entamoeba invadens
RLDPKIR

SEQ ID NO: 2901231 - protein, 8 aa, Entamoeba invadens
RLDPPTTV

SEQ ID NO: 2901232 - protein, 4 aa, Entamoeba invadens
RLDT

SEQ ID NO: 2901233 - protein, 11 aa, Entamoeba invadens
RLDTRSEQEKL

SEQ ID NO: 2901234 - protein, 6 aa, Entamoeba invadens
RLEDNT

SEQ ID NO: 2901235 - protein, 9 aa, Entamoeba invadens
RLEEDEDSD

SEQ ID NO: 2901236 - protein, 27 aa, Entamoeba invadens
RLEEKERLTERDCNDERCGGTKEDLRR

SEQ ID NO: 2901237 - protein, 55 aa, Entamoeba invadens
RLEENQARMESEGEKKKKESKRDKGDRLRKTVDSEEFQEDNGTERRQLRSKRRKV

SEQ ID NO: 2901238 - protein, 28 aa, Entamoeba invadens
RLEERYKDDLKRGITSKTAKRRSETGRF

SEQ ID NO: 2901239 - protein, 8 aa, Entamoeba invadens
RLEESPID

SEQ ID NO: 2901240 - protein, 9 aa, Entamoeba invadens
RLEESSKET

SEQ ID NO: 2901241 - protein, 28 aa, Entamoeba invadens
RLEKASNKECEKRVNELSDTVKKYSETI

SEQ ID NO: 2901242 - protein, 17 aa, Entamoeba invadens
RLEKDVSEKEGDVERMS

SEQ ID NO: 2901243 - protein, 5 aa, Entamoeba invadens
RLEKQ

SEQ ID NO: 2901244 - protein, 7 aa, Entamoeba invadens
RLEKRTS

SEQ ID NO: 2901245 - protein, 5 aa, Entamoeba invadens
RLENE

SEQ ID NO: 2901246 - protein, 6 aa, Entamoeba invadens
RLENEP

SEQ ID NO: 2901247 - protein, 7 aa, Entamoeba invadens
RLENSHH

SEQ ID NO: 2901248 - protein, 10 aa, Entamoeba invadens
RLERKEEVPE

SEQ ID NO: 2901249 - protein, 10 aa, Entamoeba invadens
RLERKENIPE

SEQ ID NO: 2901250 - protein, 12 aa, Entamoeba invadens
RLERKENIPETP

SEQ ID NO: 2901251 - protein, 13 aa, Entamoeba invadens
RLERNEDMSESQY

SEQ ID NO: 2901252 - protein, 13 aa, Entamoeba invadens
RLERNENMSDSQY

SEQ ID NO: 2901253 - protein, 11 aa, Entamoeba invadens
RLERQDSKDLE

SEQ ID NO: 2901254 - protein, 7 aa, Entamoeba invadens
RLERREN

SEQ ID NO: 2901255 - protein, 8 aa, Entamoeba invadens
RLERSKSC

SEQ ID NO: 2901256 - protein, 4 aa, Entamoeba invadens
RLES

SEQ ID NO: 2901257 - protein, 13 aa, Entamoeba invadens
RLESEERADATEA

SEQ ID NO: 2901258 - protein, 13 aa, Entamoeba invadens
RLESSGKDERVKQ

SEQ ID NO: 2901259 - protein, 28 aa, Entamoeba invadens
RLESVSTEPPKITMTPNTLPKSKSGGDI

SEQ ID NO: 2901260 - protein, 15 aa, Entamoeba invadens
RLGEESKAVLSAGAD

SEQ ID NO: 2901261 - protein, 15 aa, Entamoeba invadens
RLGEPRKKRCTTPNR

SEQ ID NO: 2901262 - protein, 11 aa, Entamoeba invadens
RLGGQTLKNEI

SEQ ID NO: 2901263 - protein, 11 aa, Entamoeba invadens
RLGKQTKKQEI

SEQ ID NO: 2901264 - protein, 22 aa, Entamoeba invadens
RLGMSKDMGKKMETESSPNTKV

SEQ ID NO: 2901265 - protein, 14 aa, Entamoeba invadens
RLGPTDVDKPDLGN

SEQ ID NO: 2901266 - protein, 11 aa, Entamoeba invadens
RLGSRSGSITI

SEQ ID NO: 2901267 - protein, 31 aa, Entamoeba invadens
RLGSVDQSEMSETSKLTPANFKEDEDTGCSV

SEQ ID NO: 2901268 - protein, 17 aa, Entamoeba invadens
RLGTDDTEDKNTSPKIR

SEQ ID NO: 2901269 - protein, 8 aa, Entamoeba invadens
RLGTNKEI

SEQ ID NO: 2901270 - protein, 7 aa, Entamoeba invadens
RLHNETG

SEQ ID NO: 2901271 - protein, 11 aa, Entamoeba invadens
RLHRRSQQLRD

SEQ ID NO: 2901272 - protein, 7 aa, Entamoeba invadens
RLKAANS

SEQ ID NO: 2901273 - protein, 13 aa, Entamoeba invadens
RLKEEGKIPQHCF

SEQ ID NO: 2901274 - protein, 8 aa, Entamoeba invadens
RLKEGRGF

SEQ ID NO: 2901275 - protein, 16 aa, Entamoeba invadens
RLKKPKTSTNRVISNE

SEQ ID NO: 2901276 - protein, 9 aa, Entamoeba invadens
RLKNAEGQL

SEQ ID NO: 2901277 - protein, 7 aa, Entamoeba invadens
RLKNENL

SEQ ID NO: 2901278 - protein, 5 aa, Entamoeba invadens
RLKRE

SEQ ID NO: 2901279 - protein, 8 aa, Entamoeba invadens
RLKSVTRD

SEQ ID NO: 2901280 - protein, 4 aa, Entamoeba invadens
RLKT

SEQ ID NO: 2901281 - protein, 11 aa, Entamoeba invadens
RLKTDETSTTN

SEQ ID NO: 2901282 - protein, 12 aa, Entamoeba invadens
RLKTKRKNPQVP

SEQ ID NO: 2901283 - protein, 24 aa, Entamoeba invadens
RLKTMSAPKQPKTRPNKTSREIRN

SEQ ID NO: 2901284 - protein, 6 aa, Entamoeba invadens
RLKTQN

SEQ ID NO: 2901285 - protein, 11 aa, Entamoeba invadens
RLKYGNTIPPN

SEQ ID NO: 2901286 - protein, 29 aa, Entamoeba invadens
RLLSQKDEHHEEEHESSEEHAEEHIEPPY

SEQ ID NO: 2901287 - protein, 4 aa, Entamoeba invadens
RLNA

SEQ ID NO: 2901288 - protein, 7 aa, Entamoeba invadens
RLNDYNT

SEQ ID NO: 2901289 - protein, 8 aa, Entamoeba invadens
RLNDYNTK

SEQ ID NO: 2901290 - protein, 13 aa, Entamoeba invadens
RLNESKSIFNIRN

SEQ ID NO: 2901291 - protein, 7 aa, Entamoeba invadens
RLNGDDE

SEQ ID NO: 2901292 - protein, 5 aa, Entamoeba invadens
RLNGG

SEQ ID NO: 2901293 - protein, 16 aa, Entamoeba invadens
RLNGTNRKEVEELFEL

SEQ ID NO: 2901294 - protein, 7 aa, Entamoeba invadens
RLNNSRV

SEQ ID NO: 2901295 - protein, 18 aa, Entamoeba invadens
RLNQQTTTFKSKSDGSLE

SEQ ID NO: 2901296 - protein, 14 aa, Entamoeba invadens
RLNSNKKRTPKPIQ

SEQ ID NO: 2901297 - protein, 5 aa, Entamoeba invadens
RLPDT

SEQ ID NO: 2901298 - protein, 5 aa, Entamoeba invadens
RLPEM

SEQ ID NO: 2901299 - protein, 7 aa, Entamoeba invadens
RLPKEEV

SEQ ID NO: 2901300 - protein, 6 aa, Entamoeba invadens
RLPKEQ

SEQ ID NO: 2901301 - protein, 9 aa, Entamoeba invadens
RLPKPDEMS

SEQ ID NO: 2901302 - protein, 8 aa, Entamoeba invadens
RLPKPDSC

SEQ ID NO: 2901303 - protein, 32 aa, Entamoeba invadens
RLPNTNVTKYPTGTKLQPITTPDIEAKDSIKQ

SEQ ID NO: 2901304 - protein, 5 aa, Entamoeba invadens
RLPPH

SEQ ID NO: 2901305 - protein, 7 aa, Entamoeba invadens
RLPPSTF

SEQ ID NO: 2901306 - protein, 8 aa, Entamoeba invadens
RLPQPPTV

SEQ ID NO: 2901307 - protein, 24 aa, Entamoeba invadens
RLPQSGTNDKLNKPPLSQQRVDEL

SEQ ID NO: 2901308 - protein, 6 aa, Entamoeba invadens
RLPSEK

SEQ ID NO: 2901309 - protein, 9 aa, Entamoeba invadens
RLPSSASKL

SEQ ID NO: 2901310 - protein, 7 aa, Entamoeba invadens
RLPTQKT

SEQ ID NO: 2901311 - protein, 6 aa, Entamoeba invadens
RLPTQL

SEQ ID NO: 2901312 - protein, 21 aa, Entamoeba invadens
RLPTSSDVKAMTDKRLTKEAK

SEQ ID NO: 2901313 - protein, 9 aa, Entamoeba invadens
RLQGTSEAP

SEQ ID NO: 2901314 - protein, 10 aa, Entamoeba invadens
RLQKQNDEFV

SEQ ID NO: 2901315 - protein, 11 aa, Entamoeba invadens
RLQKTKKKLGL

SEQ ID NO: 2901316 - protein, 12 aa, Entamoeba invadens
RLQNGSKAEIEL

SEQ ID NO: 2901317 - protein, 4 aa, Entamoeba invadens
RLQR

SEQ ID NO: 2901318 - protein, 10 aa, Entamoeba invadens
RLQRKENIPE

SEQ ID NO: 2901319 - protein, 7 aa, Entamoeba invadens
RLRAESE

SEQ ID NO: 2901320 - protein, 44 aa, Entamoeba invadens
RLREEYKKGYNNDSYTRQATKPFRKSRSPSKSRTRSKSRDYSHV

SEQ ID NO: 2901321 - protein, 4 aa, Entamoeba invadens
RLRP

SEQ ID NO: 2901322 - protein, 17 aa, Entamoeba invadens
RLRTERRKKERAERDAA

SEQ ID NO: 2901323 - protein, 18 aa, Entamoeba invadens
RLRTSKNILNNKTSQIQI

SEQ ID NO: 2901324 - protein, 10 aa, Entamoeba invadens
RLSEKNTLNL

SEQ ID NO: 2901325 - protein, 8 aa, Entamoeba invadens
RLSETNSV

SEQ ID NO: 2901326 - protein, 7 aa, Entamoeba invadens
RLSGTDL

SEQ ID NO: 2901327 - protein, 9 aa, Entamoeba invadens
RLSKNGDTL

SEQ ID NO: 2901328 - protein, 11 aa, Entamoeba invadens
RLSKNRDAAQQ

SEQ ID NO: 2901329 - protein, 15 aa, Entamoeba invadens
RLSKSQNSLSERESN

SEQ ID NO: 2901330 - protein, 5 aa, Entamoeba invadens
RLSPE

SEQ ID NO: 2901331 - protein, 12 aa, Entamoeba invadens
RLSSSGSVSVPR

SEQ ID NO: 2901332 - protein, 16 aa, Entamoeba invadens
RLSSSISSRDVNETKR

SEQ ID NO: 2901333 - protein, 6 aa, Entamoeba invadens
RLSSSS

SEQ ID NO: 2901334 - protein, 24 aa, Entamoeba invadens
RLSTESKSIERKNSSEEGSGENTN

SEQ ID NO: 2901335 - protein, 6 aa, Entamoeba invadens
RLSTTL

SEQ ID NO: 2901336 - protein, 21 aa, Entamoeba invadens
RLSTTTESQDRLNNPNETHPE

SEQ ID NO: 2901337 - protein, 22 aa, Entamoeba invadens
RLSTTTESQDRLNNPNKTHPEI

SEQ ID NO: 2901338 - protein, 14 aa, Entamoeba invadens
RLSVTGKDKREKYE

SEQ ID NO: 2901339 - protein, 6 aa, Entamoeba invadens
RLTAKE

SEQ ID NO: 2901340 - protein, 8 aa, Entamoeba invadens
RLTDNEVK

SEQ ID NO: 2901341 - protein, 13 aa, Entamoeba invadens
RLTEERKKIEALV

SEQ ID NO: 2901342 - protein, 19 aa, Entamoeba invadens
RLTESKKRAETKDEPVDTS

SEQ ID NO: 2901343 - protein, 29 aa, Entamoeba invadens
RLTETKEKFATKEKTLAQLKEENEAAKKT

SEQ ID NO: 2901344 - protein, 17 aa, Entamoeba invadens
RLTPKKVDYTKVDRTTR

SEQ ID NO: 2901345 - protein, 7 aa, Entamoeba invadens
RLTPSEA

SEQ ID NO: 2901346 - protein, 4 aa, Entamoeba invadens
RLTQ

SEQ ID NO: 2901347 - protein, 6 aa, Entamoeba invadens
RLTQEA

SEQ ID NO: 2901348 - protein, 5 aa, Entamoeba invadens
RLTQP

SEQ ID NO: 2901349 - protein, 11 aa, Entamoeba invadens
RLTRETACRGP

SEQ ID NO: 2901350 - protein, 7 aa, Entamoeba invadens
RLTSGTP

SEQ ID NO: 2901351 - protein, 6 aa, Entamoeba invadens
RLYEPG

SEQ ID NO: 2901352 - protein, 11 aa, Entamoeba invadens
RMAQSAQWQER

SEQ ID NO: 2901353 - protein, 14 aa, Entamoeba invadens
RMEAEESERRRRAK

SEQ ID NO: 2901354 - protein, 8 aa, Entamoeba invadens
RMEANPSN

SEQ ID NO: 2901355 - protein, 8 aa, Entamoeba invadens
RMEERRKK

SEQ ID NO: 2901356 - protein, 6 aa, Entamoeba invadens
RMEGGK

SEQ ID NO: 2901357 - protein, 12 aa, Entamoeba invadens
RMEKNGNVKEVT

SEQ ID NO: 2901358 - protein, 4 aa, Entamoeba invadens
RMEN

SEQ ID NO: 2901359 - protein, 12 aa, Entamoeba invadens
RMENNEDPRLSH

SEQ ID NO: 2901360 - protein, 34 aa, Entamoeba invadens
RMEQSERKQRISEKTGAKFKARKAHGDIEKNGVQ

SEQ ID NO: 2901361 - protein, 11 aa, Entamoeba invadens
RMEREEDKTEK

SEQ ID NO: 2901362 - protein, 31 aa, Entamoeba invadens
RMGNHSSKHNKPKIPQAKSPEPEPKKQGPLV

SEQ ID NO: 2901363 - protein, 11 aa, Entamoeba invadens
RMKDNKKSTIK

SEQ ID NO: 2901364 - protein, 10 aa, Entamoeba invadens
RMKESDSSIQ

SEQ ID NO: 2901365 - protein, 17 aa, Entamoeba invadens
RMKNSTKLQKALQDKET

SEQ ID NO: 2901366 - protein, 4 aa, Entamoeba invadens
RMKT

SEQ ID NO: 2901367 - protein, 10 aa, Entamoeba invadens
RMNNNSATNK

SEQ ID NO: 2901368 - protein, 10 aa, Entamoeba invadens
RMNPQDSKKI

SEQ ID NO: 2901369 - protein, 5 aa, Entamoeba invadens
RMNTE

SEQ ID NO: 2901370 - protein, 5 aa, Entamoeba invadens
RMPNS

SEQ ID NO: 2901371 - protein, 5 aa, Entamoeba invadens
RMPRA

SEQ ID NO: 2901372 - protein, 5 aa, Entamoeba invadens
RMQNE

SEQ ID NO: 2901373 - protein, 6 aa, Entamoeba invadens
RMQPAK

SEQ ID NO: 2901374 - protein, 8 aa, Entamoeba invadens
RMQPTKRK

SEQ ID NO: 2901375 - protein, 10 aa, Entamoeba invadens
RMRAQSENRG

SEQ ID NO: 2901376 - protein, 9 aa, Entamoeba invadens
RMRSNDDTL

SEQ ID NO: 2901377 - protein, 7 aa, Entamoeba invadens
RMSEQQK

SEQ ID NO: 2901378 - protein, 14 aa, Entamoeba invadens
RMSFGGKESNSGKL

SEQ ID NO: 2901379 - protein, 7 aa, Entamoeba invadens
RMSGRRR

SEQ ID NO: 2901380 - protein, 14 aa, Entamoeba invadens
RMSNDNTKDNDKTF

SEQ ID NO: 2901381 - protein, 7 aa, Entamoeba invadens
RMSPEEY

SEQ ID NO: 2901382 - protein, 5 aa, Entamoeba invadens
RMSPF

SEQ ID NO: 2901383 - protein, 15 aa, Entamoeba invadens
RMSPYSKKKCEELKR

SEQ ID NO: 2901384 - protein, 6 aa, Entamoeba invadens
RMSTER

SEQ ID NO: 2901385 - protein, 24 aa, Entamoeba invadens
RMSTPLSETSIPSYPAPPSLDMTF

SEQ ID NO: 2901386 - protein, 6 aa, Entamoeba invadens
RMSYTE

SEQ ID NO: 2901387 - protein, 13 aa, Entamoeba invadens
RMTDQPPRTPAQQ

SEQ ID NO: 2901388 - protein, 5 aa, Entamoeba invadens
RMTED

SEQ ID NO: 2901389 - protein, 9 aa, Entamoeba invadens
RMTNKNNEL

SEQ ID NO: 2901390 - protein, 5 aa, Entamoeba invadens
RMTPV

SEQ ID NO: 2901391 - protein, 11 aa, Entamoeba invadens
RNAAQNRDDDR

SEQ ID NO: 2901392 - protein, 16 aa, Entamoeba invadens
RNADEEMARGTEKARV

SEQ ID NO: 2901393 - protein, 12 aa, Entamoeba invadens
RNAENVFEPDTS

SEQ ID NO: 2901394 - protein, 9 aa, Entamoeba invadens
RNAGEIASA

SEQ ID NO: 2901395 - protein, 7 aa, Entamoeba invadens
RNAGPQI

SEQ ID NO: 2901396 - protein, 7 aa, Entamoeba invadens
RNAKTVD

SEQ ID NO: 2901397 - protein, 9 aa, Entamoeba invadens
RNAKYNNAT

SEQ ID NO: 2901398 - protein, 6 aa, Entamoeba invadens
RNALNR

SEQ ID NO: 2901399 - protein, 4 aa, Entamoeba invadens
RNAN

SEQ ID NO: 2901400 - protein, 18 aa, Entamoeba invadens
RNANGKCNIDDKNKHITE

SEQ ID NO: 2901401 - protein, 14 aa, Entamoeba invadens
RNANGSSKHHRIER

SEQ ID NO: 2901402 - protein, 8 aa, Entamoeba invadens
RNANGSVK

SEQ ID NO: 2901403 - protein, 17 aa, Entamoeba invadens
RNAPERLETTDATKKTV

SEQ ID NO: 2901404 - protein, 5 aa, Entamoeba invadens
RNAPK

SEQ ID NO: 2901405 - protein, 7 aa, Entamoeba invadens
RNAPKDM

SEQ ID NO: 2901406 - protein, 13 aa, Entamoeba invadens
RNARECEGRERSD

SEQ ID NO: 2901407 - protein, 19 aa, Entamoeba invadens
RNASIQQNARLEQRTMNFF

SEQ ID NO: 2901408 - protein, 13 aa, Entamoeba invadens
RNASLNKKEEQQT

SEQ ID NO: 2901409 - protein, 6 aa, Entamoeba invadens
RNASNL

SEQ ID NO: 2901410 - protein, 8 aa, Entamoeba invadens
RNATNADI

SEQ ID NO: 2901411 - protein, 15 aa, Entamoeba invadens
RNAYEKCKAEKCDLR

SEQ ID NO: 2901412 - protein, 7 aa, Entamoeba invadens
RNCGESI

SEQ ID NO: 2901413 - protein, 6 aa, Entamoeba invadens
RNCPNY

SEQ ID NO: 2901414 - protein, 6 aa, Entamoeba invadens
RNCTQM

SEQ ID NO: 2901415 - protein, 13 aa, Entamoeba invadens
RNCTSSKKRDCTS

SEQ ID NO: 2901416 - protein, 7 aa, Entamoeba invadens
RNDEDEL

SEQ ID NO: 2901417 - protein, 5 aa, Entamoeba invadens
RNDEF

SEQ ID NO: 2901418 - protein, 9 aa, Entamoeba invadens
RNDENGQKK

SEQ ID NO: 2901419 - protein, 12 aa, Entamoeba invadens
RNDETYKCSPEE

SEQ ID NO: 2901420 - protein, 7 aa, Entamoeba invadens
RNDKEKI

SEQ ID NO: 2901421 - protein, 8 aa, Entamoeba invadens
RNDKQVQY

SEQ ID NO: 2901422 - protein, 13 aa, Entamoeba invadens
RNDLANELRPVDT

SEQ ID NO: 2901423 - protein, 7 aa, Entamoeba invadens
RNDLGET

SEQ ID NO: 2901424 - protein, 7 aa, Entamoeba invadens
RNDLPSA

SEQ ID NO: 2901425 - protein, 9 aa, Entamoeba invadens
RNDPTYHAT

SEQ ID NO: 2901426 - protein, 10 aa, Entamoeba invadens
RNDPTYQATE

SEQ ID NO: 2901427 - protein, 10 aa, Entamoeba invadens
RNDQKASEEY

SEQ ID NO: 2901428 - protein, 7 aa, Entamoeba invadens
RNDQVNA

SEQ ID NO: 2901429 - protein, 9 aa, Entamoeba invadens
RNDSQHNVT

SEQ ID NO: 2901430 - protein, 7 aa, Entamoeba invadens
RNDTNPL

SEQ ID NO: 2901431 - protein, 8 aa, Entamoeba invadens
RNDTPLRK

SEQ ID NO: 2901432 - protein, 9 aa, Entamoeba invadens
RNDTSNYTE

SEQ ID NO: 2901433 - protein, 11 aa, Entamoeba invadens
RNDTTKEYTME

SEQ ID NO: 2901434 - protein, 13 aa, Entamoeba invadens
RNDVKDKITSFPE

SEQ ID NO: 2901435 - protein, 9 aa, Entamoeba invadens
RNDVPEKKM

SEQ ID NO: 2901436 - protein, 10 aa, Entamoeba invadens
RNDYTSAFES

SEQ ID NO: 2901437 - protein, 11 aa, Entamoeba invadens
RNEETGRPTTQ

SEQ ID NO: 2901438 - protein, 5 aa, Entamoeba invadens
RNEFN

SEQ ID NO: 2901439 - protein, 7 aa, Entamoeba invadens
RNEFTQG

SEQ ID NO: 2901440 - protein, 4 aa, Entamoeba invadens
RNEG

SEQ ID NO: 2901441 - protein, 6 aa, Entamoeba invadens
RNEGNL

SEQ ID NO: 2901442 - protein, 6 aa, Entamoeba invadens
RNEIET

SEQ ID NO: 2901443 - protein, 6 aa, Entamoeba invadens
RNEINT

SEQ ID NO: 2901444 - protein, 6 aa, Entamoeba invadens
RNEKDI

SEQ ID NO: 2901445 - protein, 24 aa, Entamoeba invadens
RNEKEELLDERDDMEKDKETLNTT

SEQ ID NO: 2901446 - protein, 8 aa, Entamoeba invadens
RNEKESAL

SEQ ID NO: 2901447 - protein, 6 aa, Entamoeba invadens
RNEKKA

SEQ ID NO: 2901448 - protein, 13 aa, Entamoeba invadens
RNEKLKKMQKKEA

SEQ ID NO: 2901449 - protein, 8 aa, Entamoeba invadens
RNEKSSLR

SEQ ID NO: 2901450 - protein, 7 aa, Entamoeba invadens
RNEKTYD

SEQ ID NO: 2901451 - protein, 4 aa, Entamoeba invadens
RNEL

SEQ ID NO: 2901452 - protein, 5 aa, Entamoeba invadens
RNELR

SEQ ID NO: 2901453 - protein, 5 aa, Entamoeba invadens
RNEMC

SEQ ID NO: 2901454 - protein, 8 aa, Entamoeba invadens
RNENETCS

SEQ ID NO: 2901455 - protein, 7 aa, Entamoeba invadens
RNENGKD

SEQ ID NO: 2901456 - protein, 24 aa, Entamoeba invadens
RNENKKRKETKEVRREDATPSFKE

SEQ ID NO: 2901457 - protein, 7 aa, Entamoeba invadens
RNENVND

SEQ ID NO: 2901458 - protein, 6 aa, Entamoeba invadens
RNEPIK

SEQ ID NO: 2901459 - protein, 7 aa, Entamoeba invadens
RNEQEPK

SEQ ID NO: 2901460 - protein, 9 aa, Entamoeba invadens
RNEQHNEQI

SEQ ID NO: 2901461 - protein, 22 aa, Entamoeba invadens
RNEQQETEEIKKYRQNLKKYLG

SEQ ID NO: 2901462 - protein, 10 aa, Entamoeba invadens
RNERERQDKI

SEQ ID NO: 2901463 - protein, 6 aa, Entamoeba invadens
RNERNR

SEQ ID NO: 2901464 - protein, 8 aa, Entamoeba invadens
RNERYGKL

SEQ ID NO: 2901465 - protein, 6 aa, Entamoeba invadens
RNESGR

SEQ ID NO: 2901466 - protein, 17 aa, Entamoeba invadens
RNESTKKKNEITKMNRN

SEQ ID NO: 2901467 - protein, 9 aa, Entamoeba invadens
RNETPPTFS

SEQ ID NO: 2901468 - protein, 4 aa, Entamoeba invadens
RNFP

SEQ ID NO: 2901469 - protein, 5 aa, Entamoeba invadens
RNFRN

SEQ ID NO: 2901470 - protein, 6 aa, Entamoeba invadens
RNFTSG

SEQ ID NO: 2901471 - protein, 7 aa, Entamoeba invadens
RNGANGI

SEQ ID NO: 2901472 - protein, 7 aa, Entamoeba invadens
RNGCGKT

SEQ ID NO: 2901473 - protein, 12 aa, Entamoeba invadens
RNGDDNPKEQIK

SEQ ID NO: 2901474 - protein, 15 aa, Entamoeba invadens
RNGDLVKDDTGNSVG

SEQ ID NO: 2901475 - protein, 4 aa, Entamoeba invadens
RNGE

SEQ ID NO: 2901476 - protein, 9 aa, Entamoeba invadens
RNGENRSLK

SEQ ID NO: 2901477 - protein, 8 aa, Entamoeba invadens
RNGEPDAA

SEQ ID NO: 2901478 - protein, 6 aa, Entamoeba invadens
RNGEQV

SEQ ID NO: 2901479 - protein, 6 aa, Entamoeba invadens
RNGEST

SEQ ID NO: 2901480 - protein, 4 aa, Entamoeba invadens
RNGF

SEQ ID NO: 2901481 - protein, 5 aa, Entamoeba invadens
RNGFI

SEQ ID NO: 2901482 - protein, 5 aa, Entamoeba invadens
RNGGL

SEQ ID NO: 2901483 - protein, 7 aa, Entamoeba invadens
RNGGLSG

SEQ ID NO: 2901484 - protein, 4 aa, Entamoeba invadens
RNGI

SEQ ID NO: 2901485 - protein, 5 aa, Entamoeba invadens
RNGIT

SEQ ID NO: 2901486 - protein, 22 aa, Entamoeba invadens
RNGKDDDDDSSNKKKKSGGCVF

SEQ ID NO: 2901487 - protein, 6 aa, Entamoeba invadens
RNGKDV

SEQ ID NO: 2901488 - protein, 6 aa, Entamoeba invadens
RNGKDW

SEQ ID NO: 2901489 - protein, 4 aa, Entamoeba invadens
RNGL

SEQ ID NO: 2901490 - protein, 5 aa, Entamoeba invadens
RNGMS

SEQ ID NO: 2901491 - protein, 7 aa, Entamoeba invadens
RNGNPEI

SEQ ID NO: 2901492 - protein, 7 aa, Entamoeba invadens
RNGNYQQ

SEQ ID NO: 2901493 - protein, 10 aa, Entamoeba invadens
RNGPDTYPGC

SEQ ID NO: 2901494 - protein, 4 aa, Entamoeba invadens
RNGQ

SEQ ID NO: 2901495 - protein, 8 aa, Entamoeba invadens
RNGRKTMT

SEQ ID NO: 2901496 - protein, 11 aa, Entamoeba invadens
RNGSDAEQQFS

SEQ ID NO: 2901497 - protein, 16 aa, Entamoeba invadens
RNGSFESKKVGAPNKE

SEQ ID NO: 2901498 - protein, 6 aa, Entamoeba invadens
RNGTDF

SEQ ID NO: 2901499 - protein, 15 aa, Entamoeba invadens
RNGTHVDGEAHLKEQ

SEQ ID NO: 2901500 - protein, 16 aa, Entamoeba invadens
RNGTISNNTKMRLSLA

SEQ ID NO: 2901501 - protein, 6 aa, Entamoeba invadens
RNGTTD

SEQ ID NO: 2901502 - protein, 4 aa, Entamoeba invadens
RNGY

SEQ ID NO: 2901503 - protein, 11 aa, Entamoeba invadens
RNHETVNSPND

SEQ ID NO: 2901504 - protein, 7 aa, Entamoeba invadens
RNHQESI

SEQ ID NO: 2901505 - protein, 11 aa, Entamoeba invadens
RNIDGKREIDY

SEQ ID NO: 2901506 - protein, 5 aa, Entamoeba invadens
RNIEK

SEQ ID NO: 2901507 - protein, 10 aa, Entamoeba invadens
RNIENDTHQT

SEQ ID NO: 2901508 - protein, 37 aa, Entamoeba invadens
RNIENSKNRNKPQKSATTPTNTKENSTKGTSFLPIFN

SEQ ID NO: 2901509 - protein, 45 aa, Entamoeba invadens
RNIENSKNRNNQQKSTQSQGRSREATSAATSASGSTVLPPFNPDN

SEQ ID NO: 2901510 - protein, 6 aa, Entamoeba invadens
RNIETG

SEQ ID NO: 2901511 - protein, 4 aa, Entamoeba invadens
RNIQ

SEQ ID NO: 2901512 - protein, 5 aa, Entamoeba invadens
RNIRE

SEQ ID NO: 2901513 - protein, 5 aa, Entamoeba invadens
RNIRT

SEQ ID NO: 2901514 - protein, 14 aa, Entamoeba invadens
RNISENSTTRLKEE

SEQ ID NO: 2901515 - protein, 5 aa, Entamoeba invadens
RNISG

SEQ ID NO: 2901516 - protein, 9 aa, Entamoeba invadens
RNISPNGTY

SEQ ID NO: 2901517 - protein, 7 aa, Entamoeba invadens
RNKADDI

SEQ ID NO: 2901518 - protein, 4 aa, Entamoeba invadens
RNKD

SEQ ID NO: 2901519 - protein, 22 aa, Entamoeba invadens
RNKDPNAPETPSQDDASEELTK

SEQ ID NO: 2901520 - protein, 6 aa, Entamoeba invadens
RNKDTI

SEQ ID NO: 2901521 - protein, 5 aa, Entamoeba invadens
RNKEG

SEQ ID NO: 2901522 - protein, 6 aa, Entamoeba invadens
RNKEKL

SEQ ID NO: 2901523 - protein, 5 aa, Entamoeba invadens
RNKFE

SEQ ID NO: 2901524 - protein, 8 aa, Entamoeba invadens
RNKGGLSD

SEQ ID NO: 2901525 - protein, 5 aa, Entamoeba invadens
RNKGK

SEQ ID NO: 2901526 - protein, 6 aa, Entamoeba invadens
RNKHHP

SEQ ID NO: 2901527 - protein, 7 aa, Entamoeba invadens
RNKHTAI

SEQ ID NO: 2901528 - protein, 22 aa, Entamoeba invadens
RNKISSESEEKQKERKERNEEA

SEQ ID NO: 2901529 - protein, 24 aa, Entamoeba invadens
RNKKEKLKSEIKRVQNETGDDDER

SEQ ID NO: 2901530 - protein, 8 aa, Entamoeba invadens
RNKKTKVE

SEQ ID NO: 2901531 - protein, 6 aa, Entamoeba invadens
RNKNPY

SEQ ID NO: 2901532 - protein, 16 aa, Entamoeba invadens
RNKPVESKVEETIKEP

SEQ ID NO: 2901533 - protein, 5 aa, Entamoeba invadens
RNKQM

SEQ ID NO: 2901534 - protein, 5 aa, Entamoeba invadens
RNKRI

SEQ ID NO: 2901535 - protein, 19 aa, Entamoeba invadens
RNKSPHNNFEPKPSTKYNG

SEQ ID NO: 2901536 - protein, 6 aa, Entamoeba invadens
RNKSRN

SEQ ID NO: 2901537 - protein, 8 aa, Entamoeba invadens
RNKSRNIE

SEQ ID NO: 2901538 - protein, 5 aa, Entamoeba invadens
RNKTA

SEQ ID NO: 2901539 - protein, 5 aa, Entamoeba invadens
RNKTG

SEQ ID NO: 2901540 - protein, 9 aa, Entamoeba invadens
RNKTTDTIQ

SEQ ID NO: 2901541 - protein, 19 aa, Entamoeba invadens
RNLQRQKAENKRREVESAM

SEQ ID NO: 2901542 - protein, 22 aa, Entamoeba invadens
RNLQTTRKVNEKSEKKKKINRE

SEQ ID NO: 2901543 - protein, 14 aa, Entamoeba invadens
RNLSSSAQLPSPNS

SEQ ID NO: 2901544 - protein, 4 aa, Entamoeba invadens
RNLT

SEQ ID NO: 2901545 - protein, 11 aa, Entamoeba invadens
RNMEATNLTSD

SEQ ID NO: 2901546 - protein, 11 aa, Entamoeba invadens
RNMPKNKTKPF

SEQ ID NO: 2901547 - protein, 4 aa, Entamoeba invadens
RNMQ

SEQ ID NO: 2901548 - protein, 8 aa, Entamoeba invadens
RNNEGRTP

SEQ ID NO: 2901549 - protein, 9 aa, Entamoeba invadens
RNNEKVSTT

SEQ ID NO: 2901550 - protein, 8 aa, Entamoeba invadens
RNNESVKE

SEQ ID NO: 2901551 - protein, 8 aa, Entamoeba invadens
RNNGNTCY

SEQ ID NO: 2901552 - protein, 15 aa, Entamoeba invadens
RNNKDVKEKSGPTFK

SEQ ID NO: 2901553 - protein, 10 aa, Entamoeba invadens
RNNKGCERCN

SEQ ID NO: 2901554 - protein, 10 aa, Entamoeba invadens
RNNKGCQRCP

SEQ ID NO: 2901555 - protein, 18 aa, Entamoeba invadens
RNNKGCQRCPSGYYLNKN

SEQ ID NO: 2901556 - protein, 14 aa, Entamoeba invadens
RNNKSSGIDPFSTT

SEQ ID NO: 2901557 - protein, 4 aa, Entamoeba invadens
RNNN

SEQ ID NO: 2901558 - protein, 9 aa, Entamoeba invadens
RNNNTNNND

SEQ ID NO: 2901559 - protein, 5 aa, Entamoeba invadens
RNNPV

SEQ ID NO: 2901560 - protein, 4 aa, Entamoeba invadens
RNNQ

SEQ ID NO: 2901561 - protein, 13 aa, Entamoeba invadens
RNNQWSVGESDFK

SEQ ID NO: 2901562 - protein, 6 aa, Entamoeba invadens
RNNREY

SEQ ID NO: 2901563 - protein, 14 aa, Entamoeba invadens
RNNSMSEKPCNLGD

SEQ ID NO: 2901564 - protein, 6 aa, Entamoeba invadens
RNNSQA

SEQ ID NO: 2901565 - protein, 5 aa, Entamoeba invadens
RNNTE

SEQ ID NO: 2901566 - protein, 6 aa, Entamoeba invadens
RNNTEL

SEQ ID NO: 2901567 - protein, 9 aa, Entamoeba invadens
RNNTENPEK

SEQ ID NO: 2901568 - protein, 10 aa, Entamoeba invadens
RNNTGKWSQH

SEQ ID NO: 2901569 - protein, 9 aa, Entamoeba invadens
RNNTKSYNS

SEQ ID NO: 2901570 - protein, 5 aa, Entamoeba invadens
RNNTN

SEQ ID NO: 2901571 - protein, 11 aa, Entamoeba invadens
RNNTSVVSDEK

SEQ ID NO: 2901572 - protein, 7 aa, Entamoeba invadens
RNNYDSV

SEQ ID NO: 2901573 - protein, 4 aa, Entamoeba invadens
RNPD

SEQ ID NO: 2901574 - protein, 6 aa, Entamoeba invadens
RNPDEA

SEQ ID NO: 2901575 - protein, 7 aa, Entamoeba invadens
RNPDSSV

SEQ ID NO: 2901576 - protein, 6 aa, Entamoeba invadens
RNPDTY

SEQ ID NO: 2901577 - protein, 7 aa, Entamoeba invadens
RNPEPCK

SEQ ID NO: 2901578 - protein, 10 aa, Entamoeba invadens
RNPGTSDFTL

SEQ ID NO: 2901579 - protein, 4 aa, Entamoeba invadens
RNPH

SEQ ID NO: 2901580 - protein, 17 aa, Entamoeba invadens
RNPLADSESHNPITPKD

SEQ ID NO: 2901581 - protein, 10 aa, Entamoeba invadens
RNPLKTTTYG

SEQ ID NO: 2901582 - protein, 12 aa, Entamoeba invadens
RNPNSRDPKKSI

SEQ ID NO: 2901583 - protein, 16 aa, Entamoeba invadens
RNPPQLQQQTKKEEEP

SEQ ID NO: 2901584 - protein, 4 aa, Entamoeba invadens
RNPQ

SEQ ID NO: 2901585 - protein, 9 aa, Entamoeba invadens
RNPTKVSKE

SEQ ID NO: 2901586 - protein, 8 aa, Entamoeba invadens
RNPTQVRT

SEQ ID NO: 2901587 - protein, 8 aa, Entamoeba invadens
RNPVHNPT

SEQ ID NO: 2901588 - protein, 13 aa, Entamoeba invadens
RNPYTGSSRPPEL

SEQ ID NO: 2901589 - protein, 24 aa, Entamoeba invadens
RNQGDAGSIEEDIEKHTTPEYRSP

SEQ ID NO: 2901590 - protein, 7 aa, Entamoeba invadens
RNQKGDR

SEQ ID NO: 2901591 - protein, 16 aa, Entamoeba invadens
RNQKPDLSADSFRQRN

SEQ ID NO: 2901592 - protein, 4 aa, Entamoeba invadens
RNQL

SEQ ID NO: 2901593 - protein, 14 aa, Entamoeba invadens
RNQLPNDPRCYQST

SEQ ID NO: 2901594 - protein, 6 aa, Entamoeba invadens
RNQQEE

SEQ ID NO: 2901595 - protein, 8 aa, Entamoeba invadens
RNQQNDES

SEQ ID NO: 2901596 - protein, 22 aa, Entamoeba invadens
RNQQQETEEIEKYRRNLKKYLG

SEQ ID NO: 2901597 - protein, 6 aa, Entamoeba invadens
RNQSDN

SEQ ID NO: 2901598 - protein, 9 aa, Entamoeba invadens
RNRDNTPVL

SEQ ID NO: 2901599 - protein, 8 aa, Entamoeba invadens
RNRISTSG

SEQ ID NO: 2901600 - protein, 8 aa, Entamoeba invadens
RNRKQCRE

SEQ ID NO: 2901601 - protein, 31 aa, Entamoeba invadens
RNRPHKSEASNEEKSKEEDEFGDYKPVDTSN

SEQ ID NO: 2901602 - protein, 10 aa, Entamoeba invadens
RNRSGTMEPH

SEQ ID NO: 2901603 - protein, 4 aa, Entamoeba invadens
RNRT

SEQ ID NO: 2901604 - protein, 8 aa, Entamoeba invadens
RNSAGTKF

SEQ ID NO: 2901605 - protein, 7 aa, Entamoeba invadens
RNSANVF

SEQ ID NO: 2901606 - protein, 7 aa, Entamoeba invadens
RNSEKQR

SEQ ID NO: 2901607 - protein, 4 aa, Entamoeba invadens
RNSF

SEQ ID NO: 2901608 - protein, 5 aa, Entamoeba invadens
RNSFE

SEQ ID NO: 2901609 - protein, 5 aa, Entamoeba invadens
RNSFQ

SEQ ID NO: 2901610 - protein, 7 aa, Entamoeba invadens
RNSGRSV

SEQ ID NO: 2901611 - protein, 4 aa, Entamoeba invadens
RNSI

SEQ ID NO: 2901612 - protein, 22 aa, Entamoeba invadens
RNSIATKEGNMPQSEITQLSST

SEQ ID NO: 2901613 - protein, 19 aa, Entamoeba invadens
RNSIQSSECSEDSLTEFTN

SEQ ID NO: 2901614 - protein, 5 aa, Entamoeba invadens
RNSIS

SEQ ID NO: 2901615 - protein, 12 aa, Entamoeba invadens
RNSITNSESDIP

SEQ ID NO: 2901616 - protein, 15 aa, Entamoeba invadens
RNSKDGVLNQYEGST

SEQ ID NO: 2901617 - protein, 7 aa, Entamoeba invadens
RNSKNPI

SEQ ID NO: 2901618 - protein, 20 aa, Entamoeba invadens
RNSLQRKSKTGESDNKIDNL

SEQ ID NO: 2901619 - protein, 8 aa, Entamoeba invadens
RNSPPNAK

SEQ ID NO: 2901620 - protein, 7 aa, Entamoeba invadens
RNSRSRI

SEQ ID NO: 2901621 - protein, 11 aa, Entamoeba invadens
RNSRSSVSMDD

SEQ ID NO: 2901622 - protein, 6 aa, Entamoeba invadens
RNSSGL

SEQ ID NO: 2901623 - protein, 7 aa, Entamoeba invadens
RNSSPHR

SEQ ID NO: 2901624 - protein, 7 aa, Entamoeba invadens
RNSSQIS

SEQ ID NO: 2901625 - protein, 7 aa, Entamoeba invadens
RNSTEAL

SEQ ID NO: 2901626 - protein, 13 aa, Entamoeba invadens
RNSTGNIRKGGDK

SEQ ID NO: 2901627 - protein, 8 aa, Entamoeba invadens
RNSTRYTL

SEQ ID NO: 2901628 - protein, 7 aa, Entamoeba invadens
RNSYGRE

SEQ ID NO: 2901629 - protein, 5 aa, Entamoeba invadens
RNTDN

SEQ ID NO: 2901630 - protein, 7 aa, Entamoeba invadens
RNTEEAK

SEQ ID NO: 2901631 - protein, 9 aa, Entamoeba invadens
RNTEGKRKR

SEQ ID NO: 2901632 - protein, 11 aa, Entamoeba invadens
RNTERDDRVSK

SEQ ID NO: 2901633 - protein, 6 aa, Entamoeba invadens
RNTERR

SEQ ID NO: 2901634 - protein, 5 aa, Entamoeba invadens
RNTGP

SEQ ID NO: 2901635 - protein, 8 aa, Entamoeba invadens
RNTHSSID

SEQ ID NO: 2901636 - protein, 8 aa, Entamoeba invadens
RNTKIDRN

SEQ ID NO: 2901637 - protein, 5 aa, Entamoeba invadens
RNTMG

SEQ ID NO: 2901638 - protein, 4 aa, Entamoeba invadens
RNTN

SEQ ID NO: 2901639 - protein, 7 aa, Entamoeba invadens
RNTNNKE

SEQ ID NO: 2901640 - protein, 8 aa, Entamoeba invadens
RNTPEKCK

SEQ ID NO: 2901641 - protein, 10 aa, Entamoeba invadens
RNTPKRERSG

SEQ ID NO: 2901642 - protein, 15 aa, Entamoeba invadens
RNTPPIRTNSANRRL

SEQ ID NO: 2901643 - protein, 6 aa, Entamoeba invadens
RNTPRL

SEQ ID NO: 2901644 - protein, 9 aa, Entamoeba invadens
RNTPSDLEK

SEQ ID NO: 2901645 - protein, 23 aa, Entamoeba invadens
RNTQSDVESKEKTLKEQKEEVER

SEQ ID NO: 2901646 - protein, 6 aa, Entamoeba invadens
RNTSTY

SEQ ID NO: 2901647 - protein, 8 aa, Entamoeba invadens
RNTTETDL

SEQ ID NO: 2901648 - protein, 16 aa, Entamoeba invadens
RNTTQLSESTKVSKDK

SEQ ID NO: 2901649 - protein, 6 aa, Entamoeba invadens
RNTTTF

SEQ ID NO: 2901650 - protein, 14 aa, Entamoeba invadens
RNTVASVGGSGSAS

SEQ ID NO: 2901651 - protein, 12 aa, Entamoeba invadens
RNVDINKETENQ

SEQ ID NO: 2901652 - protein, 12 aa, Entamoeba invadens
RNVEKVKEKYGK

SEQ ID NO: 2901653 - protein, 5 aa, Entamoeba invadens
RNVGD

SEQ ID NO: 2901654 - protein, 8 aa, Entamoeba invadens
RNVGPEEQ

SEQ ID NO: 2901655 - protein, 9 aa, Entamoeba invadens
RNVGSESPQ

SEQ ID NO: 2901656 - protein, 12 aa, Entamoeba invadens
RNVLSEKQGEPV

SEQ ID NO: 2901657 - protein, 13 aa, Entamoeba invadens
RNVNGGKKVKEGN

SEQ ID NO: 2901658 - protein, 4 aa, Entamoeba invadens
RNVS

SEQ ID NO: 2901659 - protein, 9 aa, Entamoeba invadens
RNVSNKDDE

SEQ ID NO: 2901660 - protein, 9 aa, Entamoeba invadens
RNVSPVKEI

SEQ ID NO: 2901661 - protein, 8 aa, Entamoeba invadens
RNVTERYK

SEQ ID NO: 2901662 - protein, 5 aa, Entamoeba invadens
RNWLS

SEQ ID NO: 2901663 - protein, 13 aa, Entamoeba invadens
RNWRNSASSEKVA

SEQ ID NO: 2901664 - protein, 9 aa, Entamoeba invadens
RNWSEDEKW

SEQ ID NO: 2901665 - protein, 6 aa, Entamoeba invadens
RNWTAE

SEQ ID NO: 2901666 - protein, 9 aa, Entamoeba invadens
RNYDARYDR

SEQ ID NO: 2901667 - protein, 6 aa, Entamoeba invadens
RNYEGQ

SEQ ID NO: 2901668 - protein, 4 aa, Entamoeba invadens
RNYK

SEQ ID NO: 2901669 - protein, 10 aa, Entamoeba invadens
RNYLDKRSKA

SEQ ID NO: 2901670 - protein, 7 aa, Entamoeba invadens
RNYQVSQ

SEQ ID NO: 2901671 - protein, 6 aa, Entamoeba invadens
RNYSNE

SEQ ID NO: 2901672 - protein, 6 aa, Entamoeba invadens
RNYSNN

SEQ ID NO: 2901673 - protein, 11 aa, Entamoeba invadens
RPANKNEVTSS

SEQ ID NO: 2901674 - protein, 23 aa, Entamoeba invadens
RPAPQRKTRKKVVSAERTSKFDP

SEQ ID NO: 2901675 - protein, 7 aa, Entamoeba invadens
RPASEAL

SEQ ID NO: 2901676 - protein, 6 aa, Entamoeba invadens
RPATAY

SEQ ID NO: 2901677 - protein, 4 aa, Entamoeba invadens
RPAV

SEQ ID NO: 2901678 - protein, 6 aa, Entamoeba invadens
RPCEQA

SEQ ID NO: 2901679 - protein, 4 aa, Entamoeba invadens
RPCK

SEQ ID NO: 2901680 - protein, 5 aa, Entamoeba invadens
RPCSD

SEQ ID NO: 2901681 - protein, 5 aa, Entamoeba invadens
RPDCC

SEQ ID NO: 2901682 - protein, 5 aa, Entamoeba invadens
RPDDS

SEQ ID NO: 2901683 - protein, 8 aa, Entamoeba invadens
RPDGDVKD

SEQ ID NO: 2901684 - protein, 4 aa, Entamoeba invadens
RPDK

SEQ ID NO: 2901685 - protein, 5 aa, Entamoeba invadens
RPDKN

SEQ ID NO: 2901686 - protein, 13 aa, Entamoeba invadens
RPDPNNENAVGYN

SEQ ID NO: 2901687 - protein, 4 aa, Entamoeba invadens
RPDQ

SEQ ID NO: 2901688 - protein, 13 aa, Entamoeba invadens
RPDRQNDREEAKK

SEQ ID NO: 2901689 - protein, 7 aa, Entamoeba invadens
RPDSSRV

SEQ ID NO: 2901690 - protein, 5 aa, Entamoeba invadens
RPDTE

SEQ ID NO: 2901691 - protein, 4 aa, Entamoeba invadens
RPDV

SEQ ID NO: 2901692 - protein, 6 aa, Entamoeba invadens
RPDVCP

SEQ ID NO: 2901693 - protein, 16 aa, Entamoeba invadens
RPEATHNDILDYVKNW

SEQ ID NO: 2901694 - protein, 10 aa, Entamoeba invadens
RPEELETPAV

SEQ ID NO: 2901695 - protein, 17 aa, Entamoeba invadens
RPEGEIKETVIMEIDSS

SEQ ID NO: 2901696 - protein, 12 aa, Entamoeba invadens
RPEHGESYQKSL

SEQ ID NO: 2901697 - protein, 4 aa, Entamoeba invadens
RPEI

SEQ ID NO: 2901698 - protein, 8 aa, Entamoeba invadens
RPEKNGRP

SEQ ID NO: 2901699 - protein, 14 aa, Entamoeba invadens
RPEKPTEVKTETKT

SEQ ID NO: 2901700 - protein, 48 aa, Entamoeba invadens
RPENDAEKKEREKKEDAEIEQELNASQGAGKKGEKREKVKKPQPKPEV

SEQ ID NO: 2901701 - protein, 24 aa, Entamoeba invadens
RPENKYSAEYISQETNKEVQRRLG

SEQ ID NO: 2901702 - protein, 10 aa, Entamoeba invadens
RPENPSPEET

SEQ ID NO: 2901703 - protein, 7 aa, Entamoeba invadens
RPEPNNQ

SEQ ID NO: 2901704 - protein, 9 aa, Entamoeba invadens
RPERKANKT

SEQ ID NO: 2901705 - protein, 12 aa, Entamoeba invadens
RPESIEEVEKNY

SEQ ID NO: 2901706 - protein, 5 aa, Entamoeba invadens
RPETA

SEQ ID NO: 2901707 - protein, 6 aa, Entamoeba invadens
RPETFN

SEQ ID NO: 2901708 - protein, 6 aa, Entamoeba invadens
RPETMY

SEQ ID NO: 2901709 - protein, 7 aa, Entamoeba invadens
RPETNEI

SEQ ID NO: 2901710 - protein, 5 aa, Entamoeba invadens
RPFEK

SEQ ID NO: 2901711 - protein, 10 aa, Entamoeba invadens
RPFGSSYDQF

SEQ ID NO: 2901712 - protein, 5 aa, Entamoeba invadens
RPFPN

SEQ ID NO: 2901713 - protein, 12 aa, Entamoeba invadens
RPFPSNKNTVLR

SEQ ID NO: 2901714 - protein, 4 aa, Entamoeba invadens
RPFT

SEQ ID NO: 2901715 - protein, 12 aa, Entamoeba invadens
RPFTSSADRLVN

SEQ ID NO: 2901716 - protein, 15 aa, Entamoeba invadens
RPGAVDAEKAVAPRN

SEQ ID NO: 2901717 - protein, 7 aa, Entamoeba invadens
RPGDIRA

SEQ ID NO: 2901718 - protein, 5 aa, Entamoeba invadens
RPGES

SEQ ID NO: 2901719 - protein, 9 aa, Entamoeba invadens
RPGGQPEGV

SEQ ID NO: 2901720 - protein, 9 aa, Entamoeba invadens
RPGKQQEIR

SEQ ID NO: 2901721 - protein, 4 aa, Entamoeba invadens
RPGM

SEQ ID NO: 2901722 - protein, 7 aa, Entamoeba invadens
RPGPSNM

SEQ ID NO: 2901723 - protein, 5 aa, Entamoeba invadens
RPGRI

SEQ ID NO: 2901724 - protein, 5 aa, Entamoeba invadens
RPGRL

SEQ ID NO: 2901725 - protein, 8 aa, Entamoeba invadens
RPGTGECK

SEQ ID NO: 2901726 - protein, 5 aa, Entamoeba invadens
RPGYE

SEQ ID NO: 2901727 - protein, 22 aa, Entamoeba invadens
RPHDENEKSKDLKLKSKTPRTN

SEQ ID NO: 2901728 - protein, 5 aa, Entamoeba invadens
RPHKS

SEQ ID NO: 2901729 - protein, 9 aa, Entamoeba invadens
RPHRQSYKT

SEQ ID NO: 2901730 - protein, 5 aa, Entamoeba invadens
RPIDD

SEQ ID NO: 2901731 - protein, 13 aa, Entamoeba invadens
RPIEATMETRTKI

SEQ ID NO: 2901732 - protein, 5 aa, Entamoeba invadens
RPIEN

SEQ ID NO: 2901733 - protein, 6 aa, Entamoeba invadens
RPIENG

SEQ ID NO: 2901734 - protein, 5 aa, Entamoeba invadens
RPINN

SEQ ID NO: 2901735 - protein, 5 aa, Entamoeba invadens
RPIQN

SEQ ID NO: 2901736 - protein, 8 aa, Entamoeba invadens
RPISASTR

SEQ ID NO: 2901737 - protein, 6 aa, Entamoeba invadens
RPISSE

SEQ ID NO: 2901738 - protein, 6 aa, Entamoeba invadens
RPITSA

SEQ ID NO: 2901739 - protein, 4 aa, Entamoeba invadens
RPKC

SEQ ID NO: 2901740 - protein, 9 aa, Entamoeba invadens
RPKKAKAPC

SEQ ID NO: 2901741 - protein, 24 aa, Entamoeba invadens
RPKKIRGSTSSVDGDGLKTGEVNI

SEQ ID NO: 2901742 - protein, 11 aa, Entamoeba invadens
RPKKISTRTST

SEQ ID NO: 2901743 - protein, 8 aa, Entamoeba invadens
RPKKKARL

SEQ ID NO: 2901744 - protein, 7 aa, Entamoeba invadens
RPKKRST

SEQ ID NO: 2901745 - protein, 20 aa, Entamoeba invadens
RPKLNAVTNKAAGGGYEDVG

SEQ ID NO: 2901746 - protein, 22 aa, Entamoeba invadens
RPKLNTKATRIQGGGMESSSAY

SEQ ID NO: 2901747 - protein, 11 aa, Entamoeba invadens
RPKNRTTMKPM

SEQ ID NO: 2901748 - protein, 8 aa, Entamoeba invadens
RPKQGSNS

SEQ ID NO: 2901749 - protein, 6 aa, Entamoeba invadens
RPKREK

SEQ ID NO: 2901750 - protein, 9 aa, Entamoeba invadens
RPKSDLEKA

SEQ ID NO: 2901751 - protein, 11 aa, Entamoeba invadens
RPKSQPQNSPF

SEQ ID NO: 2901752 - protein, 9 aa, Entamoeba invadens
RPKSRTKST

SEQ ID NO: 2901753 - protein, 11 aa, Entamoeba invadens
RPKTKESVKNT

SEQ ID NO: 2901754 - protein, 9 aa, Entamoeba invadens
RPLETQQSV

SEQ ID NO: 2901755 - protein, 4 aa, Entamoeba invadens
RPLH

SEQ ID NO: 2901756 - protein, 12 aa, Entamoeba invadens
RPLKKSNVTEQI

SEQ ID NO: 2901757 - protein, 9 aa, Entamoeba invadens
RPLPETPRE

SEQ ID NO: 2901758 - protein, 41 aa, Entamoeba invadens
RPLPKNFGSNSASQNVAQSPLQSTQNISSQSFGSSRRSQQN

SEQ ID NO: 2901759 - protein, 14 aa, Entamoeba invadens
RPLTPLESASDFTT

SEQ ID NO: 2901760 - protein, 8 aa, Entamoeba invadens
RPLTSTEE

SEQ ID NO: 2901761 - protein, 6 aa, Entamoeba invadens
RPMPGD

SEQ ID NO: 2901762 - protein, 7 aa, Entamoeba invadens
RPMTTTG

SEQ ID NO: 2901763 - protein, 4 aa, Entamoeba invadens
RPND

SEQ ID NO: 2901764 - protein, 4 aa, Entamoeba invadens
RPNF

SEQ ID NO: 2901765 - protein, 4 aa, Entamoeba invadens
RPNG

SEQ ID NO: 2901766 - protein, 6 aa, Entamoeba invadens
RPNIDS

SEQ ID NO: 2901767 - protein, 9 aa, Entamoeba invadens
RPNKNTEEM

SEQ ID NO: 2901768 - protein, 12 aa, Entamoeba invadens
RPNKQRKTSYYY

SEQ ID NO: 2901769 - protein, 7 aa, Entamoeba invadens
RPNNITP

SEQ ID NO: 2901770 - protein, 12 aa, Entamoeba invadens
RPNNPSESLDPY

SEQ ID NO: 2901771 - protein, 6 aa, Entamoeba invadens
RPNQKD

SEQ ID NO: 2901772 - protein, 7 aa, Entamoeba invadens
RPNQPPK

SEQ ID NO: 2901773 - protein, 12 aa, Entamoeba invadens
RPNSQKPIPPAI

SEQ ID NO: 2901774 - protein, 11 aa, Entamoeba invadens
RPNSSKIRKYE

SEQ ID NO: 2901775 - protein, 5 aa, Entamoeba invadens
RPNTL

SEQ ID NO: 2901776 - protein, 4 aa, Entamoeba invadens
RPNV

SEQ ID NO: 2901777 - protein, 9 aa, Entamoeba invadens
RPNVPLSEV

SEQ ID NO: 2901778 - protein, 5 aa, Entamoeba invadens
RPNYI

SEQ ID NO: 2901779 - protein, 7 aa, Entamoeba invadens
RPPDTLN

SEQ ID NO: 2901780 - protein, 6 aa, Entamoeba invadens
RPPFTM

SEQ ID NO: 2901781 - protein, 12 aa, Entamoeba invadens
RPPILNPNDDLQ

SEQ ID NO: 2901782 - protein, 6 aa, Entamoeba invadens
RPPISV

SEQ ID NO: 2901783 - protein, 7 aa, Entamoeba invadens
RPPKKAW

SEQ ID NO: 2901784 - protein, 12 aa, Entamoeba invadens
RPPKQSKVTEQI

SEQ ID NO: 2901785 - protein, 21 aa, Entamoeba invadens
RPPLNAQANRLQGGGIESSTY

SEQ ID NO: 2901786 - protein, 9 aa, Entamoeba invadens
RPPPQNNID

SEQ ID NO: 2901787 - protein, 77 aa, Entamoeba invadens
RPPQFQTSASVTQPTVHPPMPPKAPTPSTKSKAGHSKSGIKEEDNVSRAGSVVSSATGRKKKRENKKVLESPPRPNL

SEQ ID NO: 2901788 - protein, 12 aa, Entamoeba invadens
RPPQITQDLSTS

SEQ ID NO: 2901789 - protein, 8 aa, Entamoeba invadens
RPPQPPKM

SEQ ID NO: 2901790 - protein, 7 aa, Entamoeba invadens
RPPSVPN

SEQ ID NO: 2901791 - protein, 7 aa, Entamoeba invadens
RPQDEGE

SEQ ID NO: 2901792 - protein, 10 aa, Entamoeba invadens
RPQDKQADII

SEQ ID NO: 2901793 - protein, 8 aa, Entamoeba invadens
RPQGTNEA

SEQ ID NO: 2901794 - protein, 4 aa, Entamoeba invadens
RPQI

SEQ ID NO: 2901795 - protein, 6 aa, Entamoeba invadens
RPQIKK

SEQ ID NO: 2901796 - protein, 8 aa, Entamoeba invadens
RPQKKSRL

SEQ ID NO: 2901797 - protein, 22 aa, Entamoeba invadens
RPQLEQEYRKGINKQTAFRRYE

SEQ ID NO: 2901798 - protein, 11 aa, Entamoeba invadens
RPQNVPVKTNP

SEQ ID NO: 2901799 - protein, 23 aa, Entamoeba invadens
RPQPVKKSNPEIEEIEKKTNELK

SEQ ID NO: 2901800 - protein, 4 aa, Entamoeba invadens
RPQQ

SEQ ID NO: 2901801 - protein, 11 aa, Entamoeba invadens
RPRAMSKDTDY

SEQ ID NO: 2901802 - protein, 5 aa, Entamoeba invadens
RPRDG

SEQ ID NO: 2901803 - protein, 5 aa, Entamoeba invadens
RPRGD

SEQ ID NO: 2901804 - protein, 20 aa, Entamoeba invadens
RPRHEADVQPTAQEALRDHD

SEQ ID NO: 2901805 - protein, 5 aa, Entamoeba invadens
RPRKQ

SEQ ID NO: 2901806 - protein, 7 aa, Entamoeba invadens
RPRKQST

SEQ ID NO: 2901807 - protein, 15 aa, Entamoeba invadens
RPRMSSTSTLSKEGL

SEQ ID NO: 2901808 - protein, 13 aa, Entamoeba invadens
RPSAEDQEPEKSD

SEQ ID NO: 2901809 - protein, 4 aa, Entamoeba invadens
RPSC

SEQ ID NO: 2901810 - protein, 4 aa, Entamoeba invadens
RPSD

SEQ ID NO: 2901811 - protein, 5 aa, Entamoeba invadens
RPSDK

SEQ ID NO: 2901812 - protein, 6 aa, Entamoeba invadens
RPSEYD

SEQ ID NO: 2901813 - protein, 10 aa, Entamoeba invadens
RPSFDEKTEL

SEQ ID NO: 2901814 - protein, 10 aa, Entamoeba invadens
RPSGDISDQS

SEQ ID NO: 2901815 - protein, 10 aa, Entamoeba invadens
RPSGEGDKYV

SEQ ID NO: 2901816 - protein, 6 aa, Entamoeba invadens
RPSHNK

SEQ ID NO: 2901817 - protein, 4 aa, Entamoeba invadens
RPSI

SEQ ID NO: 2901818 - protein, 9 aa, Entamoeba invadens
RPSKRTTTT

SEQ ID NO: 2901819 - protein, 12 aa, Entamoeba invadens
RPSKYPTKSAKR

SEQ ID NO: 2901820 - protein, 16 aa, Entamoeba invadens
RPSLKGDALSASTLAR

SEQ ID NO: 2901821 - protein, 9 aa, Entamoeba invadens
RPSNTKKEN

SEQ ID NO: 2901822 - protein, 5 aa, Entamoeba invadens
RPSPQ

SEQ ID NO: 2901823 - protein, 7 aa, Entamoeba invadens
RPSQPIE

SEQ ID NO: 2901824 - protein, 8 aa, Entamoeba invadens
RPSQSQTL

SEQ ID NO: 2901825 - protein, 20 aa, Entamoeba invadens
RPSSTLLSQPNVKVKQEGIQ

SEQ ID NO: 2901826 - protein, 5 aa, Entamoeba invadens
RPSTY

SEQ ID NO: 2901827 - protein, 13 aa, Entamoeba invadens
RPSVKEKNPEMKQ

SEQ ID NO: 2901828 - protein, 7 aa, Entamoeba invadens
RPSVKPL

SEQ ID NO: 2901829 - protein, 11 aa, Entamoeba invadens
RPSWEGKGAHF

SEQ ID NO: 2901830 - protein, 8 aa, Entamoeba invadens
RPTAQPME

SEQ ID NO: 2901831 - protein, 5 aa, Entamoeba invadens
RPTEA

SEQ ID NO: 2901832 - protein, 14 aa, Entamoeba invadens
RPTETYADVGGLDK

SEQ ID NO: 2901833 - protein, 12 aa, Entamoeba invadens
RPTFSGDLKKEG

SEQ ID NO: 2901834 - protein, 5 aa, Entamoeba invadens
RPTIQ

SEQ ID NO: 2901835 - protein, 9 aa, Entamoeba invadens
RPTKIPKKT

SEQ ID NO: 2901836 - protein, 10 aa, Entamoeba invadens
RPTKQTNQGT

SEQ ID NO: 2901837 - protein, 8 aa, Entamoeba invadens
RPTLSTEN

SEQ ID NO: 2901838 - protein, 6 aa, Entamoeba invadens
RPTPEC

SEQ ID NO: 2901839 - protein, 10 aa, Entamoeba invadens
RPTPECDETV

SEQ ID NO: 2901840 - protein, 7 aa, Entamoeba invadens
RPTPPDY

SEQ ID NO: 2901841 - protein, 4 aa, Entamoeba invadens
RPTS

SEQ ID NO: 2901842 - protein, 7 aa, Entamoeba invadens
RPTSCPE

SEQ ID NO: 2901843 - protein, 6 aa, Entamoeba invadens
RPTSET

SEQ ID NO: 2901844 - protein, 8 aa, Entamoeba invadens
RPTSPETL

SEQ ID NO: 2901845 - protein, 14 aa, Entamoeba invadens
RPTSPRNTPRFTTN

SEQ ID NO: 2901846 - protein, 8 aa, Entamoeba invadens
RPTTISGV

SEQ ID NO: 2901847 - protein, 6 aa, Entamoeba invadens
RPTVAQ

SEQ ID NO: 2901848 - protein, 16 aa, Entamoeba invadens
RPVDQKSSGAASGYYK

SEQ ID NO: 2901849 - protein, 4 aa, Entamoeba invadens
RPVE

SEQ ID NO: 2901850 - protein, 13 aa, Entamoeba invadens
RPVEKRDKINSEI

SEQ ID NO: 2901851 - protein, 12 aa, Entamoeba invadens
RPVGTSNIDQTE

SEQ ID NO: 2901852 - protein, 5 aa, Entamoeba invadens
RPVKK

SEQ ID NO: 2901853 - protein, 10 aa, Entamoeba invadens
RPVNRNKSTF

SEQ ID NO: 2901854 - protein, 8 aa, Entamoeba invadens
RPVNTAED

SEQ ID NO: 2901855 - protein, 13 aa, Entamoeba invadens
RPVNTTDNYTSST

SEQ ID NO: 2901856 - protein, 45 aa, Entamoeba invadens
RPYAPRQNRYARREEGEEPRESRPARQPRFARKPRDTTPKELSET

SEQ ID NO: 2901857 - protein, 4 aa, Entamoeba invadens
RPYD

SEQ ID NO: 2901858 - protein, 22 aa, Entamoeba invadens
RQAHEKQRKEEEEEEDEDIPED

SEQ ID NO: 2901859 - protein, 5 aa, Entamoeba invadens
RQAKN

SEQ ID NO: 2901860 - protein, 12 aa, Entamoeba invadens
RQANSPTATVDT

SEQ ID NO: 2901861 - protein, 9 aa, Entamoeba invadens
RQAPKQTSL

SEQ ID NO: 2901862 - protein, 9 aa, Entamoeba invadens
RQAPTEDDN

SEQ ID NO: 2901863 - protein, 5 aa, Entamoeba invadens
RQAQN

SEQ ID NO: 2901864 - protein, 6 aa, Entamoeba invadens
RQASKP

SEQ ID NO: 2901865 - protein, 7 aa, Entamoeba invadens
RQCISDG

SEQ ID NO: 2901866 - protein, 4 aa, Entamoeba invadens
RQCV

SEQ ID NO: 2901867 - protein, 10 aa, Entamoeba invadens
RQDEKEANKL

SEQ ID NO: 2901868 - protein, 4 aa, Entamoeba invadens
RQDF

SEQ ID NO: 2901869 - protein, 15 aa, Entamoeba invadens
RQDHNTSVTQQKTKY

SEQ ID NO: 2901870 - protein, 5 aa, Entamoeba invadens
RQDNY

SEQ ID NO: 2901871 - protein, 5 aa, Entamoeba invadens
RQDRP

SEQ ID NO: 2901872 - protein, 24 aa, Entamoeba invadens
RQDRRIERHDDRDKFQEPRSSRGL

SEQ ID NO: 2901873 - protein, 44 aa, Entamoeba invadens
RQEAEEKKKEKENPEKEKEKEKEKEKESDGEDDDDDDDKIDNDQ

SEQ ID NO: 2901874 - protein, 4 aa, Entamoeba invadens
RQED

SEQ ID NO: 2901875 - protein, 6 aa, Entamoeba invadens
RQEDEM

SEQ ID NO: 2901876 - protein, 8 aa, Entamoeba invadens
RQEDSSTY

SEQ ID NO: 2901877 - protein, 11 aa, Entamoeba invadens
RQEDVTTNEQE

SEQ ID NO: 2901878 - protein, 5 aa, Entamoeba invadens
RQEED

SEQ ID NO: 2901879 - protein, 22 aa, Entamoeba invadens
RQEEERKGKSRSDSPRQTTSRQ

SEQ ID NO: 2901880 - protein, 10 aa, Entamoeba invadens
RQEEKISTKD

SEQ ID NO: 2901881 - protein, 20 aa, Entamoeba invadens
RQEHNTTGIPKTSDDKKQIK

SEQ ID NO: 2901882 - protein, 9 aa, Entamoeba invadens
RQEKEEKRG

SEQ ID NO: 2901883 - protein, 19 aa, Entamoeba invadens
RQEKESQTREFLLRHCLLK

SEQ ID NO: 2901884 - protein, 16 aa, Entamoeba invadens
RQEKGMKSTNVTIPEQ

SEQ ID NO: 2901885 - protein, 4 aa, Entamoeba invadens
RQEL

SEQ ID NO: 2901886 - protein, 8 aa, Entamoeba invadens
RQENERVN

SEQ ID NO: 2901887 - protein, 43 aa, Entamoeba invadens
RQENLKANEEGKTEKIEKKESGVVREHPEKTPQTTDTHKKAID

SEQ ID NO: 2901888 - protein, 20 aa, Entamoeba invadens
RQERLTKDRAIAKAKKEAMI

SEQ ID NO: 2901889 - protein, 44 aa, Entamoeba invadens
RQERQGFGQNPQQNTYQRPFDQDYPPQTQYRQQYQGDPGYPRYS

SEQ ID NO: 2901890 - protein, 20 aa, Entamoeba invadens
RQERRNGNGLSGVGKGTESL

SEQ ID NO: 2901891 - protein, 25 aa, Entamoeba invadens
RQETKTSETPTNPSEGQEETGDEVE

SEQ ID NO: 2901892 - protein, 11 aa, Entamoeba invadens
RQETSSKNPNE

SEQ ID NO: 2901893 - protein, 11 aa, Entamoeba invadens
RQETTSKNGEE

SEQ ID NO: 2901894 - protein, 40 aa, Entamoeba invadens
RQEYDRPTKEGSRQGQKAKEKISKVESALSKKDPKAVDQA

SEQ ID NO: 2901895 - protein, 14 aa, Entamoeba invadens
RQFEMNNTKKNTKK

SEQ ID NO: 2901896 - protein, 18 aa, Entamoeba invadens
RQGAYTPTKKTRDTTDMS

SEQ ID NO: 2901897 - protein, 5 aa, Entamoeba invadens
RQGIN

SEQ ID NO: 2901898 - protein, 14 aa, Entamoeba invadens
RQGKCSKEGRTKKH

SEQ ID NO: 2901899 - protein, 7 aa, Entamoeba invadens
RQGLQRE

SEQ ID NO: 2901900 - protein, 8 aa, Entamoeba invadens
RQGNPRLT

SEQ ID NO: 2901901 - protein, 20 aa, Entamoeba invadens
RQGQQSEDEMYRNNNDECSP

SEQ ID NO: 2901902 - protein, 9 aa, Entamoeba invadens
RQGSQKERL

SEQ ID NO: 2901903 - protein, 4 aa, Entamoeba invadens
RQGV

SEQ ID NO: 2901904 - protein, 4 aa, Entamoeba invadens
RQHI

SEQ ID NO: 2901905 - protein, 17 aa, Entamoeba invadens
RQHPGTFQPTRIVCLQM

SEQ ID NO: 2901906 - protein, 9 aa, Entamoeba invadens
RQHQTDDET

SEQ ID NO: 2901907 - protein, 13 aa, Entamoeba invadens
RQHSKKADAENTE

SEQ ID NO: 2901908 - protein, 6 aa, Entamoeba invadens
RQIDDS

SEQ ID NO: 2901909 - protein, 5 aa, Entamoeba invadens
RQIEG

SEQ ID NO: 2901910 - protein, 7 aa, Entamoeba invadens
RQIGEGG

SEQ ID NO: 2901911 - protein, 4 aa, Entamoeba invadens
RQIS

SEQ ID NO: 2901912 - protein, 17 aa, Entamoeba invadens
RQISTPERRDSPVRSSL

SEQ ID NO: 2901913 - protein, 10 aa, Entamoeba invadens
RQKANDPFDQ

SEQ ID NO: 2901914 - protein, 4 aa, Entamoeba invadens
RQKD

SEQ ID NO: 2901915 - protein, 16 aa, Entamoeba invadens
RQKEAQAAEDEVTKAL

SEQ ID NO: 2901916 - protein, 15 aa, Entamoeba invadens
RQKEDKSFQREIGNI

SEQ ID NO: 2901917 - protein, 6 aa, Entamoeba invadens
RQKEDV

SEQ ID NO: 2901918 - protein, 6 aa, Entamoeba invadens
RQKEEA

SEQ ID NO: 2901919 - protein, 17 aa, Entamoeba invadens
RQKEEEARKREEAERQR

SEQ ID NO: 2901920 - protein, 9 aa, Entamoeba invadens
RQKESGHTF
